United States Patent 8,877,916 (PROMOTER, PROMOTER CONTROL ELEMENTS, AND COMBINATIONS, AND USES THEREOF) - sequence listing, part 13

SEQ ID NO: 15742 - DNA, 3003 bp, Unknown
  misc_feature (1)..( 3003): 2750-1469P.txt file - cDNA_ID_1017377; gDNA_ID_2936565; Annot_ID_194609
acaagttccagacacgagcaccggacatgcatgatctatcaaatcttgaatattataatcagattcgatatagacatacattatatacacataattatagagcaagacaaactataatggtgtttgtccttgttaacttagcatgaccattttgaattcgttgtctcagattttgatgcttagaattcgtgcctcatatttgttagaagaaaaacacaacaatatcatcgacgtatcaagtatgaaaattttgatcattctttaaaaggagataatttagtaattgcacagaaattagtcaaaaggcgacgggtacgtgttttcaggttcatgcactcttaaaaaagaaagaaagaaagatatactattttatggtcgctcagactgttgtctagtgtatggatttatcaaattcgttagttaagcctgcctatactattaattaactaggtttgctagctgtgtgaatagcgataaatatgatttaaggaccacatttgttttactttacatgggttgtgttttgatattatgtagtccaatttatggatttcggattaaaaataaaatctcgttaaacaaaaaaataactaagttatcattccgtcatagttgcgcatctcactgagatactagtgtcatttcgagtgagtaatgaaccacataatctatatttggacattggagaaaataaacgatatgaagtgtgtgatttgtccaacatgacaatcaaaataaaaacataatatgatctatgtgaattaataagaaacagaaaaaggttaaaattgaaacaaaaaaatacgcaaagtgacaataaaaagaaaaggaaaaaagaatgaaagagtggtagggttggtcgggagaggctgcaaaagtcgtgagagtgagtgaaggaggcttcgagcagccgacatcgagaatctttaaaagtcgcaaaatatcagtaacaccttatcacatatacaatatacgagcatctgaatatattttctattttaatatatgaccaataattaaagtttcaatttagcttttcttcaaacaaaagggcttgaagcttcctctggatctatctagaaccattaaaaaaaaaaattaaatgttaaagaaaacaaagagatgtcggcaaagcttagtagaagcccaacaatttaaaatataatcgctacctcgctagaagcaaggctcgttagaaaatatgggtacttattgggccataactttgggccggaattcaacagaatttttaatatgtattgtgcaatcattttctagagatccgagtactttcattctttcaagttaccagcaatgtcacaaattggaggaaaaatacaaatgagtaaaaaatccaaatattgagggagatatttttgaggctgggaaaatggataacgaaggaacgtttgtgaagccatttacctatcaatttttggaccgataaggtatttgcatatcaatgggcccattattgacattgacttcttagctacaatatagtttcaacttgattatttcactttcctcgattatgacttgtattttccgcttattggccaatactcaaagaccttaatatattgctattcttttatattatcacctgatagaaaaataaatcttaaattcatattaaattaacttatgtatttaagcttataaaataaattgctcattaatacaactctttatttaagatcaactattttatttttgttaatttataaccaaaaaggtgcatctagaagctggagaaaaaatacgtaagatagaaaagagagcccatgtttctaataaattctactactaccttatccaaatccatctgtgtgatacagatgcgcaagtacacgtggcatccatctaggcgatttatttttcgtctgccgttagttgatgacgtgtctagctggtacaatttctcgttctcacgtcatccggctatattattgaaatccctttttcacccttccattgcacacattttcctctcttgtttttaagtcgtaaatttcacacaatttcctaatttcttattttaaatgaaaatgaatgaatcaagaaacgacgaaatcaaaacttttccaccaatcaattttaaaagaggcttttgaattattttgtcgaccaaaagaagaagtgaattattccatgcaattttatattaatagattttattattatctattaatattgtgttggttgatctttgctcacattacaagtaattgactgtgtcctaaaatgaaaacaaaatcatgtgttcttttagtaaattatttggaactatttatatatatatatatatatatgttgatgtctttcgttagtatatttttttcaattattttatacaaataagttgaggttagtactacaatatcatattagctttcaatattgttttttatatacaaaaaaaaacaaaattaggaagattatggtttacataaaaagttggcaaaattttattttcatgactaaaaaattaggcaaaatgaaacaaaatttggtgaaagggtaaaatcgacaattaaaacaaaaactgcgtcgataaagtaacggagattctttcactcctttgatctctcaagtgaagaatctctctctatctctatcttcttccattgatcctttcctctctctggcttgtttcagagctcttcgatcttcttcttgatcgatctacgtgccactgtttataccattcacgatctaatccggtttcaattattactcacgaaatcgtaagtgaatcaaaaactgtttacaatctttctaattattgatcatcatcatcatcaaaatatttgtgaatatctatggtataattcgatgatcattgattgttttgactttttgagaatatatatggaaactactgtttcgttgtatggatcagtgatctagaattttgccatgtttcgtttactttatgagattttggatttcgttatgtttgacactaaaatactctgtttgattgaaggaaggaagatg

SEQ ID NO: 15743 - DNA, 3003 bp, Unknown
  misc_feature (1)..( 3003): 2750-1469P.txt file - cDNA_ID_1017476; gDNA_ID_2214638; Annot_ID_136185
caagatgctggtggctgaaatcgacgaaaagcacaagggagactatgactttctatgcttgccgacagactttaaggtattatactataagagagagtgaactcatgatgcacttgtatgacctgagaacttactaacaatctagcttttttctggatacagaataaatgcaacatgggtcacgcttttatcaacatggtctctccattgcacatcgttcccttccaacaggtttctttaccttttctcttcagtattgtctttaaaacttctcttcactagtcatgaagttgactatgtattgtggatatggtaattatccgattcaatggcttgagattgttatagctaaaagatattcataatgtgtgtttctgcagactttcaatggtaaaatatgggagaaattcaacagtgggaaagttgcttcattggcatatgcagagatccaaggaaagtctgcccttgcgtcatacatgcagactccaagttctatgaaggaacaaaagcaattgtttccagaagtctcctaccatgatgatggtcaagacgccaatgatcacgtatgtttatccgatacaaaatctcatttttgtttttgtttttgatacatgatttcaaaatgcatatgcagtatcttcagatttttccaccgatttcaccttgtatctatgaatcatacaggagcaactgttttcaagcatttggaacataaccgcgcctgattcagattggtcttacacaatggatcttatcgaaaatccgagggagaacggtaactccaagaatgctgcagaagagtcctcttgaatccccactaaaactagtagttgggaactctaactcaccatcaaaggtaaactaagtgtacaggtctggcgcggttatggaagaaacagaatgtacagtattaaggcttgttttctccacggaacaaagtaaccagtttttagggattacttcactcgaagcaaccgattaaagaaacatccctattagtacattacgttgtatactttatattcggaaacttctctctatatcagtcatgtgtatataacatcctcttgcgtgtacattatcctttccatgtgaaagacatgatcagtatttagttgtacaacaggttcgttataagtttctgtctcaattagttatcattacaaaaccgttacacgtctctctctatgtagacatctatccatggtttcaatgacggatcagactcttcttcaacctttcctagccaaacccaccaccaaaggcttagcaacggaatcggattcaggtattattctgcggcttttctctatacttctcgtcggagcaatctctttgtgggcaaaccatgaggcttcaaaaggcttctccataagtatcatcaatgatgctaaagattctccttccggtaaaagattcgcccttttcttcgaatctgatgatacggcagtgcggatattgctcgatgcaagcttctttgtggagaggtttctctacgagggtgttcctcatcgtctccgtaagcctgtaaaccacgttaccgtccaattctgtggaaacagtagtgatagagtagataggttctcggtaacttcaggtgcaagtcatggagagtatgtgatcagattaagcccatctctcacggaaagaaaaaagtttagcaacgccgtggaatctgcattgcgacgttctatggttagaatatggctatggggagacgagtcaggagcttcgccggagcttgtggccggcatggtggagtatttggccgtggagagccgaaaacgacgtcactttgaaaagtttggtgggaattggaaggataaggaaaagtctgtgtatgtggttagcttgttggattactgtgaacgacgtagcgagggtttcatccgacggttgaaccatgggatgagacttaggtgggatgatcggacggtggatcttgcttcgagtggtgcgtgtggttcacgcaaggatgtgttgcgtgagcttaagatggacgacagtggattgataattgagagacgaacatgatatgttctcgtgctgccatattgtagcacacatggctccacgtcattatttcaatgtgtataattcatcttctatattcttatcgaaaaatgttttttttttttttttgtcgttcgaaaaatgatttaattttttctcagataaataaaagaaattatctgaaatttctttgttgttagtctcagaaaaagaaattattggagcccagttttggtgagtggaaacttttggttttgttatttcaaggccttgtccaacaagagtaggatcaggacctacgggcctatttatatagtatatttatttgagtgtcagtgtcacactaatcaaggtttaattttaaaattgcagtattaaatattaatgaaggtttttatgcgagctgatagcggcctcaaataaatatattctcgattggatttctttaaaaaaaaaatcactttaaagttgacaaaaaaactcagtttaaagaaaattaaggtggaattatctagttaagtgttactctttaatatttggctaattgcgttggttcatgcctgtttaagaaggaaatataaaaagttttgacttaggaaaatgaaaatgaaaatgaaaatgatgcagcttcccagcttttttacagattccagatattgatcagatttttgataccgagatttctcttctctattgatttgatagagtttgggaaggttttcaaatatcaaagaatggaaataatgacaacattaatggaaatacattcagtaaacagtacctaaagttttatttttatttgaaattaaaataaagataaacgtatcatttacagatttggggtacagaaataaagtgcaaggaatcaaaattgtcagccgaacaacaaaaaaaacaagggcttttcagaaaaataaaaaacctttaaaccctttttttgtgtatccgattccgtcgcaagtacattcggactctttcacggcgtcaatg

SEQ ID NO: 15744 - DNA, 3000 bp, Unknown; identical to SEQ ID NO: 8470
  misc_feature (1)..( 3000): 2750-1469P.txt file - cDNA_ID_1017589; gDNA_ID_1971811; Annot_ID_175731

SEQ ID NO: 15745 - DNA, 762 bp, Unknown; identical to SEQ ID NO: 139
  misc_feature (1)..( 762): 2750-1469P.txt file - cDNA_ID_1017618; gDNA_ID_3159; Annot_ID_146132

SEQ ID NO: 15746 - DNA, 3000 bp, Unknown; identical to SEQ ID NO: 641
  misc_feature (1)..( 3000): 2750-1469P.txt file - cDNA_ID_1017693; gDNA_ID_1620302; Annot_ID_152658

SEQ ID NO: 15747 - DNA, 3000 bp, Unknown; identical to SEQ ID NO: 6718
  misc_feature (1)..( 3000): 2750-1469P.txt file - cDNA_ID_1017738; gDNA_ID_1621102; Annot_ID_55900

SEQ ID NO: 15748 - DNA, 3003 bp, Unknown
  misc_feature (1)..( 3003): 2750-1469P.txt file - cDNA_ID_1017738; gDNA_ID_2926189; Annot_ID_140938
cgggctctcctttctaactgcattcctagaaaatattaccctaaaggcctttgtcttggcatcctcgtcctcttcagcaggaactcatctgtcttggaagaattattaccatgtctgcttttgtcagcaaatacgaaggtaagtacacttaatatgcactcttctcttcgtgttccagtaatcttcagttctccattttatgtgctttctgagttcagatgagctgatcaagacggccaagtacattgcaacgccgggaaggggcattttggcggcagatgagagcacagaaaccattgggaaacgattcgccggaatcaatgttgagaacactgagtccaaccgccaagcttaccgtgagctcctcttcacttcccctggcagttacccttgcctctctggtgttatactcttcgaggaaaccctctaccagaaaacctctgatggcaaacccttcgtcgatctcctcatggtccgtctcggaaaaagcaaactccagctctagtcttagtcattgggtccaagagttgcagagttgaagctcttgacatgacccaaatggaacttactgtttcagtttggatctgatttttctttggatcaggagaacggtgttatccccggaatcaaagtggacaagggtttggttgatctagcagggaccaacggcgagaccactactcaaggtctagactcgcttggtgcacggtgtcagcagtattacgaggcaggagcccggtttgctaaatggcgtgcattcttcaagattggggccaccgagccaagcgttctctccatccaagaggacgccagggtgctagcccgctatgccatcatctgccaggagaatggacttgtcccgatcgtcgagccagaggtgctgacaggtgggagccacgacatcaagaaatgtgcggcggtgactgagacggttcttgctgccgtgttcaaggccttgaactaccaccatgtcctcctcgaaggcactctgcttaaacctaacatggtcactcccggctccgacagcccaaaggtatccaaactagatgttgcaatccggttttgttttggagtcgttgttttattggtcttatattttgaaactgaaaccacaaccaaactgtatcggtgtgatgctattttatttaaatttacatgcccggtccttacgtaaccacaatcaaatgaatcacagagacatcaatacctcgaaatgcaacgttaatttgctacaaaacgctaaaatagttcttcttacaggttgcaccggaactaattgcggaatacacggtgactgctctgcgccgcacagtcccaccagctattccgggaatcgtgttcctctcaggcatacagcgcgaagagcaagcgacactaaatctaaacgcaatgaacaagcttgatgtgttgaagccatggacgctcactttctcttttggcggagccctccagcaaagtgctatcaaggcttgggccggtaagcccgagaacgtagccaaagctcaggccaagttcctgaccaggtgcaaggctaacaaggacgctaccctcgggaaatacaccggctgggcttctggtgactcggccgctttcgagaacttggttgtgataggatacaggtactaggatcctttgagaacgggcgtttgcctttgatgcggtttgagtagatatctaatgtttcgtgtgtgttttaactgtttgaatgttcaattttgcagactgctaataattgttattttccggttactgtcaaactatccatgtgaaattcacgttttgaaaagctaataataatgtttttattgtatgagaataaatttagaaaactaaaaattgttaaggacatattacaagatatctcctcttttcgctttgctctagtgcacattgttagccaattcaaacacacttgaagtgcttaatgacactgaaattgaatatgatcttgtccggaaacacagcggctgaagctatcaaccttcttataagcaatgggcgtacttgagggaaacatcatatttttaaaccttgtctcagtaagctaacacacaccccttgtgattacttatccatgtttatccacaagaatgcagttggattgagatattttcttctttgttgaaatcaggcctcaaggtgttcatgtggtctgcaaaaaaattcccaaaaataaagatagtgacatctgaaatcgataatggattagacgaagagtttcgtgttattccttggtatgggcgggtttggggacagatattttggcacagacgaggactaggccactgtggtcctgcagcattaggtgtcccttccatgtcctgcattacattttattgatggattcatcaccctatctactacaacggctacacaaactatgaagagttttgtttactaataaatgcccaagtgaggggtcgatcgaacccgggacacgtttttcagtttaccatatagaattatccttggaacccttgatactccataaaacatcaccacctctgttgtcatctcatgaatccaggttcaaacctagtctctctctccctagtgggaggtatatggccactgggccaatgatgacaaaatgcaaaaaaaataaaatacatttgggttcattatctaaaatatctcttgtgtttgtaagttttggttgcacactcgtgtggttgaagtgtgtgtgagaggtactatacaatacactctgcttttgttttgtacctatctctttctcttctccacatatccaagactttggggataaagctgagatcattggttgccatttggttgtgtagaagcaatcacccatttgctttatccgaggttgataaatttcctcgggttctccttctgacacgtatgacaaattctaatagtatattcctcgtagatattacctatatattctcaatagttgcaggtacttaaggctttgtcttggcatcctcgtcctcttcagcaaaactcgtctctcttgcactccaaaaagcaaccatg

SEQ ID NO: 15749 - DNA, 3003 bp, Unknown
  misc_feature (1)..( 3003): 2750-1469P.txt file - cDNA_ID_1017855; gDNA_ID_1620620; Annot_ID_162242
gcaattagtagaaaattttcctgcagttgatgacgttgcatttggaaaatactgaaaacgctctttggtcctgatgccttttgtttgttccatttactattttatgcagatggattcttcttgaggttcttgacaaggtctctcccagttcagtcaactggaagcatgcttccaaaccaccgattaagatgccgtttagaaaagtagagaactgcaatcaagtcataaagatcgggaaacagctaaaattctcacttgtaaatgtagctggaaatgacatagttcaagggaataagaagctcattcttggtaatcattacccgagagctcatgtttctcttagcttgatacaaaaacatgatcgccttgccttacaaactggagatttatatggttgtgtatctcaggtctcttatggcagttgatgagattccatatgctccaacttctcaagagtctcagatctcggacactaggtaaagagatgactgatgcagatatcctcagctgggccaacaggaaagtaagaacaatgggacgaaaattgcaaatcgagagtttcaaggttcctttctttacaactacttcaaacacttaccacaatagtattatataaagtatgtccacctatcaccttctagtgaatcaaattaaaattctccaggacaagagtctatcgagtgggttattcttcctcaaccttctatgggcggttgaaccaagagttgtgaactggaatcttgtcaccaagggtgaaacaggttttcactactctttttactaaggtatagttacttactccgtttacctgaatcaaagcttatttgattattatatggttattgaaacgtacagatgatgagaagaggttgaatgctacatacatagttagtgtcgcaagaaagctcggttgttcggttttcttgttacctgaagatatcgtggaggtaagaactgagagactataatgtatcatcatccgaaatagcaattgctcagatgagatgtgttttggtatgttgtgacaggtgaatcagaagatgatcctaattttaacggcaagtataatgtactggagtcttcagagacattcacgggagagttcagattcgtcgtcaactcagagcaccacaacgacgtgcaccagcacagcctcgtcccctgccccatctgtcacagaagaggaggaagtctcctcattgagcggtgaagtcacgagcttggccgttggtgatgcggtttctgaaatcaccacggtctcagaggaagcatccatcgaatagagagagcgagatcacatatatactgatatacatctcttgctatagcaaagtagctgttataatagtgacttctctgtaatcttttgtttttttgtttcatcaactaaaattaccaaaaataataacaatgttacaaacactcaatcacatcgagaaaagtaaagtaaaattgtgaaaatttgtttagtacttaaaaagttaggaggaggaaaaagtgtacatcttattttgaaaacagacactacgcaaacaaccatggatcagacgacgatgatccacaacagtcaaggcaaacaagagatagatagctcaacagacgatgaagatagagaagatggaacgagacatgcagacaaaagaggacttgaaaaccgtggcgttgggcacctctaagatcaactacatggatcctaggatcacggtcgcatggtgcaaacgtcatgaagcacccattgaaaaggtagttaattatatacaaaacttgaatattgatctaccatgaaacaaagagagtcctctaataaagttttttttttgtaatggctggttcgttaatgtagatattcaacaagtcacttctggagaaatttgcgtgggcaatggacgtagaacctcacttcacattctaatatgcattgcactgcagcagctgatgagagtttctctataaaacagagcaaagcaggctacattttttttcttccaagtagataaattctttttgtttgtatctttatttgagatcatgtcttctttttttttcgtatatacaattgttcattgtttgcttgaattcaaatttagtctgttttataaaaaatgaaaccataatctttactattttaaaccataaaaaaaaagtcaattgtaaatacaaaacaccaaaggccaattaagatttattccaactggaaggatagagcaaaaaaaaaagaataatctggcgcaaaaatgacttacacaaatcaataagttttccaaattttgtttctttagcagaaaatcaaaaatgttattttggtcacaaatgtaaaaattggtataaacaaggttttaacaaaaaaagaaaaatatatatatacaaaggcaaaattacccctgagaaaatctggggccttgacacgacgatcctccatcatcctcttcctcgaggaacttcaattccaatctgtgagatctctgcacaacatcttgtctattttcaatcgaaacctctgtgagatcgcttttgatttttgtaattctcgtcgcaggatatctctctcattgggatcagacatggcttttgttgtaacatccctgatattcgctgtcgtaggcatcattgcttcgatatgcactagaatctgcttcaacaaaggcccctccaccaatctgtatgtcaattttcattcctttttgcttcttctccctttgatttagtcatctttttgctgtctttgatccattgcttcgtcaaagttaataaagtgttcttcggtatcaattgagatcattatttatctctctgagcttagaaactattattggttgatgactttatatttgctcattgacttttgctaatttgtttttgaatttgttccttcctgtgatgggtttttttcaatgtaagcaactagtaccgtcacagttctaactcttgtgctggaaaaagtgttgatctttttccctttttttatcattgacttcttatgtacttgtttgtcttgtttctatg

SEQ ID NO: 15750 - DNA, 3003 bp, Unknown; identical to SEQ ID NO: 15749
  misc_feature (1)..( 3003): 2750-1469P.txt file - cDNA_ID_1017855; gDNA_ID_2926189; Annot_ID_200904

SEQ ID NO: 15751 - DNA, 3 bp, Unknown
  misc_feature (1)..( 3): 2750-1469P.txt file - cDNA_ID_1017964; gDNA_ID_1563633; Annot_ID_148028
  misc_feature (1)..(1): n is a, c, g, or t
nct

SEQ ID NO: 15752 - DNA, 3000 bp, Unknown; identical to SEQ ID NO: 12495
  misc_feature (1)..( 3000): 2750-1469P.txt file - cDNA_ID_1018052; gDNA_ID_2214555; Annot_ID_134772

SEQ ID NO: 15753 - DNA, 3000 bp, Unknown; identical to SEQ ID NO: 12495
  misc_feature (1)..( 3000): 2750-1469P.txt file - cDNA_ID_1018052; gDNA_ID_2214555; Annot_ID_185703

SEQ ID NO: 15754 - DNA, 3003 bp, Unknown
  misc_feature (1)..( 3003): 2750-1469P.txt file - cDNA_ID_1018190; gDNA_ID_2936582; Annot_ID_194945
caaccacatggaaagattgcagccatggtggtttggtggaactacattatcaattgagtaattataagcgtgtgattgagaaattgttgtcttgcgcggttaggccggagcatagtccacagaattgaattgcttgggccttaactggatattaaagagtgtaataaacaatttctactatttctatttgcccaaaacaaaactgtctcggtccataataaagcccgaatttactctaaagcccacgagcccacgcatcccctagggtttctgtgtcttcaaatgtgacctatcctcttctgctacactacccaatttattctcggccggaaagtctcttcttgattatcgtccagggattgcaacagagagaaagtaacgatgccggcgaaacagaggacagctaaggtcaacaggaatcctgatctgatcaggggagttggtaaatactcaaggtctcagatgtaccataagagaggtttgtgggcaatcaaggccaaaaatggaggcgttttcccccgccacgacgctaaatctaaggttgatgctccggtggagaagccaccgaagttctatccagctgaagacgtgaagaaacctctccccaacaggcgcacggcaaaaccagccaagctcaggtacttagctgatacactgtctcattgtcttggagtctgaaatctagctcaatgcaatagttgttttctttggttcttaaggagtgctttgtatgcatttaaatctttgaatctcccgaaattttttgactagcttagtgttttgaaatcgttaattagtcattgtggtctgttctatttggtttgtgaatttatcttgatttctgtggaaagtttgcctcttttgcttgtattttgtgttacattgttcggaatttgttatgttgtaatccgatattcatatttctctattgcagagctagcatcactccagggacagtgcttatcatccttgctggtagatttaagggcaagagagttgtcttccttaagcagcttgcctccggtttgcttcttgtgactggtgagttttatgctaatctactttctttatttgccacattctttattcgaaatgcagaacgcccattcactaaacttgctttctgtattctgtataaagttgacattcctgttttgttattgaccttaggaccattcaagatcaatggtgttcctctgagacgtgttaaccaggcctatgtcattggtacttccacaaaggttgacatttctggagttaccctcgacaaattcgatgataagtacttcggcaaggttgctgagaagaaaaagaagaagactgaaggagagttcttcgaggctgagaaagaggtatcccaaacattcttcttgtctttctctaagagtcatttggttctcattttgtaatagacgattaaagttctctcctttatacactacccaaattaaaagctatgcgtgacctccatatactttttttccttccgcaggagaagaaagagattccacagggaaagaaagatgaccagaaagccgtggacgcagctttgatcaaagctattgaagcagttccagagttgaagacttacctcggagcaaggttttcattgaaacaaggaatgaagccccatgagcttgttttctagatttcattactttttttctgaggtttctagtgtatctgtctcctgaagttttacactccaactggttggttctgttctcgtccactgaccagagacataaaatcttggctgctgctatctggatttctgtcttatatggataatttatcaatcctgtttttgaaggagaacttttcacaagattctagtaatgcttaagtcatgacgaagtgatgaaattgagaattgaaaataacattgcaataatgatatagtttagcttacaatctacttcgaatattgaaactcttattactagtctctgtcacatgcaccgagatcaagctggaggtgcttctagacgaatttgatcattatctttaggtgtttctttgctagcacaatcagcaactttagctccggcctcaacatctccggccaaacaccgtctccattttcgtctcagccaacctaaaagcccaccactctttatcatctccaacggattgacttcagccactagaccagttctctggcggctccgtgcgcagaatcgacccaagaagcaggagagaacagcaagaatgatgagaacagatatgacagcgaagaagggtccaatggagctggaagagtaatggtttggagcgtttggtgctgcgattagattggcattggtagccataggtgtgatctcattgcctcctaattgttgttgaggttgttgttggataggaaacaatgacgagctgctactactactagccatagccattgaatctaatgaaattttggttttcggtgatcaagattcaatatttgttgattgagtaacggggtcattagtatatatatacataggcatgtgcacattgatcttttgaagagcttttaagccgaccaatgtttgttgaagaaggacatgtaaaggtgaataaagcggagaaatcctcatcagcttcatcaaaagcgtctcaaactaattataaatgatatatgtgatccattgcactcttacaggtgaaggaatcgtcttgctctgattttggcgttggtcaaattgtgtggggattattagcctgagtttttagataaactactctctaactctgatttttttatcatcctgtcaaaatagttttaggtgaaaagatttaatactacaaagttgtaagaaaaaacaaatcctattatgcatgttacggtccacattaaaaggccgatataattgtaaagcccatgagcccaagaaagccctaaaatttaattagggtttcagtgtcttcaaattcacctatcctcagcctcaactctctcctctatccactctcagccggaaaatttttccttgattcattacgacagagagaaccatg

SEQ ID NO: 15755 - DNA, 3003 bp, Unknown; identical to SEQ ID NO: 15754
  misc_feature (1)..( 3003): 2750-1469P.txt file - cDNA_ID_1018190; gDNA_ID_2936582; Annot_ID_143771

SEQ ID NO: 15756 - DNA, 3003 bp, Unknown
  misc_feature (1)..( 3003): 2750-1469P.txt file - cDNA_ID_1018268; gDNA_ID_2214675; Annot_ID_136636
tcaaacttttggtttcattcttcgctgctcacgttctttctccatttgatgttttatgtattaggagctactatagatgttcaagccctggatgccccgtcaagaaacacgtagagaggtcatctcatgacacaaagttgcttataacaacttacgagggaaaacacgaccacgatatgcctccaggaagagttgttactcataataacatgctggactcggaagttgatgataaagaaggagatgccaacaagactccacagagctcaactcttcaatccattacaaaagaccagcatgtcgaagatcacttaagaaagaaaacgaagactaatggctttgagaaaagtcttgatcaaggtccagttttggatgagaagctgaaggaggaaataaaagagagatcagatgcaaacaaagatcacgcagccaatcacgccaagccggaagcaaagtcagatgataaaaccactgtttgtcaagagaaggcagtaggaaccctggagagcgaggaacaaaaacccaagacagagcctgcccaaagctaagcattcagtgttgtaccgagtggtaatttatatggctgttttaacatagattagtacaggcgatatggttatagactgtacagttgttgttcaggcgggaccagatttagattagtgtttaatggaatagtatgctttaatacctttatgtaaccacttccatttggttcaaataagagttacaggaagagaaggtaacacaacaagagcccttctttgttgatggagcctgtgtaatagttgtagcatggggatgtatatgatttgattcaaccttattaatggttatgagacaaaactatctattacttccagttctgtcttttgcattacattcttggagacgtttattctttcacttccatgcacaagatgagaccaagattcggtccatccaaccaaggtacagagcaccatctctttcttcaatcgcatacccgttgctgtaatctctcaagagggctctaatggtggctgaaatgattgagctcaaggggtatggctcaaaacccgccatggaaaaccttgacttccatttcccgagaagctcgtgtctttcgatcctctcggctccttcacaagctatgatgttgacgacatcccttgccatgcagtgctgctcgatattgatcctttccttgtgatttctcggaagcataacatcgatagattcgaacattgccgtgtaataacttaatgtctcaaggaacctaggaaggaaaggggaagtgttcgtgttgcattcttgttccacaagagtgactactttaggtgatagactcttcaccatcctcagcaaccggtccctgtggttttccatgcttacactctcatctggcaaatgatgcagcatgtaagcaaagttcactccaagggcttcgccatctcggacatcaagattttccacttcaacttcacaacttggccttgaaaccgcattgaacctgaatggaacatcaaacttctttgcaagtttctctagtctcttcttgactgtaaccaagacagatccatcaccaactccggtaattcgaatatttggagccccaccaggcctagctgcaaaagcctggataagtgctatccactggctcccttgtccaatttggaagtcaataatgtgaatcctctcttcatccttcattgcttctgcaatcgcaccattcgctgacatgtatccaaacttgaaatatggacaaacctcatgcagaacatacacataagataaaaattcataactctctggttctctggactggagagacttatatatcgaactaccagaagcagcaagcctagcaacaagcccttctaacatataagctcccaatctctggattggctcaccagaaatcgaaaccataccgcgcaactcacccatacaccatcgtgccattagaagattattctcagaaacagcttttgcacaagcaacaagtaccaacttcaagtctccccttgatattgcctccactatcaataacaaatctttagcatcatcaggccacatggagagttcatggcagatagcatcatcgatactctcagctatctctggcagtggctgcaacattattgaacctcttacattgtccatcacaaataagcaagtaagaatctttgaacatcaaccattatcctcaaatgaccttttatttatctgatcttcataacaaacacctgtagaattcatagacaaagtcattaatcagagactgaattagatatcaatattgaacaataatatccatggagatcaaaactctaacaagaactctagtatcattgaaatcaactcatgactctatgaatctacgtcagccatgaactacttcatcaataaacaaggcatacaagagttccaatcctaaacaaactaatttgacaatttctcttcacactttagagtaaagcttgctagaaagagcaatcatttacaacaaaccaacatcaaacttatcaaagaagaaatgttttcatgttttgtggataagaagaagcagagcatcaaaatcatcaagaaaagagaataaaggtttgatttttatgagaaaaacaaaccttgtgtaggttaagaagtgatctttcggtggaagtcgataagggatttggttttgcaagtgagagatccaaccaaagctcgcagctgaagcaaaaggaagaatctttttagttgctgtagtgaagaaaataacacatcacatacgacgtcgttttaggcttaaaccgaataagacccgatcaccgacttgacacatctcgcttaaagtctctggtcaaatgggaaatagtgtaagaagcaatctaagagacatcagaggacgacgatcgatggatcctcggatgtggcacaaagtcgccgctatttccggtgagatttaagataaagtaatgatcttttgattttgatcttgtgaggaaaggtactgattcggatagaattggtttaggtatg

SEQ ID NO: 15757 - DNA, 3003 bp, Unknown
  misc_feature (1)..( 3003): 2750-1469P.txt file - cDNA_ID_1018268; gDNA_ID_2214675; Annot_ID_189169
attgagctgagtccagtggagaggtcaaccaatgattcacgcattgtggttcacactcagactctgtttgatattgtgaatgatgggtaccgatggcgtaaatatggtcagaaatcagtaaaaggcagcccatatccaaggtagtgactgcttacatgtttgaaatataatgtcaaacttttggtttcattcttcgctgctcacgttctttctccatttgatgttttatgtattaggagctactatagatgttcaagccctggatgccccgtcaagaaacacgtagagaggtcatctcatgacacaaagttgcttataacaacttacgagggaaaacacgaccacgatatgcctccaggaagagttgttactcataataacatgctggactcggaagttgatgataaagaaggagatgccaacaagactccacagagctcaactcttcaatccattacaaaagaccagcatgtcgaagatcacttaagaaagaaaacgaagactaatggctttgagaaaagtcttgatcaaggtccagttttggatgagaagctgaaggaggaaataaaagagagatcagatgcaaacaaagatcacgcagccaatcacgccaagccggaagcaaagtcagatgataaaaccactgtttgtcaagagaaggcagtaggaaccctggagagcgaggaacaaaaacccaagacagagcctgcccaaagctaagcattcagtgttgtaccgagtggtaatttatatggctgttttaacatagattagtacaggcgatatggttatagactgtacagttgttgttcaggcgggaccagatttagattagtgtttaatggaatagtatgctttaatacctttatgtaaccacttccatttggttcaaataagagttacaggaagagaaggtaacacaacaagagcccttctttgttgatggagcctgtgtaatagttgtagcatggggatgtatatgatttgattcaaccttattaatggttatgagacaaaactatctattacttccagttctgtcttttgcattacattcttggagacgtttattctttcacttccatgcacaagatgagaccaagattcggtccatccaaccaaggtacagagcaccatctctttcttcaatcgcatacccgttgctgtaatctctcaagagggctctaatggtggctgaaatgattgagctcaaggggtatggctcaaaacccgccatggaaaaccttgacttccatttcccgagaagctcgtgtctttcgatcctctcggctccttcacaagctatgatgttgacgacatcccttgccatgcagtgctgctcgatattgatcctttccttgtgatttctcggaagcataacatcgatagattcgaacattgccgtgtaataacttaatgtctcaaggaacctaggaaggaaaggggaagtgttcgtgttgcattcttgttccacaagagtgactactttaggtgatagactcttcaccatcctcagcaaccggtccctgtggttttccatgcttacactctcatctggcaaatgatgcagcatgtaagcaaagttcactccaagggcttcgccatctcggacatcaagattttccacttcaacttcacaacttggccttgaaaccgcattgaacctgaatggaacatcaaacttctttgcaagtttctctagtctcttcttgactgtaaccaagacagatccatcaccaactccggtaattcgaatatttggagccccaccaggcctagctgcaaaagcctggataagtgctatccactggctcccttgtccaatttggaagtcaataatgtgaatcctctcttcatccttcattgcttctgcaatcgcaccattcgctgacatgtatccaaacttgaaatatggacaaacctcatgcagaacatacacataagataaaaattcataactctctggttctctggactggagagacttatatatcgaactaccagaagcagcaagcctagcaacaagcccttctaacatataagctcccaatctctggattggctcaccagaaatcgaaaccataccgcgcaactcacccatacaccatcgtgccattagaagattattctcagaaacagcttttgcacaagcaacaagtaccaacttcaagtctccccttgatattgcctccactatcaataacaaatctttagcatcatcaggccacatggagagttcatggcagatagcatcatcgatactctcagctatctctggcagtggctgcaacattattgaacctcttacattgtccatcacaaataagcaagtaagaatctttgaacatcaaccattatcctcaaatgaccttttatttatctgatcttcataacaaacacctgtagaattcatagacaaagtcattaatcagagactgaattagatatcaatattgaacaataatatccatggagatcaaaactctaacaagaactctagtatcattgaaatcaactcatgactctatgaatctacgtcagccatgaactacttcatcaataaacaaggcatacaagagttccaatcctaaacaaactaatttgacaatttctcttcacactttagagtaaagcttgctagaaagagcaatcatttacaacaaaccaacatcaaacttatcaaagaagaaatgttttcatgttttgtggataagaagaagcagagcatcaaaatcatcaagaaaagagaataaaggtttgatttttatgagaaaaacaaaccttgtgtaggttaagaagtgatctttcggtggaagtcgataagggatttggttttgcaagtgagagatccaaccaaagctcgcagctgaagcaaaaggaagaatctttttagttgctgtagtgaagaaaataacacatcacatacgacgtcgttttaggcttaaaccgaataagacccgatcaccgacttgacacatctcgcttaaagtctctggtcaaatg

SEQ ID NO: 15758 - DNA, 502 bp, Unknown; identical to SEQ ID NO: 243
  misc_feature (1)..( 502): 2750-1469P.txt file - cDNA_ID_1018625; gDNA_ID_76770; Annot_ID_147085

SEQ ID NO: 15759 - DNA, 3003 bp, Unknown
  misc_feature (1)..( 3003): 2750-1469P.txt file - cDNA_ID_1018649; gDNA_ID_1620762; Annot_ID_167209
ataaacaaaccaccgcactaactcgtcgacgacgcgttctcaaatctgacgatacgaactcgcccgaagactcaaacgtgactatattttaccttaatgcgctcgttttttctcagcgatccgaccgacacaattttttgggcaacgcgctttcgactagccggaaaaccaaatcgtcctagtcccccagtgtgatctagttacgccaccacaggcctgatagtattaaaacaaaagggcgaaataaaacgacgacgtttacgaggagcgactcctcgggatccggtagccaatagtaaactcagatcacatagatcttcccgagccctagcgatttcgatttctaaagcagattctaaagacaaaaatcaggaaactcgaggaagaggaacctagtttcgaaacaaaaacaaaaaccagagaagaagatgatcaacgagaatgatgaaatcggaaggaaaccttaccgtctctccgacgaagaactaacggaacggagcttgagattgagcgacgaagaagcagcgatcgagagaaagagagaagtgcaaaaactaatcttagtgaaggccaagtatggaaatgtattaatgtgttcaaacacattaaaattgaatttttttttaagaaaaagtatggtactgagattcagagatggtgaatatctgttgtacctaacagcaatttagtaaactataatttctgacgactatttttcgatacttttgtaacaattatcgtaaaaaacaaaaaattaagtgagattacattcgacgttagatgccagaaataatatatatatgtgattgtgaatatgtacctttttttcttttttcaatgagtgtaatatgaatgctttgagaggattacacgcgtgattctgattcggatcaccaacttcttttgcttcccttttaatttctttcctatcttttgcttttcccattcatctctctcgctttccacaaaggcgagatttgaatacgtaatcctaattatactctcatagagatttggtaatttggcccaaaatatctttctactttgtaatatgtcgatgcatagaaaacataatcttattctaacattcacaaatctcctatatttccatattgaatctctcagtctggatcggtttgtaatctctgtccagctacctcttacgtttcaggtgtttctatgatttatccattggcttcattggctgcctataacttatatatcatgttgcaatctttgtgtgtgttgtgttggggagagcttatagccggccgctcctccattagcttccaaatggttgaatcagtctgtatcagatttaaactcagtgatagcacccacgttatgcatgatttttaagatttgataagcagactgtttttaacttcaattcaagagcatcatccactttcggcttaatatcctatattaatttctttaacaagctaaaatgaacataatgaaaataactacactcactgattggcaattactaatatctcaaaacattaagaagtattttttttttttttgggtgaaaagtcactgtctttttcttaaagccaaaatttatacggaacgacaaaacaaaaaatatgactaaaaacttcttaagcgcaatcactgaccatgcagcctattttagtttttaagtcttttatatacattggctgttatagtcgtaaaacaatcaggtatttgttatggagataacaatttgggaacgcataaatagtgcctctgatggttggaagtggaacaaaatcacaatatttttttctagtgtataaacaacatacaaatatcatgtcacctgcaaagagaataatatgccaaaattttgatataatacgcataacagagtttatatatcaacgttctagacttataggtgatcatccattatctttaacctcttgtagctagctaggttaattaggagatgcatgcatctagataggcatatatagtctaacattacaaatccatcaaaggttcccttcttcttctccaaagaaattagctacatacaaatttgacagactctcataaatatatatatatatgtttatagattatattattaaaaatacaaatgatattttctgtattttgttaaaattagttcttaagattttatgaaatttataattgagccaacgtcttagaaataattatacgacatacgtaatttaaattcaatgacgatgacttaaacttaatgttttacagtatttatccaatcaaattttaccacatcagcagagaagagtcaaacttaggaaaagtctatcttggattatcctgacgtggcttttttcaagtaagaaataaattaatgctaatcacgtacgtacctacccagcttttggacctcgtgggctatatagaaaacaagtaaccaaagagagacgaagcaaaaacattcagagagaaaattcagcatttttgatagctcaagcacttgattctttccaaaggggtttcctgaggtatgtttgctttcctttttggttttaatttgtttcaaatcttagatcgattcttcactttggattcttaaatcgattcttgtcctcgtctgtgctgatttcgaacttttccgattccaactccgccgaatctacgtatagatctttgaggaaatgtttttttcgatttatgatcggcggatctaccgattcctttgcttgttttctttggatgtatcacactcttctgaagatgccttgacctttttatgtgaactagtaagagttattatggcttagatcgttgaatatctggtatatgtgttcttataatgggattaggatctatgttttggtgcgtattaaagcttagttgagattgatgtttttgggttttcaaattctgtttcttgtctgttgagctaatttaatgttgtgtagaaccatttgtttttttctggatctttacttatttgtatatgtattggtttatgtttatgtttttacagatcacaaaggccaagtaacaatg

SEQ ID NO: 15760 - DNA, 3000 bp, Unknown; identical to SEQ ID NO: 753
  misc_feature (1)..( 3000): 2750-1469P.txt file - cDNA_ID_1018890; gDNA_ID_1620316; Annot_ID_153179

SEQ ID NO: 15761 - DNA, 3000 bp, Unknown; identical to SEQ ID NO: 8708
  misc_feature (1)..( 3000): 2750-1469P.txt file - cDNA_ID_1018916; gDNA_ID_1971867; Annot_ID_58439

SEQ ID NO: 15762 - DNA, 3000 bp, Unknown; identical to SEQ ID NO: 8708
  misc_feature (1)..( 3000): 2750-1469P.txt file - cDNA_ID_1018916; gDNA_ID_1971867; Annot_ID_176505

SEQ ID NO: 15763 - DNA, 3000 bp, Unknown; identical to SEQ ID NO: 8708
  misc_feature (1)..( 3000): 2750-1469P.txt file - cDNA_ID_1018916; gDNA_ID_2926155; Annot_ID_139486

SEQ ID NO: 15764 - DNA, 3000 bp, Unknown; identical to SEQ ID NO: 8708
  misc_feature (1)..( 3000): 2750-1469P.txt file - cDNA_ID_1018916; gDNA_ID_2926155; Annot_ID_198353

SEQ ID NO: 15765 - DNA, 3000 bp, Unknown; identical to SEQ ID NO: 6947
  misc_feature (1)..( 3000): 2750-1469P.txt file - cDNA_ID_1019105; gDNA_ID_1621117; Annot_ID_171912

SEQ ID NO: 15766 - DNA, 412 bp, Unknown; identical to SEQ ID NO: 185
  misc_feature (1)..( 412): 2750-1469P.txt file - cDNA_ID_1019158; gDNA_ID_25709; Annot_ID_146520

SEQ ID NO: 15767 - DNA, 3003 bp, Unknown
  misc_feature (1)..( 3003): 2750-1469P.txt file - cDNA_ID_1019230; gDNA_ID_2684240; Annot_ID_192552
ccgtccacatttggaatgagaactgcagcaatatttttttcctcatgatgagatattgagatgtgtcaaaagagatatgtttctcaaaaatataatgtacctcatttgtgaccaccacatcatcctctccatacccgagtttctcgagtagttcgtgcataccacttagatccactctccagcatgcttctccgaaaggggtcaagggcaatggctcctttgttgcaggttcagtgtatgatggagtctgtcattattaagtcccatgtacacataagaaagcctgcagaacccgaaaccttggaagatttaatgtagtaatgacttacagggatgttttcttctttgacgttgggccataactcagctcttttctcaagtcttgaaagagctgacataagaaactttatgcttggcctctcgtctggttcagggcgcaaacagcgggaagctagatggataagttctgttctatcctcatcagagaattgaccatccagagctgaatccattagcaccaaatagtttttaccacggaacagatcaagtgcctgaaatgacagataagctaaaaatcaatgaaactgctaaagatacattatgtatatacacattttgctttgtgagaagaaagttacatggtttggtggaatatgtctgccgctcataagatccagtaacaaggttccgaagctaaatgtgacactctccggtatcacagtacctaacaataaaagtaaaagaaaaacatctttgagatttcagctgatgaagttttctctcaagaaaattaaacataaaacacatacctagacgtaaatattcaggaggagcaaatgccaagttggtactatagctctttccctctcggctacacttcatgagaccaaaacaagacagcctaggattcccaacctgttccatcacttttataaataacttatgataacatcaaaccgcgtatgaagtttcttaccttgtcaaacaatattctgtaggtgttaagatcgtgatacaaatctattccccaatcattacagtactccaaggctgttgcagtatgtaacgcaactctcaacctcatttcccacttcattggtcttttctcccctgaaaaaccattttagagtaaaaacaacttagacacaataatgaaactctaaagtaaagtttaaggccaaaagagatcaagaacttgaaatgtttgagtctcacagtgaaagagatgcttagcaagtgtttcattaggcatgtactcagcaacaagcaacctctcgtgaccttctgagcaacaaccgatcaaattggccatatgctcactcctacatctccctacagcttgtgcttcctcctgaataacaaatatgccatattcaagaaattttcctctgcaacagatcaagcatagaaccgaattgaatctttactaagtcaaacagacttgaaatttgcctcctctgcaacaaatcagaatccagaacattgcaacattcaagagaagtatcacggagttagtaaccaataaagtcaaatcagatgaataagcgatcactagtcaaatcttatacaaaaccaaacagagaagaatcaataagtattgatgggtaaaggacacgaacgatgaattctaaagaatcaggccatgaaagccgttgaaaccgcttgacggcgatctttcttccgtcgttgagctggcctttgtagacgatgttaggaaccctctcgttgtgctccgacacgatgttgtcggcggagaatccgtcagttgcgactctcaactgttccaagctgaactccaggaaattaggacaagtacttccttcatcttcttctttattatctgcagccaaaactattaggttagttctctcgatcatcgtcttcttcagaatctaattaacgcataggaggagtggctggcgaattcgttggattttacctagatcgtcgatgacggtgatggtggatgttatcgacggagaagacgatcgacgccaacgtttgaaacaaatgcagcccatcgccggcgacagtagtttctccggtggagaaaaacttttcaagtgcttggttaaaaactcccgcctgcagggagaaaataaattattatttttttcttttttgcctagcgaatattgttggaaagttttacggagaaagtggtaaaatagacccaaaaatatcatttatttatatatcacataattaaatagttgatgaccaatatatactttttttttttttgaaaagatcaacctttatactattataaggataaaatgtcgacatgatctatgtattaatttaaagaaaatattgtttgcttgttccatttaaattactcggtattagattaattttgagcataaacattacaggtttttattttggtaaataatcattagactgttgagtttggtctttactttagcctcaattttaaagtctatattcaatggattttgcttacatacatttcattcacgtttaaaccgaaattaaaatatctcatttaagttgtaaccaaaaaaaaaaaaaacagaaaaattctcattaaaattaatttttgctagttaccgcagcttttcgagactgggtgtgtaatatccatcacactaacctttttttttttaatccatccatacgtttaactacatttaagcaaatatcgctatcaaatcgttttggtatatttcgctcattactggcaaaattcactctacaaaaaaagtctagtttgtaatgggacgctcgtttttaggtgacttatataaaaataaataaatagattaaaaaacaaataaaatcagtataggcctaaataaaagttagcttacggaccatttatgatgaaacttgggccctaatgcaaagcccattaattttatctttggagtctgaagtctctcctctctgtgctttcacataatcacattgcatgattgatcaaatactcgattttccgtgaaatctctttgaatatttcgattccttgttaccatg

SEQ ID NO: 15768 - DNA, 3003 bp, Unknown; identical to SEQ ID NO: 15767
  misc_feature (1)..( 3003): 2750-1469P.txt file - cDNA_ID_1019230; gDNA_ID_2684240; Annot_ID_137752

SEQ ID NO: 15769 - DNA, 3003 bp, Unknown
  misc_feature (1)..( 3003): 2750-1469P.txt file - cDNA_ID_1019253; gDNA_ID_1621109; Annot_ID_56060
atgatggctgggaacaaatccgatctgaaccacttgagatccgttgctgaggaagatggtcaaagtttggctgagaaggaaggtctctctttcctggagacatctgctcttgaagcaacaaacgtcgagaaagcgtttcagaccatcttaggtgagatctaccatatcataagcaaaaaggcactggctgcacaagaagcagcagcagctaattctgcaatccctgggcaaggaactacgattaacgtcgatgacacatctggaggcgcgaaacgagcatgttgctcttcttaaactaaaggtaaactgtttatttcggttgctccttgttcagagattcaaacttttgttttcactggcttctcttcttttcaagttttggctgatgaaacgtaactatgcaagactatgtagaatactctgtttttattctcttcggtttggggtttgtgttcagtttaaagcttgttagtagtatacttagaatcttctggtgcttgcttgctttcccttcttcttcccttggtgtgtttctattgatttctggtttataaagtattttttctatctccggtttagtccggttcgtcttggctttgtttaatcaaatcattgattcctctcttatcaatgtattgtatccggttccaaaatcctctcttcatgttacacactgacaagcttctaccaaagaaaataaattttagtattacgaaagaaaaaattgttgacaaactaattttgctccatctattatcacaaataaaaatgcaattgaactgcagttactatcaaataatggctatggttttttattttgttttgaaccgaccaaattaaaagatgttttgaattaatggtattattttcaagtaaaatagaggaaagtgacgacgatacatggagacagaaaaggagtgattgagaaaccgataacaaaaacgtcattgtagcccaacttgcaaaaactaaccaattgcatgcatgaaagagtttataataaatcatggaattttacattgtcaacgtgtgaggtttttctttttggacacaacccaaaaggccttttagttctaaattgtttcatattagaaaattctaagttcggaaatgctatacatgaaaattcttggtgatttctaatgagcaaaataacatgaaaattcttggtgatccattatatatatttatgcgccgagaaaccattcagagaaacaataaggaagatagtaaaacctcatctttctaatcgataacttccatatccttcgattaaaagcttttgatcaatgcatagtccaaactttatactcacatatactcacatacccataatttagaatttagatctcatttaaattgataagctatttttgtagttataaaatacataaacccatccaaaatattatcattaagacaaaatattagaataggtatattaaaatagaataatgagagataacatttttaagaaataaacaataaagaatcaatgcatagtaaaaatgaatttgttatcttgtaaatacaatataattttatcgcctgttttgagccttcttgcttctatattattccaccctgagcacataaaatatttatcatggtctatttttattgttacccagtaactcttgttattctctaaaacttccacttgaagaccacttggaggcattacaaaattttctatagtgcgtagtatcttctctatctgcaattttggttaatataacctacccatgtgggaaagatcggtgtttgtaagaactttctctaacattttattttgatccatatcaagccaaatcactattttactaaactcttaacaaatttagaaattttaaaaaatgtttgtagaaaataaaatgtttgaagactggagctctacacatatgtttatatatagttctcggccaaaccaatgtgctttgtcttcaaaccctttaacaaaaaaaaaattgtgctttgtcttcaacttttaaaaaaaaaatgaaaaaattaatttgtccaaaaaaaaactctaaatgtagtcaattatatggatatatattctaatttttgtaatattaaatgaaaatattttctaatatgttatgtttctaaatttttacacttgttaccaacttgaagattaaactaattatagtttttttctaacatcaaattaattattaagcaaaaaatttcttataacaatcttacttttttagtcatttttattttaaatttcttccaaaatttaataaaaatcgattacattctttagaaaaataaattcagttaatactatcaaattgtattatttcaaaaacacttaaaaattgcacacttggcagcttatagttttcgattgatgtactttttacaataactcttttttaaaaaaagtttataacatcaacaagaaatttagtaattaatgtttaatgagattttcttttatagatttttttcattaaactttacaagtcgaccatggcattgtccctatgggatccactaatattataaagaaaatctatacaaattaaccatgaattctatataaacctttttttgtgaatatatttatgaagtttgtgaatatttaatatttttttgtttgacctaataataacagcagaaatcgacgtcgatacgaaaatatatatatatatatatatatatatatatatatatatatatgaaaaaaatgaaaatgtgtcatttatctaaaacgaaaaaaaagaaaagaagagaagcttttttagttctctctgcccaatggagaaaagaagaaccagagattgccaaatcatcttctgcaaaagcacccatcaaagaaattacttgtaaatagaaaacaaatcatcaaatctggaagacaaatcattaaaaaaggcgacaactttttttggttcagattttgaaaatttgattttttatttttcttatcttggcgatcgaatcctatccgaaagattgaaacttgggaggtgggtaagtgagtgaatg

SEQ ID NO: 15770 - DNA, 3003 bp, Unknown; identical to SEQ ID NO: 15769
  misc_feature (1)..( 3003): 2750-1469P.txt file - cDNA_ID_1019253; gDNA_ID_1621109; Annot_ID_171743

SEQ ID NO: 15771 - DNA, 152 bp, Unknown; identical to SEQ ID NO: 258
  misc_feature (1)..( 152): 2750-1469P.txt file - cDNA_ID_1019253; gDNA_ID_78089; Annot_ID_147245

SEQ ID NO: 15772 - DNA, 3000 bp, Unknown; identical to SEQ ID NO: 12547
  misc_feature (1)..( 3000): 2750-1469P.txt file - cDNA_ID_1019319; gDNA_ID_2214558; Annot_ID_134845

SEQ ID NO: 15773 - DNA, 3000 bp, Unknown; identical to SEQ ID NO: 12547
  misc_feature (1)..( 3000): 2750-1469P.txt file - cDNA_ID_1019319; gDNA_ID_2214558; Annot_ID_185817

SEQ ID NO: 15774 - DNA, 3003 bp, Unknown
  misc_feature (1)..( 3003): 2750-1469P.txt file - cDNA_ID_1019406; gDNA_ID_2936582; Annot_ID_194958
ttacttaagttgcagttagtttctacctgtgagttatcagtcatatacaaatgataaaccattctctgttttctaataacacgactttgaactctgattctcaagtcatgaattgagacaagttctccttttggtcaatttctgtaactttagcttacacaaagtcaggcttaaaaatcatttctgatctttgttagtgggtgggaagctacttcaaataaaatttacagatgtttttttctttctgcagcatttctgggttgcgatctccatggtgttctttctcgctgctacagtctttaccctccttaagctgtctggtaataatttgccgctgtaatagttaattttaagtatgggcgttatacttcctggaattcacaatcatgtttatagctagatattttctgtctagtgaccattaaaactagacagtttctccagaaaggaaaaacttgaaatcctgcagaatgagtcatgccttaatatgctaaatgtcctttgcatgaaattccctttcgtgtgcacagtgactgacatattcatataatcatagttaacttcagtcgtctcactaaatatatgtatattgtcatatctcttcacatatctaaatcatatcttatataagcaaatgtccattaattccttcttattttatttcaaatcaggcgatgtagctgctcttggctggtgggatttattcattaatttcgggtatgcattgtctttgccgtttctgttacatatgtgaatgtcttaatgctattcgtggaattgagcatgattgtaatcattgtgtacgtttcgcttgcagaatcgcagagtgctttgcgtttcttgtttgtacaaaatggtctaatccagtgattcatagaagctcacgtgatagagaaactgggtcatcttctaccaatattagatatcttgactggaacagtggccttggggttttttcagaagacgataggaaccaagatacatgtggcctgcaagacattggtggtcatataatgaaaatccccctcattgtatttcaagtggtactttgcatgcatctagaggtacacaacatttctatctatcatacatttcttgtgtatctagaggtcatttaccaaaatcgtgtggtttgaactttcaggggactcctgaagctgctaagtctatatctgtccctgtcctgttttctccacttttccttttgcaaggcgttggtgttctatttgctgcttctaaactaatagagaaggttgttctactgctgcgtggcgaagatgatacaggattatattttagatttctatccagagcacatgattgcttgggtttcttgcaccatggatccaggtgataattatgtttagttacttcctgatctgtttttaatgcgtatggaggctaaccataaaatatattttggtagctgcaaccgagttactaacaaacatcaagttgatgcctgacatttgatcctatacgtgctcgcttaggctactaggttggtggtcaattgatgaaggaagccgggaggaggaagctcgactatactttgatcaagaatctgggttagtacaactaaaccttctaaattttccaacgaaaatggttataactacctgctgaagacttccatgaatatatgtggtgcaggtacaataccttctgtggtcatccgcctgaaatagtcaagaaaatgccgaagaaagagcttgcggaggaggtattttgccttttttctcttacatgcaaatatgtcgtcgtttttttgtttgttaagtcttagatctctggtatcattattactcagtgctgttcatgtctttttgtatttgatctataatttggtgtcaggtgtggagacttcaagcagcacttggtgaacaaacagaaatcacgaaattcagtcagcaggaatatgagagactgcaaaatgtaatgctctcacctcttcttcttataaattacacttctcagggtttagctttcacaccgtttctcttttggtgttgcttttcctttggactgaatttcatatctcgatgttctctctgttccaggagaaagtgctgtgtagggtatgttttgaaagagaaatcagtgttgtactgcttccatgtagacaccgtgttctctgcaggtatcataaactattcaatgtttatgcattttcacaggaagaaactgaatttaaagcactaaattagttcggtgattaatccaagtgcaattgcagcctctgatgaaattattgagagctctctgatcatacctgcctgatgtttctgctaacgtgtttggtgccatgtttgttgcagaaactgttcagacaagtgtaaaaaatgccccttctgccgtataactatcgaagagcggctccccgtatatgatgtttaacatctaactagaccgtcttcgtctcttcgacatcaaatatttaagtgtatatatgtgtgtgtatagatgatatgattattcactcctttaagaaactctacattgctgagtcgttttatttgtgtgaatcagcattgagcataggtcgagcagaagtctattgttggataagatcttatgtcttatgtttaggctttttgtagatattatttacctctgacatagttacttcagcgagatattgtttgtataatatttgttttcttatatccttatgtatttctatttctggatctaattttgtggacatcgtctctgtattgaaatcttccaagacgaagaaaacgaaggatcgaatctaccaggaacattgaacaagcagttgtgggtaaatgtactaatttcggccttttcagatatttttggcgggtaattaacagataattctgtacacttttcttgggccgaataatagcccaatgggctaaacggcttattttgaaaatacccaaggcgacgcgagaaacctaacttactccggccgaacgaaatcgaagaagagagagagaaagagagtgagagtgacggcgaggaagaagagaaatg

SEQ ID NO: 15775 - DNA, 3003 bp, Unknown; identical to SEQ ID NO: 15774
  misc_feature (1)..( 3003): 2750-1469P.txt file - cDNA_ID_1019406; gDNA_ID_2936582; Annot_ID_143782

SEQ ID NO: 15776 - DNA, 689 bp, Unknown; identical to SEQ ID NO: 356
  misc_feature (1)..( 689): 2750-1469P.txt file - cDNA_ID_1019508; gDNA_ID_1564308; Annot_ID_149219

SEQ ID NO: 15777 - DNA, 3000 bp, Unknown; identical to SEQ ID NO: 14378
  misc_feature (1)..( 3000): 2750-1469P.txt file - cDNA_ID_1019620; gDNA_ID_2684113; Annot_ID_190695

SEQ ID NO: 15778 - DNA, 502 bp, Unknown; identical to SEQ ID NO: 448
  misc_feature (1)..( 502): 2750-1469P.txt file - cDNA_ID_1019620; gDNA_ID_1591055; Annot_ID_150456

SEQ ID NO: 15779 - DNA, 3003 bp, Unknown
  misc_feature (1)..( 3003): 2750-1469P.txt file - cDNA_ID_1019757; gDNA_ID_1620617; Annot_ID_162080
ttcttttcgccgacattcttgttttattctttctctccagggttatcgcatggtagtagaagcttggagcatcggtgaggaaaagagaaagagagagagaaggcagttttgttttccaaatgtcagcaattcttgcagctgccattggtggtgctgtaggagctcttgcattgattgctttgtttgtttttctcctttggttttgtgtctttcgtcgtaagaatctgtctagaacttctgagactggctcttctgatccatctactcaaggtaaatcacaaatcccatcaattctattcctctctctctctctctattgactttcttggatgatatcaaaatgatttagacttttttttcttttgttatatgtttgtgtgagttcagaaggaagaaatgttgcaattgagttgtcaatgagagaagctagaagatttgaaatggaggaacttgctcaagccaccaagagttttaccaataaaagtcttattggtattggcaaattcggcgaggtttacaaaggtttgcttcaagatggtgttcttgtagctatcaagaaaagacctggtttgcctactcaagaatttgttaacgaggtttctataattaatcttgttcaagtgtttgcttttagtcttcttagaccaagtgtattgattgagaggatatggtttatttcttcaggttcgttatctatcgtctatccatcaccgtaatctcgtcactcttttggggttttgccaagaaagcaacacacagtttcttgtctacgagtatgttcctaatggaagtgtttccagtcacctgtacggtaactctctgtccttaatgttattttcatttggtatttaatcagtttgagaaatgagtttggacgatgtaagcatcgtttaggtcttttcctctgttaggtgctggtggtaaagtacctggtaatagactagagttcagacataggcttgcaatatctataggagcagctaaaggtaaatcctctacaaaatcctcattgaagccagctctagcttgtgtcctgatcttgcatatacccttttgttatctctaggcttggcacatcttcactcgttgagtcctcggttgatacacaaggacttcaaaaccgctaatgttcttgtggatgaaaatttcattgctaaggttgcggatgcaggagtccgtaacttcttaggaagagaggatgttggtacatcgtctcacattgttgcagaccagattttcctctccccagagtaaattaaaaagatttcaccttctaagctctcatatgcttctttttagtatcaaagtttctcagattgtcccctttttttttcagggttcaagagttcaaaagattttcagagaaaagtgatgtctatgcttttggtgtattcctcttggaattagtaagtggaagagaagcatcagaaccatccccttcaagctcaacgcaaactctagtcgattgggtatgtaatcacactcaaaaccgtgccaatgtaatctattttgattctcattttgtatgcattgggagttgcagatgcaaaacttaacggattacgcagatataccaatgatgattgatgagagactaggaggtacatacacagcagaaggagttgaggaacttattacattgacactaagatgtgttgatgtatcaagtgagaagagaccaacaatgagttttgttgtgacagagcttgaaagaatattggataaagaagtgagcttaacaacagtaatgggtgaaggtactccaactgttactcttggaagtcagctttttaaagcaaccaagtgattattataaaggaaccatctttttacatatatatacatatatatatatatattatataagttctctgagacaagaaccaatcagagaacttaaggaggaagaagaagaagactgatcagctgttttgtgttaagtgtataaagaacagctgaagcttattgtttgtttgttttttccctcctttttcacttcctttggaggttattattttcagcaattatttttttgacaatgagtgcagaaaagtataactttgtaaaaacattatttattgatataaaggaagcaaagagtggaatgttgtgtgattctttgttacattttactctctacaaaagctttgaacttagcttgaaagactttattgccaagttggttggttgaataagttttgatgaaaagattccaattggctaactgttgaactaacagaaggtgataactccctgtctgaagaactctaattattatgtttgtacagaaaaactcagagctactttttcctataaagtagccaattttgggaaagattttgacctttagcttcaacctacctatgctttgatagcctttattgccaaaggggagatatagtaaccaagttggtctctaaagtcttgatcaaagattccaattggataacaacactcttggtcttggactagtatagttcctacatactccatttgctactagtgaaaataaactcaatgctctgatttattactctgtccctagttttgctaaaaaacctttgtgggcacacagaactataaacaaacagtctttggaacagattgcaaaatcaaaatcatgtttggtctgattttatgtcgggagagattgaagatctaatgataaagactcttcttctgtagatagttaactcgttaaattggtgggtctcacatttattattaccttccagattttgacctcacagaagcaaaaacacagtagtgattgaaaagcttagaaaagaaattacaaaaccagagattgttgattcttagttcatacatagaagaaagaaacagagctaatgttttgtcataaatactaaaaaccgttaaaagtatatttttaaaatgagaaaaaatgtgagccattcgatttttggatagacccatcatgtaaaggtttaagctttttttttgttagccaaagagaaagcctttttagttctattgacaatg

SEQ ID NO: 15780 - DNA, 3003 bp, Unknown; identical to SEQ ID NO: 15779
  misc_feature (1)..( 3003): 2750-1469P.txt file - cDNA_ID_1019757; gDNA_ID_1620576; Annot_ID_160994

SEQ ID NO: 15781 - DNA, 1291 bp, Unknown; identical to SEQ ID NO: 6238
  misc_feature (1)..( 1291): 2750-1469P.txt file - cDNA_ID_1019898; gDNA_ID_1621084; Annot_ID_55352

SEQ ID NO: 15782 - DNA, 1291 bp, Unknown; identical to SEQ ID NO: 6238
  misc_feature (1)..( 1291): 2750-1469P.txt file - cDNA_ID_1019898; gDNA_ID_1621084; Annot_ID_170471

SEQ ID NO: 15783 - DNA, 3000 bp, Unknown
  misc_feature (1)..( 3000): 2750-1469P.txt file - cDNA_ID_1019907; gDNA_ID_1620314; Annot_ID_153100
ttaattcgtagtcaaatatttgggttatgcaaagttaaatatgaaagactaatagtggtatgggtttatgcaatgttaatgagcagatacaagatatatatagaagggtctgcatggtccgttagcgagaagtacattttggcgtgtgactctgtgactctgctagtgaaacctcattactatgatttctttactagaggtttgcttccagctcaccattattggcccgttagagagcacgataagtgccgctccatcaaattcgccgttgattggggtaactctcacattcaaaaggtacattgttattctatcttgagattcacagcattagagctttggttgagatggtcttggtcttcaataggtacattgttaatctatgatgaaacataactttttttgacgcaggcacaggatattggaaaggcggccagcgattttatccaacaagacctcaagatggactatgtgtatgactacatgtaccatcttttaaccgaatactcgaaactcctccagtttaaacccgagattccgcggaatgccgtggagatttgctcggaaacaatggcatgtctgaggagtgggaatgagcggaagttcatgacagaatcactcgtgaagcaacctgcggattctggtccgtgtgccatgcctcctccttatgatccggctacgtattacgaggttgtgaagaggaaacagagtactaatatgagaatcctacagtgggaaatgaagtactggagtaagcagaatcaaaccggctcttgaatttttcatcttcatttcggttttggtttgtgtagagaaaaaagaaaatatatatacgtataaccaatgttgtagattactagatttatgtttcaagtttaggttatttcacacgaaactcaaaatgaccaaatttcatgtaatagctttagaaagatgaaatattatttacgagctgatgtcgtttcttaggtttccatgccatattctaagtatctaaacaccagcctaaaaagagagtttaaatttggtaaacgataacgatcaccttaagaaaatattaagctcaagaagagtagtagttagtataagattaagttggttatgaaactgatggtgtaacttgatggccactactactcactgacaccacaagttgctctaactttgagactgatatgtttcttttagattgatacattgcttctgatataggccataatcatttaaaagctgtttttgctgtctttctctctaattttcacgtcacgtagggtcaaatttcacctgttttatactatttctagttgatcattgagtgatttgcacgttactgttcagattagacccacccatcgcactacaatagtattggatgatttataaacttatatataaagcgtaagctatcaaacacatccacacaaaactagactgccgtaaaaaaaaaaactaaattatgtttttttttagttcaagctctcgaatacatccacacgaaactagattgccgtcaaaacaaacaagtaaattaagataaatcttaaagtcgaatgcacactgaacaactaaactatgtatatacgaaaatctacttgcacatgtgcatcttttgttattacttatttgctttttactatttcatattaatgattgcttcgacatattggaatctaatctcaaatcaccaagaagtagtggaacaaatcaatctttgtaatttgtcttaattttacgatatgaagaagtacaattcaaatctaaattctttaatcctgaattcttctgtttgatatcgtccctaattccctaataaatctaaaactttataaatcaaatcgtatgacgtattacaattttaccgtatataaatatagtgtattattcttggtggttttaccgtatataaaatacatcacagtaatccagtcacgtgcttttccgttggtatcaatcacgtgtctgtcaaggttcgcttcatgtgcaagaataagaaaaaagcgggagaacaaataaaagaagaaggaatttgttcagatctcgcagcctttttatcttcaaggtttcagtattcacatgcatcacgtgagaatgaatacctgatccacactctggatctatctgtacaacaccctcactgtttttttccttattatttcagatcagataatgcagatgtttatactttatagcagttaatgcagcctaccaaaaaaaacatttattgtttatggatcaaattgtgcaatatctatatttataagtgaaaacatttttccttcatgaaattataattatgggatttaataaagttcaagaaatacactgttttgttctattttcccagtgggtctttttgcagtagaattaaactttttctccacatactgacaaaaaatatacagaatgtcttgctttgaaaaaaaaaaaaatcataatcatttgcaaagtggaaaaaattattaatttttatttcaaatgttttattaatagtaaatttcaggatattaatttatgtcgtgggccaacggacctaacagccgttacttacctccgtcatttgtggcggcaataaagaagaataccaacgttaccggtttgagtttatcggtttggttcaattggttataacaaaaattaatttatattcctaaaaacagagaaacactcataaaagtagtattttcactaaaatacaaccaattaaatcataagaaataaaatgcattcgaatttaacaataaaaaaatgtattgtgaataactgaaaattcaatagttgatttttctggttaagtatggtacggttcacgtaaaccagtacagttagaaccggcaaaacaacccaaatgaaaaatcccgtctccgttatctatttagtataaaaccaaccacttcgtcttcttcatttcttcacaagtcataaccgtttcaaattctctctctctttctctttctttctcaatttttgtagtttcatactctagcttactaatcaaagatg

SEQ ID NO: 15784 - DNA, 3003 bp, Unknown
  misc_feature (1)..( 3003): 2750-1469P.txt file - cDNA_ID_1019997; gDNA_ID_2214478; Annot_ID_133175
ctttgtccttcatttttgatcagttcttactgtgattttcggctgagtagttgtaggaaagtctatgaaaaatgactgattatcaaggctgtggactttgtccttctatttggccttgtacatcagtaccatgcattttactatgatttctgagctatgttatggttaccatccatgaagcaggttttcagacggttgctattttcatgcagaacggtgaattggagaaaaaagagccagccgcaaatgcagtaagtgacaacgtggaggactcatcaaacaaggtacaaataattgccctaaatttgcttcttacgacagtgggtaaaactttttatatcgaaaatgagtgtagagtgtcttttaaatatctcttaacgtattcccttttgaaagtactgtaattgtatatgtcagtgacccttggtttatagttcagatcaaatttttagtttgtgccatagtttcgataccactgtaatttgtaatctcttgctctagagacaaaacatcggtatttctaaatttgacttggtcctttccattcatggttcatgatgtggggcatatcttggaattttgttgcatgtttttcatgctgacagcttttatatccttttccgtttaattgtctgtcagtagaatatcaattttgttagagttaacaacaaaggaataaaacatgtggctggatcaacttttttgtaagtttggctggtagtaggtgttatgatcaaaagcttgttcatagtggttcaacctggaaagccaaatgtcagaccaccttattataatcttaaagtgaaaaacacgcagagaatagaagtgcagttctctccgcagctacggcatctttgtggttgataatgttgaaagcttcactgtatttgcttgctatactaatttctttttctgtcaagcttgatattgagcctagtgtacttgttgcagatcttcattggcggattttcaaaagctatttcatctgaaatggtatgctgaactgtaattctttgaaaacatttgacacgttcaatcttctattgtccccatttctatcgtttcaacttctaggattgtctgattcctctttaacgtttttccagcttatggagattgtcagcgtctttggacctttgaaagcataccggttcgtgagcaacaatgatctcaatcagcgatgcgctttcctagaggttagaatgtacttttatttgtggccaagatacccccatcttagtctgccatctcgatgtagttcttgtgattgtttcatatctttaatttttcattttccgggtagcatgggaaggtgttattaccttgtaacttttacagagtaaccatgaatgtgactgtagttccaagtatattcatattaaccagccctaactctttttaaatctctatatttcagtacactgatggatctgttaccctcaaagcttgtgctggtctaaatggtatgaggttaggtggcagtgtaataacagccgtttgtgcatttcctgatgcatcatccgtagcggtaattcagtgacccaactttgctttcgttagttcatgttgtgtttgtatgggtgacattgaacagaaattcctttagttacttgtgagagtggtgtgtgtacgtaatatgtgttgcaggtgaatgagaatccaccattctatgggatacctagccatgcaaaaccacttcttggcaagcctaagaatattctaaagctaaaaaatgtggtaagcataattggtgtatcctttttcttgtgaatctttcccaaataaactatgtgaggctatattaacattccattctttcttgtttgacaggttgacccagaagatctcacgtcgttttccgagcaagaagtgaaagaaattttggaggatgtacggttagaatgtgccaggttaagctctgagatcatcttcccatgagtccattgagcttttaaaagctagtaaattaagaaaataggcctctgggtcttgtcatgatgcaggtttggggttattaagtcgataaacatcttggaacacaagagcaaagatatcactgtttctgaaacaaatccattgttgaacttagaatcaactgattctaaagaaatgaatgtgtcagtgatcgaggagaaagatgaaggatccgagaaagcggaagatattgcagacaatgtagatcttgcagaggttgtcatgccagacagtttgacaggtgaagacaagttatgtgaaccgtgctcggatactgctgctgaaacaagcactcaagaaaatgaagatctacactccactgaacaagagcattgtgaaaagattgttgaagaaagtgcgcaggccgaggcagagaatccacaagaagtagcatcagtgcgtaccgtgaagacaagatgggatgctggcgacaagatagaagaagaacaagaagaagaccccgaggatgtatttgagacgggttgtatcttcattgagtacagaagaccagaagcgacatgtgatgcagcccattctttacacggaaggctatatgataaccggattgtgaaagcagaatatgtttctaaagagctttaccaaatccggttcccaagtgggtaaataatcccacaacaagtgagactctgtgattcttctcatctttaccacataaccggttcaaaccgagttcagagatacatagcatctacaatcaaaaacccttcaaaaatctctttgtaatcgttgggattgatcaggttggattattcatcaccacctgtgtctcgttacttttatgtattagagaatccaagaagggaaagatgaaaccatactattgtgttggtggctatatggaccggtttgcttactgaaaaattgttgtgttaaaagagaacgtaaccttctgaatgagaaagcgtctttcattttctacaaaataataaataaaatgaacccaatctccttctttatccaaatcctccttcgaagcagaagtaacagcaaccaaaaatgacgacaatg

SEQ ID NO: 15785 - DNA, 3003 bp, Unknown
  misc_feature (1)..( 3003): 2750-1469P.txt file - cDNA_ID_1019997; gDNA_ID_2214478; Annot_ID_183209
attttttgcctttgtccttcatttttgatcagttcttactgtgattttcggctgagtagttgtaggaaagtctatgaaaaatgactgattatcaaggctgtggactttgtccttctatttggccttgtacatcagtaccatgcattttactatgatttctgagctatgttatggttaccatccatgaagcaggttttcagacggttgctattttcatgcagaacggtgaattggagaaaaaagagccagccgcaaatgcagtaagtgacaacgtggaggactcatcaaacaaggtacaaataattgccctaaatttgcttcttacgacagtgggtaaaactttttatatcgaaaatgagtgtagagtgtcttttaaatatctcttaacgtattcccttttgaaagtactgtaattgtatatgtcagtgacccttggtttatagttcagatcaaatttttagtttgtgccatagtttcgataccactgtaatttgtaatctcttgctctagagacaaaacatcggtatttctaaatttgacttggtcctttccattcatggttcatgatgtggggcatatcttggaattttgttgcatgtttttcatgctgacagcttttatatccttttccgtttaattgtctgtcagtagaatatcaattttgttagagttaacaacaaaggaataaaacatgtggctggatcaacttttttgtaagtttggctggtagtaggtgttatgatcaaaagcttgttcatagtggttcaacctggaaagccaaatgtcagaccaccttattataatcttaaagtgaaaaacacgcagagaatagaagtgcagttctctccgcagctacggcatctttgtggttgataatgttgaaagcttcactgtatttgcttgctatactaatttctttttctgtcaagcttgatattgagcctagtgtacttgttgcagatcttcattggcggattttcaaaagctatttcatctgaaatggtatgctgaactgtaattctttgaaaacatttgacacgttcaatcttctattgtccccatttctatcgtttcaacttctaggattgtctgattcctctttaacgtttttccagcttatggagattgtcagcgtctttggacctttgaaagcataccggttcgtgagcaacaatgatctcaatcagcgatgcgctttcctagaggttagaatgtacttttatttgtggccaagatacccccatcttagtctgccatctcgatgtagttcttgtgattgtttcatatctttaatttttcattttccgggtagcatgggaaggtgttattaccttgtaacttttacagagtaaccatgaatgtgactgtagttccaagtatattcatattaaccagccctaactctttttaaatctctatatttcagtacactgatggatctgttaccctcaaagcttgtgctggtctaaatggtatgaggttaggtggcagtgtaataacagccgtttgtgcatttcctgatgcatcatccgtagcggtaattcagtgacccaactttgctttcgttagttcatgttgtgtttgtatgggtgacattgaacagaaattcctttagttacttgtgagagtggtgtgtgtacgtaatatgtgttgcaggtgaatgagaatccaccattctatgggatacctagccatgcaaaaccacttcttggcaagcctaagaatattctaaagctaaaaaatgtggtaagcataattggtgtatcctttttcttgtgaatctttcccaaataaactatgtgaggctatattaacattccattctttcttgtttgacaggttgacccagaagatctcacgtcgttttccgagcaagaagtgaaagaaattttggaggatgtacggttagaatgtgccaggttaagctctgagatcatcttcccatgagtccattgagcttttaaaagctagtaaattaagaaaataggcctctgggtcttgtcatgatgcaggtttggggttattaagtcgataaacatcttggaacacaagagcaaagatatcactgtttctgaaacaaatccattgttgaacttagaatcaactgattctaaagaaatgaatgtgtcagtgatcgaggagaaagatgaaggatccgagaaagcggaagatattgcagacaatgtagatcttgcagaggttgtcatgccagacagtttgacaggtgaagacaagttatgtgaaccgtgctcggatactgctgctgaaacaagcactcaagaaaatgaagatctacactccactgaacaagagcattgtgaaaagattgttgaagaaagtgcgcaggccgaggcagagaatccacaagaagtagcatcagtgcgtaccgtgaagacaagatgggatgctggcgacaagatagaagaagaacaagaagaagaccccgaggatgtatttgagacgggttgtatcttcattgagtacagaagaccagaagcgacatgtgatgcagcccattctttacacggaaggctatatgataaccggattgtgaaagcagaatatgtttctaaagagctttaccaaatccggttcccaagtgggtaaataatcccacaacaagtgagactctgtgattcttctcatctttaccacataaccggttcaaaccgagttcagagatacatagcatctacaatcaaaaacccttcaaaaatctctttgtaatcgttgggattgatcaggttggattattcatcaccacctgtgtctcgttacttttatgtattagagaatccaagaagggaaagatgaaaccatactattgtgttggtggctatatggaccggtttgcttactgaaaaattgttgtgttaaaagagaacgtaaccttctgaatgagaaagcgtctttcattttctacaaaataataaataaaatgaacccaatctccttctttatccaaatcctccttcgaagcagaagtaacagcaaccaaaaatg

SEQ ID NO: 15786 - DNA, 3003 bp, Unknown
  misc_feature (1)..( 3003): 2750-1469P.txt file - cDNA_ID_1020005; gDNA_ID_2214500; Annot_ID_133641
ttttatgctgaatgtagatagctagaaacctaattgtttaaagatggagaaaaaaaaactatagtgtcctccataaaaaacaggtcatctccgaagagttattttcaaaatcgacattaatgatcagttacatattttttaatcattatttgaaacaattattttataattttagctaagtatgtgattaaaacaaatgaaaaaaaaaaactctaaaatggagggatgaacatatttggggaagtgatagacaatgatatttcatatttaaccattcgttattgaatttaggagttgataattgaatgcctatgaaaaatatgttcctattgttagaggtgggttggagtcttgaagacagaagacgctctaatatacaactgaagtttgagttgcttgtaaattcaagttttgtataatttattttcattaactgcaaactaaaatttatataatattgcgtgaaacagaagcaaaagcaagcaactcgttgggtaaaatctgcagtttctgcaccaaattaaagaagacctgcaacattgccgcctttacataaatacacacactagatacataggctctatgtatcttatagtatacgatatttgtttagaatattctgcaagttgattaaatttcatggatcagtagacttgtttatattctaaagtttcaagaaatagtcaatttgtctacgtataattaaaccgtttcttagctggaagtttacgataacgtatccaacatttaagtattgtcgagccatataattagagaaaatgactagtgagaacactgagaggtttagcagctgagcaagcaagttacttacaaaacttggaaacaaaggttgtcacactaatattcacactacgtgagaattcgtacagtgcacatcaatataatatttttaaaacagcaaagtgaaaaatgaacatgatactatatatatccaatttattaacaaaattttataacttatagtatcaaaaatagtaagactcatattagaccaatatatattaatgcctacctacctttgaccttaggagaaagtatgaataattaacatgtatccaggaatggcattgtagaaaatactattttacattactatttcatctaaggattgagatttcatatgaattcaatgatttatatttactgccaatatttttttatcttactaatttaaacgaaagagatattttaacttgaaataattagaaaataggttatagatcattcaaacataaaattattaaactgttcaactatttctaaatgatttatgttagccgtcagataattaacatggaaaattctagtttcatcatgataatactccaactatatgtgttaatatgcgtataagagagagtatggcgtagtatccaatcatttcttagtatcatgtagtatttggtatatgccgtatagtagtacccaattatttctttgatgggcaaatgctaatgactaatgagtattttgcaaactcatgatcactgaaaacatgagccttcggtcgacgatcaggtgtcttaaatttgtctgctctttaatttttgtaggataaaaaattgaaaaatttgaactttagaccatagaatagattattccagctagtaatctagaataagaatgatgtgaaaaacttgtatttagtggttgatcatataaccaaaccaaaggatgattacgttttccttaaactctaaaaacatgcagattattgatctgtccatcctagttttaggtacggtattaaatttagatagctgttgaaaaaaaacaaaagtgaagatatctaaatctagatatgttggagcaaatccagtagtggattctaagcaaagtttctaacctataataataataataaaataataaataatattatttaattaagatagtttataaggaaatgtgagagagtttctaattcaagagattttgaagactcttctaactatttttagaaacttttcaaattaaataatattatttcttattttattattattttagtagattagaaactatggttagaaaccaccattgagtatgctcttaatttatatcctataacaagtcaataaatcgtcaaacattaatacgttgcattatttgtttgtcatcatatcttaaatatttcgaattaaatgatacgttttcgtcacacaactaatgctttttagtagatgaaatatagtaaaatacgattttatgtattttgaacccatgtggcgttatgttttaatttattattggatagtagaagaagccggaaattctggatgtcaaatagtcacattaatattcaatgcgaaaacgtaaaaaaaagtaagatgctaccgttacctaaacaaaagttaatggtgtgattttacagcacctgtttaatatttttaaaattacataaaaaaaccaaagagaagtaagaaaaaatgaaaaagagagattggtatataaaaaggaggagtagggggtgaagcccgaagcatcttatagtatttttagcttcattccttcttttgctctgatcaaagtcttctccttcccttctctctctctttcctcctctgcacatttctgggttcttctcttcttatgctctgtttcttttaagacacagaagaaacagtacagagttgagattttcttaaacaaaagtgaaaagagaagaaacaagtgacagctcaaacggacaaaaaccactcttgggtctttcttgcttctgattctttctcttctctaatagaagaaaacgtaagtcactctctctactctcttttttcacactgaagaagagaaaaaacgtgaacaaagaactgtcaattctctttccctctctgttttatcttcttgaattctccaagattgagatctctctcagtctcttatgtgctctgttttctcctctctgttttcacttagttactaaacacaatcgattctttcgctctgttttatttctcagatctagaagctaaaaaaatg

SEQ ID NO: 15787 - DNA, 3003 bp, Unknown; identical to SEQ ID NO: 15786
  misc_feature (1)..( 3003): 2750-1469P.txt file - cDNA_ID_1020005; gDNA_ID_2214500; Annot_ID_183949

SEQ ID NO: 15788 - DNA, 3000 bp, Unknown; identical to SEQ ID NO: 1046
  misc_feature (1)..( 3000): 2750-1469P.txt file - cDNA_ID_1020019; gDNA_ID_1620351; Annot_ID_154316

SEQ ID NO: 15789 - DNA, 3003 bp, Unknown
  misc_feature (1)..( 3003): 2750-1469P.txt file - cDNA_ID_1020019; gDNA_ID_2570; Annot_ID_145792
  misc_feature (749)..(749): n is a, c, g, or t
  misc_feature (979)..(979): n is a, c, g, or t
gagtatagttctctgaacttccgtgatgagaataactctttctttttgagacttgtctattgcattttttcaataactctaccccttctgagttatatctcggagattattgaattcctgactttttcctaacgttagagtactctacattctatcgataggaggattttgtaaccgagaagaaggaagagttgtcaaaggaagagttggggcgtcttgttgcctctcgttggacaggagagaaatctgataagccaactgaggcagacgatatccccaaagctgatgatcaggaaaaccatgagcacacgcccatcactgcacatgaagcagatgaagatgatggatttgtttcagatggtgatgaggataccagcgatgatgggaaatacagcgaccatgaacctgaagatgattcctatgaagaggagtatcgccatgattctagttcttcatacaaatctgatgcagatgatgatgtcgatttttcaggtctgcactatttccacagatgtttatattcttgaacgatgttaatcatctatcatatttagttgacttgattgaatttcattactgatagagacaacctcaaatcctacttggttggagaagatacaaaagactgtcaagaacattttgctggctgtgaatttattccaaaccaccccagtggacaaatcaggtaaaaaaatagtttagcattttcatagtgatactcgtattctttagtgattcatctatattgntgtggaatgtgcagaggctgatcgggtacgcaaagaatacgacgagtcaagctccaaactgaataaaatacagtcaaggatatcgagcttagaaaagaagctaaaacaagactttggtctgtatgataagacatcctaagccttcacttacgtttacctttctttgagttagtccttatatattgtttataacaggaccagagaaagagttctattcattccatggtcgntgttttgagagcaaacagggcaagtaagaataatcttagcaatttaatgtcacatccattctttattaacattactatcagctattagaattatatatctgatgcatttactgttattacctaaataatgctgtaggtatacttacaaagtctgcgcatataaagaagcaacacaagaggagggctattcgaaaactcggttagggtaagtgtcatgccactttatcttttctgtgcatgctgatctctttcatgatacagataactaataacaaggaattggttcgcagatgataattaaatatgagtgattattttatctgtgcttattttgtcgcttccttattttgtttaatggaatttgctaaaatagggagtgggacaaatttgagaactcttaccaattcatgtcatataccaacggagaaaaatgctggaatggtcccgatagaagcctgaaggtagtgtctgattacattaaatccaaactaattgttcaattaatattttctccaattatatttatataaaaaaaattatctgagaagatttttgcgcttgcaaagatcacagagatatacaaagcttgactgtctcactaaatgcaggtgaaactaagatgtgggttgaaaaatgaacttatggatgtcgatgaaccaagccgttgcgagtaagttcttatcgtaacctacatctcacgggtcatcatctccttttatctccagtttttctttttatatccttaaatttttactctcttgttgcagatatgcggccatcttatctactccagctcggtgtttggaagacaaacttaaagtaagtttttgtgtcatctcaaatctcaaaacagacctacactagttaacacttccttaacctggtgtttgtctttgtataggaactacaacagaagctcgagaagttgatgaaccaagacaaacctcagaatcacgacgaactctgatcattttcacctgaaataattcttaccatatgcgcactgcgcttagatttatgtcagtttagactagtaatcttgctcagtcgcaaacgtcaagagaggacttaaaaaaagaacagagaagttttgggccggaagagaatgaatgatagagtcaagtttacctcatttgggttcaatggagattttctatatcaaaagtatttagacaatgttcaaactttggttaagcacaaagaacaattcttctatataaaaacatgaagaagagctaaaaccttttaacttttttggagtcttaaaaatttattcgagattgttggagctcgtcaatattaaggtacatatgtcagttatcaaacatctccaagttcacttttaggtcagaaaatggttttaatgtctaaacaagtggtaggtttggtttggttcagttttaatgctttcttttacagattccattaccaatagagacaaactagaacacaatatttccggaaataaattactgcagttcaacacttaacaccatgaaagaagacaaagaacaaagatcaacttcagaaattagtttaaacactattgccaaaatggcaaaatacaattaataccattttttaatcaacataaacacttaaaatatcattataagatattttatatttggaaaaaaacgtggcccgacaatagatcgagaagacataaaaaggtaaacgaaaacgaatattaataaacaatgtgcgtcactccttaattattgaaagaaaattaaaccggtgtgaaccaatcagtaaacatatggtcttttgttgaccaaatctaaaccaataaccttcaatttcatttctcattttttacctcaaaagtcaaaaaaaactctagaagaagactcttaactcataaatctctcattctttctcagattctctctctctgttttccttgttctccaagccagatctctctccataaatctctcttcatctctctctttccaccaaaacatccgcgatcctcgattctcaattccgtgtctgttttttttcttcacttagcgatg

SEQ ID NO: 15790 - DNA, 3003 bp, Unknown
  misc_feature (1)..( 3003): 2750-1469P.txt file - cDNA_ID_1020161; gDNA_ID_1620414; Annot_ID_156368
tccggaaggcacgaaagagcctggaatcggttggatgaccgctttcttgttctttacttgctttgttggtcttttagcattggttcctctaagaaaggtagagattatttaagattctgtctcattgaatttgtagttagagatgttgcggtaggccaaagtttgcgggtcagtccggcccatataagtgtgatatgggcctggccaaacccgctatagccaacataggacggagattaatattggccaagtttggactattaatcccctgttggctggtttgggtctacattgctaagtgttcattatgcttctttttttggttaaccagatcatgatcatagactacaagctgacatatccaagtggaacagctaccgcggttttgatcaacggtttccacactcctaaaggcaataaaatggccaagtattaactcgattttttggcagtctcttagctctctttcaccactaattctagagtttttgatttaaataaaatctgtttatatgcaggaaacaagtgtttgggtttgtgaagtacttctcatttagcttcatttgggctttcttccaatggttcttctctggtggtacagagtgcggtttcattcagtttccaactttcgggttagaagctttgaagaacacgtgagtattattcttagttctattgactgtttatatatcaacagatagaaacagaatcttgatgatcttgaaaaaacttgacagattctacttcgactttagcatgacatacgttggagcaggaatgatctgtccccatattgtcaatatatctttgctttttggcgcggttctgtcttggggaatcatgtggccactcattaaaggtcttaaaggagattggttcccatcaactcttcctgaaaacagcatgaagagtctcaatggttacaaggttccatacaaaaaacactagtactctacaataaactccgccctttctttcgcgtactttcgttcttaatttgttcataactctttaggtgtttatatcaatctcattgatcctcggagacgggctttaccaattcatcaagatactttttaagacaggaataaacatgtacgtcaagttaaacaatcgcaactctgggaaatctagtaagtatacaccaaaaaaactatagaaaaatcgtcatttcaataatgtattatctgatgttcaaacgtaaatcgcagattcggagaaagataagcaatctattgcagatcttaaaagagatgagatctttgtaagagacagcattccattatgggttgcagcagtaggatacgcagcgttctctgttgtctcgatcatcgcgatccctataatgttccccgagctgaaatggtacttcatagtcgtagcttacatgttagctccatcgttaggtttcagtaacgcttatggagcagggctaacagatatgaacatggcttataactatggtaaagtcgctctgtttatcttagccgctatggcagggaaacaaaatggtgtagtcgcgggacttgtcggatgcgggttgataaaatcgattgtatcgatttcttctgacctaatgcacgatttcaagacaggacatttgactctgacttcacctaggtcgatgcttgtgagtcaagcgatcggtacagcgatcggatgcgttgtggcgcctctaactttcttcttgttttataaagctttcgatgtcgggaaccaggagggagagtacaaagctccttacgctttggtatacagaaacatggcaattcttggagttgaaggtttctctgctttgcctcaacattgtttacagctttgttacgggtttttcgcattcgcggtggcggcaaatctcgttagggataggttaccggataagatagggaattgggttccattaccgatggcaatggcggttccgtttcttgttggagggtactttgctattgatatgtgtgtgggaagtttgattgtgtttgcttggaatatgagagatcgagttaaagccggtttaatggtaccggcggttgcttccggtttgatatgtggagatggtctatggattttgccgtcgtcggttcttgctttggccggcgttagacctcctatatgtatgggcttcatgccgagtaaatattcgagttaaagatagctttttacgagtttttacttttttgtgtagcgacaaaaaaattagctaaagaattgtggaaacaaaaaaaacagtttatataggaattgtactttgtaagtttgtatacacaataaagtaataaactagtctctcaattctatttaaaaatccatgtcccaagtaacttctccccaaaaagaaactcaatattttagaataaggtcaaatggaattaaattccagaagatatttgccaaaatagtgataaaaatacggttaaattggtatatgtttttactgacaaaaggcaagattcttctattttaagatttatttctttctttgaaatctgctaaacgttgttagatcacactttatgtgtctgtttttttttttgtcaattcagcacacgtcatatttgtatttttcaaagtaccaaacgtggaccaaaataaaatctcgtcaaaaatggaaaccaaattttaatttgatttgcacaaagcccaatttgatttgtttaaagtcaaagcccaacttgaccaaaactacccctgctcatccaaaccctaagcaaaatatcgagggtagtttcgtattttgtttatattgaacacaattaagtaggtgaggaacctctatttcttccgtcttctgctgatttctgagcttcggagctatcgaaaattctgaatctgaaagggtaaagatcccatctttttccaaaaatcgataagggaattagtatattcgttcattcatcatcgttctgatgatttcgatttgaatctgtatctagtactctgtattatcagaaattttgattagtagctttgatgtgttcttgttttgcagtttgagtgaagatg

SEQ ID NO: 15791 - DNA, 3003 bp, Unknown
  misc_feature (1)..( 3003): 2750-1469P.txt file - cDNA_ID_1020236; gDNA_ID_1620344; Annot_ID_154110
cacagagtagttcgacagatctttctcgatttgtggattctctaactcaacctaatcttatgctagtacgatcgataatcgagcaacgtgttaattaaaaaatgtagaacggacaactatatacaaaaccacaaggagagatctaagaaattcaaactccagaaacaccacgcaatgattctacgaacatgtttaggatgagaatcctaaaagagaagaagaagcggctgaagcacgacgatattaacagagcgacggaacaatggaacgaacctgtagacggaagcggcggatgctcagaagaagctaggcgaaatcgagtttgccaaagaaaaaccctagaatcggaaaactgagcgatggatttattggtgtttatatactctaaatgggccacacttaagaagctaacgtcaatttttaagcccatatttatattttatacttttgagagttagtatgaaatacaaatatgggcttttgagtatggtccttttaagagaaaaagcccatactttagataacatatgggctttttaagtccattgaaattcacattagcttctacctttttgtcggctagcttctacctatttcacaggtataaagactggttcgaaaggcgcgtctagccctcttgatgaatgaaagaaagggtttctgagccctagccctgtaagcccacacctgtgtagagtagatcgttcaacacctgcggcacaaaccaatttttgacacatcacaactcacaagtccttcattacccgttcttaatcaaaatctctaatgtatcgtttcaaaatgtgtattttctttcacaattgactagtttctaactaactacttccaaattcttccatgacgattccgttatcataaggtcatgattttgagaataataacttcacaaaaggcatacagtatttagttcaattagaagttagaacacatatagttcaattaaattattagtactgcaagtatagggagcaaggaaaggaacaaaaaaaagaaaaagtattgggaagtacactacagcgagttgtgtaaaaaagctcagagacgaaagccagtcacgaaccgattgattccagcaaaatcagaaactatcttcaaatcagagaaacagtctttgagatcactggtcatcatgtaatctacgatcatcttgctttgcttctctccattagtctgcatcatcataaacaaataggattaatctttcatggttgatgtgattattagtatatacgcaaacatcttccaaccaaataaacatataatgaaaattgaccaatcaagactttgatctttgagtggcaatcataatcttcttagaacgccaaattcttactgataaagtgaaagcaacaataagcaacaattgtttcttcggactcatacacaagaacgattatcttaaatctcttttcaatactaacatttccggttttagtatcagagacaaagagaaaaacatagtaaacccaaacgattgtatctttctactaaatattttggagaaacagagtgaaaataaggtaggtacctcgaaaacgaaaaagccaccaggttgaagcatccgagaagccccatgacagagatgaaaaagactatcagttccatcaataccaccatccaatgcaagtttcggttcgtgtctaccaacttcagcttgtaggcctggaatgtcatcacttggtatgtatggtggattactcacaagccccacaagttttccttcaagatctttcaaaggctcaaaccaagatccttctctcacttcaatcatcccctggataagtccaatttcatcacaatggcaagaagtaaccaaagctgaagaatctcatacatatatcaaaattcacaaccaccatgagaagaaatcaaactgaaaattcttcaatccacaatatactgcttttatctaccaaatcctctaatccattacaactttgatgttgaaaattcccaattccatgaatacaattggtataatttgtcatgattagctttagcaaaaaaatcaactaacctcaaggctgtatctctgcacattgtggccggcgacggcgatcgccaccggactgagatctgtagctataactctcccacggcttcccaagactttagcaatgccgatcgcaatagcaccacttcctgtcccaagatcagcccaaatatctttcttaaaccattcatctctcgttacaagctcctccaccatatcgacgatcagttccgtctccggtctcggaattagaaccccttcctcaacgcacaacactagatctctccaatgctcgcatccgacgacgtactgaaacggccgacgcttctcgatcctctgcctccataaatcgtaaagctcctccaacgacgctctcaatttcacattcttctcgccgttgtccgcgatttcgcttctatgaagaatcactaaaggatcgtctacgattgagtcttcgatcagccattttagctcacggtggagaatgacagagtcaagagtatcttcggaattcttcgaagattcctctacggaggacgccagatctttcgcccagtcgtgccatttccaaacctccgatagagaagttgcgtgcgacggcgtcctaaggtatagcggtgtcttgggagttatgctgagagacttagtcggccgagaggattttgactctgtaagcgacgtgtattgcggtggttttttcgccggagaagatgagcaaagaggtttagcggcagagagcaaagaggttaaccgtagacttgggaagattcttatcatttcaaggtttttgccgcacaaacagaccaaatcggtttataaatatattaccaactaaaccggataatccggttctgtttttagccgggttttgaaccgaggattgaaataagattaacaaggaatataaggggctaaagcataaataaagaaaagttcttcttatttttgtttgcggctccgatagatctttggagcaacgaacaaacatg

SEQ ID NO: 15792 - DNA, 3000 bp, Unknown; identical to SEQ ID NO: 4551
  misc_feature (1)..( 3000): 2750-1469P.txt file - cDNA_ID_1020484; gDNA_ID_1620714; Annot_ID_49067

SEQ ID NO: 15793 - DNA, 3000 bp, Unknown; identical to SEQ ID NO: 4551
  misc_feature (1)..( 3000): 2750-1469P.txt file - cDNA_ID_1020484; gDNA_ID_1620714; Annot_ID_165555

SEQ ID NO: 15794 - DNA, 3000 bp, Unknown; identical to SEQ ID NO: 4551
  misc_feature (1)..( 3000): 2750-1469P.txt file - cDNA_ID_1020484; gDNA_ID_2926217; Annot_ID_142283

SEQ ID NO: 15795 - DNA, 3000 bp, Unknown; identical to SEQ ID NO: 4551
  misc_feature (1)..( 3000): 2750-1469P.txt file - cDNA_ID_1020484; gDNA_ID_2926217; Annot_ID_203066

SEQ ID NO: 15796 - DNA, 924 bp, Unknown; identical to SEQ ID NO: 15121
  misc_feature (1)..( 924): 2750-1469P.txt file - cDNA_ID_1020522; gDNA_ID_2926042; Annot_ID_196088

SEQ ID NO: 15797 - DNA, 257 bp, Unknown; identical to SEQ ID NO: 111
  misc_feature (1)..( 257): 2750-1469P.txt file - cDNA_ID_1020543; gDNA_ID_2745; Annot_ID_145914

SEQ ID NO: 15798 - DNA, 3000 bp, Unknown; identical to SEQ ID NO: 2798
  misc_feature (1)..( 3000): 2750-1469P.txt file - cDNA_ID_1020575; gDNA_ID_1620598; Annot_ID_161586

SEQ ID NO: 15799 - DNA, 3000 bp, Unknown; identical to SEQ ID NO: 2043
  misc_feature (1)..( 3000): 2750-1469P.txt file - cDNA_ID_1020642; gDNA_ID_1620481; Annot_ID_158329

SEQ ID NO: 15800 - DNA, 3000 bp, Unknown; identical to SEQ ID NO: 10064
  misc_feature (1)..( 3000): 2750-1469P.txt file - cDNA_ID_1020851; gDNA_ID_2213622; Annot_ID_195756

SEQ ID NO: 15801 - DNA, 3000 bp, Unknown; identical to SEQ ID NO: 10064
  misc_feature (1)..( 3000): 2750-1469P.txt file - cDNA_ID_1020851; gDNA_ID_2213622; Annot_ID_131997

SEQ ID NO: 15802 - DNA, 3003 bp, Unknown
  misc_feature (1)..( 3003): 2750-1469P.txt file - cDNA_ID_1020907; gDNA_ID_1620756; Annot_ID_166977
tcgactgggctatgtttgtccggaaaagtggcgagagcttgtaagatactggatgagttagcaccaatgggtgtgattcttgatgcagcttgtgaagatatgataaatacattgtgtaaagctggtcggataaaagaagcttgtaaattagctgatgggataacagagagaggaagagaagtgccagggaggatcagaacagtgatgatcaatgcgttgaggaaagtgggaaaagcagatttagcaatgaagctaatgcatagcaaaattgggattggttatgaaagaatgggtagtgttaaaaggcgtgtcaagtttacgactttacttgaaacttgttttgactcttgagttttaagaattgtttgcgtttatatcttcataaaaccccatcaccggagagaacaaggctcaatcttcgtgataatttgaaggatgaagaagattcagaacaacaaaacgttgtcggcgtttgattccagtcatcgccggagagaacaagactctccatttgttacttccatggcttagtatatgggtaggtcttggtgtaagcttgtattttgtattctcgatttgtacgattttattattaaataagaaaatagacagttcaacaacaacgtattttattttcatgaaagaatcagtctccactaaccgcctcaaaaactgtcgaagcccattgggcacttgcaaagcccaactgtttataaatagaaatccagagtcagagatccattcgatagcactttcctctctttctctcatcgtaaaaccgttctttgttttctctatttctctcgtctctttcttctacccagatcactgattgattagtcgtgaattttactctactctttcatcaattttactgtgtttaattcataaaacaaaacaaacgatcgatttttgtttttttttggggatgaagatcagaagcaaaagcaaaggctatcgtcaagagatcaaatcaacttgcaccgactccaacactctgttctcaaaaggtacttttcgtcttgttggaatttttggccaaataacgtcttttttttatatggtatctaattactgtattctggttgatcgcaaaacaaagaattctcatgtttaaagtgggtttcgtctaatccaatttgaattttaggtcttatattatttccctagctctaaccctaatcatatatttctcaaagtttttgatttttattcaagattccttctaatcaattatttcttctttgtatgtagatgtggttgcaacttcggagcttttttcatctgtgatatcgtagcgtgtgaaagacggataattctacagagacaatgcatcatcccattcggctaggtcaattttcatctctatcttgtttataatctataatcttatagatagtttaattacaaaaaaggtttttatactatttttgatttttcaaaacaaaatatatttctcaaaaaaattatttttaatggttttcaactctctctttttttttcttctataatactaaattaatatgacgttgtgaaatctaaccggattttggatcccgccagttaaccgtggtcattagcgattccacaaatccaacatgtttttcacatcttcatatatatttagcatttatttttcttaaaaagttttcaattctttttttttttgttttaaaattttataaatactaaattaatatgacgttgtgaaatctaaccggattttggatcccgccatttaaccttggtcattagcgattccacaaatccaacatgtttttcacatcttcatatatatttagcatttatttattttttaaaaaattcaactctttttttaaaaggttatataaatattaaattaatatgatgttgtgaaatctaaccggattttggatcccgccattgaaccgtggttattagcgattccacaaatccaacatgttttcacattttcatgtatatttagcattttttttttttttttcttaaaagattttcaactcttttttttctataaatattaattaatatgacgttgttaaatctaaccggatttaaaaaaatatccaaaatccttaagagatgtgttatgttcaatatagtttacacataatttaaacttttaacatttatttttattttattaaatcgctttggttatgtttaaaaacggttagtttttaacgtatttaatacgacacatatataaatacgtcaaaaattaaccggacttaacatcccatcttttataattaacactcggctaagttttaaagtttctcacgaataatgttttatgtaatttgtatatacatgatattttgtggttggaccggtttttaaaatcaagatctgaaaactttatataatttccctttcttgtgcttcgttcggtgtgttctttgcatgtaacatgttagcacgataagctgaaacattatagtattgatcttttaatatagttaaatcttcattatataattgagttataactttgataaactaacaatagaatgaatgatctgttacaaacgaagttgtgacatgtcactttcgagccactaaccgcaaagttcggattcaaacttttgaagtgcgttaaagtgttcgtaaccaatatttaaaaccggattcaaattgaatcaaaccgttgaaaaactcaacatgaaaagcaaaaccggaattctattactagtgaactaaatccaattgaccgaataaaatccagtaaaccgatccataaaccaaaattggaagaaaacaatgcctgtttaataggtgttgaaactttgctgaaaaaaaacgaagcgagcaccctctaaaatgccttcgatttctctggcgccattgatttagttttctctctctgactacaaagtatccattcgttcaaaccagtttcttcccattttcgatttctgtcaaaattcaccaaccaactccaaaaactctgttattgaataagtttcttgatcttaaaacaaacgatctcaaagaatg

SEQ ID NO: 15803 - DNA, 3000 bp, Unknown; identical to SEQ ID NO: 5881
  misc_feature (1)..( 3000): 2750-1469P.txt file - cDNA_ID_1020930; gDNA_ID_1620823; Annot_ID_57841

SEQ ID NO: 15804 - DNA, 3000 bp, Unknown; identical to SEQ ID NO: 5881
  misc_feature (1)..( 3000): 2750-1469P.txt file - cDNA_ID_1020930; gDNA_ID_1620823; Annot_ID_169598

SEQ ID NO: 15805 - DNA, 60 bp, Unknown; identical to SEQ ID NO: 318
  misc_feature (1)..( 60): 2750-1469P.txt file - cDNA_ID_1020930; gDNA_ID_1563741; Annot_ID_148218

SEQ ID NO: 15806 - DNA, 2623 bp, Unknown; identical to SEQ ID NO: 618
  misc_feature (1)..( 2623): 2750-1469P.txt file - cDNA_ID_1020940; gDNA_ID_1592381; Annot_ID_152376

SEQ ID NO: 15807 - DNA, 3000 bp, Unknown; identical to SEQ ID NO: 5774
  misc_feature (1)..( 3000): 2750-1469P.txt file - cDNA_ID_1020960; gDNA_ID_1620816; Annot_ID_169251

SEQ ID NO: 15808 - DNA, 3 bp, Unknown
  misc_feature (1)..( 3): 2750-1469P.txt file - cDNA_ID_1021202; gDNA_ID_1621085; Annot_ID_170485
aag

SEQ ID NO: 15809 - DNA, 245 bp, Unknown; identical to SEQ ID NO: 589
  misc_feature (1)..( 245): 2750-1469P.txt file - cDNA_ID_1021259; gDNA_ID_1592151; Annot_ID_152035

SEQ ID NO: 15810 - DNA, 3003 bp, Unknown
  misc_feature (1)..( 3003): 2750-1469P.txt file - cDNA_ID_1021304; gDNA_ID_1620441; Annot_ID_157173
taaccgaaatggatgttcctaaatcataccttgaaacccttccaaaggtctacatctttaactcaaaacatccctataaaaaccattgtaaggttttttttttgttctgacattaaacttttggtacagaacggtaggtcctgccttggggatgttatctacaggtatgtaacatctgacaaattttctgcggagtctcttctcgattgccttgatctgtcctctgagcatattgctcttgatatcgcaaaccgtgtggaagcttcgatatatgtttggaggagaagagttcaaacaaaacttggagtcaacaataatacttcaagcactactccaaagttaacatgggaaatggtcaaagaactaatggctgctggtgacaaaaggggattgcttgtggagagatcggaaactctcttacgttgcttgaagcagcggtttccttctctaacgcagacttctctagacataagcaagattcaatggaacaaggtccagacacacaaatcctctaaatacattacagtacaaaatggctttgcttgttcttatatattcagtcctttgaaaatttcaggatattgggaaatcaatcctcgaaagctactcaagggctttggagagcttagcatcaaacatcatagcacgaatcgatgatttactctacgtggacgacttaacaaagcaatcagatgataacaatcttttgtcaagtccagcggtcagcagcattatagctcacaagaaagtagtaccactcccttatctaatatctgcatcaggaactccatatagaacaagcttctcaacaacaccaggcttctctccttcaatgattagccccaagaaaggagagaggagaacaccttactccagcaaggacactaacaaaatcattgagaaaggtcttccttctcgaggatatggagtgagaagagtcttgaacaattatcttggcatggaatcaaaactgaaaatatgcgttaatccgtcagataatgcagatacagcagtgattaaccaaatcagcaaagacgtggaagaagagaagaaaagaaactcaacatcagtccatcaaaagggtcctccaaagtacactgtctcttaaaagctaatagaagaaactcaatagagtgtataattaatgcagacatggattgatttgtttgatatttacttgtagtttctgtcttatttggaatggtaaagtgtctatctttgcaaaccaaatcagatcacaaaatagacaaaaatgagagtggttgtaacaaatattctcatcaaatttgttctggtttggtttactagctttatttatttggtaaacaatcaccaataacgtgtataatttaaagttatgattataatgtttctttttgtaacccactacaaaatgtcgttgtagtatagtggtaagtattcccgcctgtcacgcgggtgacccgggttcgatccccggcaacggcgattttttttttttttaaatctcttcctccttttttatttcctttctgaacgaagctctctctctgattggccggatctgccggagagaaaaatgacgacgagtattcacatcacagctctcgacggaatcgtcaacgtgaactcactcttcacactcgccgtattcatcggattagcttggaaccctaccgatccagacaacagcctcgtaaccgaccctaattgcgtccccacagctcgtatggctgagaatctcgtcgccttccatgtgtactctttcgcatcattcctattctcaagtctcatcgctctaggtctcaaacaagcaatgaggctcaacatagcttcttcgtttcacatctctactcgaatcgatcctgtggtttactatgtgaacaagacggctcttagatttgggatggttacatccggtttgggatcggtttgtggatgtgggtttctcatgttggctttgattaatgttgttcagatcaagcttgggactttgggctgtggtgctagtggtcatacttatgcagctgttgtgccgcttgtgattctggttccttctgcacttttcatctatgtttctcttatgttatatgcttttactcgttagagacatggtttttgattccatggttgatgcaattagggttatgtttgtatgatgatgatatgatggaaatgagaatgattctatgtttgatatggttctttgtaaatctcttggtttggcttctgatttaagtttagtgtctgagtttttggatagatgatattctagatttgattggagttaggcacttatgtgtgttttatcaggaatattaactggtggattcattcaaactgatttgatcccaggaaatgggtatgagattatgctggattctgatgcctgtttggtttgatctcttggattattgataaagcagagtctacttggaatcattcatcaaaaagagacaacttttctctgttcctcatttggatagagttttttcacttgtttatagttttgtgtcttctgactaagctgaatgattgatttcctctgtatactatcccattcccacatatctcgggaactgctttgtatgcataattgtatgaaaaaatagctttgaggactggagaaaaggaacctgatatatctagatctcatgaggtgatcagtgaattttcagcttaaaacttgaaggctcataaaaccatacttttggaagctttttctttggtttatgctattacatttgtcatgtaaaaatacctctttgctttcttcaaaggttcaaatgattagcttagagactaaagggcagcatgatcttactttagattaaaatagctatgcacttagaggctcttaatgcgactgattaggtgaagtaattactatgttcctttagtgcttcttccactacttctgtgtggaatttctctgatccttccaaatcctcctgcaatttcagttgctataaaacttaggttccataactagtagtatatgcatcaactcatcactcaagaatg

SEQ ID NO: 15811 - DNA, 3003 bp, Unknown
  misc_feature (1)..( 3003): 2750-1469P.txt file - cDNA_ID_1021348; gDNA_ID_1972172; Annot_ID_179856
cttccattatagagatctctatttttttctctatatatagaaacaaaaatatggatctctatttttttcccctatttttctttctaacaaatagagatttctatttttgaagaattattggagtaaaaatagaaatctctattttctcttctatatttacaaaaaaaaaatagagacaaccattgcagatggtcttattaacgtatcacattgggatcatgatggatttaaaaggatagatatgggcgagaccacaaagatttttcggatgtatacgtgaagcatgaaaaaaaaaaatgtgcgatgaataaagaaatatgtttagaaaatattatagataattcgtttatatatgagtgggtctggatccgcgtgttaatcacgtgacactggcccaagaagcctctcttcgtagtggagtggtgtgggaattcccttcttcccatattaaaatgtttcgatgaataaatgaatagctctctctaaccttcttctttttgtgttttaatgaaaatgttttatttttctatgtagcttgcattattcgacagctgttacaaacctgacatgcatgggatccacacaacaacacacatatctctttatatgagttattcccatttcccaaattgctgagcaaacgacatccgtaagcagagttaagactattgaaaagtgcataacaattatggttgtcaaaacgttgtttgtaagttggtttagctaataatcattataaaggtagattgtcaatggaaatatagttgtaaaagcatttaatatcaaacccccaaaaggaagaagcaatgtatcacaaacgattcaatatcttaggtgaattttgctaacttcgactaattttatgtagagtacgaatgtccacaagcaattgtctatgtaatgcaattgttccacgttatatgaagcattgctcgtttctatcgtcaactataacatttttattttcatcaaaagattgtttggattatttagtcgtataatattttgaaacatatcaaacatcatgaatgcacttcacctcccaaaataagaagtctaagtccagtgctaaatttggttagcgtcgtaatgattataaatcgtcaataacattgaactgtccaagtgtatatatatatatatacttaaatgattacgaaggagacgtctctaaattttctacgttatacgtttacacgtatagaattcgtcgtacatttaaatacacgtacatgtatatacatatttggcacaatgatcgatactgatacagtgttgtgtaatagtaaatagtaaatacgttataggtaatgagtgatgcaagtcgaaacacttctatcgatcattgttcacatgttagtttcgttggattcaaccgattttcttataattcattatatatacattcaacttaaagaatgaaattctactttcaaatgcattaattgtaagatagcattaatttgctcatttgcaaagatactttgttatatgtgtctgattaaaaaaaaaacgaattgatgtcagaaatgagtgccacaaaatctgaacacaaagaaatacaacaaatcgtcattgtttgtaccttaatggtttgtttaagatccattgtaaaacaatacctcatcgtaacaatgtgatcatataacattataagttgatgcgtagacatggattagaaataagagtctcgcatacacacacaatgaaagaaaaattaaaattgataaggtagaagaaaatatagtgatgatgataaagaccggaacatacgaagggcccaggagacaaggacgaaacaaagtgggcccataaaagaagtacccaaaaaaaaggacttgtgataaagttgggcccatcgtcgatgatcccctgtgaatacccgaaggccaaaaatgatgggggggacccactgaccaagttgcacggcgagtgatgtgttctgtttgggtctaaatgggccgcgaaaacgatgggcccaacttattcattgctttgccagagtcctttgtgttgtttgtagattgtagtactaacggcaagctgttcgagactattgccagtttccggaaaagttttctgacacagactaactttttgttgggtttcccattccaagtatcaagatattattagtttaatctggacgaacgtataaataattcatttcgaaaattatcgtatgtagtaaccaaccagttcagtattcttaagtgaaaaaagtacaaaatttcaatacgatcaaatatgtactagtttaaaaaaaaaaaacatttctcatgcaaaataactggcaaacataaaaacgggttgggtaacctgaaacaaaactccagcccaaaatgatgcccgcttatacggcccaataaagctaaagtttgctgcgaacttaaaacggcagcgtttgctaattagattgagtaaagcgatttcacggtgcaacagtcgaagcttctcgacttgttattgtttcgtagcttcgtcggtccaacaagaccttgcgctagaagaacagtttcggctttgttttgttcaattctcacctcaccccggacagagtccaaaacaacggtttatttcttgcgtttgtcgggaaatcagagttgagtataataaacacccttcacgacattctttgcttgtccaccttggtaatcctccattcactctcttcacgtgtttctctcttgataattctctgatacccgtacgcaattttatctttccttcttcgtttcttcgatttcaatacgtttggattgtgtgttggtttcatttttctgatattagaaatttagttgaaacattacctgcaaatttgcagttcttaactagatagcttgctcttttagcgatccttaaggtatattttgttatctagttatgattttgtttactataccattgcctcattggatctatcaatgtaaaagacttggaaattgcgttgttgttctttgtgtaggtatctgaaattgggggactcttattataaaagatatg

SEQ ID NO: 15812 - DNA, 3000 bp, Unknown; identical to SEQ ID NO: 14545
  misc_feature (1)..( 3000): 2750-1469P.txt file - cDNA_ID_1021383; gDNA_ID_2684130; Annot_ID_191210

SEQ ID NO: 15813 - DNA, 3003 bp, Unknown
  misc_feature (1)..( 3003): 2750-1469P.txt file - cDNA_ID_1021582; gDNA_ID_2926288; Annot_ID_143661
aagagtcctcttggtgcgaagatcctttatagaaaagccaaatgggtcaaattctattgagcatttgttatccttagtaaatcgacgaaccgaaacaagatttttgattatgtcaggtgtgacaagaacattatgaagagttaagggacgaggtttattagcaataaataaggatccagtggcagtaacaggaatgcaaccaccattcccaaaaatgacagattttccgatgctaggataaagagaaagttggagattattacctgcaccagaagtcaagtaggctgttgcaccagagtccatgtaccactgagaatcagggggatcttgaagagaaaaggtgttgaatgcttctgcaagatcagccgtgctctcaggtttaggagtcctgaagtgagcgtttgactgctgagaatggtaaggaggtaaaagaccaaaaaagccttgtccattggcattcagctgcggtgggtatccccactgatgattccacatctgatacgggtttggatagaatggtggcctgttccaggagttgaagccttgacgattgtaaccatatgaggatcgtcctccgccccgaaacctgttgttgcctccgccacgtcctctgtaagtcatctgagtaggacctgagcgttggtagttcacatgaggcgcctctgagacaacaagcacagtagaggaggatgagtggtccacatgtgttgggttcggtcttcatgatgagccgttcaggtgatcctcttcatcttgtaacatggttgtggcgtcgtcgaagcgtggaagtggctggcgatgtttgataacattgatgatgttgtcaaacttagcattcagaccattcaacacgtacatcatgagtgtccgatcttgaactggagcatcaacatttgagagagagtcaggaagctttttcatctcacgacagtaatcggcgatcttcatgtcaccaatctctttcgtacggagctcattgtccaaacgaagagcacgagcatccttgttgttgcggaattgattttcaattctcagccagatctcccttgaggttgaaccaaagacgaacgaaccttggaactgctttggtgtgagagttccgtagagccagagcttcacaattccatcacgtttctgccagttaacatcagcggcgttggcaggttgaagggttccatcgatgtgaccaagaacatcaaaggagaggcagtgggtgagaaagagttctctccacgcatcgtagttactttcttcaatgtcaagaatcacaggaatgtgagatttgatgttagagacaccatagatcttttctgggttcatgatagcggccatttttgagtaaggaaaagagaatagagaagagatataagagagaagaagcaatcaaagagagatgtgctctgataccatgtaagattgtgtaagtctccttgaggagatagctttgcattagagtgaatatatacatgattcagttacaagagttcagatctttcctagattctgggtacatgaggatattaacaaagtcgtaattaaacttataacaaacatattgagaagaatattgagaagaatatcctatctcccaataccctcccgtagtcttagcatcggtctcctaattctttacgcaattaaacatctttaaagaggcttttctaactatgaaatggcccgcactatcacccggacattgttctatgaccatcgttttaagaacataacaaccagataaaagcaagaggacaaatttatccctaaggtacttcaatgatagaagagccaaattttttagagatgtgtattagaatgtctcatatcggctgggactaagatctttgaacaatatataaaggatgtggcaatccttagctctaaagttacattttgggataaattaagccacattcccaatatggtatcagagctcatggttggctcaacaaacaaaatttccaaaaaatggtttcccacctatgtggcccatacaagtggcatgtcttgttgtatttccgagatgttaggcttaaactgatttctgttggatcgtttcacacccacatctcgaggaggcttattagaatatccatattggttgaaatcaacatctttggacaatatataaagaaggtgacaatccttaactctagaactaggttttgagatcagttaatgtgggacattctaataacagaaaagaaaccaatgaaaacagatccataagaaccacattgtacagcatcaaagtcacaagcactgaagtctgaagaacgtgtacacaagctacttggaagtaccactagagcagacccaatagaacaagtatcactctcgaaacatagctcacgcacacatcgttcaatagcggttccaacacatacttcaatatctctataagcatcactcttttgactaattagttttatactcaaactttctagaaccggagcctgtgtaatggcaatgatgtgtgaataaacagctttgattttttttttttttaattttttttttttcatcaaacagctttgattcaacatctaaataatgcagcaaaagaaccttgccggtgattagcagaataattgggccaaggcccattagcagagcaaaatcaactagacgaaatgcataccaatctggccgacgtcgaataaaaaaacgtttaacgatccaacggttatgaacaaacagaaaggaaggtgtacgataaaactccgtaagaccaaccgtagaagattcgtccccaattgtcagtcggtgaaattaaagaggcatcttaaccaaagaagtctctcttacgagttttctcttcggctttccactttttcctctgttcgtgtcattcttctcgtagatctcgagagagagccttaaggtaaagagaaacttaaaaaaaatcgatcctttaagttaaagtttgtatctttcgattgttttgttccgacccttgtaaaatttgttctcaggaaattaaaaaaggttggattttgatcgatg

SEQ ID NO: 15814 - DNA, 3003 bp, Unknown; identical to SEQ ID NO: 15813
  misc_feature (1)..( 3003): 2750-1469P.txt file - cDNA_ID_1021582; gDNA_ID_2926288; Annot_ID_205510

SEQ ID NO: 15815 - DNA, 3000 bp, Unknown; identical to SEQ ID NO: 5614
  misc_feature (1)..( 3000): 2750-1469P.txt file - cDNA_ID_1021679; gDNA_ID_1620806; Annot_ID_168852

SEQ ID NO: 15816 - DNA, 3000 bp, Unknown; identical to SEQ ID NO: 5614
  misc_feature (1)..( 3000): 2750-1469P.txt file - cDNA_ID_1021679; gDNA_ID_2926172; Annot_ID_199569

SEQ ID NO: 15817 - DNA, 3000 bp, Unknown; identical to SEQ ID NO: 3954
  misc_feature (1)..( 3000): 2750-1469P.txt file - cDNA_ID_1021721; gDNA_ID_1620675; Annot_ID_164250

SEQ ID NO: 15818 - DNA, 3000 bp, Unknown; identical to SEQ ID NO: 11092
  misc_feature (1)..( 3000): 2750-1469P.txt file - cDNA_ID_1021787; gDNA_ID_2214478; Annot_ID_133167

SEQ ID NO: 15819 - DNA, 3000 bp, Unknown; identical to SEQ ID NO: 11092
  misc_feature (1)..( 3000): 2750-1469P.txt file - cDNA_ID_1021787; gDNA_ID_2214478; Annot_ID_183200

SEQ ID NO: 15820 - DNA, 3003 bp, Unknown
  misc_feature (1)..( 3003): 2750-1469P.txt file - cDNA_ID_1021897; gDNA_ID_1620649; Annot_ID_47682
gttggcccggtatgatcaaagtacttgcatggaatttgtgaagaatgggactttcaatgcggtcacatggcatttgtttcagttcacctcatctcttgactcatgggtgaagctagggaagcagaactgcaagctttcatctaccttgatggttgaacagctccggttttggaaggtctgtatccatagtggctgttgcgtatctcgcttcccagagctattcccagctctgtgtctgtggttgagttgtccatcattcgaaaagctcagggagaaaaatctcatcagcgagtttacttctgtgtcaaacgaggcctacctggtccttgaggcttttgccgagacacttcctaatatgtactcacaaaacattccacggaatgaatctgggacatgggactggagctatgttagccctatgattgattcagcactgagttggataacattggccccgcaattactcaagtgggagaaaggaatcgaaagtgtctctgtatcaactactactctgttgtggttgtattcaggtgtcatgcgtacaatttccaaagtccttgagaaaatctctgcggagggagaggaagaacctctaccatggctaccggagtttgttccaaagattggccttgccattatcaagcacaagcttcttagtttttctgttgcagacgtaagtaggtttggaaaagactcttccaggtgttcctcttttatggagtatttgtgttttctaagagaacgatctcaagatgacgaactagcattagcttctgtgaattgtcttcatgggttaacacggactatcgtgtccatccaaaatctgatagaatctgctagatccaagatgaaagctccgcatcaggtaagtatttccactggagatgaatctgtgcttgcaaatgggatactggcagagtctctggctgagctaacatctgtgtcgtgctcttttagagattctgtttcatcagaatggcccatcgtgcaatcaattgagctacataaacgaggcggattggcccccggcgttggacttggttggggagctagcggtggtgggttttggtcaaccagagttctgttggcacaggctggtgccggtcttctgagtctctttcttaacatctctctgagcgactcgcagaatgatcagggatctgttggctttatggataaagtaaactccgctttagctatgtgtttgattgcaggtccaagggattatttactcgtggaaagagcctttgaatatgtccttagaccgcatgctttagaacacctggcctgctgtatcaagtcaaacaaaaaaaacatatcgtttgaatgggaatgcagcgaaggggactatcatcgtatgagcagtatgcttgcttctcacttcagacatagatggttacagcaaaagggaagatcgatagccgaggaaggggtcagtggggtaaggaagggcacagttggtctggagactattcatgaggacggtgaaatgtcaaatagttcaactcaggataaaaaatcagactcctcgaccatagagtgggctcaccagagaatgcccctacctccacactggtttctcagcgccatctcagcagtccacagtggtaaaacctcaacagggccaccagaatccacagagttgcttgaagttgcaaaagctggagttttctttcttgcaggacttgagtcatcgtctggttttggatcgcttccctctcctgttgtgagtgtaccgttggtttggaagtttcacgctttgtctaccgtattgcttgttggaatggacatcatcgaagacaagaacactaggaacttgtacaattatctgcaggagctttatgggcagtttcttgatgaagcgagactaaatcaccgtgacactgagcttctgaggttcaagtcagacattcatgagaactactctacttttctggagatggtggtggagcagtatgctgcggtgtcatatggtgatgtagtgtatggccggcaggtctcggtttacctgcatcaatgcgtggaacactctgttcggctttcggcatggacagtgctctccaatgcccgtgttctcgagcttctgccgagtctagacaagtgcttgggagaagcggatggttacctcgaacctgttgaggtaatttacaaaaataataaaatgttgatagtggtgaataatggcatcttgagcatccaactaagataaaatggtgaattgatattgcaggaaaatgaggccgtccttgaggcctacctgaagtcatggacttgtggggcattggacagagctgcgacgcgtggatcagtagcctatacgctggttgtgcatcacttttcatctttagtcttttgcaaccaagccaaggataaagtatccctgcggaataagattgtcaagactcttgtcagggatttatcaagaaagcggcatcgtgaggtaacttgaaatccctcatctcttgttcaatgtcattctggggactgaggatgataatgaaacgtggaaataatgtttcaggggatgatgttagatctcctgcggtataagaaagggtctgcgaacgccatggaagaagaagtgatagcagcggagacagagaaaagaatggaggtgttgaaagagggttgcgaagggaactccaccctcctcttggaactggagaagctgaaatcagccgctctctgtggaagaaggtgaacgagagaatgagaggaaagaaagtctgtgtgtttctttctctgttttgaggttctcttacagatgaaaagctgtgtaattaaaaatcgatgttcttcttctgttcttgtaagattttggatttttccaatttctgacaaagttcaattaaaaaacttgactgacattttgaaagcgacgtgtctgtcttagaaatcaatcatatattggcacttcctatcaagagagtttggctgaacccaattttactaaattatcattatctcaaacacaacaaggatagatcatcctcataggcgatg

SEQ ID NO: 15821 - DNA, 3003 bp, Unknown; identical to SEQ ID NO: 15820
  misc_feature (1)..( 3003): 2750-1469P.txt file - cDNA_ID_1021897; gDNA_ID_1620649; Annot_ID_163386

SEQ ID NO: 15822 - DNA, 3003 bp, Unknown; identical to SEQ ID NO: 15820
  misc_feature (1)..( 3003): 2750-1469P.txt file - cDNA_ID_1021897; gDNA_ID_1620652; Annot_ID_163504

SEQ ID NO: 15823 - DNA, 3003 bp, Unknown
  misc_feature (1)..( 3003): 2750-1469P.txt file - cDNA_ID_1021897; gDNA_ID_2926215; Annot_ID_142185
ttggcccggtatgatcaaagtacttgcatggaatttgtgaagaatgggactttcaatgcggtcacatggcatttgtttcagttcacctcatctcttgactcatgggtgaagctagggaagcagaactgcaagctttcatctaccttgatggttgaacagctccggttttggaaggtctgtatccatagtggctgttgcgtatctcgcttcccagagctattcccagctctgtgtctgtggttgagttgtccatcattcgaaaagctcagggagaaaaatctcatcagcgagtttacttctgtgtcaaacgaggcctacctggtccttgaggcttttgccgagacacttcctaatatgtactcacaaaacattccacggaatgaatctgggacatgggactggagctatgttagccctatgattgattcagcactgagttggataacattggccccgcaattactcaagtgggagaaaggaatcgaaagtgtctctgtatcaactactactctgttgtggttgtattcaggtgtcatgcgtacaatttccaaagtccttgagaaaatctctgcggagggagaggaagaacctctaccatggctaccggagtttgttccaaagattggccttgccattatcaagcacaagcttcttagtttttctgttgcagacgtaagtaggtttggaaaagactcttccaggtgttcctcttttatggagtatttgtgttttctaagagaacgatctcaagatgacgaactagcattagcttctgtgaattgtcttcatgggttaacacggactatcgtgtccatccaaaatctgatagaatctgctagatccaagatgaaagctccgcatcaggtaagtatttccactggagatgaatctgtgcttgcaaatgggatactggcagagtctctggctgagctaacatctgtgtcgtgctcttttagagattctgtttcatcagaatggcccatcgtgcaatcaattgagctacataaacgaggcggattggcccccggcgttggacttggttggggagctagcggtggtgggttttggtcaaccagagttctgttggcacaggctggtgccggtcttctgagtctctttcttaacatctctctgagcgactcgcagaatgatcagggatctgttggctttatggataaagtaaactccgctttagctatgtgtttgattgcaggtccaagggattatttactcgtggaaagagcctttgaatatgtccttagaccgcatgctttagaacacctggcctgctgtatcaagtcaaacaaaaaaaacatatcgtttgaatgggaatgcagcgaaggggactatcatcgtatgagcagtatgcttgcttctcacttcagacatagatggttacagcaaaagggaagatcgatagccgaggaaggggtcagtggggtaaggaagggcacagttggtctggagactattcatgaggacggtgaaatgtcaaatagttcaactcaggataaaaaatcagactcctcgaccatagagtgggctcaccagagaatgcccctacctccacactggtttctcagcgccatctcagcagtccacagtggtaaaacctcaacagggccaccagaatccacagagttgcttgaagttgcaaaagctggagttttctttcttgcaggacttgagtcatcgtctggttttggatcgcttccctctcctgttgtgagtgtaccgttggtttggaagtttcacgctttgtctaccgtattgcttgttggaatggacatcatcgaagacaagaacactaggaacttgtacaattatctgcaggagctttatgggcagtttcttgatgaagcgagactaaatcaccgtgacactgagcttctgaggttcaagtcagacattcatgagaactactctacttttctggagatggtggtggagcagtatgctgcggtgtcatatggtgatgtagtgtatggccggcaggtctcggtttacctgcatcaatgcgtggaacactctgttcggctttcggcatggacagtgctctccaatgcccgtgttctcgagcttctgccgagtctagacaagtgcttgggagaagcggatggttacctcgaacctgttgaggtaatttacaaaaataataaaatgttgatagtggtgaataatggcatcttgagcatccaactaagataaaatggtgaattgatattgcaggaaaatgaggccgtccttgaggcctacctgaagtcatggacttgtggggcattggacagagctgcgacgcgtggatcagtagcctatacgctggttgtgcatcacttttcatctttagtcttttgcaaccaagccaaggataaagtatccctgcggaataagattgtcaagactcttgtcagggatttatcaagaaagcggcatcgtgaggtaacttgaaatccctcatctcttgttcaatgtcattctggggactgaggatgataatgaaacgtggaaataatgtttcaggggatgatgttagatctcctgcggtataagaaagggtctgcgaacgccatggaagaagaagtgatagcagcggagacagagaaaagaatggaggtgttgaaagagggttgcgaagggaactccaccctcctcttggaactggagaagctgaaatcagccgctctctgtggaagaaggtgaaacgagagaatgagaggaaagaaagtctgtgtgtttctttctctgttttgaggttctcttacagatgaaaagctgtgtaattaaaaatcgatgttcttcttctgttcttgtaagattttggatttttccaatttctgacaaagttcaattaaaaaacttgactgacattttgaaagcgacgtgtctgtcttagaaatcaatcatatattggcacttcctatcaagagagtttggctgaacccaattttactaaattatcattatctcaaacacaacaaggatagatcatcctcataggcgatg

SEQ ID NO: 15824 - DNA, 3003 bp, Unknown; identical to SEQ ID NO: 15823
  misc_feature (1)..( 3003): 2750-1469P.txt file - cDNA_ID_1021897; gDNA_ID_2926215; Annot_ID_202924

SEQ ID NO: 15825 - DNA, 3003 bp, Unknown
  misc_feature (1)..( 3003): 2750-1469P.txt file - cDNA_ID_1021972; gDNA_ID_1620723; Annot_ID_165861
tctaggttcgtagattctctttcttcttcttcttcgtttggatctgcttagtgaagaagataatcttctgaaaaattgtttgttttttttctgaaaatctgaatacgtaatgatttgagctgaatctgagttagattcacatttatattctggatttgtgctatttgatgatttattagatcgatcatcttgttttcttctttcgcctttaagtatgtttgctcatagtgttgctcttccagattccagatcctgaagaaggtgaaatcttatctgtgatccagtggaagattgaatcaagtaacagattcacttagttcacttgcgtattgcatgcccctgaagataacattttgaataatgttgatattgaattatcacctataagctctggttcttgttgcttgtattggttctgggtatctactagtgaagaaaccatggcttttggttctcctaggaataattctatattagctgcggctggatttcctcggaaagtgtctacagttgcaattgctattggtggtttggcatcattctttgttttcggattgttgcttcgtctttcgtatccgaatagttcttcagttggtggcatattttatgggatagggaatcctgaacaagttcatgtccctttatctttgagcaaccatactgtcaatatccttcagaagagtagtgacatcaatgcgtttgataaaaatctgacttctgattctagctctggcttacctgttgttgttagcaaaagtataccacctccagatttcagtagtgataggaagttggagacacctttgacacaagaaaaagaggatttggtttcttcggatataactgaaaagactgatgttcaatcaggtgaacgtgaaaccaatgtttccaaggctgaagacactccaagtgcatcatctcctccagatgatgtctctgaaactgcttcagcagaaccaggtactgttgttatcttttaaacgcttatttccgtagcttttgtcgtatttggaacattttgagttatggtagcttaaatttcaataaacaaagactaagctagtgtgggaatgttatagaacatttagttttgcatttctatggaaaggcgtaagtttctgagaagttttaaagaaattcagcggctaaactcttagctatagacctactgtaattattctagccgaggactgaatatagcagattagagtaaaaacttggttagggagcagatagtgagtgctgggcttgtaaggtggtctcagcattttgttttaggggttagagtttctaggctttgtgggcatttggttgagagttctacctgttttggtgaattggaataagaagagcagtttcatagatctgttcttgtcagtttcccttgcttctcatgattctagctgttcgatgttttatatttctgttatgagtttgtcgcttactcaaatctttgattgcttgtagagtgtgatttgtatcaaggtagttggttttatgatcctgggggacctctctacacgaacaactcttgccctgtcctgacgcagatgcagaattgccagggaaatggaagacctgacaagggatatgagaactggagatggaaaccgtctcagtgtgagcttcctcggtttgatgccagaaaatttcttgaacttatgaaaggcaagacactggcctttataggagattcagtagctcgtaatcagatggagtccatgttgtgccttctttggcaggcaagtaattcaatttaatggtgaaaaccggtataagggatctattgtgttgctttattcagcttcaggagatcgtatgtattatattaaagtaggtttctgttttcaggttgaaacaccagtcaatcgtgggagccgaaagatgcagagatggtattttaagcaatcatcagtaatgattgcccgtatttggtcatcttggcttgttcatcagttcaacgaaaaattcgattatgctcctgaaggtgtcacaaaactaaagctggatcttcctgatgagcgcataatggaagctatcccgaaattcgacgtggttgtcctctcatcagggcactggtttgcaaagcagtctgtctacatattgaaagaagagatcgtgggaggccaattatggtggccagacaaatcaaaacccatgaaagtcaataacgtggatgcatttggaatatcagttgaaacaatccttaagtccatggctacacacccgaactacagcggtttgaccattgtgagaacattctcacctgatcattacgaaggtggtgcttggaacacaggtggatcatgcacggggaaagaagaacccatccttccagggaagctagtgaaaaacggattcacagagataatgcatgagaagcaagcgacaggatataaccaagccgtcgataaagtcgcggagaatttgaagctaaaactaaagctgatggatatcacagaggcatttggatatcgccatgatggtcatcctggtccattcagaagtcctgaccctaacaagatcactaaacggggaccagacggacggcctccacctcaggactgcttgcactggtgcatgccaggaccagtcgatacatggaacgaaatggtcttggagctcataaggagagacaggaaaagctcatcaacttgacttggtttgaaactcaaaggatgagagagcatattacacgacttatactattaatctgattcttggttactgataaactcaaagataaactcacttgtagatttgtgctaggcacggtgagttaggattagaatttgttccactatacttgttggttcgtttgtcctgagattgaaatttaagatttgggagttatgagttcaagtttattcatactagtcgaaatttcataaattatataaactggggggggcgcatttgcaaaatagctgagtaataatcgcctatctcactgactcacccaaagcccgaccaaaagcttttgattcctcaagagtgaaaatg

SEQ ID NO: 15826 - DNA, 3003 bp, Unknown; identical to SEQ ID NO: 15825
  misc_feature (1)..( 3003): 2750-1469P.txt file - cDNA_ID_1021972; gDNA_ID_2926187; Annot_ID_200711

SEQ ID NO: 15827 - DNA, 3000 bp, Unknown; identical to SEQ ID NO: 14365
  misc_feature (1)..( 3000): 2750-1469P.txt file - cDNA_ID_1021998; gDNA_ID_2684112; Annot_ID_190672

SEQ ID NO: 15828 - DNA, 3000 bp, Unknown; identical to SEQ ID NO: 10245
  misc_feature (1)..( 3000): 2750-1469P.txt file - cDNA_ID_1022005; gDNA_ID_2213639; Annot_ID_181151

SEQ ID NO: 15829 - DNA, 3000 bp, Unknown; identical to SEQ ID NO: 6889
  misc_feature (1)..( 3000): 2750-1469P.txt file - cDNA_ID_1022008; gDNA_ID_1621111; Annot_ID_171811

SEQ ID NO: 15830 - DNA, 3003 bp, Unknown
  misc_feature (1)..( 3003): 2750-1469P.txt file - cDNA_ID_1022127; gDNA_ID_1620444; Annot_ID_157251
ggataaaaatatccgacctgccggaatcgaaccagcgacctaaagattttctgttgcaaacaactacagtcttccgctctaccaactgagctaaggtcggatttacaatctaatcaactttttaacattataaacctttcttagtattttgcaagaattctttaatcagctcatcaacctcttcttaagaaaaaattctactattaattttttttttttttgtaattctataaaattcagcttcataataatatgcaaaagctgatattttattcacaagccatatgaagaaaacacattgatgaaagtctcaattttattcttgattttaacaacatcacaggttgtacccatccccttctctgttttcaagctatgatttataatattttggctctcttattatatcattgacaaattaatttgttctagcatacttcattaccctcccggctccaagctaggtgacttgatcatgtagcgttggtgctccacacgagcttgatatcttctctcttacttctcggttttggcctttggaggagaagcacaaaaccttctctaccatttgtctttctcttctaaattggttccactataaaacccattctttataatttatttcttttgttgattaactaatgtaacattttttttaaaaaaggaccatgaccatcaagatggatgtataattctcaagatcacaaatacaaagcttatgttgaagaaccacgaaaacctagaaagttcatagatccatatatatatatattaaagtttcatttcccatcagcaaaaccctgattgaccagtcttgttcaaaaagacatgagaaaacttgagagaagaacaaaaaaaaaacataaatgaatgaaaaggtattatcgtaaactatgtaataatagaccaaaaatctcctcattttctttcgcatcttgcaagtactggaaccttactggatttgcaccaaacttggaacataagaacacataagtagacacaacctttggattttctaagatccacttctctgtagtatccattctctccgagaatgtaagttttgtagttcttacacgtttctatgtctaattcactaaccattgctactttcttcttctcgtcgacgaggaagaaactcaaatcttcaaaccaatagctgttaggcaatgtcatatcaacttttaagaacttgctccacaacactatattgagctcaatcttagttgtaatccatattcccatctcatacgcatcagacttctgaaataacactgcaagctgctcttctctaacagtagatagaagtacagtatcctcatgacaacagtgaaatggaagaggaagactcggtccaaatctttcacatgtaaaatcaaaagaaagtaaaaatgcttcctctttcaatatgtcatgagcaataaagtaaacattacccttcaaggacacacgctgattatctattatatggtcttggtcggtattgacatcaataaccgtccacgcatcagacttaaaatcgtagatttcatactcacggtacatagacgaaaaccataagattttgtggttgttgttgctgtcgtatcccatataaaatctgccagctggtctatgattaaacctgccagctggtctatgcttatgcgagttgtttctaggttggatccacctggtttgacccaagtaagggttccaaaccatgagcttcgagttatccttagggttgcataacaacaataataataagccatcacaatgaaacacactatctatttcgacttgattaagtttacctatttgctttatagatggatctgccaagtctttgtgattatggagattgacgctcattaaacaagcctttaaatcacatatcatgatcacctgaatctccttggcttctttaccataatggttttttgtaaagctcgaatctttggataaatcattccattgtttacaagttaatttcactgctttcaaagatgttattggaaccctagagagtatctcttctaccaaatccgggaaaagatcagacatcgtcgacattttttcaaatagagattagggttttctactttcacgcttgcccacactacttttttttttgtttatatatacagtaaaaaaaaattgtgaagaaaaataaatacttacgtataggtgtatagccttttaaccaaaataaaaggacgtgatttacattttttttttttttgaaatatttcagtaaaattgttgctactaaattagtttttctgtaagacatttcaagtaggtaaagtagggcgcttaggctggctgaaaacagataaaggattgcgttagcctaacttggtctgttcatcgcgacgaggaagagcagcggcaaaattttctagaattgattcagcttgcttccaattccgtatctactagattctttcaacattgagtttctttcattaggtcagctcaaagcataaaggtgttcttcatataaaagacattaaaccagatagtaaaccataaacttaggtaacattaaatcagaatataagacttctaatactcgtatttcccattctatcatgtgcttgtgacctctataacattctcaatgagagaagcatccatgtgaacttgagaagcatgaaactgaaatcacaatgaacttctggtggtcatggtaatatgacccataacgttcattaccacttaagcaaacgatcttaaaaaatctctaaattcgtttgattatataataagactaattaatcttgtttgatatgatcataaagcgtcttaacatcatcgcatcaatgtttgtttgtctatgatttttcagacaatttagaaaataataaaaaaaaaataaaaatggaaatctgacgtggcgagtgagagggcttgtgaggagcacactcttccacatctttttcccactcttccttcttatcactttcctcttctctcttctcctctgatcccaccacacttttgaactttcactcaatg

SEQ ID NO: 15831 - DNA, 3000 bp, Unknown; identical to SEQ ID NO: 3524
  misc_feature (1)..( 3000): 2750-1469P.txt file - cDNA_ID_1022149; gDNA_ID_1620649; Annot_ID_47693

SEQ ID NO: 15832 - DNA, 3000 bp, Unknown; identical to SEQ ID NO: 3524
  misc_feature (1)..( 3000): 2750-1469P.txt file - cDNA_ID_1022149; gDNA_ID_2926215; Annot_ID_142196

SEQ ID NO: 15833 - DNA, 3003 bp, Unknown
  misc_feature (1)..( 3003): 2750-1469P.txt file - cDNA_ID_1022182; gDNA_ID_2214451; Annot_ID_182563
tccgtctttctgcagcggctgctctcttttccctctgtgctgccattgctctcctcacttcctcctattacaacaagatttacaccaaagacaaagcaaatgttgacatggcttctccttaaatatcagactgagatcagattatacaaattggggtttgtgaagctaaccactttagaaattggcttctccttctccgcctgcgcagcttcggcctgcaaacacagggagggttagataacaagtctctactaatccgagttttgtttgaaaaatagaccctgattcaaaacgttacctgagccttcttttctcgggctttgcgtagtttcttcaactcctttgttcttgctttctgcttggcgtctttttctgcctgaacaacaatcaccgtcacgaatcaagttagtctgatgatggattcagactcccatatgcaaccacatgtctccgaaaatcatataccaaatcatgccagaacaaatatatacgacaccaattaatatagtatttggcagtcatcggattctaacacatgaccacacatacatcattaactccgggatagagctcaacctaaaatcccaatgcgcaatgaaaggactaactgcactagtcctattttgcctcatgcggaatccttaaccaaacttctaaattcaacaaataacaaaccaatgcaagtacctgcttggcagcttgagattcctccatctcttttgtgagcgggctgggtactttagcatcatgccaattccatttttcaaggtttaacgccataaaccgtctgaaagtgtttctcacttccttctcatttgcaagcatgtatggcgttctgcctctttcatccttagcacaaggatccataccctcctccaagaactccataactctttcacaatcacccgatttggcagcttcatgtaaggcagttgacgtaccagtaactccatcctcgatatcctcttctatacgatttggttcctctaagattatgttgctagaagaagtttcatcgggctcttcctttcttgaggttttgccagaatcctcattgtgggtctgcaccactgtattagctttggtgacttctggtcgattaacaaaaatctcctcagttacatgtgcaatctgagtcaactgattatatatacgctgtgattccttgaaggttggccgacggatcgtaaatggaacgtttcgtacagcgcagttttggctgctaaagtacggtttgcctccattgaaaagtaattgcctactgcttgagggagcatggacaaaaacacaagcagcaccatcaaaataaggtttccagctagcaagtagctcttgaatatcctaacaatagagagaaaaatgacaaaaattacacttcaaggctatgaattatctttcctagaggtaaaaaaatatataaacattttttctttatgttttccttcctatgatcctgatcccggttgataatcatcgaggaggcggccaatgtttccacccgtttaagagacctaaatcatgtttacaaaactatacaccacacttccgagttcagaattgcctttacaaatggacagagccgcatatattattataaaaaatcaacgaccttttgtaatctcagctgaaaagagaaggaaacagtagcaaaacatgtccagagacaaaccttttttaaagcaagttcattgtaacgacgaagtgaggctccggcagagtgtatacttctcccgcttgcatcttttgtggactgctttttaccagccttggctcttacaacatatctacacatagggaaagggaattagaggacaaaaagaggcaaaggactgtgaataaagttttatgaactgagaggaaatgagaagagaagtacctgtggaatgtcttatgagccacaaccgactttccattaaagacagtaccggcaaagtggccaccacttgcaagcaacacgacacgcatttgcctatcatccttattctctcgaatcaaatttctcaacctctcagtaacttcattctcgaccaagctaccacaacagtcaacagaaactcctctgtcattctcgaacgaaacactttcagcgtcgtccatgattaagcatttccagatagaaactttgtcaccactttgaagacggaaaaatagtttctttttatcaatacccttttgagcatcaaagtggaaagagggtggtctagtctcagcttcgtcctctgaacctgatatgctagacacgtcatagtcttggaccgactcagatgtcaactcatcaacatcttcctcttttaatatagccttgccagcaacactcagcttgatctacaaatcacagcaaccacattaaggcattggaaaacgaaattgtgacactttttttttccatataattgctcgaataatttagtcggaagagagaaatttgtacgttaaggcgatgaatatcggacttgaagtggtagcgttgatcttgaagagacaggaactcaattttacaagtattacaggtccatctgtccaaaatcacgccgtccttggaactcttatcctcctccgcctcctctggatcgaaagttttgggtggtccgaatgccgattgagtctccgaaggattcgacaaccgacacgagtcaaagaaatccgccgtcaagtcaaatatcgatcgaggctgtttatattctggattaccaatctcggtggtggccgccgcgccggtggtcgccattaattatgaattggacggattgattttcctaacaccggtaccgataccgataagtgtggatttgaaagctttgtgagataaacgattccgttttgttattttcttaaatggatccataatgtcattaaagtggcccatataaggcccaataatacaaggcggcgatgcagaaagatctcgaacgaacaaaagcgccaaaagcatcctagacgcgactgagaaaataaatatagaagaaagcctctctgctcgttttgcgtttccgagcaacaatg

SEQ ID NO: 15834 - DNA, 3000 bp, Unknown; identical to SEQ ID NO: 7248
  misc_feature (1)..( 3000): 2750-1469P.txt file - cDNA_ID_1022211; gDNA_ID_1621134; Annot_ID_172605

SEQ ID NO: 15835 - DNA, 3003 bp, Unknown
  misc_feature (1)..( 3003): 2750-1469P.txt file - cDNA_ID_1022245; gDNA_ID_1620413; Annot_ID_156331
aattcgaatattttgattttgactttaaaataaaaatattacaatcctgatctggaaactctgtatcatatttgttggaagttggatgggatcaaaatttctctaacctccacgttcagcttccatttctcctaaagaaaaagagaaaagaaagaatctcattcacatacatcatacatggatacaggagcagtaaagctacccattcacgagcaccctatatttccttcggctcggatcgtttttagtacatgtaaaggctgcggtgtagaagatttcgtctacggcgggtacgtctgcaatgattctgactgtaaagctcggtttcataaggagtgcgctgaggccccatctgagatcagccactctttccaccaacaacatcctctctttctcaccaatggcctgggagatcttccatgtgatttgtgtggacaaaagcgattggaagccgctggttatagttgtcccacatgtgagttcaagctggatttgacttgtgggataaacccatcaccgcctgctattgaacatcctatctgtcatgaccatccacttgtctttttgaagaaacgagaggagaaggccccttgtgaagtttgcaaggattctattggtggaccttcctattcttgtcttggatgcgatctgtacttccacgtggattgcgtccatctctcaaaagaggtaaatcatccttgccaccctagtcatcctctcaagctcatcgcatctgaatcacttacggataatgctgagaagatttgtcttttatgtgaacaacaaccagaaaatatgctttattattgttctgtttgcaacttcacatcatgccttggttgtactaaacgcccaccacctctttttatcgagcataccaagacccacaagcatcaacttactctctttctaaacggaatttcatatcaaggttccgcgctgacatataacagcagagcttatatgtgccttccttgtggtttcgttgtcaatgggaatggtatcaacctacctcaagtcataaacatcaaccgtcacgaccatcgtatctcttacactcatcagcttggccctggatatttgaactgcggagtttgccgcgaaattgttgacagggattgtggggcatatgcttgtgtcgtttgcagtaactatgcagttcactgggaatgcgcagtacatgataatgtatgggatggtgtggaattagaagggacatctgagatcacagaagatattgcaccattcaaggtaatgggtgataacttgataagtcattttagtcatgaacaacatactctaaggctgcacaaagaaggcatcattcatgacgcgtacgcactatgtgaagcatgtacatatccgatcggatttgatccgatctacagttgtgaggaatgtcatttcattctccatgaaaagtgtgctaatcttcctatgaagaagagactcgtgtttgcaaccacaccattcaaattagtgggagcaagtagtcgtgttcgtgatgtgatagactgtgggtactgtggtgaatgttctactggttttaagtacgcatctcaaagagggtgggagatagatgtacattgtggttctctttctgagccgttcgttcataatggccatttgcatccactatattttgattctaaggaaaatcactcttgcaatgcatgccataaggtaacggttcatatgctttgttgcaatgcttgtgactttgatttgtgtttaagttgcgctagtttgccattaaagataaggcatagaaacgatgagcaccctctcactctatcttgtggtgaaacggcgaatggaaagtattggtgcgatatatgcgagacagagttagatccaagtaaatggttctatacaagctttgattgtggagtcacattgcatgtggaatgcgtactaggagatttctcacgtctcatgccaggacgcatggttgatactgttgggggaaagaaattttatgtggttcttaacaatcacaacactcgaccattatgcagcatgtgtcgctctcgatgcaaggtctccgtcatcttaaaagcttgtgatgaagacaatgtatacatatgttctcgttcatgtttttctgatatggtttcagctagatcatgttgattgagtgtttaatttgtttaattttgtgtggaaaggatgaaacttcgataccctttatattttacaagatgagtgaattattcatggttgcattcgctagctgccctacaagtccaaattcaatatctgattttaatttgaacttctttactttgctcgtcttgcaacataactgagttgtgatttaaattctaatagatactgttaagggtttccatgtctctatattttatctatataaagatatgcctaagagtttataattccatcactcataagattaatgcaagaaaatatcttagagactacaaggttcaaagatatttgtttattcttagttatgttttctaagatttctctaaattttgcccgaattcacaacacagctttaattatcattatactcttccagttttatctgtaagaaactagaatgcaatcagactcattgttatgcgatagcatgatcacttatagttatgaaaatcattgttatacggtaacatattgaaaatattgaattgctatacaccgaatggccaagtatatataaccaaggtaaaaatatgtcaaaataatggcttcgcccgggttcgaaccggagaccttcagtgtgttagactgacgtgataaccaactacaccacgaaacctacatgcttctttctaacctcaacaatatatatatacatatagataactgtttaatattgtaacttgtaaccagtgtcggctaatttcgacttttgtagatctttttctgctctttctctctctctctctctctctctctctctctctctctctcttgtattatttctatctcccccgccgtcgaaagagaaacgtcgatcggagaacctttgaaatg

SEQ ID NO: 15836 - DNA, 3003 bp, Unknown
  misc_feature (1)..( 3003): 2750-1469P.txt file - cDNA_ID_1022296; gDNA_ID_2214625; Annot_ID_135948
atctcaaccatataatcagtctatgtcggtttgaatcatatcattcatctatcttcttcaatcaattcatcagtaatgtagttcggacaagatctaaaatcatcgatacctatgtcttctaacataaatgtgttacttaaaggaatgcagaacaacgacatgccacacaatcttcaaaaatcagtgtgagtaagtaagagtgatgctgacctgtggcaaccaatcggttcgagtagttcttcttttgctgccttaagctcatagccattctatgaatcaatccaaacttgaggtgactgaaactgaaaggggatccaatcatgagacttaaaacgattactcgttgtaggacttgacgcttccaacaaatttgaattgctgatgctggaaaatggaaaggatactatgtcacatccagggactttaaaaggacaatgatccactagagagtttgaaagattacgataatatgtgtaatctctggttaaacaatctgagctgtttgtgtgatgaaatgtctggagctcttggtttgcagcaaccacgtcttcgtcatcaataatatacctctcgagttcatcatgctcaaaatggctggcttggttcgttgttggtaagaggaaactgcctgaaatggaatgagagagcagaggtaaagggtacagctcccttgtaaccaaatcatgggatgaagaatagtcagagcaccatggattgtctgtcaaagatgaggatgatgcatttggatacgtgatgagtcttgtgtgataactaagtggaaaatcatctgtctttctggtgcttgcggtttcagtattccactcgagaagtaatgcagatgaaggctctctatgttcgtgtgataagtcctctgtgctgtatccaatttctcctctgtgataatccattgaaaaaggcttgtagtttctgaaatggaggctagatatgggagaacactccaaattttcttcaacaggaaacgacaggaactccttctgtttcaacagtggaggtcgataaactgattccttaggatataagatgggaaagctaatctcttcggaatctcttgggatgaaactgctctgaacgtgaggatactgcagcctcggggtaatgttattttccagccatccctgccaagatatcaatctctccctttccatatgcagactgtggtcaacttctgcatagctttcatgggacctcttaagaaactttgagccaggagattcaacaaacgttcttcttttgactctggccgtcgtctccttggaaaacctagaaggctgagaaggaaaaaaaagtgctgaggattgatcaagataagcaattgacaaatactcagggattctatcaagcttacctgtgtctcctccgtaccaggggacagccgagttaggagaacagaaactaaatcatgcctgaaaaatgattattttctgagtgcattatagaaacaagtattaagattaggataaattaacaactattgtgtacccgtttgaggtaagctcagggatttcagtaagccatgtatctttgacccactgatgcagtttctttctcttcacagagaatatatctcctttctcttcactgattcctgataattcaaactacaaaatcatatctcttaattgttaactagtatcttttgcttctttgatatgtaagaagtagaatatccaacatctacctccactttcagatctcagattgtcaccacttggaactgtgtacctatctctactgaatgatgaagaagatctcccattacattttcctataaacaacagaaatcagaagaatgtttatggatcactacttccaaaataccagtaagagattctacagaagtatccggataagagacacgagatcttatcatgtggcacaaacatgcaccaagaaatcgaagtagcaacctctatccctttgagtcaagttggcatgtaacatagacgacccacgtctggcactatgaatgggtgtggagaagctatagctcttggatctaccattatcgtcgcagtccgttcctgcacatcctggtttatgaaacagtatagatgaaaatccaggggaaagccaagcaaacactatcatcatcatcatcacaaagaaaagctcaaaaacctttgtctggtttggctctggattcgaaggttttaggaatttgttgaactttatttgatggtttagaatcagaagattcagagcagtgaccaaaattagactttaacttcttaaagaatgcaaactcagaggtcttggcatcaatcgctgcaaataaccaataccaggcgattttcaatcaaattcaacattctaagaaactctacgcttattcacgtgaagtagacgcgaacacttacatcctccggcctgagattcgttcaagggactccgatgatcagcatcgtcgaaactcacccttctcctgcgtttcaaatctaaaccaccagaaggaaacaaaattaaaacacacacacaaactcacggaaatcgaaatatatgttgtaagatacctgaatttgctcgagcgctcgaaggatcagtaaacttgaatccgatttgtggatcggtcttatttagggtttcgccagctttcgttcgctgattccttcttctcatcaccgagtatctgaattcgttctacagaatcgtggatcaaacgctgttataatcacgaaggcgatgaagaatgagagatttcacatcacgcgtccatggcgattcataagaatttgaaatcggagaagatgagaaatgaattttggcggcaaaatcaatcaacccttattacagattctttgctctaattatatatttcattttctaaggttgccacgtcatcacattatccagacgatactgatatgtgatcacacgtgtcatatcacaagtggtttaaaacgattccttttaaccccaaacaatctaaagctttgtccaccttttcggatcactcacacaacttccaacgatcacacacaaatg

SEQ ID NO: 15837 - DNA, 3003 bp, Unknown; identical to SEQ ID NO: 15836
  misc_feature (1)..( 3003): 2750-1469P.txt file - cDNA_ID_1022296; gDNA_ID_2214625; Annot_ID_187775

SEQ ID NO: 15838 - DNA, 3003 bp, Unknown
  misc_feature (1)..( 3003): 2750-1469P.txt file - cDNA_ID_1022370; gDNA_ID_2926269; Annot_ID_143386
caagccttatccatgagaatctccggaaactttgctgctttctacaactgcaaattctacggtttccaagatacaatctgtgatgataccggaaaccatttcttcaaggattgttacgtcgaaggaacattcgatttcatcttcggaagtggaacctctatgtacttggtacgtaacatctcatacatattttctttatacataaagtgtgaaatctctaacgcatgcttgaattcaaaagggaacacaattgcacgtggttggagacggtattagagtgatcgcagcgcatgcaggaaagagcgcagaagaaaagagtggatactctttcgtgcactgcaaggtgactggaactggaggaggaatctatttgggaagagcatggatgagccaccctaaggttgtctatgcctacaccgagatgaccagcgttgtcaaccccaccggatggcaagaaaacaagactcccgcacatgacaagtaagtacacttttcacactacatagaaaatgttgtgaatatcacacaatcggtccatctcccttatgatctttctatcaaaaatgacaggaccgtgttctacggagagtacaagtgttcaggaccagggtcacacaaagccaagagagtgccattcacacaagacatcgacgacaaagaagctaactgtttcctatccctcggctacatccaaggatccaagtggcttctcccaccacccgctttgtaaattctttaatatcaacctattaaaattaaaattaaaacgtaaaactaaaattaaaacttctacttacatccttttttcaccgaaatatgtttatcggtgtatattatttttgtcgatattttctttcaatttccagaaatcctctcttctttaaatatcatggaggagttgagatttatgtaattttggtttcattataataaaatgttgtttccgttcataactcttgtatatttgtttaagtagccccttttcttatgtttgatatattttatctcgagaacttaattgtttttcttatgcttgatatatttacaagacaatgcaatgaaattatcaattttaatttgtatatcacggagatggtgattatcacattattatccttttaaggtcatcgggggtaaattgtgtagcaaacacacattctaatcataagattgaatataaaattagggaatttaatgaaaaaaaccctcaactttggccagatccatttttaaaccctaaactatgtttttagtaaaacaaaccctgaactaaaacctgttaataaacttaaccccacagtaattaaatattaatggaatattaatttccaaaaaaaaaaacaacgagacatttgtatttagcgcaaaaaccacatgatgttctttaaaactgttttgaatttattacaaaaaaacgttctaaatgattttgaattgcttaattagtttggattttagaagctggaagaaagacacaacaacttaaaataatccaaagagtcatgcttaaataaatccaaccaacataactatcgaaacagttgcaacacaacaatatttgtcacaaaaaaaaacaatcgtttcagagggacaagatattgtaaagtaaagacttgtcaagcattaactttgaagagaagattgtattggctgagtgatagggttctcttcatccattgttttctgtttttttcttggtcgtccttgaagtttcttgggtggttttggcactgctttacgcttgcatgaacgtttgttgtgtccgacttgttgacagttgctgcaagtctaaatatgcaaatattaaattaaataatttgaaaaggaagatcttgtgaaacataattcattgttctctattttatcatttgaactttttcacgtgtataaggaactttttgaggtggacgatcttcagttggatcacggattttgtcattgttctttgatcgatttttggaaattaatatcccattaatatttaattactgtggggttaagtttattaacaggttttagttcagggtttgttttactaaaaacatagttcagggtttaaaaatggatctggccaaagttgaaggtttttttcattaaattcccataaaattattgtgccttactttaattaatatgaatctttaaatagtttatgttcatagagtgtaattgttgatacatataccatcttttacgtgacgactatacaatgagatagcagtgtaagaaagagacatacagagttggcagtacaaaaacatataagctgacgctacattgctacaaaaattttatagttgtattttacaattaatatatacaaaaatacttaattacatattgccatctgtaaccaccaaaaaatattattgtctagtataatcaagaccagtacaatctaatcagacatgagaaagaagaaaaaataatggacatgcacgcatatatgattgactaattggtaatgttccactctttatgtgaatctacgaagcatctaaacgcaaaaacaaacttgtacttttccatgagcctactaaggaaagctcgaggttttctatacaatgcagtttcggcaattatgtaattccttttatatgaaaatatttggattaatatatatgattcttatttgagtctctgatctctgattaattattaatgaatgataaccgtcaattatgtggatagaatatcgaataataagctacttgatttccaaattcatcacaattcacacaccaagtccataagaaatgactgcttcgagggatataaaccacaaatgagaatgcaaaagaaaaaaataccacacacgagaatagtaaaaagagatctatccggtcatgcatcgacgatcccgaccactgcaagtatataaaatgtcccttcaaggcttcttcatctcttccatttttattcccaaattaataaatatctttttttcttttattttcttttactttaaaaaaaaacttaaaaattaataaattaataaagatg

SEQ ID NO: 15839 - DNA, 3003 bp, Unknown; identical to SEQ ID NO: 15838
  misc_feature (1)..( 3003): 2750-1469P.txt file - cDNA_ID_1022370; gDNA_ID_2926269; Annot_ID_205045

SEQ ID NO: 15840 - DNA, 3000 bp, Unknown; identical to SEQ ID NO: 6973
  misc_feature (1)..( 3000): 2750-1469P.txt file - cDNA_ID_1022478; gDNA_ID_1621119; Annot_ID_172005

SEQ ID NO: 15841 - DNA, 3000 bp, Unknown; identical to SEQ ID NO: 1355
  misc_feature (1)..( 3000): 2750-1469P.txt file - cDNA_ID_1022554; gDNA_ID_1620391; Annot_ID_155613

SEQ ID NO: 15842 - DNA, 3003 bp, Unknown
  misc_feature (1)..( 3003): 2750-1469P.txt file - cDNA_ID_1022586; gDNA_ID_1620459; Annot_ID_157720
gcgaccaatccagttatgaaactggcgagttcctctggtggcattttcgatggcagtatctatggacaaaatgtgaacggtctggtgaaagaaactgtgtatcttacccttggtataatggattctcttgggacgtattcccaaacagaagccaatcaagttgtaagcatgaacatactcagaccatctgcgaaacataaagtttctgttgagcacttgatgtccatcctgggaacatttggatcttttccacctcagcgtcttgaaatcgaggatccagttgagaactctgtctgtcaaggtgtctttctcttccaggtcctcctttagtttcctcagtctagcgatggtccagtcagatacacagaacatgagaagagcaatggaatcaagagctattccacatatgagcaatgcgtaagtaaggacgacatcgaatccatcatattgatctttcttattcatcttgaagaggcagagagatgcaacaaggcaccccaaagctataaaccggaacacagctccagtccagttatgcagaatctctgctttggtgaacagacaatcatagatgagtccgagctcgacttcgatgatacgtaaagcttcttctgcagtcagcttgtcaaagaatttcctgctctcgtcgcgctcttgattggtgaagattagatcaacaataagacctttgaagatgttaaagtatttgtaagcatactgaataacttgtagtgcggtcaattcattgtcgggcctaactggagtattgccttcccgtcctttctctggatccttcaccactattacatcagttggcatattcatcttcttcctagcttcatattcctccatgagtttcgcgtaattagcaccagggtcaggatcgtcgagcatagagtccttgaacttgtcaagactcgctgagaacaacgcagctgttctctcgacatacttgatcactcctcccacaaacatgattaatgttggagtcagaagcctatttggtatagacaacaagatcacatacacagtggctaccgcttgacagacaagactaaacaagtgtctgtcccaaagctcattatcctccaaggcaagtgctgtaatggtatctggacctccaaggtgcaagagaagaaacggtgaccaaaatgctagcagctcacggttcttggatggtttgtttgattcagcttcttcttcttgactgtctgagatttgcccaaccgcgtaatcagctgcccaatcagcaagaagataagctgaccatatgaggacaaggaagagcttctttgcggtgcgtcttcggctaggtgcaaagaaaataaggattgtttggaggaaaagactgagtattatgactccacgtatgttccatttgtcccaaagtttcctcagatgtggtggaatcatgtcagtcatcttgtcttcttcttcgttggaccgcaaaactgcacttggtttactgtggatgttcacagtagtgtcaaaggttagtgaacgtttctttcacataaagtttaagtttttgtctatgggtttctttgcttccattgttttgagacttgaaatagaaacacaaaccatcaagtgttattgttacactataagtaactttataccttgcttataaacaaataatatcttaatctcttttgctttttgtttttattcctagtctttgttcttttcttatgaccataagtaaactactaaaaaaagacaaaagcaatcgaatgtagatttatcacatggtattaaacgtatgtacatttaaatgtattacctcatagcttctctaaagttaaaagttaaaatattctacttgaagcttgtcttcactttcactgttttttgtttctaacactaatagctttctggataagtgacaaggtctctatattcgttgtctgagtattgtgtgaagttaaaacttggaaagttgataggtaaaaaacacattgggaaaaaagttgcatactcatttcctacattattacacactcttcaacataaactctctacaccacgtcaatccaagatggaaacacttgctaattgggacatatcttgctggtactttcgtatgtctttcttacctttggacttaaagggcttgattggttcttctgatattaaccgcaaacgcttgctagtatttaaacctaatcatagagacaatttcaaactgctccaaaatactctaaaccatttgtaatagctgaattttaaaaggtccttgcggtggcaagttaaaaaagaattcacataaacaacaaaaaaataaaattatcaaaccctttatatattaacgttaattctcaaaatcctaatttgatttcatgttgtcaatccaaactggagaaagtcaaatattgtaataatattatcaatttggaagatttaagaattcaaactcacttttagtagtttgtcaattatttgatgcaatttttggtgatgagctaaaatgaagtaataaacatttcactattaaatttctttgtctttgaataattatgtaacattttatttacaaattttattattagttatgttttgatgttttttctattttatcacaatagtagaaatttttgatatatctaataaccaccggctttgaaatttgtcctaagttctataaaaacatttcagacagaaagcaactgttttttttttctttgtatttttgcttgcccatgaagacaaattccagtttttcactattgtgtgtgtagtcaagtcacttgaattttccagctaataattgattatttaagaaacttaaggtaaaataccaaacattctgaaagttaaggggttttttaaaaatatgacagctaataagaagagagagttagagagaaagagaatcaacgagtctttcgtcttcatcatataaatactctctcactttttcccgtctttcagagactctctttctcatttccacctgaggaaaaaagctttttcgaatctcgcttgctttttgtcgccatg

SEQ ID NO: 15843 - DNA, 3003 bp, Unknown
  misc_feature (1)..( 3003): 2750-1469P.txt file - cDNA_ID_1022613; gDNA_ID_2926129; Annot_ID_196835
atgaaattataatttaggcttgtattgttcatttacttacatgtgttataattttaccttttatgtaataaaacttgatttttattacttagttaaactgaaaccatctcttccaaaatgaacacaatttatgatcattcttacaaaatttatgtaagaatttatgatcattcttataattgacatgtggtacactacgggtttataattgtattcaatagtttttttattttgtttttagcatgttttataaatatatgttaatatattttttaatttaaatatattatacattttggaaggatactttataactaaaaaatgaaaattttaagttgtattagttttgttaatattgtttatttttagtactttaaaattgtataactgtaatttgattgttaatataaataatcaagttatattttgaatttatcatattattttttatatctatttacttttgatattatattagtattttctgtaaatttaatttcacaatcaataaatgtaagatcaatatgattattattggttctcaacaaaatatctttaagaatccaaacatgaattttttcacatctaagacatctgtgaaaatagtcggatagatgatatcttttttactgtgtctattgcttttagtaagacagaagccatatttctgaatcttttgattagccaggtcacgatcatatatgttctcctcttctgccaaaatccaaacaacacaaactttagacgtggcagaaatcagcatttatttctaacaataattggaaaaactaaaaaaatagaaaaatatttcgagttttagctagagaatgaaacaaataatcaaaacgaaaactaaaagaaataaggtgtctgtaaacgctaaaatatttcatacctttgtgttgggtgatggtaaatggcgtggtggtgcatagtatttatagggacaactaataggttactaacccgcatctattaaatagaaaatattccctgaagcaagatatttggaagaaaatctatgaattcgatagattttgaggaatatactattgttatgcgtttttaattttttatgcggcattattatgtttctttaaatggtttttgtgtagattatgtagaggataaaatatgaaatccgaattggtgagttattacttgattttagtaaaaaacggaattgatttttatggagaagaaacattagttagtttcttaaaatctgttttgtagggatatattgcaatgtatgaatttcaaaaatggatatgatttgtttggaagaaatcgtggagttaatatggagagattttaggaaataattttgatagagacgattaagatggcaagacgttaaggaaatcataaattgtgattagcaaaagaattaattacgtttattaaagattgactaagattgcctattgttgttggaattaattaagaaaaatataggagaatatatgtgataccaaaaacatattaaaacaaatgaatgttaaatctggcagattttgaatcaaatcatattttatcctctacatagtcccaatcgtaatttctttgaaaacagaatgattctgaatggtttagaataggaatatgcttgagtatcataagtgcaaaataataatcaaaatgccgtatttagattttgatttgattctgaatcaaactgtcgagatatggtaaatgtatttacccttatttttacgcttgtacatgtaaaacagaaagatttgggtggtttataagatggaatattgcgggatttagattatatcttgactggcaagcaaatagtaaaagattttgtagttaaggtgatatacgtaaatcaggatacataattgctatgaatgaggagtggagagaatatatgattcgatcggataaattttttggaaggcaataatcaataacaatttgaataatattatagttggcgaaatttaatttgcgaggtgatatattggaattttgaattgatgatgatttgtagaatgtgtaaaaatatattgactataccatatgtaagattatatgataaatagagggttcttttaaggtttatggaattaatgcatgattaataatcgtttaacttatagaaatgtgatatcgaaatacgaatatttggtaagagtgtagtaaatatttagagattttggaatgaagtaagtaaagatatggttagttatttggttgttcggatttttaagaaatattatttcgtgtaatattgaattagtagagatttaagggattaatgtgtgcaatttatgagggtagtgcaaaataatatttttgtttaggtaattaattagtgcaaaacgtgaatagttcatcaaaaatttggtcattgtcctaacgcagacaatcttgtctgattgattttatagggactaaacatacaatatcgaaattgaaaaagaatttttcgacacaaatctttcccaaaattgtatatgtagataatttataaatttgttatcactatcttctaagaaatctgtcaaccaaaaaagtatgatataaaaaatctgtcgtatttaaaaaattctactgaataagaataaatctggtataactaaatgatagacttttgtaaaatcgctagaaatttttttaaagaatattttgtatttattttatttttaacacatgaaaaaaatattttaaacaaaaaaaacaatttaattccaatattttagaaaatattctaataattaatctcattacttaagttaacccctaaatatgttacgttttaaaactatctaagcacgttctaatacacatcatacatcatacagaaacacatatattcctccgtgctgtaacacgggtctgatcttagtaaaatagtggagagaagaatattcttctggataccttttaatattccccaaaacttctgaatcttcttctcaatttttctcgacattttctcatcgaaagctctcttcctttccctttttggcgctcaatacaatcatg

SEQ ID NO: 15844 - DNA, 2470 bp, Unknown; identical to SEQ ID NO: 15355
  misc_feature (1)..( 2470): 2750-1469P.txt file - cDNA_ID_1022613; gDNA_ID_2926130; Annot_ID_196843

SEQ ID NO: 15845 - DNA, 3000 bp, Unknown; identical to SEQ ID NO: 10205
  misc_feature (1)..( 3000): 2750-1469P.txt file - cDNA_ID_1022623; gDNA_ID_2213635; Annot_ID_181016

SEQ ID NO: 15846 - DNA, 3003 bp, Unknown
  misc_feature (1)..( 3003): 2750-1469P.txt file - cDNA_ID_1022691; gDNA_ID_2214514; Annot_ID_133918
acggaaaaatggctacgatttggtttctttcacttctctttctctgttgtattctcctcgccgcctttaaacacaagaagcgtcggacaaatcagcagcaaccaccgtcccctcctggctttccgatcatcggaaacttgcatcagcttggagaattaccacatcaatctctatggagtctttccaaaacgtatggtccggtgatgcttttgaagcttggaagtgtcccaacggtcgtagtttcttcttctgagacggcaaaacaagttctgaaaatcaatgatctacattgttgtagccgtcctagcttagcaggtactataactctaacttaacacatacaattttctttctttctatttgttcctttgttcatagaactcaacaaaaaccatgattttgatcattcgttaggggcaaaagagctctcttacaattacttggacattgctttctctccttttgatgattattggaaagaattaaggaggatttgtgtccaagaactctttagtgctaagcgagttcactctattcaacccatcaaggaagaagaagtgaggaaactgatcgtttcagccacggaatcagcctctcagaaatcaccagttaacttgagcgagaagtttcttgatttaactgtaagcgtgatatgcaaggcagcattcagtctagacttccatacttcagttctcaataatgatggatttgacaagttaatccacgatgcgtttttgtttttggggagcttctcggcctcaaacttcttcccaaatggtggctggatcatcgactggctcacgggtctacaaaggcggagagaaaaaagcgtcaaggatcttgatgtgttctatcaacaaatgtttgatctgcataaacaagaaaacaaacaaggagtcgaagatttcgtggacttgctcttgaagttagagaaagaagaaactgttcttggatatggcaagctcacaagaaaccatgtcaaagccatcttaatggttagtactatacaaatatgtgcaacacattagataccttatgattctaaactttgttttctcatcttatcacagaacgttcttcttggggccatcaatacttctgcaatgacaatgacatgggccatggcagaactaataagaaacccgcgagtgatgaagaaagtacaatccgaaatcagaaaccaaatgataaacaaatcagtgatcaccttagatgatatagatcatctaccttacttgaagatggtgatcaaagaaacatggaggctacatcctccagtacctcttctacttccaagagaagttatgtctgaatttgagatcaatggctacaagatacaacccaagacattgctttacgtgaatgtttgggctatagggcgtgatcctgattcctggaaagatgcagatatgttttatccagaaaggtttatggataataacattgatgctaaaggacagaactttgagctgttaccgtttggaagtggccggagaatctgtcctggaatgtacatggggacaacaatggtggagtttggtctagcgaatatgttgtatcagtttgattgggaagtaccagatggtatggtggtcgaagatattgacatggaagaatctcctggactcgccgtgggcaaaaaaaatgagcttctacttgttcctgtcaagtatttaggtcattgatgatcacttaaagtactaattttcttcctttgagtacaaaactaaatgtgttccctaaataaaactaaatcttgtattccattgtctctcggagtggatcaatccaacgatgttctttgttgccttcaatatttcatatagataatctatttattttgactaaaatatgaaccacctttcaagtaaggcatgttcgtttgtacatgagaatgatgcatatagatgacctatttggatgttgcacatttttgaatttggtagtacatctggatagagcatttgaatgaagttttgttcgtttggtttaggttttaacaatttgttatatttattcaaacatatataaggaatatgccggaaaaaccaagtatctgaaattccaaattccgaattaaacatttgattatttaaagttctagtatgattgaaaatccctaaaatttatcaaaattttctcataatttttagatatttctcaaattatccgaataccactatctaaattaaacttatattgaaattagcaagtgttttttaccaaaatttttcgaacatggccaattacgcgaattttccatgcggtattttatacgaaatagtagtggtagatttttttaatactcaaaactatttgcaaaggggggtgcaaccaaatcttatattgtcagtgatttgatttattttgagagtttttatatgatttgaagaatttgggtaaatttacggaagttgttaggatttattgtaaaatcctttcaaatttcacgtaaaggctaaaaccatgagatttaaaattctatatttttaactaagtaaatctactaaattcacttaaatatcttaaagtcactaaaaatccaatccttaaaatgttttttaagaagattttgaagtagattttaaagtagattttaaaatcactagtccaataacattagatttcatgagacttttaaaaatccatgattgaataacatatgatttactattttaacacaaatcacttcaaacgtttgattgaatatacccccttaagtgagcctaaggttttttcggttttatttcataacatgagatttttatcttgaattatataatctttgatttagattttaggaaaccatgaatatattcaaacatgttttatcaattaaatgttaaaccaagtattacagagagtttcatagtctttactctaaaaccacgtatgagcaaaccaaattgaacgaccaaacaatttcaggcatttttgctgcttctggaaataatatatctattgagtcaacaaagatcagatcaaagctgaactataaaaatg

SEQ ID NO: 15847 - DNA, 3003 bp, Unknown; identical to SEQ ID NO: 15846
  misc_feature (1)..( 3003): 2750-1469P.txt file - cDNA_ID_1022691; gDNA_ID_2214514; Annot_ID_184387

SEQ ID NO: 15848 - DNA, 3000 bp, Unknown; identical to SEQ ID NO: 11142
  misc_feature (1)..( 3000): 2750-1469P.txt file - cDNA_ID_1022712; gDNA_ID_2214480; Annot_ID_133229

SEQ ID NO: 15849 - DNA, 3000 bp, Unknown; identical to SEQ ID NO: 11142
  misc_feature (1)..( 3000): 2750-1469P.txt file - cDNA_ID_1022712; gDNA_ID_2214480; Annot_ID_183298

SEQ ID NO: 15850 - DNA, 3000 bp, Unknown; identical to SEQ ID NO: 11429
  misc_feature (1)..( 3000): 2750-1469P.txt file - cDNA_ID_1022807; gDNA_ID_2214495; Annot_ID_133561

SEQ ID NO: 15851 - DNA, 3000 bp, Unknown; identical to SEQ ID NO: 11429
  misc_feature (1)..( 3000): 2750-1469P.txt file - cDNA_ID_1022807; gDNA_ID_2214495; Annot_ID_183809

SEQ ID NO: 15852 - DNA, 3000 bp, Unknown; identical to SEQ ID NO: 4274
  misc_feature (1)..( 3000): 2750-1469P.txt file - cDNA_ID_1022876; gDNA_ID_1620694; Annot_ID_48645

SEQ ID NO: 15853 - DNA, 3000 bp, Unknown; identical to SEQ ID NO: 4274
  misc_feature (1)..( 3000): 2750-1469P.txt file - cDNA_ID_1022876; gDNA_ID_1620694; Annot_ID_164878

SEQ ID NO: 15854 - DNA, 3000 bp, Unknown; identical to SEQ ID NO: 4274
  misc_feature (1)..( 3000): 2750-1469P.txt file - cDNA_ID_1022876; gDNA_ID_1620699; Annot_ID_164997

SEQ ID NO: 15855 - DNA, 3000 bp, Unknown; identical to SEQ ID NO: 4274
  misc_feature (1)..( 3000): 2750-1469P.txt file - cDNA_ID_1022876; gDNA_ID_2926208; Annot_ID_141855

SEQ ID NO: 15856 - DNA, 3000 bp, Unknown; identical to SEQ ID NO: 4274
  misc_feature (1)..( 3000): 2750-1469P.txt file - cDNA_ID_1022876; gDNA_ID_2926208; Annot_ID_202409

SEQ ID NO: 15857 - DNA, 3000 bp, Unknown
  misc_feature (1)..( 3000): 2750-1469P.txt file - cDNA_ID_1022944; gDNA_ID_2926273; Annot_ID_143482
atgcgtttaatacagtgagattgggtggtttcctttacttgtgacgtcaacagatggttactattctggtggtcacagaccttataagtgagtgaattttgtttctgttcttgaacgttaaaaaatgagtcttgtgaaagaaggtactactacttcttctgagtttatatacgtcaccaatttagaatctaacgggttgcgtgcaaaatttcaagaattaatagtttttttttaattatgaaaaaaaaatcaagaaagtcaaagaaaatctactaattatctttccattttaaatttcactaattaaaaacttttccgattatatagatgagagaagggatgagataagctaacaacaagtaacaaggtaaagaggcaaccaatttacaaaataaaaaaaattgaattctgtttagacattaacactgaccctttccttctcgaatttcagcaaacaacaccaacaaaacaaaaagggactgtgttatttgattgtacaagtactaaagatctcaaaacaaaatgaaaaagaggatcttggccattctctgcatcaaaaccaagagtttcactggttacatatctgcaaaaccatttagagttccactgacaatgggtgtgtgttggcattggcaaagttaccttgtcaatgttttcagaaaagggctcattgaacacatattagtcgatatttggaagccataatttgaaatgtactacataatctggtccacatcttcaaaccaaagccaaccaaaaaaaaaatcctcagctacaacaacaacatcgttttatagtctatggtttcagaaacatttcctgtgaaccactgatggtccagtctcgtcataatctgctttagtaacgtgctgattctgcggaaacaccactttagctagtatggctcctccaacccaagccgaatacatccccaaattctccggcatatattctggcggtttcaccagtgttggcctaatggcagatgagcacaagtttgcttctttctggaatctactttcgaatcctgccatcgaccattccaacaaacccttcagttttccgacccaaaagatattcaaacacactatgatatcaagtgttgttagtacctgtcatggaggttgtaccaccacaaagtacagtgttctccaagagctgcctatggttctcagatgacactgtggagataatccggacaagctgctcaacgattccatgctcctccagtcccagtattgatggctgaaacagagcttctccaaccgagtatctctctcgcccgatgcttatcacctataaggccattggttttgttatctatatgtataaggtaacaacacaaaatgtagaatcttgatttcacacaaacctgtccatcaggaagagtatgctgctcgatttcacagttttgggtttttttgtaagcaatttcgtcctcggcacagtttgcatactgctccttgagtttttcaacatcagacatgctgagattcatcgacgggttggtttttccaagctcttgggcaaataatttagttagctcggttccacctagctcaaaccgtttcgaggcaatgtgttgtactgcaccttcaagaactggggcaatatctgaaaagagttggatcaaccacaaagttaaaacatcagacataacaacatcctgatcatatccagctataaacacaagaagaatccaaaaaaaattggtttaacaaaacgtttaagatcatggaaaaaggttagtatagggaatcagcatctcatgtaacatcataactcacataaaacatggaattatgagtttatgacaaagtgaaagacacaaagagtaacaaaggccaagcaagttataatacctatcttcccatgaccaatatcaacagtgcaaccggagatgcgtccaacagcataaagggacaacactgcttgctcagatgcataaaatccagagacattgaatgtttcaaacatcaactgcaccaattgctccctaatagcctgtccacaaacaaacatttgcagagccaaatcaggtcgaaacattaaaaataacaacgtcttactatctaaaatgaggtactaaaagaacaaaattgttccttttcataatccaacagaacaggattatgggaattgaaaagagactcaaagttgtaatcttttaaattaagaacaaaggaggaaatttggagataagaaccttaggagtacaaagtggatctgtaaaaagtatattgccttcgtttccctcttcccatccaagcccagtgtagacaacataacgcaacagatcttccatagcatcccaatctctaatcaaacccctttcaataggatcaagagtgacatcctcaaagacagtggtggggttatcagctgaagaagacccatcatcaaccattcgtttcatttgagagggaattatcattgcaggagactggtcaggaattgctgctcctgctttcaggaacttagagccagcatcaacaactagtgcttccattgttttcacacacacacccaaaaaccctaaattcccaactttccacaaatgccaagatttagtggtagcagcaagtcagtgaagctagagaagtagaaatgagagaaggaactagagtgagaggcaaaagaaagaacggttttttcgaagaacaaatcaatggtctagaagggaaaatggaagcagcttacgagtttgcgttgagagagaaaatcgaagacgaagaagaagaagaaaagaaaagaaagattatttctttggaattcaaagcccaaataaggcccattataaagcctattacagcccgtaatttccacgtccaaaacggtattgttttgagtctccgtctttttcttgttaacaaagccagagctaataagatccgattcggaagtttctttgacatcaaaacacaaacccggaaagcttcgtctgccatttttcattcttctaagccctagctcaaagctttctctctcaaatccgccatg

SEQ ID NO: 15858 - DNA, 3000 bp, Unknown; identical to SEQ ID NO: 15857
  misc_feature (1)..( 3000): 2750-1469P.txt file - cDNA_ID_1022944; gDNA_ID_2926273; Annot_ID_205209

SEQ ID NO: 15859 - DNA, 3003 bp, Unknown
  misc_feature (1)..( 3003): 2750-1469P.txt file - cDNA_ID_1023143; gDNA_ID_1620681; Annot_ID_164453
atcaatggcgtccatgtcccttcttttttttttttttttttgtgtgtttcgtttttattatttgttctgaatgaaaaacaaattgtgagtcttcggaaaaattacggcaaagaagatatatagaaaaagagagagagagggaacgtcacatggatattgaagaaccaatcacagaccgatcctccacggagttgtgccatgtcagcaaagtcaaaactatagtgggctcgcgttgctttttttgaccaaagcccattttaaacggctatggcactaggcactagctgagtaacattcccttcttgatcttggataacatcaggttttggtgagttttaaaatgattttaaaattttagtgatttcaaatgaatgaatatatagaaattgatatgatttttaaaagctttttgagattttcaatcaaaaccatagatctataacatgtacacacctttgtgttttgagtcaaaatattcctatatacacctaaccatttaaaagacaagtcaagatcaagtacaccagaataaccttgagagacgtgtacatctataaccaagaataccagatatcattggacttttaacattcatggattgtatacatagaatttgtccttttaacacaaaatcattaattctaaaagatgtggttgaatacactcctctcccttgacattggtacaatataacatttggaaattgtaacacacatcacctagctcctcaattgaaaaagttgtatagctttctttggttctcaaaggacaaacacaaactcatattaatgtctcaagtagtagtaagttggaaagtgatgaacaaaatatacattacttgcaatttattccatagattcaaaggtaggagcataccaaccaagctgatcgatgagcttcttcaacctctcttcttgtcccttggagtctccaaaagcagtggtgaaaggatacacaaaggtaaccttagtggccatacacctgtaagcaaccacatcttgcttcaccaaaaactccatcacatctctgctaaatcctcctccttctacctctgcctccacatacctccctgcaaatgcaattgtgtgtgatctttcctcaaatccttggtgggaatcatttaaaaatccaattgtggtgagaaataatttaccatagggagtatcttcaagaaccacaaacttggggttcttctgggtgctcattattgcttctttcagtttctgcgttgaacaaataatcagaaacgatgctaaattgatgaagataggaggaaatatacctcaatgggatcctgtgtatcggtttctgggatcgtcaatggaaaagagaaggaagatgaggttggattcgtcgatacacatcctgggttcgtggaagggcaaggcctaattttgctacaaaaaaaagagagtaataaagattagctttgtttagagagcagaaatcagagtgagaagaggaacaaacccattgagaagaccggtctggacgaacttggattgggtgaaaggagtggtgagtggctgagaagaggagagagaaggaatggctaaggcaggggaaaaggaagttagagagatagcaagagcaaaagagattagttttggtaaaagagagattggaggagaagtagaagagagttcttgttcttgttttgggctttgcaatgagcacaacaacttggtgcttctcggccgtggcgggaggatgagttgcaaactggcgaccaaactcatgtttgtagtttatggttactctcttctcctccaaatattattaatatataagtgtctcaaaacgctttactgaaatgaaaattaattaaaattgttttttttttttattgtatgtttgaacttttaaattttagttgactacaaattccataatgtcccgatataaaatgtgagatgtgttcttgtttgaccacaataaaaacactatgagattggtagaaaattatcaagaaatagagtttcacccaataccaatagcgtttcacctagttttcatcatcctattacaaaaattcgatggtaaattacaagcggcaaagttcaatgtaactaatgatacaccgatacacgtaacatgttcattgaatgtttcattaaaccaacaaaaaactattgactcatgccactagaaaaattaccaccgaattaaattaaagagagcgagaggcaaatgaaacgatagaaaataagacgttcaatggtcttgagagaattaaatatgtttctttatattcaccagtgtttgaacatttgcagaattgtgcagagaaaggactaaaggagaatgaacaacattttattggacaaggaaactctattttcacgatttcgcaggtatgtctttttataatattacttatttcataatattttgatatagatgattactcaaacaaaagaggtgaaaactcttgtaaattttcagtatttaacctgcaaaacagatactacttttttacttgatttatcaaaccaaagttaagacttacaaaagcaccggtgacaatccgacattgttgccatgcaaagactcaaaccaatttgaccgtcgacgcttttttagtatttcaaaaatatttttatcaattcatgaattatgattattgccaaacatcgattcagtggagactaggtttatgaattatgaccgtagaacatatgaaaactgtgtaaaactattgtataatttatgtattaaattttgtattaatcaactgatatgcggtcggaccggatccaaccggcgatcgaaacataccatttatattttttctttttctattttactagaaataaaataaatagaaacctccgttgcttttttggcaaacactgtgagagagttgaccaaaatcgacccagtgggaggactaggtttatcgaaagctccagttttcatagataaatccagtaaaattatacacgcaaattctagtttcttagagcaaagctttgttgaattgatagcttgaatttgggaatg

SEQ ID NO: 15860 - DNA, 3000 bp, Unknown
  misc_feature (1)..( 3000): 2750-1469P.txt file - cDNA_ID_1023205; gDNA_ID_2926272; Annot_ID_143438
aatgttgggatgattttgcaggcaatggaatgtatttatgttcatatatgcagaaggaggagcacataaatataaagaatcaacaagccagttttacagaggaaaccatagaagcctaggctaatctgaaacctgagtcctggttcaacatgtgctttaccaacataaataacgcccaaaacatgttatattgcctcatcaaacagctcaaatataaaagatcttctcaaatatcaacaggaaacctcagatgtcagactaatcctctcaagcaggacgatcttgctatctaaaaaaccatagtgccatagagaaataaatgatcgcttaacggacctcgttgatgcagaataagcaattaaaacgtaataatacaaatctgttttcctgcatacctgtgacaaaaatcgaggtagcatgagtttaagaatttgatcaagaacttgtgtcccagtcgcctctattgctcccactgggaagactctaaatgcaaaaggaatctcgatattgacctacaatcgccaagtaagtcagagataccacagcaatgcactgattaactaagcaaaaggaaaaaaaatgaagaacttagctacctcaatgactgcatctgaagtaatttgttgctctgatgagccctcctgagtgctatcacatgatacccggttcaccatagaagctgcatgactagaaaataataaatgttaagcccacacaaccatcactaaatttaaataatttcagtacacaaaacttgacaacatggcagtactttcaaaacgggttaacaaagtgaagcgtatacagggatatgcttaccatcaaatttgtcattttgagcaaccacaacaggagatccctcaagctatatggcacaagaaaatacaaaaatcatcacagtcttaacaaatcataactggatttgatttgacatatgtctaaacgccacaagttcctctctttgtttgcaaattcaatcatttccaaaagaacaaaagaagaattaccttgcaggacaagagcttgatgcagcagccattaggctgttcttcaaccctgacaagcaaaacagggcagacttcaaagttgaagaatttaaacgtataaacataacatctaaacgtgttatcatcaactctctcaatcctctccgcatcaagcaccgagtactgactcgcaggtaagctcatatactcaactgcaaaccataaacaaaaagcaaattcaaaatcaaacaatccgatccagatttaatcatccacaggaaacagaaatttagatcagagagaatcgcgctgaagttacttagaggtcgctgtagctgacgaacggagacggattgtttctgacgagcgatgaatcgagctttgggggtagaactagaggagacgcgtataggtgacgtagaagaggaagtggcgagagaagaaggtttgggtgattcgtcaaaggacgatgagctagtgatggtgaaggagagagctggatttctagggtttcgattcgtcttcttcgccgagaacgacagagaggtaagtctaagcgtagctgagctcaacgccatagctaaaacgacggcgttttaggatatgagatgtttaacgactaacggcttagcttaaacacacaagcgaaggagagagagtgagagaaacgtgataagattattgggacgacgaagatttgggaggtggcaccaccatcaccacctgcttcgactgcgcatgttagcctgctgacgttgtttcgttcgctacagttaaaatacgctgaatattgaaagcaagcccaacaagagcccgtgaaatgtatatattgggccaacaacgaataaccttcgcaatttgagtaagtaaatatgaaaatgtcatgtaaccagactcggttggatccataacacttgtcagtatttttgattaaaataattagtttttttcctaattaaagagtacaaaattaattaagaaaatgcgaaaaagagttatctaattattgaaaataataatgtgtgaggaatttgattactaattttaaagttcacaaaataacatgattattttattgaaggttttaaccaatgaatctgtagtcgtgaagaaaacacaggttgccacttcccattatttattttggctaaagagccacttcccattattgccgggctaaaaaaccaaaatcaccttataataatattgaacttacattattaaatcgaccgattcaaatcataaacatgcattaccattaatcgtatctatcgtcttcgtcaactctaccgtacaatttgataaacatatatttactgcaattcaagatctaacaaactatgaaaataaatcaaaccaatgcaataaaatcaaattctaaaatgagaaaatagagagaaaaagacacatattgccatttttattttattattatcatgttcattctattgctttaaaattgtagaaaaatgataattttggtgttttattttctaattatgttttatttcgtagcacattttgatgttaacacattttgtagttgagttgatttgatattttaacaaataaaaagtgagatgattgtgaaagaggaaaaaaaaattaaaaaagaaatagagaggcggtcaataaaattaaatttaggaaaaataaaaaataatagaataagggaggctagtggatagatagacgaaggacaccagagccaccttcattcacttcacaaaccgctcggcgacaaagacgaagaagccgaggaagcaccgatacgacgattgagacttagttttgctcagattcatttaaccaccggcgccaagtgacgacgacgacggagggagcagattcgaattgtgtgaagacaggtaaactttggaatttttccttctcaatctcagatttcgatgaacgagtcttatctcttcctctctctccgatttcgttcttatttctcttcattgaattgataatgtcgattggttaatgccgtttatcttctgtagcagcaatg

SEQ ID NO: 15861 - DNA, 3000 bp, Unknown; identical to SEQ ID NO: 15860
  misc_feature (1)..( 3000): 2750-1469P.txt file - cDNA_ID_1023205; gDNA_ID_2926272; Annot_ID_205157

SEQ ID NO: 15862 - DNA, 3000 bp, Unknown; identical to SEQ ID NO: 988
  misc_feature (1)..( 3000): 2750-1469P.txt file - cDNA_ID_1023208; gDNA_ID_1620344; Annot_ID_154103

SEQ ID NO: 15863 - DNA, 3003 bp, Unknown
  misc_feature (1)..( 3003): 2750-1469P.txt file - cDNA_ID_1023229; gDNA_ID_1620620; Annot_ID_162250
cctcgttcaattatagcatggagatagagaaaacagacacagaagcaggatttcccctgcaaatgccatgtccagcaacttatgggagatcttgttcatctaatgaataaccaaaccacaaaagaaaactatgactcgaagactcgagaagatgttaatggaaacatagaaccgtaacaaaatttatgaaaaccagctgacttcttcttaagcatcagactctttcttttcttcttggttctctcctccctgggtaacaccaacctcagctggtcttataactcggtcatacagcgtgtatccagactgcacatattgacacccatcattactaattggtatttaagactatacaatatgaaataaagagacaaagaattgagcaagctttatatatttaccttcaagacatgagcaactgtgccttctggcttagaagcatcagggacttggaacactgcgttatgtctgtttggatcaaatggctcgtttataggatcatacttctccataccaaatttcttaaatacctgcagcggcacacatgtttaaccggtctcatctgcattgcttacttaaggtcttataattacatttctcgatatttacctcagcaagctgtttctcagtcatctccactccttctaaaagggtctttaatagtggagctgctccagcagaatcttctgaggtgtcaagctttgagaagctttctttgacaaccgaagaagctcttccaagattatccgccacatccaataggctctttgcaaaattctgcatacatatatagtgaatatatatatttcagaaaactattatatgaaacaaaagctgcaaaccaagttcttaaagactaacctgtacggcatactttttggtgttttcagcatcacgtcttgttctgtccatgacattctccatctcagcataagtgcgaagaactttgtctttcaactgcttaatctcttcttccttctcagacagtagctcttccttctcagctacgagcttcaccaaatcatcggctgacaattcatcatcatcactctcagaatctgattcagaagatgaagatgcagctcctttagcacctttccgctttctttttgcagaatctgtcacagaatctttagattcagagtcaagacctggttggtttgcctcagctgtaggtttctcttcacttgtctttgaggcctcagtgtgggtcttcttctcatctgattcaggcgaggtagaggaagaaaaattgaacctttgcagtgcaaacgaatccatcatagacatctgagctggaacaagctgcccccaaaaaaaaaagtaaaatgggttaaactcagtgaaatgatacagagcaaaaacctatagagaatctaaaccattcttctattgtttattcatatatctgaagattcaaacataagagatcaaggaaacagtatcagaagatagcaatcatttctagaaactcaaatgagggaaagccttaaaccctaacaaaaccctgaattgcaatttcggcatgaatagtgattaatttgagtgaaaatcgaaccttatgcgagaaatcgtgagctagggagtgaaaccggctcgagaaaacaggagtctgattcctcgccggaagagtgacggcggatagagatgagcgtatgcccgcgttgcgggttactcgcgacaaaattctcaaaaccaacatctggagatccaccacagatgaacaaacagagatcaagaagataagagaatcgaatcgaatcgaaatgtaattgttctgaggaaattgttaatttgcagaggcacacagagtgcttggtggatggatagtagaattcacaattctctctttcggggtttttagtaatttacgtaaatagccttaccgctgcacgagcgggctgaggctaaaatgatcgctttgattcggcgagcctgtgagggtattattgtcattatagcaaatgggagattttgaaagctaatttgagaagcctctagaaagaaccaaaggtacttgtatatctttgggacagacgaagtccatttatctcctgggcctgattggtacagtcctaccaaacagaacaagcagcagtatgttactgttgctaagtggtttggcttttttagtttcattcttgtgtttaattaaaattgctggattaatatagaggttgtgtagatttgacgtcatttggatgggagaatttggaaattaatgttcaactacttaatctataattcaacaaacgataaatgaccacttaattgctaatagcctctagttaattcaaaacgcaaacctatgttatgaaccacttgtcaataaatttataaatctttagttgagactcaaaaaacaaagttactttatcggaaatgtcacatttgacgcatgagagacactttcttgccgttacttgttattgtcgttgcaacaaccaaaactatggttgaactaaaaagccccaaaacgtgcgacacagttcacccaaagtgcaaataatctttacattcaagactctagactcagtaagcaataaaaacagtaagtgatacaagaacagagagttgagttttgagcgtgaatccggtaaaaaggaagatgcgttacatatacatctgaagcttgcaatggtacgaatccttctattttaaaatattctgtctttctctcttttttagtagctataaatacggctctctgctgcacaactattattgaaactctcaatcattttcagctcattactcacctcaactaactctctgtggccaaaaataaacagagacatatcagactaaggagtatttaataagcatcatctaacaacaggccaaggtattaactacacgagctaaatctgttttagtcaggtttgatagaagatacctatctttctccatcttaaatgcttgctccaattgttcttcccaattaatcgtgaggttcttgttttgcagaagcaaaaaattgaaaaaacttgtgtaaaaagcatg

SEQ ID NO: 15864 - DNA, 3003 bp, Unknown; identical to SEQ ID NO: 15863
  misc_feature (1)..( 3003): 2750-1469P.txt file - cDNA_ID_1023229; gDNA_ID_2926189; Annot_ID_200912

SEQ ID NO: 15865 - DNA, 3003 bp, Unknown
  misc_feature (1)..( 3003): 2750-1469P.txt file - cDNA_ID_1023233; gDNA_ID_1971816; Annot_ID_175990
atctgcgatttgacaggtgtcatatgtttcattgaaacagtgataacgcttagtaaacagctcggaattggatgaggtcggtctctattgaaagataagcctcggggctcagttgacacttagatcgcctcgtgatgccttttagatcgccgggaatttgattccgaggtcaacagatcggatatagctcgatctgtattttatcagtcttctgcagataaacggcagtatctccgagaaaacagaccctaacgaagtgagctggggcttgttaaaaagaggagcctcagcctatgcaatgtgcttttcaagatcatcactaagacgatggtagagcgtctgaaacctttaatgacaaatctgattggtccggctcaagctagttttatccccgggagagtaagtacggataatatagtgttcgttcaagaagcagtccattccatgagaagaaaaaaaggggtaaagggctggatgcttttgaagttggatttggagaaggcttatgataggatccgatgggattatctggaggatacacttatttctgcggggttccccgaagtttgggtaagatggataatgtgctgtgtgtcgggcccggagatgagtttgttgtggaatggagagagaacagactccttcaagccgttacaaggtcgacattcgagccgtgctggtccgtcactggagcaacttgagaggtttgcctcgaaaaaccaagctgatctggagacatgttcaggtcttcatccccaagctcgatgacgttcaaagcattgacttcgtcggacgcccttttggttaactccttaaggctgctgagttcggatgccgcaatcttcgcgcctctctgcatcagaatacctactatctcctcagcacctttggcctgattctcagcatccacctttggcccgacgaggtcctcttgctccttgagataagcctttactctatcaagacgagcttgggctttctttgtagtacgggcgaccttagaagctcgatcattccgcagtctgttgcactcccgctccccgtgctccttcgcagcaaccaacgcgacttgaagatcgctgatctctttctgaagagcagcttccggagatcgcccggagcacgtttggtgcaaggagggttgctcctgaagtgggtcgtgcggatgcttctaaacgaccgcgggtaagcgaccatagatggggctttcgttacgacgatatggctgctccctttacttctaattctgttgcttgtgctgagcttcttcgtgaaattggtcgtggctcgggtattccttcgatgcccttagacttgaaggaggagaaagttttcgccggagcggccaggaagtcgatcgaggtatgctcaccttctgggtttgattccaattttttctttgaattgcattcgcttgacacgctctttgtccaggcgatcgccgaatgggatcgtttgacttatttgtacgagcgttgtgttcggagcctttccgtagaggctactaacgcgaaagatgcccatgaggctttggccgttgaaaaggaaaaagtagctcaggcgctggccgacctggcaaggtctcaagacgacgccaaggagatgaagaggaaatatgacgagttagctggtcgcgctctttcggagatgaagaggcttcgagaacgtcgacttgaatatgctgaatttgtccggagatcggcccttgataagatggcggagctcgttcagaagcgattggatcgtattaaagctcatattgacgatacgaaggcggcagaaccaaagtttcttgaattcaaccaagtatctgggaatatcaagactctcgaggcgttggtcgaaggtggcgaagtggagatgaagtcggatgacagatgttaagattggtagcggatgcagaggaattggaggccgaggtgaaagcttttggtatcaccgatcttatggacggcgacttcgatgttcgtactttatttgccgagctgagtcctgataatcgtaattccgttccaccgccgactgaaggggaagatctcgcggatggacgaggtgagtgcgaaggccaagctggtgaaagaatcgttggtcaaactgaagttcgagacgagatcgcggatgctagagactgatattccaggaggctaagccaaagggaagaagcggagctcagatgcctaaagagatcccaatatggcaaaacaaaaaatattctaaaaactgaataatcaacgaattttatattatgtgaccaaaaaatgaaaacagaaactatgtaacaatcatcaaatacagtgttttcagcatttatttttttctaaattttccagcaacatacaaacataacgttactactagacataaaaatactccctctgttccaagttatttgatggtttggatttttttatttgttccataagattgatgttttgtaaaaattaaatatgattattaatcttgtttgttgccaatagtgaaaggagagaggtaatagtaatattattaaactattaaaatagtaattaaaattaaatagaaaagttactttttcttaatttatgtgcgaaacttaaaacatcaaacttacagagagagtaatatataacatgatatgagatgaaactgtacggtgtcgttgcataattacataaactagttataaactcacacactgccttcatttcaggtcgagacagaacttattgtgtgatttaaatcagacaaaccttcgaactttgactttttcatcgcctcctgtcccttcgccgcaaaatactagtctaaacgctcaactcctctctcctgtcttataaacttttttttttagaaaatgagatgatcaatcgaattttgttgtgtgtgacctcaaactgacaacttccagtaattgtaatattaccaattttttttatcaaaaagatgaacttcactttagagcaatagcaatccctcgagtctcccctatataaagattccaactccttaacgattcatctaatg

SEQ ID NO: 15866 - DNA, 3003 bp, Unknown
  misc_feature (1)..( 3003): 2750-1469P.txt file - cDNA_ID_1023233; gDNA_ID_1971816; Annot_ID_175992
gctacaccgaagaaggtgaggatcccaataacgtctttgtcatgttccagtgtcgcggcgactcctactggtccaagtgccccccttgcattagcaccgccgtctctggggtaattgtgacttcaatattataaattagcagtcatatagttacatgtaaaaattacgatgagcacacacgtcggttaattttttctgtcaaatcttaaatatgtgggcaatgatcctgatactttatataaatgattgaattgagacaaaactgatagacattaaaggctagttaaaaaatactgattaaacaatgcaatattgttcttgatatatatatgtacgtatatgtatgtgacagcttcgtaggagatgtccaagaaataagggagcaataatatggtatgaccaatgtcttttaaagatatcttcagttgcctccttcaataagatagattatgagaacgatttctatttgtccaacccaaacaacatgagtgatcgggggttgttcaacaaggagacgtcggctctcctggagaagctggcatataaagcctccgatagaaacaacttggatggtaaacaattggtgttgtacgcagcaggggagaagagaattgggacaaagaaggtgtatgcaatggtgcagtgtacgaaagacttaatatttacaaagtgctttgagtgtttggaagggattttgaggaagtttccacagtgttgtgacggtaaacgaggagggagagttttcggtacgagctgtaactttaggtatgagttatatccttttcttagaaactaacagcaacaacagtacaatgagagctccatattaaatgaaagggttctagagataaacagtcttataatatacactgtgttgcattttagtacgtgaacttgagcgaataaatgtactttcctctttgtgatttttgttttttttttgtgaacttgagttattaagaggaaatcttcaagtaaagaatttatctaatagtatatacatcccacatagaataccaaatagctcagctcatacaaactctctcataatgagagaaaaaaatcctgaaataagggtaagaaaaactcttatgcctcaaggttttagtaaatctcataattttggccgaaccacaaaaagagacgtgcgaaacaaaatagtagaaaattgatttcccgaatcgacaaacatggactaaactatatgtatgatacataactggtcgtacttacaatgatgatacttggtttcacgaagacgagggagcctggagatgaatgatggtgataaggccatgtgtcatcaccaaaaggagggttgctcctgaagttttcgccggagcggccaggaagtcgatcgaggtatgctcaccttctgggtttgattccaattttttctttgaattgcattcgcttgacacgctctttgtccaggcgatcgccgaatgggatcgtttgacttatttgtacgagcgttgtgttcggagcctttccgtagaggctactaacgcgaaagatgcccatgaggctttggccgttgaaaaggaaaaagtagctcaggcgctggccgacctggcaaggtctcaagacgacgccaaggagatgaagaggaaatatgacgagttagctggtcgcgctctttcggagatgaagaggcttcgagaacgtcgacttgaatatgctgaatttgtccggagatcggcccttgataagatggcggagctcgttcagaagcgattggatcgtattaaagctcatattgacgatacgaaggcggcagaaccaaagtttcttgaattcaaccaagtatctgggaatatcaagactctcgaggcgttggtcgaaggtggcgaagtggagatgaagtcggatgacagatgttaagattggtagcggatgcagaggaattggaggccgaggtgaaagcttttggtatcaccgatcttatggacggcgacttcgatgttcgtactttatttgccgagctgagtcctgataatcgtaattccgttccaccgccgactgaaggggaagatctcgcggatggacgaggtgagtgcgaaggccaagctggtgaaagaatcgttggtcaaactgaagttcgagacgagatcgcggatgctagagactgatattccaggaggctaagccaaagggaagaagcggagctcagatgcctaaagagatcccaatatggcaaaacaaaaaatattctaaaaactgaataatcaacgaattttatattatgtgaccaaaaaatgaaaacagaaactatgtaacaatcatcaaatacagtgttttcagcatttatttttttctaaattttccagcaacatacaaacataacgttactactagacataaaaatactccctctgttccaagttatttgatggtttggatttttttatttgttccataagattgatgttttgtaaaaattaaatatgattattaatcttgtttgttgccaatagtgaaaggagagaggtaatagtaatattattaaactattaaaatagtaattaaaattaaatagaaaagttactttttcttaatttatgtgcgaaacttaaaacatcaaacttacagagagagtaatatataacatgatatgagatgaaactgtacggtgtcgttgcataattacataaactagttataaactcacacactgccttcatttcaggtcgagacagaacttattgtgtgatttaaatcagacaaaccttcgaactttgactttttcatcgcctcctgtcccttcgccgcaaaatactagtctaaacgctcaactcctctctcctgtcttataaacttttttttttagaaaatgagatgatcaatcgaattttgttgtgtgtgacctcaaactgacaacttccagtaattgtaatattaccaattttttttatcaaaaagatgaacttcactttagagcaatagcaatccctcgagtctcccctatataaagattccaactccttaacgattcatctaatg

SEQ ID NO: 15867 - DNA, 3003 bp, Unknown; identical to SEQ ID NO: 15866
  misc_feature (1)..( 3003): 2750-1469P.txt file - cDNA_ID_1023233; gDNA_ID_1971816; Annot_ID_175994

SEQ ID NO: 15868 - DNA, 3003 bp, Unknown; identical to SEQ ID NO: 15866
  misc_feature (1)..( 3003): 2750-1469P.txt file - cDNA_ID_1023233; gDNA_ID_1971816; Annot_ID_175996

SEQ ID NO: 15869 - DNA, 3003 bp, Unknown; identical to SEQ ID NO: 15866
  misc_feature (1)..( 3003): 2750-1469P.txt file - cDNA_ID_1023233; gDNA_ID_1971816; Annot_ID_175998

SEQ ID NO: 15870 - DNA, 3003 bp, Unknown; identical to SEQ ID NO: 15866
  misc_feature (1)..( 3003): 2750-1469P.txt file - cDNA_ID_1023233; gDNA_ID_1971816; Annot_ID_176000

SEQ ID NO: 15871 - DNA, 3003 bp, Unknown; identical to SEQ ID NO: 15866
  misc_feature (1)..( 3003): 2750-1469P.txt file - cDNA_ID_1023233; gDNA_ID_1971816; Annot_ID_176002

SEQ ID NO: 15872 - DNA, 3003 bp, Unknown; identical to SEQ ID NO: 15866
  misc_feature (1)..( 3003): 2750-1469P.txt file - cDNA_ID_1023233; gDNA_ID_1971816; Annot_ID_176004

SEQ ID NO: 15873 - DNA, 3003 bp, Unknown; identical to SEQ ID NO: 15866
  misc_feature (1)..( 3003): 2750-1469P.txt file - cDNA_ID_1023233; gDNA_ID_1971816; Annot_ID_176006

SEQ ID NO: 15874 - DNA, 3003 bp, Unknown; identical to SEQ ID NO: 15866
  misc_feature (1)..( 3003): 2750-1469P.txt file - cDNA_ID_1023233; gDNA_ID_1971816; Annot_ID_176008

SEQ ID NO: 15875 - DNA, 3003 bp, Unknown
  misc_feature (1)..( 3003): 2750-1469P.txt file - cDNA_ID_1023233; gDNA_ID_1971816; Annot_ID_176010
gacgacgccaaggagatgaagaggaaatatgacgagttagctggtcgcgctctttcggagatgaagaggcttcgagaacgtcgacttgaatatgctgaatttgtccggagatcggcccttgataagatggcggagctcgttcagaagcgattggatcgtattaaagctcatattgacgatacgaaggcggcagaaccaaagtttcttgaattcaaccaagtatctgggaatatcaagactctcgaggcgttggtcgaaggtggcgaagtggagatgaagtcggatgacagatgttaagattggtagcggatgcagaggaattggaggccgaggtgaaagcttttggtatcaccgatcttatggacggcgacttcgatgttcgtactttatttgccgagctgagtcctgataatcgtaattccgttccaccgccgactgaaggggaagatctcgcggatggacgaggtgagtgcgaaggccaagctggtgaaagaatcgttggtcaaactgaagttcgagacgagatcgcggatgctagagactgatattccaggaggctaagccaaagggaagaagcggagctcagatgcctaaagagatcccaatatggcaaaacaaaaaatattctaaaaactgaataatcaacgaattttatattatgtgaccaaaaaatgaaaacagaaactatgtaacaatcatcaaatacagtgttttcagcatttatttttgggaaatttactagagtaacccatattttatacataatgacccaaaaggaatgctaaaaatatgagttatttgagtaataattatacctaaattatccttgttttcctttgcagagaaaaacaatattacagaaatgccattactatttaattccagcaaggcaataaaaccacatttatttacgaaaatgccatcgtcgtttttggtaaatctgtggctcttgttgcgacggatttgttatcgatcacagatttgttggtcaaccacagattttttacaacagacttgttttgtaccacagactttactttgttatgttacgccagattttttttttttcgcagattttttaaccgtgactgatttgtttcatatagtctccacagattttatttaaatttcaaaagtaagaatgttgaaaccaaatctgtcactgatttgttttccggaccacagatttttctttatggtggcaacagattttctatttgcacccaaaaatctgttgtgttataacagatttgttaacctcgaaaaatgttatataggcatgacagagttgttttgtgtaatcacagatttaattaacttgttaacaaatctggtgttttacaacagatttttgttaaaaaataaaattactacacagtcacatagtgataacagatttgtttttagtgatgacagttttgtttttcagtgtcaaagcataacagatttactcatgtcaatgttatggccgatttgtttatgactagaataacctttttagtaataacagactttttatggcagatttatttttaaaatttcgaaattttttgttatatgagatttattagctagccctcaattaaattatttccggtctgattgtatgttaaatccggtttgactgaattttttttttttttgaaaaagaaataacgttacgacagacttttattaatgtcggcagatttttacataatattgtcatatttgaattttaatgaattttattagtcatgataaattctccaagggttttcataaccgttttttttcttcttctattcctaccatcaaatcaattatttgtgaattgatacatgtcaaaatattattggtaagctaaaacaagtcaatttatcaaaattaaattgtttttctttagtatttttaaaatcaaaaacgaaatatgtgaagaagattcttctttatctaaattttgttcaaaattattcttttaaaaaaagtttgttctcacgttaactggattttcgtttttgttttaattatataatataggttttggttttcttttttatccacgatttcttttttgattttataattctgttgaaaaataatttggttttgctgatttgtcaaaattttattggtggagtgacttgtgttttaaaatataaaagatttgttttattttttattttttgttttaatttgattacaattaatcattaaggttatttcgtctttttaccaaagatatgggttactacagtttttgaaaccaaacgtgtgtcatttaagttatttatgttaagagttgagtcaatctaagcaaatcttactttatttttttctaaattttccagcaacatacaaacataacgttactactagacataaaaatactccctctgttccaagttatttgatggtttggatttttttatttgttccataagattgatgttttgtaaaaattaaatatgattattaatcttgtttgttgccaatagtgaaaggagagaggtaatagtaatattattaaactattaaaatagtaattaaaattaaatagaaaagttactttttcttaatttatgtgcgaaacttaaaacatcaaacttacagagagagtaatatataacatgatatgagatgaaactgtacggtgtcgttgcataattacataaactagttataaactcacacactgccttcatttcaggtcgagacagaacttattgtgtgatttaaatcagacaaaccttcgaactttgactttttcatcgcctcctgtcccttcgccgcaaaatactagtctaaacgctcaactcctctctcctgtcttataaacttttttttttagaaaatgagatgatcaatcgaattttgttgtgtgtgacctcaaactgacaacttccagtaattgtaatattaccaattttttttatcaaaaagatgaacttcactttagagcaatagcaatccctcgagtctcccctatataaagattccaactccttaacgattcatctaatg

SEQ ID NO: 15876 - DNA, 3003 bp, Unknown; identical to SEQ ID NO: 15866
  misc_feature (1)..( 3003): 2750-1469P.txt file - cDNA_ID_1023233; gDNA_ID_1971816; Annot_ID_176012

SEQ ID NO: 15877 - DNA, 3003 bp, Unknown; identical to SEQ ID NO: 15866
  misc_feature (1)..( 3003): 2750-1469P.txt file - cDNA_ID_1023233; gDNA_ID_1971816; Annot_ID_176014

SEQ ID NO: 15878 - DNA, 3003 bp, Unknown; identical to SEQ ID NO: 15865
  misc_feature (1)..( 3003): 2750-1469P.txt file - cDNA_ID_1023233; gDNA_ID_2926176; Annot_ID_199849

SEQ ID NO: 15879 - DNA, 3003 bp, Unknown; identical to SEQ ID NO: 15866
  misc_feature (1)..( 3003): 2750-1469P.txt file - cDNA_ID_1023233; gDNA_ID_2926176; Annot_ID_199851

SEQ ID NO: 15880 - DNA, 3003 bp, Unknown; identical to SEQ ID NO: 15866
  misc_feature (1)..( 3003): 2750-1469P.txt file - cDNA_ID_1023233; gDNA_ID_2926176; Annot_ID_199853

SEQ ID NO: 15881 - DNA, 3003 bp, Unknown; identical to SEQ ID NO: 15866
  misc_feature (1)..( 3003): 2750-1469P.txt file - cDNA_ID_1023233; gDNA_ID_2926176; Annot_ID_199855

SEQ ID NO: 15882 - DNA, 3003 bp, Unknown; identical to SEQ ID NO: 15866
  misc_feature (1)..( 3003): 2750-1469P.txt file - cDNA_ID_1023233; gDNA_ID_2926176; Annot_ID_199857

SEQ ID NO: 15883 - DNA, 3003 bp, Unknown; identical to SEQ ID NO: 15866
  misc_feature (1)..( 3003): 2750-1469P.txt file - cDNA_ID_1023233; gDNA_ID_2926176; Annot_ID_199859

SEQ ID NO: 15884 - DNA, 3003 bp, Unknown; identical to SEQ ID NO: 15866
  misc_feature (1)..( 3003): 2750-1469P.txt file - cDNA_ID_1023233; gDNA_ID_2926176; Annot_ID_199861

SEQ ID NO: 15885 - DNA, 3003 bp, Unknown; identical to SEQ ID NO: 15866
  misc_feature (1)..( 3003): 2750-1469P.txt file - cDNA_ID_1023233; gDNA_ID_2926176; Annot_ID_199863

SEQ ID NO: 15886 - DNA, 3003 bp, Unknown; identical to SEQ ID NO: 15866
  misc_feature (1)..( 3003): 2750-1469P.txt file - cDNA_ID_1023233; gDNA_ID_2926176; Annot_ID_199865

SEQ ID NO: 15887 - DNA, 3003 bp, Unknown; identical to SEQ ID NO: 15866
  misc_feature (1)..( 3003): 2750-1469P.txt file - cDNA_ID_1023233; gDNA_ID_2926176; Annot_ID_199867

SEQ ID NO: 15888 - DNA, 3003 bp, Unknown; identical to SEQ ID NO: 15875
  misc_feature (1)..( 3003): 2750-1469P.txt file - cDNA_ID_1023233; gDNA_ID_2926176; Annot_ID_199869

SEQ ID NO: 15889 - DNA, 3003 bp, Unknown; identical to SEQ ID NO: 15866
  misc_feature (1)..( 3003): 2750-1469P.txt file - cDNA_ID_1023233; gDNA_ID_2926176; Annot_ID_199871

SEQ ID NO: 15890 - DNA, 3003 bp, Unknown; identical to SEQ ID NO: 15866
  misc_feature (1)..( 3003): 2750-1469P.txt file - cDNA_ID_1023233; gDNA_ID_2926176; Annot_ID_199873

SEQ ID NO: 15891 - DNA, 3000 bp, Unknown
  misc_feature (1)..( 3000): 2750-1469P.txt file - cDNA_ID_1023297; gDNA_ID_2926239; Annot_ID_142816
ttcagttagtgatttatgaacagtgaacactgaacagtgatgaatattttcttcttcagtaaaagaataacgtatgactgtagcataacacaaaaccgacaatgataaaagttacaggtagacattgacaaaaaagaattaaaaaattagaggtagactaaattaagaagattatcaaataacctctctaaacttggaaaaatcaggagttcttattcactcaaacacagttgtgtcatccaaaataaataaaaggaacaagacaacagtttaaccaacactacaaacagataatgtaaattcttcaaaatgtcttaggccagaatctgaaaatattgaagaagaaaaacaaagaagagcagagaacgaagataaaaacccagtaaggacaaactggaaaacccccagggcttctccggaagcagacttaacttcaagctcaaaagcatttccggtgaacaatcgacgggcctgactcatcatattctgcctttgcgatccacatctacaaaattcaagaacggaagaccgatcagtcagagctgcagagtggaattattatgtttagtgaaaggaaattgattggattattattcacctgctggaaggtactgagggaggccaagatggatcctccaatccagacagagtatttcctctcaggaggtgcaacgactttgatcttcatgctgctcggtgccaaagcagtgatctctttgctcattctgtcagcaattccagggaacatagttgttccaccactgagcacaatgttaccatacaagtcctttctgatgtcaacatcacatttcattatggagttgtaggtggtttcatggataccagcattctccataccgatcatagatggctggtaaagaacctcagggcaacggaaacgctcagatccaatggtgatcacttgcccatcaggtaactcatagttcttctctacagaagagctggttttagccgtctcaagctcctgctcatagtcaagagcaatgtagcaaagcttctccttgatgtctctgacaatttcacgctcagctgttgtggtgaaagagtaaccacgctcagtgaggatcttcatcagagcatctgtgaggtcacgacctgcaagatcaagacgtaggattgcatgcgggagagcgtaaccctcatagatagggaccgtgtgactcacaccatctccagagtcaagcacaatacctacaacataaatcaacaatttttacgacttggtctagaatctacagaataaacatgtaaagcctatcaatttctggagttaccagtagtacgaccactagcataaagcgacaggacagcttgaatggcgacatacatagccggagcgttaaaggtttcaaacatgatctgagtcatcttctcacggttagcctttgggttaagaggcgcttcagtgagcagaataggatgctcctcgggagcaacacggagctcattgtagaaagtatgatgccagattttttccatatcatcccaattgttgacaataccgtgctcaatagggtatttaagggtaagaataccacgcttggattgagcttcatcgccaacatatgcatccttctgtcccattccaaccatcactccagtgtggcgaggacggccaacaatacttggaaacacagccctcggtgcatcatccccagcaaaaccagcctaagtcaaacacacaacataatcaccttaactacattgttcatatgataaaaacatattgaaattttctaaggttcagattgatccccaaagattatatttgtaatccagtttgaaaacgttcgttagtagaaataccttaaccattccagttccattgtcacagacaaggggttgaatatcttcaccatcagccattttctactctctgcaaaaacatgagaccaatttggcaaaaaaacaagaataataaaaagacaaatcagtcaatgctatgtttcatatttatgctaaaacaaatgccggtaaggaatatatctaaacattataataaacagattcattttcaagggagtgaagaatattaatatccaaagagagacaaaatcaaatcctaagaagaatgtgacatatatatattccagatccagaatcacgttatcaattcaatctattataatattacagctgaagatctctgttaaaaaaaaaaaacatagcaaatgataaatgaggtacacactcatttacgcctcaaacgcatataagcacgctgatacaatgacgaaatcacagatcggaaaaaaatcaaaatttcacagaatagaagatgaaactgacaattgtcaatcagaataacgatatccggatcaggaaaaagaaaaaaacacaaattaggctataacattaccgaggaaaatagattaaaatcgttctctcggcaggagaaatctcagactgaaaacaattcggttctatggaaggagaaatcaaagaaacaagtaatcaaatgaggccaatgaacaaaaaaaaacgaatggcaagtaaaaaagtataaaaacgggtccaaaggcttcgaattcggcacacctcgttttccgattcaattccttgtggaaatgacgttcttgccctctaccttttttttgtttttttttctcgctcggcctcggttaaggcttttggtaaatggtaaataattaatcacgttagcaaagcagctatagccttgtatttactttgtcaaaactgacccaaaatttataaggcccaataaaagcccaaactggactagggttttttcttgagtctctctggtatatatacaaaaatgtaattttcagtcggcgtccttcttttgtctgaaccaccggaggagctcgatccattgattaggtatcttctatcaatcccttttgatttaactctcttcatctctttattatctctgaatccgtctcttgtaaaatttgattttgtattgaatagaaagttttgtttgtttgttgtctatgaaatttacagaagatg

SEQ ID NO: 15892 - DNA, 3000 bp, Unknown; identical to SEQ ID NO: 15891
  misc_feature (1)..( 3000): 2750-1469P.txt file - cDNA_ID_1023297; gDNA_ID_2926239; Annot_ID_203988

SEQ ID NO: 15893 - DNA, 3000 bp, Unknown; identical to SEQ ID NO: 14840
  misc_feature (1)..( 3000): 2750-1469P.txt file - cDNA_ID_1023335; gDNA_ID_2684228; Annot_ID_192138

SEQ ID NO: 15894 - DNA, 3000 bp, Unknown; identical to SEQ ID NO: 8948
  misc_feature (1)..( 3000): 2750-1469P.txt file - cDNA_ID_1023490; gDNA_ID_1971948; Annot_ID_58602

SEQ ID NO: 15895 - DNA, 3000 bp, Unknown; identical to SEQ ID NO: 8948
  misc_feature (1)..( 3000): 2750-1469P.txt file - cDNA_ID_1023490; gDNA_ID_1971948; Annot_ID_177303

SEQ ID NO: 15896 - DNA, 3003 bp, Unknown
  misc_feature (1)..( 3003): 2750-1469P.txt file - cDNA_ID_1023494; gDNA_ID_1620491; Annot_ID_158615
gtaataataacaggatactttgaaatagcaaaggcattagctttaatagattccaaacattttcccaacttcacttcctttgtcaatgtcctgtagtttcatcaaagtgagaaacataataataacagttccatggagccaatacatacaaaagcaagaccataccttccatgtttaacgcagacatcatcggtaccacgtggccaaagatccaactcaacaactctcacgcctcgtctcaatgcatctgcaataggaagttcactgcagttgctacttagctgatttccagttaaataggaattgtggcctgtgaatataaagtaatgtgacaatggagcatccatgttttgatggacctgaaataaacaaccaacaatgttttagttatatcactgaagaattgagaatcttctctctgcagaagtaagcaactactagaatagaaagtatccaaaatagaaacttctaaatttagacaggttaatcaaacagtcagattccagaatttcagcagcagctgcagagtacacaccaagaacatatcatcgagaaaagtttcacccttttattgggatttgatgaattattcataagcattaagaagaagctaccaaaagtgatgatttttattttctctttgatcaaactaaatttaggccagaaaatagcaaaaagagaaaagagtcaaatagcgatgagagagaaaacattctgagattttccggtaaaaccaacagagagaagaatctaaagtcgtaatctttcaatctcaatctttatcaagaaacaaacaccatcaaatcccagattccaaaaagtctcagacttttcttcccaggaacaaaaaaaaaaaaaagagtttgacttgaaaaatttataaacctgatcggcgataggaggattaagatcagtagaaaagaggtaataattgaaatcatcaagagtaaggtttcgtctggtgaactttgcaatgtgatgtttccggcgaagaacctcgtcaacgattctctctgcttcctctagacttgtttctccttctcctccttcctccgtcatgagcttctgtagctgctccggcgacatatgagcatcgccttcggtgtatttctcgaaaagatctctgacgtcttcgacaggaccagactccgtcatcctgaacttccttgtgaagatcagacagaatttgtaactacccatctctttttttccttccatgtttgtgtatgtatcgtcgtcttgttcagatccaagaatgtgattctgattctacataaatactcggattgttcctgagttttaatattattttaaaacttcgaaaccatttcagagaaaacctcgtcaaacctcctctcttacacgctcacacctgaacacacaaaaatacaaaaacaaaaacttttttttactgaatctcgttttttgtaataatttacaaattagtctcctcgttaattttaaaaccagggaaaaaattgactaatttaaaagggatgagtaaaaatagtagttactgagattatatcgccaggtgttcattgtttttgtccctccccataaataacatactacaaaagatattttcattttcatttttgtgtgaagtgtgaacacaaaatcgagactattgagaaaaaaaaattagatatgttgaaatggcaaagcaacaaaataaagaactggtctggctacattggtggggcagatgcagatctaaatcttttgcaatttgttgtgttttgtattgtctttgtttttcttctctcaacagaatacattcttccattgaaataactccaagattaatatcgtctattgttgtaagttttgttactatactgatagacaattatctaccgcaagattacactctcgaaagctaaaggtcataatttcttgttggtgtttgaatatcttgttgataggattgagtggcgggccaaactgtagagttttgaaagctttggatctgttttgaacataacatcatggttattcatgatgtctcttttagaccaaaagtgtaaaaatatattgttttgttattcatagtaaaattaattcatatatttccattttattttatagcatgcttgggaattatttttcccccaaattatttgatgtttgtaacaatttgtatttttgcactatttatcagtggttgaatttctttaattatctattaaatgatgttttatgtaggaaaaaacaagaaatgcgaaattcaatttaatttttgaaatacttcagatgtcggccaaaagaaaaaaaaaaacagataacattagatatgttgcaatagcaaagcgacaacaaataaagtgttcggctatattggtggtgcagctgcaggtctgttgtctttccaaatccatcttttaggccaaaagttaagtactaatctcgccctttttaccctttctttttactaatagtaaaatattatcaatgatgtagcaaaataaaatgtactggaagactggcccaggaaagttgacagtatttaaatgtcatcgaattcttaatatggatggaaacgtgcttaattaaaatgatactgacaattaatatttaactaaccacttataaagttaagtaaccatattaatattagctggaacaagagtaatgtgacatgcttatggtattgatgttgagtctttttgactaagaattaaaaatgacttttgggtatccgatccagccatgagccatttcttccattagggttaccaactctgaattactattattatcatttcttaattaacaacaataaagaatcatagaattcacaaagattaatgggctgtaaccaaaccactcattagcccattacggttctacaacgatccgggcccaattacaattgtacacgctacaagccaggtggcggaatttaattggatattgacgtggctttggtgagaaatagcggtggacaagggaaaaaaaaagggactgtggagaaacactttagcacggtgcgacaagatg

SEQ ID NO: 15897 - DNA, 3000 bp, Unknown; identical to SEQ ID NO: 9603
  misc_feature (1)..( 3000): 2750-1469P.txt file - cDNA_ID_1023528; gDNA_ID_1972159; Annot_ID_179534

SEQ ID NO: 15898 - DNA, 3000 bp, Unknown; identical to SEQ ID NO: 9655
  misc_feature (1)..( 3000): 2750-1469P.txt file - cDNA_ID_1023634; gDNA_ID_1972165; Annot_ID_179748

SEQ ID NO: 15899 - DNA, 1727 bp, Unknown; identical to SEQ ID NO: 4250
  misc_feature (1)..( 1727): 2750-1469P.txt file - cDNA_ID_1023707; gDNA_ID_1620692; Annot_ID_164840

SEQ ID NO: 15900 - DNA, 3003 bp, Unknown
  misc_feature (1)..( 3003): 2750-1469P.txt file - cDNA_ID_1023707; gDNA_ID_1620675; Annot_ID_164252
cggcttcggctgcaaagaaaaaaacgaaaagtctcttctgagttttgaaacgaattgtatcaataatcgacgagaaaatcgcgccgagagttacaccgaagaactcgagctctatctcaagaggcgtcactgcagaaatcccctgaggagatgatgcttgagaagaagaagaagaagagctgttacaggagattacgcgagctcttccacctccggaaacttttcgatgctgctgaatttgtgcattggagaaggtgaagccgaggttgaaacctaacgaagccatttcttccggctaaatcttcccgtgttagcttccgatctccggcgactttggtacgaagattccagaaactaaagctaaaccacgaatttaattatgtggacttcatcttctacatgttataaggctttttgtctctgttgttaacccattaacaagcccatttaacttattttcaatttatatcttcgacttatctttaaattataaattgaaaagacgttaagtgggccttttagtgctaattttttcaagcccatttaacttatttgagtcttggaatatttcacttggaaaacaatgcgctaattccatctcctataatttccctgtatatattttgagaagatggatggattgagcaattttaaagacaaatatttatgtaactaaaaaattattcttaactttctgatgatttatgtctgagggaagcatctagtatgcattgtttctgtttcatgtgagataagcaagaaaagtaagtgggaaacaagaaagcagaacagtgagattaccaattgtgcaaacaatcatatcatatagtatactttgttcgccatcttactgtcacttaaacaacaaaattcactatcatcgtttagcggattattttcaactatataacccagtaaaagatagtttacttgtcatgtggtatatttgacagttatcaaacttttgagagtttgtgacacgtacgatacagacacaaaatcaaatctccctctccgaccatttttttttcttagttacataaatctcttttccttctccagcaacagaagaattctgctcgataatagattggtaatcacaaaaagaaaagaaaaagtgttggagatccttccgagagagacgcgacatctccttcctcttcgaagatgagtggtactgtgaaggatatcgtttcaaaggaggagcttgataacttgcgccacagcggagcaccactcgtgcttcacttctgggcttcttggtgtgacgcttcgaagcagatggatcaagttttctctcatctcgctactgatttccctcgtgctcacttctttagggttcgtcgtctctgttcgaattttatctctttcaattggtttttgactttgattggttttatttatcttcttaggtagaagctgaggaacatcctgagatatctgaggcttattctgttgctcttgtgccgtatttcgtcttcttcaaggtaaactttaggcatattgattctttgtttggttgcaattttttggcttattgacaaagcttgaatctttgtcactgcactgaatccttttcttattgaaggatggcaaaactgtggatacacttgaaggggcagatccatcaagtttagctaataaagttggcaaagttgctggttctattactcctgcaagcttagggttggctgcagggccaacgattcttgaaactgttaagaagaatgcgaaagcttctggacaagaccgagctcagcctgtatctaccgctgatgctctcaagaatcgtttggaaaaactcaccctgttatgttattcatgaatggtactcctgaagagcctcgatttttaatatctattgagtactttctttatagttggaattcttgtggatatatatcaggtagctacttggagcaaacatgttgctaaagttgacctgctactgttgtttgaagaacacgtgctatgtcttgtcgttgaaggaattatgttcatatgggaagaacataagcctactggaaagtttacccctagctctattgttaacccagatacttgagcctccatatcacaaacatctagttaaggtttgtgtagtaagaacaagaaaaacaacacgtgttcccaattcccatataaatgaccattatacttctatcaacccaattaatcacagtccggagactagttgattaaaaaatcagctaatactaatttggtggtttcaataaacatcttaaatactccataattaaactagattaaagtgggaaaaatcgtcatgagtagttgtaaaatcgatttcatttaagagtatagaaattcgtcatgagtggttggttcatgagttctctctcttactcatattagagtaagaaatcaaacacttataatcattcaaaattcaacaactctcatctcaaaaccatatatttaggtaaagttatatgcatacattttgcattttaattttaaaacagattatttggcgcgtaatgataaaattatgtgtataaaaattatttaactaatcgatctaacaaccacatatgagtaaagtagttaacattgtactactacaccaaattatagtgtgttggttagattagatacacaaactcactttctcaaatcaataacattatgaatctatgataaccttaatttaaaaagagtctataatgccatgattttacaatcgtacttttttcttttgggctgaacttttaatcatatattatttgaaagatgtgattattataatattaaagggaattaaaatcatgtaagagaaacccaataaagtagcttgaagaagaaaaagacaagctttattatacacttacccagaaaaacaaaaaacaaaaaactgataatatctctctctctctctctcgttgagtgtgtccatgaaataatactctgccagagacagagagaaagactgtaacggaggatgtggtggcgaagtggccacactgacacactggtttcatg

SEQ ID NO: 15901 - DNA, 3000 bp, Unknown
  misc_feature (1)..( 3000): 2750-1469P.txt file - cDNA_ID_1023707; gDNA_ID_2926202; Annot_ID_201936
cttcggctgcaaagaaaaaaacgaaaagtctcttctgagttttgaaacgaattgtatcaataatcgacgagaaaatcgcgccgagagttacaccgaagaactcgagctctatctcaagaggcgtcactgcagaaatcccctgaggagatgatgcttgagaagaagaagaagaagagctgttacaggagattacgcgagctcttccacctccggaaacttttcgatgctgctgaatttgtgcattggagaaggtgaagccgaggttgaaacctaacgaagccatttcttccggctaaatcttcccgtgttagcttccgatctccggcgactttggtacgaagattccagaaactaaagctaaaccacgaatttaattatgtggacttcatcttctacatgttataaggctttttgtctctgttgttaacccattaacaagcccatttaacttattttcaatttatatcttcgacttatctttaaattataaattgaaaagacgttaagtgggccttttagtgctaattttttcaagcccatttaacttatttgagtcttggaatatttcacttggaaaacaatgcgctaattccatctcctataatttccctgtatatattttgagaagatggatggattgagcaattttaaagacaaatatttatgtaactaaaaaattattcttaactttctgatgatttatgtctgagggaagcatctagtatgcattgtttctgtttcatgtgagataagcaagaaaagtaagtgggaaacaagaaagcagaacagtgagattaccaattgtgcaaacaatcatatcatatagtatactttgttcgccatcttactgtcacttaaacaacaaaattcactatcatcgtttagcggattattttcaactatataacccagtaaaagatagtttacttgtcatgtggtatatttgacagttatcaaacttttgagagtttgtgacacgtacgatacagacacaaaatcaaatctccctctccgaccatttttttttcttagttacataaatctcttttccttctccagcaacagaagaattctgctcgataatagattggtaatcacaaaaagaaaagaaaaagtgttggagatccttccgagagagacgcgacatctccttcctcttcgaagatgagtggtactgtgaaggatatcgtttcaaaggaggagcttgataacttgcgccacagcggagcaccactcgtgcttcacttctgggcttcttggtgtgacgcttcgaagcagatggatcaagttttctctcatctcgctactgatttccctcgtgctcacttctttagggttcgtcgtctctgttcgaattttatctctttcaattggtttttgactttgattggttttatttatcttcttaggtagaagctgaggaacatcctgagatatctgaggcttattctgttgctcttgtgccgtatttcgtcttcttcaaggtaaactttaggcatattgattctttgtttggttgcaattttttggcttattgacaaagcttgaatctttgtcactgcactgaatccttttcttattgaaggatggcaaaactgtggatacacttgaaggggcagatccatcaagtttagctaataaagttggcaaagttgctggttctattactcctgcaagcttagggttggctgcagggccaacgattcttgaaactgttaagaagaatgcgaaagcttctggacaagaccgagctcagcctgtatctaccgctgatgctctcaagaatcgtttggaaaaactcaccctgttatgttattcatgaatggtactcctgaagagcctcgatttttaatatctattgagtactttctttatagttggaattcttgtggatatatatcaggtagctacttggagcaaacatgttgctaaagttgacctgctactgttgtttgaagaacacgtgctatgtcttgtcgttgaaggaattatgttcatatgggaagaacataagcctactggaaagtttacccctagctctattgttaacccagatacttgagcctccatatcacaaacatctagttaaggtttgtgtagtaagaacaagaaaaacaacacgtgttcccaattcccatataaatgaccattatacttctatcaacccaattaatcacagtccggagactagttgattaaaaaatcagctaatactaatttggtggtttcaataaacatcttaaatactccataattaaactagattaaagtgggaaaaatcgtcatgagtagttgtaaaatcgatttcatttaagagtatagaaattcgtcatgagtggttggttcatgagttctctctcttactcatattagagtaagaaatcaaacacttataatcattcaaaattcaacaactctcatctcaaaaccatatatttaggtaaagttatatgcatacattttgcattttaattttaaaacagattatttggcgcgtaatgataaaattatgtgtataaaaattatttaactaatcgatctaacaaccacatatgagtaaagtagttaacattgtactactacaccaaattatagtgtgttggttagattagatacacaaactcactttctcaaatcaataacattatgaatctatgataaccttaatttaaaaagagtctataatgccatgattttacaatcgtacttttttcttttgggctgaacttttaatcatatattatttgaaagatgtgattattataatattaaagggaattaaaatcatgtaagagaaacccaataaagtagcttgaagaagaaaaagacaagctttattatacacttacccagaaaaacaaaaaacaaaaaactgataatatctctctctctctctctcgttgagtgtgtccatgaaataatactctgccagagacagagagaaagactgtaacggaggatgtggtggcgaagtggccacactgacacactggtttcatg

SEQ ID NO: 15902 - DNA, 3000 bp, Unknown; identical to SEQ ID NO: 3288
  misc_feature (1)..( 3000): 2750-1469P.txt file - cDNA_ID_1023835; gDNA_ID_1620636; Annot_ID_162918

SEQ ID NO: 15903 - DNA, 3000 bp, Unknown; identical to SEQ ID NO: 3288
  misc_feature (1)..( 3000): 2750-1469P.txt file - cDNA_ID_1023835; gDNA_ID_2926204; Annot_ID_202068

SEQ ID NO: 15904 - DNA, 1006 bp, Unknown; identical to SEQ ID NO: 510
  misc_feature (1)..( 1006): 2750-1469P.txt file - cDNA_ID_1023870; gDNA_ID_1591537; Annot_ID_151132

SEQ ID NO: 15905 - DNA, 3003 bp, Unknown
  misc_feature (1)..( 3003): 2750-1469P.txt file - cDNA_ID_1023889; gDNA_ID_2926166; Annot_ID_199151
aaagttgccgtagttaatctgaaacgaggacagagtccaatctctgtagccattaatgagatgtccaagaggaaatccccagctttagtagcatttcaatctggagaccggttactaggcgaggaggctgcgggaataacggctcgttatccgaataaagtttattcacaactgagggatatggtgggaaaacctttcaaacatgttaaggatttcattgattctgtctacttgccttttgatattgtagaagattctagaggtgcagttggtattaagatcgatgacggttcgactgtttactcagtggaggagttgttagctatgatcttgggttatgcctcaaatctagctgagttccatgctaaaatcccagtgaaggatatggttgtttcagttccaccttactttggacaggctgagagacggggtttgatccaggcttctcagttggctggggttaatgtcctctccctggttaatgagcattccggtgctgctttgcaatatgggattgataaggattttgctaatgggtcgagacatgtcatattttatgacatgggttcaagtagtacttacgcagcccttgtctattactcagcttacagtgagaaggaatatggcaagactgtttctgtcaaccaatttcaggttaataatgctcttctattatatgactcggatttttttgagatatattgtattttgtggtttcttcattttttccttcttggaacatgtgtgacacaagctcagcgtactaatttgtattcgtttggtctgctttcagttggaatagattttcaatatgggtcatgatatatttatgttaatgtaggtcaaggatgttagatgggacttgggacttggaggacagagtatggagatgcgcttggtagagcactttgcagatgagtttaataaacagctcggtaatggagttgatgtgaggaagttccccaaagcaatggctaaattgaaaaaacaagtcaagcgtacaaaggaaattttgagtgcaaacactgcggctccaatatctgtggaatctcttcatgatgatcgtgacttcaggtataactacaatatttgggtttctctatttccccagcacatcgaaaattggctgcaaaagtgttataatgatgtctcatgctctaaattgcatcatgattggtctaatttttgtgatgtgcgtgatattctaacctacttatcttttttcaggagcacaattacccgtgagaagtttgaggaactgtgtaaagatctgtgggagagatctcttacacctttaaaagatgtgctcaagcattcaggtttgaagattgatgatatatctgcagtggaactaataggaggagctactagagttcccaaactacaggtaggttttcatgctctcaaagccaatcaatttggcattctcatccaaaactgggggactttcactttttttttcttttcaaatgaagctaagatataatttttgttttaattacagagcacaatccaggaatttattgggaaacaacagttagacaaacatctagacgctgatgaggctattgtcctcggctcagcactacatgctgctaacttgagcgatggaattaaattgaaacgtaggctaggtatagttgatggttccccctatggttttctggttgagttggaaggccctaatgttaagaaagatgagagcacaaagcagcaactcgtaccacggatgaaaaagctacccagcaaggtaccgcattacattcaaaatctgtttaagcttagaaacatttctgtcttgtaataattctgtgtacctgattctcttacagatgttcagatcctttgtccttgacaaagattttgacgtgtcacttgcttatgagtctgagggtattctaccaccaggaaccacctcccctgtgtttgcacagtattctgtctctggtttggcggatgcatctgagaagtaagagcttaaagtttgttctctgaatgttctgtttatctttctgtttggagagatatatgttttcttaatatggaaaatcttcgaataagttgataaatgtaagttcattgatatggacagatattcttctcggaatctatcagcacctatcaaggcaaatctgcatttctctctaagtagaagtgggattctcagtctagatcgaggagatgctgtaattgaaatcacagaatgggtagacgttcctaagaagaacgtgactattgatagtaacacaactacatcaacaggcaatgccactgacgagaattcacaagaaaataaagaagacctgcaaaccgatgctgaaaacagcactgcttcaaatacaacagcagaagagccagctgttgcttctctgggcacagaaaaaaagctgaagaagcggacattcagaatacctctgaaggtggtatcctgaatttattgtttccaagattttcttgattcatttcattaccaccaaccaattctgtgtgaatatataacttgtaggtagttgagaaaactgttggacctggagcaccattttcgaaagagtctcttgctgaagctaagataaaattagaagccttggacaagaaagatagggaaagaagaagaacggctgagttaaaaaacaaccttgaatcttatatatatgctaccaaagagaaggtgtgtgcttatatatagatcactatctctgctgcttcatggattttttgttgctatagtcttcgtttcccctgtagctattttttgtctttggttggcattcctctcaaaattcttaagtgttggttttattttgttcatggtgcagctggaaacacccgagtttgaaaagatatccacccaagaagagcgcaaggcgtttgttgaaaagcttgatgaggcatgaataaattttcttttgaactatataatattatttgattccaatgatgagtgtaatcgtttgacactgaggacggtcttgtgtgtttcaggtgcaagattggctttacatg

SEQ ID NO: 15906 - DNA, 3000 bp, Unknown; identical to SEQ ID NO: 12031
  misc_feature (1)..( 3000): 2750-1469P.txt file - cDNA_ID_1023980; gDNA_ID_2214528; Annot_ID_134222

SEQ ID NO: 15907 - DNA, 3000 bp, Unknown; identical to SEQ ID NO: 12031
  misc_feature (1)..( 3000): 2750-1469P.txt file - cDNA_ID_1023980; gDNA_ID_2214528; Annot_ID_184838

SEQ ID NO: 15908 - DNA, 3003 bp, Unknown
  misc_feature (1)..( 3003): 2750-1469P.txt file - cDNA_ID_1024003; gDNA_ID_1621094; Annot_ID_55594
tcctgccaaagttaatgagccatgatttcagatccattcataaggaccgaaggcgagaataacgaaggaagaaaatatatcttaccaatatctggtacaacccgtgtgtagggtgtgcttgggaatacccagataggaggtcaaatgttggaaatagtccagcacgctgcatgataggagttttgtgtaaacttagacaagcttaagaaggaacagatgtagagaactaatcttaatgccataaatttgcctcaagaataggtgatggagacttgagagaagagtgaagcaacggaagatcctctttgtgcaaacaagttacttcgccaatagggaactttgattgaaacctgccagctctccctacaacaggatcatcagaacattagagaggacataccaatactcttgatgtattatttggtgctttttgttgaaaatttacctgcaatttgtttaatctcagatactgttaggtctctggtctcggaaccatcatatttttgaagggtcgagaagataatccttgaaatattcaaattaagacccatgccaatcgcatcgctggcaacaagcacatcaaagtcattggtctcatcgttaaaccttgttgcctgcagattttaaagcatttggaaacaaaaaaagataattcttagagcatccagttaagcctatagccaagacagtaaggaactcaaacctgtgccgtgcgagtctctggaggcaacgaaccataaaccacagagcaaagatgcttccccgcacgttcaattgttttctacgaaaaggtaccaaaaaaaagagtaaagaatatgtatggaagcattcaatactcatgacgcgtagagaatagagctatgtatgcatataatatgatgccaaaatgttctatttctttcgcagcaaactcaagcagaaaaaagcaaaatacaggaagagagaacaagataagtaactgctaaccttatacgcatatatatcttttcgggaaaaagtgacaagacaatccccagttttaatactggaaactgatgaaacaggaaccttcaaagggactaatggtgaaagcctctcataggtatgaacctgaattcaaaataaaagggatcaagaggtcgtgattacatcaagagtattggtatttaattataaacaagaaataattagagaagaaaaagggactctagctcgaataaacatgatacctcgacatcatctccagttactttcagtatatcttcaacaagaggtacgacagctggatcgccacataaatgtagctcatcagccgcgattccaagtaaagcacgagtaaatgcaaatcccctttgtttacatcccaccatctgaaattagggaaagaaaggatgagaataacaaacaaaaagttcttgtcgatttcttaagccaaagtcgagcaagactagcctgaatttcgtcaatgatggcacaatcgtagacagatgtaacatcagccatttcaactgtcacagctttgtgtgttgccccttccactaagtctttctcttgtcccgtgatcaaatcacatggaacatttgctttgtttaaccgtttagctacctcccatgccaacaatcttaacggaccacaatatacaccttcaagtgaaagaagcaaattttaaacagttcaagaactggcttccaaaaggtttattagtcaccttcaaggcatacctgaagaactctgttcaaggtgcttaagggcactatatgtcttcccgctgtttgtcgggccaacatgtagaatgaccttacgcttcttcttccgagctataggataccatgtatgaggacagctagaattcaaagtaatgacagaaatataaatcagttcctctttactaatctctccacaacaacaatggaactgcaaagagaatcgcaattagttgctactggggagctaacaaaaaaattctacaagaagttttactcttacgtgagatcagtgaaatcgaactttgaggtggttccagtgccagtgaaatcaaactttggagatccagagttctttctataattcctagtcaagacacctaatctcaaaaggtcaccaaactcaggttcaaagtgaaaccgccacaaacttcctttatcagctgaaacattaggcaacacgaagccatcataagatacaacgttaaaccaatccaatcttcttctagacactacacagaaacagatgtagaagctgcaaagctcataaaggttcaaactttctgtatccagatgatcaaaatttctgatagttcctttctaagatcacttacaaactacaatccgcaatttctaaccaaaagagaaccagaaaacagagaaaaaaagggtttaaaagctccaaccttgaagaacacgagaaatccccaaagctgaaacctttcgaagccgaacaacagaatacgccatgtttagattgttttatctattgaaatgaagacacaacacttccttatcctttattcaccatgggaaatacaattcgagtatactcacgacgacacctttcatttgctttgaaggaagctcaaagttacagaaatcaaactcttgaaatcgaggacgagataaacaataaagagaaattaaaaccaaattctcttttataattagaaactgaagaaaccatctcagacttccattgttagaccttattcttctcagagggtcggcgactcagcaagaagcgggagagagaagaaaacgagaggttcctttttaatttacaaattaacccctaagcttttcctattactctctcttacaccctcctactttaaaaaatagaaatgtccccataacgttaatatgtctaaaatacccctgactatattctagaactaccaaatcaacccgtcttgttcgccaagtcgctttgatctaaaaagctcttaaactattcttccagcgaccggaagaaacgaataatcggaatcgaaaaattcgaaaaaggaactgagaagaaacagatctgaagatg

SEQ ID NO: 15909 - DNA, 3003 bp, Unknown; identical to SEQ ID NO: 15908
  misc_feature (1)..( 3003): 2750-1469P.txt file - cDNA_ID_1024003; gDNA_ID_1621094; Annot_ID_170855

SEQ ID NO: 15910 - DNA, 3003 bp, Unknown; identical to SEQ ID NO: 15908
  misc_feature (1)..( 3003): 2750-1469P.txt file - cDNA_ID_1024003; gDNA_ID_2926162; Annot_ID_139742

SEQ ID NO: 15911 - DNA, 3003 bp, Unknown; identical to SEQ ID NO: 15908
  misc_feature (1)..( 3003): 2750-1469P.txt file - cDNA_ID_1024003; gDNA_ID_2926162; Annot_ID_198812

SEQ ID NO: 15912 - DNA, 3003 bp, Unknown
  misc_feature (1)..( 3003): 2750-1469P.txt file - cDNA_ID_1024037; gDNA_ID_1971713; Annot_ID_175142
gaatctgagattttgcctgtgagattcatccccgccaggtcgagcttctcaacattgccatttgagttgcaccgaacaccggtccaattacagtgatcgctggtgtctgaaagcttccagtctttgagaaagttgagaggatccacaagagttgatttcaccgacagcaaaacagagagctcgttgacattgtcgatggaagctaaaacagaggaagtagaaccaatgtaacagtagtaaaggaagagaactattatcttcatcttcatcttcaacttcttcctctgtctcaacagcttcaactgaaacttgactccttagttcattaccaagaacgagactagtgaacatgcaaggaggtggtggaggaagagagtagaataagaagaaactctgtaagtatatgcttgttctgtgtttattatgttatatatatgtgacatataaacacagagatatataaaaatgaatcttggttttatatggatgtagtgatcaaagagtatgtagggttacatgttctaagaaaaaaagaaataaacaagatcttggaagtatttgagaaatttcttaagacattgaacatgtgaagagagaatgtgttttcttcacaattacaactaatccaaaaatgtgttcggtgttttaaaattaattaagtcaactattgatttgctgtatagtgatttgtgaatgtgccatagatagcttaagcttaaactaatactaatataattactattttttatacatacacttggtgtgtggcatagaggtagcttatgcttaacttcattctaattcagcttttgtagaatgtctttatctattttcccacctttttccttttgtgtcttttaacgcttgccttctaaggaagaaaaacaaaaaatataccattagctcttagcaatattcgattacattacatattaatgatgaatcagtgattatattgtaaatctcgtatttaggatatagccaccgaggtgaacgttcgaagcatataagaatgggtgacctgcacatgtgatgaagaagaacagatgatcctattaccctatgctctgcagcatatttaaatatcagataggtccaaataaatttcattattaattaaaatcagcaataatgaagatattcccacgatcgatcttcacgtttcttcttaccccttttgaatttcgaaaagcttctttctatttggttggttaaaaaaaattaagatcgagcccactcatggccattatacgtgaaaacatatttctttagttcaatcatacttaccttgatgcgtaacaaaagtgtgaatactataatgtatgccactgcagagagtgcaggcttgttactgttctttcgtttgcatgattgattagataagaatcttcccatgttacagatttatggcagtgtaatataggtatagtataatattgttgataatataacaaataaaaattaaataaagtggttaattgtatcacttcttgaatgtatcagcaaattgtccctaattaaaatgctactttcttaaacgttcttcagatataaaattctaatttcgtaaactttctacctgatgtctaaaagactaaaagcatgtgtagacgtatacacccaaagtcagtgccaatgcctttaaggtaaagtaaaatggagacggaataaaaaaaacgtacgtcaaacgagagaatataatttttatttttttttcagactgcccaattagcatagcatagtaatttgatatcactaaaaagaatccaaacttgataaataataaccgtgacaaattcaacaccaagatgtttaaaaactcaaacagatatgtatgtatcaagaacgggtcgaggtaaactaactgatcaatttgataaaggataagataagctaaatgctaaatgatttgtgggaaaatggcagagaaatgcacacgcataatattcatcaaaacaattattgtaatactccaacaattacccactcctcttactgatttcatgtttccatccttcttattacagtactaaacacaaactgttgcttcacatgcactcatgtggacctgtcttttatacaattgttttttctttcttattatttgttgtttttagaaaacattccgatccgtagttaagttcttcatttgcttaattatcctttcgatcgttggataaaataccttaaattctacgattactcagtaagtaatttttttttatataattgatagaatacacttttcagttttgaatctttcgactgatcactgatatatacaatatcttaggaaaataaataaatttgatctacaccataaatattataataatcaattattacccaaaagaacaatggatggtttataggagattttatagactatagatcataaagaaataaacacttacaagaggtttgaaggcttaatgggatgcatgtggatcagcacctatagtgacttaatttagtattaatttctgtattatcagagagagaaacctaatcccacaaataagtacctaaactctttgcaaatggtgttttgttgggttatattattaataccatactaattaatatattaacaagtaagtatgtatgctgacgattcgtcacatggccatcagggatcaggccatgggattcgctatggcatcacagacttgagagtccagcttttccttacgatctacacgcatgtgccacgtgtgtttcatgcatcttaaaaacctctgagacagcaagagactctctgactctgtctaaagccaaaatgggtttattatatgacaatttgaccaaaatgggcttattataaacatctcgggcctaaaggtaaaagcccataagttgagacgatgacggtatccaaatgaaggaacggctttggtagtgacacgtcacgattctcccgccaccacaccacagctttttgcttcatctccttcttactctctgtgtctctaactcctcgtgcactcagacatcacagatatg

SEQ ID NO: 15913 - DNA, 3003 bp, Unknown
  misc_feature (1)..( 3003): 2750-1469P.txt file - cDNA_ID_1024045; gDNA_ID_2214551; Annot_ID_134669
gtctattataacttttttattttgttcatcaagtaagatttcaggcttttgtttcgatttaggttacacatattcaaacttatccatatatacacttcagaatctaaattaaagtaatctgatcatgttttgcctaatgttgtcataaactctttagacatgtacatatttcattggaaagttactgaaattattgtttttgtcttatgcgatacgaaaatattatcacacttacctttcaaattataccaaaaaatatgacaatttattatatagattatcttgtagataaccgagaagtttgacatttccttaaacgttacgtgccgtcaagaattggcaaagccactcccaactactcacaaatcacaatccataagtcatagccaagaaaaccctttatgaaacacaaatgtttattattcctgaaaatacaaatttaaattccaatttctaccacgaagatagcttactttataggtatatatattttcttcaccaaatccgtaaaaagcaaaagtgatttgaatttaaatcagaaacgcgtatagattgtgtatatatgtaagttaaagggcatgcatacctttttaatgttatttaatattaatcttaattccattcttcatagacttttgaataaattttatttttttcttgagtttataagtcagggaaattgtcacccacttaaccactaggaaagcagatttggttactgaatctttttcacacctaaggctcaatcaagttttgatgggacctaagttgacctagaactcattttcacacccataataataataatatgacaaaacttatcacactttatttctttaatataagggaatctcaatattcgagtacaacacggaccattgatcatggaatttaaaagactagctagatcatgtacatcaataggaattttggtctcaagtactgtcatgctttgtgttgtgtctcaatcagacaggacaaaaaactgatctcttggttgcacattgggtattaagtatttttcgtctgttgtgtgaatcttaccaagcaatggttttgatgcaaatatgcattacatctggcctgctcgtatgtcccggtctatacgatctgcattatatgtacctggaagctctctaaaatcctcgttgaatatggaatatgcactgcgaaagaaagcatgaaaaaagatcgaacttattcagctctaacactcaaaagagaagatatttcatggcctaaaactcaacaatactcatgaggataccactttacagctaataagaatactagcagaatcttatgcttccagaatcctaagacttttttttcacatctccaagttaccaatgatgtttacgttttagataagtgttatataatttggtatctggaaaatgagttgctatgtcagtcagatcaatggaggctaagtgtttttagaaatgtacatacctaacatcaccaggctgtcgtttaccaagattgagcaagatgattgaaaatccagtccctagtatctgaaaccccccgtgataacaaagaaagccatcaaaggagattaaacagaaacgacttgttagagacactacctctctatacaaaatgtctcatattcaatggcattgcaaaaacgttgggcattttcaggaatccagacattgaagataaagatgacttacaaatatagggcccagatcccaccgatgtgcaataggcgccaagataaaccacaaggtgataataacccacatctttagacttaaagagaaaagtcccataagaatgatatctagaagatcatcacacaaccacagatcaataaactatttgtttcataagttcttggacattgcagatgatgcacatatcaaagattaaagagttctcacctggcagcttcaacttgttacgcagaaagtagtataacttcctcttccaccggcttgctgacggtgggagtttaaacttctgcaatgccaaaagagattttataaggacagaaactaaaaaaccattctttaccagttaagaaaccattctttaccaaatcatcatcatcatcatcatcaaatgactcaactccagctggtggatttggtattacagcaacaataaaggaatctacacaataaaatcaagacttgtgcataacctaaagacgcatttaacaaacacagataagcattgatgcttataacattttcagcagaacctgtttaccttggtccttgagcgtaacgtataaatcatctccatcttcttcgtcttgcaatgcctttccacgaagaatcatccttaaagttgaaacgggaaatttacccttttccgcaattgcatttctcaaatcacgaatctaaaatcagcccaaggatcaatcaatcattcccttcgtacaaaggaattcacttagagagataaagaagaagaaaattctttactttgatatgagacgccactcgaatttgagacggccgagctgggccgatggttttgtacgtgatctcgacggtgccattgttggttgaatctgagctcagctcttcggttgaattcatcatctcaccacgaattgtatgcaatcaatgagaaattgaggattagggtttcgaatttgggaattgaaaaaaacagagtttgttttctcacttgctacttctccgatgacggagagtcgacttgagttttcaatattttcatatctgtccttacatatgtttttaattccacttttaaccccaaaggtttcagagagtataaaaaactccaaaacattggaaaagcaattgtaagagcttctgcgtcaaaaagaaggtttgggttacacttttcatacacaccatatgcataggatgaggccttcaatttctgccttacatatcaaaagatagaacacacacacaaataaagcaaagaaacagaatatctttgagatctcctctttatttggagaagacaaaacacagaacaagaattagaaagaagggagagaaagcaaaaatg

SEQ ID NO: 15914 - DNA, 3003 bp, Unknown; identical to SEQ ID NO: 15913
  misc_feature (1)..( 3003): 2750-1469P.txt file - cDNA_ID_1024045; gDNA_ID_2214551; Annot_ID_185559

SEQ ID NO: 15915 - DNA, 3003 bp, Unknown
  misc_feature (1)..( 3003): 2750-1469P.txt file - cDNA_ID_1024126; gDNA_ID_2926147; Annot_ID_197830
atagttttattggttttctcatatcgttttgggattttctcggtaatgttttgtagttctaactgaaaatatgagtagacaataatgtggttggttagctaatggtgtaagtaatttttttgtttgaatctttgtctacataatatatcacaatggctgatggtacctaagaggaatttcatcattaaatacttgaggttttaaaaaccgatgaaacttaggaggagtaccatcattaaatacttaaagaatttttttttttagtataaaaaagttcttgagttttacactcacacacgatacaaaatcatttgatattacttgccaatgataaaatatgattaacataacgataaacccaaatcacacctccaattgtaaaacaatatgataatataacgattgaaaacggtagaattttgtaggcacacatctgttgtgctagcatgggagcatcggttctctcgccggttaccccttcttgttacatggcttcataccatcggttaaaccatccccggttttgacctcatattttcattcttagtcggaattttgatcttacgataatgaaatcgggagaaaacccttttgaagacatgtctcaatagattcaataaacatttcctcgagactatacttgaagttaaaccccatctctgtgagcttcttggaactgaactcaatactctttagattctcatcaacaccttcaaacctgttatatagagttttgtttaggacaaaacaattatgggccaaaacattttaaataatagtcaacacacttttcagtattttgtttagtaattttctaaaaaaaccaaattttaatcttacacattctattttgctatataatttaactatctatttcattataataatcccgattttgattatgcacacgttattttaatggataaatgttaaattttctatcaaaataatatgtataccatatcaaatgaatataattacttcatactaaaataattaccaaataacaaaacataatgaaccaaaaaaaaagaaaaccacaaaaatgttttagaaaagaaaaattgcttaagatatagttttgctatattctataatttcacaaattaattttacctaatgtcaaactcatattaaatgacttaaaatttataaataaaacactaaaattttatattaactttttttttatatcaaataataaaaacaaatcaatccctttaagccctaatttcctaatttttggttttttcactaatggctacatgcattaaaattgttagactaaaaaataggtataactatacaaatattctcattaagtatagaaataaaatactatattacattgaaaaatacaattttaaccaattcaatttatgttaaataaattattttgttattttaaataaatcattagttattattcatactaatgatttttttttaaaattaatacatgctagatttatttaattgaccaataacacatgtaaaatcaaatttgttaattttccttttgatgaataaaaatgattatatatgtatatatatatatatatagacataaaaattagtatatgtcaatttgtttacttttttaggttttttattttgtaagagaataaaaaaattaaatctttaatgacatatgtaaacatcttatcgttagacttgccacatgtcatgatctcgtgagttactaactttcaaaaccgtactttatataataagatatattgaaagtacaaaaatgggaaaacatcttattattgatttggaaaataaggaaaacatattattatagatatgagatttcgtcatggccgacgacgacgtgagacaaaaaaaggatggcaatttcatttgagaccctttctatccaaatctccacctaaaacctaagaaattgttctttacattttacactagaatttctattaaattcttgccaaatcattttgtcatacaaaaatacaataacttgaataacacttgcttttaatagaattcagaaatccggaaattgaataacactaaattttaatagaactagatgatcacccgcgctacaccgcggttttttcggattttttttattgtttaatttaaatataatcttttttatctactcattcactcatgcaatgagcaattacttttagtattaaaaatatttttttctaacaacgttctcaacaatgcatcatacacataattcataaacaacgtttgtctttaaccaatttaacaaagggtagtgttggattctaaaaacttaagaatttgatgatggaaatccttacgtattatataaatatcaatttaaaagaatataaatatcaatttaagagaataacttactcaaatcattaagtaatccacgactattaaacactcatactttgagtttggattacgaaaaaaaatcttcgaatatgagaaaactattaaaatagttttattgaaaaatcatgtaatattaaaataaatttagtaatagtacagataaatatataaaataaaataatatgtaaaattaaataagaaatatatcattaacctataaattagaagttgaagagcttacattaattattttaatagacacatggcaaatgctaagtgatgatgtgtcaatcatacggaaagagttagccatgattaataaaatacctcaatgacactagaatttgaattctattaaactctgtcaaattccacggtttaataaccccctttataaaagttgatcaactctgatataaactttttgttatttatataagtgttccatcgaaaataatattttaataaatattcatgaagggtaaaatggtctttaactatttcagtattacgataaccctactaatgtgtaatatatataaatcattgaaaaaccctagcagacctcttttgtgttcttcactctccagcgatcgtttattgcttgaagacggcttcttcttctcacaaacctcatctctgctaatcaaaatg

SEQ ID NO: 15916 - DNA, 3003 bp, Unknown; identical to SEQ ID NO: 15915
  misc_feature (1)..( 3003): 2750-1469P.txt file - cDNA_ID_1024126; gDNA_ID_2926147; Annot_ID_139161

SEQ ID NO: 15917 - DNA, 3003 bp, Unknown; identical to SEQ ID NO: 15915
  misc_feature (1)..( 3003): 2750-1469P.txt file - cDNA_ID_1024126; gDNA_ID_1620633; Annot_ID_47303

SEQ ID NO: 15918 - DNA, 3003 bp, Unknown; identical to SEQ ID NO: 15915
  misc_feature (1)..( 3003): 2750-1469P.txt file - cDNA_ID_1024126; gDNA_ID_1620633; Annot_ID_162773

SEQ ID NO: 15919 - DNA, 3003 bp, Unknown
  misc_feature (1)..( 3003): 2750-1469P.txt file - cDNA_ID_1024170; gDNA_ID_1972155; Annot_ID_179455
tgctcaaactctgaagcgatcggagtctcctctggttttgtttcgtctttcttctttcccaagaaatcgaacaatccacgatctgtaacctctgccgatgattcctctgttgctacctttggcacctcctgttcaggaacattcttgatttcctcagccatagttatcggaaaaagattcgatgaatgaaacacggattcaaaagtattttttttatgtgaaggtttgaaattcaaaagcagatgaaaataagaggtgatggagattagagaagaaagtgtgttatatagtgttgaggactcgggaggggtccaagccaccgcggatttcacgctctttgtacactttttttttgcaatttaaaaacatatatctaattatatgaaattacaaaatgacccgctttttatggcatcttctccttcgtccccacgttaattatcatttttctgttaattagataaagttatattggattaagaagaattcattaattaattgttaatagtttgcttacgtgatctgatatcaatttagtggaataaaaaataatggataagaatggcaactagatagttttttttcaaaagtagtgaaaacaaactaaatggtttgttcaaggcgtgtactgtttttaatttaaatattagactttcataagtttttttgtttgttttaatacttgttatgtggactttgtagttcaatgatcggtttatcaagttaaagaaaactgattcaaactttaaatagagtaagaataatatggaataagcaaaaatgttttttcatttcctctgaaagcaaaaataatttatttttgacaacgcaaaagagattttaaagaatgggatgtccctataaattattgttcttaaagtttcgggctttcttatatatatatatatattcacaaatataggaaccatcttgcaaattccaaaaatggattacagattttgaaaggattaacaatttaatgcaccatagattggaagacacgtgtcaagcattagcgcaaatcggacgacggagctcatagtcagaaatggaacgtcggatgtagacaaagaaaagagtcagagagaaatttagattaatcaattacatcttaaaacgtgtcaatataacatgggaagttgtccttttgtaggacccaatagtatgtactgattggcgtaaaagacgtgatgtcggttacgtgggtccacttgacttattgactagtgccacgctggaacaagcttgttcgagaagaaatgatgattttttagaaatttataacgttccttattttttctttcttctattctatgcgttacaaaatacaaacaaaccaataagaacttggttatttaattcttatcacgctatgaatcctcaacgattaggtgttattttaacttattattcactaaacatgttgaagaggccaatctagtaacgcatgatctttgaaattgtaaatacatgatcttggatactctaaacaaaaaaaaaaacaaatccaacaagtaatataagtccgattggctcaatcgattaggaaggtgttgttgcaatgctaccggatctcatttttagtcctaatgctacaataagacgggtaatttgcgcttgtgaatccgccaaaagtattatcaaagaaatgatcgtggacataaacaaactaaaactaaagatttagattttagaacgaatagaaagttagcatcatcttttgtttaccatttttggggcacataaaacaatctttcgtaatctcgtttatgggaaaagggtttgtgtatgtattttttcaacgtaaatggttatgttttcatgcagtttttaaagataaacttagatgtagataatgaaatcatgagtagacaaatgagcataagatgacttggatttcttatgaattaatatgttaatgtgtgggatgtcattttcgacctattgaaaaagatatactaaaaatattaatgaaggacagatggtaatcggtaaatgcatcatctcttaaaattcgcctaaaataaaaaaaatgaaccgacgtgccacatcagtaatctctggtctctaaatttaacaaagacgtagcacgaaccgtgacgtatcaacacacatatcaaacaaacctatctttttcaatactaacttattcgtctttttggttcttgttgtcatatacaccgaagctcagctcttaacttattctttggataatgttttcggtgatagcgaaccgacaaattgtagccgacacttagaattcacaactaaactatagattttaaaataatattaattaattcgaaagtttgagatatctgaacaaagttttctgaaaaacgtagaatacatatggatcaaatactataattcgaaagtttcagattagtgctaagtaatgaacgtcatgcgtttgttcttctgtcgatttcttctttttcaccgcccgtctgagttttatgggcgtgatattttccttattgtggtcaaatcaggaatattcaacaatatttagcactcgctttacttggtgggacatgagaatcaatcgatgcatcgctgttttatttctttttctttgatgtttctatttctgttagaacaaagttttcatgattcttaaaagcccaaatttcatggcatcggaacaaagttttcatatatgatgacaactcaaaacaaaagagtaacggtaaaagcccaatacccataaaatgggcttaagaatccagatcggatctataacccgacccggttgttgacaccgagagagtccacgcaacgttcgccgaattcctaacgaatcggacaccgtttcgtcgctgtaaaattttgatgcgaaattttccaattcacagattttgtttttccattgttttggatttctagattctagttatatgttggtgatagatttttcctacatctcgtgattctcaaacgcttcttgagctcttcgtcgaatcgggactgtgatcgggacttggtggagaagaagcgatg

SEQ ID NO: 15920 - DNA, 3000 bp, Unknown; identical to SEQ ID NO: 10522
  misc_feature (1)..( 3000): 2750-1469P.txt file - cDNA_ID_1024257; gDNA_ID_2213659; Annot_ID_132510

SEQ ID NO: 15921 - DNA, 3000 bp, Unknown; identical to SEQ ID NO: 10522
  misc_feature (1)..( 3000): 2750-1469P.txt file - cDNA_ID_1024257; gDNA_ID_2213659; Annot_ID_181811

SEQ ID NO: 15922 - DNA, 3003 bp, Unknown
  misc_feature (1)..( 3003): 2750-1469P.txt file - cDNA_ID_1024370; gDNA_ID_2214471; Annot_ID_133076
gcaaccatggagcaaaacatgaaggacacatacaatatccccagagagattgttcccaaatcctgaagtaatcaaaacaactcaaatatcacaacacacacacacagtctaacatgtcctgctcctaaattcatattcctctctcttaagatccatcaatacaaaatgacagtataatttaacggtagagcaccttatttacggtagtttcgaggttctgagcagcaccgtaagcgaggaagattagcagaaaggagatgctgaggatatgaacatcccttgtgtagcactttccagctctgactttccgatcctcaccagaggcagagatcaacggcgcctcctcgtcgtttcgagattccatggcggagatttagtccggtcacctcactgactacagctccgggaaagatgagcggtgctccacggagagagtgaaagtcaaactctgtagagagagagatcgatgcctaccgtttcagagatttggaacttccaagaccggtgatgattgcggttcggtttattttggtacggtatttctaatttcaatttatatcggttcagactaaattgagattggtgtttgttgggctgggccaattaaagaatctcaagatttataatttccgtttatttcccggggaaactgaggaagaaacgagatcctttacaattttgtatttattatacccaaagatttgtaaaccctaatttcaatagcatcataacgtaaaatcaatcatagaaaatatcgaagagactgccgaaaattatatctttgaaatcaactggtgaacatattaaccgaaaataaaatcgaagagaaaaaaagaacctaatctaagaactggtgaatttggtgacggctttggtaccctcagaaacagcgtgcttcgctaattcaccaggcaacacgagccttacggcggtttggatttcccgggacgtgatcgtcggtttcttgttatacctagccaatcgcgacgattccagagcaattttctcgaaggtgtcgttgatgaaactgttcatgattcccatggcttttccagagatcccgatatcaggatgaacttgtttcaacaccttgaataggtagatcttgtacgtctctgtgctcttcttagtcttcttcttcctctcgcttcctccttctttcgtgatcttcttatctgcctttggtgctttctccgacggtttcttctctgccttcggtgccattgctttggataaaattcggatttcgcgactagttgtaaattgacgattaatgatcgctctccgagtgataccgagatatatatagaggtgctgatacgaacatgattggtttttgatcaatctcacggatcgtctacgtggcgttatcacgtgcgttgatacaagataatctacggttgaattcacgagaggaaccgaactaatcgtgggctcatctaatgggccttggccttttacaagacggcatcctttttaaaaaatttcgtcgatttccaacttatttgctctgctcttctttaatctgctctgttcttctctttccatttcagcgttgacttagttattgggatttctcagaagcaaaaatggcgtctccggcgacgtttcaattctctagaacaaaacttaaccttcagatcaacctcgtcgagcgaaaatctccttcaaaactctcgtttcctcttttattcagagaccaagcaaagtcaacaccaatcagatttcccgtcataagagcttcatcatcttcgtcggcgtcaaatcataaaccttcactgcttaaaaccaccttcatcagcctcaccgcagccgcagctctgttctcagcatcgttttacttcgtcaacaaacgcgccgcgatgactccagttgctgtggtagagacgacactcgagaagcacctcgagacacaatcaaacgatgtgaatgctttatcattgctgacggaaatcaaatttaagtccgataaacatgagcaggcgattgtatttctggaccgtctgatcgagatcgagccatatgaacgaaaatggccggctatgaaggctcggattctctcataccacgggaaaagtgaatcagcaatcgaagctttcgaggagattctcgaaaaggatccgatacgcgtcgatgcttatcattacttggtgatggagtattacaactctaaacctaaattaacagagatagagaagaggatcaacaaagtgattcgaagatgcaagaaggagaagaagacgaaagagattctcggtttcagaatgttgatcgcacagattaggtttattgaaggaaaatcagttgaagcaattcggatttgtgaagagctagtgaaggaagatccaaatgatttcactatatatttgtttcaaggagtcgtgtatacattgatgaataagggagaggaagctgcgaagcaatttgagcatgttgctagggttataccaaggaatcacccgtctagagagactgccgcgaggaccacgaactcaaatgaatggagagtcatcgtagcttacgataatgtctactgctatttatctacatttgctaggctttccatggcttctttgtttaataagtttggctaagtatggtggaaattgaaaaagttcaaaactctctattgatttttgtttgtgattttaacactttgtacaaagattgggtgagtatttgtcatttgagaagcggaagcttcattgtgataataaagacaagatgaaattagatgatgcaatgtgactgaaaccataaaggtcacgtgcgtttatttgctttaggcttctcgtaatgaaagtgataatacatgggctaaggcccattaagtatttctcttaagttaagctattgggtatgaataatgagctttataccacccaataaggagactcgtcatatataaatgaccactcctccgttattagggtttctgattctcggagctaaaagaagagcaagcagcggcgcagaagttgaacacaagtgaagctcacaatg

SEQ ID NO: 15923 - DNA, 3003 bp, Unknown; identical to SEQ ID NO: 15922
  misc_feature (1)..( 3003): 2750-1469P.txt file - cDNA_ID_1024370; gDNA_ID_2214471; Annot_ID_183015

SEQ ID NO: 15924 - DNA, 3000 bp, Unknown; identical to SEQ ID NO: 7337
  misc_feature (1)..( 3000): 2750-1469P.txt file - cDNA_ID_1024400; gDNA_ID_1621141; Annot_ID_56630

SEQ ID NO: 15925 - DNA, 3003 bp, Unknown
  misc_feature (1)..( 3003): 2750-1469P.txt file - cDNA_ID_1024400; gDNA_ID_2926149; Annot_ID_139242
cagcattttaaactaaaagaataatctaaaaccactattttcagctttgattccaaaaacacaataattcttttaagaagatgtacaaaaattcgaaaaaactaggtagatttgctaaatttatccccaataattacaaaaccagataccaaatcaaaacacatgtatattatttccgaactggttcggattaattgattttcaactcatagaaacagcataaaacataggggtaattagaagaagaaaaattatggtaatgtaaatttaaaataatgtagacaaaatcaattaagatgttgtatttgtttaattcttgaccgccactatatgtaaagcctattcttgttcgacgagcagtttgctatttttgaaggctttaaagatttgtttgtcggtcttcaaaaattatatatgattcttttttgtgttttgttctcattcaaacactaccgaaaatcactttccggtagatcatctatcatgaaattgctccagcacaaacatgcttaactgtaaagttttttcgatatgtttaatcgaaaagataagtgcatttcgtggatatagatgatctaattaatttttaaaactcttttcattcactactatatatcctgaaatcgggatgttacaatttatttctgaatttttttaagtgtctcctacataactagatatgttacaaccactatggatcttatttctaaaaagtattgaatacatcatgtctaaattgattaattctcaaatatactacattttatgctattttctgtaacttccatcagaatccaaaatttttttttaacataccataaattttaattttatgatttatgaaatatttatagattttattattttaatatttttaaaaaaatccaaaataatagtatctttttagctaaaatttcttttactgtattttaggatatttctctatctaattgtacaccatacatataaccataatttggtgtaattcagatttaaattaggatgacatcaaaattagtcaaaatcaaaatagcatctctattttattcttatacttccaaggaaaaaaaataaaagagctttaaacgtgtcgttatagctgtaaagctggtgatggaactggtaagttggtaactgcttcgaccaccgtacgaatatggtggttactggttaggctacacggtaatttcttttatttacctgcagtgagaaaggtaaataataatgagtgagagagtaatggataattctgaatttgtaatgtcattgtcattgttttgtcagtaagtgatgctttagttaactcatgtttatccatatgggccattctatgtttcatatatatatatatatatatatatatatatatataatatgttattttactttttataattttgattcttagtctttatcagaaaagaaaaagaattgattcttagttcttggatttatgaaaagtaaataattatgtgcaaagagattctttgataatttttcaatataataaaatattaagaatattatttaaaaaaaaaaaattgagggaagagattcatttgattttacgaaaacgctaaaacgagatggattaaatgttagcctttttcatgacaaatatgttgtaaagcataatcatgtacaaggtaaaataattttgggtttttagtgtttatgtcgtaattctataatttttctcaactacttttttctttgtataatttagcatttttaatatcaaacacttttgattccaaatacagtttatttttattttcttaagactacttaccaaacacacataaacggtttttaatatctaaagttaccaaatgtatgtatttcaaaaaacaatcatcagcaaatttagatgttttgaatttttattagaagaaatgcattgcatggttataattagaaaattaaaataaaatataaatcaggattatatgaccaaaaattgttttaacttttacttagcatttacacataaattaacagaaatataatattttttaaaaaataattttcttataataaaaattgttatattgaaattcgaatattaagatttggcaagtcgccaaaatataatcacactcaacaaatttatattgtctcactaattatctgttcataatacatatatcaaatgtataaatcttaatataataaattttaaactaatttcaactgtcatactaaacaagagtttatacaagtctttacctagtgttatactccctctggaaatgttaaagcttattgtttaagaaaacatattatacacctaaagaaaactatgcattcgttttgtgccatgtgttgttttactagtcgtgactcgtgattctccatatcattacgttaatcccaactctcaactattattatgttattttttactatagaatggaaacttgtagattacttatatgaaggttgattaaaatgtaattaaaatctgtatcttttttataaaaaaagtctcttcatatatgttttagttgatgagtgatggacaagtaaaaataaataaaataagtacatacgttttgttttagtgatataaatatatgatgccaaaaatgtacatatattttctggataaatattagagttgtagatccaggtttgctatgatctagctctgtccgaaaattgcagagcgtgatcttttctctgtagtacgaccgatttgttttactttatccaatcgttttaactttttcaccacggttaaaaaagttaaaatcagatctctaaccattttctcaacgaacctcgctaatatttctcatttaatcaaaatttaatcaccattaatcctttggttgattactcttttgtcctcttcttcttctctcttctctttcttggtggctctcttcttatagccactgttccctttttcattgtattcctcaaatctctttacttgatcgttggttctctcaaaaatcagatttttatttctgggttttgttcgattttgtgatcatg

SEQ ID NO: 15926 - DNA, 3003 bp, Unknown; identical to SEQ ID NO: 15925
  misc_feature (1)..( 3003): 2750-1469P.txt file - cDNA_ID_1024400; gDNA_ID_1620725; Annot_ID_49269

SEQ ID NO: 15927 - DNA, 3003 bp, Unknown
  misc_feature (1)..( 3003): 2750-1469P.txt file - cDNA_ID_1024576; gDNA_ID_1620673; Annot_ID_48189
ttttctattgataaaatttgactgtttacttatttacaacaagaagttttcattttagaaacagtcttcacttggaaactttattaacctcaaattcacctaagtattctacacatattgtgaaaacaacaaataataatagtcattataattaaaatagcagtaatggtttgactaatgattttaaaagtccactagaacagcgattcatcaatacgacaaaggaaggtgaaaagctgactatttaaaatgttaaagtagtagtgctactaaattattgtaagaaaataaaaaataacgaatttacgattatttctttgaacataaagctatttgacgacctcggtaaccgggtggtcccattaactcttatatgaaccactggattttcgaaaggtcaatccaacggtggatctgtggatacaagtgttgactatgtttttatgattttatgagcctattaaaatctccagccagctattaagttcttgtcacgtgtcgacttttgttatcatgttccactattgaaattgtttcaaaaatgaatggaacagaaattaggcaaggcataaaattgagaaaaagggaaaaaaaatttatttagtgttttgatgaattatttttgtttgtagaatttttattaacgaatgattgaaaaataaaaaatatcggaaattgtatatagtgacataaaatgtactcgtatgtatcaacattatcttggatactagtccattggttacaaaaataaaatcttccaacttggattttaatcgtattcagtaattgtgattatcttagctggcaataattatattgtctctctatgttttggaaattaatctggacttcagcttaaaattcttaaattattaacaaaataaaaaatgaaaatagaacgtgttgagtgttcatgtaacgtgttttatggctatatatgggtggggaagaaaccatggattgttgttatttaaaacagtttcttatgtcaacgattaaattataacatggggtagttgacccgatcgaccgagttgtattattattgtcgtgcacgtctatattatctacatagttacaaaatctcaatgatcatccttttttctatgtctcaatcactcattgtgttataatatttctgagcatctctttttcttcccgatcaatatttgtttggttaacattagaataagataacaaatatatatttgtaagagaaaaaactaacatgtcaatgcggttttggaactagtctttcactaattttaaaagtaaacttgtttttgttctatacatgcggggtaaaatcgttccccgtattaaaactacaatgaaacataaaacaagataaaaaaaagtaagatgatttttagaaaactaaaaataaaataataaaattatgctcgtttttctctggttgtatttcgttccaataatttatattattattttctatcaagcaggtgcaagaaacgtgttcgttaaattgcatgttgatataaaaaaaaaattaaaaaaaaattgcatgttaattctatctctacgactctgcaacgttacgtactatttattttgtcgtattaataattgagtatattttgtacttcatgacaagaagttacataacaatttaacggataaaaaatattaattcaaataatcttgacataacaattatgttatttttttttaacaacaactcaaacaagttctttaaacaacaaatgttctgatcacaaatctcttttttttttttttttgtcaaggatgattataaatcttaaaattagaaataactacagagtttatatacagagaaatatgggatgataaaaaagactaatatttgtagtcctattagttttgtttcataagtcttaatctcacttcagttacagttaatacatgcatgatcaattctactatatatgcatatataatgcatgcatgttgtagagttgagggttatgacacaatgctatgcctattttacttgtactaattaaataaacattgaaagaaagctgtaaggaagaatatgtagataaaagacaaaaagtaaaatgagagtggaatccaatgtggacttcaactagatgtcatattttgtatttttctaatatcaatgtttaacgcatatttggatgtaacgttgggtgtcgaataattttgctttatattcttcactttaacgtctaaacatgaaccaagcacatggtggtcttggaagatgaactataaatatcaagaaaatgatgtataatgggtgatccaaaccaaagcacatataatctctagagttaaagtgggtcgaataatctctagagtttgtggaacgcatagtatctttgccatttaacgtacgtacgtatctagaaccaataatgataaaaactgtagtggattaattactcgaaactcaaaagtcttattcccaacatcaagataagtggtaaattttaatactggaataaaccattatcccacgaaagagaatattataaagtttatatattggttgactttgtgttaaataatgatgggattatattaagaaaaacttgttaaatgaatatcagaatcaataatcgtatcaattagacaacttgattaagatttgattctggtcagtaaaatatatgaaacatgctccatatgctatcatatcttcaataaaataaacgaattgaagacgagtatatcgctatcatggcaggttccaattagttatctccatcctcttttttgtttccacaaaggagccactttgtgttctttatttttgaaaatgtttgattggttaattaaccaagtgaagttgtaatactattatgcaagaattaattgcagcactctatgggtttcgtaatttggttaatagtttaatgggcctcgtacaagtcagcccattggatatatttcagattaatcgggtcgggtcacaaatgattatccttgttgccttgcctttgccaatcgtttgtttccaaaataaaaatcatg

SEQ ID NO: 15928 - DNA, 3003 bp, Unknown; identical to SEQ ID NO: 15927
  misc_feature (1)..( 3003): 2750-1469P.txt file - cDNA_ID_1024576; gDNA_ID_2926200; Annot_ID_141467

SEQ ID NO: 15929 - DNA, 3000 bp, Unknown; identical to SEQ ID NO: 6000
  misc_feature (1)..( 3000): 2750-1469P.txt file - cDNA_ID_1024639; gDNA_ID_1620835; Annot_ID_57957

SEQ ID NO: 15930 - DNA, 3003 bp, Unknown
  misc_feature (1)..( 3003): 2750-1469P.txt file - cDNA_ID_1024639; gDNA_ID_1974092; Annot_ID_180635
atatataaaccaaaaaaaacaatttaaattgaaatccaaacaaatctagatgtccgtataaaatcacgtttaaaaattctaaaagttatcatcaggtgtgacacatgtataatcaattgtattatccagaacaatgagttgatgtcaatgactcgatgctatgagcttatgagtagatcatacaatgtggacacgacaacctaaatttaacaaaggatataaaattgtgaactgtttttctgccaaggatttaaaattcatttagcgttgtaatttggtacacacatatacatattaataaaatctacggcatattattaacgaggtaatcaacatttagggtataaatggttgcaaacacgatcaatcatacaattaggttaaccggtttgtgacacaatgggcgactcaggataagacatggaggaggagctgatatgataagacgaagttaggtgatatatatagagatgtaccagagatcataatgcatatgaaatgagatcgatagctgtcttctcttaaactgaattacgacctctctatacttctggtcctatccgtgagtcatgtgctctctgtctttagtcataatatgattttgaattggctctgcaccattcaagatcatggcccattatggttctctgcacctgattctgtttccataataattccatttacctacaaggctatacatataatttattagtataataaccatattatgagaagattaattatactgttcatacggcaattaagatatcgatgcgaaaggattcgtgatctttatagagtttatattccgccgttgctagctaatcatgtttattttgtttctctagtacttaacgcgtttgtcaatttattaaattcgattagctaaaaaaaggatttgactcaatttcatctttagagacttacaaaccaatttatacaaatcaattttttatagatgttacattttttcgttcacattaatgacaggttttcttctttctatgacttaaatccacctaactccaaaattaaatccccaattcatgttaaagaagtgaatttcaacgcttcgaaaagttaataaaagacaatgaagaacatacatgaaacatgcttagcgcctagcggacgagcctcttaattagaaccaagtccttagaaaattacaaaattttaggtatatgccaaaaatcaaactaaagttgtcgataaccatgataaatgttgcgtatatctatctaagaaatatcacgcctaaaagataaattttggtacaactctcctcaacgttcatttttttaatactctgaaataccacaactatattccatatagatgaggtttgaggtttctaagacttttaaaacttaaagtcctagaattaaagaaacgtgtaacctttcaagtttaatatgggggaggtttggatcggcggaagctaaaaacagcaaggatcaggacaacaatggcctaacgaatgacacgtgatgctcttttcatgttgctcaacttcgatagcgaccgtttttctatttttatcactttcatattttacccccaagaaaaacaaaaacaagcgagtccgatatgtttaagagtcccaacctaaaatctattttcatcaccttccctatatagcccgcacaccgcacacaactaatacctcaaaatattaatttgtttgtgtttgcgcttgtttttatgttcttaacatcagggtaaaatgtatcttatgtgattagttttagtgggatactctacatagcattcacatgtctattagtttaaatacgtgtatgtcaatctaatgatacaattcagttcgcatgacttgcaaaacataaacgtaaaaagcaacacatatgaaccacttaccacaattttcgctacaactttttccaccatattagcaaaaaaaacaagggcgaataacattcatttggtataatccataacgatcaaattatcgattatcatcactacatttagctagagattttctagcctttctatttgccaaaccttttaatccattcttccttttaaaaaaaaaattatttatttcttttcaatttttatgaaaaccgtatctttaactaattgttatccttgctaatacatgcatcaacattttcttaaagtttttggtaaaattaacacataagaaataagaaatagttttcttctttaaactcgtccttatcacaaattttagattgtatgatattaaattcgatcttatcttaaatactttaaataacgttttatttactcttctcatattacaaatttactacactgttgcttttctatgttttacaattatatttaggagatcttttgttgtattatcaatactcttagatattcatttatgtagttaaaatttattaagattacttagattttattgagctttgaaatatattttaaaaaaaaacttttaattacacgttggtaaaaaaaaaagacacgtatgcaaaagcaccaaaaaaggtaaaaccggaaaaattctcaaatttcaaaattacccaaaaaagcctttaacctaaccaccttactttataaacaacctcaccgtctctcttagctcaccaacaatcacattcttctcccataagaaaaaaaaaataatcaaatcctcctcctctgcttcaccaccaaaaagcatattcttctctcgtcttctccggttaatcaaaatctctccgtgtgaatcgtttgtgaatggtggaaactaatccgatcggtggtaagtttacgctctccctttccatcaaaagggcgagcttttctcttcctctctcgacatcctctgttttcgctttcggatcttgcaaagaaggctggtactttcgctgccttggcctcgacccgtgaacgattcgcccctaaaattcacaacccggaaccctaatttcctaaaaagtggttctttttttattgattctgttacttgtgagatttgctctgttttttgttctctcgatttcgaagatg

SEQ ID NO: 15931 - DNA, 3000 bp, Unknown; identical to SEQ ID NO: 6000
  misc_feature (1)..( 3000): 2750-1469P.txt file - cDNA_ID_1024639; gDNA_ID_1620835; Annot_ID_169834

SEQ ID NO: 15932 - DNA, 3003 bp, Unknown
  misc_feature (1)..( 3003): 2750-1469P.txt file - cDNA_ID_1024765; gDNA_ID_1972069; Annot_ID_178530
gttattattcttttggaactgatacactagttgatgcagttctctcattttacttttgtttgttgaatcacctttataattaatatagattacaaggatttgcaagctataagagctacagtttttttttttttaaacttgcttccatttctttgtacaacataacaaaacaacacaacatctcatgctaattcaaataggtcaagtatgctactttgttgtccaaacatagacttgtcctccagctgtggatcctgcaagcgttccaacattataaggatggcaatggattctgcatggtatagctctctgcagagggttatgcagttccatcactgttcgctttagttttggattgatcacatcaatcttctttgacaaattgcccacatagatgtatgaatcatcccacccccatactgccctgcaatcaaaatcattaccaacttcagtttttcgacaaatagacgaaatcaattcctacttcttttcatttctcataacaaaaaagagtggaaaaagagtgtattggtcagagaaatagtgaaagactcataacaattacttgtggattcttttgtcagaacacagtacattaagcaagaagtgtattggaactgagaggcttattaaggtacaagatactggaacatacttgaatttggagatccatctgctggtgttattgtgatatatcatgcaagtgttctcaaaattggcgccgcttagaacaccaatgtagttgtcaaggctacaaggaaaacaaaacaaaacaagagttcagcaaaccccagagatgcacatagggacctacattatacatcagtttcactctctctacacatgtttactcttgtctacgttgctaaaagtttatgagatgtatttatttcccgtctcaaaaccatcaaggcacaaagttttctagctaagtaaagttcccagacataattgcttcaaggcagtggtgttttttcaaatatgtgcaacttttaaaccgaaatgcacagactttatgacctcaacaaaactagaacatatattacttaatctctccaatataatgacaaacaacatttgatgtgacttaaatcaaggagattatacttgtagttcttaatgaagtgtattgaataggctgtggaaaaaatgacaagataccttgtagttgcaagtgaaaggccagaaggtgagaaataagcagagtgcacagccctagaatgattaacagtagacaatgttttcggttttttggctcccatgcttctcaagtcccaaaggcaagcagttccatctgtggaacttgtcgccatgacatgcggattctgcgggttgaagtctatagagttaatcctccgttcatgtaactcccaatggaaaactgactttcctgctcggaggtcccatacattgaacactccataatcctgaccaaagtacaagctttgctcatcatttggtctctgcgagagtgaaaatatagcttcgtccgtggaataaaccagatcaaaaaccgacttctcgacatccatcaaccggatgagaccatcatagctgctgctaataacctgccatgaatgcaccaacgaacttgatgacttaaagaaagagataacgtttctccaatttcaatagacaactaaataaagacaagtcgtttaacaaaaaacttacccttgataaagagttttgctgaaacacaatagatgaaactggtgctgagtgaggagtgaatagatatatcccatcattatcttcctcattcccacaatccaaattccaaaacccaacattcccaagtttgtcccctgcagcaaccatcttaacattctcgcaaggtaagaactggacaacaaaaatcctcccaggcacaacacgagctacattctgcggttctaaagtcaacaaatccagatcaaactcaattttctcaggcttaaccggaatactaaattccttgttcacataatcactgaaggaatcatcttcaggctcttcctttttaacagaaactttagatacacgagaactactcctagtcctcaccataggagactcgttctcatccttaaccactccaatttctcccttaaccaatttgcctctacaagacttactctcaatacccaaaagagtatcaaccaattgcgtataagaaccgtatccttcatacgcggattcgaagggaataggagccaaaagacgcggcgattgcttctgaggagatggttggttgtgtgtgatctgagaacccatccggaaatctgaaaagccatcaggtaagccagcggaatctggattcaaacctctggtgcgtagagacattcggataacagtgggcgttgaagcaggtttgggcttcttcttcttaaaagatttagaatcatctcgagagcgtttggcggcggagagaagagaagaagctttggcgcggacattgagagcagccaacatctcatcgttccgtcttatgttctccaatctcttccgctcgtactccgtcgccattgattgattgatgcttgagaaaattgagattttttctctttacacacaaacaaaaaaggagagatttttttcttcacaccaaaactgaaagaagacctagaagaaaaagaaaaaagctaacaacatttgatgggtcggaaataggcggcagaataacaactgccgccaaaaaaataaaaaaacgaaaatatataattacacatttacaccaaagtgtgatctaaattgaacggtgcagattagtttaacatttatcccaaattttaagaaccgtacgatggagcatcttaatgacttaaaccctaaaagaagaaaaaccccaatcgagctctgtcaatggctcgcttcgtcagatgtctgagaagaacactcttttctaattcgtctccttctattgctcaccggagccctaggattggtttgcccacgaatctaaatcctaaaattttaatcagccgcagatgtctgagctccgggagttacgtctcagaaatg

SEQ ID NO: 15933 - DNA, 3000 bp, Unknown; identical to SEQ ID NO: 6872
  misc_feature (1)..( 3000): 2750-1469P.txt file - cDNA_ID_1024765; gDNA_ID_1621110; Annot_ID_171771

SEQ ID NO: 15934 - DNA, 2552 bp, Unknown; identical to SEQ ID NO: 99
  misc_feature (1)..( 2552): 2750-1469P.txt file - cDNA_ID_1024912; gDNA_ID_2569; Annot_ID_145788
  misc_feature (1)..(1): n is a, c, g, or t

SEQ ID NO: 15935 - DNA, 3003 bp, Unknown
  misc_feature (1)..( 3003): 2750-1469P.txt file - cDNA_ID_1024961; gDNA_ID_2926258; Annot_ID_143163
acaatttaagataagttttgacttttgactaaatgattaatagtaaatgcaattactaattacaacgaaagacagggaggtatggaacaaagagagtttccatttgtaaacgaatagttaatgtgaactgtgacaagggttgtggatgattatgactattcgtatgattagtcaccattccttaatttcttgttccctcaattaagttgtcttctcatcatttttttttaaaatattcatcctgaatataaccaacaaacaaaaggttcgagtatctataaattccgcaatgcaatctaaattggactactagtgagatctgcaacagtgaaaagagaaaacaaaatggacttgaagaggttttgacaatgccagagataatgcttattccctaatatgttgccagccaagtgtcaaattggctttttaaatatggatttctgtatcagtggtcatatttgtggatccaacgtattcatcatcaagttctcaagtttgctttcagtgcaattctaattcacacgtttaactttaacatgcatgtcattattattacttcttcactaagacacaatacggcaaacctttcagattatattatctccataaatgaaataattaacctcataatcaagattcaatgtttctaaatatatatggacaaaatttacacggaagattagatacgtatattagtagatttagtctttcgtttgtgcgataagattaaccacctcatagatagtaatatcattgtcaaattcctctcggtttagtcgctaaattgtatcttttttaagcctaaaagtagtgtattcgcatatgacttctcgtcctaactttttttttaattaacaaaaaaatcgaaaagaaaataatctgttaaatattttttaagtactccattaagtttagtttctatttaaaaaatgcttgaaatttgacagttatgttcaacaattttgaatcatgagcgatgtctagatactcagaatttaatcaagatgtcttatcaaatttgttgtcactcgaggacccacgcaaaagaaaagactaatatgatttttatttggtctggatatttttgtagaggatgaaactaagagagtgaaagattcgaaatccacaatgttcaagagagctcaaagcacaaagaaaaatgaagatgaaggactaaagaacaataagcaactacttataccctatttcccataaaggattcaggtactaggagaagttgaggcaagtttcacatgcaagtccctgtcatcatatatccatattataccacacctacgtctctatgtgtatttcttggcatcgactttctcatgaatgattcaaattttcatttatttttacaatttaattcacctaagattattatgcatttctcatcattggtacattttctgtatagcgtatttacatatatgaaataaattaaatatgtcctcacgttgcaagtagttaatgaatgtccccacgcaaaaaaaaaatccctccaaatatgtccaccttttctttttaattccaaaattaccataaacttttggtttacaaaagatttctagaaattgaggaagatatcctaaatgattcatgaatccttcaataatctgaagtttgcgatattttccgattttcttcaagagttgcgatatttgtaatttggtgaccttaaaactttttttgataaagagtaaaacgttttttcttaaaagtaaaacttgattttatgttttagggttctagctcaactttgtattatatttcttgcaaaaagagttcgttaactgcattcttcaacactataaagtgattatcaaaaacatcttcatgaacattaagaaaaacaatatttggtttcggttagagcttggttttgcttggcttgattcacatacccattctagactttggcataaatttgatacgatagagagcatctaatggtaatgcagaagggtaaaaaaggaagagagaaaaggtgagaaagattaccaaaaataaggagtttccaaaagatggttctgatgagaaacagagcccatccctctccttttccccttcccatgaaagaaatcggatggtcctccttcaatgtcctccacctactcttctcttctttctttttttctttcttattattaaccatttaattaatttccccttcaatttcagtttctagttctgtaaaaagaaaatacacatctcacttatagatatccatatctatttatatgcatgtatagagaataaaaaagtgtgagtttctaggtatgttgagtatgtgctgtttggacaattgttagatgatctgtccatttttttcttttttcttctgtgtataaatatatttgagcacaaagaaaaactaataaccttctgttttcagcaagtagggtcttataaccttcaaagaaatattccttcaattgaaaacccataaaccaaaatagatattacaaaaggaaagagagatattttcaagaacaacataattagaaaagcagaagcagcagttaagtggtactgagataaatgatatagtttctcttcaagaacagtttctcattacccaccttctcctttttgctgatctatcgtaatcttgagaactcaggtaaggttgtgaatattatgcaccattcattaaccctaaaaataagagatttaaaataaatgtttcttctttctctgattcttgtgtaaccaattcatgggtttgatatgtttcttggttattgcttatcaacaaagagatttgatcattataaagtagattaataactcttaaacacacaaagtttctttattttttagttacatccctaattctagaccagaacatggatttgatctatttcttggttatgtattcttgatcaggaaaagggatttgatcatcaagattagccttctctctctctctctagatatctttcttgaatttagaaatctttatttaattatttggtgatgtcatatataggatcaatg

SEQ ID NO: 15936 - DNA, 3003 bp, Unknown; identical to SEQ ID NO: 15935
  misc_feature (1)..( 3003): 2750-1469P.txt file - cDNA_ID_1024961; gDNA_ID_2926258; Annot_ID_204630

SEQ ID NO: 15937 - DNA, 3000 bp, Unknown; identical to SEQ ID NO: 7610
  misc_feature (1)..( 3000): 2750-1469P.txt file - cDNA_ID_1025036; gDNA_ID_1621154; Annot_ID_56964

SEQ ID NO: 15938 - DNA, 1018 bp, Unknown
  misc_feature (1)..( 1018): 2750-1469P.txt file - cDNA_ID_1025094; gDNA_ID_1591353; Annot_ID_150865
ggttgttgttgcgagagtttgctttatccctgtgatttaatttataaacttcaaatctaccaatattttagtatgcaaaatgttagtgtgcaacatacaataatatgatggtacgaaccttttgggaagtggatggaaaaaatacagactavcaataaatttaggatggtacgaagttgtatgttcaattacatattactagtgaaattttttaggatttgaatggttacggcagttgaggcggacaaaaccgtcaacggatcagaccgttttttatttaccattcatcaattatagtccgcagtggtttggactaaaaaaaatagaagaaaaccgatgcggaccatctgccgaccgtttttacatacaaataaacttggtccgcagcggtttattgtccgccccaaaaatgagatgaactaaaccgcagacaaattagaccgctttgtccgctgcctccattcatagccctaatctatattaatgcatattaatccgcaatagtgaatgatgaattaaatacgggcttattcgatttcagtcagatttgcatcatactacacaactatttatattttagatttggttaaccaacttataaaaactttaaatactacacaaccatttgttttttagatttggttaaccaacttataaaaacttaatttatataatcttgttggtttttgttaattttcacatagatgtccaattgttcccacacatctcagttttgatatccatcttcttatcttcgttaaccacctaccaaatgtcacgtggacgctccattcggtttctatccggattcgcggtggattctcctcccaccccaatcatcggttcatttcagcatttggttatatccaaataattttaaccggtttataccgaaactactcgaaccagacaatctttgattggtagaaagagagccacgtaagattatctcttctaatggcaaattaaccaaaaacgtaactgaagatccaaagagagagagagaaaaaagacgatg

SEQ ID NO: 15939 - DNA, 3003 bp, Unknown
  misc_feature (1)..( 3003): 2750-1469P.txt file - cDNA_ID_1025117; gDNA_ID_1620689; Annot_ID_48539
agtaggttgtcacacacaatcttcccaccgtgagacgctgcaacggattaagataacaaatacaactcctcctgagctgcaacgaaattccattcatacctatactttatatagaccgttctagtcaccaagcacacaaattctattattcagcattgctcctcttttctaaaaggaactagcttctaggactttctcacaatatataaaccagatgaccaaaattcgaaaataactatagctatgatctttaactaaaagccacagatagtcaataaacggttaacagttagtatgggccagctcatttaaacgagaaacccgaagggttcaagcctcaaggcctttgacacattttttttgtgtgtgtttgctaagtccaaaaacaaataaaaagcgtctttgacaaaataaaattttacatatttttgaagttgatggatttttcatttttccatacatttggtatttggatataccaaaaacaactttaaaaaaccaatttaattaaggtggtcgttttcaaaatattattatacacatgtttgatgtctctgtgtcttttatattctttttcaattgcaaaataggagttcgggttgcatgattacaaatgaattatcagcaaatccatcttattcaatcgttttccaatcctaaaatgcaaatttctctggaagtttagaagattgtaacgtgaaaagaacagagttagattatgaatccggaccatccggtctattgacatattttgatcgccagttgttgtgcacttgactttttaaatattcagattattgcatgaacgatgaatcattcctttgatataattaaagaaactaatgattacataaaacaacacgaccaacggcgtcgcagagggacgcaattgacgaattaaagatatcataggtcggcataaaatgacaagaacaatctgataataccttaattttccacgtttcaatagaattttataaagaaaaacatagatcaatcgttagctatctaaaatttaggaaataacatgtgtggactatatttaaagtatagagagacctcaatccatttgtttatcaagtaaattggcgaaatttgttagtatttaacattcgatggaactgattccttatcctaaaatgacggattaaatttcagttttcgtgaaaacccaaacatagtggtcaggtggaaataccacaagttttcatatcatttatatatcaattgaacatttcttattctacatattggatcaataagattctgcactttcaaattagtgatgatcaaaagaacgctacattacacataagtaggtatcgtccctttaacaactcgtaaaaaggggacatctacaagactactagctagtaaaaactgagaaaataagctatatttgatcatgaaacaaagtgccatgcaagtactaatgtttgggctaaacttattagatcatggaaacaagtcccaccagaccacttagacatgataaattgataagcttttcttactctacccgatgaatcttgttcttgtcttacataaatttaccaaaggtttcttatactcgtaaactttatacattaattttttggtatagagtgaaagttaaaacaccgacacggtatggtataaaccaataatacgaatgttttatataatcatgtttgagaaacgcttatcttctttttattaagttcaataactttaaatatatagtcgctgtctcttttggattatttgcttgcgcagacttctttgtttgattattctctctgttgaaacaccttttcgtttagtgattattcttttaatgtgtactagtatagtagtatgcatgttattcatctgctgaatatatcgaaaaggttaaagaaacagttgacacaattatcgactacaataagacttgcgaccaagtttataataaaattataaaatgaatttaattagtaattaacgataattttagtagttaattaattttccctccaaatatgaacaggtagttaattccgttaatcatggtggcatgtcaagatctaacccatccccacacctttcatcacaaccagctgtcctcctgccatcatcttatttgttctttggctttttcttctttttttttttttttttttgcaactagatttatcatttttcaattttattaagccagccaataagattgaagaaaaaaaaacttaaccactgaaaataaattaaaaagaattcgacactgttttttgacaaacaaaacttgatatttacggttaaattcataacgtcaagtgaatatttgatcatttttgagacgaaaatagatatttaggtttagtagttccaaacgcaagttttattatgggattatttcatggcgttatagagtttggtgactttggtctttaatattaacctaatgaatttcagaaaatatttatctaacaacttgatagattacggagtgaggaattaatcaagtaaacaattacatattaaaataccatttgcagtcttttattaaaacctgttgaatctttagcaacttttctacatattgcccaatttttctgacttgtgtctttttaaatatctcttccgtgtcaaaaatagtttgtgtgttcttgattatacgtaaattcatctgggcatctcttaattttttctaatcgttaaccttaattacaacctcacgatctgtcttaatcgtgtcttaatcgtgtttttactttatcctctttttattgcaacattagagagttttgtgtgttgcagctttatcggtgtgtaagaaaaagacttataagcaagcagttgaagtggtggttgaggtttcggtttcatttccacgagatctctttggctttcttgttgagatctttccacaagaaagtttagttgttttcttcttcctgtgatttcttcgcctaattttttctggatttaaaaacacgagaagtcaaggtgaaatattatcgaagtctctgaatctgtttttgaatg

SEQ ID NO: 15940 - DNA, 3003 bp, Unknown; identical to SEQ ID NO: 15939
  misc_feature (1)..( 3003): 2750-1469P.txt file - cDNA_ID_1025117; gDNA_ID_1620689; Annot_ID_164710

SEQ ID NO: 15941 - DNA, 3003 bp, Unknown; identical to SEQ ID NO: 15939
  misc_feature (1)..( 3003): 2750-1469P.txt file - cDNA_ID_1025117; gDNA_ID_2926184; Annot_ID_140684

SEQ ID NO: 15942 - DNA, 3003 bp, Unknown; identical to SEQ ID NO: 15939
  misc_feature (1)..( 3003): 2750-1469P.txt file - cDNA_ID_1025117; gDNA_ID_2926184; Annot_ID_200464

SEQ ID NO: 15943 - DNA, 3003 bp, Unknown
  misc_feature (1)..( 3003): 2750-1469P.txt file - cDNA_ID_1025139; gDNA_ID_1621194; Annot_ID_57532
cattgaagaaaaacttaagaccaagctgaaggcctaaggcatatggctcattaatgtgtactaaatatatattatcggcccgagttacggctcgttaagaaaacatagaaatgatttaggcccaacaaataatgtatgttctatattataagcccatttattattacccagctaagtcggctttgaaaagagtataggcccatttaggtgtcacgctcattagggtttattgtaacctagaatcaaagctatataagccgtcttttccacaaatccatacatcggccaagcgagctcctcaatttttcttgtttacttgtttcctcatcttttagttattgttagaggttatcttaggatcgtagcctgtgatgtttgagattgtccgtaccatctgagtttctccttgacgattacctccactttctgaggctttagatctaagatcattagttttatttttacttcggcgatgatgatgaaacaagattaccatcaaactttgagaggtttttcgctcgttgatgtaaacttctttttataatctgagcctagtttgtttgtttgaaatcttatgtgttacatgttatatgaaatcgttttggtgataggaaaggcaacaaattagagtctctgattcacttatgtcaatagtggataaagcgctgtacgttgccgagatagatatggcgatattctggtacttggactagttttgatagttccatgtgcattcaaaagcccttacatgtttctctcaacttattcccattagtatatgtattttgatttggtaaaggcaacaaattagagtctctgattcacttattcaatagtggataaagcgctgtacgttgccaataattacttggtccaaagatctcccaatcggctttcagtcttattttagccgatatgatcgatgttcctaaattatagattttgttacgtgttttcatatagctgagctgaccatatcatgctatttaccaaatctttttgatcaattacctgacacattgacagacgatcgatttttagacactgaaatatgggccgaaattttgaaggagtaatgtctggtaaagcaatgtttgataatgttatggactgctgcgcttgtagcagttagatttcattgggttataagatcgaattcaatatcccctaaaaagattgatgtaaactgtagctttgtagcagatcataaattatttcataaaacagctttcgacgggaaagtttataattttgatataggaaccggataataattgtatcagtaattcttaatcgggctttggatagtcccttcctttttagtgaattcgaatcgaaatgcaaaaataatgaggctgacgcgcttaattttctcaaatatccaaaaatggccaatttcaaaaggggttacctacagatttgtggcgcgtggtaataactcgcttatagtgcaagtggttattttgttttctaatagttaattatttaccatacaaattgtcttctaatgtgggcttactaaatactttacggccttttcgttttcaggcctagggagttaggcccattttacatctttcttgtcggtttcatttttaatgttcgtatattcgagctcttttctcgtctgtacaatgaacaaagttttactgagaacaataaagatactcaaatcattcatagggtgatcaattcgtataaacttaaattttgttcgaggattaaagtataatttataatgcctattaaggttctttgataatgctatgagcccaattttacgatcgtcgtattctatgctaccatcccattggacaagtacgatgccatattagactatttagttcaattgtctaatttaattccgaatttaaaaggccttaaataaataaatatagtaaggtttgggcgaaggttacaaatcatttcactctttcagaacacaaaatagcccaaaacatgtttcgacgagcaaacttaaaatttgtttatgaaaaccgttacgcgtataagagtaaaaaattgtcgtaactgggctagaaagagctaacgatttacagatcttaggtgcaaaattacttttcgaattccttaaactacagagataagtcgagggagagttaaaacttagaagcaccaaaaaaaaataaaaaaaaaataaaaaaacttaaaagcatcacgcgctagttgacaaaaaaaaaaaaaaaaaaaacatcacgcgcttactttttcgaactatacaaaaatagctaatttcgaaagggggttaaacctacagatttgaggtgcgtgctgataactcgcatatagtgcgcgtggttattttattttcaaacggatacaaatatcgctagtgtgggctttcttaataccggtctttttattttttgggcttaggcccagtttacacgtgtcttatcattttatttttttatgtttttctatgcattaaaaaattccttatggcaaggacaataacaaaaaaaattcattaaagatcacatagtattgtaaatgtgagattaaacatgaaaattttattttccaaaattactgctttttaatgcataagattatacttttacggtactaatgtacaaatattttccttgaaaaatcatttactaaaaataattaaataaattcgtacgtcttttctttttggtcggaattagtacgtcttttctttcttttttggtggctatttattttgttcatattagatcaaacttaggagaaatataaatatatatagatatcaaataaaaagtaagaaacataaaaatattagaagtcaaaataaagaaaagaaaaaatacaacgcgaaggtttgattaccactcaaaaaacgagcagctgtttatcttccaacaaagcttcttcgtgcatcttcgctcttctcaactcgtcatcctctccctctgattctcttaagtcgccttgaaaaattaagacaaaacaacaacaaaagaacaagagaagctctaaaatccagcagctatg

SEQ ID NO: 15944 - DNA, 3003 bp, Unknown; identical to SEQ ID NO: 15943
  misc_feature (1)..( 3003): 2750-1469P.txt file - cDNA_ID_1025139; gDNA_ID_1621194; Annot_ID_174667

SEQ ID NO: 15945 - DNA, 3000 bp, Unknown; identical to SEQ ID NO: 11124
  misc_feature (1)..( 3000): 2750-1469P.txt file - cDNA_ID_1025215; gDNA_ID_2214479; Annot_ID_133213

SEQ ID NO: 15946 - DNA, 3003 bp, Unknown
  misc_feature (1)..( 3003): 2750-1469P.txt file - cDNA_ID_1025318; gDNA_ID_2926145; Annot_ID_197701
cggagccgtacaacgaccaatgttaagagcgaaacccccacaccactctcccgcactgtttcttagcactcctcccgctgtagccagacccggattaccccgtgatgccccaccagtattgagcttcagccacccatcgttaggcacaccccaaccaaccattacttccaccctaccgcctatccccgaacctcctttatgtttactagtagcggtagttacttccttagccgcatccttaataaacctcgttctatcccgacacttaccacgtttgtcaaacacgttatcacagcgccacttccaagcccaccaaatagccatcgtgaaaaccgtagaccatacactctcatatatttcccggtcatcacctaggttatcatgctaccattcgatcaacgactgtgcaaagaaggatctcctccgccgctggggaatgatacgatcccaaagtcctgccattgcgggacaatcccgaaggatgtgaataatcgtctcacttccccccttacagacttggcaaacatctgttatacacagatgccttctaaatcgctcagcatccgtcattagagcttgattcccgactaaccaaagaaacatttttgctctctccgtcgccaccaccccccatatgcgactaaaaagaacaacacaacatatacaacaaaacatagaatatcaacattaaagaatataaaaaatatcaacaaaacatatacaactcgcagtgtattatatatttaaaatcaaataaaataatatcataaatttattaatcatctttacaaaaaaagatttttagtttaactaaaatataaacttacccgcggtataccgcgggttaatatctagtgcaaacatatttagtaggagtatcataaaaaatctcaaacattataaataatacttaaaaattccttatgataccatatgagtatcacccatatacatgctattattgtgggtaaaaatagatagttttgcgcaagacctattaaattatgaatattttgattatttgttccataattattaaaatttgaacatttttgttgttagcgcaagattcaatccttgctttggggaaaaattaaagctatacgtaatttcactgatcgtttttggaaagaaacatggaaattaaaaggtgagctttttttttagttgctgcttctctattgatgagttcctagcgttatgtggaatctagaaactttgtgattttgtttataatctatgcttactcttttctcatgtttacgcttctagatgataaacaacgaacacgttggaataagtcctacaacatcttgtttgggatggagccaggaagttctgagatgaatctatcttatatgcccaactacaaaggactttgttgatttcatgtttgaaaagcaaaagcctatccaattcttcactccaacggttaattttaaccacattcgcggttctactatatatccttaatgaaatgtagattctaggaccttaaaattgtttttcctctgtggcagagaactttttctacatcgatgcccatgaaagtctcttgacttcttgcctcctactattttatgcatcctaaagcgaatctcgataaggttgtaatctctattatatccatcctaaacaccgtttgtgtattctccatgtgtttgattccttttgaatgttttggttcctagctgaaactccaatatgaggggttagagcattagttattcaacctaaaactccattatctctgactcaaagacctatcattgtctttagtgtgactccaaattatgaggctttctctctaccttgcaagatcaaacttgaaagaaatcttgataaaatcctaacttcaggaaaattgtgtatatacatatgtcgtttaatcgatactctacatgtttgcttgtttaacaacgatatgtgtgtacgttttgtgcatactattttcagcaaatagtttttttcatagagaaattaaattttagtaaatacacgaatattataattatgatctcacaaaaaagaaaaaaaaaaccgagatcttcaaataaatataaaacttacttacatagacatgcaaagccttcttgacatgcaaatggatgttgtccatgttcctaatagaggggatgaaaccaatccacaaaatttatttttactaaagtgatgaggacttatagccttagaaatatagtaattatgagtatccaaaacagaacagttggtcttcttaaataaaaaaaataaaaaaaataattagatgtttataataatatcttattataacagttggtcctcttaatttttttttaaaaagagataattaaatgtttataataatatttgtaaattaacgatgtcggctcactagatttacgatgattgacgtatttgtttgtaaattttatgaaattacgttcattaaattaaatatttaaatactaaagattaacagctaaagaaatcttaatgaaatattgccatctttgggttttaaattttctatttttcatatttcatatcggatatccgattaaaaatgaaatcagtaagtataccaaaatacaagcgttatatttattgggcctattcgggccattcaataattaattcacccacgcgcaaatgagttaatccgtaaaataggctttaaagcccattcaataaacccgtttcgcaggaaaaaagcccattaaataagtaatttccagaaatacccttttccaatcattgaaaattcaaacttgacctaaaaagtatctgaaaagccagcgccttttttcgttacgaatccgtgtttttgccagctttcaatccaacggctctcctttcttctcacaatccgtaatcatcgctccccactcattcattataaacaaaaacaaaaatccacggagccgataaaaaaaaaaaaaaactctctcagatctgagaatcatttcttcttcttcttcctcactttgttcatcatcttcttctccgatctaaacaacaatg

SEQ ID NO: 15947 - DNA, 3003 bp, Unknown; identical to SEQ ID NO: 15946
  misc_feature (1)..( 3003): 2750-1469P.txt file - cDNA_ID_1025318; gDNA_ID_2926145; Annot_ID_139082

SEQ ID NO: 15948 - DNA, 3003 bp, Unknown; identical to SEQ ID NO: 15946
  misc_feature (1)..( 3003): 2750-1469P.txt file - cDNA_ID_1025318; gDNA_ID_1620778; Annot_ID_167825

SEQ ID NO: 15949 - DNA, 3003 bp, Unknown
  misc_feature (1)..( 3003): 2750-1469P.txt file - cDNA_ID_1025340; gDNA_ID_2214558; Annot_ID_134837
ccggtatgcctagcgatatttttcaacgccattgacgacgctttatataccactggtaaatctctcctctgttttttcctattttccgatttcttctttgttaagaattctatgtatgatgaatttagctgagtgaagaagatgaattttagctgagtgaaagcttatgatagtctggtgaaatctttaatccatttaggttcaatctggtgcaagtttgtttttactgtattatgcgcctctttatttgtttgtgtggatgtaatgaagagtatggagctaaaaggatcaaattatggttttattctagcttaggctgacctgtctaaggttctcttgtctggtctgtacttttacattgacttttttcttgtgcttgatttgaatcagtgactgttcttttagttttgagtatgttaatgatcgcgaggaaagctttggcctcggcgcatactaaggcgtttcgtttggcaacaagggatgtacattgctttagttccatcttagtgtctcctcctctcgtgtcacttgacttgcctgaaaattggattccttactctgatcctccacctcctgtttcctttggtaatactctttgttgcattttcatggctatatatatatgttacaagaaaattctctaattgtatgagttgatttctgtgtgtatgcatttatacagagactgaacagaagactgtggtgatagatggtaatgttatcgctgaggaaatcagaacaaagattattagtgaagtggggaagatgaaaaaggctgttggaaaagtccctggtcttgctgttgttttggttggtgaacaaagagactcgcaaacttatgttcgcaacaaaattaaagcttgtgaagaaactggcattaaatctgttttggctgaattaccagaggattgtactgaaggacagattatcagtgtattgagaaaattcaatgaagacacgtctattcacggaattcttgtgcaacttcctttaccccaagtatgtttctcatttttttctttggacgttgtgatgggggatgttagtgttgttgatgtcaaagattagttctatgttaggaggtcaagtagttacgtttactttgttttcatacttgtatgtagaaattcttgattcatatattttcatcgaccatggactcatgcataacattttcccctttaaggtttccttttcgttggtaggtaaagcatttaatttacaggttatgcgatagagcatcttacttgtggagctctttttcaggagaacgttcttgtattttgttggtttcctttcctttttttttttttttctcatgagtccaatcatttaatggaagatatcttgtacagcatcttaatgaatcaaaaatcttgaatatggtgagattggagaaagatgttgatgggtttcatccattaaacgtggggaatcttgcaatgagagggagggaaccgctgtttgtatcttgcactcctaagggctgtgtggagttgttgataagaacgggtgttgaaatagcaggaaaaaatgctgtggtcataggcagaagcaacatcgttggactaccaatgtctttattattgcaggtattagttcttctttatagttcaagtggattcttatgcttaaacattttggtttgggaattaactatgcatttatgttttctgaaattctcggatagaggcatgacgcgacagtaagcacggtgcatgcgtttacaaaggatccagagcacattactaggaaggcggatatcgttatagcagcagcgggtatacctaatttagttcgtggaagttggcttaagcctggagcagttgtcattgatgttggaacaactccagtcgaggtaaaaacgaaactattttccttaactgatcaaaagtcttaatactttccaatgaaaaaagacttataccatagcttgaatccaatctgatatagaaaacgttaaactgaattagagcttgaaatgtttttccttcagattgttttcttgtttctgattagacattgaagcatgacgtgttataatattgcaggatagtagctgtgagtttggttaccgtcttgtcggggatgtatgttacgaggaagcgttaggtgttgcctcggctatcactcccgtaccgggaggagttggacctatgacgatcaccatgctactatgcaatactttggaggctgctaagcggatcttcctctgagtatggtatctctgtctattactaaatatattttgtaatgttagataggagactccatgctgttcgagttattaacgatctcttttgaattattgtataatagacctggcgattgtgatgccatggtttatcctaactcatcagcatctttagcatcaagttcaactaaacaagtattcatgttttcgtttcattggcttttagaagatgagaatccatttagttataatttaaaacttaaggtagttagatcactggtcctactagcagctaaagtaggaggaatgttgcgtcttacatcaacgatagaagatgactcaagcaagaggtgtcacatgaaggatcacgaaatatttgcttcctacgatattttacacgtcttctcaaagtttctcacctttacattgtttgctttggttcggtttagattctctcttttgctgcttttatcacttttgtaaaactcgaaaccggttttggttcggtttagattctctcttttgctgctttgatcacttttgtaaaactcgaaaccggtttttgattctttttttccttcgaaacttaaatgatatctttaaaccaaaacgaaccaaactaaatcacacaattacgatccggtttgaagatattttgttgtccgtaggattctgattccgagtctctagttccaaagagaagagaacatctgtgagagatctgagacgtctggaaatgtgaagaaaacaaaaaaaaaaaagatctgagagagagagtttcgaaattctcgtgttcgtaagcaaaaatg

SEQ ID NO: 15950 - DNA, 3003 bp, Unknown; identical to SEQ ID NO: 15949
  misc_feature (1)..( 3003): 2750-1469P.txt file - cDNA_ID_1025340; gDNA_ID_2214558; Annot_ID_185808

SEQ ID NO: 15951 - DNA, 937 bp, Unknown; identical to SEQ ID NO: 173
  misc_feature (1)..( 937): 2750-1469P.txt file - cDNA_ID_1025443; gDNA_ID_24186; Annot_ID_146430
  misc_feature (747)..(747): n is a, c, g, or t

SEQ ID NO: 15952 - DNA, 3003 bp, Unknown
  misc_feature (1)..( 3003): 2750-1469P.txt file - cDNA_ID_1025511; gDNA_ID_1620391; Annot_ID_155621
agaatcattgaaaaggatataattgattttaatatctaagtggtaaccacatcaataattataaactttattatagaaaaaaaaacgtagcgaatcatcgtcactctcagtcgttttgtggcatatacaataataagccaaaacacaatgaatctggacaatttgcgaggcattattcactagtttacaagacttgccgctcactgataaacattttggaccacaaagcaataaggcaaatagtgttttcggggaatacaaaaatatacaataattctacggacttgagacttagctataagtcaatattgaatattttatagaaatccgagactagtggagacatcgcatgaattaagacggtttatcagcattattcaagattgatttggtttgcatctaactaacatgattaaaaataagaaccattgattaattcattccttagagtatgggttcatgcttgcatataaatcactcgttcgatttatttcgtattacatctatttattctgtttaggtgcaaagccggtcttaatagaatattgtcttgagaacatacatatataaactgtcattgtttctatctccataaattttgaaatcgatcctaactagttgaataatccctctataccaagaaggcaagaaccgacatttgaattaatttaaccaattatcttccacaattactttctttttgttgtccattgttcttcatttacttttgggttgaatttatgaactcaacaagtcaacaacattttatgaatcatatcaattttgggtacacaatcgtgaagataataacggagaaagcttgctaaagacttaaaagtggtgtttgtgaagcagtctatatggcccactattaaacatatgtgatatcatgcatgagttttggttactcattcaaaagtatgctgaacaattctttttttgttttcaaaaattacgggtatgttagattattttgagttaactaaaaagcatagaagattaaaaaaatgttacattttttatataaaatattacaactacatctagtgccggcttagcacatgtgcttaaggtgctaggacatatggtctagggtccaaaaaaaaaaaaacatgatatgattacataatagcactggatctacaaaatgtttgagccggtcctgactacatcacataatttcatgctaatgtttttgtgtgttcttacgcctaacgtcttctctacacaaaacaaaaacatgatcatgatttagatttggctgaaaacagagttcttgatttgaatttgactggaaaaatgtttcttgatttggttgaaacatgttttcttattcgccttactctcggatacctcgtagctgagaagatatggacattgttctttatagaaataatgtaaagcacgacttccataccttcttgcaaggatctttgataagttcctatcctcattaacatgtgttgcaccttgtttttcgatcctctaagcttccaagtatatgactacaacaacgagattgaatatctaatgatacaaatggtatcttaactatatactttcttttcaattcttctggtaatgtgtatttaacaattaattttgctaatcttggatgtagctttgcacatggattgctacagattagagctgtcacagcgggctgtccatgtccattagcccagtccaataatgtccatttcgatattggacaaatagtgttcatgtccactaaggcacatgtccattaacgcccgtgcccattaatgtccatgtccaaatgggttgtccaataggcataacaaaaccaaattttaacacaatagtatttgcttcagcaagatgcttgaatgtttctttgtaaataatcgctctagagagcattagatgtgtagaattccattttgtgcttactaccaattcttttttctgtttaagtaactcatattagtgagctaagcttttgatatttgcagtttcatgaatacacggtgtcaaaggaccaagcttcatagttcatactatgcataatgcagacaatgaacactatatcaaacaatagtaacagaaatcgaaagagacccatgtcaaaatcactctcaataagcaaaaaacagtaacaaaaaatcatttcgaattgagtaatcaaaaacccagatcgaattgagtaaaaatgacgagaatttgcttacttgaactggattaggaatctcaggaggatccatgatgtgatggagttgagatgttgaaggaactcgccggagaaatcgccggaaagaagaaatcgccaaataagcgtcggggaaatgttttttccccaaatttatttttgcccgaacacttaaacctaatattttttgaccattgggccgcccatgtccatcacgtccagtccgctgatgcccatgtccgttaacgcccatgtccattaatgcctgcttcataatgggcttgtccatgcccggtccattaggcgttggacacgggccactcgtccattttgataactctactacagatcaatcgttcaaagaaataataaaatctcagtagacctatgtttggaagaaacaagaaaatttcatagatccgtataatggatccatgattcaagattagcataattaaattcgaaagtaaattgaccttataactaaagtaaagtgaattaggtggttacagttttttccaatgacattgtaacataatatcttacaaaagccaatattactatttgaaaggtacttccgtactagtaatgtagggatttgagacgtgattatttatccttaatattctaattagattgaaggtttatatattaagttttccatagttaaaagtcaatcttgaaacaaaaagatagtttgagggttctcttgtaaatttcctaaaagtaaaacattaataccctaaaaatcgaaaaatcagaaaaagcttcggagcaagaaaaatcagagaaaattcaaaaacccttcacttgcctcactgttcttcgtcatg

SEQ ID NO: 15953 - DNA, 3000 bp, Unknown
  misc_feature (1)..( 3000): 2750-1469P.txt file - cDNA_ID_1025540; gDNA_ID_2684239; Annot_ID_192513
gcctcattttatgtcatgattattatctttaaaccacatttgaatcactctcattagaatcagtttgattaatgaagcgtttaaagctaatcttacgcagaacttacttgacaagcactggagtgaattgcagttttgagatctcacgtctctcacgaatcgggaaaatcaatgaagcacgaaagtttttcgattcgttacagtttaaagcaatcggttcatggaactcaattgtatctgggtatttctcaaacgggttaccgaaagaagcacgccaactgttcgacgaaatgtctgagagaaatgtagtttcctggaacgggttggtttcagggtatattaagaataggatgattgtagaagctaggaatgtgtttgagctaatgcctgagaggaatgttgtgtcgtggaccgcgatggttaaaggttacatgcaagaaggtatggttggtgaagcggagtcgctgttttggagaatgcctgagaggaatgaggtttcttggactgtgatgtttggtggtttgattgatgatggacgtattgataaagcaaggaagttgtatgatatgatgcctgttaaagatgttgtagcgagtactaatatgattggtgggttgtgtagagaaggaagagttgatgaggcaaggttgatttttgatgagatgagggagaggaatgttgttacttggactacgatgattactggatacaggcagaataatcgagtggatgttgctaggaagttgtttgaagtgatgccggagaagactgaagtttcgtggacttctatgcttttggggtatactttgagtgggagaattgaggatgctgaggagttttttgaggtgatgccgatgaagccggttattgcgtgtaatgctatgattgttgggtttggtgaggtaggagagatatcgaaagctaggagggtttttgatctaatggaggatagggataatgcgacttggcgaggaatgattaaagcttatgaaagaaaaggttttgaattggaggctcttgatttgtttgctcaaatgcagaaacaaggagttagaccgagttttccgtctttgatcagtattctttcggtttgtgccactttagcaagtctacaatatggtagacaggtccatgctcatttggtgagatgtcagtttgatgatgatgtctatgttgcctctgttttgatgaccatgtatgtcaaatgtggtgagcttgtaaaagcaaagctagtattcgacaggttttcctcaaaggacattatcatgtggaattcaatcatttctggctatgcgtcgcatggtctaggagaggaagctcttaagatttttcacgagatgccatcatctggtaccatgccaaacaaagtgaccttaattgcaattctgacagcatgtagctatgctggaaaactcgaggaagggcttgagatatttgaatcaatggaatcaaagttttgcgtgactccaacggttgagcattattcttgcacggtggatatgcttgggcgtgcaggacaggtagataaggcaatggagttgatcgaaagtatgactattaagccagatgctacagtttggggtgctctgttaggagcgtgtaaaactcactcacgattggatttagctgaagttgctgcaaagaaacttttcgagaatgaaccagataacgctggtacatacgttttgctatcgagcataaatgcatctcgatccaagtggggggatgttgcagtagtaagaaaaaacatgaggacaaacaatgtaagtaaattccctggttgtagttggattgaggtagggaagaaagtgcacatgttcactcgcggaggtatcaaaaaccatcccgagcaagcgatgatactaatgatgttggagaaaacagatggattattaagagaagctggttatagtcctgattgcagccatgtcttacacgatgtagacgaggaagagaaagttgatagtttaagccgtcacagtgaaagactcgcggtagcttatggactcttaaagctacccgaaggagtacctattcgagtcatgaagaaccttagagtctgtggagattgtcatgccgccattaaactcatttctaaagtcacagaaagagagatcattctaagagatgcaaacagattccatcatttcaacaatggagagtgttcttgtagagactactggtgagaatggtctatttctattggtttatttcggttcaacttctattggtttagtttgagatgtctgtattattatattgttttataagaagagaatgtttcacacatatcaatgcaccactcaattatcatcttaacattattcgttttaataattgaatcattgatgatgatttgttgttattatctctttgagaagtgacctaccacttttgttatatggaataaaagaatacaaaacatatgtacctcttgtcttaatgtcttgttttgtgatttatcaaacttccgtccaaagtggaacatgattaaagttaggtttcaattgattggataaggacaaagactggttgttgtgtcacatttcctctctctctcagattttacaggcaaatcgatttcactcgaagactggttgttgtgtaattgtgttcgtcgtctcaggttttcaatatctgtctctttgaggtaaaagtttcgatttttacgtttcttgatcatcttattgaactgggtttgatctaaagttaggtttttttagaatttttaatttttgatctttttatcgtctgggttcgtacggaaatagaaaaaagctgcaaactttgttcttaatgttgataaagttattaactttatgttaaacttgttgagatctggattcgtttttgtcatttgagtatagagtgttgtctgattgttctaaatctggctggtgttttagattgttaataggatagagtcactgtgacactgtcagtgtcctgtaatctaatatatctgacagaaacagctttttgttttcagttgtattgatg

SEQ ID NO: 15954 - DNA, 3000 bp, Unknown; identical to SEQ ID NO: 4118
  misc_feature (1)..( 3000): 2750-1469P.txt file - cDNA_ID_1025683; gDNA_ID_2926149; Annot_ID_197929

SEQ ID NO: 15955 - DNA, 3000 bp, Unknown; identical to SEQ ID NO: 4118
  misc_feature (1)..( 3000): 2750-1469P.txt file - cDNA_ID_1025683; gDNA_ID_2926149; Annot_ID_139226

SEQ ID NO: 15956 - DNA, 3000 bp, Unknown; identical to SEQ ID NO: 4118
  misc_feature (1)..( 3000): 2750-1469P.txt file - cDNA_ID_1025683; gDNA_ID_1620685; Annot_ID_48435

SEQ ID NO: 15957 - DNA, 3000 bp, Unknown; identical to SEQ ID NO: 4118
  misc_feature (1)..( 3000): 2750-1469P.txt file - cDNA_ID_1025683; gDNA_ID_1620685; Annot_ID_164574

SEQ ID NO: 15958 - DNA, 3003 bp, Unknown
  misc_feature (1)..( 3003): 2750-1469P.txt file - cDNA_ID_1025879; gDNA_ID_2926227; Annot_ID_203547
tcttgttgcttctctggtgattccatttgctctattcatcttcaccatttacagatacgttttgaaaaagattcgtctcgcccgccagtctgatagggctcgacgatcagctcatcaggaggtttgttcttgtttttctttttttttcttattggaccaaatgaaattagttggtggtgttggattaagatgatgatgatgagtttggacctccctccccttcatgtttcagatggagctcatttctactgtccgcaatccatttgttgtcgagtacaaagattcatgggttgaaaaggtctctccttctcatctccttttgctcattcttcttctgcctccttactctactcaatagtcaatactcatcatctctcttgtttcccagggttgctatgtgtgcattgttattggatattgccaaggcggggacatgtaaattggtttttgcccattttcaactacagacaagttgtgtttagtttgaagaaattggctcttattttcattttgaatattgcaggacagataccatcaaaagagcatgtggtgttcattttcctgaggaggtttgtctcactctcacccatcccttcacttcttacaatctatcactggatctaatatttgaacaaataactactaaatgatgcagaaattatgccaatggcttgtccaactattaatggccctcgattatcttcactccaaccatattcttcaccgcgatgtcaaggtaaacatgtaacctcactatcaattttcagaattttgttcctttttatgttccaagcatctaaattaacatctaaatgtcttttcagtgttctaacatattcttgacaaaagagcaagacatacggcttggtatgttttgtagattcatgtatctttaagcctttttgtcagttactaacgcatccacaatttcggtctcaggtgactttggactcgctaagattctaacttctgatgaccttacatcctctgtaagttctgtacaatgaaactaatttaaattttgtgacactgttattataagtcagtgtgtttataggttgttggaactccaagctacatgtgtcctgagcttcttgctgacataccttacggatcaaagtcagacatttggtcgttgggtataacaacaatacattcttctttgatattttactcctacacttgttcaccttgtgactaccgtttcatggatcatcatggaaaacaggatgctgcatgtatgaaatggctgctcataaacctcctttcaaagcttccgtaagtatccttacagttggtttttgattttggcattaaaacacataatgtaaaatgtgaaatcttgattgcaggatgtgcagacactgatcaccaaaatacacaagttgataatggatcctattcccgccatgtattccggctcattgtaagcctgaaatcatttcctctgttaacaacattaaccggcgttgctgtaccaacctcttttcctcccttatctgcagccgaggccttattaaaagcatgttgaggaaaaatcctgaactcaggccaagcgtatggttcctataatgcttatttgcttttgatgataagtaatccgtttgtggttgaactaagcattgttgttaactcgctgcaggctaacgagctgcttaaccatcctcatcttcagccttacatcagtatggtttatatgaagctagagagccccagaagaagcacttttccactccaattttctgagagggacgctacattgaaggaaagaaggcgttcatcattcagcaacgacaggagattgaatccgagtgtctctgatacagaagcaggttctgtttcttcttcaggaaaagcatctcctacaccaatgtttaatggaagaaaagtgtcagaagtaactgtgggagtcgtcagagaagaaattgttcctcaacggcaagaggaagccaagaagcaatcaggtgcagccagaacaccaagagtggctgggacctcagctaaagcaagcacgcagcgtactgtttttaaacatgaactagtaaggaagaaaaacttaaagctttatgtatttgagatacaatcagggagtgatctgactatatatgttctgtgctgtgtacagatgaaggtatcgaatcctacagagaggagaaggagagtatctctgccgttggtcgtggaaaatccttacacttatgaatcagatattacagctctttgttccctaaattcaccggatgtttctgtaaacactccaagattcgacaagatcgctgaattccctgaagatatcttccaaaaccaaaacagagagacagcgtcaagaagagaagtagctaggcactctttttcttctcctccttgtccgcctcatggtgaggacaattccaacggttcgatcacaaaggacaagtgtactgtacagaaaaggtcagtttcggaggtaaaacagagaaggttcgacacgtcatcgtatcagcagcgtgcggaggctctggagggactgctggagttcagtgcaaagcttttgcagcaggaacggtacgatgagctcggggttctgcttaaaccctttggagccgagagggtgtcttcgagggagacggccatctggttgaccaagagcttcaaagaagcttccgtgtagatgaagcaaccataacaaacgctctatctcttcttctcttggcttgcttttgtcctgtgtggtttgtatataaataaaaacgacgacgcattcggttctcattgcttaaatgtttatccgaaagcttgcagtttgggccttgttgggccaattcgttagtggatttgtttggacattttgaatttggtggaaaatgtttgggtcgtttcgtagaggttgagaaaaaagcggggttcttcttatcaataaacaaactttgtgagagaatttagcgaagaacgaggaaatcgggagaaagtgatactatcactgtgatagtgaaaggagctttgcttgtgaagagagaagaaatg

SEQ ID NO: 15959 - DNA, 3003 bp, Unknown; identical to SEQ ID NO: 15958
  misc_feature (1)..( 3003): 2750-1469P.txt file - cDNA_ID_1025879; gDNA_ID_2926246; Annot_ID_204216

SEQ ID NO: 15960 - DNA, 3000 bp, Unknown; identical to SEQ ID NO: 5232
  misc_feature (1)..( 3000): 2750-1469P.txt file - cDNA_ID_1025895; gDNA_ID_1620774; Annot_ID_167635

SEQ ID NO: 15961 - DNA, 3003 bp, Unknown
  misc_feature (1)..( 3003): 2750-1469P.txt file - cDNA_ID_1025923; gDNA_ID_2213640; Annot_ID_132258
aaggggactcaaatatgtatcccaacggaatccaagaaagataggcatgcaatgcagagagtgtagcacgtataagctcttgtctttgggaagctgagaggacatataggcataactcgtgaatgagttgaaactcgctgcatataagaaagcagtataaatcagtaaagcagttcgtttttatgtattgattctaataaagtaaacttcttgaaaagtctaacttgcctgtttagagactgtttcagttcttttatcttttgctgagtcatctctccttttgagaaatcaaagacctcttcacttaggagctaaacaagaagaaatgttatttaagtacaccatgaacttaattaatgcaaaggcacttaagactgaacttactttcaaaatagccatgcaattctcacagatagtttcactagtcttagcagctataactaaatcaggaataaagcttttccactttgccggccactcctgtttcacgatctgtacacagataacattatatgttattcccaaaaactaaacaaacaatttcaataaattggcaggagcaaaatctttcaggcgaaattggctttagcaaagccttaccagagaaaacatcagaagtaagtagatagtgaacacaaaagaaggactcaatacaaatatgtattattagcaggaaaccccgaagatacctgaaccaggatgatatttaacttgttgacataaagcctttccgttctgaaagatgcttcatcccttgacagctacacagcaaattcagtatcaaaacgattcagttaacttaacatcttagttctaaccaaaaaacaacctaatggctctccaaataatatacctgcacaatgacatcagagatgtaatttttcattccatcacgttgttcaacgggtaatgcattccacctatattttataacaccttccagcacctgaaattatacgatggaagacaactaaatagaatgctaatgctgtcttctttggaatggatgtagtgggacattatatataacaacgggaatgctaaataaagagaagagcaggtataagagaacactaaaacactgacctgaagggcaaaaaatttggtatgcgtactactggtgttctgtagaatgtgaacaacttgaagccaagtatcaggattagctttcaaatcccgcaagatattatccgcagaagctctctgcaaggtgttttcaaacattcttatctcattgaaagcacacatatgcaaacatcgtttttacacacaaattacattgtttagtgtttttccagataacaagaacagccacaaacaatcgaaacctatctctaacccaggaaaaagaattaagcaaaactcatccaattcgtatcgcaaatactaaaccctcgcctaacccccaaatcgatagaacgcattaacagtgaataagagaccgcttaatgtggtggcgatactcgttcatcgttaaaattctcagagaaattatgataaacaacgggactcacttcttccttagatccggtagagtaaaaggcctcaacagtggcatcgagtaaaacgacgtcaatcggctgactcaagtctcttaacttctcggcagccatggcggagaggatgcgcaaattctagaagaagagactcgatacgagagtgaaatcaatggagggagacaaagttcgagagagagggagagagtttttttttgggtagagcggtacggaggagaggcagtttaaatattgagagaggtttttgaaagacagcttaagattgacgcaggcgacgctgagaaaaaggcctgacttctaattttgttttctcttctttttttttcgttgaccgcctcagggtttgaatttgtatactctacagtctacgctactcaaatatttactaggattgtttattttattcaaagatttactttaaggaaagattattataaaatgaaatgcaatcatatagattaatcaaatttccaacactttttgaggttttacaaaaaaaaacattattaagttttatttttaaataagctatattcaatcactaagttgtagaactttattatttttatttaatgatgttcattattagattttgtatgatattattatataaaataaaattgagtgttttttttttttttggatttatgtatttatgtcatattattatgtttgcattaattaattaatagcattttccccaaatattaactttactttctttctttttttgaacacggaactttactaagtagtagtattcatttgatcccatgaaatctaagctaaggagtaagcttggaaaaaccttaacaataggagatctatcattatattgaaatcgagtttaccattcgtgaagatatgattataatacgttgtgtactcttagcttgtaaaatggctaatgggatttactaagagaggaagagaagtgaactgttaatgttatgatcatcaaatgctttgaggaaagtgggaaaaacagatttagctatgaagctaatgcatagcaaattggaatgcgtagtgttaaaacttaaaaggcctttttttttttttttttgggttttataatgcgtagtgatttccttttttttgataacatatacaaaatgaatttcctttttttatttttgaacaactccttatgaataaatacacatcatctcttcttattcactgagaaatcaaaattacaaccctatgaatgtatgatctaatgctttgaggaaagtgggaaaagcagatttaaatcttgtatttcttgatataccaaatcatagtagaaaatgtatattcatatgcttctctgccacatcatcatggggaaggccatagcgagcaagtggcccaggtaaacacaaagcgtagcccaacaaatacaaaacgatgcgtttagcaatcgtcatcatgtcccttgttatttcgacaacgaaatcaaatcccgattccgagagagagagagcgatagcggaagacgatg

SEQ ID NO: 15962 - DNA, 3003 bp, Unknown; identical to SEQ ID NO: 15961
  misc_feature (1)..( 3003): 2750-1469P.txt file - cDNA_ID_1025923; gDNA_ID_2213640; Annot_ID_181206

SEQ ID NO: 15963 - DNA, 3000 bp, Unknown; identical to SEQ ID NO: 13101
  misc_feature (1)..( 3000): 2750-1469P.txt file - cDNA_ID_1025971; gDNA_ID_2214598; Annot_ID_135502

SEQ ID NO: 15964 - DNA, 209 bp, Unknown; identical to SEQ ID NO: 369
  misc_feature (1)..( 209): 2750-1469P.txt file - cDNA_ID_1025971; gDNA_ID_1564417; Annot_ID_149420

SEQ ID NO: 15965 - DNA, 3003 bp, Unknown
  misc_feature (1)..( 3003): 2750-1469P.txt file - cDNA_ID_1026104; gDNA_ID_1620621; Annot_ID_47037
aactactgcattttccttaacaccactctcaattcagctttgacgcagacaatttgtggcaatatgaaggttggtttcactttattagtatctcctgtacaaaagaaaaatgtgaaactaatctgccaaggagagactttgaacattatatcatcgttgcaggatctattcacggttggactaggctggatgctctttggaggactcccattcgacctggtaattttcttcaacattcctattattccattgaacctaaaatcggcatctacgtttgctacatctcactacctttcttttttggttcatttacacagatgaatgtgattggacagctttttggtttcttcgggtcaggtttatatgcatattataagatcatcgggaggtaacaagtccaaaacaaagaaaagccaaagaaaacatgagtggcctagtgatgataaaggctcattagtttaaggaaaagttgttgactagtagtgttcaagtggagatagagtgttgagcttttggttttggaggtgactttagagtagtattaataatgaaaggcctaattttttgaacttgcgtcttgttcttcttcagttttcaacaaggcgaaagattagactatggacaaaactgattttctatttttttgagatctactgactctaatttatacaactgcttcttttcattgtatatatgtagtattattatacacacttgagaaaaggatgactgtaattatacaactgcttcttttaaagcgttcaatgatgatttggtactaggcattcttgcaaagagctcggtgaaagcaaaaataattacttcaacggttaaaattgcaagtactagaaaagaaaaaaagagcacacccagtgggactcgaacccacaatcgcttgattagaagtcaagcgccttatccattaggccatgggtgcttgttgctacatccttctgagttgttttatatatcatataattgtatttgtaatcgtgttccataccttcttcaaaagcaaaacattctctcgccggtaaaaaagcagagatcccttaaccatgatttccttcaaagtatattccccttcctcatcctcttcccatgctcatggtatcaatcttccactctgacccaactcaagctctgatttctcctactccgtcgccaaaaatcttggaagtagatgtcttagcccgggaaaatcaaattttctcaataatcaatctatggacgttccaccacgccgctctttggctgcgtctctctcgcctctccggctaatcgatggactccctcgtcggaggagtttcaattataatcagatgcctgaagagcccatcaaactcactgttctcaagcttgatggatcttcctttggtacccattactcatctcctacttgcttttaccattaaattttatatgttaactaagaatgtttgctcaaaagaactaaaagttattgctttacaacgaattctagttttttctgtgttgtttcgtttgaggttgtccagagaaatttgactggtttctgaatttgtgatttagtacaattccctttaagcgtaatttggatttgtaggtattcaagtgttgaagacagcgacagtaggggagctcaagatggcagtagaagctgcgttttctcacttgcccatctcaggccctggcaagatctcatggtaccatctctgattctttgacttgagttattcttataatgattccgattttgtgtctatattaggataagtaactgctaaatgattcttgatgatcctatttttaccctgtgattataaaggccgcatgtttggggacaattctgcttatcttatgaagataaaagattgattaatgagtctgagtacctcactgaatttggcattaaagacggcgatcaggttacccttttactctttctttatcacttgaatacatcaaagagtctatgcttatgatattatttcatctttacatgtgatgtcgtagaacgatgcatttgggtagctagagtctctaacctggattatgtagattgttatagtccagtttagttttgacaacatagtgctttgttttgatgctctataatgtgttttatctgccatcattcagcttcggttcatccgccatatctcaaactactgcatgttaatggtgaagcataagagcaagacaccccgtgtttcttctttcaaacaactcaaactgtaagaacttttggtgttaaaatgtttttagcatttcattatccggaatctccatagtaatacatgtttttggaccaatcaggttctcaaccacaccggaaacccggaaaaagaacgtaataagggaagttgaagaagacggtgttgttgactccatccctcggagccaaccaagctttctagcaactgtattgggaggtttgctctcttacaagtcgacgccaagtcaacgaggtactaaatacagaaacgtgactgcaagtagagtttttaacaaactcattgcaaggtttcgtttcaagtgtaattccgagaaggatgtgtggaacagaaaaaaactcatatccgaaacctaaaaaaaagcactccttttctatcatttgattcttgtagagattttgatttcctaatcttggtgtttatatacaaacttggatgttgtgtgtgtgcaaaatgaataaggcattgtgtatttacgtttgtagtggatataattgcaaccttaccgtcttagccattttaaccttatctggtacagcgttcgcgtttgcgtttgcgtttgcgtttgtgtttgcgtttgtggccaaaacgcaatcatttactttttaattgattttccgctccattgattttaatctgacgaccacagcctttagcttatttgtgtggcgaagagaagagataacattcctaagcaaatctcttctctctcccattcgtctccaaagagattacagttttgagcatttctcatctctcgaagctcttctctgtgtgtgtggcgatg

SEQ ID NO: 15966 - DNA, 3003 bp, Unknown; identical to SEQ ID NO: 15965
  misc_feature (1)..( 3003): 2750-1469P.txt file - cDNA_ID_1026104; gDNA_ID_1620621; Annot_ID_162312

SEQ ID NO: 15967 - DNA, 3000 bp, Unknown
  misc_feature (1)..( 3000): 2750-1469P.txt file - cDNA_ID_1026104; gDNA_ID_2926201; Annot_ID_141536
tactgcattttccttaacaccactctcaattcagctttgacgcagacaatttgtggcaatatgaaggttggtttcactttattagtatctcctgtacaaaagaaaaatgtgaaactaatctgccaaggagagactttgaacattatatcatcgttgcaggatctattcacggttggactaggctggatgctctttggaggactcccattcgacctggtaattttcttcaacattcctattattccattgaacctaaaatcggcatctacgtttgctacatctcactacctttcttttttggttcatttacacagatgaatgtgattggacagctttttggtttcttcgggtcaggtttatatgcatattataagatcatcgggaggtaacaagtccaaaacaaagaaaagccaaagaaaacatgagtggcctagtgatgataaaggctcattagtttaaggaaaagttgttgactagtagtgttcaagtggagatagagtgttgagcttttggttttggaggtgactttagagtagtattaataatgaaaggcctaattttttgaacttgcgtcttgttcttcttcagttttcaacaaggcgaaagattagactatggacaaaactgattttctatttttttgagatctactgactctaatttatacaactgcttcttttcattgtatatatgtagtattattatacacacttgagaaaaggatgactgtaattatacaactgcttcttttaaagcgttcaatgatgatttggtactaggcattcttgcaaagagctcggtgaaagcaaaaataattacttcaacggttaaaattgcaagtactagaaaagaaaaaaagagcacacccagtgggactcgaacccacaatcgcttgattagaagtcaagcgccttatccattaggccatgggtgcttgttgctacatccttctgagttgttttatatatcatataattgtatttgtaatcgtgttccataccttcttcaaaagcaaaacattctctcgccggtaaaaaagcagagatcccttaaccatgatttccttcaaagtatattccccttcctcatcctcttcccatgctcatggtatcaatcttccactctgacccaactcaagctctgatttctcctactccgtcgccaaaaatcttggaagtagatgtcttagcccgggaaaatcaaattttctcaataatcaatctatggacgttccaccacgccgctctttggctgcgtctctctcgcctctccggctaatcgatggactccctcgtcggaggagtttcaattataatcagatgcctgaagagcccatcaaactcactgttctcaagcttgatggatcttcctttggtacccattactcatctcctacttgcttttaccattaaattttatatgttaactaagaatgtttgctcaaaagaactaaaagttattgctttacaacgaattctagttttttctgtgttgtttcgtttgaggttgtccagagaaatttgactggtttctgaatttgtgatttagtacaattccctttaagcgtaatttggatttgtaggtattcaagtgttgaagacagcgacagtaggggagctcaagatggcagtagaagctgcgttttctcacttgcccatctcaggccctggcaagatctcatggtaccatctctgattctttgacttgagttattcttataatgattccgattttgtgtctatattaggataagtaactgctaaatgattcttgatgatcctatttttaccctgtgattataaaggccgcatgtttggggacaattctgcttatcttatgaagataaaagattgattaatgagtctgagtacctcactgaatttggcattaaagacggcgatcaggttacccttttactctttctttatcacttgaatacatcaaagagtctatgcttatgatattatttcatctttacatgtgatgtcgtagaacgatgcatttgggtagctagagtctctaacctggattatgtagattgttatagtccagtttagttttgacaacatagtgctttgttttgatgctctataatgtgttttatctgccatcattcagcttcggttcatccgccatatctcaaactactgcatgttaatggtgaagcataagagcaagacaccccgtgtttcttctttcaaacaactcaaactgtaagaacttttggtgttaaaatgtttttagcatttcattatccggaatctccatagtaatacatgtttttggaccaatcaggttctcaaccacaccggaaacccggaaaaagaacgtaataagggaagttgaagaagacggtgttgttgactccatccctcggagccaaccaagctttctagcaactgtattgggaggtttgctctcttacaagtcgacgccaagtcaacgaggtactaaatacagaaacgtgactgcaagtagagtttttaacaaactcattgcaaggtttcgtttcaagtgtaattccgagaaggatgtgtggaacagaaaaaaactcatatccgaaacctaaaaaaaagcactccttttctatcatttgattcttgtagagattttgatttcctaatcttggtgtttatatacaaacttggatgttgtgtgtgtgcaaaatgaataaggcattgtgtatttacgtttgtagtggatataattgcaaccttaccgtcttagccattttaaccttatctggtacagcgttcgcgtttgcgtttgcgtttgcgtttgtgtttgcgtttgtggccaaaacgcaatcatttactttttaattgattttccgctccattgattttaatctgacgaccacagcctttagcttatttgtgtggcgaagagaagagataacattcctaagcaaatctcttctctctcccattcgtctccaaagagattacagttttgagcatttctcatctctcgaagctcttctctgtgtgtgtggcgatg

SEQ ID NO: 15968 - DNA, 3000 bp, Unknown; identical to SEQ ID NO: 15967
  misc_feature (1)..( 3000): 2750-1469P.txt file - cDNA_ID_1026104; gDNA_ID_2926201; Annot_ID_201881

SEQ ID NO: 15969 - DNA, 334 bp, Unknown; identical to SEQ ID NO: 389
  misc_feature (1)..( 334): 2750-1469P.txt file - cDNA_ID_1026239; gDNA_ID_1590641; Annot_ID_149882

SEQ ID NO: 15970 - DNA, 3000 bp, Unknown; identical to SEQ ID NO: 3799
  misc_feature (1)..( 3000): 2750-1469P.txt file - cDNA_ID_1026502; gDNA_ID_1620665; Annot_ID_163896

SEQ ID NO: 15971 - DNA, 3000 bp, Unknown; identical to SEQ ID NO: 3799
  misc_feature (1)..( 3000): 2750-1469P.txt file - cDNA_ID_1026502; gDNA_ID_2926196; Annot_ID_201481

SEQ ID NO: 15972 - DNA, 746 bp, Unknown; identical to SEQ ID NO: 116
  misc_feature (1)..( 746): 2750-1469P.txt file - cDNA_ID_1026618; gDNA_ID_2804; Annot_ID_145943

SEQ ID NO: 15973 - DNA, 3003 bp, Unknown
  misc_feature (1)..( 3003): 2750-1469P.txt file - cDNA_ID_1026625; gDNA_ID_2936583; Annot_ID_194993
tcacaatagcctggtctgtcgaatgaaaccatatatacacctagttcctctactaaatcctataaaatgtaaatgacacaatgttagaggtcacaataaaaaaaaaacgaaaacgtcattctcaaataactttctcactaaacttctctatagtacaaggaattctaacaacactacttgctagaaattaacataccactaattagataaaaggtttaaaacatagtgatcaaagtataattacataacaactatctatcaaatcaaccatagaagcatacatgcataatcttgagtgaataaaacttaccggagaaagcagcgtggcgaagacggcatcgtgtctacaacaatcggatccatggatgaagacgattttgcggttagctttctctcttggaagtccatgctctttgtaagccaaatacctcccatcttgaagctttatccgcggtgctgtaatcggtggaccacttgaggagccacatagcttcggctgaggaggtttcaacttcgactgataagtcaacgccacgattatcccaacaatgacaatcacaacagaaggaaaaagaaaactctttcgagaagatggctttagtgagctcttccttgatgaatcacttgccatttcacgaacggtaagatgatcggagaggcacggcggcaatggcgacgattcttgaaaaagagagccaactgttcaagaactacaacatatcgtgtgtttttttttgtgataagtcttctcagccacgtcaatatcagggatgcattaaattcaaatacgttacagtgatttgatacttcaattgtgtggttgccaaaaaaaggaaaagaaaaagatacatgttaagctatcaagttaaaatgctacactttggctaaaaactattccaaatgtcttagattccagctttcttggttatcttcaatgaccactttggtgattgccacttggttgtagcacaagcatgtgctgcctcacttagataatgtgattaggcctagtttagattgtaccaaaaactttaattaatgatgtattagacactaaggcaaatctagtagacactcaagtagatgaattcttcattctcttaattaaaagactaacatagaatataaaacaaaaagaccaaacacatgttgctaaaagatcaaattaaagaacatgataagcttgacaagacaattgatgaaggcttggtcgattaaattacacgtgtaaccaaataaaaataaactacgatgctgacaaatgtaactagtacataactctattgtatccgtgtatttttttgggattttttttcagagtttttggaagctacaaatgatcaaatacaaactctagatgctcttacatcggaggttaagagcgactttacaatgtcatcaactacacctttagtgtagtggaagaagtggccacttctcggaacctcatgatagtgaacccatggaagctgatgagcaaggtaacgctgcagcttcgcaggtactaacatgtcctcatctccttgccacaaatgcacagagccttccttattcaaaaacggattctcgaggtctaaaggaccaaattcccagttcccaaaaccaacgatcatgtcacggttaatactctcatgtattccttgctgccttacctctgcccaatgtggtttcctcgaagaaccaagcttcgaaatgatatctttatccggctgtgccaagagactgtgatctcggtttgcaatactcgaaccagggaaccatttttgtgtgttccaccaatagataagccaaggagtatagtgagcaacacgaactgccaattgatctctcttttgttgaaagttaaaaccttcagtggaaacgttcaaaggtaagttcttccaataatagttaaccactggagcaactagtgttactccggctaacctatgaggaatgtatttaagacatccccatgctgcttgtcctcccatcgagtacccgagcacataaaatttcgatcctagactcaactgatcagctagctcttcaatatccgaaaccaagcttcgcggtgtacgacttggatgcggatcactctcacaatagcccggtctgtcgaatgaaaccatatatacacctagttcctctactaaatcctataaaatgtattgacacactgttagaggtcccaataaaaaaccgaaaacgtcactctcaaataactttctcactaaacttctctatactacaaggatttttaacaacactacttgctacaaattaacatgccactaactaaataaatgattaaaacatagtgatcaaagtattattacataacaactatctatcaaatcaacgatagaagcatatagacatgcataatcttgattgtgtaaaacttaccggagaaagcagagtggcgaaaacggcatcgtgtctacaacaatcggatccatggatgaagacgattttgcggttagctttctctcttggaagtccatgctctttgtaagccaaatacctcccatcttgaagctttatccgcggcgctgtgatcggtggaccaccggaggagccacatagcttcggcggaggtggtttcaacttggactgataagtaaacgccacgattatcccaacaatgacaatcacaacagaaggaaaaagaaatttttttcgaggccatggctttaatgagctgttccttgatgaatctctcgtcatttaaaagaatgggaagttgatcggagaggcacggaggtcaacggcgacgattcttgaaaagagagccaactgttcaagaactacaacatagagatcgtttttttgttgttgttttgagataaaaatagagaagcccatttttatatgttattcattatagtaatggcccaagatgcttaatatactaatgccccaatagtgttaaggcccataagcccatattagggcttcttcttcgtttttctccctcgagtagcagcagcagcctttggatattcggcggaatcgaaaatg

SEQ ID NO: 15974 - DNA, 3003 bp, Unknown; identical to SEQ ID NO: 15973
  misc_feature (1)..( 3003): 2750-1469P.txt file - cDNA_ID_1026625; gDNA_ID_2936583; Annot_ID_143796

SEQ ID NO: 15975 - DNA, 3000 bp, Unknown; identical to SEQ ID NO: 11267
  misc_feature (1)..( 3000): 2750-1469P.txt file - cDNA_ID_1026667; gDNA_ID_2214486; Annot_ID_183509

SEQ ID NO: 15976 - DNA, 3003 bp, Unknown
  misc_feature (1)..( 3003): 2750-1469P.txt file - cDNA_ID_1026697; gDNA_ID_2214603; Annot_ID_187140
ttattgttgttaaagattagtatgaacaggacatgtctttaaaattctgttctgatcgggtttgtgagagatatgagtgattggtggttaggacatgagaacaaggaagcttatctcagtagcctaccataaaaaagacactcacttcaccttgttccactcattgtatatataataattacatgttgtgcctaatgtatgtcgatttcagggattcataccattgttcttttttttttggtgagtataccattgttctttttgtacaaagacaacaatatatgtaaatccttttttaaaatttgatttgattcattttaattaagactcaaaatataatgtgcaattgattaaagagaatataatacattatgtttttaaaatatagacaagatgtttttgacccaaaaaatagaagaaaaatcttaacaaatatagcatattttggtatttttatttttatccttaccaaaaaaaaattagtttggtatttttatgatatataaaaagaaatcctaattaaaaaatggtaattcaagaaatatttattccaacaaaaaaaaaacagataaatactttcttatagggcctaaaacggtttttgtgacccggcccatttaatgtgagtcacaaatggagttatcttatagtttacctgtaaaaaaaaaacttttgtcgtcacttaaccgagaaagcaaaagagaagaagaagaaggaatcgaaaaatgaagactccgatccacgcggtttcgacatgggtgaggaggcagcctccaaaggtgaaagctttccttgccgtcgtatctggcatggcggctcttgttctcctcaaactcatcgttcacgatcacgacaatctcttcgttgccgccgaagctgttcattctattggaatctctgttcttatctataaactcatgaaggagaagacttgtgctggtataacctcatttcctgctttgacttcgttatctgtagggttcttagctttaactagagaatttcgatctgtgttgagatataaaaatgtaaactttattcaacttttgagtacccaaatctcccaaaggagttgatttagttgaatcagcattcttcttacagattaaaagtctatttacataccttttttggggggtatttgcaggattgtcattgaaatctcaggagcttacggcgatatttctagctgtgaggctttattgcagttttgtaatggaatatgatatacataccattctggacttggctactttgggaacaactctctgggttatatatatgatccgttttaacctcaaaactacttacatggaggaaaaagacaacttcgctctctattatgtggtaagtgagtcattctcggttttgatctttttacttagattctgttcatgctaggcatgttggttatataagcagcttaaagtcttttgtttttagttaagcgtaccctttaaggtcagatgaagatggtgcttattaatgttattcatttgaagcttagttataagttataaccagtgttcctttgtatttgccatcagtatcaaatttattttatctgcatattacatgccttttagaacatggtggcatctaactactggtgcaatagtttaaggattcatgaatattaagttttagttcttttggttttttgcagctggcgccctgtgttgtgctagctgtatggattcatccatcaacgtcacacaatatattgaatagaatatcctggggattctgtgtttacctcgaagctgtttcagtactgccacagttgagagtgatgcagaacacaaaggtatgtgttttctaaggttgttgctttcggaaacttgagtactgaaaaacaagtgtaatccctgatatttttggtgtgttcagattgtcgaacccttcacggctcattatgtttttgcacttggagtagcaagattttttagctgtgcacactgggttttacaggtaggttcttatcttcaacagagagttgtgattacatggttaagttgttctttccatctcttgcataaaccaatggctttacaaatatgtctaacatcctatgcttatggcactggagcaaatggtcaactccacaatatccccattagatatgatattttcgcaagtttgtttgtgtgatttttccaaactgaacgcataaatttggtttggtcttctgtgttgaaacagatgatggacacgcacggacgactgcttgtagtgctgggttatggactatggccatcgatggttataatctcagaaatagtccaaacattcatattggcagatttctgttactactacgttaaaaggtacttttactttcttcccccacacaagctcttcggtcttttcgcttcacctctttgatctatctttcttgtgcagtgttttcggtggccagcttgttctaaggcttccatctggggttgtgtaagttataaaggaaaaaagataagacacattatgacgaaatttgttacacgaagatagatctcagcttggtgtaatctgagtagcctctggttactctcaagttactccctcaggccaagtcctaattctattaactgtgttgtatatttttgtgtgggtcatcatcatagacagtcccttggatattattgacatgattttttccactgcatttgtgctaaattatccttggttcccacggtaaagttgctgcaaatttcaccaagcagagtaaaatattacacttcccacacaagttcataaagacattgtaatcgggcaatcgttgcaagccgcataatttgcaaagaacctgtaactacaaagaccacaaagaatttggtttgctgctagtcttaagattttacccgaaacactactgttcactgattgggctaaatttatgtctgtatacgtaaataggccggttaattacgaataggcccaatgcttatataatctgaaccgttctcttattttttttgttatcgacactattacaccaaagagatg

SEQ ID NO: 15977 - DNA, 3000 bp, Unknown; identical to SEQ ID NO: 8854
  misc_feature (1)..( 3000): 2750-1469P.txt file - cDNA_ID_1026880; gDNA_ID_1971906; Annot_ID_176997

SEQ ID NO: 15978 - DNA, 3000 bp, Unknown
  misc_feature (1)..( 3000): 2750-1469P.txt file - cDNA_ID_1027013; gDNA_ID_2936557; Annot_ID_194280
aaaccaatgacgttattaaggtatcccaaacgcccatttatcctttttttttttgctttacaaaaaccaatcaagacccaaatgagaccataagaacctaggaaagcttgaagaagaccttacaaggatgttgagtttggcaccaaatagagaagaaacagtctgcatcaattgcactctctgaggtcgagaggaaacatcacagattgaaccactcacttcaaacccttttgcatgccatccacttaagcattcgtttagcagagtttcgtctatgtcacagatgtgaactcttgcaccaaagcctacaagttcctccactattgcatacctaaagtcaagctcaacctcaaatctctttgtttcaaactttgcttgaatattatattctcaccaaagagtggatatataaaaaacagagtagaaactaggaaacagagcatttgggaggaagaaaacgaacccaattccctttgatccaccggttacaagagcagtcataccttgaagactccacctgttaatatccattgttgtgttgtgtgtgtgacgacacttagtcactatagccacaagtataatcagttagaatgataagcttaatggttggcaatgaatccgacgtacgaaacagatagttgaacaaacatggacctctcgttttgacactggcttgaaactcgtggataatacgaatcagtaggtctttttaatttctttttaaaaataagttaggtgagatattatttttttcttagccaatgatagtatttcagtcagctagtgtgatgttggattcgattgttgggtgcacgtactaagcctgtgatcctagtcatttgcattataatgagtttaaagatctcaataatacccacatttagccggttgttgattatacacatttgttgttaattactttaagtgatgacatgtctcagatcaatgatttttttatgtaaccaaataggtatagattcttacttgcacgtatatttcccaaaaaccttgtctggttctattttattgtatgctagtttaggaagtttaaatccatctccacaagttagctctacgacttattatcacgatcagctaaactaatacttgaactgttcaacattataatttctttggaattgactgtcttaaagaagtttaacaaatggtcgagattttttctttcttttcatgaagcctatatatgagagaacaattcagacaagcaacttcacacagatcaacaaaacagacttttatttcttctttttagttgctcatcaatggcaattactttcatatcaatagctctattcatagtcacccaattatgcttcgtttcttgcgtgctaagtcaacaaaacgaaaccaaatttctctaccacggatttttcgaagccaatctactcaagtatggatcctccaagatcctccctagtggcatcttggagctaacaaacagctcacgaagacaaatgggtcaagccttctatggcttccccatagccttcaaaaacagtactaactcatcaaactcgttttctttctccacaagtttcgttttctcaatcgacgcaccaggtcatggcctaaccttcctcatctcgccgtccatggatttcacgcaagccatgccgagccagtatctcggtctcttcaacactacaaacaatggaaactccactaaccgaattctcgcggtagaatttgacacagtaaagtccaacgagtttcttgacatcgacgataaccatgtaggcatcgatgtgaacggtttggtctccgttgaatctgcaccagctgcatttttttccaacaagcaaagcaagaatataagcttgaagttatcgagcaaagacccaattcgggcttggatcgaatacaatggagtagaaaggcttctcaatgtcacattggctacccttgacacttctaagcctaactttcctcttttgtcaagacagatgaatctttctgagattttcatggagaaaatgtatgtaggattctcggcatccacaggaaacattacgagtaatcatgatgttcttggatggagctttagcagagaaggaaaaccacaagactttgatcttaaactacttccttcgctttcaaccccgtcgccatctgactttgatgaccttgatcccattccagatcctccttcagattcagcaaccgtaaagcctaatcacaccaagacgatgatcataatctgcacacttgcaataatgatctttatgatatgattgaaggaagaggcaaacacattggtcttatgataaagttggatgagtactctatttatgtagttacatatatcgcctctaaacctttggcaattacattgtttggtctgcttttttttccaaccacgcgtaaattggtttgttgttgttacacaagttaattaatttttgattgccaaagaaaaagttgtaatttcattctcaaactctttgcttgtcataagtttttagatgatttagtttttaacagaatggatcaggtgaagtcaacgaggtgtcatataaaaacgtaaataacaaattttttgtattcattaaattttttaaaatctattttccttttgtattttttgcatcttttttgtctgaaaaagagagaaaggaaataaaatctcaatcgtggagatgatagcacgtgtcaatgttgcgacacgatctgatccaaacctatttatattcttcgctgctttttctgtcttgaccgctcttcttctatcgatctctgatctcctcttctctctgtcttctgagttctgtctacgcttcgtcgccgatcccggccagactccgtcttaccggcacaaaccctaggtgagcctcaagagtttggattggtttattgtttttgttctgggggaaatttatttggcaaattcacctaaaatgttgtttctgatgaaatcagattcccggaggacgaaattcgttttttcgccggaactaaattaaggagatttgagaggctatg

SEQ ID NO: 15979 - DNA, 3000 bp, Unknown; identical to SEQ ID NO: 10988
  misc_feature (1)..( 3000): 2750-1469P.txt file - cDNA_ID_1027032; gDNA_ID_2214470; Annot_ID_182987

SEQ ID NO: 15980 - DNA, 3003 bp, Unknown
  misc_feature (1)..( 3003): 2750-1469P.txt file - cDNA_ID_1027047; gDNA_ID_1621100; Annot_ID_55878
gaattggcttttgggtttctctggctgctaagtattttctgttatgaaataatgacagttttgcctgcgggatggagcaatgataaccatggtgggagagggggaatgggacgtggtcgttggtcaaatgggagaggaggacctgggcttcttcctcggcctggaccttaccctggacgtggtggtaatcgtggtggttttggcgggagataccagaattatcagcgtgatgaacgttttgtttctgagcttaagctttcgaaaagcaaagaaacgttggctagaaaacaaaccaactttcaggaggtaatatatatcaaggaatgctgttttaactactacatttttatggttatggtaacgcgtttcgaattgcttgatattaacagccatgtgagcttacttgctacagtcgagtagaaggtggagaagtaatctacgatgaccaaggattggtgaggcgtttggtgttatagttcctttagattctctcttttcttcttttgtcatcccattgaactatttaattgatggggtatatgcagacctttaaacataccaactatcacagcttatatgtatccactttgttcttgtttcccagaggcttttcaaacgtcatattggtgaagagattggagcggatttaaatcaaggttatgatacttttattgagaaaaaaggtaatgcattagtggcactagtgaactattagcatgtgtaaaatgaagaattgtgatatattcagctgattagtcgttcttttgaggcagatctgggctctgagggctttggtgaccttcttggcagtattagagcaaaaaacatttcgctggacaacattcattttgtggtatgaagtgcggatgtatatatgtccatttcactgtcaatttattactttgaaagaggttatcttaatggtgtcttttatttttgcttttttggacagacttttcgtaataatctaaacaaggtaagtgagatccccaacagttatttgatctctatgatatcaaatgaatcactctgtgcacattgtttcattctttcagatattgggcgctgcttacaatcggcatgaaccgtgggaaatgggcgtccataagagaaatggaaccatatatctagatgtgcataaactgcctgaaaggccgcagagtgacttagatcgccgcaggtaatcttcgctttaattgtatttgcggattggagtgattctactagttttattataaatggtgctaaagaatgtctgtgtagaagacaatgctaatgttttgaaaaaaatgggtcataaagagtttataacactgctctgcatattttgctactaataaacttgatgttatgtttccatcagatgttactggggttattgttttgaaagccttgctacggaagatccaggaagagcttatggagaagaaatacatcatgtggatgcaaatgttgaattttgttctgttgtcaggactaaactaggagctcaccgagttatgatgggtgctgaaatggactgctgtgatgtatctgataagggaaaaaggttttacgtagagttgaaaacaactcgtgaggtatgactcttgctatagttttcctaataagctcgtttgttatttcagcttctctctttcatttcacacacatacatattggccagtaatgtccctactgtttactctccagttggatgatcgtaccgttgacagatttgaaagagagaaattgcttaaattctgggtaagtatgatctaacacgggttacatatatcttctttgtttctccattcttgtttagacttaaatggttttaacatgctgcagatacaatcattcgtagcaggagttccatacattgtcgttggatttaggtatgaatttgccaaccattctaaggataaactcaaaaagtctaaacctttcgccatttaagcaaatcagttcaagataacattaccatatcccttttcatcttgatgtagagatgatggaggaagactagtacgcacagagagactaacaacgagagatattgcgcatagagccagattgaaaaactattggcaggtaagtgttatcagttctcattacagacatgaatgataagaaacactaatgaatttgggaactagggaggagtgtgcttggcatttgccgatgaagttctttgctggctatacggcactgttaaagaaagtaagttcattttttgttacgtctacatagaacaatggaagaagatcttttaaatttacatttcccaacaatgtgttttgcagacgaagattacatacttcagttcgtgcaccctttcatgagactagagcttcttcaagctcaatcttgtcctgatgccatcactaatcatgttcaccttctacaaaatcctgcatcaccaccaccaccacctcagtaactttatgcttctttagtggagtcataaactgtaatacttagggttcaaaatcaaatttgaaatgaaggtttagattttggatttcttttgtaacattttattaaccaaaaacccaaacattgaaaaaggaaaaaaaattgtgattcaaagattttaaactgggtccaagcagaaagcgagtctaacatgggccgggtctgttttaaactgggtccaagccttctaatcttatcacgtgagcgtcacgtgctctctttttctctctctctctctctccctctggctgacgaatcaccggagaacccaatttgtttcattcctttcccgttttgcccttccctgttcttttattcttttcttatctacaaaaaaaacttcgagcaagaacaaaaaaaaaaaactgtccatgtaccacaccatgagattagttgtcagatagatattcgcgagacgagaagctccaattaaaaaccctagagctcatctctctctccaggtacggccttttcgtttttggctttcaccggcgtggatctccggtgacggggagattcggaatttcggagagattttagatcatg

SEQ ID NO: 15981 - DNA, 3003 bp, Unknown; identical to SEQ ID NO: 15980
  misc_feature (1)..( 3003): 2750-1469P.txt file - cDNA_ID_1027047; gDNA_ID_1621100; Annot_ID_171385

SEQ ID NO: 15982 - DNA, 3003 bp, Unknown; identical to SEQ ID NO: 15980
  misc_feature (1)..( 3003): 2750-1469P.txt file - cDNA_ID_1027047; gDNA_ID_2926168; Annot_ID_140014

SEQ ID NO: 15983 - DNA, 3003 bp, Unknown; identical to SEQ ID NO: 15980
  misc_feature (1)..( 3003): 2750-1469P.txt file - cDNA_ID_1027047; gDNA_ID_2926168; Annot_ID_199304

SEQ ID NO: 15984 - DNA, 3003 bp, Unknown
  misc_feature (1)..( 3003): 2750-1469P.txt file - cDNA_ID_1027071; gDNA_ID_1621151; Annot_ID_56884
tatgttatattatattattcacaaatatcaatttaatatatattttaaaaataatgtacttatagaaaaacttgtacttatagccaaaatagttaaaaattatattttttaggctgtgagaaaaaataagaaaagtacaacatgattgtagttttttagtgtctttataaatttcctacaccccaaccaatcaatcatactcggtgtcttgaagaaaacataaaaaatatttataggaagacatgtaactgaagatgcgtgttttaagtcataatttttttttttttgaaagacacccaacaattcactaatggaggttgtctaaaaagaataaccaagaaaatggtctctgaacccatctctaaaactattttataatgtgtatatgtaacagtaagaagtgaaaaaaaaaatccatatatcaattaaggtgttaaaaaaaaaagtccatatatcaatcacttttctaacatcgtcgatcattgtgacgaaaatcgcttacgtctgtaccgtattaacgtaatgccatcaaacgaaaaagtttgctcactcactccggtttagatctttgttaacataagcaaacttttcagagagtgaactaatagattcacgaaacgacaccgtaattagtatcgaaaacttgactgacatcagcctaagaaaaatatcgcaaattgttataaaatattaaacttaagaagaaaaatgaaaatataatagagtttacttaaaaaaaaataatgggttagctgattttatacccataaactaattgcattctcagctttttcccccacactttttggctcttaaatttctaccataaactttgataattctttaaattacaacatgtactttcggattcatccttaaacatacatttccaattgaaccggtcattaaaccaggattaaccacaaatccgcgtttactgtaccacgatgcgatttacccgattaatcacctctatccgttaagaaaagggttggctgattttatagccataaactaattgcattctctgctttccccctcacactttttgctcctgaaatttccaccataaacttcgataattcttaaaattgcaacatatactttcagattcatccttaaaaatatgtttccaattgatttagattgtcattggaacaatcttcaacctcttttgtctattttggatgatgtattttcggaagttgattctctttaagatgatattatttaggttgactaattgatttggagtcttatctatccttatgattaggagttttatctagttcgatttgtcattttccttaccaattaacacaacacataacatatatagatagattcacattataaaacaaagagaaaacgatgtcgttttcttaacgggtgtgggattagtcgggtaaatcacaatagcggtacactaaacgcggatttatggttaatctcggtttaacaatctaaatcaattggaaacatatttttaaggatgaatctgaaagtacatgttgcaattttaagaattatcgaagtttatggtggaaatttcaggagcaaaaagtatgggtgaaaagcagagaatgcaattagtttatggctataaaatcagccaacctttttcttaacggatataggtgattaatcgggtaaatcgcaatcgtggtacagtaaacgcggatttgtggttaattccggtttaaagaccggttcaattggaaatgtatgtttaaggatgaatccgaaagtacatgttgtaatttaaagaattatcaaagtttatggtgaaaaattaagagccaaaaagtgtggggaaaaagctgagaatgcaattagtttatgggtataaaatcagccaacccaaaaataatagaattaacaagaaagtaagagacttaaggaaagagtaatagataaaaataagcattatccatattttatagatagaaatgagcgatggattaccaccacgcttatacgattgcgataattacatctatacttatccagttttacagaaaaaataatagataaaaataagcattatccatattttatagatagaaatgagcgatggattaccagcacgcgtatacgattgcgataatcacatccatacttatcgagttttaaggaaaaagtaatagataaaaataagcattatccatattttatagatagaaatgagcgatggattaccaccacgcttatacgattgcgataatcacatccatacttatctagttttaaggaaaaaataatagataaagataagcattatccatatttaatagatagaaatgagcgatggattaccaccacgcttatacgattgcgataatcacatccatacttatctagttataaggaaaaaataatagataaagataagcattatccatattcaatagatagaaatgagcgatgaattaccaccacgtttatacgattgcgataatcacatccatatttatctagttttaaggaaaaaataatagataaagataaacattatccatattttatagatagaaatgagcgatggattaccaccacgcttatacgattgcgataattacatctatacttatccagttttacagaaaatataatagataaaaataagcattatccatattttatagatagaaatgagcgatgaattaccaccacgtttatacgattgcgataatcacatccatacttatcgaattttaaggagaaaataatagataaaaataaacattatccatattttatagataaaaatgagcgatggattaccaccacgcttatacgattgcgataattacatccatatttattcaattttaaagaaaatataatagataaacataagcattatccatttttataaatagaaatgagcgatggattaccaccacgcttatacgattgcgataatttcatctatacttatcgggtttataacaccgataatccgatttggtcaaaatccggcggagaaaaaccctaaaaatg

SEQ ID NO: 15985 - DNA, 3000 bp, Unknown; identical to SEQ ID NO: 3750
  misc_feature (1)..( 3000): 2750-1469P.txt file - cDNA_ID_1027071; gDNA_ID_1620662; Annot_ID_47989

SEQ ID NO: 15986 - DNA, 3003 bp, Unknown; identical to SEQ ID NO: 15984
  misc_feature (1)..( 3003): 2750-1469P.txt file - cDNA_ID_1027071; gDNA_ID_1621151; Annot_ID_173248

SEQ ID NO: 15987 - DNA, 3000 bp, Unknown; identical to SEQ ID NO: 3750
  misc_feature (1)..( 3000): 2750-1469P.txt file - cDNA_ID_1027071; gDNA_ID_1620662; Annot_ID_163834

SEQ ID NO: 15988 - DNA, 3000 bp, Unknown; identical to SEQ ID NO: 3750
  misc_feature (1)..( 3000): 2750-1469P.txt file - cDNA_ID_1027071; gDNA_ID_2926151; Annot_ID_139323

SEQ ID NO: 15989 - DNA, 3000 bp, Unknown; identical to SEQ ID NO: 3750
  misc_feature (1)..( 3000): 2750-1469P.txt file - cDNA_ID_1027071; gDNA_ID_2926151; Annot_ID_198095

SEQ ID NO: 15990 - DNA, 2650 bp, Unknown
  misc_feature (1)..( 2650): 2750-1469P.txt file - cDNA_ID_1027104; gDNA_ID_1620788; Annot_ID_50425
gaattcaggaagctgctatatagtatttttaaaatcctaaatcagcaatgaatttagcaacttttatatttttagatctgggttgttaacatagaatagaaactgcagagcaaaagctaaatataaattctaatcgttttctatattttgtttgtaaggaaacattttggtgtcaagaaagtactcgttactttggaacaaagaaaacaatacccataaatataagataaggtttgagaatgtgagaatcgaggtggaatacaacagaagaagcacaatctcacgtggaacttaggcgtgaagatcctcttcctagaaatagtaagccaccaatttagaatctttctcactttcttattgtttataaaaaaaatgtcttcaaaaagtctttttggttttagcttttttcagcacatttagtccctttttcttgaaatcttagtatgcattgattaatctatatatggttttaaaataacagtttcagtttcattgaactatattcaggtcaatatctagtgtagttacaattgattagaaaagtgcatgcataattttgttttaaaaacttataattcaatgaacacatataatgtacattcatttcgaccaaagtaataaactcactaaaccaactgaaatgttaatgagcttaggcttactactttgttcttaacttaaatatcgaaacccattagcattatgggccttaataagattcatggcccaatgatctttttgcttcatcttctgctttcttctacgacaacctaactcatccacttcttctcctttcacaactcttcttctcttctttacccctataaattttacatattagtttatttttaatgtaaatttgattgaatttgaaaaaatacttggttaaaattagggtttgacccctataaatttgttctaacttccaaatgacccctttagttgatataactttttaatttatcgtccatcataaatttttttgtttatttgaccgctataaaacttgtttgtagatccgccactggtatatacatacattttaatggagctgtgagaatacttttgaggttcaactctcgttacaataccttttgtgaccgatatggtatcaccacctgtatttgcgcataacataactataataactcattttctttaagtgaatcatggttgctattcttttctcaataccacatatgtcaaagcttttttcttgccagctaatttgtactcagtgcgaaaaaaatttagcattgttcaagacgtaccacgaggataacctaaagcgtagacagtttcaccgataaaaggtatgcctccgagctccaaaggatttatatcctcccaaaactcttcactatcaatacctaagatagctaagtcacatccatacctaaacgctttaacttcagctttgtatttagtgggtgaaccatgttttctcacttgcaggtataagtgatcacccacaacatgagcgtttgtaagaatcctcctcccggagattgcaaatcctaacatagatattccaaagccgaacaataccatacgattttttaaaatttggaagtctaataaagaaatcacacgagagagagagaaagagagatgtttatgaataccagagcttgagtattctttctcagttgtttgccaaggttgaacaacatttggctctctagaaaaggagaagatcttcaccaccgcgtctcgagccacatcaacatcgctcacagaagaacaacaacgagatatcaaagaagcattaaaagacgaacgacgacgaagaagggaaggagaatagaaaaatcgatgaatcggagtgctcgtggagttgctgaacctagccacaatatgatgaacagaccggaacaacatgttcttgttaagtactatgtttactcgtattaacgatacataaatatatcatttacttgatactcatattttcgatccataataattacactacaaatctttttaaagattttaatggaaattgttaacattttaatataaggcttttatataatcaaatgaaactatagattctggtagcacataattaatctgttaagctctctcttttttttttactatgggaaaaaggtccaatgggcttaggcccaattatttaaacagaaaagattctaactttctaatggaaaataaaatttgcgatcaagcaactactctctctctctctctttcttctgccatcgccaaaaacttgtcttttgcttcttatttggtaagcttgcatttttctctcacccaatttctaatttcatgcttattagatcgttaattgaatctgcatcccgcagtgatcattctttgatttacgaatttgtttttttgttgtgattgataatcttgttgtcgatttttgtcaattttatggtttaatttacaaagtgtatattgtgattgaatcgactgggagggtattgagagttgtttgtttgaatctaacaaattcaagtgcaaatctattttatagccacttatcttctgctagtagatctacttgagttttaagagatgtgacttctttaataccattgtgaatttcatggctaactgataaaaaggtctcagctctgatcttttgattcaacggctcccggagacgacggaagcaatg

SEQ ID NO: 15991 - DNA, 2650 bp, Unknown; identical to SEQ ID NO: 15990
  misc_feature (1)..( 2650): 2750-1469P.txt file - cDNA_ID_1027104; gDNA_ID_1620788; Annot_ID_168192

SEQ ID NO: 15992 - DNA, 3000 bp, Unknown; identical to SEQ ID NO: 5555
  misc_feature (1)..( 3000): 2750-1469P.txt file - cDNA_ID_1027367; gDNA_ID_1620801; Annot_ID_168658

SEQ ID NO: 15993 - DNA, 3000 bp, Unknown; identical to SEQ ID NO: 7592
  misc_feature (1)..( 3000): 2750-1469P.txt file - cDNA_ID_1027414; gDNA_ID_1621153; Annot_ID_173328

SEQ ID NO: 15994 - DNA, 3000 bp, Unknown; identical to SEQ ID NO: 6299
  misc_feature (1)..( 3000): 2750-1469P.txt file - cDNA_ID_1027467; gDNA_ID_1621088; Annot_ID_170572

SEQ ID NO: 15995 - DNA, 3003 bp, Unknown
  misc_feature (1)..( 3003): 2750-1469P.txt file - cDNA_ID_1027467; gDNA_ID_2926212; Annot_ID_202708
gaagctgtctgaagatttcttatgtcatctttgccttttgttctgctttctttctcggtgctatcaaaggtttcaatttttcttctttgttttggctctgttttcctctgtttctaactttctatgattgattcttcatgatgggttcttttgaacaaaacaaagtttgattttttatatatatttcctatgcaggtttgatcgtaggtccaattgctggattaacattaatagttgggaatgttggagtgattctttgtttgttccctgcacatgttacttggactatttacgctgttgcaaagtaagaaaacttcaacactgttttctcaaaagatttccctgcaatttctttcttaaaggagaatcaattttataaacatgtcttcttgtgtattttctaactttcaggacaaatagatttgacattcctctgaaggtagcaatcttagtggcacttcctgcattgtttgggatatggttaggtctaagtctagcaattagtgttcttgttggtgttggctatggattcttcactccttggatctctgcttttgaagcctttagacaagacactgaatccaacaagttcttccactgtcttgtggtacttacataacttcccccagaagtttctttctcttaagcacttgttagtgaatcatatcacttgactgctctgtatattaggatggaacttggggaaccatcaaagggagttgcattgtggttactgattttgcagatttttgttaccattcttatccactttacttaaaggagttacgcgaatccccggtttcagatgagcttcaaactcttaggtaaagtaaaaacttttgtcctaaactattccaaaagagtttttgctgattcttgtgtctcgtcttgcaggttgattcatgttccaggatgcatcattgttgggattctaggattagtcattgatatccctcttttcactgcaatcgcggttattaaaagcccttaccttcttctcaaaggctggtaccgactagctcaagacgcgattaatcgagaaggaccatttcttgaaatagcttgtataccagttgctggtttgacagtactgttatggcctatagttgtcattggttttattttggtgaccatcttctccagcatctttgtaggactatatggagcagttgttgtatttcaggtacaccatgatcatattgaccgaatgattcgagaaaaatatcgggtttcttactcattgttgaatctctaatctgcaggaaaggtcattcagaagaggagtctcttatgtgattgcagtagttggagaatttgatgagtacacaaatgattggctttaccttagagaaggaaccatcttcccaaagtatgtctctctttgatttccatctttttacattccctttctttgcctccattatcctaacaccgcgaaactgtaatccgtgacacataggccaagatatcggatgggaagaggatcgttttcaagtgaagtatctgtgatcgttcacccttcagatgtaacaagagtcaatagttctggttctgtcgatgctccagcgatgctagtaccgagcctagttcactctgtatctgttagagaagcaatacaagaagtgagaatggttcaggtatatatcaaaagttttcattgtcgataccaaatctctcacgtttctactgagttttaaatatttgaaaatgtatttaatagatttgggagcatatgatggggtggtttgagatgcaaggcaaagagctactagatgcagaagtgttaacaccaactgatctctatgagtctttaaagggcagacacggaaacgaatcatcgattatcaatgtcgggcttccttcttacgctttgttgcatacattgcttagctctataaaagctggtgttcatggtgtgcttttgcttgatggctcggaagtgacacatttgaatagaccacaagacaagttcttggactgggtctttaatccaataatggtattgaaagatcagattcgagctcttaaacttggagaaagtgaagttaaatacttagagaaagttgttctctttggaaaccatgaacaaaggatggaagcttgggataatcacagtaacccgcctcaagaaaaccttcgaactgctcaaatccaaggaatcagcagaaggtaaagattgaaaaaacttctcttacaaagaaaagttcaatctgtatggcttctttggttctgcctgaaacttgtttgtgttaattaatctcattaagacaatgatggttttatttatcttgaatgttctaggatgatgggaatggtacggagcgtatcgaagcttccgacttatagaagaaggttcagacaagtggttaaggctctaattacttattattcagagaaacaaggcttaaatcgaaccggttccatgagctctggagatttcattgaagagggttaacctaggactaggagcaattgttgtagtctttctataatttttagatgtgtttttcatttcttgtagtacaaggtgtaaaaaagaatgtacagaagttgctaagtttgggactcaagaaaacagagcatttaaaaaaaaaaatgatttcaaagattgtgacaaagaaatataaaacaatagtctaatcttgatacgcgggccaaacaactcagaactatctcatctggcaaagaagaaaattcagacgtagacggataagacgacatcttcaatttcttcgtacacggtggcccttcgtcggcgccggaattcgacatcgggttttgttttaactctgttttgtttgagagagcataacgaaggcagactcaaactctgttttgttttaactctgtttttatttaaagttacggctcaagtaaaaaagcccatgtttgtttaagttttggcccattaatagcccaatatcacaaacggaagcttgtgaaattgtgtgagacgaagacggcgaagcggataacgaaaagctcgccgagaaagcacaaatg

SEQ ID NO: 15996 - DNA, 12 bp, Unknown
  misc_feature (1)..( 12): 2750-1469P.txt file - cDNA_ID_1027574; gDNA_ID_798; Annot_ID_144524
gcttttgaaatg

SEQ ID NO: 15997 - DNA, 3003 bp, Unknown
  misc_feature (1)..( 3003): 2750-1469P.txt file - cDNA_ID_1027604; gDNA_ID_2214579; Annot_ID_135225
tctcattgcagactcagctgcagctgcactgatgaaagatggtcgtgttgatggtgtcatcgttggagctgatcgtgtggcttcaaatggtacactcaaacaccttagataaatccgttttctctcacaaatctgattccttatgactgaatcacttcttaaccaattcattgatatactccaggcgatactgctaacaagattgggacttacagtctcgccttgtgcgcaaaacatcacgggatcccattttatgttgctgcacctcttacctcagttgatctgtcactttcatccgggaaagaaatcgtgatagaggaaagatctccaaaggagttgatgcacacacacggaggacttggtgaacgcattgcagcaccagggatctcagtttggaacccagcttttgatatgactccagcagagctgattgcaggaatcataaccgagaaagttcgtttttccagccttgcttgttctggaagatatttatgctcatttatttgaatctctcaacgtgtttgtatatgcagggggtcataacaaagaatggcaatgatacatttgacataagcagctttgccaagaagataacaggaaactcatctcgttgaagttagagtcagcattgcgacttgcggatgttcccctctctctatatacttgcaacaaagcaaattactttgtaatgtttgagctactaagtacactgtggtaaaaattgtcaaaaataagaaataatcgatacgttttagccaattgtaggtagccaaaatgctggtcttgggtttaatgctaatgaagattgggaaacaacttgttttagtgtaaaacaacttgtccatgggcttgcccggtccatcttgacttggttcttatttctctatttttttaagtttaagaaaagaataccgtttctcctacccgtcaatattgaaataatttcagaggttttccttgttctgtgtcaacaaacaattcgaaatgcctcgactttatcaattttttgataattctgaactttagaccaaatgcatatggacgagctatattctggaccaaaaaacaaatggtctaattgggcatatgaccagttttgtccacggataatatgggcttgaccatatggacaacgggctgcccatgggcatgaattgagtcaatagacatgtcttcatttaattgtatttttataattttaattacaattacaactaaataatttttaaataatatattttacatttataagtttttacttttctgaaaattttaaattttaatgaattatttcttattaaattatttacgattttaaaggaaagatagtattccacaattttctggaatacgcaatttttaaattttacggttttgacgggaaaaatacaattctccgattttacgattttgacggaaaaacgtaattctgcaaattttccaccaaaatcgtgattttattatattggcgagaacacaattttacggttttgacgggaaaacgcaattctctgattttacggttttggcgggaaaacacaattttccagccaaaatcgtgattttattatattggcgaaaaacacaattttacagttttagtgagaaaacacaattctccgattttacggttttagcggttaaatcgttatttttttgtatcggtgaaaaaaataattttacgattttaccgttttggcgaaaaaagcaattccataattttttcgtcaaaatcgtgattttattgtattggtaagaaaaacacaattttaccattttgtcgaaaaaagacaagtcttcgatttctacaatttttacggaaaaatgcaatttctcaatttttctttaaatttatgatttttgatttatcaataataacaataataaaataggctaaccatgggcttgccatatggacatggtctttattgggcatggacatttttcggaccaaaccgtccaacttggcccataaaaaaactgtccgtacggacacgcccaatggtctttggacggaccatttgacacatctagaaacaaccgtcagcagtagccattcgttaagagtttcagaattccgatatatacattttgatacaacctacacaaaaacaaagacaaagagagaaaatccaactatgaggaggattatcttgttgatagtgccatcaaaaacaagagttagttattcacctgaaggtttggctaaacaaagtatattatctcttttcatatacctgtcaattacatcttgacgctgcattgtcaacaatagagacctcctatgtcctttgtattcactcttggctttcttaagtactctagtagattcatctacaaatgtaaacatggttgtcttcgccgcgaggtcgtttgcatgttcttcttttacttgtttcgtttcagttcgttcttgatcctgcaagatcgggcgtcttctcattgcggcgttagttaattaaagtattttgtgcaaaaaaaatttccgtccaattttgcaactttatactctatgtccaaaaaaaacaaaataattatatgaaatttaaaataatacgtaatatagtcaatttttacaattttacatattgtaaacgtaaaaacatttgtttttgaaattttttaaaaaataaatagttaaactactcatatcaagaattttgatttgatatattatttatcaaaatttaaaagtttaataatatcaaaaaaaattatattgtgtatttttttaattttatataattattctgcattcttttaacgtgaaatgtaaagttgcagccccagggagtattttagagttttttcgaagataattgtaatcttaacttattatttcaagggtattttgggagattgactatttttttttgggttctgtcttgaagacaaagaaagctttcttctataatacatctttctctacagatcacacagaagcaaaaattccatctccgatttcggaagagagttgttctcttctctgagaagaagaagatg

SEQ ID NO: 15998 - DNA, 3003 bp, Unknown; identical to SEQ ID NO: 15997
  misc_feature (1)..( 3003): 2750-1469P.txt file - cDNA_ID_1027604; gDNA_ID_2214579; Annot_ID_186417

SEQ ID NO: 15999 - DNA, 3003 bp, Unknown
  misc_feature (1)..( 3003): 2750-1469P.txt file - cDNA_ID_1027695; gDNA_ID_2214704; Annot_ID_189774
actctcttcacacaaaaaagatgagtaaaagaaagacactttacaagccatcccttaaacctttgactcctcctcctcttcttgtatctgcaagtttcaacaagagcaagatcaacgatcaagattcgtcttacagcttgttcccggctattgaaacctcccctgagtcttttgtgtatagtttctacgaagaggatgatgatgatgagttcgttgaattttccaacttcaagatcaacacaaagaacaaagctttcaccaagcagaaggtcaaagtgattgattcggtagagaaagcttgtactgcaagcaagccgattaagaaaccgcagaaaagccatctttctgtgaaaatttcaagagatgaagatgataatgaatataaagccgagaagaagtaccaaaggcaagtttctagtggaagaaaaccatctgctgggataaacctcaaaagagtgaattcacctagaattcaactctcaggtactcgtagaagcacttctagaagatcagagagcaaacaagatgttctagagagcttcgctgtgatgaagcggtccgttgatccaaagaaagatttcagggaatcaatgattgagatgatagaagagaacaacatcagagcttcgaaagacttggaagaccttcttgcttgctaccttactttgaatccaaaggagtatcatgatcttatcatccatgttttcgaacaaatctggcttcaacttacaaaaacaaagtaaagaaaaaaataattcttaatgtaatagtagttaacctaatggtgaaagtaattagtatcattctgcttgtgaaattgtagttgttgacttgttgttgatgttcataagaagttagatggaactgtggagattctctctttgaatcccactttttatgtattgttttctttatttatctttttggaaaatgtaagcaaataataaaagttgttatcatattgtcgttttaatacaaacatgatcactaagggcgtgaaaacactgttaattaagacagatttttttatcactaattaaacatattcttgtcttctctatgattatgaacatataaaactactcacaaaagatgatgcttcaagatttgattatttcttagaatatgaagatggattaattgcgccaatatcatttgaatattttgaaaatacaaagttgaaaatggcggtaaacagcaacaagaaaaagacaacagtgaagagacatgaacaatttgaaaacgcaacaagtacggagtttatatatatgcatgaagaacattggataatcgttgaaggtagagagaggaccactgacacataaaactgagatgtgattaaagaagaaagaaacagtgatgagatttaatccttaagggtttttttttttctgtgaagaagggaagaatgaactcatgaagaagaagaagaggaccactgttgcaaattccatcccctaccacagttggcttatgaagtttcagcaaaagacatgtgatatggtatggtttctgacttctgagtgaacataagcaacaaatattcaaatcaatgggcctaaatgatcttgcagttttggattataaagttaagaattaaaaagaataggtgatatatgtatcataattttaagttttaaacaagtatgtcagacaaaattctacattctaattttatacatagatatgagataacctcataaccataaactacaccaaattttcatgaacaaaatatgattcacacgaacttttttctatcttgatcacctagctaacttgacaaattagttgttcgtctaaaactacacaaacattcaaagttcgttttaaattcaatatatttaaaaataacagttaaagttttattaaatggcattccaaatattgattccttctagaaaatttgtgtggttttaaattgtgaaatttggatctagaaaaaatagcaagtgtggtttcttgtgacctatggttgttagtgtagttgtataccattttttaaagttacattgtaatttgtaaaccatttttgtgtggttgacaaaaaaaaaacctatgacaaaattgctccgtttttattttcaataacaaattataatgtaaattaatatgtatcatagtgtttttaataaaaatatttaaaattaggattgattgttctgaaaaaaataacgcaactaatactttgttagcaaatactaacgtttacgtaccaaaaaagcattatgtaaatccattcatccatcattgtatacttgactttctacattattcttttgttgtatcaaatttaaaattaatgaatgaacttgacataataaaacacaaaatatatacttaaattgtacgatataaaagtttgatttacatattttatatctataaaaaagggtaaataaatgaaataaaacttttttttttttttttgtcaaagaaatgaaataaaactcaaattacatttttatgtcgtaatgcgagcacacaagtgagtgcatatccagtattaagttttttttttaataattcagaattgaaagcaaaggaaaaagaagaaatcgaaatcggaaactgtatattgttgttcttcgattcctcctcgctctacgccgcgtcctctctctcaaattcatcggaagcaaccttcttctcccatcatcgcctggttcgtttctaaaccctacttcttctatttcacagtatatcttcctttaattttcaatcgaatctagctttgtgtcgatctcaatgtagatcggaatcaagtaaaagaaatcgatgaattccaaaatgttcccgatctattgcaatgcacgaatcgtagaattatcacctacattagtcttgatctaatcgccctatttcaatttcaaattcgacatcgaagtttaaaggagatcgcaaaacctagttatagaatcgttgcgtttgagttgtttcgctggtgatgtagaaaccctaattttggttgtcctgtgtttggtacttgctcagaatccaatg

SEQ ID NO: 16000 - DNA, 2571 bp, Unknown
  misc_feature (1)..( 2571): 2750-1469P.txt file - cDNA_ID_1027716; gDNA_ID_1591932; Annot_ID_151718
  misc_feature (141)..(141): n is a, c, g, or t
  misc_feature (190)..(190): n is a, c, g, or t
cgcatataatgtgagataattccagtgggaagaggtgccgcagcaagagcacgatatagtttcttcacttctttattcttgaaaataagattaaaaaaaaacaaaacgtattgaaaaaattaactaatcagcagagcttgntcctgtttccattcaaacagcattgtaaaggaaactcactcttattttngtgtggaagaccgagcagtactcttttgttctagcaaatacgacactgtagagaaagaaagcaatttaacctggtcacttaaaagatgttaacttaacaaacttcaaagcatgaaaaagcttttacaggacagtaccagccttctgtacagttatcaatctgatgcgttgttttcagtggttctggtaaatccaatgcacgtgaggcaaatgtagcacagctctcttcgatgttatccgtcgtgcccccaacctgataacattccaatgtaggtcaacacattcaatcgctaatttcagtacttaaaccacaatcagaagtttctaagaaattgatgaaaggaaatatctctgcatacccaagaaatggaacacaataaaacattttgatagtaagttacagtcacataatgtataaaactagtccaacaatatttacaaggtgaagtactttttttgcaagatatctaatgcaactacaatggtcaagaatattgaaaagaaagcctaatggatatattacacaccgtagtcccggcaggtttatccaaaatgacataagagtcagtcacagcaacaatccgtgacttccaatcaatttcataacacctgataaacaacacaccctcaagtcaattgacaatcaatcaccaaaccttccaaatttctaaacacattccttgaaacgtgtaaataccttggagaacgcttcgggtgaacgtgcacacgcaaatacgttccagcttcagcatactgattggtatgtgtcacacgaaacgttttctgagcttctctaacagtttttcctttaatagaagatctcttctttagtacagaaggagaggttacttcttcaaacagtctaacttcctcaggagtcgcagttggtggaggtttaggacatacaagagcgtaatgtacagctccaaatcgaataagatctgcaacatatcttcataaaatgaaattctttatacacactccattacaagccctaagcataagagtacttagaccacaaagagttagtgacttacaaaggaggaagatctaattgtttagagataaactcagaaacaagaacgtcgtcttctaaaacaaccatatgttcaattcttggtggaagattatatgcaggacatggcatcaatcgattgtattcatggtatctgaaaaaaacacatttcacagtaaagtatcgaaatttgaacgaattgaatcaaaagaatcagactttaagcatacccagaattggaagaagaagagagtgtggtttcattttgagaatcggttttgagtaaggataagcaagtgaatctctttggagaagaaatgaaacgtggagagtgtttgttggaacgaaaaaatggagtagtgatacgggtgaatgctaaagtgcgcagaagagatgccggcgcagtgaggttccggtaaccgccggttaacgccgcgaagccattgttgatgctgtggtaaatgccctaagaatcgttatcgttatagcgccaatctactatttgggccgaactgaatctttgtattgggcccatttgagaaacttggttcagtgataaatttggttggtttggtggtttattccggtttgttggccgttttactaaggttgataaaccgaatattaattactttttcttaaattatgatactaattaaaaatcatgcagtctctggtttgtttatgggtcgaaattattatgttccctgactttatggtaaaaggagaaacatactaatctaagtgaaaattaatctacggcatgatagaaggaaaagtagttgaattagcccatcatgatttaaatgttataatggctttaaataaaaagttgggtgtagccaaaaagaaaatgtaggttgttcgaatattgtagttaatttaaaaagagtttatgtaatttatcaaccggatcatattttgtcatttctctaacaaccttgtgtcattgtatagagcatcattgcgttgtttggctgttcattttagagcaacatctcgacttctatattcgcttaaaaaatcctcaatcttcgacatgtctttgttaaattttccaaaataatatacattttatagacatattacgtctaaaatgttgatggtccgatcctagtagtcttttttattagaaaaatataaaagttaacagtgagattatatttgaacataataatcttaaatacagtaaaaggaagaaaatagataaagaaatgggatgaccaaccaacaaaagccatcacctatcatataaaaagataatacattttctactactttagcttcaaggatcttaataacacttcgttaccacttgatcaagagaaacaaaaagaaaagctgttcataaaaactctctatcaatg

SEQ ID NO: 16001 - DNA, 3000 bp, Unknown; identical to SEQ ID NO: 8946
  misc_feature (1)..( 3000): 2750-1469P.txt file - cDNA_ID_1027928; gDNA_ID_1971948; Annot_ID_58610

SEQ ID NO: 16002 - DNA, 3000 bp, Unknown; identical to SEQ ID NO: 8946
  misc_feature (1)..( 3000): 2750-1469P.txt file - cDNA_ID_1027928; gDNA_ID_1971948; Annot_ID_177317

SEQ ID NO: 16003 - DNA, 3003 bp, Unknown
  misc_feature (1)..( 3003): 2750-1469P.txt file - cDNA_ID_1027932; gDNA_ID_2936554; Annot_ID_194152
gtatttcaaaatttgataatcagcttcatgttaaccatggacttacaagtatatgtgtatgttaaacccaaaaagaaaaaaaaagaaaaaggtgtatatgtggaagcaacaccaatgttaagttgtagttttttttgttaaaatcactaattgaatttggttatcattttggtccggattgaactaaaccaaactatatatgaaccaatctaaatcctcaacatctaaacaaaatttaattaaaccaaactcagaaaaaaaaaaaaagtgttttcagctttcacataccttaattaggacttgaacatcgtcatcaagagccaaagaatcctttgttattcctcagattctgtttagttttattcttttgtgattaatcatattaatatgttggtgcagaagaattacagggcaaatctcctttggcagataactcactaattaaaagcaatgcataaagagatgcaaagatctaagtaatggtttcctgccaatagagatcttaccctgtaatgcatttccacctttgatccatctcacatgttcacaattgtaacttgcaaatttgatgttatataaacttggaaagaagcatattccacggtacaatgctactgcattgtaaataagaccgatgttttattccgacaatgatctcttcttcgtataatttcttaggaataatcttccatgccacaagttttatggtcagaaatattcctaaatgaagagcagtctaccaccttcttctcttttaacaatttctaatccttcgcaacatcttccgcgtgcatcacaacaaaagtaaaagatcgtacatgtgtcatttaaattcacaaaatttaatctctagttttaacataaaaagtcaatactaatgtgtgtctattacatatagtatgttcttgacctcgtggataaagcaatattatagttcactttaatactatatgatataatgtcaagccctttcatatgtttaacccaattatttgtctgatttgaatttagtccaaaagttgagacggttgtgagtcttgtgacttgacaaaatgtgttttgagatcttttgtttgggatcggagtactatattaaaaaaaaaatcataagaaaataaaagaatctttaatactatggaataagataaaaaagagagtggtataatagtaaagtaataagtagaaagtgattcttgaaatggaagatccgtaagaatgttcttgtgattttaataagcttctacctgaagacgcataaaatgcaaaagctcgaaactgcaatatgctctagaaagttataaatatgtacatttatgccactcaataaagtcaatcaactatgaaaaagaacaaaattcgaattctacagtatactataaaaggtacattaccctaaagtaattgactttatatatattatgtcattactttggacattatagaagattaacatatatcttagtcctaatatatatgttaatcaggtctcattgtaacaggttaacatatacactagaacataagcaatctatctactattaccatcaatcacaattcgaaagataaccttgttcatatgtgaaactctcagtaacttacatttcttcttaagcaagatcccaactttattccaactacattcctttaacaaaaaccaaaccaattccacaacaaataaagatgaaactgttttgcaatcacaaacttacttatgaatcaactggctctaggatccatcccttgctgccaaacataaacaagctcatcccaaccagtactcgccattaaaccttcaacaagaacactcatatcgatcccaacagcaaactctgtatgatgatcatacctaccaaccaaagcatcttccaccatatagtcccaaagacaaacactcatatcataagagcaagaagctatcaaactcctcctatgcggcgagaatttcaccttcctcaccgcatatccatgaccattaagcacagccaaaggaactctataactcctaacatcccaaaccttaactgtcttatccactgaagaagtagctaaaatacaatcatcatacttattccaatcacaagacaaaatctcaaaatcatgagcagggatgatcatagttgatccaggttctctaacatcccaaatccttaaagtacaatctccagaagcagaagcaaacacatcaccatgtttaggattccaaactgcttgataaacgcaataagcatgttccttaaaagtccttacactcgccggacgatccatagcccaaagcttaaccgtatcatcccacgaagaagtgagaaacgaatcgcgccgcgtgggattgtaatccacagattgaacctcacgcgcgtgctcttggaatgatctaatcggattagaaggaggaggaagagctgtgtcgtaaatcttcactgagccgtcaccaattgcggcgatgagcacagagtcatgagattctgaccaacatacgtcgtatacagcgtcggctgtatcgtacgagacggattcagttacgcctggagctccaggagcgagctcgaggacatggattcggccgtttccgagaattccgaagttctgagctgtagcgacggcgaggcgtgactcgtagaatggactgaatttcacagagtagccattgaacggagctttgaacaccggcatagcttcttcttcttctccggtgagtgattgaatcaaaagaagagtcttctcgaagattcaattcaacgatctgatcggataacgccgattttgctcatcgcagaattaattttccccccaattgggcctattgggctggagcctagcccatttgtgtaggttgtgttaaaacgatgtcgtttggcatttcaagttagggttttttgggggtttggttcaagcttcatcgtcgtctctctgtctcttcaatttcattcgttttctgagataaaagtgagagagaaatctaaattcgagaggagaagttttaatttttctgagttagattcaatg

SEQ ID NO: 16004 - DNA, 3000 bp, Unknown; identical to SEQ ID NO: 14851
  misc_feature (1)..( 3000): 2750-1469P.txt file - cDNA_ID_1027959; gDNA_ID_2684229; Annot_ID_192173

SEQ ID NO: 16005 - DNA, 3003 bp, Unknown
  misc_feature (1)..( 3003): 2750-1469P.txt file - cDNA_ID_1027990; gDNA_ID_1971748; Annot_ID_175261
catcctcgagaactccttcttgaggatagacttgttaacagagagcttaggcttgttttgtctcttagtcttggtggttccgagtacaacaccttggtccttgccagccgcctgaatggtcactgtctttttgttggccaaacctataatcatataaaaaagactcaaacttcaatcacattatcagatactaatacaaatccaatcacccaatagcatgtaaccaacaaaaagatagtcatcaattcaacaagttgttaattttcccaattacatttagctagacatataaaggtaatgacttgtgttcatatcaacagattcaacaaaagaacaaacttgagataaatctagagtaagcaacagttgtgtattaccagagtgcttgtacgagttgatgttgacgaggttgttgctctctttgctgaactgaaccttggcattacctctaccgaattgcttcaccaagaaacagttgtttctcttcacgatctcccagatcaactgtcctggaactgtggccatttcgagctccttcactgattattgaagaagaaagcatttagtaacacaacatatatgaagcggtaaaacaagggctacacagattgaagaacaaagaacggcaaattggtttgtaaagagatgattcaagctcaccttgatattagcagacctagatgacggcggtaaagagaagagaacgagactcgtgccggagttaagttatgatttatgtcgatgcgttaatatatatacattctctgcaaaaccctagtttggttctcggaggcaatgtttataagtcaaatataagtaaaccagacttttatcaaaagggcgtttggtctagtggtatgattctcgctttgggtgcgagaggtcccgagttcgattctcggaacgccccttctaaaatcatttttttttctgccaactaaactttgtttttcttcacccttgctaaattttccaaacaactctgcatccattagactcaaattgaccacttaactggataaatgaaaatcatcatcagacataattttcacttcaatggagcaaatccaaatcttgttttatatggtgaagctatagatcttacatggtgaataactatctatatttgaatacaaactcttcatgaagcattataactccctgaaaagcatcagcacaacacaacaacatatgaaaacactcttgacacattctttgttaccatcatcatcatcatcacagaagattccaagtttcagacttgaatgttcggacttagacccacatatcttcacctccttcagcccacattccccatttccatctcactctcgggttactcatcatacatgtcgatatcagattgcttcttactctaggatctttgtcctggtgaatcatcagtctcatgtctgtcaaacctctgtacttattaacaatagacctgatgaaagaaactgtttgatgaacattggtatgatctgacatctgtacacgtgctgttatttgcttcaggctgtctgttcccttcatatcacctaggccgccttggctttggaaatgtgtttcgatatctgaccaagtcctgggactcaaactaagagaagtaatgccagggaatgctttgaggattgttgccagtccaagttctaacctctcagattgttctatagactttactgaatccactgcaagctttttgatcttgttgccaaaactgatgttgctgattaatctgtacatatcaggagatacgagctctaaagtcttcagatcttgaaactccccaaaactaacaccttcagcgtcctccacagaaagatggcattgcaccaacttgggcgtttcaactagaagagatttaggcttgttgcattttagcttcagttcaagcaggtttggcgccacgatagccaaggaaagtggagcattcgacacagtccaatgacaactctttaggtgaagaaaatggattcttggttccttaagtcctccaacaccaatcaaattcagctcttgaagaaaagggaaacaatcattgaccttctctagattctcatcatcaagtctgatgaattcaagtgtcaagtatctgagattaggcatctcagtcaggccaactacagagagccaagcattcttcacctctagtttcactaacttactacctgcaagatacaaatagacttaatctagttactatcatatatcatcatcatcatcatcatcatcatcatcgtcttccaataaaaaacttctatttcaaacgaatccgaaacgaaactagaggaaatgatgatggagaaaaaaaacttacagtttgaagaaatgagcgccaaaatatccgattttctccagcaagattgaatccagaaatccgaaattgacaaattctccaggtcttcacgaaccctaggcaaccactccttcacaaattcgacatcggtcaggtacaaatccttggaatcttcttcattgaagtcgtcaaacgacattcccttaagcgccttatcgactccgactgagattgagcgaattttgctagagttctcgattaggcttctgaagatcgtcttgaacggtgtgacaacgacgatggaccgcgattttaagtaccgagaccaggtacagatgagattcacggcgcgaacctctcgagaaagcgagttcaatgtcttggaagcgactctacatcgtgctagggattcggaatcgttgattcgactcagaattttgatccagagctctggtggtaactcgtccatggtgtttcttgatttgggaaattgaaggaaaggaagaagacgaaggagagaaggagttatagaaatttggaggtacgtgtggttaaaatcccgcacgtgttaaaattgtaaacgactaaactacccttatgaattctggaaaataacaaacgtgtcatagagtgaagaaaaacccttattgttttctagatttctccgatttgtgtagtatcgtcgggattttttgaccggagaaatg

SEQ ID NO: 16006 - DNA, 3003 bp, Unknown; identical to SEQ ID NO: 16005
  misc_feature (1)..( 3003): 2750-1469P.txt file - cDNA_ID_1027990; gDNA_ID_2926196; Annot_ID_141259

SEQ ID NO: 16007 - DNA, 3003 bp, Unknown; identical to SEQ ID NO: 16005
  misc_feature (1)..( 3003): 2750-1469P.txt file - cDNA_ID_1027990; gDNA_ID_2926196; Annot_ID_201438

SEQ ID NO: 16008 - DNA, 1157 bp, Unknown
  misc_feature (1)..( 1157): 2750-1469P.txt file - cDNA_ID_1028034; gDNA_ID_1591466; Annot_ID_151028
tataaaaaatattaaatgcatttgaacmccatacaaattctcctaaattataatattgctaaacatatggataaagtaaatggtatcttatgtgtaaaatataatccatttaatttagttaaaattgttaaaattcaaacaacattctcttatagttatatcatattctatggtcatccattcatttaaccaatataaattatctttcaaaataaataaaactaaaatagatacatttttggtaaaatgcttatagatatatatattcctctatctatttctttatatatatcatttatttatttatttatacaaaaatatgcttataaaaaatgtgtatatatataaatatttcattaagaagttattatactattgatctgcttttctttgtatttttaatcaaattactattgatctgctatggtaccaattcgattcggagatccagtgatatggaaaaaaccttcggtttgatgtttgcattgtggtgaaatacatattataaaatcatacmcaatcactaattcactatataatggtgaatgcaaggttccccctaaatactagctgcaatacgttaaatttaatagaataacaacaaatgcaaagccaagaacacttgtttaataataagatgctcattcttgccagtgtcttctatcaaagaaaaactcacaaaacatggtgtgtatgtggtttgtttttaagttttaaccaagacaaagatcgttggtcttacggtagacacatgaatacatatgagtgggatttggtacaagaacacttgtttaaaaataaacaagtttaagcatgttattattaaacaagtttaagcatgttattattaaacaagtttcctagatttggtttgttttagcgaagacaaagatcgttggttcttcttaggtgtattataaaaatgttgtaatacgtatttgttcctcagaatctttagtttgttatgaaagtgagtgaaaacgcaaacgtgggtttgtggggagcgtttgcgttctaaagtttcaagaatcgacgcaaaacgtgagatgtgtttttggtaagcgtcgtgtctctctctcttatcctctgttcacgccattcacaagcctgtgtgaccacaaaatacgacagaattagagagaaaagatagagagatg

SEQ ID NO: 16009 - DNA, 3000 bp, Unknown; identical to SEQ ID NO: 2711
  misc_feature (1)..( 3000): 2750-1469P.txt file - cDNA_ID_1028034; gDNA_ID_1620580; Annot_ID_161121

SEQ ID NO: 16010 - DNA, 3000 bp, Unknown; identical to SEQ ID NO: 12550
  misc_feature (1)..( 3000): 2750-1469P.txt file - cDNA_ID_1028073; gDNA_ID_2214558; Annot_ID_134841

SEQ ID NO: 16011 - DNA, 3000 bp, Unknown; identical to SEQ ID NO: 12550
  misc_feature (1)..( 3000): 2750-1469P.txt file - cDNA_ID_1028073; gDNA_ID_2214558; Annot_ID_185813

SEQ ID NO: 16012 - DNA, 3000 bp, Unknown; identical to SEQ ID NO: 7202
  misc_feature (1)..( 3000): 2750-1469P.txt file - cDNA_ID_1028131; gDNA_ID_1621133; Annot_ID_56487

SEQ ID NO: 16013 - DNA, 3000 bp, Unknown; identical to SEQ ID NO: 7236
  misc_feature (1)..( 3000): 2750-1469P.txt file - cDNA_ID_1028131; gDNA_ID_1621133; Annot_ID_172537

SEQ ID NO: 16014 - DNA, 3000 bp, Unknown
  misc_feature (1)..( 3000): 2750-1469P.txt file - cDNA_ID_1028352; gDNA_ID_2936573; Annot_ID_194815
ggaccaggtccaggtcgcaaatcagtgtaccatccggtttcacctgaaacatttacatagcaagtatgtaaaatgtcaagtcatatgtgcaactcagaaaccaagatggggactgagagctgcaagatgagctcacctttaaccaatacattgtagctacatacttaattccccacgcagggaatagctctttctcaacaaaacttagtaatttctctctatttgtcacccacaaagccacgagagctccttcagcatgagcaagctgcttgatcggaagagataagaagtattggttcggtaaagtaggatacctaaaacaaagaaccaagaaacattggtcatgaactttcagatacaaaaaatacttatccacatgcatacattaagtagataacgaactttgatttctgatgagcacttgcattttcccaaggcggatcaataactataagattgtagccttcttcagatttagctgcatatatgacatcaataagactattacatcgcctaccgatatgataatgactgatcttttctcacatgactcaggaccaatcaacaagaaccagaatactctaaaatctcagcttttagcaaattatctataatggacaatagcacaagacttaccaggaacgaggtttcggatgtgatgtaaatcagacttcaaggcaacatggtaaaaagaactgtaatatcagaagaaccatttcacacagcaactaaaagtttccatttttttatagaatcataaaatcagacaagtaaaaaacacaaaccatgtagaagcaactgtttctgggcattatatatctccggttggaaaactcagcttcaacttcttctccaatctcattcactactaggttattgaacacttgaaacactctctgttcattacaactctcacctatcaagtccacaaaacaccatcaaattcatgggtttcaaatacgatctagcaagtgacatagagaaaccaaaaaaccttcattgtcgcaatgtagattaaaactcagtgttatctcatagaaaggagcttgccacactcctccaagctcaataaaagagacttcatcgtcacaacacttgttcaacaaactagaatcatcatcatcattatcatcacttagacctttcgttaaactcaacaactcaatttcctttagaaaagattcatgggctttcgataagaacagcctcgcttcctgatgacgaagattcgaagcttgctctcctacactaggaaggtgaaagctagagtttttctgcttccgttttcgctttttcggattagactcgctagagtgttgattgagttgcttcgaattgaagaaacgagagtagtaagcagaaggtgaaaccttaaatcgggtatatgaacggttggtgatacgaactgtgtctaagaagaaccaattgaattcgtcggattcgtagataccagaatcaaggaattgagctagcttatcagttttcgccatttaacggctccaacactctctagtctctttgttcaaacaaaaccctcaaagacgacgatagagacagacgtgtaggattattctcattaacccctcgaattttcataattgaccacaattagtcacctaattttgaaatgtaacaagtaacccctaatttagtgcaaatcctctgaaaatttcccggtaattaatggattttgttccagcctctagatttcgtaggtttatgtttaaaaacaataaagaacaaaagaatgaaaattttgatttttatgggaggggaatggtagtaagggtaagcattaaaagttacgaataattgaagcaggcgtttggtgaggggtcgctttgacagtttccccaaatatggggacggttttatttttgggtgggctttgttaactgtgacaatgacaatgactcgataaaagttttggacaaataattgatccaaacatgtaactttcatatagtaagaaaatcatgtatgattgtatgtaacacaaaaaaagaaagataaaatattcatagatcatatcgatcatctacctttataaaacctttataaaaccttcttataatcggtcgaaaaaaggtttttgtatttgcgtctcttgagctcttttgatgataatatcgatgtgtgtttaatagtgttatcattaaagagacacaacattaaatcccttagattttctgtatctaatatacccaattatcccatcgaccaatttgattgctttttagccattatatgagtttaaagtttatgttcaatgtttatcttactgtatttgatccatttatttcacttactaagcagtacttgtttcgtttattttgctgttttgagaacctggttttcataaagtaaaacattgttctcaataataataaaaatctagtaatggagagagcaataattatgaaagaaagaaaattataagataaggacaaagaagatccaaaaaaattcaaactatggaaaaaagttacgtgactaagggtataaccgtcatttaaataaaaacgggtcccatctatctctgtctttattaaacaccagtcaaccattcaggtcaatcgcgtgttctgtaattaccaaaagtacccctccggttaaatccaaacaaaaaaaccggttctgtttttgcataacgcatatagtttcagtacaatgctgacatggcttcttctaattggtccccgtggtgaaaaacctgtctctatcatcctctctttccctcctcctctaccttctctttactctgcttcttcttctctcatctctcttcttctctctctgcttcttcttgtgggacaaaccctaattattttacttcgatatctctccacttttcccgctcaatcatctgatctttccctctctcagcaatgcatgatcttcgattttctatcagtgttcaaagctgaaaaaaatcgaactgggtctgttgatttcttcaggtctaaaatcagattagattagagaagaagaagaagaatg

SEQ ID NO: 16015 - DNA, 3000 bp, Unknown; identical to SEQ ID NO: 2409
  misc_feature (1)..( 3000): 2750-1469P.txt file - cDNA_ID_1028371; gDNA_ID_1620531; Annot_ID_159729

SEQ ID NO: 16016 - DNA, 2396 bp, Unknown; identical to SEQ ID NO: 865
  misc_feature (1)..( 2396): 2750-1469P.txt file - cDNA_ID_1028388; gDNA_ID_1620330; Annot_ID_153633

SEQ ID NO: 16017 - DNA, 3000 bp, Unknown; identical to SEQ ID NO: 7200
  misc_feature (1)..( 3000): 2750-1469P.txt file - cDNA_ID_1028612; gDNA_ID_1621133; Annot_ID_56484

SEQ ID NO: 16018 - DNA, 3000 bp, Unknown; identical to SEQ ID NO: 7200
  misc_feature (1)..( 3000): 2750-1469P.txt file - cDNA_ID_1028612; gDNA_ID_1621133; Annot_ID_172532

SEQ ID NO: 16019 - DNA, 3000 bp, Unknown; identical to SEQ ID NO: 12790
  misc_feature (1)..( 3000): 2750-1469P.txt file - cDNA_ID_1028623; gDNA_ID_2214572; Annot_ID_135089

SEQ ID NO: 16020 - DNA, 3000 bp, Unknown
  misc_feature (1)..( 3000): 2750-1469P.txt file - cDNA_ID_1028801; gDNA_ID_2926230; Annot_ID_142635
tgctagagccataaaaccaatagatcaaagtattgactactttttcgcagaaagatgataacaacatagaattattacagttctgataagtaaacagccagagctttcctgaattcaccttttttggagccactttcaaggtcttctttttgttttcactagcttgacgtgttttcttcctgtgatacaaatttcaaagaaaattaactaacaacaacatggttgattataaacagcccacaaaatgctaaacaaatttgatgaaagttaactgtaacactaacaaaagttatctcatctactatttcttactgacaagattctttcaaaagaacaggcatcaataaattagtcagcatgaactacattctatcctgattccatatgtacattagctactattagccatgccaaatcaattttcccatagcaaatatatgatcgaatgggtttcatacccagagcttgatgacaagtcgagacgaatgcgagctgctgcactagtagaggaagatgcgtctttacttcttttttgtccagaggccttccttcttaccgtgtaaacagaccaaggctcagtaaaatccttgtcactaacacctaagcataagacaattatttaacatcagtataagatagacacagaaaccaattttgcaaaaataccaattgaaaatcaacagagactgagaactagcttgatagcaattttcaatccactcaatattggtgccgttttggaaatttgaagtgacccaattagtgctcttccactataacagaaaacatgataaattcaagcatcaatctaaaccttcttccaataattcctaaaaatacccaaaacccgaaaactaaaaccctagagttgcgaacaatttcaattcagatgaaattccttaaaatttgatacagtataacaaaactggaacaaaatcatcgcagctaaatcaattacccatatcagatcgcgatgtttggggacgagaaggagctgaggccggagaagccagatcagcagacatacggcgagttacgggtctaacgtccgtggtaataggccgagaagcgatttcgggagcagtcgccgaagtattaacatctttgggtttctccttgagcgtagtttgttctactaatctctttagtgaagaagtgagactcggattcgcgaattttacagaagaagatgactgttgagaagatctggagacggtgttagtacaatccgcgagcggtttcctctgtattcttcctccgacggagcgaggagcttccatttgtttacccggcgtcggaatcttgggatgattcatctgaggttttgtgggagaagatttctactctctgttggcgggaatgtgaaaagcacgaaaagaagaagagttctgaagaaggctcgagagagcttgagacgataataattgaggatttaagagaagcccaaattgggaaagtatcgttgggcccatattttttattttatcaactgggcccatgattttgttttgacagcactgggcccatatcataatctattctactacctttttagaacttgatgaggtgtaggggatcaacaaaattattgcttttctttttgtaaggataatattaaatatattgtatagaggggaactgttttttagaagtgggagcaaagtattagagcattatgtatcaaagacttgcgagttgttgaccaattaataaaggaattgcaactttaggtgattgtgatgtgaggctgaaatctttgtaaccaccaagtagacaaagtatgattcagcattgtatgatatatacgtaatttcaataacgattggaatataaagattcttgcatttcgagttatgtgatgagatctttagagttgtgttgaaacacgtaaattgcgatcgtcattacacgagttcctcgaataggttcggtgagagggacagagaatgagtgccatatttcaaaactacacgcattattgatagatatatgctgatgtgtttctttgatggacgtcgcataggaaagccacaatggaaatattgataatgttaactacaaaaaaaagtttgggaatccatataagaaaccatattatacttgagtctctcattcctatgctcactcgagtaggattccaaaaaacggtacacatcgatttttagccactttttaaacaacaaaatatcaaagaatatattggtctcatgaccgattctgaaaattcagctacttactgtttagaattataaaattcaatatgaatagtgatagataagatattcgcaattttgaatgataacaatgtaaaaccgcaaattgtgaaacttttgtccatcattcaaaaaatttagtttttggcaaaacaatccgtgaaaaggacaacattatttatgtatcaatacaccccactacctagtcacctaaagataaaatgagttagttcggcttaccattcaaactccacatgtataatatgatatttttatagattgacatataatatttgtgttttattgttcatgatattctttagaaagcttgaaaataaaatattaggataaaaatagttttctctaagttcatagtcaaatactactatctaataaaagtaaactttgattgaccccatatatataaaaattaggtaattggtactgcaacaaaacatgtgtagtacaaggagacctcatagaattctttgtacttgtactttctgttagtggattttaaagttggtaagcttttttccacatcaggtataactaaccttcctaaacctttatactttattattggaaatatggtaaatgcactaattcataatgttctcgtttcctttacgctaacttctccgaatctttgcttttgcgttactataaatattcagaagacaccatttcttctcattcaacaaacaagcatctcattctctgattcggtccatcgatctcaaaggctcaaagcttaatcgtttcctttcttcttattctagccatg

SEQ ID NO: 16021 - DNA, 3000 bp, Unknown; identical to SEQ ID NO: 16020
  misc_feature (1)..( 3000): 2750-1469P.txt file - cDNA_ID_1028801; gDNA_ID_2926230; Annot_ID_203643

SEQ ID NO: 16022 - DNA, 2630 bp, Unknown; identical to SEQ ID NO: 553
  misc_feature (1)..( 2630): 2750-1469P.txt file - cDNA_ID_1028866; gDNA_ID_1591913; Annot_ID_151683

SEQ ID NO: 16023 - DNA, 3000 bp, Unknown; identical to SEQ ID NO: 12317
  misc_feature (1)..( 3000): 2750-1469P.txt file - cDNA_ID_1028885; gDNA_ID_2214543; Annot_ID_134510

SEQ ID NO: 16024 - DNA, 3000 bp, Unknown; identical to SEQ ID NO: 12317
  misc_feature (1)..( 3000): 2750-1469P.txt file - cDNA_ID_1028885; gDNA_ID_2214543; Annot_ID_185294

SEQ ID NO: 16025 - DNA, 3003 bp, Unknown
  misc_feature (1)..( 3003): 2750-1469P.txt file - cDNA_ID_1028905; gDNA_ID_2213663; Annot_ID_132603
tggttcctccaagtatatgcaccctatgaatcttagcacggccatgctattggattcttctaaaatctagtttaagtgatttctgtcaactaaatgtcaggtcattccttctgtactttgcattgttgttaatgtgttgattaataagttcaatggctacaattagtttaagcatgcaagagagtttttattgtcggtcgtctagtttgatgtctttgcttgttgtatcttgttattttttttattttataaaagaaccgttgtatcttggttagcttagtttagtcttttttggtttgtatgccaattatatcatgtaatatttgaaaacttgtagtgattgatatatgattttcttttctattcgagatgattgatacaactctatatggttaatatgaactacgagcgttaaacttgaataaaaacaaatctatctaattcaacccgaacccgtataagaagaaaacaagattcgataacaagaaagaaaaaagatttgttgattaaagtaaactttgttttcttttatatacgtatatagaattatgaaaaataatataaacctttttttgtctggaaattgaggatctactcgattgaaaccaaaattgagataaacctaatccacattaattgattcagtttaatcaaaaccaaccaaaatgcatgcatggtaactgaaaactcatggctataaacgatagtacttcactaacaaaaagcataacatacatacacaaagggtttcatctcaattaatacagtaatcatttaaagggtatatatgacttatgagccaataattattgttttccgtcaaccatgagccattaattatttgctctaaatgtactgtattctgtatttaggttcagaagagtaataaaccctcgcagctcttaagaaaattgattactaaaataattatcgatattatgatgatatggcgaaatcacgtgcgaaaaatgaatatatgtgagaaaatttaagagtggcagcagatgacttaactctccagttaaaacgcaaccgattttttttttttccctttaatttgaaaaaaaagaaaagaagaagaagtctattttaaaatatgaggagtcacagtttaactcttatttatttctttgccggactatattatatacacgaagaattaatactgttgcatgttattgtaatgatatgtgtctctgtacttttcggaaaaatccttgtcgctatacattactgtggcaacggatcattaacatgtgaaggatgggaagagtacagaagaaagtttgttgaggtattccgcagacattgaaatgtgaataataataaaggaattgagttctagttggtgaagtgggtgaaacttgtatgtacattgtatttaaaatttaatagagagacatagagaagtttaatattctttcactattaaaaatatagtatatatattctttcacaattgacattttttttttttttttttttcacaattgatggacccttattaatttatcatagcgtcaaaccataagccaattttaaattgtgacattcctcgtttatgaaaacacgaaacgaccttattattgataatttgaggtattgagcctttaatctatattcttgaagtttttggaaaaaagaaaagaaaagaaaaaactattttttgaagttttacctgtggataaatctctaaaatcaaagacatgtcagacaaggtaactaccaaaatttcatcactaaattaatgtaagacatttctttgttcccaaaaaaagaaaaaaagtaagacatttcagatattaatgggccagtgggtgtacttttagatttttttataaattaggcctcattcgtattgggcccaatgggctactaaaacagtttcacgattgtttttttttttttttttttttaatttttaatatgtatgtgggatatttggctataaattatgtaaaaaatttcacgatagattgttgaatttttgaatttcgagttaaaatatcttcaaattacctcacatttacaaaaaggtagaactgttgaaaaactaatgctctataaaacactagacaataacaaaatacgtaatgcgtaaagaacctaaattatgattttatttatctttcttcctttttccgtgagtataagccatttttcatagtaaagcattacgaatacgacattgaacactactgacatataaagtagtagattttgatgggttaacttgtatgcttaatttgcttaagcatgaacttcaatgcttttataaaagtacttcatgagaatattcctcgttctatactagcagatgggttcgatagtgattttacaaccgttcaacaaaacctttaaacccaaaaaaccaaagaatgaaagtatctaaacttgattatacatttcttgtctaaattatcaaataacatactctcttttgtttacttataaacgatatgaaagaaataaataaaaagaacatagaatcttattatgatctagaagaattaattaaagaaatatatatatattttttttcatttctactcatgtttcttatacattctttaaatttgttcaccattttgatttacttgttctcatattagtttgttatacaactcacttagaataatgtagattacatttcagccaaattcatgtaaaagatgcttttctttgtgatgtttttaaaatgctttcttttcactttttttctttcttaactataaatcttgatgcaatgcctaccttcttagaacataagatcttctttaaaatccaaaatcgtaggccactatttcattatacttatgtaatatatgtgatacagatacatctatatacaaattaaacacgaaaccatacatgcacggtgtgatcacacacgcacacacatagaaacataaacacgcaataatttctatacagtttaatttcatttttaacttacttctttttttttggtgaagattcttgagagaaaagaaatcgaagatg

SEQ ID NO: 16026 - DNA, 3003 bp, Unknown
  misc_feature (1)..( 3003): 2750-1469P.txt file - cDNA_ID_1028908; gDNA_ID_1620627; Annot_ID_47166
attcttaaaacgatgtcgtttttaagttatagcatcaaatacgtgttattttgactcagcaaccgtaacagttgactattacccattatttacgattttgaattgtgcagtaactgtaaagtccagatataaaattcaaattttttgaagtttgaatatgaattaatcctataatttattcgcgtatgaaaatatacttaacagattttaaggatatgaaaatactttttacttcatatgcatatgtatatacttgtttgaactttaaagtcaatggagaaaatacactagaggttacaggtgctgccgctgcaatgcaacatgtcgtttatatagtaactgatagaaactatcaactaaagtctcatcactaaattttccttaaaacttattacattactcactactacacaatgcattaaaaataacatatttgaaagtatattgtgtatgctaatttttgatgtgtacttaaatctcattattggtatataagtaaagaactttaaaaactaaagataggcagtaaaacaaatcatacataaaatttacgttgaaattagtttgaatcaaatttgcgatctacagttttcgtgtaaaactaatcaaagaaaaacgattcaaaataaccaatatattttgaaatgatgattaaaacttggcgacaaatgaaataaaaataaacaatgggaaaaagttttgtgttgttgaccaattagagaccaaaagactggtttttgtagtaaaaagcagattacgtacaaaacaatttagcgggtgggtatatggaatttaggttcagaatattttcttccttttaggattagggtttgtcttgcaatttaggatgttattggacatctgttcaattatggataggtgggaatagggtttgagtctcacatataaatccttgaattttccactaccatgtacatctatatatgaaacttcataaagtccgatttaacaagtttgcagtatggcgagatctgttttggcatcttagaaacaaagcttaacactaatacaaaaataaatattcgtcaagaacaagagtagatgacaaacaagctaaaggaggaggaaaacaactaagataactagcaaaagatagcatttcatactacaagtataaggtaaaaataataaaggcacaaaaatacccggagaaggcatttcttttgggtctcttcaggtgtctcactcttaaacttcttgatcatcttctcattctcaaaggaggtgtcgctctagtctttacctcatacattcttttgttcattttctctttcttatttttttttttttttcaactttcgtttaatgtggagatttaatatgtaattcttatctaaaagataattaactttttgcttatgttttgcttatttttagtctttttttttgttaatatagtttctttgtttttgtttatttatttttaataattgtagacaaaaataattattaggtttttaaattagtttgatgtttttaagcaatatagttgttggcggcggaggaatacatgtactgaagataaacacagttaaacctttttagtaaccgaaccgacccatttggattgagataaaatacaatcgaatagtttgagtcttagattgggtttggtttgggtcggtttgagttcggttgggttgggtcggttcggttaaaatgcccacccctactttcccatcatccccttgacaaattaataaccaaattagtcataatccaatctttcaacatgaaaaccggaatatgagggtcaaagcggacccattaagagaaaaggtgggtcagttgacacaccttaaatctacaaataaagtttaatgcatgaaatttgttaaagagataatagctaagttggtttatcatgtgtcattgacacccccattatccaagttcaatccttccctatgtactttttcgtaaaaaatttctttttatatattaaacgaaaaaactattgactcaggtaaaaatctttcctgggtccgccggtcaacgaggaggaaacacgacggaatgagagagagaagttggtggcctaatttttgtaggagaaaaaacacacagaaagaaaagtaaaatgttgacaaaatggggttgggaaattgagaataaaaattcaaagaaggcatgcatattgcaataataatgtgcgatttgtcaaacaagtggggctgtgagagagagcgcgtggtcagcacgaagaagaagcaggtacagagttttatcaccagctatctatctttggtttgttcttaaataataatcaaacgccatctctctctattctctatctatcttctccacgttactaccacctaacctctcatccaccttttctcctttaagcatatttcatttcatctccgaaaggaattgtatcgttcctcacacacgcctctcatctcttatccgtaagttttgtttctcttttctctattgatgtacccttttgcccatatttgtgcttgtgaactcgcatttgatcgtttatgctagatctggtttgggtttagtcgtttagatgctcgtcaagctccctttgaatcactagtgctcttagactcttatatttactgatttggaattttgtaattcaaaagtccgagtcttttgatgaacccccgtgccgaccacacgattgctttcaatttgggcttcttcttaattttggtgaactattgaggatttttgcaagtttctgtgtgaatcctagagtagaatgactcaaaaatgatttcttttgattcaattatatgcgattgttaatgtctttgaggttctatgatctggaattagattttggtattatcttagtatatcaaagcttagatgatgtttctttagcatgtaactactattgtccatataaattgcataactcatttaactttcgagcattctctgcgtctcgattacttatatggttcctttgtttgtttttgttcagattcttgtccttttttcagctcaacaagaatg

SEQ ID NO: 16027 - DNA, 3003 bp, Unknown; identical to SEQ ID NO: 16026
  misc_feature (1)..( 3003): 2750-1469P.txt file - cDNA_ID_1028908; gDNA_ID_1620627; Annot_ID_162522

SEQ ID NO: 16028 - DNA, 3003 bp, Unknown; identical to SEQ ID NO: 16026
  misc_feature (1)..( 3003): 2750-1469P.txt file - cDNA_ID_1028908; gDNA_ID_2926186; Annot_ID_140810

SEQ ID NO: 16029 - DNA, 3003 bp, Unknown; identical to SEQ ID NO: 16026
  misc_feature (1)..( 3003): 2750-1469P.txt file - cDNA_ID_1028908; gDNA_ID_2926186; Annot_ID_200652

SEQ ID NO: 16030 - DNA, 3000 bp, Unknown; identical to SEQ ID NO: 11942
  misc_feature (1)..( 3000): 2750-1469P.txt file - cDNA_ID_1028949; gDNA_ID_2214523; Annot_ID_184683

SEQ ID NO: 16031 - DNA, 849 bp, Unknown
  misc_feature (1)..( 849): 2750-1469P.txt file - cDNA_ID_1028984; gDNA_ID_1591471; Annot_ID_151034
ggaaacaaaaaaaaaactaagcagcaaaacacattccacatcaattaatcccttgtgccattcgaatccagaatcgctatacctacaaagacatcaattccagatctctaacctaaccagaataggtgagctgaattacccaatcgaaactcctcactctttacgaattcgaaatcggagtgaaaaatagagttacgcagaatcttacgttgttctcggaagtaatttttgccttgaaggcgacaaccgaggcgatcaagagcttgaccagtctcacggatccaaaaaccgacmgagtaaaatgctctgcctagggttcccattgatcgtcactttcttcgagctcacaggtaaacgaggactcaacactgaatgaagaagacgaaaatggtcgaagctgaagaagagacggaagaaaaaaaatcagcgaaaatggatttcaacaggaacattccgggacggcgaaacaataaattacagttacagtggtttaatatggtttaatcgaaccaaaacaatacgaaatatgaaccaaatctaattcgatatttcaggtagtagtttcattaaaccgattatattattcggtacgaatttattactatattttcactaaattgaacggtccaaaacctgccgaccaaaaatcaaatggccctatcagtaacaatgtcgtttcgtatcgtcgtcacttgcaacgcataacacgtgagaaaagataaacatcgggtaaaaatggcccactggtgggtggagaatggtaataattcagtttaaaagctaagccttctcactgattaactcaatcattcatccgtctctgcaaacaaaggaagaagaatcaagatg

SEQ ID NO: 16032 - DNA, 3003 bp, Unknown
  misc_feature (1)..( 3003): 2750-1469P.txt file - cDNA_ID_1029444; gDNA_ID_1621105; Annot_ID_171547
taagggtgcctttaatgtgtgaacatgagagattttgtgttttcccaaagaaattatagaccatttgatttctattgttcacatattaaagacaccctcatttttaaagacatctcttattttgatgaccaataaggatggttctgtcattttattcgaggaaaaagacacatataccaatattgaagttggtgtagaaccataaaaaaactgtattgcattatgttttacttttaatactcttgtattttactttgaatacttttattcaattatttgtggtttagatgttacacaatctccttagcaagtaaaactttaccctcattgatcccatccagctcgatcatgaatacaacaaccatttgccaacataacaaacatgtgaatcattgcttcttaaagcaactgcggtaacttccctcgtagaaggtatgccatcattattattaaataagattatgcaacttgagcatgaaggttgttttcgagatacatagaaaccaaattcttggatattctggacacataatgtgcgagtgaaatgcttggagcttaatttaaaacataccatcaaaatgcttacacttacattatggttttacaaacttatgaggtgtaaaggcaatgccaagactctatagacacaaaaagtttttcacttgcaccatagcgtatagctctaatggaatcgtcatggaaacccatcaaattcatccaccaaaataactggatatttttctctgtgaataaaacatttaaataaattaaagtaacaatcatattgaatactagatagatatataaacactcatctattctagcaagtttttttttaaagctagaaaatcaatctttgtgcaacaagataaaaaaaattacaatatcaatcttttaggaacatatggagtacaagttactaactacaacgatgaacaatgttgagtaattgtatgataaaaaaatcaataagccggtagggagaaaagagagaacaaaaaaaagtaaacaacttcttaaacacatgacaaaactaggtaaacctatttaaaaaaacacatgacaaaatttatgtgagttagacacggattgaatattataaaatatcaaaatatatgaatatgaatccgaatatgttggataaaaaaaaagaaattatatgttccgccagcgaatatatcaattcagatatataaaaagagttgaaaataataatataagagtatgaaaaactaaaaaaaaaaattattattaatatatatatatatatatatatatcatagaaaagttttcaaaatgattttataaacaagttagaacatcttataaataaaagtaagatttcacactatccttattaatccacttggcaatttatttacaaaaaaaatattttcaattaaaccacaaataaaacacatttaatgagagtcaaatacaatttagctgggttcaaagagagtcaaatatggtagctgattctttagcgaagcaaccgatacaaggaaatgtttcatctgtgtttcatttctatgttccttttaatatttctgatgcatttgcatcgtgactatgtagtatcatgttcttgattaataaagctgatgttcaaaaaaaaaaaaacacatttaatgatatataattaagtcacactattttttggtgcttacatttaactcacactttaatataaaactaaagtcatataaattatatatttactatatttctctacaaaattttattcacacacaatcaattagaattttcaactctcatatttatttttaaattgtaactctatcacttcccatcctacaaatattcattctctcattgactcatcctcttccactatatctcaaatctatttttattttttgtggttgttgttgtatgagttaaaaaaaatcaatttaaataccattgtaaaagcttaattttttcaaaaaaatttctaatgccaatacgttatacttatcccttctttatttttatttattttttatttattttgaattaacatatgtaaaataaaagtttttttttaattgacatatttttatttctgaattgacatatataaaataaaaaattgatggctataacaaaactttcaggtttattctcaaacattaccaatgtgtaattgtaggcttgtagctatgttcctggcttttagctttttggttccaatatgttttgttttgtttttaacatttgtgtattttttgttttttaatttttaataaaatagaaataaaagatttatgaaagacatattcaaaaatataccatacttttctatgtactcgatatttattttagttgatgttttagaataaattgtttttttaatttagatgatatttcaaatttcaatgcaaaattaattagatttcatattgattttggctatttatattttgcatattgttttatcatttgttaaatcatgtttagatagacaataaatattattttcgtttagaactaaacaaaagttaaataaattttttaattgatgtgcaaaaacctccaacatcaacaaaaaaaaaaacacggagagggtaatagacaaatgtggatccatatcgaaatccggaacaataatctgataatcccatgaacttcaggtatcgtatttttcatagcatatcgtatagatctgggattgagggtagaatttcagacattgtgcaccccttgatgtgaacaaatgtggggacaattctaagccacatgtcactatttccttggttgtcttccgaccattaataccccatctcccaaactaacactcttctttaacacacacacacacacacacacaacaacaacaacaacaacaacaaagaggctttaatgttttagtctcttgttcacgtgaaaaaacaaactgcaattggataaccacaaccagaatcgattttgaatcatcatttctataaatatatacgactcatacatacatatacatacctcttaaacaaaactgagatg

SEQ ID NO: 16033 - DNA, 3003 bp, Unknown
  misc_feature (1)..( 3003): 2750-1469P.txt file - cDNA_ID_1029469; gDNA_ID_2684126; Annot_ID_191105
aataggccatttaatatgcaaatatacgagtagatattttagtagtatctctaaccataaattaatagacacgtgaatttccccattaaccgccaagaaaagacaaaagaaattgtagaaaatcaataaattagctcaagaaatctgtaatcatttttaaaattgacaataaaaataaataaatataccgtttatttttcaagtaacggagttagattgatttctataaatagttaaaaatgaccaattcatcttcttcttcttcacaaactttctttctccaacaaatattattcagtgccgagtcaaaattagtgttgagaatttgctgcttctgatcaggtctgttttatttaatctctgtgaattttattacttcttcttgttggatctcataatgcgatttatcagctgcgattaaatctgtttgattgaaatttatgcctgattaggaaaaattatctctaatagtggatcaatttcgtttttttaattcgggttttcttgggttatgcagtgagtgaagaaagtttgaagctttgagtaactttgaaacaatggaggtatttggaaaatctcatgtggttgttggctctgctaatgttatttacttatctgctatattgggtcacgaaggacccaatcacaaatgtgattggaaatgcgagaatgagaatgtgtgtgggaatatgtaccgttgcaaactaactgggttgactcatgtttgtgacaagaactgcaaccaaaggattttgtatgataatcataactctttgtgtcgagctagtggtcggattttcccgctttctttggttgaggaacaggcggttaaaggagtgaggaggaagcttgatgatgagagtcaacaacaaccttctgaaagttgtgttaagcgtcgtcgacgtgatgctcagtttcattcttctccttttgagaggtcttttgctgctgtgagtcctttttgcagccaagctggtggagatggaatggagattaactagttcttttctatctcacctagaataacttgcttttctttttcgttttggacaagtatgcaataagagatatttactcatgtgctcttacagagagtctaggcttagctctctgtctgaagaagcacttttatcttagtattgttgaactctatgtagtatttaacgtaggagagactttatgattctgctactttgttctggacgttcttgttttcgctattattaggtgaagtagaataacacccttgtttcagctttctttctagtgctgtctgatattctcctctcgcaccttttcttagctttgtatcttgtttttgcttgcctcttgtaccattggtcattcttttaagtttattgcgacaggtttttgtcacattgctgaaaattgcagtgtaggtttccaccaagtttttcaagaccaatttctttctggtttgtcatcttgtagaatattcctcttcatcctctcaatggagacattgttgtatcctatactttgttcaaatttaacttacttccttgcagtgattgatgagcactagaagttctgaaagttttttctgtttgtgcaggtttcacaatcttgccatgcaagagagtttagttaccattatttgactgttatgtttcttaattctcagtgtttgaggagtaagtctaacaattggaagcttgaatttttctttgtaggtaggtctatgtttgtgctcagcaggcagcagaggaaggacggttgtcgaaagaaatgatacccgacgtaagattgcggatgaagacacaagtaatctaatatcttacatcaatggaactgcgtgaaagaaaggaaagggttggtgctcttctttgcattcaaaaatggatgattctggtacgtagtagcttatttacaactacttgttctttacttaatatatccagacagtgtaataggggctaaaagaaacatcaaataatatatgcatttcccatgtaatggtaattgttggaatggaaaatgttattttgtcagtgaggaaaattctgaggtggatttatattgaactatatcatataagacagaaaggcgaaggtgtggtggttgatgtgacaactatcttactgggacacagagaattttgcccaaaaaagttggcaaagtatcaattgttggctcgtcctctgctataaggtacaatgctggaacatttctccttagctattgattattatgatggaggttatattcaacttagagcaaaatatgtgaagtagatcttttgttgtttgaagaaatcaatgtaatatctaaattatgacatattcttacagtcttctgtgcctttcaatctgctacaatgctttcttcaactttgcagaaatctgtacacattctgattaatctttgacgttttcttaatcgaatatgaattaagtgttgtttcttctgtatcaaatccaggttagaggatgaaccgagcagccaaatcttcagaagttcagaaccacctagtccgaatcataatcagaatcaaaacagcaaggtgtggcagtggctccctaaggttagcatcaagatccaaacctaataccttgagcatcatcaatctacagagttctccctccacattcagcggcattttcgtttgtttttatagtaaccactaagctcaatctactgaaacaaaatatctcgttgttgatgatattatacaaacaagtaaaatgtctatttgagcttctttcatgcttcaaacatcatctaaattcagacacaaaacaagcttctctatacacacccaacttttttacctaaaaagaatggagaaattgagcaattttcagaaatcagaactgagtaaaatgtggcaaagacgataaatgggcttttttcaggcccagcatatcatatataacccaatgggagatgagaaggagggagagataagactgagaagcagagaaccgaaagaagaaaacaaaactctcgaagtcgcaacagaaaagaaacgagagagatatg

SEQ ID NO: 16034 - DNA, 3003 bp, Unknown; identical to SEQ ID NO: 16033
  misc_feature (1)..( 3003): 2750-1469P.txt file - cDNA_ID_1029469; gDNA_ID_2684126; Annot_ID_137196

SEQ ID NO: 16035 - DNA, 2707 bp, Unknown; identical to SEQ ID NO: 2529
  misc_feature (1)..( 2707): 2750-1469P.txt file - cDNA_ID_1029535; gDNA_ID_1620552; Annot_ID_160338

SEQ ID NO: 16036 - DNA, 3000 bp, Unknown; identical to SEQ ID NO: 9117
  misc_feature (1)..( 3000): 2750-1469P.txt file - cDNA_ID_1029576; gDNA_ID_1971986; Annot_ID_177720

SEQ ID NO: 16037 - DNA, 3003 bp, Unknown
  misc_feature (1)..( 3003): 2750-1469P.txt file - cDNA_ID_1029586; gDNA_ID_2214595; Annot_ID_135473
aatttcgacatcaaacaaacttaatatatatatttgatatttgttaattcaaatcagatcagtgcaacgaatcagaaggcaagaaactaaacatgaccatatctctaacatttcctttaagatacataaatttcctcatcacaccttctttcacaaacccaactttttcaagaaccttttgagatccaacattgtcaacgtcaacaagtgcctcaagcctctgcatctctggcttctccttgaatatctcccccgccacaagcctcaccgcttcagtggcgatccctttcccccaatacttgcttccgaggacataaccaatctctcctctgatctcatcgactggcgttacggagatcgagccaatcggacggtcgttatctaagcatatagctctaagccaagggtgtggcaaaagagcgtcgtttaagtacgcgatcgcggcttctcggctagtgtaaggctcccacgtgcaaaagcgtgtgacgtttgagtcagtggcccaaaccatgaaatcgtcgacgtcggaaagagtcattggccggagatggattttctccggaggtgaggaactcacggtggatagggtctccggtttgatcgtagtagttgagtccatctccattgactttttcttggttactttcctttttgagtctttgaagcttctttgggattctttaaaataaattatctctctcaattcttacagatttgtgtagaggcattatgataatacttcttctacaaatcacgatttaaatactgatttttttttaacaaaaaagaaaataaacagaacgttccttcttgcttcgatcggtcaaatacgcaacaattagttcttgttgaatggaaggtgtgaaaaagacggtttataatgggtatgggtgaaccgtatatttaccatccattcatcgtttttgatttaaaagaggtatattcaatctagtatttaaagtgactttcgtaaattttacaagtatatgttatttaattatggattttgaaaattctaatgaaatctagtgttattaaaataataatttaaaaatctacctttaaattcactgttattaaaaataatttatggatttgatttttataagaatgtattcaatctaatattttaagtgatttgtgtaaaatttataaattctatgttgttcgattatggatttgaaaaactttaatgaaatctagtattattgaactaaagatttaaaattctatcttaaaatctattgttattgaaaataattggtagatttgattcttattaattttgaaggatttgagaaagttctttagttaaaaataacaaaatcgaaattcatggtcttatatagaattttaaaatattttataataaatcacatcaattttcctaaaatcatcaaactcatataaaaactagctaaaactcaaattgtaaggtccaaattaatgagtcaactcaactcaactcaactcaatccatgaaccctaatgagttgaaaattttgactcaaatgagttgatgagtcaaatgagttgatgagtcaattggtttgatgagtaaaatgagttgggttgtaatggttaatggtttcaatggtttatccaattaacccatcaaattttgtaaaattgaattaaaccaactaaaatctctaaaccaatgccaatttaagtctaaccaacacatctaaaccaatttaataaaattaatatttttccaaatttcttaaatatacaagcgatgaaattgagaaaaagtaaacccgtaatttttccgccaaaaacgtaaatccgtgattttcccgccaaaaacgtaaatccatgattttcccgccaaaaacgtaaacccgagattttcccgccaaaaacgtaaacccgtaaaaagtggaatccgtaaatatattaagttttgatgataatgaattaataatgataattatttattattattttataataataattaattaaattattacttaaatgggttaacccatttaacaactcaacccattaaattaaatgagttatgggttgacttaacccatttaacaaaatgagttggatcaacccataactcatttaaccctaaactcatttgattatgagttgagttgagttgtgttacccattttgacacacttagatctaatacacctctttattaattttaaaggatttgagaaaatttaaaaagatttatttagttacatatataaaaattcaaatctcatatttttactggaatttgattttttttttttacaataaatcacataaaaagacattaaaactcaaaattatttaaaatataaggttcaatacatattttgtcaataaaaatttaataagctgctaatatagttcatgagaaaaatcaaaaattaatttatcaatcgaaaaaaaagacgaagaaaaattaatttatctacgtagcgcaagagacggagtgttgtttatttaaagaaaagaaagaaaaaaaaaagaacgaatattaaaatggcgagtcgctctcttttctctatctcaatctcaccttctcaatttacagttttgccatccatcaacaacgagagacgacgccttgctatcgccgctcgatctcaccgactatcacgccggaagattcgtaagagacctcctgatagagatatgtcctccatagtttcaatcccggagcttcctcgccggcgggattctgaggaaagcctgcttttagattctcgaatcagtaagttcttaaagcaacagaatcctcagaaattggcatttgggattaggttttgcaagtatcgaagctccattaactgaatcctcagaaatgtgtgtatatgaataggtgtagctgaaggagatacatcgaatacagatgtagaaggagacagagatactacttctagtattagaacacagcctccccctcgtaaaggaagaaatcttagtagcagcagaatcaaattctacggtgttgaattatcaccagataatgttgctgtagcaatg

SEQ ID NO: 16038 - DNA, 3003 bp, Unknown
  misc_feature (1)..( 3003): 2750-1469P.txt file - cDNA_ID_1029586; gDNA_ID_2214595; Annot_ID_186886
aatggattaaatattttaatactgttaatatttgtggtgcaaatgatcgtaatcgtttgttatatactgtcaaaatcaactcaagaatcaagtcactcaacatgttgtatgattaagtaatttagctaaagattaattaatcgaatgttatcagaattccattcatctatcgctgtaaaactagctatcacactatctttttattgtataaaatatttcatgtttagattcaaaaagaaaatatatatatatatatcatgtttcattttgtacttttaattttcaatataaacttacattttttctgagatagtgaagctttgttttatttggtgaagtgaacatggtaaatagtaaatacattactctcaaattataaaaaataacttttgtatgaaatagttaatatataaggttacaactaacaattacataagaagaagaaagatagagcatcacatcaaattatacatgtgatttttacaaactaagcaaaatataaatttcgacatcaaacaaacttaatatatatatttgatatttgttaattcaaatcagatcagtgcaacgaatcagaaggcaagaaactaaacatgaccatatctctaacatttcctttaagatacataaatttcctcatcacaccttctttcacaaacccaactttttcaagaaccttttgagatccaacattgtcaacgtcaacaagtgcctcaagcctctgcatctctggcttctccttgaatatctcccccgccacaagcctcaccgcttcagtggcgatccctttcccccaatacttgcttccgaggacataaccaatctctcctctgatctcatcgactggcgttacggagatcgagccaatcggacggtcgttatctaagcatatagctctaagccaagggtgtggcaaaagagcgtcgtttaagtacgcgatcgcggcttctcggctagtgtaaggctcccacgtgcaaaagcgtgtgacgtttgagtcagtggcccaaaccatgaaatcgtcgacgtcggaaagagtcattggccggagatggattttctccggaggtgaggaactcacggtggatagggtctccggtttgatcgtagtagttgagtccatctccattgactttttcttggttactttcctttttgagtctttgaagcttctttgggattctttaaaataaattatctctctcaattcttacagatttgtgtagaggcattatgataatacttcttctacaaatcacgatttaaatactgatttttttttaacaaaaaagaaaataaacagaacgttccttcttgcttcgatcggtcaaatacgcaacaattagttcttgttgaatggaaggtgtgaaaaagacggtttataatgggtatgggtgaaccgtatatttaccatccattcatcgtttttgatttaaaagaggtatattcaatctagtatttaaagtgactttcgtaaattttacaagtatatgttatttaattatggattttgaaaattctaatgaaatctagtgttattaaaataataatttaaaaatctacctttaaattcactgttattaaaaataatttatggatttgatttttataagaatgtattcaatctaatattttaagtgatttgtgtaaaatttataaattctatgttgttcgattatggatttgaaaaactttaatgaaatctagtattattgaactaaagatttaaaattctatcttaaaatctattgttattgaaaataattggtagatttgattcttattaattttgaaggatttgagaaagttctttagttaaaaataacaaaatcgaaattcatggtcttatatagaattttaaaatattttataataaatcacatcaattttcctaaaatcatcaaactcatataaaaactagctaaaactcaaattgtaaggtccaaattaatgagtcaactcaactcaactcaactcaatccatgaaccctaatgagttgaaaattttgactcaaatgagttgatgagtcaaatgagttgatgagtcaattggtttgatgagtaaaatgagttgggttgtaatggttaatggtttcaatggtttatccaattaacccatcaaattttgtaaaattgaattaaaccaactaaaatctctaaaccaatgccaatttaagtctaaccaacacatctaaaccaatttaataaaattaatatttttccaaatttcttaaatatacaagcgatgaaattgagaaaaagtaaacccgtaatttttccgccaaaaacgtaaatccgtgattttcccgccaaaaacgtaaatccatgattttcccgccaaaaacgtaaacccgagattttcccgccaaaaacgtaaacccgtaaaaagtggaatccgtaaatatattaagttttgatgataatgaattaataatgataattatttattattattttataataataattaattaaattattacttaaatgggttaacccatttaacaactcaacccattaaattaaatgagttatgggttgacttaacccatttaacaaaatgagttggatcaacccataactcatttaaccctaaactcatttgattatgagttgagttgagttgtgttacccattttgacacacttagatctaatacacctctttattaattttaaaggatttgagaaaatttaaaaagatttatttagttacatatataaaaattcaaatctcatatttttactggaatttgattttttttttttacaataaatcacataaaaagacattaaaactcaaaattatttaaaatataaggttcaatacatattttgtcaataaaaatttaataagctgctaatatagttcatgagaaaaatcaaaaattaatttatcaatcgaaaaaaaagacgaagaaaaattaatttatctacgtagcgcaagagacggagtgttgtttatttaaagaaaagaaagaaaaaaaaaagaacgaatattaaaatg

SEQ ID NO: 16039 - DNA, 3003 bp, Unknown
  misc_feature (1)..( 3003): 2750-1469P.txt file - cDNA_ID_1029685; gDNA_ID_1621146; Annot_ID_56761
gtagcgagttcatagaaaactggatccagatctgtgcaccggccaagaacaggatcaagcaggattgtaaagacctaagctttgaagatcagtgcaccaactgtgagaaggtacgtaagtcgtaacaagacaagacaagacacaatctttgctctgttttttctaacttttaaagtagaaaactgagattgtctctcatgtgtgagcaggaagccgtgaacgtgtccttggggaatcttttgtcttacccattcgtgagagaaagagtggtgaagaacaagcttgccataagaggagctcactatgatttcgtaaaaggaacgtttgatctttgggaacttgacttcaagactacccctgcctttgccttgtcttaaaagattcctcctactcaaatattttctctatgttgtttctaattatgttcttataatcttcttctgttgcttctgtaatgtcatctttgctacttctattccaatagaaatgaataaagctttaaagagcatttacttttatttccaccctcattaatacaaagagaagataacacttgctatgcttatacacatagatagataaaggctactacactcaagccagccccttaaggaatgggataaacaacgaccttccctgtggcatggttcgtttctaagtatgaaaaagcatcagcaacgcgtgagaatgggaacggtcctttgggatcaaccacaggcttcaccttcccactctcaatatatgggttaagtttcttcaaaacatcgccattagatgtaacaacgaatcgaaaaccaggaggcgtgacagctccagtcaatgccacaactttccctccttccttaatcaccttcactgccttatcacacatcccttttaacaacacaaaagatgctctaatcagaacgttttgttgcaacaaattagatatgtgttaatggtgttgtgttttgtttgtttaccaatggcgtcaaagacaacatcgtacttgtcaggcaagtcttctatattctcctttgtgtaatcaatagctaaatcagcacctaagcttctcactagctctagcttttctgtactcgcagttgcagctacttttgaagctccatacacgtgcttcgccaactatatcgaacacacatatgagtaatcaatcaacaacaattaatctctgattcttagattacaaggaaccaactattacctgaatcacaagactccctactcctccggcaccattaagaacaagaattgactttccggctgagaattcagtcctaactaaaccttcatcagcggtttctatcgccaacggaagccctgcagcttgcgcaaaatcgatgtttttaggttttaaagctaataacttctcttccacggccgtgtactccgctaaagaaccaaactgctttggaccttccaatgctttctcgctcacgttagcataaacttcatctccttctttcaaatccttcaccgcacttcccactttcaccactactccggcaacgtcgtatcccggaacagtctactccgacgaaagattcaaaatgttaaagaatccgaaaccttcaaaaagagtgagagagagagatttgaatttgcatttaccgggagaggcgaatcagtggctttaaatttcccttgccgtctcttagcatcgacgggattaagagccgccgcaacaactttaatcaaaacctgatcttctttaatctccggcacaacaatgttactctccagcttcagaacatcaactccgccgtagtcactatacacccacgccttcatctctttcggaatcgaagcatccgccgtgacattgaccgccgctgaagcgctctgagagctcgccgagattttcaagaatttcttgctgactgtttgcacgcaagatccgaatctaactctgttgatttggtaaaccggcgattttgttgtgagagaacaataatgaagaagaggcgtctcacggcggagtacgggagttgtggcggtggttgttgcaagcgctgcgttcatttttcagtctgccactagttttgtctaaaaggcttatctctttcgctttcctctgtttttaaaatactctgtttcgtggctttctttgattggttgatattttcttgtggttgtcattttaatgtttatatcacaaaaattgtggcccataatcgtttttgatctggtgctgattttgtgattcatctttgtttcatttcttttagaactacagaagtctagaacaatcacaaaacacttcggtttttgaacattacaatgtacaatttttacgtaagaagatacaatcgacattaatgggcctaaactttaaattgggctttatgaataagcccaacagttgagaaaacgcagtactaaaagtcgatcatctaggcacgatgagattaaccatagaaaccgcgcacaacgaagcacgatcagtacacgtgttaaattatgattgggtccttggtagagattaaagatccaccgtccatttccccagaactagaaaaaagagaagggagaaaactttctccgagctcgattgtttttggaaatcgtcaatcagatatttctcgttcgtctccgccttcgatttatccaaaggtaagctattgataaaaaaaactaaatccctgatatttgattttgaatctcttatactcatacattgctgttcatgtgttgttgtcttgatttcaaatctgcccagctttttgtaataatgatgcatgcactatgtttaatgcttgagttcgatttccctttgtttcgggttttgcctcattgttataactcggtcgaaagtcatctcctttacatgaaatttctgttgttaagattatatggaatgtccttcattgttctgctttctaattcttgtgtcaatcttatctaaatcttataaatcagcatttgcattagaagatttgatctattttaaattggttaagaagtgaaatgattgattgtcaatgcaggctcttgttattgaaaatg

SEQ ID NO: 16040 - DNA, 3003 bp, Unknown; identical to SEQ ID NO: 16039
  misc_feature (1)..( 3003): 2750-1469P.txt file - cDNA_ID_1029685; gDNA_ID_1621146; Annot_ID_173049

SEQ ID NO: 16041 - DNA, 3003 bp, Unknown
  misc_feature (1)..( 3003): 2750-1469P.txt file - cDNA_ID_1029952; gDNA_ID_2214654; Annot_ID_188720
cagaacctttcaagaaaatttctggccggcaatgaacaatcttctgatcaaaaactgtattagtatatgtttgatatataaagtcgtcgagtagaagttttgagcaaatctttattgcttattactattagcctgcaagaaacacacaacaacaccatctgcattagtataactgtatatcatattatatcttccccaagttatagtgatagtgaaagaaacctttttcaggaatttttcatggatcttcaacgcttctttacatgcttttttggcgtcaagattacccgcaatgtctcctagtatctgcataccaactttaactttgaagttccagagtttgatttttccttgtttggctttgagagaaacgagtgaaaagatacagagacagacctgaacaacatcgtctaagcctttggcctccttcaagagacgtttgttctttgtctgtagaacgcttgcgaccacaaaaacagcaagcgtgttgcgatgttgctcgttctgcccactgtttatgtatttcctttcaaacttgccataccgttttagtaacttgggatcggatgctgcgttgtttcggttttctagttcctcgtacgttgcaaacatggttggattgtactccatcgcccacatcagctgcaaccataatccatctcacattattctcattacccaaacagcagataacgcaaaaaagaagaagataataaacacacagcaagatcttacggcttcataaacaatcacggcaagtaaaaccaggaaccaagaaaagaaatgcagaaagtttgtcattacctcccaaaggtacaaagcgtcaaggaaagagaattctctcctgaaaagtaccatcagcatccgaatagcaaatagatactccccaccatcgagatcctctgtcacattaacacgttttagcccaccacaagaagagtttttatgataggaaaacactcttacctagatgttgatggagacgaggatccactgtcttaatgacctgtgagagcacacccagttgagtctggacacccattgatgttgctgttgccctgaaattttctctctgaaattcaaagaaaacaataaaccgtgaatacaatggtctggtaatgacatgaaacatgagaagttatgtcataggctattagttattactagtctccgcattgcccgctcaaagcaccagaaagcgtcgccttcatcatcaaagaggattatcattggggaacatatatcattcattcctacatgaatagacaaagtggatcagttctgtttcttatatagtttcaaaagattaatcgttaacagcaagtacacttaccctgaacataaccaatatcaagattcaaccacgtatatatggcaagaacgtcccatagttttgattgattacgatcattctcataaaaacagagataccgatctgttctagcaacatcaaggcctgaaacaaaatatacaagaatatgtaaaaagaggttataagaagataatcagatagaactaaacttatttatatgtaaaggcataccgatctggtgtagtgagagcatccattgtagcactctctcatctgtaacagtgtttttcacgatccatccttggttttctacagaagattcgtctattgggttcccattttcttgaacgactgccattgtgacgtacttgccactaccaatgacaggaaccattttcttacattcttctttccatgcaccgtactgctcccttagatgatcaataacatttaaagttagccatgacgtgcatctacaaaactagtaaatgatcaaccaattctatagtaccttctgcgattcctcagtatgttcctttcctcaaaagtgctgtctggatcgtagcatcctaacaaaaactcccaaacagcgcctttgatggaaggatgaattccctagcaaagaaaccaagtgaacaacaacaaaaagagcatatagatagaaacaagatcaggaaaagaaagtagactcactccgcgctgtatacgtctaagcactttttccatatccaaatggccatcttcagtaaaggcagcgtgccatcttctagcacttagagtctttccagcctgacaaattacatatcaagatgaatcatttcatcagctacaaacaaacaaacaagaacctaatgtatcatcaattcatcaagacatgaaacaggtgattgagaagaagaatggtacccttgatttaaaacgggtcctgggaacatctggttgacattcaggtctaactggatagaaaccttgcaaatcttctcctccggatttccacataaatccgcagcaaaacattcaaccttccttcttcttgttcaaaccaaacttatagtttcatccatctcccacataaatcattcatggattcatcagaccactgttcaagaaataaaacccaggatcagaatggagaaaaaatgaaaactttacaaatatgtaaacgaaaacacaaggaagatatattctttttgcaacgacgaagctcccattgctcaataatatatataaccttaaaatcagtatcagaacaccatcatcattatcatttggataatccagaaaccgattagacccaacaatttgaaattgtctacagagagaatacgaacaaaagaaaaatacatacagattgagatcctaaacagccggaatcttcagagacatgcccgtcttcttcttccatctttcatctttcatctttctatttctagcagagtactttcctttttaaccgaaccaagccgattttattagctccgatttcaaacattaaaccgatcggtttcggtattcttaaacgacgtcatgtaatctctccacatttaatgggcctttaaaattgttagtgggcttctatatgcttatgtgcctaattcttttatatcaaaaaccctaataatctcttgggcacataaaaatctcttcgccgcacaattgctccaatctgtttcttctagccggccaaaatg

SEQ ID NO: 16042 - DNA, 3003 bp, Unknown; identical to SEQ ID NO: 16041
  misc_feature (1)..( 3003): 2750-1469P.txt file - cDNA_ID_1029952; gDNA_ID_2214654; Annot_ID_136474

SEQ ID NO: 16043 - DNA, 3003 bp, Unknown
  misc_feature (1)..( 3003): 2750-1469P.txt file - cDNA_ID_1030309; gDNA_ID_1620396; Annot_ID_155780
ttgtcttcgaataaaacgtctcgcttttgttttgttgttccttttccatgttataatatctcttttgggatgcagtaccgagataaccgttgtgcaagaatcaaggaaccgtactctttgtcaaaaatcatgtttcatgagtttgaccattggacctacttcatgtattcatctaaaatagctaaatattctatctctcttttctttccaacaacacccaaagatgaatttagaattttataatgattttttgccaatttagagggatcgtattcacttatagatttgtatatttttataaataaactaaattttataagaaattagatttgaactcgtccgatgtaccgactttaaaacttttaaataaaataaatttaacaagaaaatatattaaaattttattgtaaagaaaaactatatttcggaaataaataaaaacatttggagtaaaaaaagagttatttaatggacttggctagtttttaactagcaactcaaaagtgatttagttgaacgaattttgtttaaaccgactttgacaaaaggctatcaaagatgaatgatttgtgttgattatgtgactacaatgccaagcaatggaggtacttattgcttttgagactattgaatagatttataagtttttgtaatgaggttgaaaaatatttgcaagtacaaaatcctcctcaaataataatgcaagccttagattctcttcatgccttaatttcaatcaatcagcatggaattttaacagaaactggagccatgctttctaaattgccagtggagcaaaaattgggtaagatggtaattttctcaaaacgatatggatgttttgaggaagtaataatcgtggcgatacgaatgttctgaggaagtaataatcgtggcaatggtttgaggtacaattatagagaaagggcttgtgattcagatcgtctttcaatgttatttgcctatgagtcatggacagaatctaattattctgaaaattggtgcaagagaaacaatatgaagtattatcaaatgaaacttgtgagggatatgaagagaagattgaaggaaaccctcgagaaacttcaaataaaaatatatttcaagaggaatgatatggatgttgttaagaaatcgattatatcatggttttttctcaactctacaacacttgaaagagatggtttttataaaacacgaaagcatgtgaggatagaagttgatccaacttctgtgcttaacgaggtaagttcttaaatactaacaaagtttgtgaactaaatcaacagtttagttgattaaatttttttcttttgttttacctggttcaaaagcctaagagcatttcaatggagagagttctcattttgttataaattaaaagaatatttatgactctagacatttatggagagaggtttagtttttggtcataatggtcataatgtgttctcgtccctccactttttcctcataccttatggttcaaggccatatttgttttgataataaatgtttagtatgttaaaacgtttttatgactaacattttattaaacactattttctcttaattgaatttattagtagtttcctcacactttatgaatttattattagttttaattttaaattgtcttttaaaattcaatatcgtatatttacgttttttggtggagtagatcaaattagcatggatatacaagcaactctatgagatcacatttacaagcaactctctcaagatgtaattgaagtttgaaggacaatttaatgtatcaaaaactattaaataaaattagtttttactttaaaatagaccaaaaaattgtttggtgataagatttatattaagaaacttttattaataccatcattataaacaaaaattgatatgataataataataataataatcaaaactgctgaaaataggttgcaaaacgtggcttatatataaaacagttcccaaattgaatcgaatttaatagtttattattttttaaaagtgtgtataccctacaagatttggtatcaataaacattgttattatatgtttcaaaaaaattcttaatgtttcaaaaatttgtttaaccttctctaaggccgaagtaagttaacgatttgcaaccaggcccatttatgtcacatataatggcccataaattcacttcaatcctaaaaataaaaatctaaccttcataatgggcaaaataaattacgatcgtattcaggcccacaaatacaaacaaaggcccatgcttttaagtacaaccctagaattagaaaacgttgatataaataagctgtcataaaattgagcttcttcttctctgaagccgtatcctagggttttctttgcacactactcgctccaatggtgatctctcctcttcctctttcgtcgattgaccatgaaaaccatctctgatattattattgtggaactttttgagtattgcagggaaagggaacagggagtttcggtaagaggaggaacaagagtcacacactctgtgtgagatgtggtcgtcgtagtttccacatccagaagagtcgttgctcggcttgtgcttacccagctgctcgcaagaggacttgtaagaactctcttcattgttttaaaaaaacattctctgaagatgcgtttcattttctcgatctagatttgcttttgtgtgttaatattcattctccatgatcgtgcttgagtctgatatgcatttggaccaatttgtatattcgttctctaacagaagaagcttatctatgtagctcgattgacatgtctattagttttgtttattatagcttgaaatgtttaaactttatcagttctttaatgtctttgcttcaattgattggttggaatttgagggattatctatgttcatttctgtctctgagctcaattcttgtctctttggttaacagacaactggagtgtgaaggccatcaggaggaagactactggtaccggaaggatgaggtatctccgtaatg

SEQ ID NO: 16044 - DNA, 3003 bp, Unknown
  misc_feature (1)..( 3003): 2750-1469P.txt file - cDNA_ID_1030333; gDNA_ID_2926130; Annot_ID_196882
aaatttctgttaggagggattataatcgtggttgctcttgttgctcaattctacaacaagaagtttcctgagaacagagactttttgatctgctgcatcggattatatccttttgattcccatttgatttgctagggttaagatgaaattgaattgaatttgataattgtttccttgtgtatggcttgattggtttgtgttgtgtgcattagattttgagatactataatgtctattaggtatgaatgttatgtataatcagagaaatttctcaaagtctttatcttttggatataatttttgaataagatgtgggatttgtttgcttcttgactttggcaagtatgtggtgttgactgcggtaatgcagctgattctgtacattaaggagaagaacgctatcttgttcacctatcctcttgaggtttgttctcttgactgcttagaaaatgtggttaggttgtgtgcttttgggctacattcttgtttttgcttgtatcataaccagggactgttgtttctgtgattcggtgcatattttctcttcataactagaactatattttgatgtccttctgttttgtaaccacttagaattgttcttctgctagcttcacatgtgttgtagagttctcatatcttaggtgatcttggtgtttggcatttgagctatagcaggtgctacatctccctttcactccactcattctaaaccaactttttctcaatgtgttacttgattcgtcgatatcttgattattcggggtgtggaagttcgtgtaactcttggtatttgtgattctggcgatgtcttgttatatgagacacacttgttcaaaatgattctggaatttaatgttggtgtttgtggcttttgttatttgtctcatcagctggaaaaagtttcccatctcaattaatttgtatacgaaaaaatgcgatctttcaaaacatttgattagttctcattatggttaaggtcagaataggcaacaaagctagagaactccatttgttttgccatttcagtttctatgataatttggtttgcagattattcatatattttgctactgttaggacatgtatatttggttgttttgctgacttgaaattcggatggttaataatatgcagggatcattcaccagcactggtttggtggtatcttccaagttacctagattctctgatcagtacactctaaccatcgacagtgctgatccgcaatcaatctcagctgggaagtcggttcagttcaccaaaagtgtcactcaatggtctctttctttctgcatttttcatacacgtgctcacaccatatcctttgcattgcgtaagctgttgattttgtttttgtatgtgtattctaggctcacaaaagatggagttcttgtcgagggtttattctggaaagatgttgaagccctagtcaaagagtacacagaagcaggagaaccaaagaagaagagatgatcatctataatgggaaaagtatgttgctccttattagttctaaatgttacattttttttatgactaaaatcgatggtgacttggtttaaaagacgacagagtttttgcctcctaacagaagattcattcttataaattggaaccaaattttcaaatcattccgagatttttacaaccatcgatcttatcatgttctcttatttggaaatgttgccgtaagctagacttgttcggtcttgtctggcctaattcagttattttgttgttattgatcacttaagaaaatgttatgttgggctggtctggtccaacccaatcagtaataaacaacttaaaatattagttttcaaaaaatccgatctgaactgaatttgtgtctgtccgacattagcttttaaccagagtaacacttctactctaactaggtatgaccaaaatttaaccataaacatattttgaaccataattgtattgtttttaaactggaaccgaatcgtaacctgtcaattatgattaaaaccgaatcgtaacctgtcaatcgtaatcgtaaaatggttaaaaaccataatcgttaaccgtaaaaaatagaataattaccgttaaaatatatattaattgtaactgtcaattaaccataatcgtattaaaaccatagttaaccgtacggttaaccgcatagttaaaaccttaaaaatacaattttaactatttataatgcaaagataaatatcaaatgttcgaataaagattttcaaaaagtaactaaagttgcttataaaaaaatctacaacatacttttcattttcttaaaagcaattaaaaaaaagtcggatgatacgtaagattttgccttcagtattaaatgtatcgtaaccatcaaataaccataagcatatttaaccataattgtattcattcgtaattttatataatcgtaaccgttttaaccgtatatataataattaaagttatgtttacaaaaaatttgtaactataattattagttaataaatcgtaaccgtaataaccgtaaccttagtgatgcctaaattctctcattaaagcgtagataaaccggtgttaaaccatgaaaccatgagattttttccccctctcatttgtgaagttgattctaaaatttaatgaaaaaataatactacagtaaggtattaatgggggtggaatatgaagatattataagcttaggaatattaaaatagaacaagaacaaaacgtcactccacaaggaaagttactaaaattgacaaaaccacaagtaccaacaaatctaagttttgtattcctcctttttaagttacataattccccaattcctccaccatatcacgcgcccacgtgaattaaccagacaccacaaaccacacacattagttataacctccacgcgcttaatcagcgcgtataacaaatgaacgtctctctagcgttgttcgttttgatatcttctcgacttctccacttctttagatttgattcttcttctctgatctctgaaaaaacacaatg

SEQ ID NO: 16045 - DNA, 3000 bp, Unknown; identical to SEQ ID NO: 7996
  misc_feature (1)..( 3000): 2750-1469P.txt file - cDNA_ID_1030333; gDNA_ID_1621181; Annot_ID_174293

SEQ ID NO: 16046 - DNA, 3003 bp, Unknown
  misc_feature (1)..( 3003): 2750-1469P.txt file - cDNA_ID_1030432; gDNA_ID_2214528; Annot_ID_134215
ttcttttctttttttatgtgaatgtaacaacgattttatgtgaattaatctaaccctctcttaattgtgtttctgcaagtatcttgaggacgtcagtttcaagaaggcattgttgagtaggactccacttggtcgtgttggagagccaaatgaagttgcatcactagtggccttcttgtgtctacctgcagcttcttatattactggtcagactatttgtgttgatggaggtctcaccgttaatggcttctcctatcagccagaggtttgagtatggtcatgtctcgttctttttgtttgtctagaattttcagtgttctctcaaataaaatatttcaaactatgagtatatgaataaaaaaataaatatatcataattacattatggatatacttacaatgtatctctcatacatgaaaatgttctattccatcttgtgtttactactaacttactaagtgaaaagaagactctgtttttatgctctgttttgttgtaaaccggtagacttagaaaagttgggacctcatagttgaacccaaaataacaaaagtgaatttcaaaactagcatatatataatagagactcaaaataaagcaatcacagagagataaacccaaaattcaatggatggcaacgagaaaaccttttgtgaccaactacatgatacattgatataccattttatgacatactattaattaataaatgctgtggtgtgcccataccggattcatataaatgtttatacgactgcatagcatttccactacagtttaaactctaccacccaaataccaatttttttttttttttgacattggtttcaaggaggcattgttgagtagaacttcacttcgtcgcgttggagagccgaatgaagtttcatcactagtggtcttcttgtgtctccctgcagcttcatatattactggtcaaatggtcaaaccatttgtattgatggaggtctaactgttaatggcttcacctatcagccacaggcttgagaatggtcatgtcgcgttctgtttgtttgtcatgaattctcagtgttctcttaaatcaaatctctcacactatgagtatatgaacaaaatcatatacaatatcacaattccattatggatattctcccaatctatctctcatacatgaaaatgttctatttcgatcttgtatttaaataatgttaatactctgttttaatttgtgtatcctgatttttttttctttttgaagttcaacaaatatatcaaaataactcagaaccattactattttttcttagttcatcaattctttactacacatagaaacgtatttatcttgtttgatctactttgactctatatatgtcatgtggcatctctggtcattgctagtcacaggtaaaagtaaaaattgatcaaagataaagagtctttcatggtaaaaattctcttgtaactggtggagatagtagatgtcaattcgtttgcaataacttacatttgcaataacatgtcagccatatttatttaaatttccatgcatttgatattattttctctctaatacatatatgatgtgttacggtcattctaaaaatccagttgacagcataatgaagctggtacaccatacatgcacttgattatatatggatgttactgccatgattgatgttttgatggaattagtgttaaaggatggaccctcactaacgcggttggaaattatgatcaaactcttcaatgtcacttatcaagagagctaatgactagcacgtttagttgttctgttgtttcttatggctgcttaatgtctccatcaaatatttagacattgtggctagtaaaatgccatctaccttaatcctatatataagtataactagataataatccatatttttgctgggtttagtagctgatacgacgtttatggttgttattgagtttgaatacaaaatatagagtattgttggagttatattgatttttgttcatattagttaacaaataataaaaaaattaagaaaggtttttgaaaatgcatcttctagaatatatgtatattcgaaaaagtcacatctttaattgacatatgttttgtttgtttgttttttttactggccacacaaattgacaacaatggtcatgcatgaaatgaaatgtttgttgtcaattttttttactaacttgtaatatcattatgaaatgaaatagaaggtatatattacaaaatattacctaaaagtagagcaatcttagaaaaaaaaaaaaaaaaaaaaaaaaaagaaaaagaaaaagaaacaagattacaatgcatttaaaaagagatggaaagaatccgagctatcgaatccaaagaagcatcagcttcctccatctgttcttgtatcgtctaccagagatggtgttccggatctctcgatcaatattcttaaagatggttgttggagggatcctttggctattatggagaacattattcgtttatctccagatgtgatagacaaagggctgtgtggcctgtgagaccgatggccacttaattattggttttttgtcaatggttgtgtatgcatagaaattcccacaaccgtttgtggcttaacacaatttaccaggggtttaagtggttaaattgatacatgtagatctaaagttttatgctaatataaattagttttaattatataaattttaactacgctcatgacacgtaaatggtagaccaatatgtggtgctctattaactaaggggtcttcattattaattcataaagactttctttactatacaagacttgtcaaaaggaaaagtagtattttcgtactacgtctacccctctcacggatatgtgtggtcgagcagtcattatcataatgtggaattttgaattgagcgaggtttcaaagttcaaaactatcacaactagtcttgatcaattctatataagatctgtgatcttggttgaagaaaagaatcgtcgtaggttgatatttaacaaggaatg

SEQ ID NO: 16047 - DNA, 3000 bp, Unknown; identical to SEQ ID NO: 6516
  misc_feature (1)..( 3000): 2750-1469P.txt file - cDNA_ID_1030500; gDNA_ID_1621096; Annot_ID_55689

SEQ ID NO: 16048 - DNA, 3000 bp, Unknown; identical to SEQ ID NO: 6516
  misc_feature (1)..( 3000): 2750-1469P.txt file - cDNA_ID_1030500; gDNA_ID_1621096; Annot_ID_171036

SEQ ID NO: 16049 - DNA, 3000 bp, Unknown; identical to SEQ ID NO: 6516
  misc_feature (1)..( 3000): 2750-1469P.txt file - cDNA_ID_1030500; gDNA_ID_2926164; Annot_ID_139831

SEQ ID NO: 16050 - DNA, 3000 bp, Unknown; identical to SEQ ID NO: 6516
  misc_feature (1)..( 3000): 2750-1469P.txt file - cDNA_ID_1030500; gDNA_ID_2926164; Annot_ID_198976

SEQ ID NO: 16051 - DNA, 2614 bp, Unknown; identical to SEQ ID NO: 2218
  misc_feature (1)..( 2614): 2750-1469P.txt file - cDNA_ID_1030508; gDNA_ID_1620505; Annot_ID_159007

SEQ ID NO: 16052 - DNA, 3003 bp, Unknown
  misc_feature (1)..( 3003): 2750-1469P.txt file - cDNA_ID_1030553; gDNA_ID_2214460; Annot_ID_132971
aggaaaaagaatcataagagtcagaattaattaattacctgatggtaaattcctgcccagaagagaatcagagcagtataggttgtgaagaaagcaagactaggaatatcaagcaagatatgttgcataatctacaagataataatccaagttttgcaaatttagaaaggctgacatagaaatgtttcaagtgtttaaatttgtttttggatcatagagtttttttttaagtttataccaattttcaatgaaaaagtagaaaccatcctacatatatgggattctccttaaactttctgttattatccatgaatgttttactttaattaaacatcaacatttttgctatatgagagtaaagttttgtgtgggaaaaaaaaaagagagcaaagtttggtaaaatattattttttcatccctagctattacttcttttgtattacatatcaatgttttgtattatttgtaaaaactctgttagttattctttttcagatcttattgatacaatttaggtattcattttagtaatataaacacacataaaaaaaaaatcacatcaatcaatttttcatttaaagcaagtataaatgtattaactaaaagcagaactaaaaaagttacgaatcaaatttagtaaaaaagaaaagaaatcatactcaagcgcaaaaaaaaaacagaaataaaatcataattccaaatctaaatttttttagttttcgacgaaattgagagatttgtttttaataactggataaataatcttaaatattcaaaagttaagatcaaaatcagtttaaactttaaagactacaaactttcaagagagccttaaactaaaaatgatgatgaagacccttgaacctgtgaatgcatgttaagcacattccgcctgaagacaaatacaacagccctatagcatatatctatagatcatcttaaaaacattacttcttcttcttcttcttcttcttcttcttcttcttcttcttcttgatgaatgattcctctctttttagggttattatttaaagccaaggactaattgtgatttgtgaatccaaatgtttagttctgaaacctcacctaatgtctcgaattcagagtgcatatgatacttattggtttcaactgttttccctatcctccatgtctgttttaaatgtggccttcttaaattgtaggtgatggaaaagaatattgaacctattagtgagaagaaagacatgcacacaggagatgtggcttctccaagtctgaaggaaaattcttcgcagcttgagagtaccagggacctaattatggttgccgcaaatactaatttatggagggagagcttgtttggttctgctaaggtgacacctagttatttcttttggttggtgctctaattattcccatcatcatgcagaagattgaatagttttatcaagctgttacgttccagtccagcaagaaccatagtttatgcaaacaagatttataaaagaaccttaatcattgattttagggtttatgtaccagaaaactgaaaacaaaacaaaagccagaatcgtgaaatagaaaaagggcttttggatttgagaaataacaaatttgttgaagctctgaacttgaaaaattatggcttttgatatgcggaaacaataaaattgaaaccctgatttaaaacgtataatcataaaagagaatctttgaaattagaaaagattgattttgctcacaaccaaaaaccaacaataaagtatttacaggtttcaaatgcatgacattattggactagaaacaacaaccaccctgtcatgtaattttacaaacttgcaaacaaatcatcttccaaagatgaagtattatcacacacacaaggttcactggccaagtatatccgctactgatttcttgacaattttcgaaagctcctgtctgaaaaaataaacaaagacttaggttaaacaaaaacaccagcattcgatttcataaccgcatttaaagaaaaaaaaattacctgtccggtttgaacaagagatatcgatatgtgaaccactgcagaaatggagatatcaaatgctagaagaatcaaggatcataacatttatacttattgagatgataccaagccttattacttaccgtggagaacaagataccaactagttcgaatccgctcgagataacgggcaatttgtcgattgcctaacgaagaaaaagaacaagtctttgtcatcaagtctcacaaaattaagcacaacaaaagataaaagttttgagtcttttcattactataccgtgatgagattcaatgatgcccaaagagctacaataccagcaaaacccaaaccaataagacctaacctatcttcagacttatcccactgcaataatttacaaatttaaaaaatgtccaaatcaaaactaaggcatatatgtaactgagaacagagtctaatgtagggtttatagagatttagggactcacaacattctgaatcgtactaacaacgtcgagatcagtcgatgaatctgagctttctccactagctttcaccatcagactgatgctgctagggtttcgagtaagagataatggagaaagatcattcgtacctcgagttagagaaaatgggagtttttgaatcgatgtgagattggattttctctgtgtgagtaacaatggcgaaggcaaagttgcagaaattgaagccattctttaaaaaaataaaaagaacagaacaaaaaaattgaaactttagagattttgattcgattttggagacagagacgaagaaatttttggttatggattagagatagccttatctttttataatccacgtggcatttcctaagtggcatatcaaatctcaaagatgacaacccaattcgccacgtggcagaacaagatctatcaaatgagtgaagaagattctccactatacaaattacatcaatccactcacttactttggcaacaaacaaacaacaacaaagagagaaattaacatg

SEQ ID NO: 16053 - DNA, 3003 bp, Unknown; identical to SEQ ID NO: 16052
  misc_feature (1)..( 3003): 2750-1469P.txt file - cDNA_ID_1030553; gDNA_ID_2214460; Annot_ID_182730

SEQ ID NO: 16054 - DNA, 3000 bp, Unknown; identical to SEQ ID NO: 3645
  misc_feature (1)..( 3000): 2750-1469P.txt file - cDNA_ID_1030715; gDNA_ID_1620654; Annot_ID_47826

SEQ ID NO: 16055 - DNA, 3003 bp, Unknown
  misc_feature (1)..( 3003): 2750-1469P.txt file - cDNA_ID_1030715; gDNA_ID_1972176; Annot_ID_180025
agatggttcggttaagttcggtcatggtgatggttcggcttatttgttcgatcctgatatttataccgatggacggatttcggttcaagggattgacggtgttttgttcccggaggaaaaaactccggtcgagaagaaaaccggcgttccagttgtcaagaaagcacctaaaccaagaagaggtaatcaaattttgatcaatctttagtctattaatttttgtccttacctatttgatcgtgacattttaaccccaaattatagaaattaaaaaaatacataccactactacaaaaatacaaaagttttggtatagacaccattacaaagttataaagtcactcgcttagggaattttttatgttctatgattttgtcatattaaatggataactaaatcattgttatagaaagataatggtgattagtccatatacaattagtctttcaacgagagagtactaagtaaacaagtgagatttggaaaaagtacaaacgtgtgagaatggagacaaagtctctctaacaaactttgatataatatataaaatttcaacaatattatacaaaattttggagataattaggatttataactacttaatgatccaccgacgaaagtatcccatgttaaagtgaatgaaaatcacaaagtgttcctttttctttgttttttgttctaaagccaagtatgagtcatataatcatattgtaataaagagagaaaattttctttatttatttctaaatatattatttttgcattagttagaaacaatcattttaatagtccttcgttgttattgttaataaaacaaaaaccaaaccgtttgaaaaaattaataatttgtatgatttatattatattgcaggtaaattgatggaagtagcatgtacaatgctgggatcacaatttccaacatgtcaatgagatcaaattaaatccgggacatgagaattttataattctgtaaacatgtgataaaaatgtgaacagaaaaaagaaataatgtaaatgattatttttttgggctcgttgcaatatgattgttaaattgtaattttcagttgttttgagctgacgtaaccaaaccagattgggtgggtcttttcttttctgttggatgctactgtattggatcgaatctgtccatttagagatcttctaatggactactagattaagcagccctaggtggtaggttatgcattggaaatactgtaaactgtaaaggcaacaatgtccataactctaagaaaataatccatctaattcagaacatcaatatacccaaatccagttttagaaacaaagtaaaaacagtataaaaaaaaagccaaaatgtgatgagaagtcacatgtcatctcgagttgatattccaacaagttgctaacattaaacaacatgggatagcatatttgatattccaattcacaacatgagcatgcccggtccacaactcaagctacccaaacaatggctaagatcatcaaaagagatgagtaaaaatacaaaatattataggtatttgttattaattcattttttgttggtcttttttttaccatatcacatgagttttaagctttaaagttaataaatactaattaagcggattggtaatgaatttttagtaaaattttggttagaaaaaaaaaaacgaaaacaaattttttcttcttctttttgtatgaatataaaactatattcaaaaagacgtttgcacaaaattttaatttcgattgattccattgttatttatttttatgttggcttggattccattggtattaaggtaagtgattttagtgacaaaatggaagaagttgctttgaagaaaaataattgaaaacaaaaaaaaaaaattgactattgtttttattttcttacaaactatttatggatttaaaagttgttttatcaagttttagtatgattttttttatattatattattagtaaatttgcgagaaaaatataaagagcatggtttttttctttacgtaaacgttcaaaattatcagtccggctctaaacatgagatagtagattctaattctcgtcatgagatcgtagattctgattgacaacaagagataggagattcctgtttacagtatgagattgtagatttcattcacaacatgacatcatagatttcaattcacaacatgaagcaaatcattaattattttcaaatgtcataccaatctcgtcttctcgaatgtttggagcttcatgaccaacctttgagtaaagagcattacaaagtcgtaatcgttttaaaaacaagttaaagatttcgtttctttggatgattttatgaatagtataatacaaatttacacaactcaccacataatatcctttgtatgatccaaccaatttcagatggagaaaatatagttgcatgagtatctacaatctaagacacaaagacatagatggatctaagggagactgaactcttgtataatggattcacaatcacaagaaacaaggagagaaacacaaattgaacgttattatttccagcttaatggacttgaagaatgaccatcatgtttgtgcctaatctgattttctccaaattctttagaattctctctttgctaatcctgaccaatatgagaaattcaccatttttttgctcataggtgctatcaataacagtttcaagtttcaacaattcaccatttatataacattaccaacagtccaacactagtaacataatcaccaaaatatattagtaataaattttcatcacagctttatatttttgtgattagaaattaggatcttacagaaatctttcaaaaaaaaattcataacagttccattttttttggtaagattcataaaaaaattcaagttaaatgcattttataaaaatgtaggaaaaactttcatcaaaaatcgttgagaagaacatacagtatatcttatccactctcttcctcatccacgcggcaaaggcacaaacctctttagaaaaatg

SEQ ID NO: 16056 - DNA, 3000 bp, Unknown; identical to SEQ ID NO: 3645
  misc_feature (1)..( 3000): 2750-1469P.txt file - cDNA_ID_1030715; gDNA_ID_1620654; Annot_ID_163601

SEQ ID NO: 16057 - DNA, 3003 bp, Unknown
  misc_feature (1)..( 3003): 2750-1469P.txt file - cDNA_ID_1030924; gDNA_ID_2214566; Annot_ID_134964
caccgtgtacttctgttttcacagactcagcaaatgcttgacatcctcgagagcttcttggttgcaaatgagtatagttaccggaggatggatggtcttactccagtgaaacagagaatggctttaattgatgagtttaataattcagaagacatgtttgttttcgttctgacgacgaaggttggtggtttgggaacaaatttgactggtgcgaacagggtcattatctttgacccggattggaacccctcaaatgatatgcaggtacgttttactttgaatgtcacagattcagtgtgcaaaaaacccgtcgtggccataaataacaatcaattttctgcttttttgggcaggcaagggaacgtgcatggcgtattgggcagaagaaggatgttaccgtttacagattgatcactcgtggcacaattgaggagaaggtatatcatagacagatttataaacattttctcaccaataagatcttgaagaatccacaacagagaagattcttcaaagctcgggatatgaaagatcttttcatcctgaaagatgatggcgatagcaacgcctccacggaaacctctaacatcttcagtcagctggcggaagagataaacatcgtaggagttcaatcagataaaaaacctgaatccgatacacaacttgctcttcacaaaactgcagagggatcctcagagcaaacagatgtggaaatgactgataaaactggtgaagccatggatgaagagacaaatatcttaaagagtctctttgatgcgcatggaatacatgtaagtacattaataagtgctcattgaaggttcttctccgacttactttcccataatttccaattcccttcactctcttacaatttttaacacagagtgctgtgaatcacgacgccataatgaatgcaaacgacgaggaagagaagatgagacttgaacaccaagcatctcaagtggcacaaagagctgcggaagcattgcgccaatcacgaatgctgcgtagccgcgaaagcatctcagtgcctacatggacgggaagatctggttgtgcaggtgcaccatcatctgtacggaggagatttggatcaactgtcaattcccggttaacccagactggagacaaaccatcagcgattaagaatggaatcagtgcgggtctatcttcaggcaaagcaccatcttccgcagagcttctcaacagaatccgcggaagcagagaacaagccattggcgttgggcttgagcagccacagtcttcattcccttcttcttcgggttcaagcagcagagtaggttcgttgcagcccgaggtcctgatccgaaagatatgcagctttgtacagcaaaaaggtggaagtgcagacacgaccagcatcgtcaaccatttcagggacatagtttcttttaatgacaagcagttgtttaagaatctcttgaaagagattgccacgcttgagaaggatcaaaatagatcgttttgggtcctcaaatcagagtataaagactaaaaaggagatgttttggctgcctctactgttcaagtctgaagacggagaaggcaacattggctccacacatatttgccaagtattctctttttctttataagctcacgcacttcttaacctttttttttaccagcaaagtcacttacacttcaaagtctacttttttgttttgtttaacatgatgttaaataaaaaagtaggaaaatcttagtaaagagagcacaactatgaatcttttattgaccaactcgaaaggcagacaccagttaagtaacagtaaaacaaactctcaagtgtaaagactaaagataggttttcttgtgtttgaatgttggtgcaggcaggtcgagagaggttgggatcgacctaccgagtaacttatgaagaacttgaatcaaacggctgatgtagattactcttatttggaagccgtattgagacgaagtggttgaaggtagagttttcatcagctacaatctctcaattcttttactcctggtggacggtgaaccaaattaacactcagactcagtcattgtgggttttcagcgaccagagtgtcagtctcagcttgcttggaaaacacttggtttcgctccgcaagaccagctaattagcaattttcatgagtcatgactccacaaagcatgatcaaaatagcaattgtggtgtgattcacaattgctaacatccctaggtgtgaatattgattcagcctgctcctgagattttaactcttgtaatgattgctcaaacacaagcaacagaggaagttatgagagctagaaagtaactcttgtaatcttgttttaaaacttctaaaaaatgtatatttgtcaatatattaatgtttggacccaaaaaaaaagtcaatattgttgtttttgttaactttgatattactgaaatttcttgtacgaattaaatcgaattagtgtgattacaagtaatcaatcgaattactgtaaatctgaaccaatcgatttcggttcaagttggtaggtataaattaccaatttagaaccgtactcaattcaatgcgttgttgactcatcataacttattaacttgtgcatatctgacgaaaatacccttgtctaattccaaaatatacaagaaacccttatcagtcccaattctcacaaataacaacaacaatttcgccggcgtcgtcgtcgtcgtctctccatcaccgtctctgctgcattgattcgcagcactgagtcctaaatttccagtattcttctctaattctttcgctgtttcattgatctcaattttaaaattttctctttttttttttttttttgcattcgcattcgttttatgatcggtgactaatttcacttataggcatcaattctattcaattcctcttcttcgttttatgattgatggtttgatctccaatttgattgtatattgtctgatcttaatagtggtaaattgttatgttctcaaggtgtaaaaaaaatcagaaaatg

SEQ ID NO: 16058 - DNA, 3003 bp, Unknown; identical to SEQ ID NO: 16057
  misc_feature (1)..( 3003): 2750-1469P.txt file - cDNA_ID_1030924; gDNA_ID_2214566; Annot_ID_186017

SEQ ID NO: 16059 - DNA, 3003 bp, Unknown
  misc_feature (1)..( 3003): 2750-1469P.txt file - cDNA_ID_1030940; gDNA_ID_1620717; Annot_ID_49130
atagctgcactttttggtctggaatgctttgcgtggtactgtgcaggagagattgtaggaaggggcttcactttcaccggctactacccttgaagaaagaaagcaaccccctcataaacaaacatgcgtttcagatccattgaataccgaaaagcctttttatatcataattagcggcttattatctatctcactgctgacattagaagcaaagttaatttctgtttctctggataatttatacacaaaagttttgaaggtgaggcatcatcactcgtgctagctctaataatatcagtcgactaatgttggccatttggttttttctttgtcattttcatttatgtgaataaccatttttcttgggtttagagtctataaaccgtttggtaagatgtatcattcgtgaaacctcagcacataccaaccttaccagagaagagtaagacggcattatattataaaccgtttggtaatatgtatcattcttcttctatcacaaaaaaggaagaaaatcctatatttttgacaattgtctgaaaatacgattaggttcagagtatttcaacgttgtctctgtcatttgtctatcgcaatttcgcataaaagcaagccttgtaggtgtagaagccatcacaccagattgtagtggatgatcggaaactaagacttcagtcatctggtattctcctctctctctctcgaccggtcctcactataagtcttctctttgtaacatttttgtgatcattttggatcgttagttttgtagttgttctttttttttatgagtgttttgatagtgaacataaacttgattcataagtcaactgtatgctcaatcaattggtttttgaagaagttagttctaagaatcaagcaattggataagataaaatcagataaaatctacacgccttttatcaaggcaaagcttatagtgtttaaagctgttttccttgaaaacttgaaagatctacactttcagaaaaaagttgtaaactgcagcaacccataatcaataaagaaccagtagtagttttcttcagttatgcaagcaaagattatatgaattagcatggctatttaatatatgcttttttccttgagcagagactttacagtgtttgaggaacgaagattgtgagacacaatggctaaggatgaagccaagggattgctgaaaagtgaagagctctataaagtttgtccttacatactcatctctacgttagttcacttctccatttctctgatacatttctgtgaaaaatgttgtagtatatactggagactagtgtgtacccacgcgagccagaggttctcagggagcttaggaacattactcataaccaccctcaagctggtatggctactgcaccagacgctggccagttgatggggatgctgctgaatctggtaaatgcaagaaagactatcgaggttggggttttcactggatactctcttctcctcactgctcttacgctaccagaagatggcaaggtatttgcatagatatgaccaaaccaaaagaaaaagtgtcatgatgtttttcgttgttttgcttctgtatcatttctgcaactgatttggtacacgagctctgcaggttatcgccattgacatgaatagagactcgtatgaaataggattgccggttataaagaaagctggtgttgaacacaaaattgatttcaaagagtctgaagctcttccagccctcgacgagcttttaaacaatgtacaacttcatacttctttgtctttcaaaaaaagaattagtatgtatcctgagatggtctttttgttttgatgtttgtgatgcagaaagtgaatgagggtggattcgacttcgcatttgtggatgcagacaagctgaattattggaactatcatgagaggcttattagattgatcaaggttggtgggatcatagtgtatgataacactctctggggaggatcagttgctgaaccggactcgtccacgcccgagtggaggatagaagtcaagaaagcaaccctcgagctgaacaagaaactctcggctgatcagcgtgtgcagatctcgcaagctgcgcttggcgatggtatcactatttgcaggaggttatattgagcgagtattgttgttctttgtgatctttagggtcatatgattgtgagccctttatattgagctattgtgatgcaagagtgttattgttctatgtgatattttggttcctgtgtgaatgtgaaccttttctatcaagtttgtggatttcttcaaatttcaagattataacagacagttacgaagaaacacaactcattttatgttttgtgtcttttggcaaaactccaaattctgaacattgctctaaaatctaatataaaaagtaaaaaaatgaatggggcgttccgagaatcgaactcgggacctctcgcacccaaagcgagaatcataccactagaccaaacgcccacattgatatatagtttgctagcttttaatacaatgtatattaaataatttagttttgtgatataaacagtaaacagaacaagatattttcacccaaagttaaaaaatccaacgtttgttcaaaaataagaaaaaaactatccaaagttaaattatcaaatgttaaaaatcgttagacgttaatcacaatataaaggaactcttttttttttttttgagttaagaaacacttagttgggccataaaaatataggtctagtagatgaaaggcccataaaatcaactagggttagttcttcttcttatagagcgccgcatataagcttcatccttctccgtcaccaccggctctgtatttcggcatttgtggagagaagaaggtactctcatccctttctctttcttatcttaatctccttttttaaaatttgtgacaaagtaaaatgagctaatctcgtctttaagatcatatgtcaaaactgaatttgagttttgatatattcaggtaaagagagaagatagaaacataaaatg

SEQ ID NO: 16060 - DNA, 3003 bp, Unknown; identical to SEQ ID NO: 16059
  misc_feature (1)..( 3003): 2750-1469P.txt file - cDNA_ID_1030940; gDNA_ID_1620717; Annot_ID_165678

SEQ ID NO: 16061 - DNA, 3003 bp, Unknown; identical to SEQ ID NO: 16059
  misc_feature (1)..( 3003): 2750-1469P.txt file - cDNA_ID_1030940; gDNA_ID_2926188; Annot_ID_140908

SEQ ID NO: 16062 - DNA, 3003 bp, Unknown; identical to SEQ ID NO: 16059
  misc_feature (1)..( 3003): 2750-1469P.txt file - cDNA_ID_1030940; gDNA_ID_2926188; Annot_ID_200822

SEQ ID NO: 16063 - DNA, 3000 bp, Unknown; identical to SEQ ID NO: 11275
  misc_feature (1)..( 3000): 2750-1469P.txt file - cDNA_ID_1030987; gDNA_ID_2214487; Annot_ID_183536

SEQ ID NO: 16064 - DNA, 3000 bp, Unknown; identical to SEQ ID NO: 13073
  misc_feature (1)..( 3000): 2750-1469P.txt file - cDNA_ID_1031052; gDNA_ID_2214595; Annot_ID_135475

SEQ ID NO: 16065 - DNA, 3000 bp, Unknown; identical to SEQ ID NO: 13073
  misc_feature (1)..( 3000): 2750-1469P.txt file - cDNA_ID_1031052; gDNA_ID_2214595; Annot_ID_186888

SEQ ID NO: 16066 - DNA, 363 bp, Unknown; identical to SEQ ID NO: 386
  misc_feature (1)..( 363): 2750-1469P.txt file - cDNA_ID_1031100; gDNA_ID_1564626; Annot_ID_149775
  misc_feature (52)..(52): n is a, c, g, or t

SEQ ID NO: 16067 - DNA, 3000 bp, Unknown; identical to SEQ ID NO: 3898
  misc_feature (1)..( 3000): 2750-1469P.txt file - cDNA_ID_1031118; gDNA_ID_1620673; Annot_ID_48183

SEQ ID NO: 16068 - DNA, 3000 bp, Unknown; identical to SEQ ID NO: 3898
  misc_feature (1)..( 3000): 2750-1469P.txt file - cDNA_ID_1031118; gDNA_ID_1620673; Annot_ID_164160

SEQ ID NO: 16069 - DNA, 3000 bp, Unknown; identical to SEQ ID NO: 3898
  misc_feature (1)..( 3000): 2750-1469P.txt file - cDNA_ID_1031118; gDNA_ID_2926200; Annot_ID_141461

SEQ ID NO: 16070 - DNA, 3000 bp, Unknown; identical to SEQ ID NO: 3898
  misc_feature (1)..( 3000): 2750-1469P.txt file - cDNA_ID_1031118; gDNA_ID_2926200; Annot_ID_201775

SEQ ID NO: 16071 - DNA, 3003 bp, Unknown
  misc_feature (1)..( 3003): 2750-1469P.txt file - cDNA_ID_1031198; gDNA_ID_2926195; Annot_ID_141250
cacgtattcaagacggtgaattaacacgacgtggcaaggtatgattggataacttacgcagctgcctaacaaaaacaagtgatttgagttttcagatgattagaaggaaaaaaaattctggaactttcgagcttctgttttgcggtgctctcaaagcttatatcggatctcgaatcttgaatcggactcagaacctcggatcttcgaaaatcgacgaacatgtcttctcctggcgagtgagttccgttcccctctattgaaactttgcttcgattcgattttgatcgagagattcttagcttggtcttcgtacccaggattttgagtccttaggttaataattttcatgattcgtttagcttgtataggggtttttgaagcattcaactgttgattcttctcaattcgagcgtaattttgcaacaccaagcgagttctgtgaacttgagctaacgctatttttagtatatagttatcaatttgcattgtcatcatttgatattttggtgatttgagatgtaaagaaacatcttttatgccatggaagttagtacaagtcaactggtagttagttcttgaaatatggaatctcatagtgtcttgaagcaaaactgttctcgtttgctgtatcatagttacaaggctactttgattctcctagctacgatagtctaaaatatctctgcgtaggcttgtctcttgtggtaaagttttatgctttagctgatcttgatgacatttcctgattagaaatttatagatggatggaatatgtatgattttgattgtttatctgtcaaattgtttcttagatcgcttgttattgattgcagattctataactcacttccacctataaccaaggcttatggtacgttgtgctttttcactacagtagccacgcagcttggcttagttgctcccgttcacattgctttaattcctgaacttgtacttaagcagttccaggtatatgatttattcttttttatgattttcctttctttctcacaaatctctgtcatcctaagttcctaattcattctgcaatttttgatctatttggtgtttgtagatctggaggctgataacaaacttgtttttcctcggtggtttctctatcaattttggaatacgtcttttgatgatgtgagcatactattttcacatatatagatgaacaaagctaatttcgatttttattatcttaacatactcttttaaatgattgtgcagagcaagatatggagttcaactcgagaaagggccatttgaaaggcggacagcagactttttgtggatgatgatctttggatccttcactctattggtatgtaaagcctcccctgtattctattcttactgatcattgttattggttctttgagaaccccagtactagtatgtggtatgccacaaagtagataatcgctggtacataatatcccaaagctgagaagatcagaagctctcaaagaattgaatcagggttgcattttattaaagcgagacaaaattttggaaggtattcatactagtaaatccgtgtgttaaaacagttaccttgttcaaatttcaggtattatcagtcataccatttttctggacaccgtttcttggtgtttcacttgtgttcatgcttctttatctctggagccgagaatttccaaatgccaacatcagcctatacggtcttgtcactcttaaggtattgaaagtgtttcttttgtaatcaaatccactccttggtatatataatgttaatggtgaaagttggaattactccacaggctttctacctcccatgggcaatgctagcacttgatgttatcttcggttctccgatcatgccagatcttcttggcatcatagctggacatctatactacttcctaacagtccttcatcctcttgctaccggaaaaaactacctgaaaaccccaaaatgggtgtatcctttattcaaattctcgattatttccagatgattgtttctctcgcttctcagtttttgttttgctgttgtaccttgacattctcaacagtaataaaatcgtagcaagatggcgaattggagctccagttgcaagtgttcgacaagcaggtggtgtaggagcagcaggacccggagctggaggaggagtaggaggaggaggagcttattcaagcgctcgtgccccacccgagagttcaaacacagcattcagaggtcgatcatatcgtctcaccgactgaaatagaaatcttctcgagtttctttgttttcatcatatcaaatctttttcaaacaatgccactaactaatcccaggtagctttgtgttttcgaacagtacagtttttgaatatatgactctgtaggaagaatctttgaggttttaatacaatgttcttttcaaaatgtggttcatgtttctatgtttttgtttttgtctagcaatcatctccttactaaattgaattcgataaactatagccactatgaatataatcaaatgaaatttgtgacataagaatttggacgtaacgagtttgaatatctatctagataagttattaaattcgtgaccaaagagtttggtcgtaacaagtttgaattttttaggacataatattattattggctaacaagattacgactaacgagtaaataatcattccttcggtccttcctctaaaatgccgttggtgatcgtttataaataggggaaataggaaaagggaagaaagtagacgtggcaaatagcgaaacaatgattgagctataacaaaggcgaaacttgagcggcactaattgaaaatcactccttgtttttttgaagaaaaagtaagatgtagggctgagaattcgtctatgtgatccaacggttttaaaatgatccttgttccttcctctcctatttatctgaaggacgaagtccccacgctgcacataaccggggcacttaacgtatagatcataaacaaagaagaagaaaaaaaataagaaaagaagaagaagatg

SEQ ID NO: 16072 - DNA, 3000 bp, Unknown
  misc_feature (1)..( 3000): 2750-1469P.txt file - cDNA_ID_1031299; gDNA_ID_1620314; Annot_ID_153103
atgtaaatgtaattcgtatttagtatgaaattttgatttttaatgaattaactctaaagacgaatttcctaccatgttttatattttaaaactaccataaacaatcaaggccccaaaattattggaaaagattcaatcaaggccccaaaattattttttttcggtaaggtagtcaattcgtgttgtcgttatagaacatgtggttttgtcaaaaaaaaaaaagtttaaaatcaaatttaatgtgtttataaataatatagttcttcgagacggatcggtctctccgaaatgaatccacgtgattgtgaatgaacaaaggcggtaggtaaggtagtaaataattgacattaaacactaatattataaccttctcgtgtacaaaaacgtggggtttaatatatatggatatatataatttatgcaggccctggtccagagcatcatatgctagttatgatcctatctacttattctgtagattataaaatagcagacttgcatagaaacataacatgtattacaaacttgtttagtcaaacttgaagaagaaaaaaaatctttttaaagagctttgaagatccatggcgatgtctcatgtccagcctatgctactcctcctcgtatcactcttcttcttaccggctttgcgtggcgccatagatttcgaatactgcgccagtaagtatctatttgttaagtcttcagttacttttctatatgatttttgtgtgtttattagtttataaatgaattataaattcagatagaccttgatttcatagattctggcttgctcatggctctgttttttgtttcttttagtaaaccaatatttgaactctttgacatttgaattggattccaattttttttaacctaccggggactcgtaagttatagcttccacaattaatatatgcgactgttgcagaaaatggaaacgattacggaaccgtcactagcattgtggtctctccatctgttgggcctcacgaaaacccaaccatcactataaatttattcggttctgcaagtaagtaacaattaattttatgatctagtttcaactctctctttttttctctagttttgaatattttcttgataaaatcctttatatatataggcaaaaacatccccgcgggaacccttgtgtacgtagcctttagagatggggaatttaccggccttttaaaaacttacaacctttgtgatgtgagtgcatgtaacaatgaagctgagattgaagctggcaccaactttgagttaactctttccgacgttctttatgttggttatgatgaggtaactacatttctactcttagcataggaaaataaaaagcatgaatgaatgtgaattttccttaatcctaggaccaatgtttcaaacccaaggttggactaattaaataaccgtaattgaccggcaaaacccctaaaactagtacaaccggttcacattggtttatttatttttcattttcatttttatttttattttttcaagacttggctttatgctttaacatcacatcttctattagaaattttttatacttcctttttctcaacacgtttaattttattttatatttcttataagttatttagggtatactataataattctgttgatatttaagatttcactttgatattgttattttgagtttaactacaattccatgcttacaaagttaacttcaaaagtaatgtttttggtttcatgatgttatatatttctcattaactctacttcttttccattttatcatgtgttgtatatcttagtgataaatataaaaacattttatgtatattatactattagtgaaattaaatataaataatcaaaccggtctgacttgattcacattacttggcaggaaatcaagtactcggtatctttgcgccgaaagaccttagaggaggaggatccaataataaaaatgtgtgtcgacttcaaagtacctgccccagctcctgcatttgtctctatttagtcaagttggctgatgaaaagatgtttccaagtctcttttgattatatgagtctctctcgcaactttgcttttccttttccctttttgtgttgtccaacaaataaattaaaatcttggaccgatatcgatagcgatatgaacaagcaatcgagcatgtcttttcttcgatttactggttgatattaatcaaaaataaagttttttacataggaaatgttttactagtagcccatgagcataataaaagcagagagaacagagaaatatgaggagactttcaaataattacaacaaagttggatgattatcctattttatatgattttaccaatcataaagctctacaaattaacaattaatctaggtgactaaaacaaaatgaatgctatcattctgcatggttatttcacttagccgttttttttttcatttttggtgagaacagagaaatatctcattttgttgcttccgaaactatcataaagtatacactgcaaggtataaagaaccggtccacaaatacagtgaaattgaaggtgtgctaaacattagataactggttatgcacccttacgctaacactttttcttgctaagatacaacatcaagagtcaagacatttccttgagatatataggccgactttgctagccgttaaaatgttaactttacgttcttttcaaatctgcagattttataataatacagttcttctagacggatcggtctctcccagataaaatccacgtgattgtgaatgagaaaaattggtaggtaaggtaataaaaaattgatgatgatcatactaatattttaagattctcgcttattatgtgggagattaaaatatatggatataatttttgcacttacgatcccatctacttattatgtagattataaaatagcaggcttgcataaaagcataacatgatgtaccaaacttgttagtcaaacaaaaaaaaaaaatatccaagaagctttgaagaaccatg

SEQ ID NO: 16073 - DNA, 3003 bp, Unknown
  misc_feature (1)..( 3003): 2750-1469P.txt file - cDNA_ID_1031360; gDNA_ID_2214555; Annot_ID_185696
actccaccgaaaaacccgagcttttgaaccaaattgtttgagttcacgtcaatgtaaagttttatctggaagggttcatgcttattatacaacaaatgaaagaacattttgccaaatgaatttggagtttaggaagaaaacaaaaaactagttgggcctctttgaaaccgtttcatacacacagatataagtgaggcttcctataattatttttgtaatcaaattataataatgaatgggctttacttaaaggtacgtgaagccctaaccataaatggaccgtcatataatttcaattttgggataatcatcagaaccttcaacgagtcattgtcgttgaagaattgaagatgacaagtccgagaatcgttatccatgcggacttgaaaaattatccttaggagatttttcctgacctatcctcgcgtcgcgccttcttgtcttctctctcaatccagcatattcctacgcaaatcccttatcgttttcatgtttgtcctggtttaaatcttcaatctcctacccggtcttttcatcctccgatggcattccttgttcgttcgccggagatacccaccgtctcggcgagaatcttctccgatgcgaattcgagtgttattagtcatgtgtttatgaggaggaaggctacggtttcggcgattgacgccagagatttgcctggtgttaagaatccgaaatcgagattgtactggcaattctcagctccggtgaaagaagactacaagattagcagagaggaggaagaagaagaagaagaagataagcagagttactacgtgaatatgggtcacgccgttcgtagtatcagagaagagtttcctttgttgttctacaaagagcttaattttgacatttacaggtttgatgaagattctcgatttaaattgaactgctctttgattagctttctcaaagaatctttttgcttcagagtcatgcttatatcccaaatttgatctgttcttggttaggtttcttagagaatgatctgttttatcagttggtgattagctctttctcttgtctaatttcgcagggatgatattgttttcaaagaccctatgaacactttcatgggaattgataactacaaatccatatttggggccttacgtttccatggaaggatcttcttcagagcactatgtgtggacattgttagtgtttggcaacccacagagaacactctgatgatacgatggactgttcatggaattcctcgtggtccgtgggagactcgtggtcgattcgatggtacttctgagtataaattcgataagaatggcaagatttatgagcataaagtcgataacatagccattaattcgcctccaaagtttcaaatgctcactgttcaagagcttgttgaagccattagctgcccttcgactcccaagccgacctactttgagttcggagattgattcatcatcatcgtctgaaacatcatgctggtgttatgtatactagtagtcttttgtgtggttataaatagagtggtactgtaatatagatgaagaaggaacgatttaaaataaacccaatagcatgaatacattacacgctttttttgcgtataataatcaataaaacgcctatatgtacataaatttgtaaaataacagtatagcatcatgatacataaatatgttgactttgattactattatattttgattcaaaaatattgacaagtcactgcaactccatgaggcaccgaaactagtaagcctggttgtggaacttggtccacgaagtcgtgttgacggtagatgtcaaaaagagttgacaaggcagttaagcaaggtgtgaagaagttgaatttcaagactaaatgtaagtacaaccatagctactttgaacatttcttgcctttaccgcaatctcctcaagcgactgagctacaggcttgaaattaaattcgagcaactcgtacatttgtgtatatccatactttgacaaaagctttttatttatagaatatgatttatacagcctacatttgtgtatatccataatttaatcttaaaaaaaacgcatatttttctaaatagaaattcgaattatataacatgaagacaacattggcacaaaccaaagaaaaaaacttgtttggtcatttacggctgtcttttaattcacctgaacagaatcattgaaagcaaatggcaaaaatgatttgtaagactaaagttggggccaatgatttttgcccagtaaaaccatgatggacccatgggcctttgcacgtgcaggtccgttttgacagctagtccacacgtgtggatctcatgtgaatgaagctggcttaatgctgacgtgtccgccagcgttactttttcatgcaacttgccggagtcaattataaaatccagttgaccggtccttttggcaaggctagttccgtcatttcaaatcctatagatccacctccgtttactttaaatgcttgcatagaatctaaccacaaacacataaataatttaatgtgttatcaacaaccgcaattaaagcagcatatacaaagacatgtgattttttttacgggagtatttttaatgtatactcgacaaaaatattaagttaatgtcctttcaaattatgctgtattaattttgtaattcagaggtatcttatagtatgatcaaattattaattaatcttgtttttttatgtgttcataataacttatttaagagaattatattcaaaaaaaaaaaaaacatagtgcgtctttcccaaagtcgttttcttctatacaccttttttaataactctggaagcaaaaatggcataagagtcctttggatttggaatcgcttctacttcactctcaccttcctcctattctctctctctttctatgtcaagttagcttagccgtctcaccagaaagctaaccttacctcacaaacattgattgtgttacactaatctcttaaatagagagccgtaatttctacacactctgatcgctagatg

SEQ ID NO: 16074 - DNA, 3000 bp, Unknown; identical to SEQ ID NO: 5601
  misc_feature (1)..( 3000): 2750-1469P.txt file - cDNA_ID_1031484; gDNA_ID_1620806; Annot_ID_50550

SEQ ID NO: 16075 - DNA, 3000 bp, Unknown; identical to SEQ ID NO: 5601
  misc_feature (1)..( 3000): 2750-1469P.txt file - cDNA_ID_1031484; gDNA_ID_1620806; Annot_ID_168865

SEQ ID NO: 16076 - DNA, 3000 bp, Unknown; identical to SEQ ID NO: 5601
  misc_feature (1)..( 3000): 2750-1469P.txt file - cDNA_ID_1031484; gDNA_ID_2926172; Annot_ID_140164

SEQ ID NO: 16077 - DNA, 3000 bp, Unknown; identical to SEQ ID NO: 5601
  misc_feature (1)..( 3000): 2750-1469P.txt file - cDNA_ID_1031484; gDNA_ID_2926172; Annot_ID_199578

SEQ ID NO: 16078 - DNA, 3003 bp, Unknown
  misc_feature (1)..( 3003): 2750-1469P.txt file - cDNA_ID_1031488; gDNA_ID_2213663; Annot_ID_132602
gataaagaatggcagataggttcagaatgaaaaaaaaaaaaaaaaaaaaaaaaactccatgtgaacacccttgtgaatttgagaacagggtcttgctttggtttggtctggtcatatttccacacatcgaaaacctttactctcagatctcgaagaaagtttgtacacaaaagcttggtgttttactgagttcctaattttccacttacatttccaaggaagttgacaattttctacatcggacatgtttgggatcagtggtaaattaaatcctaatgatcttaaaatcaacagcttttgttttgggaataagttaaaatttcagggtaataatctattcatctgtatgatcttataagcttgattttatttatcatttataactagagctacactcttgtttatctaatcaaatacaaatctcaaaggtatggtgtatataggaaatattcgaactcaatcctttatttttaggttcaagcacccaaacattgccgtatcaaaccaatacacatgaaaagccaactaaaaatttggtttgtctaaacataacaaatttgaactttcactaattagatgctttgaaaagtgaagtatagatataaacaactcaaaagtgtaggatatataattccactctaaacacttgcatgaccaaaagtttttaagatctagggtcacgaattttggctgcaaaaggaattgaggattttgacaccaaaacaaaggaattaaggatacttcatagaacaaaaagaaaagatactcactagttacgaatgcacagaaaagtaaatataagtaattattattaattcaggtttacttctggttcggtttaaggtttataaagagtagaagtagatgatctctggcgaggtatcatttggaaaaggaaagaaacgaattcgattcagttttagactaatctagttgggttgattaaccagtgctggatcacaatgcaaaggagcttggaatcgatcttctctccagaattccattgtgttagaatgctccaattctgtttggtttaaccaaaccaaagtcgaattgattcggaaactttgttgaattttaatgagcttttcaaattcattctcatgggtcaagtttgttgatcatttgggcttgtgagatgtttgtggagtcctaacgcaagcagagagcccaaaacaaaaccatgattttccatagtggtacagtgaagtttttattttgggccattctgtttctttgatataattttatatttaaaaagtctattttcttctacagaaaaactttgtgttggttggtttttgtttacggatagacatcatttaattttactgtataactttacgaataaagacactgatatattttcacctttatggtaacgaattttatcaaaaaaaagaagaaaaaaaagtaactaattaaatagccggaaaaggttggtatgatttggagatgatattttacgttttttttttaatgtatttttcaaaaaatcaaaattcataaatcatgatgcagtcggacagggtagcttcatcatgttaatttatgacgtgagttggttgagttggtagatctcttaatttcacttctatctctctctctccaataattttatttatacagaaaattacttagtagtataaaaatcaagacaaatgaaaagtcttcttttgatcattcttgagtaattagtggaatgtattctgaattatccatttatgcatcgtaatttgttaagtcaacattttcaagtctcatgtattaacaaacataaggtgtatatgattaattaacaagtagtataattgctcttttaccaatttcatgaaaacatcaaatggtttgtgtaattttatcctagaaaatatcaagcataacccgcatttcaagaaaacaaattaaaatacattttataattacacaccaaccaaattgaacaacactcctactataaaatacatcaagattttcaaaaagtatggtattgaacacgacccattacattgacatcaatggctctaattgttatatacaccttctttttttttttgaatgcttttctctttctttctggatgctttatttatgtaatattccagctttgaaaattcgtaggtagtacgcgttaatgtgataacgttcaaaggggaggcatagttggacagaaaaagtttatccaaaaatatatatttaaccaattgaacttctcgtaattgaacatttagatggcatgagtttgacattgtataaatcttagtgaagtctagtttaaatttatccatccatcagctgatggaaacatttttagttttcaatattaaatattatgtcatgtaaaacccatgacaaaaaaaggagaggatatgattgatgagccgcctaaattcacgtatgttacgttaactatatagcatatagatatttcacatattaaccaagtagttcgaaatggatgggttatacaatatggtttctttggggaccgtccggtcactgcatctcgatttgtgacattggatataaacacaaaactacacaaaaatggagatgaagaacggtaaagattagtttctttggatcgatatacatatacctaatcacttcaaaatttacacgtagattgcagacattgagatcagtaaccgtcaatcaaaaaaattatgtcacatcgaatttcaatggttgaaagataattccattttaggagaacaagcagtagtacaatttctaacatttattacatccaaacaacaaacaagaccaatttttatggtgtatcagttggcagcctctattaatgtctctattttcttaaaatcacaccaacaacgaaaaaaaaaaaaaaaaaaaaacagatacacattacttattgaaccctaaacctattgtcagtgtatatatataacacacactctccatatgctctcatatcatacgtcaatttataaacgtttcttctcattcgtcatctagtcccattctctgtccataacaatg

SEQ ID NO: 16079 - DNA, 3003 bp, Unknown; identical to SEQ ID NO: 16078
  misc_feature (1)..( 3003): 2750-1469P.txt file - cDNA_ID_1031488; gDNA_ID_2213663; Annot_ID_181891

SEQ ID NO: 16080 - DNA, 3003 bp, Unknown
  misc_feature (1)..( 3003): 2750-1469P.txt file - cDNA_ID_1031563; gDNA_ID_1621125; Annot_ID_172263
cacgaaggcgagaagcagagcaaactctgtttatcgagatttggtgggcaccactttattaagtcaaaccagaagaaaacactcttccttttccttatttccattatttttattttataggttacacaaaaacctattttcacttgtttacacgaaactctcaaaagcctgttactaatagaacttagaagtctaagctagaaatatactatattggcattattttgggcagtggatcagcttttcattgtgctgatataggagagagatatatatctatatatataagggacgaaacaagatttgggaattatgagaaggttcgattgccttttctatgactcgaagcgaatcttgtgttatgcacttttgattaagtttattctacggtgaatgaatttaccggaaaaaaggtgtaggaaaaagtatatactcaaaagttatacttgatgcaatcacacattacattgatttctttaattattgtgttgttgataaaattttggtacgaagacgttgacataagccatttaaatcaaattatcattattcattttccgtcaacttatgtcaacatgaatcgatttaattatttcaatttaagaaaagccttatacacttttcggtatatcacatacggataatacctacatagtattgtactacatacggtatatctagccgttatttgttgtatcattattttcacgtattacaaattcattagaatatgcatattaattgataatcttggcttggcagaattggaattcgtctttatatatataaaaaacgtacggtaattcatatatgatctcataatttagacaaatctatagggacgtgacttaattttgaatttctcaatccatatattattaccctaaatctatttattccgtttttaatattttctttggagtttacaaagatacatataaatattagacattaaaagtttggtgctcgatgctttggctatagttagaaagtccactcacttttgtgtctttgacgtacatctccataacctataattttctacctagtcatttaaatatttcaaggtactttcataacttgaaggcggaaaacatgtaaaaaaggttaccttccagaagaaataatatatactatttattgaagaaataacatattcgctgtctatagattttagttttacatgttattttctttcgaaatcacctgctccctttgaccaattaaaccgagtgactaatataacaactatatgaaatgttgcagttacaaattagtttcgttaaaacaaattttgattagttttgtagaacatcaaaaaaatgattgtttggaaatatagataagactttttctaaataaatttggtactgggagtggcgtttttctaactaggcaggtttgcaaaatgcaacatgtttgactttagttattttgcaagcttttcttctttctcaaattaaatagagaaataaattagaattcgatgaatacaatcatcccgtaacgatgcaatttatctgtaaagacaaaatgttatattgatttaaaagatgttggcaagatagacccatgagccaaaagcataattgataaaaagtttgatcataaaactggtagagttcttatacaagattagacaaaaacacagattagttggttttgaattatacgttgatactcaatgtgaaaataatgaaaaacatcttagggttgggatcaatgggacaatgaacttttaagttagatctcccacgatcttgtaacaactaatttgtcagtacatgtttttttctttttttcttaactaataattccaacctaaaatttgaatctaagagattagtcaattgtttgaaatattctccattcgacaccttttctcacgaatcattattaaaacgtaacaatacaacacatttaggagatatataaaatgaaaaactggaccttataaagaggaaaaagaatcccccatgtgcatgtgctatacagataacatttattgctttgccaataaatttcagacccttgcttaactgtccatctaaataaaatctataaaatatcattagaatggcctcctcctaagcaaaaccatcccaaaaacttaatagccttcaaatgaagactgaaattgttagaactattagatacttaagaactacgaattgttaagaactactttgttaagaactacgaattgttagaactattagatacttaagacacatattcacctaggctatgttatgccttaagagatttccactaaaaatcacttaaatagtcctaacgactcatttaacaggttttatgcacaatttaaacaacatcgattttattgacaactgtgtatactcgtgctgcagtggtacgtagtcatctcaaaactgaagaaaatctataaatataaacattctctagtatctctgtagatcaactcattttggtgcgtttagactgacacaatagtcttaaacttctgtatgccgctcgaacaatatttatgttgtcatcatcaattcgacggtattaagaaactaaactaaacatattcaagcccgcgtatccagattggtgggcttgagagtgtagttttaaagcattttaacactcaacaaaattcgatggctttcaatttaacttcggcccatcgttagggagccccgttcactgaaagacaaacatgttatcacaatctctaattggtaggatcgaaacttcgaaagatttagcgatttttacaaacgccgcgttacgcgtttattacacaaacgcgaaaaaagcgtcaggaaagattggccccttgcgcactcttgcttttttctggaaacgtctctgaacgaccaactatagatcgtggaaaattcagattccattgcgacgaaaagaaggcggcggattcaaagaacacccaaatacaaatcgaagacggagccttttcagcaatttcgttttattcaacctctggaacaccaatcatctcaaactgattgaatg

SEQ ID NO: 16081 - DNA, 3000 bp, Unknown
  misc_feature (1)..( 3000): 2750-1469P.txt file - cDNA_ID_1031563; gDNA_ID_2926198; Annot_ID_141353
gaaggcgagaagcagagcaaactctgtttatcgagatttggtgggcaccactttattaagtcaaaccagaagaaaacactcttccttttccttatttccattatttttattttataggttacacaaaaacctattttcacttgtttacacgaaactctcaaaagcctgttactaatagaacttagaagtctaagctagaaatatactatattggcattattttgggcagtggatcagcttttcattgtgctgatataggagagagatatatatctatatatataagggacgaaacaagatttgggaattatgagaaggttcgattgccttttctatgactcgaagcgaatcttgtgttatgcacttttgattaagtttattctacggtgaatgaatttaccggaaaaaaggtgtaggaaaaagtatatactcaaaagttatacttgatgcaatcacacattacattgatttctttaattattgtgttgttgataaaattttggtacgaagacgttgacataagccatttaaatcaaattatcattattcattttccgtcaacttatgtcaacatgaatcgatttaattatttcaatttaagaaaagccttatacacttttcggtatatcacatacggataatacctacatagtattgtactacatacggtatatctagccgttatttgttgtatcattattttcacgtattacaaattcattagaatatgcatattaattgataatcttggcttggcagaattggaattcgtctttatatatataaaaaacgtacggtaattcatatatgatctcataatttagacaaatctatagggacgtgacttaattttgaatttctcaatccatatattattaccctaaatctatttattccgtttttaatattttctttggagtttacaaagatacatataaatattagacattaaaagtttggtgctcgatgctttggctatagttagaaagtccactcacttttgtgtctttgacgtacatctccataacctataattttctacctagtcatttaaatatttcaaggtactttcataacttgaaggcggaaaacatgtaaaaaaggttaccttccagaagaaataatatatactatttattgaagaaataacatattcgctgtctatagattttagttttacatgttattttctttcgaaatcacctgctccctttgaccaattaaaccgagtgactaatataacaactatatgaaatgttgcagttacaaattagtttcgttaaaacaaattttgattagttttgtagaacatcaaaaaaatgattgtttggaaatatagataagactttttctaaataaatttggtactgggagtggcgtttttctaactaggcaggtttgcaaaatgcaacatgtttgactttagttattttgcaagcttttcttctttctcaaattaaatagagaaataaattagaattcgatgaatacaatcatcccgtaacgatgcaatttatctgtaaagacaaaatgttatattgatttaaaagatgttggcaagatagacccatgagccaaaagcataattgataaaaagtttgatcataaaactggtagagttcttatacaagattagacaaaaacacagattagttggttttgaattatacgttgatactcaatgtgaaaataatgaaaaacatcttagggttgggatcaatgggacaatgaacttttaagttagatctcccacgatcttgtaacaactaatttgtcagtacatgtttttttctttttttcttaactaataattccaacctaaaatttgaatctaagagattagtcaattgtttgaaatattctccattcgacaccttttctcacgaatcattattaaaacgtaacaatacaacacatttaggagatatataaaatgaaaaactggaccttataaagaggaaaaagaatcccccatgtgcatgtgctatacagataacatttattgctttgccaataaatttcagacccttgcttaactgtccatctaaataaaatctataaaatatcattagaatggcctcctcctaagcaaaaccatcccaaaaacttaatagccttcaaatgaagactgaaattgttagaactattagatacttaagaactacgaattgttaagaactactttgttaagaactacgaattgttagaactattagatacttaagacacatattcacctaggctatgttatgccttaagagatttccactaaaaatcacttaaatagtcctaacgactcatttaacaggttttatgcacaatttaaacaacatcgattttattgacaactgtgtatactcgtgctgcagtggtacgtagtcatctcaaaactgaagaaaatctataaatataaacattctctagtatctctgtagatcaactcattttggtgcgtttagactgacacaatagtcttaaacttctgtatgccgctcgaacaatatttatgttgtcatcatcaattcgacggtattaagaaactaaactaaacatattcaagcccgcgtatccagattggtgggcttgagagtgtagttttaaagcattttaacactcaacaaaattcgatggctttcaatttaacttcggcccatcgttagggagccccgttcactgaaagacaaacatgttatcacaatctctaattggtaggatcgaaacttcgaaagatttagcgatttttacaaacgccgcgttacgcgtttattacacaaacgcgaaaaaagcgtcaggaaagattggccccttgcgcactcttgcttttttctggaaacgtctctgaacgaccaactatagatcgtggaaaattcagattccattgcgacgaaaagaaggcggcggattcaaagaacacccaaatacaaatcgaagacggagccttttcagcaatttcgttttattcaacctctggaacaccaatcatctcaaactgattgaatg

SEQ ID NO: 16082 - DNA, 3000 bp, Unknown; identical to SEQ ID NO: 16081
  misc_feature (1)..( 3000): 2750-1469P.txt file - cDNA_ID_1031563; gDNA_ID_2926198; Annot_ID_201589

SEQ ID NO: 16083 - DNA, 3000 bp, Unknown; identical to SEQ ID NO: 8842
  misc_feature (1)..( 3000): 2750-1469P.txt file - cDNA_ID_1031665; gDNA_ID_1971905; Annot_ID_58531

SEQ ID NO: 16084 - DNA, 3000 bp, Unknown; identical to SEQ ID NO: 8842
  misc_feature (1)..( 3000): 2750-1469P.txt file - cDNA_ID_1031665; gDNA_ID_2926146; Annot_ID_139114

SEQ ID NO: 16085 - DNA, 3000 bp, Unknown
  misc_feature (1)..( 3000): 2750-1469P.txt file - cDNA_ID_1031892; gDNA_ID_2926237; Annot_ID_142781
gtcaaccgtaatttatcgtctcaggtgatagttagagttgaaatgcaagatcaatatggttggagaaaattggtttagccattatcagattcagattatcaaagtaaccatggttgtgaaatttttaaaactaaggttatatatgttcaattgatggttacattttagagagtgcatgtatcgttagtagaaatttgacagatatatcgagctttatgtataattgaagttatggcccatcaaatacataaagattcatgagcctagtagaacctaaaagcccataactatttatcaggccaaaacgtttcaatggtcaggcatttgttattcttttggtcttttgggttggttacaaattaaatagaagtagaaactgggctctagtagggagataaacgaaaagtctatatcaatgaaatgagactaattcgcatccctcatacttattttagagtatatttcttaatattaaaaagtgacagatgatgaaaactcgtaaattttattaagatttaagaggtacatgcaacattagtttgttgaaacatacttgcctctatccataattgtatattgttgaagccgaaccacgcaaatatatctaacacttgaaaattaatgtgagacaaatctaaaggtgagtcggggcatgaattatgttacacttatccgaaatcgttaattgatagtataatattagagataagacaaatatgtcttcttctaatatcacttgatgattgtcgattttgggattagagagagcgacctggccatttaaagttgctagcatgtgctcgtgtgtgtgtggacgtgtgtctcgacttctcctagcaatgagtggttcatattaattaattatgcatttacgatcaaatacaaaacaaaaacattgtgattacgtggatggtttgaatgagtcaagttttcactaattggaatcgtcgagaagattattgcgaaatgatttagagatagactgattaatgattatgaataaagataatcaaaatgagagttgaaccgagtccaatatcaaaccaaaccgagataaagtccggttaaaaaagatgtattttcctattagtcgaaaaggtaaaatgcaaaaatacacgaatgagtaaagaatctgtattttcctattggctctattttccttcttcttcttttttaactcccacactcatgtttctgacgcgtgtgtttcacgtcccattcctgttaacgaatatatattttatatttttgcaaataaaaataaacatataagtgggtttgagactttgagtgacctttgaaactttgagcagcttataaaaaaatgatgaaccaagcttagagtattcattatttactagtatctccaattcatccatatttttttccttaaactctatttttgcctctatttcactctaacacatatctattctcatcactattatagagatttctattttttcctctaaatatagagataaaaaataggggtttatattttttcctctatttttccttctaccaaatagagatctctatttttgaagaaccattgaagtgaaaatagagacaactattaaaaacggtcttatatacactttaattatatatttgctattagtcatggtttttgattaaaaataactaaataattcttgattccgtcttaacatgattcgtcattgatattaggacattacaatgaaattatattatgaaattatgttatcctaattcttatcaatataaaatttttgcataaaatttattttttaattgataatattttatttagtggttggttaacaaagatgttaacgactattgtgagaaattaattccacgaattacgtcctaattttaagtaattaaaggtataaagcaaaaatcaaaatatccatactgatgtacgactttctcacacgacttttacggcgttcgcttacactatatatccagccggtatcttaatcagtgtttatacgggcaagtggcttctcacatcaaagagaaaaagatttgaaaagatgtaactggtaagaatgacgaagaatcagagaatatacgatatgtacactttctcatctataatgtaactcttaacgaatacattcaactaaaaaaactagttataagtctttcagatcatgtaaacacaatctccaaagaaactacataagaagaatcatttgtgaaaggagcaccatccattaatctatgtagtagtggatcttataaactttttttatgttaaatcggttatgtgaaatcaaatagtttttgaaaatattgaatattttgttaaaatgaatatggagaatgagacactagacattggtcttcaaatttttttttttttttttttttttttaaattagaaaagatgtcaacgactttgatatagtttggtcacttttgctatgattaaaaacgttgtccgccagatttaaggaatgatattgtatattacgcccataaataaatcatactaacaaaatcgtcttaaccccacattttcctaattctttttggcatcatctagttggcagcctttgaacattcatttacttttctttacccaaaaataataatatcattccttaaatcttatttcaataacatacaactaaaataaaaatattccaaaatacaacaagtggagcgcgtgaggatcaaaattcataaatgtcattctcaaaaagagacttcatcgaaccatcgccaccatagcttcttcctttcttcacaataacacctctctctctctctctctctctctctctctctctctctctctctctctctctctctctctctctctctctctctctctctctctctctctctctctctaattcattttaaattacaaatttattcatttttgattgctttctttttcttcctcaagtctcttcttcttcttcttcttctaaatctcaccttttttcagattctgaaaattttggtttcattcttctccgagactctcttatg

SEQ ID NO: 16086 - DNA, 3000 bp, Unknown; identical to SEQ ID NO: 9787
  misc_feature (1)..( 3000): 2750-1469P.txt file - cDNA_ID_1031898; gDNA_ID_1972187; Annot_ID_180184

SEQ ID NO: 16087 - DNA, 3000 bp, Unknown; identical to SEQ ID NO: 12071
  misc_feature (1)..( 3000): 2750-1469P.txt file - cDNA_ID_1031965; gDNA_ID_2214529; Annot_ID_184875

SEQ ID NO: 16088 - DNA, 3003 bp, Unknown
  misc_feature (1)..( 3003): 2750-1469P.txt file - cDNA_ID_1032019; gDNA_ID_1620379; Annot_ID_155276
gtatgactactaaccattaacataactctctaattcatactactgcaatagaagttttattgacttaagttataatactgacataacatatttgactgcttttagtcctagtttatcatgacaggtaggctaacacttcatatccgtaatgtttgtatgttcataccttagatcaacactaattagatactccactatcctcacgagtaggattgaaattaatgctataattttctcatatatctgtggtcactgtatgcatattattaggatataacagctacaggttgaaatgccttgatacagtgaccactctcattgaatgaagttccagggcaagaagttgcagtattcatgtgcttatgcttaaaggttgatcttgcttctaattttgttggttgatcatttgcagagatctgttccatcatctccgggaccaaattggcttaactcacctggtagttcgtccggtctcatcgccaagcgtacaatcagggtcgatattccagtcgacaattatccgaatgtatgaactttcatttctacactgagatatactacttcctggttggaatgtaactccttaattttctatatggcagttcaattttgttggtcgcctcctgggtcctagaggaaactccctgaagcgagttgaagcaagtactgattgccgtgttcttataagaggaagaggaagtataaaagatccaattaaggtatttattattaaactttacaacttcatttgtatctacatttcaatgtttgtacaaggtgttaatatatttcttcttgtaggaggaaatgatgagaggaaaaccgggatacgagcacctaaatgaaccacttcatatcttagtggaagcagaattaccgattgaaatagtcgatgcacggctcatgcaagctcgggaaatacttgacgatcttcttactcctatggtttgtttttagctctccccctccctttgattttaaaccagttattgttacaaagttttcacactcggtttctgttttataggaggaaacccatgatatgtacaagaaacaacagctgcgcgagctagcattgctcaatggaactcttcgtgaagaaggatctccaatgtccggttctgtttctccttacaatagccttggtatgaagagagccaaaacaagagaagggtaaaaaccatcgaacagtttggctgtgatcataaagcaatatgaaaccgatccaaaagtcgacacaaaaaggccataccactcttgacgacacggtactgtctcttgtccttggggtagaaatgttgtatatatgatttatgaaatgtgtttgtcagtctatgtatcattgtcccggagagagatcagatgacaaaattgcaacggaaacacaagagctgatgagtctctgtctctctccgagactttgattttgtttttgtttatgtttttatgtctggaaagttgggttccaacagttttcttttaagttttttgtttatttgttgttttagcaaaaagaaaacattaaatcatgatgatggtttgtgtctggtattggtaatgataataatcataatatgttttggatacataaacgtcaaagtaaagcttgtttcaatatgatatgtggaattatgtaaagcaaatgttctgttctcgagtatttttcacatttttattactggaagtcgacattttctattacatgtcaactctgttttcaacattgaaagattacttgattaaactttaaacagatctatatatttaagtaaatcggttagtatacccatatgtcaatcggtttaatggcctgtgacccttataacctagtttcttgtgatgcaaggtagctttcctttactgttttacaaaaaaggcctattcaaaaattgttatgtactttatataaaagataattttaaaatcctatcgaatttggtaagagtaacatcttacatatgaaatctaccattcacaaatactactttattagtaatatgcaaatgcataacaatttttgtaatgtatagattttatttgcatataagaaagtgtttttcttttcatataagaaagttttttaagaacaaaaggaacatatgtcaaaaaaaattgtgataagttttccacttttcccttttccccttaaggtaccaaatctttgcaatctgaaataaatatcattttcttttgatttcctgtttcttttttgaaaatttcttgtttaatccttcttctattttctttttccaaatttgcataacgtttcttattatggacaaaagagtcaatgggctccgtcagtaaacgattgggccttattatagcccataagtacagaatctagctcgctacgtggcaaagcttcaccgctcgaaagagaggaatctatataaaccgtatcgatgctaacaagtttcatcttcaaaacaaccccttgagatttccgaagatcatcaaatccaaaaccctagaaaccgaacaaaaggtaggtcaaaattagctccgataaatctcgatttcgatttgaatcatcgttactcttagggtttattcgtttcccagttcttgatcttcgtcgtttgattctctcgcggttttgtttccttgcgtcgatccatgtgttttttctgttatcttggttctagaatattctcgtacctacttctgatgatttacctttaactgatgcgtaattgcttgatctgtttctgaattgttcgttgattttctctctgtttgatcgaattctgatcggattgtctcttgggcttgagtgtttgatttcgagatttttctggttgatttcttcaggaggtgtatcttaggctaattatcaaagctgatttgcataaagtctttccttttaggatagctatgttcttgctccatatgttaactggtttttgctgtgtactgcttttgcatctgtacttgtagcagtatagtaatttttttgatttgattttgttcctagctagcagaagctaggactattcaatg

SEQ ID NO: 16089 - DNA, 3003 bp, Unknown
  misc_feature (1)..( 3003): 2750-1469P.txt file - cDNA_ID_1032141; gDNA_ID_1620601; Annot_ID_161655
caagaaacatatatataatccttaattaagatacgccaaagaaataattaagggagaaagaaagttgaatttgattgtgataggtgtcacggtaatcttacgtgagatgggtacgtaggatctccaaaaataaataatcatgcacttttatacgttacttttgagttttgagtttacaaatatatataagctccttttaatttattgcatgttaatgactcgtgaatcacgagtgtacattactttttataaagcaatttttttctttgaaaagaattttcttgtatcagaactggtctgaatgtttaacatcaaccaagatttacaaactgtttagtgatgaagctacaatgaaccctcaaaaatgctaattaatttggtgaaatagatcaatatcaactttcaacgacacacctttgtttttttatgaaaaaaaagtctcattttcgtttgttttgattataaacaaagttggtctctcgcatgcaatgtacgttcacgctgcaatgacaatagtgtacgttctttgttgtaatttagtcgagaatccatctccgacgttaggaacaatctatcatctttcctttttttctttgcacaaatatcgtaaaagtgatacccacgattatctacaccaaaagtggtcactgacaatgtacgaaaaaacttagaaaacaacttaaaaaaagacagttcaaaatgatggtatttgatcagtgagtagcttcttcagtattaaagctcaattacatttattcaacctatggttatgattatataaactctgttttctctccaatttaccctgaatatgttagcacttgtaactaacctaattctttctattaatttcacatttaaacaaacatatataaatggattaactaattcttggatccagaatttagcttaccatacttaagatcaatccatggatctttattataaaacttgaagcgaacgctaagactagtagagtcaataaaatagtaaaccaataaacctgaagcttttacaacaactaagcaagtcctaaaggaagtctccacacaaagttctgtgctttttaactctcgaatctgaattctgaccttcactatttgaaaaccattcaaacctatcattcttctttacctctgcgaataaacataactcttcttggtttcttcccgggtaagcccgactagacccgacatctattcttgtagacggttctgaagatataccgagcctcaaggataaatcacagaccctctcagttgcttcttctgagggctttataccaataggcatgccaatgattatgggcgcttcagggactctaaaagacatgtcagcttgctgcgtttgattattaccttcgtaatacaaaggatagaccgaacccaagttgactggagctggagcaggagcagaagcaggaccagttccttgtctaattgccaatggcttttgatgcatctgcatggattcatgaagaaacgggtaaccgcgaggagtagctacacgcttgttgctgttatcaagtacatcaacagggactgcagcttgaactgtctggcttggtttggttgatgattgttgagcttgctgacgatattcatgatggtaagacggctcattagtcgacgcagaaaccggttcctgaattttaggaccgaggtaagtccttccgctactatgtcgttggcttcttgaagctcttacagcaatacatcccaaattaagagcagctaaccatataaaaaaaaaccacatcaacaaacaataaacagtacaaagcactaacttctaagtagtttcaataaggatcactagagctaaagagagaaacaaaaatgacaattaccttcaacacatggaggcaaaagaggaccagtttctgtactctcatctcttctaataattgtatcaatggcatcatttactctattccacatagtatcagcatctgtatactcttcctaatggaaaccgaaacccaattgtcattttgtgaagctgaaaacacactaaaaaaagagaaggaaaatttgtttaaaacctcggaattggctttagagtacatgatttcttcagcttttaacacaaccacaggcaatttctcctgccattctttgttcttcctcgtcgctgcgctatgtgcttccattgcgagtctgaaatcaaacaaagaaaaccccaaattaagatacaaagaaaccctagcgtacggttttgagaaagatgagtgaatgaaaaaaacctgaaaatctggcgaataatcgaaccacgaataggttgatgacgatcgctatgccaagctcgtttcacacactcgtaaggtcttggtcctggcctcggcattttctccttcttcacacacttgagcagtgacacactcagctacaaatcgaagtaacaagtcactcactcatcaaactaatcggttcaatttctatccgggagtattttccgatcagcgagttcgatgtacgagtcgccaaatggtgtggaaagaaaaatcaaccttaaaactctttttaaccgatccaaggaaacagatctgaagctttgaagctctgaatcgtttggagatttcgtctacttgagctcataccggtcacatctccgtcatcatcatcgtcatagaatctccgattgttgtctccatcgttgccgcttctggaaatggaaatggaaatggtgtgattcgggaccgcttctttaaaaacgaaccagttttgtgatttgtctattatacccctatttgtactaactgtcgtttttttttttttttttgtcggcaactgtcgtttaatatggctttttactaaaccggaattgaaataaccgggttttgaacagataatattaatttcaaacgacaccgttttggagttgtgtctaacactttgattgattctgaaatctggattcgtctcctccattaaacatctctcgtctgataacaccgatccatctctttctttctctctccgtcgactctcgttcttaaagatg

SEQ ID NO: 16090 - DNA, 3000 bp, Unknown; identical to SEQ ID NO: 14688
  misc_feature (1)..( 3000): 2750-1469P.txt file - cDNA_ID_1032199; gDNA_ID_2684212; Annot_ID_191564

SEQ ID NO: 16091 - DNA, 3000 bp, Unknown; identical to SEQ ID NO: 14688
  misc_feature (1)..( 3000): 2750-1469P.txt file - cDNA_ID_1032199; gDNA_ID_2684212; Annot_ID_137367

SEQ ID NO: 16092 - DNA, 1378 bp, Unknown; identical to SEQ ID NO: 342
  misc_feature (1)..( 1378): 2750-1469P.txt file - cDNA_ID_1032244; gDNA_ID_1564117; Annot_ID_148883

SEQ ID NO: 16093 - DNA, 3000 bp, Unknown; identical to SEQ ID NO: 5127
  misc_feature (1)..( 3000): 2750-1469P.txt file - cDNA_ID_1032288; gDNA_ID_1620764; Annot_ID_167282

SEQ ID NO: 16094 - DNA, 3000 bp, Unknown; identical to SEQ ID NO: 1960
  misc_feature (1)..( 3000): 2750-1469P.txt file - cDNA_ID_1032303; gDNA_ID_1620473; Annot_ID_158070

SEQ ID NO: 16095 - DNA, 3000 bp, Unknown; identical to SEQ ID NO: 10342
  misc_feature (1)..( 3000): 2750-1469P.txt file - cDNA_ID_1032307; gDNA_ID_2213643; Annot_ID_181350

SEQ ID NO: 16096 - DNA, 3003 bp, Unknown
  misc_feature (1)..( 3003): 2750-1469P.txt file - cDNA_ID_1032702; gDNA_ID_2214522; Annot_ID_184660
atggacccaacattttaatatatttcttaatcttgaattttgtatgaatcctctgtaaatatactactgtgttattgttaatactaatttttattattagaaaatgagtgcttatatctcagaaatccatctggggccactaataaagacaagtacagttgaagattccaaggtgagtctgacttaactaaagtaataatatttcacatcactgtcctctctctctctctgcagctctaaactgttttgaaacctaattgcagaagaagtccagacaaaaaaaagaggatgaatccatcacaacaacacttaccaaagctatgtcctaagcgcctattcctcttcttcactccattcttattgttctctctctattacatcctcaccactatcaaaaccatcaccatctcttcccaagatcgtcaccatcctccacagcttcatgtaccttccatttcccattactactcccttccagaaacttcagaaaaccgatcgtcaccacctccactactactaccaccaccaccatcatcctcatcatcgttatcttcttactttccactctgtcccaagaacttcaccaactacttgccttgccacgatccatcaacagcacgacagtacagcattgagagacactatcggagagagaggcactgtcctgacatagcccaagagaagttcaggtgtttggtcccaaagcccactggctacaaaacgccttttccatggcctgagagtagaaaatatgcttggtttaggaacgtaccattcaagaggctagctgagttgaaaaagactcagaattgggttagacttgaaggagaccgttttgttttcccaggaggcgggacttctttccccggtggtgtgaaggactatgttgatgtgattctgagtgttttgcctttggcttctgggagtatcaggactgttctcgatattggatgtggagtgagttcagttacatgaatagacaccagaacttgattcatcttgatattttacagcagtattactactttcgattatgatggattccatgtgttttgttggacccaaaatgtcaggtagcgagttttggagcctttttgctgaactataagattttgacaatgtccattgcaccgagggatatacatgaggctcaagttcagttcgcattagaacgtggactccctgctatgctcggtgttttaagcacttataagctgccttacccgtcgaggtcttttgacatggtccattgttctagatgccttgtcaattggacttcctatggtaatgtgtgtatttaaatagacctgtttatatgatttagttcactgtgttttgaactgcttgcttcatccactctgcttctgatactgaaagagagaacattttatccagatgggctttacttgatggaggtggatcgtgttttacgtcctgagggatactgggtgttgtctggaccccctgtagcatcaagggttaaatttaagaaccagaagagagattccaaggagttgcagaaccagatggagaaactaaatgatgtttttagaagactttgttgggagaagattgctgaaagttacccggttgtcatctggagaaagccttctaatcatttgcagtgtaggaaaagactaaaagctcttaagtttcctggattatgctcttctagtgaccctgacgctgcgtggtgacttcactttcccaaaatctaatttgctctgcatcttcaaaagcttaagcttgattcggttggatctttttattaataggtataaagagatggagccgtgcatcactcctcttccagatgttaacgacacaaacaagaccgttctcaaaaactggcctgagagactaaaccatgtgcctcgaatgaaaaccgggtcgatacagggaacaactattgccggcttcaaagctgacacgaacctgtggcaaagaagagttttgtactatgacaccaagtttaagtttctcagcaatggaaaatacagaaacgtcattgatatgaacgcaggattaggtggttttgctgcagctttgatcaaatatccaatgtgggttatgaatgtggttccatttgatcttaaaccgaacacactcggtgttgtgtatgatcgcggtctcattggaacttacatgaactggtaaatcactcaaaacgtctctgatatcatctaatttgacatctcttataccatattttccggtttttgtaggtgtgaagctttatctacataccctcgaacctatgacctgattcatgccaatggtgtattcagtttgtacttggacaagtaagatccgtccctaacttgaaaactttgatttacattcatttggtgatcaaagtgtaatggtttctttttctttgtttcttatgatagatgtgacattgttgatatactcttggagatgcagaggattcttagaccagaaggagcagttataatacgagaccgttttgatgttcttgtcaaagtgaaagccataaccaatcaaatgagatggaatgggacaatgtatccagaagataatagtgttttcgatcatggaacaatactaatcgtagataactcaattaaataaaactctttttggtatcacacactactacaaaaaatttggaaacttttgagagagttgttggtttgggtttaaattggacaattacaaaaattaagaggtgcatttagatattttgaaaactttaatggacctcataaatatttaataacaaacatgtaacgacgttattgtgacggtggcgttaagtcgttaactgcgtctgatctactcgtagcttcttcgttcttcagcatttgatcggagtaggtaaagttgtggatctctttgtttcttgctaattcaaattgattaaggttcctgggtttgatcggctctagctaggggtttatggtactcgttatataattcactgaatttagggttcaagggttctgattgatctgcagtgacctttttgattgacagatg

SEQ ID NO: 16097 - DNA, 3003 bp, Unknown
  misc_feature (1)..( 3003): 2750-1469P.txt file - cDNA_ID_1032884; gDNA_ID_2684227; Annot_ID_192030
taatttgacctactcatcaatgtttttttctcatctagtctgtaataaaaatgtggaattgtaatttttctcagagacattcacactgtaccattcatataggctatatcattaaactcgcttccaaatttttaaagacagttctctgatttctttggaatgacaatttaatcacaattttacaaaattttcattatatcctgatttaatttagattccattgctattaaaataaaataaataattcagtacattttagttattcataattatttcacataccttcgtgtacaaccatattttcacctttttatttatttaaatttataattatttcacaccagttcgacttagttacatagtgaaatccaaatgatgcgttagttatatagatattgtaagattaaggaatgttgtgaagaggatggttggggcggacgagttttgttctattgtttaaagaaatttaatttttgttgcctaggctaggtttgatttgaattgtgagacaataatcttcttacatggtgaacactgatcgtgctcaataaagcattttaatggtgatcgattcttgatcgcactgatgatgttgccgacgaggttcggtaaggactatatataactagtaaataaaatatcaaagacaagttcccttaatttttagtactatatttttttgtgttaaaagtatgttcccttaattcagttgaaagtttattaattcttacaatacaacggtcccgcacaaagataatgtgatgtgataaaatgaatacacggattgtcggaccaaccagcggccaaccacctattaagacgtttaacaaaaataagtaaatgtctaattatatgtttctcgatttttcagattgtaggaattcgttgcaactctcaactattttataatttgtatttattgtaggaaatgtccttatttctttgtaatgtcagtccacatgcaagaagtgttgtttttttcacttaactcatgttaacatagcaattctcttaaaaacttgccaagctgtttttttgtttgatatcgtaagacaacctataaaggaattactttgatgcttcccaatcaattatctcaccctggcagattaaaaaaaaaaaaatgcttgaaatggtagagccgccacaagcaaacacttttgctcatcattcatcattttcttataacttcaagtgtatagggttttccgcaggtttttaacaaatttatgttactatttttgataacacactattttacataatattatgatttttaataagctcgatggaaatactaattttcgaaaacgtcagttttcactattggtctacaaatgcattagaagccaatatgttggatgaaaatgcaatttgtggagattgtaagattaattaagttgaccaggacaattatatgtgtaaaaaattctttacgagtgacaaaagtgcaaaaaaatattaatctagttggcagtttgttttactatatttgttccttagactaacaacatttttaagtaaaacacatcatcatttggtttaataattgtattttgtatttatagattacagatacccaaaaaaaaaaaaaaaatcatagagtgtatggtatcgctatcaagtttcgtttagcaaaacgttcttttgatatcgagatgtgcaagcatcaacaaaacatcttttgaagcatggtatttgttcgtatagatttttcgtcaattctttgttatggttcatcccgaatgaagtattgtatatcctattcgcattgggattatgctataatagccttcattttttgcgggttgttacgacttgtgagcttgatgaactctagaatgtctctggtctttgccgtcttggtattagcgtggatgagttttggtttcagtctatattttagttttattgatagaacttaagtatttgctacaaaaatcaaagttcttttccaaatctttaacaattttccgaatcttgaattggaaatatagtgttgatttttcgtttattccatttagagggaacataaatagttttagtagcaattatgaagtgacgtgtttgtatagtactattgggtggtatttgataagattgatcattaaggagaccatcttcccaactatctttattaactttgattttgattttgattttgataatattatactaatatatttgtgactattggaccataagtattctcactatcatgtgttattttcgagtatcaattatgcaaacgagctgaatgatttgactataagtttttgtcacgtggtgctgaaattatgttatcgctttttccccaaccctagctttaattaagatgattaaaaaataaaaagtcatttgtgagtttataaagtaaaaaaataaaattcatctgtaatgaacttacacaactcataagacattagctaacaaaaatttgtggaatctcattttgacgagaaattacacagtcagatcttcaattttttttttgcaaaaaacttgtttttactttcacaatcaaaacttatttataaaacaccacaatcgaatcgcagttgttatactttacttcgatcgatatataaaaattgttaagaattcatcttataactttatatcatattgaagtataatcgtttatatcttctagtcttttagattatgttactttgacgattgataaatatcagaaacacatgttcctaccaaaaaaaaatatcagaaacacatgcgaagacatgggtgtgttgaatatgcattatggacttctagaatgcgttaaaaatatttaaaatctttaaaacccaatgggctttaaaaatcaattcgaaagcccaatgacctgcacttctttgacataaaataaaataattatcatttctccaacgtgagagagcacgaatgtgatgaatcacccactctgcttttacatccacaaagctcacttttattaaaccaaatcacaatctcaatatcacattcgttgcagagacaaagatg

SEQ ID NO: 16098 - DNA, 3003 bp, Unknown; identical to SEQ ID NO: 16097
  misc_feature (1)..( 3003): 2750-1469P.txt file - cDNA_ID_1032884; gDNA_ID_2684227; Annot_ID_137601

SEQ ID NO: 16099 - DNA, 3003 bp, Unknown
  misc_feature (1)..( 3003): 2750-1469P.txt file - cDNA_ID_1032925; gDNA_ID_1620375; Annot_ID_155138
agtaatttggatgcaaggagatgtttctcaatgggttcgtatcagtatatactcggtaactcggaacttaaagtcccgtttgccaacgacagactgccgcgtttgaaacctcaggacaaagaatctgagcagacagggaattcatcatcagaagacaataaaaagatcaatactgtggctaaaggagagagcttttcggtttcgaagatttggttgtggcctaagaaagataagttctcttcagatgctcaaagaaggttgccttcttcatcacttaacgttgatgatcttccgaaacttccatggatggaagaacataagaagctggagaacgacggaaggtagtatcttttgctcatttttcaaccaaaatcatcgatacttagggttgttactgatcatattttggggggttcgtaatcatatgttgtaccatattgttcaaaagggtttaattcttgataagaacttcagttggattatgcttgttaatcatatgagatcaaatttaattatgcatgctcaacaaaaatggattccaaaagactgatgctttagctttattttcattatctttgtctcttttttcttcactttggggtcactggttctctttattttcttcttttccatatactttcctttactctctcaacaaattcactgttaactttataaatataaatgtatttgttatatacatgctggttcctgctggtcatcaactaatgcattatagtatggtttacttttttatttttataacttgtctagaatttttaactgatatactcaagtctggatccagaaaacaaatgggaacttttgacttgtgttcaaacacaatcttgaatcttctctttggtttaggttaggggtttttggctctttgtgctataaaccaaaacaaaaatgaaatcttctataaaccaattacatttaggactttaatttcaaaagtctttggctctaatggtttatgttggttgttgtagggtcaatatgtttttctgacactgatataaaaccattatatacccactcgatcttgatttgattgcacataaacaaataaagaaaaagataatccagaataaacaaatgatgaattagaactctctagttcccttgcactgttgcacatatatctcttaaagtatatgataagtataataatatatagttatattgttatattaataagattatttattaaataatcttactatttataagattatttaatatatatatatatatatatatatatatgagaattcaaattaaatattttcatttgtaagaccaccctctagcttatggaaacatatatcataccatgacaatttggctccgagccaaaacacaaaaagagctgcaaagactattaatccttctaataacctgttttggaaggaaaaaagcactagtccaaaactacagtctaattattgttgtaaatttgaccacaataagtgtaatgcgttaaaatgtaaaatcttcaaaatctatgtcagtgtgaattaattaatttctgtacttttgaaaataaacgtaaatcttgttatagaaatctacgcaaaaaataaagaatttgacctcaggatactaaaaacagtaaaacgtatgcaattaagactaaaccgggattgcattgataaaccgatataaaaatttgaaataaccatccggtttattttccgtggccagcaagtcccatgaattttgtttgatggtcaaacaaatcccatgatatcgctcgtagattttgcatgtgtttgttgtgaattgtactgttggtggcaaatctcgtaattatatagaactttaagaccctatcagtaatctcaaaaactaaattctgacgtggcgtgtaacaacaactaatacggacgtaacggaaaactttgaacacacgaccactctgaaaaattcagaatctttttaattattagaaaaataataaaataaattaaaaacgactaattaatttacgatttcatgcttatccttacgattcaaacaaaatttatcttaaaaccaaattgaatatcattagttttttttcttcgggtatattgttttttaaatatattatgcgttatcaaaattaggaacgttccaaaattagacattgtaccttctttttttcaacagacgttaaattggtattctttttttttgcaaaatcagatattataatccgaccttaattatagcagtttaagataatatttggtcaaaacaaataaatttactagtctttagataattaatagttggataatctttggtcaaaacaaattaaaacgactaattattttcagtttttactcagatttcatgtttatccatacaattcaaacaatattgatcttaaaattctatcaaagtgataatataaattcttgacatacgataattaagtttccaagtcaaagatttaatactatcattaatagttttttctttctccgcgtataaaattgttttaaagtgatggaactattttaaaaattattatgctttatcaaaattagacattaatgcacattccttttttttcttgtcaacagaaattaactttttatccttttcttgcggaagaaaatcagatattataccctaagataatctggtcaaaataaataaatttggtagtgtttggataataccaaaaatagaaaagataatgataatttccaaaaaatgtttaaaataacaaaaataataataaaagagaatcataagttgataacaaaaaagtattacgaaataattaatacattatgataattccccaagtttaggagaatattgactccttgactcaaacgtctctcttatcttaatctctaaaatctctcttatctctctctctctatatatacacacacataatacccaaacgctctcaattaggttttcttctacacttgttcttcttcatttgctctcttcttcatcaatctctctctttttgtaaacggcgattttaaaatg

SEQ ID NO: 16100 - DNA, 3003 bp, Unknown; identical to SEQ ID NO: 15530
  misc_feature (1)..( 3003): 2750-1469P.txt file - cDNA_ID_1033038; gDNA_ID_2213640; Annot_ID_181187

SEQ ID NO: 16101 - DNA, 3003 bp, Unknown
  misc_feature (1)..( 3003): 2750-1469P.txt file - cDNA_ID_1033176; gDNA_ID_1620377; Annot_ID_155182
tagacaaaagtaaaacataactagattagttcaacgtttatgaactccgtcaattacttctcattttagccacttcgatttcggcctgtaagtagttgctttcagcgatttccagtttagatttaagggcatcgcatgaagcttcccaagtctccttttccttttcctaaaggaacaaaaaaaaatcatggcttctatgaattacaacaaaagaaaatagaggaatttatatggccaaacaaatagaaactctaaacatgctgtctgatgacagactgacgccttagatcatgtttacaattatctatacgcactcctatattcattccctggttaaaaccatgctagtaaatctgctaaatgatggaaatcatttgacgagtagtatgcaaaacaatgtcttagaatatacgaatgggcaacaataacgaaggacaaatgacagttggcatcagagagtcctgcgaatccatctttaaacattccacttacattctctgatttaaggtgtgcaagctctcctttaagagtttctgcagcagcccttagccttgctgcttcgccagttgcagctgcctccatctctgcaattttagattccttctctgcaagcagtacctaaaagaggtgtatacttggtgtgaagaatttatcacttatttcaaactattctctctcgctcatttgaaaaccaaagcacatcatccagtaatagaactaaagaatttagtcaaaagactaacctgcagcgacgaaatggtttcggctgctttgtccctctcagatagagcatctacgacctgtgcttccaaaccctctaagttctgtcaagaaggtggagagaagagaaaaccttggatgtcattagcggaaaatggtggctcatagcatataagaagtaacacaatcgctgatgctgactaccttttgatgcttggctgacaactcagtaactgcaatttgctttctctcttccacagcttgtaattgctttttcaggtcctccagaatctaggattaaagcaagtacgcatatgaagcagagtatacagagccatccctccccccccccccccaccccccctctctctctctctctctgtctcttttgtctctctatttttctatatattgcagactagtattacagaaaatgaaagagatcaaacctggtccttatcaagaagtgactgttgcaatgtctcaatcttattttctttaggctgcaatgagccacgtagttcctcgatagtatccctgagcctgtgtaaagagaaaactccagtactcaaattcttagaggtagctggagaagtgggaaaggcgacattcattttatacaatttctgtaaaaattatcttcgaattatttacttgttattggcactccttagttgttgcctctccgcatccattgctttaagtgcttcattcgcctgttgcctagtgcgttccagctcttgttgcatggatgagtgttgagaagatgctcgttcagctgtttcattcacttcccggaaacgggcgtcgagatcatctttttcctgaagatagcaatataatataccactgagattaagacagcacatagcagcgaaatctatatgtctgaaaatgcagcatagaaattccgaaatagtataagatggtttttgaaactcacagtagcctcaaagtggctaaaacagaaagcattataaaatgtagagaaagacattcaccttttggatttcttgaatgcgttgtttagcccttttgtgaagcctggtgaatttggcgtccaggtcggcatatttctcgtcgcgctctttgatttcctggtccagtttctgttcaactacaccaacaatgtaatagcacaagttgagaaaaggcaaacactggttccggtcaatgaatgagcaaatagaaaagatggcttctgaccttgggaaaacttagaggagtattcttgggatttagcatcagcctcagagtatgcttcccttagatgctcaagagcttgctcagctgcaactcgagtttgtttttccacatcaatttctctgctcaatgatgcgacctgttcttgaagttgtttcagctgagcagagtccgcttccacttgctcagctttctggagagacctaccttgcgctacctcatccttgagtccctcaaattgggatctgagaaagtcattttctaatctcagttcagcaatcatttggagtagctgatcaccattttctgtcagagtctcgttggaggcatcatttaactctttatcttctttgatcacatggctctcctcttcttctccaaccacatcagattccttgtcttcggacatcttggcagagcagatgtcagaaagatgaacccagacactcaagagagcgacgacaactagtaagcgcaaaatcgggatttgaatcaacaatcaaaagagaaaggagtcaagtcgtgaaattcgaataaaccagcaaaagcaacgcaaggagaagagagatttgaatgtaatcagtgccagagaagaagcttaccttgaggtgagggattagagaagagtgtggaggcagagagagagaggtcacaaacaaggaatcacgatttcgaaatattggatcggatctcaacccaaaggttaaaaacgtcgtcgtctctttcccgtcgatcagtgagacggtaaaacgttgatctgatcgactgacgaagaatggtaagaattgtgtaaagggtgttttactaatgaataattgcattcagaagccttaaaccttttgaaaattcatcaagtaaacccaagacgaggttagctaaaatgatgccgttttggaatggtaatatgaaaatatgaaggacagtccgaaaacagcttagcccataaagcagcaacttaggcccattatgtatttgtaatatatggcccaattataatcactttcccaactaatttatataaaatgaaattattgaagtctttgtccagtcaaatataataataagccattgaaaaaaatg

SEQ ID NO: 16102 - DNA, 3003 bp, Unknown
  misc_feature (1)..( 3003): 2750-1469P.txt file - cDNA_ID_1033212; gDNA_ID_1620413; Annot_ID_156326
ccgcatgagagccatatgcttcttcgacctttcattctatattctttccttttaaagatagcaactattgatcaaaaaaaagaagaaaaaagataggaactatagaactatagtctttttttttcaacgaagaacaaatatatggttatgaactattcttaatggatggtcaaacagattttttgatttttttctaagaaattttgcatgtgaatacataactacagttaattccattcaactgttacttttctttgggtgaaacaataggttggcaacttggcatagatatcaacatcagagttttgaacaaatctatcatcatttaagaaatgatagaaaatcaagtattgtttttcaaatcaagaaatatcaaagaagaattctgtattaagtttagttctcatggaagccatagaatatatcagaagtttgaaacaaacagcaaatatatggaataaaaaacatagttattggaataaatagaatagttatttttttttgtttggcataaaataaagaaaattatttgttcaacaaattgttacagatttcacttatgtatattttgaactaattcttatttttatattaattaaatcaagattttacttttgaaaaataattaatgaatttatgaaacaatctctatgtaaataaaataaagcaaattaaaacgctcacacatgtttacttattcggactagagagcttccgcataaagctgaggaaaaaaaagagagaagacgcacaccgaagaaaacacacaagactccattattctcctgcttcttcgtctcttcaattattttctctgagactagctttgattcaaccatggtgagctcaagtctaatttttctctcttatatagttctctttctttgttctctatggcttgatttgaactttgcttctcgattcgagttccatttcatcttggattttcaattcttccgatttaagttctcgcccagagttagatatgattagatctgtagatggactcgtttctttgtttagatctctgagattttggatttgtatggttagatggactgatctaggatatgaatcggccgatagtaaagtcttcaatttcagtgtgcttgtgttggttttagccaattgattttgaaaccaggaagaataatagtgttccatgtggttttcctttgattttagggttacgtctatcgtttgtttagccttttccttttataagatattgttttctcgcttctttgagttattatttgctgctgttgaagttttcagatgtgtgtttgattctgttgatggtagagtatcatccgattaatatgattcagaactgtaaaatctgtcaaattgatattatgatagctcaacatcatcgttcatatacgttgtgggagtcatccacgtcttccctttgatatacacactaccaagatctgttcatgattcattatgtttgatctctgaactaatgtataacccgaacgccgttttaaaagatgggtatagtgtctactaatatgtgtattctgaagagagttgcatcttaatgttctatgttttgttggtaacaggctaatgcagcatcaggaatggcagtccatgatgactgcaagctgaaatttatggaattgaagacgaaaaggacacaccgtttcatcatttacaagattgaggagctgcagaaacaagtgattgttgagaaaatcggtgaaccgggtcaaacccatgaggaccttgctgcaagtcttccagctgatgaatgccgctatgccattttcgattttgattttgtcagttctgagggtgtcccaaggagcaggatttttttcgtggcatggtaactaactaactatactatctctgctaaaacctgtctatcttggtttcacattcttttcattaacatttcttcttgttttttttttgccaggtctccggacacagcaagagtgagaagcaagatgatctatgcgagctccaaggacaggttcaagagagaactagacggaattcaggtcgagcttcaggcaaccgatccaaccgagatggatcttgatgttttcaaaagccgagccaattgatgaaagaaatcccctgaaaatttcggttgaatcaaactttttcgtactattactcagtgatgctttttcctaaagtttgctgtgacggtaccaacctgaacagcttcattttatcagtttggtctttgtctttgtctttggtctcctttttgggtccttatagtgttgtcttaaaacttaaggaatctggcttgtgctctttaccattgtggaagaaatcgaaccctttattaaacaagaatcctattggcacatcttgtcttcacataatgaaaactaatgatccagggattaaaaagttgtgaaagttttataggcaagttgatactgtgcaaaggtaatatacattttcaaacataaggatctctggattgatagaatttcatttcgtacacgactattcacatattcgtcaatgcgactatttcaggttcaaagtattaggaatttaggatagttccaataacgagaagagttgctcaatcgagtttggtccaataagataaactgaccatcaaacataaaatcctaatcgatacttttgattatttggaaacagatccaaccattggcagttgtccattgctcattctacgcaatctttcaactgtcaaatcttagcccaacaaaaatacttagatgattattatatgttgaccaaaacaataataatatgcttaccatatagtttattaattcataaataaattgaagaatacgaaattacgaagaaaataaataaaaatacaaaaagcaggttcttctctatatattcggaatttagcttccaaataacgcagaagaaagtaaagagagaagaagcaaaaagagtcatattcgttgaaaacatcattcactcttctctgcgtctccttctttcacccgaaattgtctctgacaccgttttgattcagccatg

SEQ ID NO: 16103 - DNA, 3000 bp, Unknown; identical to SEQ ID NO: 11790
  misc_feature (1)..( 3000): 2750-1469P.txt file - cDNA_ID_1033366; gDNA_ID_2214517; Annot_ID_133965

SEQ ID NO: 16104 - DNA, 3000 bp, Unknown; identical to SEQ ID NO: 11790
  misc_feature (1)..( 3000): 2750-1469P.txt file - cDNA_ID_1033366; gDNA_ID_2214517; Annot_ID_184467

SEQ ID NO: 16105 - DNA, 3000 bp, Unknown
  misc_feature (1)..( 3000): 2750-1469P.txt file - cDNA_ID_1033557; gDNA_ID_2936554; Annot_ID_194175
tcgttggactggacctctttgatcctactaaaatgtcaaaacgattgcaatgacacctagccccaaccaactagaaacaacaagtcaagaccactactttatgtgaaaattgagttaccgcttaccatcatctatcatatcaacactgagatattgtaaccaaaactaggatatgtttgtttggctttcatcagtgatacacaacagtgacaaatgatgaaattatgtttgttttgtagtttgttggttcaacaatacctttcagcgataaaatcatgcttgttacattgttgctaattcagaaaatttagcctacatatcgttaacgtttataaaacagttggttaacaatcactaaaaattaatatattaaaaaaagactaaaaaattaaaaataaataccgatggataaactaacgactacaatgcaaacacgattctattatctttactcttcgttaacaacaattagaaaataacaacaccatcatgaaaaaacaacatttttcttgtgtaattgggtatcgttgatgcttacaatacaacgaatgtagaacgaacagagtaaatacctctctttttcaatgacatcattatgaacgaatgaatttgtggtccactaaagttgggatcggcccgttaaaaaagcccataaaccaaaaaatattggctgacgaatatttcaaaactgccattctttatttgtttacataactcaaaaacatgacgataatcaaccaatattaaaacgccacgtgttccctcgcggtcatttatcattgaatcgaagagcacccgcccagcttgtttcaatcgtcgtcgtttttctctttgatttgcctgaaatttgttctcttcttttggttgcaatttctcgatctcgaattttctgagagaatacaaaacttaatttctcaaaccccagcagattcgaatttagggtttcttacacccattagatttcgcgtcgatggcgtccaatcgcggtgcgggtggttctctatacggcggagctgatccgtatagatctaggtatatttctaatattatcagtttctccttttctgaaatcgattctggatagagaaaacgggtcctagatttggtgaattctgcgtaaagtacaagtatttatctttggtgtgtgatttgtagagaagggctaagcactagaaatgcttcaggttcagaggaaattcagctgaggattgatcctatgcactctgacctggatgatgagattctaggtctccatggccaagtcaggcaattgaaaaatgtaagaaaccctctaaatcccatttcgatctttctactttttatctatagtgccatttgtattgtcttcttgtggttctgaaggatcattgttctctttaagctttaagttgatcatatgaatttggaaatttgtcttcttttcggttttgacagtggttagagcttggttaattagttgtgtaggtgtttttttgttcagggtactatgataatgttattgttcacaatacttatcagtcagtccacgattaattagttgaatccacttgtctgatgtcttttgtatacatctgtggttattgttttatatcaccacccttcttgaaggaatcagtcgacattctctacaattccttgtgttttaccttgcacttttgcgcattatttatccctcatgattttttgttatatcgttgatcgcttattttgatgcagattgctcaagaaattgggtcagaagcaaagtctcagagggacttcttagatgaactggtatgttgttgatgtccctttagttttttctttatccatcatagtaaattgcaatgtaagcacttaacatcagtaacatgcattcatttactcttctttacctttaagatgaatcactgattatatatagtatatccgaatatcggtttcctataacttgtttcagatgtctctgttcattattagttgggaaaatatagtttcatcctaacatatgttagataactttaaccgtagcttacaaaaccaatgaatcttgataaatccaaagtgtagattatgtttacttaggatctggtctgaacgctggtggtgggtaggattagatatcttcaatctcacctagtttggtgaaatgcagcaggaaatggttacagcttatcattgagttcctgccactttgtcaatgagaatgttggtgttgaatgtgttcattgcttttagttcgttctagttttttcttttgttacctagaagaacatcctagagaagataatgacaaacaactagatttggtagtgagactgcagaaacaagcatttagtgctgttataagcaaaataaaataagtagacgaaatgttgttcttgtctgaaacataaaacgcttcaatggtattttgtttttgtttgtgacagcaaatgacattgatcagagcgcaagcaggggtgaagaacaacataaggaaactgaacctaagcataatccgtagtggtaacaaccacataatgcacgtagttcttttcgcgctcctcctcttctttatcctctacatgtggtccaagatgttcaaaagatagatagagagactcatggcatacttgtgttaccccccaaaaaaaaacccttgatgaatgttggataagttgtagaaaatatcctctagattacaaacattttgtggttcttctcgttacctgttatatagagtgcctgtttttaacagtttacatgaagcaaaattgtatcacagaacaacagcatgagatattttagaccagttcaaatctggccttaacttgattaattacccgtccggtccaattcagtattgggcttttatagtcttatgggctgaagtgtcgtgatacgtgtattattatggttggttcttatgcgtaagtttatggtggtatcgtccgtagacgatagaggttccacactatgtaaaggagaccggagaaacaaaggaactgggtttggagataagaagtgggaacttgaatg

SEQ ID NO: 16106 - DNA, 3003 bp, Unknown
  misc_feature (1)..( 3003): 2750-1469P.txt file - cDNA_ID_1033727; gDNA_ID_1620705; Annot_ID_165241
ccatgtcttgtttcttggcattggtagatgaagagcctaagagcagcctatcgtaagatattcatgtctactgaaacagtctccttaagttttgaagagcgtctcacggagctggtacgtgtaatcaatgaaaactcacttcactgtcttcttccctgtggatctagtgcataaacatctaaacatattatatctgatgtaattcaggaacaggaccaagagctgtacagtgttcctgcagtatcggcaatgttgcagtcaatccgagattctttcactgaaagtcgccgtgggatatgcaagttcagacaatggctcgattccacaacttagagacttagcttaggcattcagtaatcagcaatggcttattatacctaattgctcaataccatttccttcactggaactgtaatagtttgatatatagctttaactaagtgttgtcaacattctgtgggcacataacatccttaaaaatcacttgtcagagaaaggaaaattcattttggtattatttctaatactgtaatgaagctataacttttggatgctagactcatagatggagatggacttgaaaagcctgaggcagcagagtacctgcaaattccgatatgctcaatatacaaggtatagagagacagagaaccaataaactcatggtcgaaatagaggaactaataaatcgcatctcttcgtgagaccccactttgtttacaaactcgtgaagccatgaagccaaaggaaaatctcaaggctgggaatgcaatcttctacatcagtttcagggactgtggtctgaccaagatcaccgagctgtggtaagaagaaccacagatgggcatccggaacacatgtttcttgaagttaagtgtacggttgcggacttttcgagctgctctcttaactaaactattctgctctattggctacaattggtctgaacacatttcttctaagatgttgcagattatcctctgcttttatttggtgttccaatgtaatctaccaagctgattgttttgtattaaaccgctgcagccttataattccttgaagaatgaatctatatatcattcatttccctttctagccaagcattggatctttcccgtctttagattcagtttttttggagtgttaccaaaagatcatgtcttgtttcttggcattggtagatgaagagcctaagagcatcctaccataagattttcatgtctactgaaacagtccctttaagtcttgaagagctacttaacgaagatggtgcttgttattactcaattctcttcactgtcttttaccctgtgcatctatcgcagaaacatttgtacattttgcattttgcaggaactgaaccaagagatgtacagtgttcctgcagaatccgccatgttgcagtcaatcctagattctttcacagaaaaaggcttatacaagtgttgtgaacattgtgggcacaaaatatccttaaaacagtgagaagaaagttcactttggttggtcactttataataatatacatattgaagatgtgtctacttacattagccgtgagagtaaaggcaaaattaggttttcctgtaaaaatagccagttgcttttagtggcttagtgtagatctcattctcatgtctattcgtgattttagttcaattcattcttctggtctttccataatatcgtttctcttagttctttcttctttgttgtcattaacagtcaacaaaacagctacaaaaacttttaaaccaataaaactgtttggttgaacaagatacctaggtctagttttaaactacaaaagacaatattttgttttcttatcatagaagagaagagaatccactgtttcctttatacagccatagatgttagtctttcaccatggacatgctgaaattgtgaagagaacgcgtttccttttacataactatatacataatatacttgataacaaatgcatggtacatggcattacccgtgatacacgccagcgtgcatatactgcttcgtgcacctcctcaaccttgatgccagaattaggagttgttgccatgatttgagagaatgtaccaactggtatgatctctaaaatatgagcaagaactttcacatttgctcgagttacgggtaacagttcctgtttcaaacaaggaaacatgtttcgactacaatcaatagagagttatctcagttttatacatgtgcattctatagtctttggcatctacttactttaggtttcatgattgacgacatttttgcttgtttctcctgcggattaagaaaagttagttagaaaaccaagaatcttgttttttctatgcatagctatcgatccttttaccagatacaccaaaaaaaagaaacaagatcaacactacataagccaagtattagcatccatttaaacaaatccaggctcaattctactagacccgatgaataacccaaagatctctgctcagaacagagcataccaaagaaaaaaagaaagaaagagaggagatgcaatgatttcattacgctagctagacctaactgttacatacgttcgctatagtttctggctttctgtacacggaatgcaaagaaagggggaaaacaaaaatttgagaaaagataaaagacgttactgttgaccggtgaccaagtagacaatagccggcgacgaaataagcgggaatatcgttatccaatttgacgattggtccaaaaccaaatgagcctagcagagcggaatgaaaatacatcggtctaaacgacggcgtttatctgaatatttattgcctttctacttgtctccgttgccatccgccaaatcgacgaagacgacgattaccaggttcatgaaatctgcttctcacttttattttagccatcgtagatctattttcttatggtcaattcgcttcagtgttttgaaattttgaagccacagctttctggatttgtaatttcgaatatgaaaatcgactgaaattgttttaggatatg

SEQ ID NO: 16107 - DNA, 3003 bp, Unknown; identical to SEQ ID NO: 16106
  misc_feature (1)..( 3003): 2750-1469P.txt file - cDNA_ID_1033727; gDNA_ID_2926196; Annot_ID_201450

SEQ ID NO: 16108 - DNA, 3003 bp, Unknown
  misc_feature (1)..( 3003): 2750-1469P.txt file - cDNA_ID_1033921; gDNA_ID_2214478; Annot_ID_133189
tccgccgtgttgtacggtggttgagaccagaaagtgaggtatgagcggcaagaaggtgggccgttacatgtgaatccgttggttatgttgtcgtagacacggacctcgcaggcgagctggtggttgttgacgtacggttgctgagctttcgccggtgacacggcaaagaagagaaggaggaataaggtgactgagagcgcgtggagtgtacacgcagccatgttttgtggtgttctgatctgaagagggattctcgtgagctttctcctgatttaaacagagaggacgatgatgaaccaaaggagacggcgaagacttatttagtcaatggaaacgcgtcgtatgtgttgactttttgtgacgtttctcattggtcctaccgtcaaaatgataatatgtgggattagaggagattttggtacgtcttctagaaagttgaccaggtcagtaaatttgttcagtaatagtcttaagctgaatacaaaagtgaactaagtaatactaatcatgctaaatgcccttaagctacgttagctctctcatggacataaagatggtcttggtctcttggatctcatgtgaaagagacacattgtctcagccaatacgtgttgctaccgtttttccttccgggtactcaacccatacccattctcgacgtgataaacaacttaaagatggtcatggactatttctcgtcaatctaaataatcttctctacaattttcaaacttctaagttggcgttgttcctagaaggaaagagattcatttggtttgcggtatgatgctgttggaaactcttaccggcaccacgattttctcatcatcctactatacggaagatttagtttcatcgtttcgatatgaaaactgtataactagattaacctatatcataaccaaactacagttagataaaataatgggccaactattaaagcgatccatgaacatggcttttggatagcaaagtcatgaaaggtttaccaaagaacttgcaacgcattacatatggttccgacggatacaaattcggttagaagactacatcaagtcatcaacaagcacaccaaactgatgaatctaaggacgcaaagcagaacaaaccaaatccatctgaccaactcatagaacatccaagataaggacactaaagcatatagctccaataatgagtcgaggcaataacttcaatactataatccacaacaaaaaacagaggtccattgtcaatcgccatcacatgatataaaactaagttatatcccggggaagtaagctttccattcacgatcgaactaaagaacaagacagacatgcttttctaatatgacacgagaaaatcacccatccttgtggcagagcacaaacataaaccaaccacagaataattgcaaggacctgaaatgatgcaagtcgatgcatctcaccaatttaaagggtaaaaaaatttcgaatccgacgtatataagtttacagcatcggtgttccaaactggcaaacttcaaaaaaaaagttactaaccatgaaaccaattggtgccaaattgaacagagtaaaaggaaatgatagaaagtttggagtcaaaacgaagtttcagatccatactcaatctcacaatgcacataaaatccttcagagatggtttggtaacaaaaaaagtttccatcttttattcgttgtaagttacaactatagtgtctatacatgatcattagctataaggaacaaaactgtagaagctaacttacaaccaaatgttcaaacttaacagaaaattcaatcttctgacttatcagttccgttcttgtttccatatatcaaaccagtaacctacaaatagcataagaaaaaaccattgatactctaaacgaagaatccacaaatgaatactaaactactaataaatgttggaaatttacctgagggtcagcgattggtttcctcttctcaacgtattgattagtatcagccattgcaagagctgccctagcctaaatcaaaccagagataactgtggaaatgagactagaggattcaataaaaacacaaacttttttggatgtgcaaaaaaatcaaaattggtacctcttgttcctttttaagatcttgttctggcttaatccagagaaagtaagcaatagttccggcgacgacccaagaagcggcactctgaccacctctaagacctcccatggaattaccgatgaaagatctcacgtttccaattgatcttctccagctgctagccattgattgatgcccaactatacgaactggtctaaggttcttctggatctcttctctgacaattgcttgactttgatgatgattcgatttggaactgaaattgcaagaaaagtaaaagcaggcgatttgattttgattcgcatttgcttggtgaacactgccaaaggctaaaccggtcgccgagacggttaatctgatgtttgggattgacacatcatgcggctgttgtttctccacgtaacatttggagacccgctcaaatatattgtgggccggagaacattgttttaccatatagggcccatagactttgaatatgtgtaggtaaataaaatacaatctgtggaacaaaaatggcaaaaatatttgaagtcagcaggattggttaacaatttgagcacagaaatacatttggtaacatctgagcatatcattcatatcatatcgctgtcgaatttgaaggaaaaaaaaaagactaaggaagtggatatattggtgaatgctgatgatgagaaaacttattattatatacgaaaaatttactaaagacagcaatattccaaaataatgatagggaagattctgagatggtgtgtggtcagtgtggaggcactacagatggtcaaacagtagcatacccacctggctatttggacaaggacaaggaagaagaaaaatcgagaaccatcttctcagccgattttagtaaccatcttcttgtttgctccgaacaatcaagagatcgaaaatg

SEQ ID NO: 16109 - DNA, 3003 bp, Unknown; identical to SEQ ID NO: 16108
  misc_feature (1)..( 3003): 2750-1469P.txt file - cDNA_ID_1033921; gDNA_ID_2214478; Annot_ID_183224

SEQ ID NO: 16110 - DNA, 344 bp, Unknown; identical to SEQ ID NO: 39
  misc_feature (1)..( 344): 2750-1469P.txt file - cDNA_ID_1033925; gDNA_ID_1507; Annot_ID_145123
  misc_feature (154)..(154): n is a, c, g, or t
  misc_feature (223)..(223): n is a, c, g, or t

SEQ ID NO: 16111 - DNA, 855 bp, Unknown
  misc_feature (1)..( 855): 2750-1469P.txt file - cDNA_ID_1034108; gDNA_ID_1564347; Annot_ID_149294
cgtgtctttttcaaacatcattcattcatttcttataatgctttctgattttaaaactcttgacactttgaacagaaaatggattcttgttatttgcatcaaacatcatctatggatgttaaaatcctattatcttcagatcaaatccaaaaccmaaactatacmaacaaatataagaatgaaaataagtttttttttaaaaacaacaagtgttacagctacattataagtytgaattataaaatcttacaaatattagtaatttttgattaaacataaaacaaaactttttattatcgtagctaacaatcaaagttttatttttttttttaaaaacagacgctaattcgcactactacacaaatcaatagttttagaaaaaaaagaaaaaaagagagagatgatcataaaataaggaaaaagaagaaaaggataacaataattaattctaacaggatagtgcacatcacatggcagaagtaggacagtaatttgtttttggttacatgtgtataaaaatgcgattctttgcttcattcctctttgttaaaataaaatagaataaaaataaaggaagaagaagaagaagaagaagaagaaaggattcgtcttccttcttccacaccctttctgacacctcatctcccctcccaccttctccgtcccgttccgtttctccatcaggtaattattaatctcctcttaatcatccctctaatctctttcccgtttcttcatctcccgattctcaattccatctacacagatcctcgattccgatccaacagttcgaattcagtttccgattctgatctgatcgaaccaatactcactgagatttgatcggcgattatg

SEQ ID NO: 16112 - DNA, 3000 bp, Unknown; identical to SEQ ID NO: 1305
  misc_feature (1)..( 3000): 2750-1469P.txt file - cDNA_ID_1034141; gDNA_ID_1620385; Annot_ID_155404

SEQ ID NO: 16113 - DNA, 3003 bp, Unknown
  misc_feature (1)..( 3003): 2750-1469P.txt file - cDNA_ID_1034215; gDNA_ID_1620721; Annot_ID_165813
agcaagcactgctcagtctcgaagatgagttctcaaagacaagtcagtcaaggttaccttcagactcaagaatctgggctctctttttacgctcagcttcagcttgcatttccatagcagctcgcactccatgagggggcataatatcccctggaaaaacatgaattagaaataggaaaaaacagatatgtaactatcaccggaaaagaaaaaacacgaacaacttacttatctcataacgaaggcactgaagaccccagtcttttgcagcaacattgatggcttcctgcaagaatatatatacatctcaaaaatccatcatatattttcttcttcaatggatatacttcctctaaccatcatgtctccttatgatttgaaaaagagacgcaaataagttcggatatccaacaaatacaacatgactaaatcccccagctgaatctaaattccatatacccaacttgtggtatacaaacacactgccagatgtgactaatttttccaactaaacagctcaagccgcaatgctcagtagggagtaacaccaacagcaatattcaagctaacgtgacttgactttgaaattgatcaacttagcggattctaaattctttgaaatgcacaggagcttaagtacggtgagtcctaacacttcaaaacagagataaagaaggctggagaacaaaccactatcttctcgttgagagtgtctcgttcctcaaaggtcttatcaagagtgatcttaccaagctcactacgcattgtggtctgagccagctgtacaacagcatagataggactctcaacgccataagaagctaacttaggatccacaatctgcaaaaaaaaattcccagatcaacaagaagaaatcagtaaagaatcacaaaagtaagaactcaaaacaaaaaaaaaaaaacaagaggaaaatggattggtgaaagaaaagaagatgaccttaacgtagagaacaccatcgatgtggatactaacgttgtctttagtaatcgcagtctgattcggaatcgggatagcttcttccttgagagaatgaacataagcaatacgatccacgaacggaatgaggaaatgaatccccgacggcaacgtcgtagcgtatttaccgaatcgctcaatcacaaacgccttcctctccggaactatccggattccccaattcgtcggcggcgtcaattgaaaactacaacgaacatccataaatcaatcctaaggttctctactctaatctaaaaccaaatgcttcaaaaacgaaatcgtaaggtgagaaacataaatgattcaaaaatcaatcctaaggttctctactctactctaatctaaaaccaaatcgtcaattgaaaactacaacgaacatccataaatcaatcctaaggttctctactctaatctaaaaccaaatgcttcaaaaacgaaatcgtaaggtgaaaaacctgttggaaggatagccggcggaagtgaactggcgaacggttgaagcggcggcggagaaaatcggaggtggagaggtaacggcagattgacggaggtacgaaacggacctcaaggcggagtaaccgacggagcttttacgaacgaggtggttcatcttcgtgggagaatcagaaaaatgatatgtgaagaaggaaaaaccccaaaacaaaacctcttataatgcgtagtcaatattcaggtactgtttcttcgccggatcacgaagatttcacgcaatatgcgtggagaggaggcaaatattttattgggctttagtggatagtttggtacctgctgttattattgggcttatctctagcccattcagacgcctgaaatatccatctgttattaatttattattcattgttttggttgttattttaaagagttttttttagttgaatccaaaattcattgtgaatcgagaaattgcaagaaaataatggctccgattggtaaccacttttgaggaaaacaatgaataggaaagtcgtgttcctttttgttcctcggtattttttaccatttgcaaggaatttttgatccattttcagacaggtggatcctacatttttcctcatcattcctcaaaaaaaaagaatgatagaacaaaattgttcctccccaaaattcctattgttcatttctttggtcaccaatcggagccaatataaaaaatttgggtaatggtttcttttagtttctaaaaatcatgtaatgatgtgagtgaattataatgaatatttatattgtaaggaataaaatacatattttatttcaagaaaataaacttatatcatgaaattttgatagttgtagatagtcattaattcattattatacgacgttttggatattgaaaaatttagacattacaaaagccatgaaggggtgttaaactttactataatggaaaaaagcggtttaaaattcagaatgcatggaaaaaacaagtctaatgggtttcacatggtgaagaactgtgtgtgagtcatcaaagatccggcgccgttcccttttagatataccgacgtcaagaaataaaatggcaacaattaaaagcttcgtaatgacgaagcgcatttcacctttcaaaagtgtcttctctttcttttgtctaatcttttctaagaaaataatttctatcttttgcttagatttcaaaagattcaatccaagttttcttttggtgggataaagtaaaagatgaacatgtaacatgggatccaaagtctaaagaaggttatattttgtgaactatatctaacaaagagaatagtggtgacacactttacactaaatccaagtcactagatcctaaaaagcttataacatgacgacttcaacaacatgcacctcatctcttctgcatgaaacccaatcactgtcgtcaatatatatatgcacacacctaagttcgtgtatctctactatatataaaggtaagtgtgcatagtttgagttagaaattggaattcgaccaaaatacatagttaaagtataatg

SEQ ID NO: 16114 - DNA, 3003 bp, Unknown; identical to SEQ ID NO: 16113
  misc_feature (1)..( 3003): 2750-1469P.txt file - cDNA_ID_1034215; gDNA_ID_2926191; Annot_ID_201047

SEQ ID NO: 16115 - DNA, 3003 bp, Unknown
  misc_feature (1)..( 3003): 2750-1469P.txt file - cDNA_ID_1034283; gDNA_ID_2214703; Annot_ID_136907
taaaccagagagcacagtacctttgagaattacgtgatggttttatcaaattatggaaaatttaaggatactcagtgaatgaatgctgtcaaagagttaacatcaagagcagctataaaaggacccactagttaatgcaatggagaaggaagcatgtgatgaacaacatgataaaagaagcacataataaagacgtgtgaagagcatacacattatataaccttaggaccactttctctgctctcttgtttttttttagatatgtaaaagggactagtggaatttaaggaacatcggcccacaaccctaggaaagttgcaacttgaggatgatagttcgaacagtacacatctcaaaccccttaagaaataaaactcactcaatctcatttacacaacagtgcaacctgccaaaacggtctcatttttgtgaccaaagctacatatataaagttccaccgaccctatagaccatgtggttcaatccttgggagttgggactatggcttcttacacaactaattttcaacatctacttgcttgctaccattgctaccatcactcagaatctccgatcttgttgtcagaattcaagacaaacatatcaaaagtcatagcaatggattcatatgaaaaggtagccattgagaagacatggttcatgtagttccatgactgcttgtaaaatagatcaggaggatattgtgtaagcagtataatatattcaagaatcaaataccatggcattatcagtagagaggacctaaaagacattatatttggtataactatgttgagaaattaacattatagatgtggttctcaagaatgtgacttggaaaggtaaccgagaaaacaaaatagaagaagagatcgtgaaataagctggctcagctagaggagtggaatagattctcatttatctgtgcatgacttcattttacctcttctttctgagttcgagagagatgagcttcttcgatacgccgggttagcatagaaattccataatgtgaagcacttgaagatgcataatacgaggtaactgtcagctgagcaaactttggaagtgcataacctagcaagcattgtacacaaacaaaagttcaggtgctttcttcaaagtaaacatacagatgtatctacatatataccaggtacatcaaacaaaagactacgtgcacaaagctactaacatacccactaccacctggcatttgaaagttttaaacagataagaggaaagccaattctcttgatggtaaaccattaatgtaagtaattcacctaaaggtaaaagttgcaattctacactgtgcagcacaccttgattcgtattctaaccatactattggaaaacttatcgcggcttgtaaactttcttgcattaaaaagctacaagtacaaaagatgctaacagaactacataagttcaaaacacaaaataaagaggttcaaaacacaatgagaaggccattcacaaaaattcaggacaaatcacagacagttaatcactaacgcaggatatatacgaaacaaatattcaggcacaagagaagcgagtgagccaaaaacgattaggttacctccaaaagcagcccctacacctgaatatactagaagcaatggaacctataaggaaaagcaataattgagaagtacataaaattcatacaaggtaatgtcaacagaaaagaggaaacaggaagaattccagaactagtaggtaaggcaagagaaaatacatacccccacaagaaaggaaagccgctttgacccggaaaaccgattttgaagataggggatccctgaaaacccaaagagataagatccactgtagaaatgataagtatttgacgacaagagaatcatgtgatacctgtattgaaagcatggacggcactaagcaagccaccaataccagaaccagcctatagcacaggagacacctagttagaaacagagtagtatagctaaatgcacagcaagataaatcgatttccatgctatccaaaaagccaatacacatcatggtattcccaaccaaaaaataattcccaaccaaaatactaagtcaaaagtcaaaacacaacaaatctgtgaacggaaggataattggagaatatgatggatgctctgcacccaacagccaacacaaatcatttcaaatgaaaaagctaaaacacaaacatcgcaatagaccaaattaacattaacctggaaaaggctatttcagaagtcaatgaaaaaaaggttaaacctttacatgaccaacagaggaaaccaaaaatcacaacacaataccctaagctagaattcaaattctcattcgcaatataattgcaactaaattcagctgattgccaacaaaccaattacccaactaggagtccaaaacaagtatccgtgcatataaagtaatcccataacacataattgaaacggagactgaagagaatttcaaagagatgaatgagatagaaatgcgaaaactgaccactgcagcagcatcgtgtaaaactggagttatcgtccactctcctttctcctgagaaattattaaacacaagaacatgagtctcagacgcttctgacacaaaaccacaaaacactgtagaagaaactttggcaactcactgaattagggtttaagagagaaagacaacgaggacaccgagcagaaccaagaccaggattcatagtcggatcataatcaagattcccacgccgaagcttctcttcgtatacttgtctcgttcccatcctctctttctctccgatcaccgtctctcttctctccgagaatgttccttctccaccgttgctacgccataactgaagcttacaactaataaactactgggccttatgggctttcttattctggcccaaataaagacactacgtcatcgtcatcgtcttcccaaattgagatgccctacaaaattcacactactatcttcttcttcttcgatttagcacagaagctgcagttttatcaatg

SEQ ID NO: 16116 - DNA, 3003 bp, Unknown; identical to SEQ ID NO: 16115
  misc_feature (1)..( 3003): 2750-1469P.txt file - cDNA_ID_1034283; gDNA_ID_2214703; Annot_ID_189747

SEQ ID NO: 16117 - DNA, 3000 bp, Unknown; identical to SEQ ID NO: 10899
  misc_feature (1)..( 3000): 2750-1469P.txt file - cDNA_ID_1034424; gDNA_ID_2214461; Annot_ID_132983

SEQ ID NO: 16118 - DNA, 3000 bp, Unknown; identical to SEQ ID NO: 10899
  misc_feature (1)..( 3000): 2750-1469P.txt file - cDNA_ID_1034424; gDNA_ID_2214461; Annot_ID_182780

SEQ ID NO: 16119 - DNA, 3003 bp, Unknown
  misc_feature (1)..( 3003): 2750-1469P.txt file - cDNA_ID_1034497; gDNA_ID_1971795; Annot_ID_175624
tcgaaaccatcttaagctttgttctgcaaaatgatgtgagctatatccatcccttggggtccaattcttcaaagagttgtcttgattctggccaataacaatgccactaaactttcaggtttctagaccgcttctgacagagaattgtatcaccaccattgaagtttttgactcaaaggaaacactaccatacgctatcttcagaatctccgttcaggtaaactgatcatcctttcttctcaaataaactctttctgaaagacccgaaattgtgaaactcttgaggttgcagatgctttgtccatgtactggggaaaatgagatccggaaaaggacaatggttttgtttgatcttctcaaggaatacagatgggatgcaaaagctgtgttagtactaggagtccttgccgcaacatatggaggactattgctaccagttcatctggccatctgtgatcccgttgcagcatcaattgcaaaactcaaccagttgcctattgagagaaccaagttcagaccgtggttagagtctctaaacttgctcattaaagccatggtggatgtaaccaaatgcatcatcaaatttgaaaaaattccatttaaacaagcgaagctagacaacaacattttgggagaaaccttgtctaacatctatctgactacttatcgggttgtcaaaagtgcactcacatgcatgcagcagatcccttatttcaagcaaacgcagcaggtgcaaattttcacccttcttatatcttctctgcaaaatgaagaaccagacacacagaaattgtttccagcatattagcagtcaacattgagttttctcatgactaggaattctctgaaatacgtaggcaaaaaaatcaaggaaaacagcagcggaactttcaattgaatcaaggagagcagcaggagaactgtctagtttgggatatcagttgctgaacatacacacccgcctcaacaagcaggtagaagattgcagcacacaaataggtaactttcaaatcttctgatgttaagttccataatcacaactttctactaaaagcaaaactcgatctctgatattgctcctctgttgttatatctaaagaggaagaaatcaatcaaaggcttagaaacattaacatagagactcatcaagacaaccaagacgtactccacctacttttttctctacaagatgatttgccacttcaacaatactccagacaggtataaagaactatctatttttctttttccatgttccttcttattgtttctttcatgtctcgtctttaactttacataaagatgagctccgacattccgtatgacgatacatagaccgattcttttatctttgcaaaattgcaatagcattgaatattctttattcacccaatggcagatatctataactgaggtacaagataaggtaacactactgctattatcaaagccaccagtagagccacttttcttcctactccaacagctatacgatcatccatctaacaccaacacagaacaaaactacgagatcatatgggttccaataccatcatcccaaaaatggacagacgaagagaaagaaatcttcgatttctactccaattccttaccatggatctcagtaaggcaaccatggttgatgagctccacaatactcaactttttcaaacaagaatggcattataaagataacgaagcaatgttggttgttatcgattctaacgggaggttcgtcaacatgaatgccatggatatggtgttgatttggggtgttaaagcatatccattctcagtttctagagaagatgagctttggaaagaacatggatggtctatcaatctcttgcttgatggaattcatcctacatttgaaggaagagagatctgcatattcggaagcgagaatttggattggattgacgaatttgtgtcactagcgagaaaaattcaaaacctagggttccagttagagctgatttacctaagcaaccagagacgagacgagcgagccatggaagagagctcaattttgttcagtcctacattgcaacagctcttctggctccgattagaaagcatcgaaagatcaaaactcaagcggattgtaattgaaccatcgaaacctgatcgtgtttttgaagaagttaggaaccttctcgacttcgattacgggaaacatagaggttggggaatcattgggaatggatcaactgcggagacggttgatggagagaagatgacggagaggatgagaaagattgtgcggtggggagagtatgcgaaggggttgggttttacggaggcgattgagattgcggcggagaagccgtgtgaactgagtcacacggcggttgttccgtttgaagaagcgttgacgatgaaagttgtcacgtgcgagaaatgtaagtggccaatgaagaggtttgttgcatatcagtaactcacagccctgttactttattcttacctccataataatatgtttgtattttatttatgttgttgcttcgtttaaataattgattcaattctgaacatggaaaggcaattgttagatttttggatattccaggcttgatttcacaatcctctgtgatatattttattgtataattctttataacagtttgctctattcctataaagctaacagctctagttaacagttaaaaaatttgtacagtttttaattaccaattagattcgatataaaaagtagaaaaaaaaaaagttcgtaagactaatccgactccaaaatatgaaatttcatttatccggaaccgtagaggaagagatatctatatggtcaaagcgacacgtggcatttatacaagacaatccaatctacggtagtaaggtgtatctttccgcactagatccttccccaataacacatcctccagggcttcatcgcgcgatctgcgactcctctctctctctgttctgagaaacgacgacgagaagaagaagatttagctgacgaaaactacaacaacaatg

SEQ ID NO: 16120 - DNA, 3003 bp, Unknown
  misc_feature (1)..( 3003): 2750-1469P.txt file - cDNA_ID_1034523; gDNA_ID_1972119; Annot_ID_178880
cccgatgtgagccaatctagtcttaatccattcatgtccttccattccatcaacataacgtgccacactttctccatgctcatatgtctccaccaaaacagcaggatgtacaagaggatacacaggtttagggaaagagacatccttccatctacggaagttatatatgaaccgactcaaatgtgaagcttccctcgcgagatcaacttgagacaacatgaagacaccaaactgttgcacactctcgtccaatctcaaccatttcaaagctggaattaaagtcgatatctttgccaccaaattaattatcacaaaatctctcctaatcgattcaccaacacccggatgtctaactttaaccgcaaccagcgaagacttggacttttgtcctggatactgaaaccttaaagaagctctatgtacttgggcaatactcccagatgccactggcacctcatcaaactcctcaaatatctcagaaagtttacgaccaaatgccttctcgatagttttcttagtgtaggcgaagctatgctcaggagcattactgtgaagctttgagagctgtgaacacaaatccttggggaatagatcaggtcgcgtggctgcccattgaccccatttgataaaagcaggacctgctctttccagagttcgatggaccatctcaagccatattttcctaaaacgaggcccacatgattccacaaccagccccatcagaatagtaggagtaaacaaacaagctatataaaaagccctcccaatcaagataaaaccctctataaccgaaaacaataacgaagacagaaagataggaccattcttagcccttgtatagagagatttatctgaagcatagtgatttatccccgaaccaggagctctttgtgcccatgctacttgtccacaagtgacagcaacgatcccaggtattaacaagtgcgaacgggtaagagacaagctaaacgcctgagcaatggtactaatacgctcagaatacttataatgaagccttctccaagcaatttgggcatgatgactaactacatttcttgcaggggcagtagtataacttcgagacagatgattacttaaaaaacttcctttgagatctctaaaggcaaaagtacaatacacattactcggaatcctaccagatgaagagtaagttctgagctgaggcgaccttagagcagctgtaaaagcagttctatagcttccccattgagacactctatctttctggttcgagacaagagattgtgtttgctttccaacgattttagagatcaaaactctgcaataacaacaacaaatcaatgatgagaaagtaagcaataagcagctaagagagtatacagaaggatccgatcaacattaagacgtatgaaccattgaaactcgtaaatgtcgaaactttacagataaaatgagtctccgaggaaatgggaaacaaaaatccgatcagaaatcatgaaagacccacgaaagtggttaagcccgtttgattaaacaaaccttgacatagcgacgaagatggtgagaaaccaacggaaagaatatgcgaaaacagggcttgttgggtatggatctctaaaacgttaaaattgaggagcattttctcattgacttgagcttttggggactagtcggtcacagtctaccgtccggcgttaattgggttcgaagctttcttcccggagaagacctaaagccgatacggagaagagacggaggaagagagagagagatcaggtcaggtcagtgatttcgttcggagagagagacaggcccaaaaaaaggaaattgatatctcgtgggcttaacgcttgatttagtcgacgtgtgacattgtcaaaccaaggaatgatgtgaacataaaaagccttaatgtcggtctaaaagacagcttgtcgtcaaaattaaaatgttcattccaaagttttttattttgtctccctaagtatttattaacttgtctaattttgattttgattggtccacatatctttttaattttatactttagaaagaagaagaaacagaatacacaaaacatagttaaaccacattaagctgtctcgatcccattccttagggtgtcaggtcacggtcgacataaaaacatcttttccatccaatatttaccggtttcgtttcaccggatttgggctctccggcgacggagaatagccaccatctccgtaggtcagctttctttttttttcttctctttcctctctctcatatctctgtatgattggccgaggtgtagggagctctggccgccggcaaaaaaaataggttaactaaatttggtgtgttctcggtttttgttaacagcaacgagacgaaattagaggaaattgaattgagctttaaggttgattgaaactggaatctggaaagtttgtctttttggttatgtttggttttaggatctgtaatgaagattttgcttgtgaggttattaaatgcagccaaaggaattctatcaccaaaggtttatactttgatgataagaaaacagaaaaatgagctgggactttgtattgcatggttttgaaataactgattgttgtgtggttataggaagtggtgtttgatatggcgaatttcttttgtggttgctaatgcttacagctcactaaacaatttttaagttgaatttgaattgttgatcagatgtttgctactgagttgtgtgatcttttgaatatctgctataacttgtatactcattcttgatacacgagcttacatgtttcagagtttagaaagctttataatgtgtgaactacactgttgtgcatttagcttcttctaacaaactgttgtaactcaccgttaaaccaaaactagattccttttcctgtctaaatgtttaactccatgaattgtttaatgaaccctgtaaatttgatacagaaaacagtatacttgatagctgaggaacaagagaagtgacaagggtgattgaaaagttgaaggactcagatg

SEQ ID NO: 16121 - DNA, 3000 bp, Unknown; identical to SEQ ID NO: 13441
  misc_feature (1)..( 3000): 2750-1469P.txt file - cDNA_ID_1034582; gDNA_ID_2214627; Annot_ID_135987

SEQ ID NO: 16122 - DNA, 3000 bp, Unknown; identical to SEQ ID NO: 13441
  misc_feature (1)..( 3000): 2750-1469P.txt file - cDNA_ID_1034582; gDNA_ID_2214627; Annot_ID_187840

SEQ ID NO: 16123 - DNA, 3003 bp, Unknown
  misc_feature (1)..( 3003): 2750-1469P.txt file - cDNA_ID_1034834; gDNA_ID_2214620; Annot_ID_135870
ttgagatatgtttaggtacttattcgagttcggattcgggtttttcgggttttgaagtttagacccgttagactattttaaaagttcgggtctaggttcgcatcaggtttttcgggtcgggttcggatcggttcttcgggttcgggtattatgcccaggcctgaccaaactgattcttaactaatgattaggagttcataaatataagtttttgcaaaattaataaataaaaggtctcggtaggtataaagttaaatataaaaccacataccaatttttcttttttcttttacaaacatatatatatgactaacttgtctatcttttgtcgttagagtttgtaaaacaaagctaaaacgacaagatagctactagtacttacagctatactatagtctgattccatatttactatttatttttaaattattattactggaatttgtaatctagttatgacaagctctttatcgagctccgggatcaatttcgtgtccatatttgaccatatggatacttaataaagttgctaaatatgtttttaagaaaaattatactatagagagccagtggcagagtttgagtaggtatatacctcaatgaaatccttgaagagccgtttcgggaaccacatgggtttatgaacagcaagggtgaagagagtcttgagccctttaaccgaagttggtaacaaaagatccgccgacgacttaaatcctaactggttcaaattagactcactgatcgtatcagtcatcgcgagtatcgaacctgataaagaaaaaattgttcttagtgtatgtaagttttaataatgaaattacaatgtataaatataaaaaaaaaatagacttttagaataatttacggtatcttgtaattactattattgatatacgaaaagaggagtgttaaatgtgatcttgaactcgcggtatgggagtaatttccaagaccatggttttaggaaaaccgacacaccaaaactcgcaaaacattgtagcatgttttaaccactcgcaaaatattgagtcatccaaaatatagtaatcacctgaaaccaccatggcttgaaccatctcagggtactcctcggcgatcttgaaagcaaccatgccaccgtaactaaaccctacaagagtaaacttttcgataccgaggatacgaagagacttgactaaacagtgggcttgaaacgctggtgatcgatccgcgttgtcggagtaggacccaccaaagaagaggaggtctggtatatagactgagtacttcttggctaatgatccgacctggaactgccacgtcacgatcccttcggctgcaaagccatggatgaacaataggactggtttcgtaggtttttggggttccacggcaaagtttttgtcagattttttggttttttttagggtttcttttgggatccagaagttcatctttgtccctggttcaagctctacggtgtaaggaatgacaccggccaatttcatgaggcggtacaacaatggtttttgtaaatccacaaagttcaccattgtatgtactctttttcctttcgttcttgtttggatatatttagagggagagagatgtaagaagatgatcaatagcaaatggaaggtgaagattttaaagcttcttgagttgggattaattataatgtatctggtgttgggttcttgtttatattcaaccaagcatttattgttttacacattttatatacatatcttgtttgacgttttgaatgataagtgacaacttgccaaatagcataataaactcactagtaactagaacattttaataacaaaagagaccaaaacaaaaactgtttttcttcagtcttttatgtaaatatttaagttttcgaagtataagaataagttttgtaattgtaataatactatcattctattacacctgtatatacaaattttgtttgaagatttcacctttttctaaagttaccaaccaaaactaataaactattaaagtattaattatcaagggaaatcttgcctcattttaaattaaataaggaaaaattagagatgatggagttcttaataacttgctttgcatgtaatctctgaatctagtcagaattggaaatctgcacttcctacttgtatcggtatgctgtaaacaaaaattattgttctttttggggttaattactagatagtcaaaaaatgtttttgttaaaattcacaaaaaggttgtggctaaatcgtaaataatgtgcttattctcttcatttttgtttattttgttttctatgaaaagtgtgtataacatataaaaaataaaataaattataaatgctttattactcttttgtaaaataattatttacatcattgtaatattgaataaatatctgaaagacatatatcatctacattattcatcttcgttttgttccggatgttattggtccctttcttactactgcaaagaaagcccacgtcccatacctcctatgatttttatattctcaattggttttctgaaaatattttattataattattgagctatacgcaattagacaattacgcacatctaatttacgtactatataatttatctaatctactcctctgtgattaatattaatgaaccatttctagactaacctccaacacttaagtaattaaacacgtcatctttgagtgttgtagatgtagtcaccaattgtacctaaaacgattataagttgattgaatatggacaaacccaaactgacaagaaatctctataacctaactacctagatcaaataatatttatttttaagtatatcataccaaaatgttgaaacttatattttcatttcactccatcaacccaaactaacatctactaattctcttattttaatataaatttcctagtccgccatatatataaacgcttcgtctccactctacatatttagcaacaacaaagaaacccctaagatttttatttatttttttctcaatttcttcaacgatg

SEQ ID NO: 16124 - DNA, 3003 bp, Unknown; identical to SEQ ID NO: 16123
  misc_feature (1)..( 3003): 2750-1469P.txt file - cDNA_ID_1034834; gDNA_ID_2214620; Annot_ID_187649

SEQ ID NO: 16125 - DNA, 3003 bp, Unknown
  misc_feature (1)..( 3003): 2750-1469P.txt file - cDNA_ID_1035323; gDNA_ID_1971873; Annot_ID_176645
ttgccttgaatttgtagtttcatttgcactgtttctgtttctgttctataatctttacatgtggtttgtattacatctctgatagtggctaagtagctaaaagaaatagatcattggtttgaagtatggtgtatgaatcgatgatggagaaatcatcttaaactgtcaaatgcttaagaattttctatgatctttatcatcatctttgttttattacaccttacaatcagagatttttcaatttggtgttctagatatttgtgtagatattggtatactctttgaaccataacgttacaagagatgttagctttattcttttgaatatgatgatactcaatgctgatatttcttgttgtttatacattacagtgatactagcatttcttctgctacttcattttcaaagccgatgtactaccaagaccaacctccagctctgccaagagctcctccagtggcacagcctgaaaccacctcggcccaaagctctcaagtcttacctcagactgaaaacacttcagcccaaaccacctcccatgtcttatctcagccaggtacgtacacaactatggatcaacaacaacaacaacctctggctcaacaacctttcttacaccaaggcgttcagtatatccctcacccatcacaatacataccaatttactctcatcagcaacaaaactaccctgtttacgtgatgtccgtcccacaatctcagcagtatatcccagcaggaactcccccgctctacccgaactcaaaacccggcacaaactcgagacctgaagctgcccagaacgtttaccgagctgctccccctcaggttattcagcttcagcaacagcatcagtacatgggttacgctggagctcctcaacatagcacaaacgcaaacgccaattacggtactggagctcctcaacatagcacaaacgcaaacgccaactacggtggaccctttgaatacacaaactctccaaacgagacagtgtattaccacacacaagctcctgctgcaaacactgccattccattagcgtctccataccaaagcatgacaccagcagcagccgcagcagctctagccgatatgtccaagcaaatggctcttgacggcggcaaacagcaacagcatatggctgcgtctcagccgctttaaacgctggatctttggtaataaatgcgcaaagtgttaagtatagccgacacggcgcgctctgttctttttgcgtattacatgtaacgtcctgttacatctcgttagatatacataggatttgctatctcgttgttcttatcgtagtttgcttatgtctctctctcttttctgataaataaatatgttttggatatttttttaagttctatattggaattatcttgatccgaagattacacaaaaactcaagaaatggaacaccagtgtatactagatatagaactgtgaagtgatctgttgaggttgcttcatgctttgtcactttaagtgatgcattcaacacttgaaaacttgatattgccgctcagaaaagaaaaaaactccattaacaagtcaagagaacaattccagctttttaaacacaacataaatctccattagcttcattacttataaaacgttcaatcacatatctccaccatggcctctgttaagaccataaacatgtagcagtgattgaagtaaccaattcatcctctgcaaaacttgattccttagctagcttctaggatttcctcatgcgcatcgagatcaaaatcctttgaattcactcgaatcatatgcataaaacagaatcatcttagcctctaacctgaggctctttgattcaacttgtagtcaatctcaccaacagcttatactattgtagattcacgtcaataacctgattgaacaaaccgagtttcaaaacagtacccctgttcaaccatcttgttaaacagaacacaccagcaacttgaaacccactactagtagtaacctttaccatgtcacttatcagcaaaccttgtgatatccctaagacacgcccttaaaacagcttacatatcaactctagaatccttgatgtatctttcaagctgtaaagaaaaacctgcaatacttcttcttgtatgcaactaccaaaacgaatttggctattacaccattcaatttgcagtctttagtcaatgcccttcattttcttaaaaacaaaatccttcacttgactgacctgcagataacttcccatgagtagacacttacgttgtctcgtcatcaaccaagacaaatttatgctcatgagttgttgtcttctaaatgcaatttgaatcctctgcatttgcattcctttctaggacttcttttcagctgctaacaccagctttgagatgagttgtttatcaggcttgatacacaacactttcatagtcttgaagtgaaataccttgagacaactcctgcaacacttacacatgtctcttttcagttccttctttagagaattcattgaaccacttcaataacttcatctctatttacacgttagtgtcttttctgaaatttgcagccagcaactcctatctagaaacctgcaatttatttctgaaaaatctgcagtctacttctaaatgaccttaccaacaatcagctccaaaccaagcctgtatccaccttgtaccatctttgagctgaaaacccgttgataataaactgttcttgacttgttttcttataagcatattgaacttccatgaatctgataaactagtgaattacacagccctttaactcttttatcttcagctaaccttctaagacaacatccacaaacatagctccaccatgaaaaaataacaaccttaagtatatgtattgctaactaaaccggacagatgaaactaaaccggagattaagacatttaaccaaattattgattcaggttctgtagcagattcaggtatgaagaagagcttttttcctgtcacaacctaaaaccctaaatctctgatccgccatg

SEQ ID NO: 16126 - DNA, 3000 bp, Unknown; identical to SEQ ID NO: 1455
  misc_feature (1)..( 3000): 2750-1469P.txt file - cDNA_ID_1035346; gDNA_ID_1620403; Annot_ID_156010

SEQ ID NO: 16127 - DNA, 3003 bp, Unknown
  misc_feature (1)..( 3003): 2750-1469P.txt file - cDNA_ID_1375255; gDNA_ID_1621115; Annot_ID_56186
ccacaaagcctacaacagcaatgagacagtattaaaactatataaaacaaacaaagaacataataaattttggatgtttcaagtaaatatacaaagttcataccccacaaaggtagatcatctgaagttagaaccacccgatgaaagtccacgccaatcagatgccacagaaaaaggtgagaaataaggttagcaatccaaagaagttatgtaagattatatatcctacaacatccaatgccgtaaatgatattggtaatgcagtgaagttagatatcggaataatttagatttgcatgatgtaaaaatgaaccaaaggaaaactcagcagatacaaaatgtttccaaactttacatagtaggaaattgcaacatcatagataataaatcagcattattttcatgaatttcagtggtaatatgtacaacagacgtgaaacatacccataaaaaattcgaaccagtagctagattcaatggcatctttaaaatgcttgaccttagcttcatcgagttcaagcggacagatgacacttctctcgacattctctgtggaaaaaacagaaaaggtattgtaactagagaataagtacgaatgtacgataactgttaactagtatgaaaaagaagcttgtataagaattgaaacgtactcatgaattttatcgcaatctcactgtcaatcagctcatttccacctagaacttcaccaagaccaccccatttgtgaacattgtttccagatgggcggcaaaatggaagactgtaatagttgtatgtttcttgtggattgttatatgggccaactttgtttacccatagggtgacctgctcctcggcttgatactgaaaaaggtgaaggcaaaaaaaattgacttgacagaaaagcacagaaatgtaaaagtttatgggattaactagtaagagagagtaagaaccaaaattccattagagagaacagaacaaaatgtcaaacgtagacagacagatactgataaaggctacgttcaatatcatttcaaaaatcaggagttaaagtcttcacacaaatgatggttccatagaaataatggctcttgaataatgctaccagattgctcttgaataatgcataacccgcctttatctatcatctttcacgcagaaaatatatagttggaatcgactttaaatgtcacactacttgcgagcgtaagaaggcagaggagcaaaagcattaaagctagatctcatgatctccaatatcacaaaaggcaataacaattttgagctgaaactgaccatcagcaaaagaagccatgtgtgacactttcagtatcacattttagataccaattgaaaaaaatcatcaacccgacctcggaactataagatctacatctcgaagatgctaatacattaaatgccactcaattacaacacaactcagtgttgatccaagtatttgaacatcaaacaggctaccacgtgcagaaatcaacgagaatctcaaaccaacatcaaaatttcttattaaaatcgagattgtgaaaagcctaaatcacaatgaatagacaaaatacgcctagacttgcaacgaaaagatacgcctaaatcacaatgaatagaagctcgaggatcctagcaatccgtaaacgaacagatccatgaaaaaaaattcaatcgcaaacaccatgcaaatcacggatctacggacacagtgctcgatttcgagctgcattaaaagaaaagaaaaaacgactggagatccgagtcttaccttgtgatctgaatcggatgcgaacgtaggagtgagaagggaaacgagaagaaggaacacgaggacggcggcggaggaggaagacggcatcgtgaaaaccggcggacgatcagatctgaggaaggacggagcgagagataccaatcgagagagagcgagatcctcagctcagtgttttcactttgtagagattttgggtaatacaaaaacaacgataaggcttacaacttcttttttgctctattaattaattgggcttgtagtactaagaaacgtatattaagtttaaaacccatataaggtcttttaatgtttgctctattaattgattgggcctttcgttctaacaagtgtatattagtttagcggcccatataaggtctattaatgttttcatatacgcgcacgaactatgtcatttcaattaaaatatacactcacacatgggaacataacttcttctttttttgtatatatgttgaaaaatgttaaaagtagatgaaaatcatgacataaattcattaaaaggttacgtttgagtgacaatcttcatagagaaaaatgtgatttatggacaatgactctctctatatagaaccaaaagaatctaaggcgaatttgcttgctgctgaccactcgtgtcgtgtaaatagtgtatagttgaagtgttgaattagggagaaaaaaagcgcgttggtgacaaaaaaaaacgtagttatacactcgaatcagcaagggaaacaaacatgtatggatcgcatggaaacttgtgggtccctctttcttttaaaaaatctcgtattaattaaataaatggaaaaaaaaacatgatgggagtttgtttaggcaggggagattcttcttcattctcatcattatttctctattaatttcaccccaaaaaagaaaaaagaaaaattccaacaagaaaaaaaaaagaaaaagaaagttgattcttcgcttaggcttgaaatctctccaatccaaatctcaaattaaccttccatcgtcatctctttccctttttttttcccactttctttgcgaatcgcgagatctcggaatcgcatccttgattttgggatactgttttttttttttttaatcttgtttcattttcacgtgaaattcttagctgctagaactggacttgaatttcaacgagaattttggagattttttttttgtttgggtttttcctttctgttttgtgtgtttggaattagggttgtcgagcgagaatg

SEQ ID NO: 16128 - DNA, 3003 bp, Unknown
  misc_feature (1)..( 3003): 2750-1469P.txt file - cDNA_ID_1375398; gDNA_ID_1971953; Annot_ID_58655
taaataaatttaaatgagactttcgtgttccacatggtctctcatccctctctactcggaaatggaactgttgatacggacaacggagtttttctcgaccgcaaaacataaattgtcgagtactatttgtaatttgagatggtttacgtaaattgaaatagtcctttctgatcataaatggcctgttttctccactcttttaaatgagtttggattgttcatagacagattttctcatttttttcgatatatgtaaatctccgattattaaattgtaggccggattgttagataaagcttctacaactatagatttgttgagttgtcatacgtaaacagttttgcttcaaattcactaacctaggaccctccttttgatattaatgtgtggttgttagaaaaacaatttttcgtgttccatataattttagaattacgtggcatggaacatttacatcggggataaattaagcgtcgtccacagattttacgacaatgctccatataagaacatgcattacaaaaaaaaagggaaaaaatgcatgttcatgtatggtcgtctgtctgtttataattgaaaaggactttgatgttgttaatgttattaatggagattactttgaatctcacacggtttgattaaacgaatcttcgtcagcacacactctgttcacacttattatttgagactagcagaagaaactcactagtttatcatagattctgaccttcgcacttgttagtcttttaataacttgaagatactcgccattgtatatcacaactaggcgatttctcgttcatttaaaatgttaatattcgtgtttaatgtatatttaattgaagtaatgattttacatgtacaaatgtatcctagtattttgaatcttctagtaccaagtggttttctcttcgattacctttttgtcttttttcattacaacatgaacaacaccagcaataattaaaatatcgtgctttttgtttttgtcattttttggggtcatacatatataatatatacacgtaagttcaaacatttgtttgttgttctttttgtttgtcttggattcgacatccttagaaataaaaaccacatttttaataacgaaagttcattaaaagtatttcgaatattttaggcatgttggtttgattagagtttgtattccttattcaaactaatgtcgttgttttttactgtttagatcgaaagaaaagttttttttcgtaattttcgtttatttattttgtgaaatcactagcaaagaaaaacgtacgtgactatcacatcaaaccactataacatctcattttatctatcgcttaattcgttttttaagatcagatctgagatcattgtgcatttcaattgtaaaaccgagcctaaagtcaataatataacattatttcagaaccaataatttttaacagacgttgtttgtttttgggtctcaagctgaacgactttgcaactagtacacttggcatatgtttcatgttttttttataaataatgtgctaccttgatgaagttccctctctctataaattgaagtgtgtgagatgcatcatccatacacaacatcttccatcttccgataattctcctttagtcttataatcactaataagtacgataattgaaatggatccaagattcatcaacaccattccttccttgaggttcttatctccaattcatgtatcattaatgcaacacattcacacacacacacacataaatattctgtatatagagttaatgcttcttaatttgatttagttatttaaatatagatcgatatatatccatgcagctgtttatgtaacaatatatgcatgtatgtcgcgatgcaggtatgatgatgataagtgtgatgatgaatatgcgtttgtgaaagctctatgtatgagtggtggagatggtgccaacagttactccgccaattctcgccttcaggttcttcaatatcttcgcttacttttagggtttaagcagaaacaaattattaatgttcagatttttctctggtgatacaaacatttttacaatcatttaattatgataaaattgtaaaaactgaacatgaactaactaattgtcaatatcaaatattaaatgaatttacatataagaacataatatttaaatgtctttatatgaattgcaaaaacttcaaatatattatgcatgaagtagaaaaatataaacatatactcaatagaaatagattttcttgtttttaaaattgaaacatatgttctttctatctatatgttgagacagtctttaataaaattctactcaaaaagagaagttatgaaagatgcatgatttccatctattttatccaatcaaattcattcatatcatatgttagtttgtttttaagaagtttacatttgtatttaggaaagtaaaaatatattaaaaatataagtaatttaaaacgaaattataggtttcatttaaaataaaaaaaataaaatataactaagatatttatgttagattaacctctactaattgactaaaaaatggtatatatgttgaccaaaaaagaaaaagatactaatgatacaattactaacatatgcgttctgttaacgacggttctgccaaacaaattaaaatgttgataaatgacgattcttaggactagtataaattctctaaattaaaaagggctcattacatcacctataacttataaacctacaagtcattaaagaataataaggcatgtacatgcactagtcaaattgtaaactcgaaaatgcataaacactagtaatatataaatgtatataactcaaaatcatatattgttgttgttatcgtatgaagcatgggtccagtatcacattatcacggatcgacatactgtaaagaaaaaaatcatattttctaaacgaattataaaatccagataataatactattttttataactaagcttctttttttgttgttttttttagaaaaaagttttatcaatg

SEQ ID NO: 16129 - DNA, 3003 bp, Unknown
  misc_feature (1)..( 3003): 2750-1469P.txt file - cDNA_ID_1375398; gDNA_ID_1971953; Annot_ID_177399
taaagaagaattaagttttctttcaaataaagttttactaggccataacctgagagacttgtgtcatatacaaggggcaggttcaggttactaagatgatcaatcttcaattagcaaaatcaaataggaaactccaatggctaatgatggaaaactagatggtaagtaagtaagaattaccatacatctagcaatggtggtccgaaccaaggttcgagcaagcaaagcattcttcttaagctcatcgcctcgcatctgaagaactttctctttctcggttggtgacagaagttgagagtagtgttttagaagagatgtactcttcacttcatctggtcgaataaaccatagatgagtctccctacatgtcaaaagataacacaatgtagaagataataaacagataagaatgttgaagatgagtttcaacacaatttggatcattgcacaacattaggaacgtacatccgagatggaagttgcagaggaaccagtgaaggcaattcgatcgataagcttcgctgcaattgagacatgactctgattctcatcagctccaacaaattcttattctattggaatcccaaaatcgcaacattcaaacaagaatcagtaatccaatcagtgacaagacaaatttagagaatcgatctagaattctaagaacaagtaatcaactggacttggaatcaattattcagatgaattacccaaacggaaattaatactccggctaaacgacggcgaggtcccttgccggtgacggaggaaagatactctaatcgaacggagatggtaatactttctgtttgagaaaaaagtactaacagtgtcgaaccaaatcgaattttattttgaaccaaacggttttacttatccttaaaccaaactaacccgtaaatactttggttcccagttccgttcgctggataccgggaattacatttaaccggatattagaattacaacattttttgttttgttttgattaataacagagttctacacttctacttctaacttgtgaaccttaaagttccatagttaaggaaaatctcatgatatacaagattagggcaacatttttttgttttgtctttaacttatctaataaaaacaaaattttagtaaattcgaaattcagtttggcctgtaggagaggtccgaccacccatccaatatctccggtttatgaaacatggactagattataaaagaatcttttatcgtacgaggaaatttgaacgtatgattcatcatgcatgctttgccgattttctaggataaaaggtggcgtaccatcaattggatggggccgccgcagaaattagttactagtactaccaaagaaataaataaatttaaatgagactttcgtgttccacatggtctctcatccctctctactcggaaatggaactgttgatacggacaacggagtttttctcgaccgcaaaacataaattgtcgagtactatttgtaatttgagatggtttacgtaaattgaaatagtcctttctgatcataaatggcctgttttctccactcttttaaatgagtttggattgttcatagacagattttctcatttttttcgatatatgtaaatctccgattattaaattgtaggccggattgttagataaagcttctacaactatagatttgttgagttgtcatacgtaaacagttttgcttcaaattcactaacctaggaccctccttttgatattaatgtgtggttgttagaaaaacaatttttcgtgttccatataattttagaattacgtggcatggaacatttacatcggggataaattaagcgtcgtccacagattttacgacaatgctccatataagaacatgcattacaaaaaaaaagggaaaaaatgcatgttcatgtatggtcgtctgtctgtttataattgaaaaggactttgatgttgttaatgttattaatggagattactttgaatctcacacggtttgattaaacgaatcttcgtcagcacacactctgttcacacttattatttgagactagcagaagaaactcactagtttatcatagattctgaccttcgcacttgttagtcttttaataacttgaagatactcgccattgtatatcacaactaggcgatttctcgttcatttaaaatgttaatattcgtgtttaatgtatatttaattgaagtaatgattttacatgtacaaatgtatcctagtattttgaatcttctagtaccaagtggttttctcttcgattacctttttgtcttttttcattacaacatgaacaacaccagcaataattaaaatatcgtgctttttgtttttgtcattttttggggtcatacatatataatatatacacgtaagttcaaacatttgtttgttgttctttttgtttgtcttggattcgacatccttagaaataaaaaccacatttttaataacgaaagttcattaaaagtatttcgaatattttaggcatgttggtttgattagagtttgtattccttattcaaactaatgtcgttgttttttactgtttagatcgaaagaaaagttttttttcgtaattttcgtttatttattttgtgaaatcactagcaaagaaaaacgtacgtgactatcacatcaaaccactataacatctcattttatctatcgcttaattcgttttttaagatcagatctgagatcattgtgcatttcaattgtaaaaccgagcctaaagtcaataatataacattatttcagaaccaataatttttaacagacgttgtttgtttttgggtctcaagctgaacgactttgcaactagtacacttggcatatgtttcatgttttttttataaataatgtgctaccttgatgaagttccctctctctataaattgaagtgtgtgagatgcatcatccatacacaacatcttccatcttccgataattctcctttagtcttataatcactaataagtacgataattgaaatg

SEQ ID NO: 16130 - DNA, 3000 bp, Unknown; identical to SEQ ID NO: 10947
  misc_feature (1)..( 3000): 2750-1469P.txt file - cDNA_ID_1375432; gDNA_ID_2214466; Annot_ID_133026

SEQ ID NO: 16131 - DNA, 3003 bp, Unknown
  misc_feature (1)..( 3003): 2750-1469P.txt file - cDNA_ID_1375709; gDNA_ID_1620736; Annot_ID_49487
ggaggctctcccacacgaagaggaataacactgtcacccaaaatttccctaacaggtcgagctacaggagggctagctgaacccaagtcttttacttgctcaggtgactgggagccctcttctgatgtttttctacccccaaacctatcctctctgcgccaatcattcaggatctcaggacgagcagggctttttctgttattaacagcattcctactacccgtctcgaaccctggacttctcccaccaggacttgatctgtcgccgtaacgacggtcatatccatcttcataaggtggactccgagaaccactagaactacgtgtctcacttggagacttatcatcattcttctcattcgtataccttttatttacatacacatgtctgatgaagtcccttaaccgctcaacattactgacagattaaaaaaacacaatcaatcaatgtaacacatccatctccacaacaagaagacagatttgtaactgtaataccttccgtcaggcactgattgccgctgttgatccaatcctttaaaataaatatccttagcatgctgttacaaaaacaaaagatactaaatcacaaatgccaagagaaaaaactcatcaaaagaagagagatttagcgtgtttacctgatttccaccttctttcaaagcagtaacttcttgtgaggtaaatttcgccattgatatcgatttaacacgatgtgtaaactcacgactgttcaaaaatacatatgcatatctcaaacaacatttccaatgaacaccatctacacaagaatatgagaagataaagtacactcactgtattccactgcagttggtacaaacaaaagtccagaaagtagtgcaaacatattgtggtccctaagtaaatgatatcgaagaagaaacgttaacgttaagttctctcaaaatttttatcggaaatgatcaaatgaagagcaaaaaaaaacttacaaggctgttacagtttatacacctcttattctcaggaagtttaagaagactcctaataatcttctcgttcttctcgtcttctttaactcgacccgccattttcgattccaaaacactaagctagaaactacacaaactttagaactcaggatcagttttctgaatcaataatggcgaaatcaagttctgaacaatacgaattacagatttgttcgcttagtctaacgtaaacacgagatttgacaacaaattctagttcggttcacagagttgagatcgatcatgactaataacatacagatccagaaactataggagatttagaagagaaacggagcaaagtagacgaacctgagacgaatcttcaacgacgatcgaatttctggagattttgattcttctttgttgaatcagtgtttgcagagagagagagagagagactttgtacagctaagaatggtctgtggggttaaaagagtagagagagagatttgaggaaggagatggacggaaataattgacggcgttagatttttgtggaatctaagtttgtgaccggtgttgacgacgtcgacggctgtggtctgtctcgttgacggcaaaatgagacaatagtcgacttacttatctacgctatttgcctatttataattttataattattttttcttttaaacaaataaaaaaatattagtaaactaaaacaaaatttaatacatagtaggtagatatttttttatattgatttgtattacgaaaaatagattaattagtatttaactaaaaataaatgatttgagtaaacattaagaaccttttttatacgattttaggtaaataagattaatttgattaaaaatcgaatgaagacacgtccaaatttatgatatttgtttattagttcatttaatatgtttaatagatattttgtaaatgaagatctttgtttttattaagccatatgaatttaaaatttggataattaaatttaattttaaatagttaaaaatttgatataaaatttaagtcgaattgtaagatgatttatacaattgtggggtattctatattataattgattattatagaagacaacgactaagtgttacttataattttttaatttatttttatcacataattgggtagttttaaaaaaactcaaaacaaatttgataactgaaaatatttaaaaatatcgatgagaagtagttaccaaattttgaaataaacaaatatttttgaaggtagttgtgaacttgtgatctcgcaacaatcattacgagatccagtgtcgacgaacaaagactaactcaatctcttcaccccactgaatctcctcacctataatctccaggatggagaatagattagaaaaatattattcaagattttgtgcactatttaatactttggagattgatgatgtgattttgtattcgtggttcatataattttagtttttactttttcaccgattatgaaaattttaaaccaaaaactcacatatatgcgaatccttatctagttagacatatatattgtctaaagtaatattgtaaaccgcatatgtgttaattgcgatttaatattgttgtaaggaataagccatttgttagattggttattataattagtttccaattggctattaattcaggattttcactattaaataaatcatcttaaaatcttcttattttaatgctgattttcgaacatgttttttttttttctgtcaaataaaaataatttaaaatcaattacatggactcaaccgctcgaatcaaatggaccgagacaaaggcaacaaaagtgactttacggtctaaagaaacctctgaagcagaaagagtgtttcacttaccatctctatctccgtcgctgatgactgtatcttcttcaccactatgatcatcatcaaaactttgtctcatcgcatctttttccccaaattctcacaaaccttctcttctcaattccaccaaaccctcagattctcaatctccgatcgtcggaaattctcagcgatg

SEQ ID NO: 16132 - DNA, 3003 bp, Unknown; identical to SEQ ID NO: 16131
  misc_feature (1)..( 3003): 2750-1469P.txt file - cDNA_ID_1375709; gDNA_ID_1620736; Annot_ID_166265

SEQ ID NO: 16133 - DNA, 3003 bp, Unknown; identical to SEQ ID NO: 16131
  misc_feature (1)..( 3003): 2750-1469P.txt file - cDNA_ID_1375709; gDNA_ID_2926157; Annot_ID_139561

SEQ ID NO: 16134 - DNA, 3003 bp, Unknown; identical to SEQ ID NO: 16131
  misc_feature (1)..( 3003): 2750-1469P.txt file - cDNA_ID_1375709; gDNA_ID_2926157; Annot_ID_198497

SEQ ID NO: 16135 - DNA, 3003 bp, Unknown
  misc_feature (1)..( 3003): 2750-1469P.txt file - cDNA_ID_1375747; gDNA_ID_2214558; Annot_ID_134824
atatatatatatatatatattatgagatttcctaatctaaaataaaaataaatgtaaataatatatataaatattactaaaactaatatatgttaatattttaaatctttctacaatctttatgatttttatattgttcgacgatcatctcaaccattgactctcgatctccaactacagataaagtaaaattttaccaaagaaaagtctagtgactcatcataccaataaaaaacacacaacacctagttttaccaaaataagactagaaatagtactatagtagttatgggacgatggagtgatggttttgcaaagcaaaagccaataattgtacatttcaggccgaaaccgacaatgaccccatcctacccatgtgtcatgcattcagtatttattatgtgtatcagtcaaattttcacataatgacgaaccatctacatacaatctatggcgtggcctgtggagggcaggacaaaccgacataatattgtgtatatccactgaaatttattattaaaaaaaactaatacaatgataagtactagtattagtgataaaaaaaacttatacaacgttgttttcatcttacaattaaagatattcataaacgataaatctctacttcgaaattttttaacatctccaaatgtttgttcaagctagtagtagtccacataaagtcacgttggggtttcaggctttcgttaaagattcacaccgtcggattgggatttccagacgtcacagatagacttatcttcttcgttaaatttagaatccaaagattattgtctgcacactcgttattatctaaaacagccttttttagttaaattgacgatattttagtgacattccaattttaaaattcgtatgggtctacattaaatgagtacagcgaccaactactccttccctcatagtagtatttaggtattgcattcacattacataagatgtactttcctactctatataaactctcactcccctaacactcttcatcatccatcacatctcctcttgcaaaccaacgtaaaacactaactaagagatcaatatggctggagtgatgaagttggcatgcatggtcttggcttgcatgattgtggccggtccaatcacagcgaacgcgcttatgagttgtggcaccgtcaacggcaacctggcagggtgcattgcctacttgacccgaggtgctccacttacccaagggtgctgcaacggcgttactaaccttaaaaacatggccagtacaaccccagaccgtcagcaagcttgccgttgccttcaatctgccgctaaagccgttggtcccggtctcaacactgcccgtgcagctggacttcctagcgcatgcaaagtcaatattccttacaaaatcagcgccagcaccaactgcaacacgtatgtgatcttttcactcttataagtatatgttataaattttttagtttattttgttaaatattggaaacttatattaacgttgttatgttaatttgtatgtgaatgcagcgtgaggtgatgagcgacggtcaaatgaagctactagcggatgtttcgaatattatataatcgatgagataatattaaataaagatgttcgaatggctgtactcttttcaatttcctgtctttttttatcgtggcgtttctattatgtgatcgtctgtactatgttcgcaaacaacgttctttgaatttcagacttgaagtttaagttattctatactctatatctatactaacacttactttagtttaatcgatatgaccaaaatgattaacttgcattacagttgggaagtatcaagtaaacaacattttgtttttgtttgatatcgggaatctcaaaaccaaagtccacactagtttttggactatataatgataaaagtcagatatctactaatactagttgatcagtatattcgaaaacatgactttccaaatgtaagttatttactttttttttgctattataattaagatcaataaaaatgtctaagttttaaatctttatcattatatccaaacaatcataatcttattgttaatctctcatcaacacacagtttttaaaataaattaattaccctttgcatgataccgaagagaaacgaattcgttcaaataattttataacaggaaataaaatagataaccgaaataaagatagaatgatttcttagtactaactcttaacaacagttttatttaaatgacttttgtaaaaaaaacaaagttaacttatacacgtacacgtgtcgaaaatattattgacaatggatagcatgattcttattagagtcatgtaaaagataaacacatgcaaatatatatatgaataatatgttgttaagataaactagacgattagaatatatagcacatctatagtttgtaaaataactatttctcaactagacttaagtcttcgaaatacataaataaacaaaactataaaaattcagaaaaaaacatgagagtacgttagtaaaatgtatttttttggtaaaataatcacttttcatcaggtctttttgtaaagcagttttcatgttagataaacgagattttaattttttttaaaaagaagtaaactaactatgttcctatctacacacctataattttgaaacaattacaaaaacaaacaatgaaaatgcaaagaaggacgtaggcactgtcacactacaaatacgttaataaaatgtattttggtcgaattataactttccatacgataaagttgaattaacatgtcaaacaaaagagatgagtggtcctatacatagttaggaattaggaacctctaaattaaatgagtacaaccaccaactactccttccctctataatctatcgcattcacaccacataacatatacgtacctactctatataacactcactccccaaactctcttcatcatccatcactacacacatctcctattgcaaacgaacataaaacactacctaagagatcaatatg

SEQ ID NO: 16136 - DNA, 3003 bp, Unknown; identical to SEQ ID NO: 16135
  misc_feature (1)..( 3003): 2750-1469P.txt file - cDNA_ID_1375747; gDNA_ID_2214558; Annot_ID_185794

SEQ ID NO: 16137 - DNA, 260 bp, Unknown; identical to SEQ ID NO: 297
  misc_feature (1)..( 260): 2750-1469P.txt file - cDNA_ID_1375747; gDNA_ID_1563531; Annot_ID_147851

SEQ ID NO: 16138 - DNA, 3000 bp, Unknown; identical to SEQ ID NO: 8914
  misc_feature (1)..( 3000): 2750-1469P.txt file - cDNA_ID_1375813; gDNA_ID_1971923; Annot_ID_177222

SEQ ID NO: 16139 - DNA, 3000 bp, Unknown; identical to SEQ ID NO: 8914
  misc_feature (1)..( 3000): 2750-1469P.txt file - cDNA_ID_1375813; gDNA_ID_2926219; Annot_ID_142376

SEQ ID NO: 16140 - DNA, 3000 bp, Unknown; identical to SEQ ID NO: 8914
  misc_feature (1)..( 3000): 2750-1469P.txt file - cDNA_ID_1375813; gDNA_ID_2926219; Annot_ID_203229

SEQ ID NO: 16141 - DNA, 121 bp, Unknown; identical to SEQ ID NO: 474
  misc_feature (1)..( 121): 2750-1469P.txt file - cDNA_ID_1375975; gDNA_ID_1591317; Annot_ID_150833

SEQ ID NO: 16142 - DNA, 3003 bp, Unknown
  misc_feature (1)..( 3003): 2750-1469P.txt file - cDNA_ID_1376113; gDNA_ID_1620769; Annot_ID_50183
catggctcgtttcatcgaaggatttgcgaggagtctctgttttctgaggatcacttctgttggtattgaggttaggatcgtgtctagttcagggacgtctttttccgcaacaaagactcctatttcttcccaggggatggcgtctgcgaaaggcagtactatgtcgtctgctatgataactggaatgcacccaaacacaactgcttcaactaacctagggctccatggagcccatcctagaggacatagacagaagatggctctctgcatgtcttcgtagtatgttgtcgggtgatctgttgagatgtcaaacaaagggttgttcttgaagttctcccacaccgctgctcttgcacctctatacaaagagagaagttccagtcagcagattctaaaacaatttgatcttagctaaccttatatataacctaacttcctaatgaggaatgcttaattgttatcttaataggtagatcttgatgtatatgtgcttcttttattgtatgatactatagagtttgcagttccattttggttgaaaaatctatgtaagactagagaaaactcatcacttgagagttttacaagtctacaaaatatgtaccttgcataatatccaccttcggggtcgttgttaacatcataaaataaaccgcggaagtagacaaagatagagcgtggaatatctggaggaataaaatgggcctgcatcttctgtggaggtgcaaaaggaggaatagtgatcgagccttcgtccaaacagacatggttcctttgaccaaatgtctgaaccaaagtggcacgctggagtagtggaagtatccctctttcaatggctttttcctcctgtttaatgtcaatcaaatcttcaattcccacacaaatcattggaatattccacaatcttatacaataaactcataaacagattctcagtttccatgtaactaagtactaatgtgatgatacaacagctaattttaagctaatgatcatctatcattgtaagatcacagggtattcttgatgaacagcaaccaccaaagtattcaatgcatataaaaaatagagtttgttcctgaatgcagagataatctacctgataatggaagcaagctccaaagtcatggggcacaacaaagaagtgatcagctccttcagtccgattccaataaggccaatttgatgagattagttgtatcgaacttctcatcatacgcggcgatttaaacggtaatggcaagccggtaggagtgaggtcgcaagtaggataaattggcgtgtaaaaccaatcagcttcatcaggattacgcgttcgaacaggactagataaaaggaacctgtgcataaaaatctcagcagcaaacatgtgtgtaagacatcgaggatccttttgcagtaatttcttgttgtacttgcttggaagctcatatacataaaccttaagctttcccactggatcatcctccaaaacatcaccagcacttcctgcatttcaaaaacacacctttttgagctctcttacacagctgttacatagttcctcaatcaatagcattgacttcttaagcaaatcaaattatatgtctataaaccaaatgctggagaaacgacagatttcaaacttatttgagcgaccctcaaggattaatcaattcaactctacattccaatctgctggagcaagaagaacaagtacctgaaattcgctctgtccgaacattttgtttagcggaagaagcagagaagaagaggaacagaagaatggcggagaggcaagagtggattttcatatctaccggagatgtgtttgaaggtttggatcgcagaaaggaagaaggaagaggaagaatataagggaagagtatcgttgggaggtcatgggcgcagtggttgacgagtttacttcggtattaggttttagggtttattttattcagaaggaagacgtgaatggtgaaaatgaaatagagtgtcgatggaaaacgaaattggagaaatagcttcaagtcacagataagtaagaaattgcttgtgatgtactttttttttccttgaattcaacgaccaaagacggaaactggtgcacatcacaaggcgcgtgctattatgggctgagttaatgtccattgggccttgctaacgtccaacgttgactagttataacttccgtagtaggtcatgatcgttttagagtggccactatcaacaactagttaacgacaacaattttttatatatatgttttatagttgttggtaatacgacaattataggtgacataattcattgattagcgattaatatatttgagatcactgtaaaagaagtactatgattcagtttttgatcgttttatgtcattagcaacgatgaaatgaacattgttatatatctctaaatgtaaccataacattgtggataataatctgttggagtgtgaacactctgaaagattctaaatcatccaattttatgtgaagaaatatgtagaaaaaacaaacaatggatgagttataggtttggttaagacttgaaaagtcattgatcacggcttttgtccattattccgtgtttaaagtaatttacattctcttttaagatctctcagtccaaagacaatgcaaacaataataatttctccacttgtttctcatcgtctctgtcttgctcgtgctgttccttgcaaccgtcttctcaacaaccaccaccgtgctcctccttcgatccgcctctcaaaccaccgttcaaccacctcactccgcctcttctcctccgccggtagaccccaccaccttctatttcccttttaaactttttgtttccttttgaaaaagatattttgcttgcgtggggcaattccgtcaaagcgttaccattcgggataaattggtcattttttcatcactgtgtctctctattgagtctttagggtctctctgtgtttgcaaatctgacgccgagtattttgctaaagcagcagccagtcgggacagtgaaatg

SEQ ID NO: 16143 - DNA, 3003 bp, Unknown
  misc_feature (1)..( 3003): 2750-1469P.txt file - cDNA_ID_1376113; gDNA_ID_1620769; Annot_ID_167439
ttagccaagacaaaaggagtgtacagtattatatgatcaatcgaagagaaaatgtacaacaaacttggtacatgtacctcgagtaaatgtactaatgttatctacaaaaaaaatccactcggaggacttggacttctaatgtttttgaagtgctatagaaaggcaacaacgtatgctctaggtgaaacccaagatatacaaaaagattcctctctttctgactttaccaaggtttcaggtcagcaaccggaccagcagtccagttcagtgccttctcacctgtcttcaagtatatgcttttgtcgtggggtaacttccgagctagcccgttaagtatctgatggaatgcatcccctggttgtgcaggttgagggaaaagcatggctcgtttcatcgaaggatttgcgaggagtctctgttttctgaggatcacttctgttggtattgaggttaggatcgtgtctagttcagggacgtctttttccgcaacaaagactcctatttcttcccaggggatggcgtctgcgaaaggcagtactatgtcgtctgctatgataactggaatgcacccaaacacaactgcttcaactaacctagggctccatggagcccatcctagaggacatagacagaagatggctctctgcatgtcttcgtagtatgttgtcgggtgatctgttgagatgtcaaacaaagggttgttcttgaagttctcccacaccgctgctcttgcacctctatacaaagagagaagttccagtcagcagattctaaaacaatttgatcttagctaaccttatatataacctaacttcctaatgaggaatgcttaattgttatcttaataggtagatcttgatgtatatgtgcttcttttattgtatgatactatagagtttgcagttccattttggttgaaaaatctatgtaagactagagaaaactcatcacttgagagttttacaagtctacaaaatatgtaccttgcataatatccaccttcggggtcgttgttaacatcataaaataaaccgcggaagtagacaaagatagagcgtggaatatctggaggaataaaatgggcctgcatcttctgtggaggtgcaaaaggaggaatagtgatcgagccttcgtccaaacagacatggttcctttgaccaaatgtctgaaccaaagtggcacgctggagtagtggaagtatccctctttcaatggctttttcctcctgtttaatgtcaatcaaatcttcaattcccacacaaatcattggaatattccacaatcttatacaataaactcataaacagattctcagtttccatgtaactaagtactaatgtgatgatacaacagctaattttaagctaatgatcatctatcattgtaagatcacagggtattcttgatgaacagcaaccaccaaagtattcaatgcatataaaaaatagagtttgttcctgaatgcagagataatctacctgataatggaagcaagctccaaagtcatggggcacaacaaagaagtgatcagctccttcagtccgattccaataaggccaatttgatgagattagttgtatcgaacttctcatcatacgcggcgatttaaacggtaatggcaagccggtaggagtgaggtcgcaagtaggataaattggcgtgtaaaaccaatcagcttcatcaggattacgcgttcgaacaggactagataaaaggaacctgtgcataaaaatctcagcagcaaacatgtgtgtaagacatcgaggatccttttgcagtaatttcttgttgtacttgcttggaagctcatatacataaaccttaagctttcccactggatcatcctccaaaacatcaccagcacttcctgcatttcaaaaacacacctttttgagctctcttacacagctgttacatagttcctcaatcaatagcattgacttcttaagcaaatcaaattatatgtctataaaccaaatgctggagaaacgacagatttcaaacttatttgagcgaccctcaaggattaatcaattcaactctacattccaatctgctggagcaagaagaacaagtacctgaaattcgctctgtccgaacattttgtttagcggaagaagcagagaagaagaggaacagaagaatggcggagaggcaagagtggattttcatatctaccggagatgtgtttgaaggtttggatcgcagaaaggaagaaggaagaggaagaatataagggaagagtatcgttgggaggtcatgggcgcagtggttgacgagtttacttcggtattaggttttagggtttattttattcagaaggaagacgtgaatggtgaaaatgaaatagagtgtcgatggaaaacgaaattggagaaatagcttcaagtcacagataagtaagaaattgcttgtgatgtactttttttttccttgaattcaacgaccaaagacggaaactggtgcacatcacaaggcgcgtgctattatgggctgagttaatgtccattgggccttgctaacgtccaacgttgactagttataacttccgtagtaggtcatgatcgttttagagtggccactatcaacaactagttaacgacaacaattttttatatatatgttttatagttgttggtaatacgacaattataggtgacataattcattgattagcgattaatatatttgagatcactgtaaaagaagtactatgattcagtttttgatcgttttatgtcattagcaacgatgaaatgaacattgttatatatctctaaatgtaaccataacattgtggataataatctgttggagtgtgaacactctgaaagattctaaatcatccaattttatgtgaagaaatatgtagaaaaaacaaacaatggatgagttataggtttggttaagacttgaaaagtcattgatcacggcttttgtccattattccgtgtttaaagtaatttacattctcttttaagatctctcagtccaaagacaatg

SEQ ID NO: 16144 - DNA, 3000 bp, Unknown; identical to SEQ ID NO: 5547
  misc_feature (1)..( 3000): 2750-1469P.txt file - cDNA_ID_1376639; gDNA_ID_1620801; Annot_ID_168688

SEQ ID NO: 16145 - DNA, 3003 bp, Unknown
  misc_feature (1)..( 3003): 2750-1469P.txt file - cDNA_ID_1376726; gDNA_ID_2926232; Annot_ID_142694
gtgtgaggattcttagggtttcaaatgaaggacgcgaatcgtacctcgatatgtggaagaacgctgttgatcgcgagaagaaagagaaggcctttgaaaaaattgcagagaatgttgtagctgttgatggtgagaaggagaaaggaggagacttggagaagaagagcgatgagtttcagaagatcctcgaggtttccgttgaggaaagagatcggattcagcgaatgcaggtcgttgatcgtgccgctgccgcaatctccgcagctagagctattctcgcctctaacaattccggcgacggcaaagaaggattcccaaatgaagacaacactgtcacaagtgaagtcacagagacaccgaaaaatgctaaacttggtacaaatcttctacttgttagcacaatccaaagttaatgatagtattagtcaccttacttggctatgttattggaaattttattaggaatgtggagcagaacagtgtatgtgccacggtcagaaacttcagggactgagacaccaggaccagatttttggtcatggacacctcctcaaggtagtgaaattagttctgtggacttgcaggctgtggaaaagcctgctgagtttccaactttgccaaatcctgtattggagaaagataaatcagcggattctctttcgataccatatgagagtatgctttcttctgaaagacatagctttactatcccgccttttgagtctttgattgaggttcgaaaagaggctgagacgaagcctagctccgagactttatcgacagaacatgaccttgatctcatatcttcagcaaacgcggaagaagtagctcgtgttcttgatagtttggatgaatcttcaacgcatggagttagcgaagatggattgaagtggtggaagcaaacgggtgtggagaaaagacctgatggtgtggtttgcaggtggacaatgatacgtggggttactgctgatggtgttgttgagtggcaagataagtattgggaggcttctgatgattttgggttcaaggaacttggttctgagaaatcaggacgtgatgccactggaaacgtgtggcgtgagttctggagagagtcaatgagccaggttagtgtaaagtagttgccgtagtaaatctaacgcactatagactatttgagacttaatttgaattgtctattacaggagaatggtgttgtgcatatggagaaaactgcagacaaatggggaaagagtggacaaggtgatgaatggcaagagaaatggtgggagcattacgatgctaccggaaaatcagaaaaatgggctcataagtggtgcagcattgaccgcaacacgcctcttgacgctggccacgctcatgtctggcacgagaggtattctcaaaatcctcttttcacataacgaaacactaataacataatcgaatctttatcctttaactttcagtccttaaaatatcaatcaatctctttaacacaagttagaatgtttgtcctttaacttttacaccttatattgttgaacatcaaatcagttcagtagcaaaacattgccttttcatactctttaaggtgctctattaacatttagaagcttagtctgcgagctttgttgaactgttatcaaaacagaactgacactagacaagctgtgaccaaataacagggaatgtagagtgtttctaaatatgtcttgattggttttgaccaggtggggagagaagtatgacgggcaaggcggaagcacaaagtacacagacaagtgggcggaacggtgggtaggtgacggttgggacaaatggggagacaaatgggacgagaactttaacccgagcgctcaaggagtgaaacaaggtgagacttggtgggaagggaagcacggcgacagatggaaccgaagctggggagaaggtcacaacggatcaggatgggttcacaaatacggaaaaagcagcagcggtgaacactgggacacacatgtaccacaagaaacttggtatgagaagttccctcactttggcttcttccactgttttgacaactctgttcagctccgagccgttaagaagccttctgatatgtcctagatatatcaaatactaagcataaaatatataaataagctgggacaatcaaagaattggcctacaatattagagtagtttgatcaagtgcaatgtatgtaatatttattatgacttctaatttgttctatgctttggtgtttcttaatgagtatggccaaagtttatttggtagttactaatataacacaaatctgattagaaaactggaacacattccattccaggagcataaagttatatgaacagataatctaaactctttatttggtaaagataagaagacaaatattttctgtaaccaataataatcttcagttacatttgtattaaattctaataaaaaaaatatacagaggacaagccaaagtggaaccccacccactgtcttctcaaagattaaaaaaaagaaaaggattttacccaaaatctccgatattcttattcctttgctgtatcatcttcttcttctacttcgtcctcatcatcgtcacatagatcctcctttttcgttaattggggagagatatacgtaacagctcttctctctacaaagaagttgacttttgcatccttacatctctcaaatctttctctggttaatctgtattcgtgtatttttgcagtttcttttgaggatcagatcgtgacagggtttagctcaaggagaggtattagatccgtactttgtgataaactttctcaaggtttacgatctcattctatctagatcggcttcgtatagatacaatcttgtttcaattagcaatggatcgattttgttattcgaatatttagaaaaaggaaagatttttccaaaggggtttcctcttataccattttttctgggttttttgaaatttagggtgagaaaaagaagaagaaggtgagaaaagtgaaggcaaggctttgaggatg

SEQ ID NO: 16146 - DNA, 3003 bp, Unknown; identical to SEQ ID NO: 16145
  misc_feature (1)..( 3003): 2750-1469P.txt file - cDNA_ID_1376726; gDNA_ID_2926232; Annot_ID_203746

SEQ ID NO: 16147 - DNA, 3003 bp, Unknown
  misc_feature (1)..( 3003): 2750-1469P.txt file - cDNA_ID_1376881; gDNA_ID_1972143; Annot_ID_179295
ctccgcttcaatcgggtcaaaccccaatcggacggctctaactcctcctcaccaattcaaattttacaatgtgtctacaaaaagggctctgagattaaccaaatcagatcctttctatgccggagttgaaacactagatagaagaaacagagacgtccaacaatccaacgaatccgggttattaattggaggtaaaagtaatggttttgccatctgccgacgacagatcggcggtgacaacgatgataaatactagtctctcttttttcacaaacgggaagaaaaaaagaaagaaggatcaaagctcacaagccaatgctacgattctgacaaagagattgaagaagagtgatattcagaatcgcaggaaagacgaaatagagaaaaacaaaatgaactttttggttttctctccagaaacaaaaacttccgttttcttctgttcttttttttgtttgtttgctttcttcaaccattcttttttaattacattaatattgcacgtcgtgttattttattttaactttatgttttaaaaaaacatataaggaagtaagtactactcctcagtgttttaagaattactatattagttgactaaatataatttactcaattaaacatgcatttaatttgttcagtctcgtaatagacagtgattagtgattactgtattttaatttctcttgtttacgaattcataaagaaaagaaattagtagtacacattacacaacaacaaaacgtaatatagaaaaacttgacaacttggtctgactctgagccgtctctgctcggtctgctgtcaaaatcttttctttggacaattctaccccttgttttaagtgtattaaacattatatattcgaggccgaaagagttttcgcactttattcaaattgactaattgagcatgaaatacagcattaagaaattagttatttgtaattaacgaaactttgacctcactttttattctccacattgtatgatagatagatccattcattgaccattgttcatcgtgatgccaaaaaaaaaaaaaaaaaaaacattcattgtccactttagttaagctggtaataaagcgagtatagaaaataataccgcaaatatccgaatatattacctaatttcctaatataagacatgtatatataagtcgacggaaaagacggtaataattaatatttccatttaggacctaatgccatctcattttcatttccaaccgtaaatatttttaatgtgaaaacggtaaattttggtgcaagataagtaactttactaatactgttgatttgtattttgtagttgtagttaacaaaggaaattcggggaataaagaaacatagtaagggcacaacaaaaattttatctattaataaccacatggtcccaaaaagccataataaagtcgtatgatgacatgtttacacgaccatcgttagaaaattaatacatattacggatatcaaaatcacacccaattttcaaatctctttatctaattatctaaactgttccgtttttagagggacccaacaacaagccaaagcaaaaactttctggtaattgaatgtatattgtatcatttcgccaacaatttgtttgaaaatggatgatttcgccaacatagtttttggaagaatctgaagttttggaaccctatttataaattatataagtccattaaataaaagtatgggccgcgaaggaaaacgttatgggcttcgtattgggtttataatagaaagcccaatatgttaaaatttatgaaggaggctgggcttcacgtgagttattactactagacctctgtattcttctgaatctgacatatcgctgattttaatgcgacgtggagctttataagacgcaattcatcaaaatgaatgagccccactattttgttgttgttttggagtttttctgattgagggaaaagatgaaggggatcttcacagtcccccaacaacactccattggagccatttcccaagttggtaacacgtttatcaaagccctccctcgttttcatcaacaacttatcgattcatttgctttgtagatctctctttgtttcctgagctgagtttacttaggactaatcttcttcttcttttttttaaaagaaataaatgcatggcaagattgaaaatcaaattaaaattcagtaatcactatgctaaactaataccccatcaatttataatagaaaatcaaattttgatacgttaccggtggattttagatatactcatactaattaattactaggatttcgaaaatgactagacatcttcttgccatatttgctaagtatgattgaaatcaaactgatttaaagttagtaatacatatatatgctcatgattttcttgttttttggggtcaacatacatttctgcaaatcaaatatgctggtttaagtctactaaacacaaaagttctcatatattaatatattttcttttgtctcaataattctagtaaataaagtagaggaagagaatgatgcacgccagtagagatttttattcatataaaatcgttgtctttagaggaataatacatgccttaattctcaacaaaaatacatttataatgaggaaagtttactcaagttgcataatatatcaaagtacccaatgcacgaattctaatctttttttaatactaatcattaagtccattttgacgaaatatgtgaacgtcattacaaaaatcttcagaatattcagaccaattcaattttattaattacaaggattatcagcttcgaacataattagacggtaagagccgccctgttagggttttttgtcctcaatgccaaaatcctcccattgcagatattatatcactcccactgtctaataaacaactctcttctcctctctacccagagcgagtcaccttatcgtctctctatctcctccttcctatatccccttgctctctgggtttttgctcagtgtgctacgtgagagatagagagatg

SEQ ID NO: 16148 - DNA, 3000 bp, Unknown; identical to SEQ ID NO: 14141
  misc_feature (1)..( 3000): 2750-1469P.txt file - cDNA_ID_1376943; gDNA_ID_2214702; Annot_ID_136892

SEQ ID NO: 16149 - DNA, 3000 bp, Unknown; identical to SEQ ID NO: 14141
  misc_feature (1)..( 3000): 2750-1469P.txt file - cDNA_ID_1376943; gDNA_ID_2214702; Annot_ID_189714

SEQ ID NO: 16150 - DNA, 3003 bp, Unknown
  misc_feature (1)..( 3003): 2750-1469P.txt file - cDNA_ID_1377007; gDNA_ID_1972029; Annot_ID_178213
tatcttctctgcctgttgtattgattttaattgtattcgaggttaagttttgactgatgttttactagcgatcgcagagtgatcgataattaacaagtttatttttcgatttggtaggtatatagtgaattaaacatgatttttgttcttcctgaacaacctaaagcagtgttatgaacgcatcacgcatgtaacaaccagtcaaccatattagtgtgactttaattcattgaataaatgaaatttttttattttcaacaaggcttgtaacggttgataaatctactcagaaaacttctttttgtttgtcttgcaaatacaaacgatacgtttcaactctttttttggcgtccaataatacttcttaaaaaataatttgtttattgtcatgagctacacgtgggaagacaagtcctatccattattactacacactactccaacatttgcccacattttgaaaaaaacatttttttgtaattcaattattcgacacaaccaatcccatctcttgtttcacttccgccctccatctttcttcgtgattgagagaatcttcaacgaaagaaagcaactttttttgggtgaaattcacagaacaaccaaggtttttcttcttcttcttcttctccagttcctacaggtttactcttactcatcttcatctttgtctcgttcttgctcttcaatttctggtctttttgttgttcttgtcttctcgccaaatatactaagatctaagttttatatcattgtaattatcaccaacgaactgttaagaccaaatttgattactcgaaatggttttgggtttagggtatgaagaactgatcaaaagattcaattttttatgaagtcaactttcatctgcaaattgagcaatctcagatttcgattgtgtttcagaatcatgcctgacaagaacatcgtagaggacgttatcggtgatttggtggataacttcacggagactgttcagaagaacaaacatggttcctccttcttcgaacaagaagattccgtcagttctcgtttcaaccgtttgtttgatcgccagaagccaattcatcatgtcttaggcggtggcaaatgtaagaattcgtatacaggaacataaatatgagattggtttttcttgtaattgagtattgagagattccttcagctgctgatgtgttgttatggaggaacaagaagatctctgcaagtgttttgatgggagctaccgcaatttgggtgctttttgaatggatcaatttccatttcctgtctctcgtttgctatgccctcttgcttggtatgattgcacaattcgtttggtctaacgcctctggattcttaaaccggtaacttgttggagtgttgttgtcattattattggtaccttgtgattgcaatctaacacaatgtcctttaatgtctcaaagcagctcacagtctagagtgcctcgcctagttcttccaaaggatttctttgctgaagtcggtgtggccgttggaaaagaagttaaccgcggtttgttgtttcttcaggacttggcttgtaaagggaatttgaaacagttcctcatggtgcgttgtttgtttcaataaccacaatcttgtttgtataatgtattagcactttcattactatgctaagatagaaactttgatcacaatatcatttttcaggctgtaatcggactatgggtagctgcaatggtcgggagctgttgcaatttcctaactgttttgtatatcggtgagtggttcttattagtgtatcctcttttgagattggaagttgagtaatacaagactttaaagggatgcattttatgtgtgtgtgtgaagggtttgttggggcacacacaatgccggttctgtatgagagatacgaagacgaagtggatggttttatggattctatgatcatgaagtttcatagtcattacaagaagcttgatactgggtttctcagtagaatcccaagtggaaagtttggattaaagaagcgtgagtgactaaatcactcaagcattttcttattttaccttgtttgttgttagaacaatatggattatggtttgctaaatgaatgttttgagaatattattcattcatgtagattttgtgtatttccttactaaacaataccttgtccatgtatttgtcaataccttggttaataagagaatcatcatatctgtcaaaattatacaagtagattgagagttcattaactcaatgtctaaaaatgtaagacttaaaacaagtttgaatcaaaattatttcacaaatcaaaagtatggttttcttatttcgtaagaatcgttgactaatattgaccggctggctaataagaagatcagataactctacaggtatgggatccaccattgtcaaacattttacacgtgtcagcttcctgagcttcgaagcctgaatgttaaaattaaaaaatttaaaagaaagaaatataaaaagaagtaaatcaaagaaaatggagtaaagaaattgatccacgatcgatcaacaaagtgaggttaggttccatctccacctctttctctctcgaatcttctccgattaaaggtgctcttttgcttatgaaatttgtgtttcttaagctaatcgaatttgttttcttgatcgttttgatgttcttttttttttttgttattgttgttgatttgatgtgatccggttgtatttgaagacgaaatcgattcgaagtgttgaggtttagtttggggtaaaatagatgattctcaatctgttcttatttgtgaattattttgtatttctgattctctgtttttttctgtttttttttgtttttttttggatttgaaacctagagaaagaaccttgtttcattagtgggagataaaaacctctaatgatttgatataaatttttgaacttgtacagattcgaatcgatttcccttgtaccctctcttaatactggttcttgcctgacaggaacaaggtctggtttacaaaagtctcatagatg

SEQ ID NO: 16151 - DNA, 3000 bp, Unknown
  misc_feature (1)..( 3000): 2750-1469P.txt file - cDNA_ID_1377119; gDNA_ID_2936560; Annot_ID_194411
atatctcagtaaacgttttcagcttcctctcttcttcttcttgtttaaccagatcaaagatcatatcttggtcaacacgttcatcttccatgattacaacaagcgggttccctgaatcttgactttgaaccggaagaggaatctgtgaatcttgttgttgaatgcccctatcatcatcatcatcttcttcttcttcttcatccagtatgttttcgagctcatttgcatattcctccatgttttgatccgttgtggatcttgaaccatgatcttgaagttgaagatgaatctctaggtgttgttgttgaatggcactatcatcatctccttcttcttcttcatccagcatcttttcaagatcatccgcatattcctccatatgtttatccaatgtggatcttgaatcatgactttgaagaggaaactctggatgttgttgttgaatggccctatcatcatcttcttcttgttcttcatcaagcatattttcgagctcatccgcatattcctccatgttttgatccattgtggatcctgaaaccatattgttgtgtagtggtggttgctcaacgaggttgttgttgttctctgtcgggaacttaaattggtcaaggacgttcttcttcatacggatattacacaaggcaacttcttggaattcagcatcgttctcactcgctagccaatactcagtcatacaccaaccagtggcttctccctcttataatttatttttttatttttatttttttgttttgataaacttagttttaattttttcctaaaattttcctaaaacttagcattagaaggttttttttaatctccctaactaactatgtattaaaagggttttttcttccattatacgaggttatcaaccaataaaattaaaagataaatcatttcaaatttgcttaatcaaaatacagatttatcgatattttttaagtaaactttttgtaatgttttttccttttctaataatacaaaggagttaattagatatttcaagattataggaaaattgttatctataaccctatacgattggttacgtgcataagaagttagtggctaatcatatccaaacttggtgatttttatacgatttgattgcatagcgataaacttgttaacaaattaaaaagctcttgtattctctgttttgtgctgcaatatattaaacagtctacttcatttctggtataattcaaaggcggcactaatattactaaataatctctgatatgatctatatttagttaataaattaccataatgataaaggatatttaacaagtaacaacattaactggcaacaaaaccatccatgaactacttcggtgtaaaataaaaactgaaaattttagataacaaatgttactctaaaattagtgtttataaacaaaacaatttctctaaaatcttcattcttaataaccctctctttaagctttttcgaaacaaaagaaataagatgaagaagtcatcaccattgctctgtttctctcttgctttgttttctctcctctcatctccttcctcttccactcgtataatctcctccattgtcccctccgccgctccttctcccgccgtagcccccaccaccgacggcgacgtagacgaaaacgatttctccgccttcacgcaatggaacattttaaacctaacggaccttaaaagtacctttaaaaacctcccggatttctctaagctcaacatctcatcccttcacgtgtcacccgccgttggctccgtctgctctaacaccgactacgccgccgaatgcatcgtctcaatcctcccactcctccgtgacttccgcaaattcgagccaaaacccatcgacgtccttcgaatggagatgagtgcgctctacgagaaagctaacgccacgcttgacttagccaagcgtctcatcgtggataagtcaacgccgcgtgacgtggctgatgtattggacttgtgtgtcgataactacgagtcgcttctcgatgatcttaaagatgcttccgtagccgtcgatgatggagactttgaacggctcgagagtgtggtcagtgctgcgatcgctgatgtggtgacttgctctgacgcgttcgctgagtcgtcggagcttgagtcgccgatggctaacgttgatgattttcttaagaaactttgtagcaatgtcttggctatttctcagatgatccacatgtaaatgcgtaagtatattaatgataaagagatatagtacaacgaaaaaaataatatagatactaaagttacgcaaaaaaaaatttcttccaaattatcaaaatgtgaagtcttgaatttgagaaaaaaaaaagtgtatggtaatgagttcaaaaatgtaaatgttattaataatgtacaaattattattaaagtcagtaagttgattcagaagagaaatgtatagtttcttcttaaattttctgatgagaattgtaggaaatcaaattactactatttaaccattttagaattatgatccatttgaatatatttttcaacatatcataaactttataaaagaattttggaagaggtatttatggttggcccagttatatctgtttcacacaaagcccataaacacataattttcgaacatgcatatttatgtttggcccatttctctgtttcacacaaagcccataaacacatattctggaacagatatttattgtttaatgctttaattctaaaatttcctctttgaaaacaacacgtgacaatcgcgttttgtaagtaccgaaaggcgttagcgtgtaatataatcggacctaaaattgacccgtcccaatcctaaattaacgggttcaaaacccgacccgataacacacacacagatatcaccaccattagtctcacttcgaagaagcaaaacaaaatccccaaattttcaacaaggataagagccggaagctcatcgccggtgaacggaactagggtttcattcatccccaaattgataacaagaaaatg

SEQ ID NO: 16152 - DNA, 3003 bp, Unknown
  misc_feature (1)..( 3003): 2750-1469P.txt file - cDNA_ID_1377348; gDNA_ID_1620467; Annot_ID_157925
gtcagaatcttcaggggagggattagaggggataggggcagagggtaatataggattggaggttttgatttggtaagagaaatagaagccttgtttgtgagcaagagagaggttgattttggtttaagtatagtgaaagtttcagctaccttatcttgtattgtagcagtaattccagatctagaagaatttgaaaccgcatctggacaaacagaaataggagtctcaacaagatgcatctctacatcagtagtagttggatcagaagcaacgaccaacacagagcctaccactacaggctcaagaacacgagcagtttgcaatgaaagctttggggtcttggaggaactggaggacagggaagggaactgggacagggataaaataggggaagagggatcagggggtcaggagggagaggcggaggagggatctggttaccaccagcggtgggaagcattggattcaaggcggaagcacgaccattcgagaaccagcggttctgcattgggaactgggacagagagaaaaaagaaaaaagaacacacaataccagacaaaaaaactatttagcaagttatatattcatatcacctcaataccatacatcacaatgcttaaaataaatagagaatatagtataactattcgattccataatttaaggtaaattgacctcgaaaaaaatatctacaacctccaccaaataaatttgtttcgaaaacgtttgatatattccttaaacaacgtaatttataaattcaaatcaaaaaacagatcttcaaattcgactaaatctatatattcgattcaattgattgtcattgaacaattaataaaattaaatacccgaatatatcaagtatatatcttaactaacattatacacaaatattattctaggttgtactttcctaaaccctatatcaaacaattcacgaactagattactataaatatatggtgaagaatgcaattgaaagtcaactaaagaaaagtgaacaagctacacaggttcatcagatatggagagtggtgaagaatttgatagtagttattattttacaaatataagaaatagaatttatttactaataaaacttttttattctaactattacaataggaatatattctgtaagaacattgttttttgttaactaaatcaactttcagttatccaaaaaacacaaccaaacttttcaattaaatcataatgaattgtataaattaacattattctctacatttgtaatagatcagacattaaataaaattcagtttaccaacattaaaaataccaaacaattaaatgtataatatttacgtaaaatatatatactaatataaaatttaatatcacaaaataagtacacgttttattttaacaaaaaagttttaacaaaattaattaaacaaaaatacctacatgtatgtgcgggtcatgatctagtattcaataaaagaacatgaacaaactctatatttacataaggaatttgaatacaacaagtttctctcatatgtggctttagaaattataaatgagagaaatttaaaatattcattttggcctaatacaaataacaataaaaattgtctacaatgagagactaattttctgatacttatgttactgcgagataaatatcttttaaatttgacgactctttactaggaattatacaatcaaacttatgtaatggagctatatattttaatagtactccaaacttttaagtaatattacatgattctacaatatttaataaatgtttaaaaaatatacacctgattgaaataagtttcaacaagaaaaacatggctattttgttggtgtatcaaatttattttaagcaatctacatctctttttaatctgtttattcctagatgataaaggacaaacaacaatatcagttgtacatggtaaaatagtctaccctctacgtatacacataaacggttaaaatgaacacaaattacaatttagaccaatggaaaatcgattttactcaaacaccaacaaactttgaacaaagaactgttacacgtagaaccaaacaatatgatgaaaagtattattaaaatttagatcctttagaaattcaccctcttttggaataaattcattttatgcacatttttttttctccgattataggtctagccaaactattactaactcggaaaaaaatacagaaaaaatattcacaaaaaaaagagaataaacctatcaaatttcacctaggtgatttgatagaagtcgtatcacctagttttcctacttctccaaaagtttcagatttgaaatagacaaagaatatcaaatttaaattagagaaaaaaatatcttaaaggagaatttttatccaataaagttaaaaataaagaaaaatggtactttgacaccttcaaagaattttttttttaaagagaattatggtataaagatatgaagtacatattctattttttgcatggtttgaaatatgtgctgtagaaaataaaatagattatccttacaaaaatgaatcaataacattagttcaatagtatataatacatgggaaatgactattgagaaatacaaaagaattcatccaccattaaaagatatatgttgtgactagtgcatggatagaaaaacaagaatttaaagaaatcagaagaatttatacttcttctctttcagggaatacagttttcgtctcaacaaaaaattctttaacaattcctgcggctggacttggactggttagaattgctccttcacgaaatttggggtgaatttacaaataaacataaataaagggaggtttcacgaatttttaaaaataagtatcctgatcactaaatattacaaaactaaagaacgtcacacagatggtgatcgaacaataccgacacctaaacctctgtaccacaattcgacgcaattcatcgttacccaaaaacctctgtttcgattcctagacactctcactagggttttacaactatg

SEQ ID NO: 16153 - DNA, 3003 bp, Unknown
  misc_feature (1)..( 3003): 2750-1469P.txt file - cDNA_ID_1377706; gDNA_ID_1620553; Annot_ID_160368
ggtacaacgggatatgagctgtgcacaagaacgaagaaaaggcataacaacaaattcatcagttgtattgcttcacgaaataaactgaaaccatgcaataaatatacaataaacagataaccccactaactcgtatcaaatagacaagagcatataatagacatccccaatggtacatactatataacattaagcttagcctgatgaaaagaaaaagaacattacccttgagaaataacattctcgtgtcagaatgagatgctacgcactgcagagtaaaacaacaagacagaaaatcattagaaatctgatggattcagcaaaatatatgaacatgaaataaaacatcctaaataagaagacgaaatctccatgtgaacctgaagaagagcgagcgagttgcaaacacggttggactgagcaggagtcagatttggaggtgcaagaacagagtagattgatacaatctcctgcaagcacaaatagacgaaacagtcaaatcaaaaccacgctactaacaccgaataaatagcatttagatataaaagaatcatttgcattcaacgctcatcaatttaacaagaaaggaaaagcatttaagtaactggagataaccgaaacagatgcatttaagtcattacctgtaacaaggcagcaatggtaccaaaagagttccacaacaaaggcgccagatcctgaaacaattctcttttctacaaaagaaaccactaattcagatactgaaccaagttcccaaattcacatactcaacacaatttgagaaaagttctcaactttagcaaatttcaagagtaaccctagcgctcgttgacgaatcagacaaaaaaaacgactgcccagatggaagaaatgaagaagaaaacatgagagattataagaaaaccttggaaagctcgagaagagcattttctctgagttcaggattgctgagatcgagtaccaactgttcagcagaggccaaattgcgatctttgttggccggagctccggtaggattttgtgcggaggtgctaggaccaccgaaaggtgtgcccatggagagagaagaaggtagattcgccattctccagagttggttttctcgtttgtttgttaatgggacttttcaaggattcggtttctcccttcttctctcttctttatagatggcgattacgcccctttcttccttatttatttattttcatgtcaaaacaaaaaaaaatgtttagtttcaaaatagttttaatcatcactatttacgacttaaaccgttttttatttgttattcataaattataatatgtagtgatgcatatggtaaacaaataaacaaaaagtagtgttaattggtttgtgtacaaaattaagttataagttaaacaacatgaatgtgaacggaaatcaatttatcaaagcaatggcacataagcaagaaatagttctctaataatatcattaagttttttaatcattgatgtaaaatatcacatatgagtccaacataagaaaatatttttaaaaaaaattgttgactgaacgaatttagacggaccaaaacgtaagaactcgaacactaaatgagatttaaattttcaagataggcgtaaatgtaaccgatgcttctgaaacaaataataaaagagttagaaagctttataagaaaagtacaagcggaaaatctgcggttttccaagtgtgacgatatctttaaaaaaaattctattaattttcaacttttttttattcagaatatatattaaaaaactaataaaataatgttttgagtcaaatgtcactatgtttgtagtttaatttctgcatattacgtaaattttaaccttaaatctacatataaatttttgcagccattttgtgaaataaatcatatagttgagacttatttacaatggctgccactgaattttaatgtttgtttttgataattagaaagagagtcggctatggcctatgggccaaactggccaagcatgggattgtagtggttatggctcatagtgggaaggtgtttgagtaaccatgtttacatatttttttaacttgtaaacatactattactgaaccatatattattttgggcttgtggtcttcattttgttagggccatttctgcttataaacaatttactgagtataatttcaatattatttcgcggtcaaaaaaaaaaattcaatattatttctgtgtcaagtttacattttatgaattgatttccaataaagcatagcataagcaaaacaaaatacttgggacttgaatgtttcattgcattttaatttttggaatatcagtgtcataaagcatagtgtgtttgcagtaagcccactggaaaaaaaatcatatgtaaagagtgcttttactaggcccagcgggaaaaaaatattttgacccaaaagttaacaaaaattaggactgtttttatgtgagatttcatttgttaattgagcatccattttgtaagtgctcaattaacaaatgatattttgacccaagttaacaaattaaaatgtgtatgtcacaccaatcaacaacataatactataattcttatctaccaaactaaaaccacaaacatagattttagcataaaatacacaatacaaaataaaactaaacgtaggcatattataaaaccgattcagagcataaatttaggtttattctatgttgaaaatagtattttgattttttttattctatgggtttatgaaaagatttatccaaaatagaaagaaataaacaagaggagtggttgaataaattgtactattttggagggttcgttttcaaaattagaaagaatacagttatagatacgaaaaatatctgatcctaatcatcacttcaaaatatctttctttccctttccactttttcgcttacactttccccaactcatcatcactctaaaatatctcccaccacataccacttaacccgacccgacccgaccggaaaacccgacccgatccatcccaatg

SEQ ID NO: 16154 - DNA, 3000 bp, Unknown; identical to SEQ ID NO: 11013
  misc_feature (1)..( 3000): 2750-1469P.txt file - cDNA_ID_1377843; gDNA_ID_2214471; Annot_ID_133094

SEQ ID NO: 16155 - DNA, 3000 bp, Unknown; identical to SEQ ID NO: 11013
  misc_feature (1)..( 3000): 2750-1469P.txt file - cDNA_ID_1377843; gDNA_ID_2214471; Annot_ID_183032

SEQ ID NO: 16156 - DNA, 3000 bp, Unknown; identical to SEQ ID NO: 5553
  misc_feature (1)..( 3000): 2750-1469P.txt file - cDNA_ID_1377914; gDNA_ID_1620801; Annot_ID_168677

SEQ ID NO: 16157 - DNA, 3000 bp, Unknown; identical to SEQ ID NO: 7258
  misc_feature (1)..( 3000): 2750-1469P.txt file - cDNA_ID_1378100; gDNA_ID_1621135; Annot_ID_56550

SEQ ID NO: 16158 - DNA, 3000 bp, Unknown; identical to SEQ ID NO: 7258
  misc_feature (1)..( 3000): 2750-1469P.txt file - cDNA_ID_1378100; gDNA_ID_1621135; Annot_ID_172639

SEQ ID NO: 16159 - DNA, 3003 bp, Unknown
  misc_feature (1)..( 3003): 2750-1469P.txt file - cDNA_ID_1378208; gDNA_ID_1620620; Annot_ID_46993
ttcatctcccaaaaagctcctagatgatggcttgtcctgtttgattaggctggtgatggtttactcaaagaacagactcttgaatgttatggaaaaaagaacggggaaatggttttcaacttttcgtactattatcaatgactcatagcttcttacctgaaatccctttacctgaatatttttccacttaagtttttttattgttttgttttctacgctctcaattttactctgcctgtctgtacctcttgcaggaatggtctaaacaaggatggtaagtatgcatttgcggagatgatgaccgaagacgtagagacttgtagagatgaacgatgctaccggctatggatcaacagcctcgggattgacagttatgtcaataatgtatttgaagatgttagaaatgggtaatctttattttgagcttatagtaaatcaagcaattagtagaaaattttcctgcagttgatgacgttgcatttggaaaatactgaaaacgctctttggtcctgatgccttttgtttgttccatttactattttatgcagatggattcttcttgaggttcttgacaaggtctctcccagttcagtcaactggaagcatgcttccaaaccaccgattaagatgccgtttagaaaagtagagaactgcaatcaagtcataaagatcgggaaacagctaaaattctcacttgtaaatgtagctggaaatgacatagttcaagggaataagaagctcattcttggtaatcattacccgagagctcatgtttctcttagcttgatacaaaaacatgatcgccttgccttacaaactggagatttatatggttgtgtatctcaggtctcttatggcagttgatgagattccatatgctccaacttctcaagagtctcagatctcggacactaggtaaagagatgactgatgcagatatcctcagctgggccaacaggaaagtaagaacaatgggacgaaaattgcaaatcgagagtttcaaggttcctttctttacaactacttcaaacacttaccacaatagtattatataaagtatgtccacctatcaccttctagtgaatcaaattaaaattctccaggacaagagtctatcgagtgggttattcttcctcaaccttctatgggcggttgaaccaagagttgtgaactggaatcttgtcaccaagggtgaaacaggttttcactactctttttactaaggtatagttacttactccgtttacctgaatcaaagcttatttgattattatatggttattgaaacgtacagatgatgagaagaggttgaatgctacatacatagttagtgtcgcaagaaagctcggttgttcggttttcttgttacctgaagatatcgtggaggtaagaactgagagactataatgtatcatcatccgaaatagcaattgctcagatgagatgtgttttggtatgttgtgacaggtgaatcagaagatgatcctaattttaacggcaagtataatgtactggagtcttcagagacattcacgggagagttcagattcgtcgtcaactcagagcaccacaacgacgtgcaccagcacagcctcgtcccctgccccatctgtcacagaagaggaggaagtctcctcattgagcggtgaagtcacgagcttggccgttggtgatgcggtttctgaaatcaccacggtctcagaggaagcatccatcgaatagagagagcgagatcacatatatactgatatacatctcttgctatagcaaagtagctgttataatagtgacttctctgtaatcttttgtttttttgtttcatcaactaaaattaccaaaaataataacaatgttacaaacactcaatcacatcgagaaaagtaaagtaaaattgtgaaaatttgtttagtacttaaaaagttaggaggaggaaaaagtgtacatcttattttgaaaacagacactacgcaaacaaccatggatcagacgacgatgatccacaacagtcaaggcaaacaagagatagatagctcaacagacgatgaagatagagaagatggaacgagacatgcagacaaaagaggacttgaaaaccgtggcgttgggcacctctaagatcaactacatggatcctaggatcacggtcgcatggtgcaaacgtcatgaagcacccattgaaaaggtagttaattatatacaaaacttgaatattgatctaccatgaaacaaagagagtcctctaataaagttttttttttgtaatggctggttcgttaatgtagatattcaacaagtcacttctggagaaatttgcgtgggcaatggacgtagaacctcacttcacattctaatatgcattgcactgcagcagctgatgagagtttctctataaaacagagcaaagcaggctacattttttttcttccaagtagataaattctttttgtttgtatctttatttgagatcatgtcttctttttttttcgtatatacaattgttcattgtttgcttgaattcaaatttagtctgttttataaaaaatgaaaccataatctttactattttaaaccataaaaaaaaagtcaattgtaaatacaaaacaccaaaggccaattaagatttattccaactggaaggatagagcaaaaaaaaaagaataatctggcgcaaaaatgacttacacaaatcaataagttttccaaattttgtttctttagcagaaaatcaaaaatgttattttggtcacaaatgtaaaaattggtataaacaaggttttaacaaaaaaagaaaaatatatatatacaaaggcaaaattacccctgagaaaatctggggccttgacacgacgatcctccatcatcctcttcctcgaggaacttcaattccaatctgtgagatctctgcacaacatcttgtctattttcaatcgaaacctctgtgagatcgcttttgatttttgtaattctcgtcgcaggatatctctctcattgggatcagacatg

SEQ ID NO: 16160 - DNA, 3003 bp, Unknown; identical to SEQ ID NO: 16159
  misc_feature (1)..( 3003): 2750-1469P.txt file - cDNA_ID_1378208; gDNA_ID_2926189; Annot_ID_140956

SEQ ID NO: 16161 - DNA, 3000 bp, Unknown; identical to SEQ ID NO: 4367
  misc_feature (1)..( 3000): 2750-1469P.txt file - cDNA_ID_1378280; gDNA_ID_1620702; Annot_ID_165117

SEQ ID NO: 16162 - DNA, 3000 bp, Unknown; identical to SEQ ID NO: 4367
  misc_feature (1)..( 3000): 2750-1469P.txt file - cDNA_ID_1378280; gDNA_ID_2926189; Annot_ID_200891

SEQ ID NO: 16163 - DNA, 3000 bp, Unknown
  misc_feature (1)..( 3000): 2750-1469P.txt file - cDNA_ID_1378400; gDNA_ID_1621142; Annot_ID_172884
attccggtcttaaactttgttgctagactatgctgggagttactcgacttcagcaaggtaatcatcgatctctgctggtgttagtaccctgcattaatcccaaaaaaccaattgagtatcaacaacattctattcaaacatcatcagcagcaaaaaagattctttgtttcaaagaaaaagggtacctgaaaactttgtcagcaccgattttgccaatttcaatatttttgcttgagatctctccctcaaagctatcacaaacaaaaaacaaaagacaaatgaggtgaaggcttttcggcacagtgtatgaagactaaagttacacatgtatgtatgtgtgtgtgtgtgtgtacaccatcatcagaaacagcttaaggtttaccacaagaatacaaacgttttaaaaccctgtgctttcattataaaagacagtgctatgggtttggtaatctatcagtcacactgagagtgtgatctatgaatatgaagtgaactctgattatcaggcgaactactttctaataataatgtagatttgtacttacccttctttcaatgtcagtatcgctgtgtgaatggcatcgtcaagttccatgtcttctgtgtacctgcaaggaaatcgtaattggttaaggtttgtcagcgacgaagagtggtttcatattgttatgacaggagcctatattatcgaaatttgagtagtaaaagaaaattttcaaaatcagtatactggttatatatctttggatatcaacaaattgtaaacagtattaccttttctcaaggaaggtttttgcattagaaacgttcttccccatggctgaagctttccaggagaaataagagccagatggatccacctagtgcaaaaacaaaatgatttgaattaaaccccgagtaaggaaattcaaaagcaaagttttaattctcaggttatattctcaagatgagatggtaattcagtttagacagaaacataaggtggtaactattgtaacatgatagaacagaaaggtaaatactctgctacaagttttgctaaagtttagtatttcagcgctgaaaagaatggaaattgagctaagaagattgggagactcgattgtgctcaatcaactaacacatatcctaaggaggaaaaacctgatacaattgtggacccttgtcatcatatccagccaccagcaaggaaaccccgaaaggcctaacacctctataaacaagagacagtaaccaaaattagaaacaggatatacaatgggtacaaatttgctaaagcaaaattatttcagagaagtaatacaaattagaaacaggatttacaatgggtacaaatttgctaaagcaacaaaatttacgccaagtcaattttcaaatctcaaattgcaagtgaaaagctaccactcgacagttacttttgctgaagaaatagttcagttcaattcaaacatattaggactatgggaggaagtaaaaatatgacagatgaggttgaatttacagttaaatatagcactcaccccgattgagtaaactcttgcataacagtagcggtttcccttacaagttgggtaacagggatgggttcctgtaacaataaagcttccttaggtgaaaccatatcacattagcaagtatttcaagcaaatttgagaaaagagagagaaaggattactttgtacagacgaagatattgctcagcctgtttcctactcttcctaacaagaactcgaaaatcaggacccatgccacttcatagaagaaaatgcagaaaaagttagtccttaagctataacatcaaaaacaaaaacaactaaaaacttaaaataaatgatgagcaaacctgtaaacaactccaatattaggagtcaaatgctgaattttttgaacctgaaacaggcaaaagagaaaactaatgtcagagatgttgactaaattacacaatcgaagaaagcatcacagagcatggctatatggtaatgatacgaatattcttgttgattatcaacttacagatgcttcatcaaccagaatagaaggcaacttcttttcagttgcaatgacaactccattagaagctgcagtaagaaaccaagttatcagaagaaatctacaaatttttcattgatctataaacaatttcatcatgacattgacaaacctttaatccctaaagatgtttggccagatccaacagctgtaagggcatgttctatctgcaccagcttaccagatgggctgtttcagacacagtacaacaaattagtcgcagcaaaaactaaccaaaatactcactatgattaaccaagttcgtacctgaaagtggtgagagaaaacgagtactgactatctcccatagctccttaagcaaattagcgaaagctgtgaacaacacaaacgagtaggatcaatttccccggaattcagggtttcaacgtcaccgggatcaaacgattcaggttttggtttggttaaatcattagagtcttaaaaacaatttgatagaatgggatttttgagatcgacacgaatcttcggaaaagaactagcgctgtgaagagaatagcttacctttagcttcagcttcgagatcgaacaagtgattagttgcagagagagagagagagaggtgaaataaataggcttttaggtttcttgcagagaagagaaggttgaagtgagattttacgaattcttttctggaagaagaaaagggaagtaaaaccaaacgactgcgttttatcagaaacgcgatttttaataaagagaacgcgaacgcgaattatatcaaagagaaggcaaacgtgaattttatataattaaacatgcgttagtcgcgtcacttatcctgatcactagtgatcagtgataatctattaatcatctaggtggcagaagcagcatcgttgagaacgaagaagcttgaaaaagttgcgagctcagagaatctggaagtagcaaaatttggcggctttaactcagcaatttgttctgtacatg

SEQ ID NO: 16164 - DNA, 517 bp, Unknown; identical to SEQ ID NO: 164
  misc_feature (1)..( 517): 2750-1469P.txt file - cDNA_ID_1378446; gDNA_ID_3474; Annot_ID_146327
  misc_feature (162)..(162): n is a, c, g, or t

SEQ ID NO: 16165 - DNA, 3000 bp, Unknown; identical to SEQ ID NO: 6723
  misc_feature (1)..( 3000): 2750-1469P.txt file - cDNA_ID_1378577; gDNA_ID_1621102; Annot_ID_171459

SEQ ID NO: 16166 - DNA, 3003 bp, Unknown
  misc_feature (1)..( 3003): 2750-1469P.txt file - cDNA_ID_1378577; gDNA_ID_2926189; Annot_ID_200870
accacaatcagctgcctccgcctctgcctcctccaccggtgcagcgtagaagcagtggcggtgacgttttcatggaggcaggtcgtctagcaacagagtacttggtttctcaaggtgttctaccacaaactgtgctttccagtaaatggcagaatggtaattttaggaagcaagctggagagtttcagagttccaggtctcaagaagaagcccgaatggatgtttcagctccagctgcagagaaaaggaggtatattgatggctatagctcagctggatccaggaatagcttgaaaggaaggagatcccaccgttatgactcggattttgggaggagcggatcttggtcagagagaagtaaagcttttgagactgagactggtgacgactctgtgtctgggcatcaagaagagcagccgcttgctgaagatattgctagctcggttcagcggtcagcctctggtgaatttatgagaaaatgtgaaggagcaggtgattccgagtctgtgttggacaagtacaatctccaggatgaggcacagtctaagacaggttcctcgagtgccgggaaagatatagtacaggattgtgaaatctctaaagtatccgaaggctcttctagcttgagtgctggatcaggagagatgaaaggtaggtctggtggtaatggtggagaggatgagaaccagactgctatcgaagatggatctatccatcaacgttgtgaagatgcatctattgatcaacagtgtggggctgatgaatcattcaccaagagtggtattgatttggcaacgctgtgtaaatttgagaaggtgcctacgaggacacgctcttctctgactgcaaaaggcccaaagctttatttgagtcataatatcaaggatacctctcataattctggacttgaagaagaagatcaaaccgaaaatcgatgtgagactcgaggccaatcatctggaaaggccgatagtactggtgatgaaaatgaccaagttgaagattttgctcttgttcaatatattgagaacagtaaatgtcataggtctaattcttttcccagtagcattctcagggataacagtgagaaagaatcaggattagaattgcctaatctgcacagatcacattcggtggggaaagtaggtgagaaaaggcctggtgaaggcagtgacttggaggagggatcaaaaagacagagagattgggtggcagtttctgaagctaatgaacgcttcaacatgtttaaaacaagcggaaaccaatgcgatccggaagaagaaggaaagacaagctcgttcaacaaaagactgattgacggtgctgctggaaaaagggtcagccatgaaagtctggttaataactctacatacaataggacacacactggcagaacaggtccagggtatgctgaagaacatcagctgtttcctgcttcgtttaagatgtgtgacctaaatctagggggagcgtcggatgtgaatgatgggataaaggaatctcgtcaagctgttgattttgatctctcaatcagcagttctagtaagtctctcgagtttggtacgagtactcggatgagcaatggtaaagagatagaagtgattaatttggatgatgatcaagaagtggtaaagtccagcaatgatccaggaagaaagtacggccaagtcctactcttaacacttatatatacacacacctattacattttggctaatgggttttcatatctaacaggcaagaagctgctccatatatgggcatcgatgacgtcccagactacaatgaaagactcatgatggtagagtatcttgattcctttactccaataaaccagggaaccagtagtgtcccacagaataacaacacagttagccttcaagaccgagaggtacctactctacttgtcaagttttatgtcacatagaatgtttgttgttgctaacagatcctgaaaacgtctcagggagctattggaaatgaccaagtaccaaataatacagacgatgattcgatcttcatgtcactcggagaaataccattgagtaagaccaatatcaaattctttctcttttctattttagcttcttaaagagctgagattcattatgtctttgcaattgtgcagcattcttgcaagcttgggaccaacctccagctcgaggctacgagaagcctttctgattctctttttttttgttatgtttcttcagtctgtgtaatgagtgtgtagtagcccaatttcgtttgtgctaatctcaatcctctcagatgatgtaagaatgtgacttgtggtgttttatggttgtatgtaccctttgtaattctctgtttattctcacactgtccccatgttttaggtcagttcaacaattttctgaaattgtaataaccaaaatgataattattaacggtatatatatgtcgtgtccaatctcacggtcaaaaatgaagaaggtgatgctgagaggtcaggcgattccgacacgtgttatattccaaccacccacacgtaattttcaaaaaggaacaaaattgatcatgagggaaaaaagaataaactttttcccacaaagaaactttccacattgaacgagagaattatagatctgcgaatccgatcattggattagggttttcacttttcaccctcctttttccatctctctgctgtatacccttcctttctccaaaaagaccaaaactttgcgattcaattcgaaatctgtgttcttccattgagctggattttcatttttggaatcatttcttctcttctttgatccgatagatggtggcatggtaggaaattttagacctttatatttctatttaaccgtcaaggaaccaatgaatttgtatagcttgttgagttgactttttgattgtgtatgatcgaatttgggatcctcatttcgggttttgggttattgatctgagctcctgttacttctgaaaccgatgtgaatttggtgggggatagatttttttgtggagtcaatg

SEQ ID NO: 16167 - DNA, 3000 bp, Unknown; identical to SEQ ID NO: 8686
  misc_feature (1)..( 3000): 2750-1469P.txt file - cDNA_ID_1378584; gDNA_ID_1971851; Annot_ID_58418

SEQ ID NO: 16168 - DNA, 3000 bp, Unknown; identical to SEQ ID NO: 8686
  misc_feature (1)..( 3000): 2750-1469P.txt file - cDNA_ID_1378584; gDNA_ID_2926180; Annot_ID_140503

SEQ ID NO: 16169 - DNA, 3000 bp, Unknown; identical to SEQ ID NO: 1264
  misc_feature (1)..( 3000): 2750-1469P.txt file - cDNA_ID_1378596; gDNA_ID_1620377; Annot_ID_155189

SEQ ID NO: 16170 - DNA, 3003 bp, Unknown
  misc_feature (1)..( 3003): 2750-1469P.txt file - cDNA_ID_1378727; gDNA_ID_1620490; Annot_ID_158578
acccagaaccttgaacgtgtatgcgtgtggaaacctcaacacatgcacaaacatgcacacacctaaattgcgtttaacattacgatttaaatgtgattttctcaattcgaatccaatttatgtataccaccaaattattacgtaacaatccgaattctaattcttgaatgactaacacagatgaatgaaaaaaaaataaaaaaaatagatgaatgaaatccatattccgtagtggagcaataatgtttataaatatatcattttctaatctcttcagcttaattagcttagagctgtaatacccacctacaatcatatattcatataaatttatgttaaagttatatttattctttaaatttcacatataagtatattattaagtgatttgattgtgaattatcatcacatttggttgccatgaataagatcgtgacgaaagaacaacaaaagaaattgtgtcttcatctggaaataagtaaacaaagacaaaaatatctctgtcgtcttttatcatcagtgtgttattgtgctaaaaaaaagttatctttgattcgaatatgatagagacccaaaggagtatataattataaatcatttttattcctatatatagtccgaatctatcttatgttcactaatatttgattaatttaaaccacgaaatcaatgtatttctttcacaaattaatgaggtagaacggatgcatttgcatttatattcagtaggaaccttatttcgaaaagcgcaaagaatttaatataatgaattaactcactttcaattggttataaaataaaaatttagtacttttttcttttcttttttttgccaatttcttatctccatacgttcttaatcagaaataattaaatattattagtcagaacctacaacggatcacaaaattgttatacttatatcaaaaagatttgaatgatatatcacttctcacttctgaaacgcaattcgatgaagtgatactattcataaaatttcatgttaaatgataaaagttaaaacgatttttcaatttttcgcacattttaaaattacatctaaaattattaactttttcaataatattttattgtttatttgagagtggaaagtaaaatgaggaagtggcagaggaacagagccatgtaggagccacacgaacatgtgctttgtggtaacagtcagctactacatgttgcagccgtaccaccataatatattagttaatggattaactcttttaataatcctctcttattgcttagtaagttagtttacaaaagcaaacgatctttttaaagtctaataatcccaaaataaaagaaaaacaaatattgacaaaatcctaacctaatcaacatcagtctcttgttttaatgttaatttcaacttggcagttcttatctatcccaatctcatatggtttattatcattttttttttttgtctttttatcactatggtgtattgtatctagattgaattagattcttgaaatgatgtaattgtaagaatatctaacgtcaagaactttgggattaaatttaaatttataggaaagaatggacttaagtaaggagataatatttgcagctatatatttgacaatggatcatgtcatcatacatttttttgtcaactcttaaaatcttaattcaagaaatgtttttttttttcttttgttttaatctgtttttgtcaatattaaaaccctattttgtacaccagggtcattttcattgagtaaaattcttaaaaacttcaaaagtttatgttgttggcaaaggaaatacgtaagcgtgtaatatgtacagttggaatagtgtttttgctaaaaagaaaagaaccatatgattgaaacaatggaatatataaaaagacatgtgataaaataaaatacaaaaatagtcaagaacagtttaatggattttccttgcaagtcgtcatgctcatgaacctgttttaattgcatgcttacatataaaaataattaactcaaaactcaaataagatcaaacaaaatatcaaacttttgatacaaatttaactgtcttatatccttgacaaaaaaaaaaaaaaaaaaaaatttaactgtcttatatcttggttcttaatcccttgtgaataaccataattagttgctagaaacaccttgcaaatttcataatcaaagtgattcctaatttatgtgcgaacagaatattaatagttgtaagcaatgcaaaaacaataccaaaacgattattcttgatgaaaagatggaaaaaagctaagcacaactaatgttcaaatttctaaaattagttaggcagtaatctggcatttaaacatggtgtaatacctagtaagccaatcagagattaattggaattttgtttttcccgtattctcgtttttattgtaattttaccacttctagccatttataaatattcaaaattaaaaaaaaaaaatatcttgtaggactttattttttttggagttttaaagttcactgataatttaaccaatttagccaaaattaaaatatttgaatgttttgataaatttttaacatttcgttttccaaacatgtaaatttgaaatcgatacatttacaagattagcacaaaccattatgctaaagttttagtcggtgcaacatatataaatatgaaaaaataaactattgaatatatacacaacaaaagacaatttctctattattatgttgagaaaaaaatctttttagattaaataatagtaatggctttatgggctttttactctatcgtgtccacagtacccccaactaaacaaaaagaaattgttaaagagctctctctctctctctttcataaaaaggcaagaggagagccaagtaccaaactttttccttcagggttttcctctcaaaatcccaacttggcctctgtttttgctttcttttatgttctcttcttctctaaaaaccatctcatacttccaagaatttctctcacaaagaccaagaactcaaaatg

SEQ ID NO: 16171 - DNA, 3003 bp, Unknown
  misc_feature (1)..( 3003): 2750-1469P.txt file - cDNA_ID_1378800; gDNA_ID_1620409; Annot_ID_156222
cagaggactgagaaatagagaaatgtgagattgatgaaatcgaacggtcagaaaactaccaccaactttacttatttaggtttcagatcaagccacgtggctaaattacctattgactcctctcatagtcacggacacgtgttcacaagccctgcttacttcatatagtagtcttgcccaaaacacaaacagagaaagctaagaaaactcaaaaggcggtggtgagtactggtgagagtgtgagtgaaaaaacaaaaaaaacaattcaactgcaaaaatgagttccggaatcggaagtttagtgaaggtcatctttaagaacttcgatgtcatcgctgggtaatttaattagtattatttagcctgattatgattttttttctcgttttattttctccattaatttgatccttcttggtgtgcagacctgtgattagcttggtttatcctctgtaagtttcatacaagtatctctttattttcctgagaatatattatatatgtcaaatcttgagttctttttaatttggattttggtttacacagatatgcatcagtgagggcaatagagtcgaggagtcatggagacgacaagcaatggttgacgtattgggctctctattcacttatcaaactctttgagctcacttttttcagactcctcgaatggtaactttcacacaaaatctctaaacctttcttgattacgcaagctactacttatgaaaagagagtaaggtcacagtcacacacaatatgtttgtttctagggctcttaaaatttgtgataaaatcgatgacttggattttacctaccgaccttactatatgaaatttattaaaaagttggtttggggggtacatagatttacctttcttgtagtccaagtaaggtacttcaggtaacggatgagcttatgtttaacattcctagactgacttcaggagataaactgagctgtatgtaacggtggttcattgattcaattatatagactgaagtttcgagatttatggtatgatcaggatcccattatatccatacgcaaagctagccctaactagttggttggtcttaccgggcatgaacggtgctgcttatctctacgagcactatgtgcgttcattccttttaagcccacatactgttaacgtatggtacgtgccagccaagaaggatgacgacttgggagcaaccgctggcaaatttactccagtaaatgattccggtgcgcctcaggaaaagattgtgagctcggtatgacctcttaactctctattactctataagaccctatttgtgacctaatgttcgatctataaggcacatcaatctcttgaacgtttatattttcaggtggatacatcagcaaaatatgttggtcattcggcttttgatgacgcctatatctactaggctagtagctagtaaactacttccggctagttgtagctgagcatcctgatcttagtgtatcgaaatacttgttttctcctctttttctttgttttcgggttttatgaagtttgttgttactgctaaggaattttaatatcaaaataaatgttaattgagtgagttatataattatgtaataaaatctgagcacaaaaataatagtgaactaaaaggtaagagtctagactagctatgatcaatttagtatcgtatattgctttcttcctcgaccaatgatgagagaattcagaaacgaggttttgatagcgtagctcaccgctcagtcgctcacgggctcggagtagatatattttctttcaatattcgtcgacttactcgactataaacaagcagtatgaagaagagttgacactaaagaaatggtaaagccaaaaatcttatagctgtaaagagaataagaatgagtaggtgtactagccatatattcgttttcttaccacgttaccaaaagcattgtgtgtttgaaccggagctaattaatttgattctattcacatattgtatttacatacatcatgtgaagtctgtcatggaaataaatgtctcttttcatcgtcacgaaaatatgtttaatttgatgttgtcattcttaaatgattttctactttattgttaacaaaagaaattgatttcctaccttacacatatcttgttggtaaaatagacaactaattttaataccctcatctcaataaatgctatttacactaaataaagtctgatatgagaaatgttacagaatgcaataaacagaaagaaataaaaaaaaattgcaacaaaaaatcattctcaattggggaagaaaataaagtcgaaatgataagtttcataagaaatgtatattttaccatgtttactaaaaggcaagacccacgtgggaaggcgttacatattacacagtccaaatcagcatcgttattattgtgaactctcacattagctgttaccgaaactaaccaacaacaagtttttgcctctttgaggacatttaaatatagagaaattgtttctttctttgattttttaaaaaataaaagaaaaatcaaaacttagtctattaagcatcggtcattatcacaaatgtaatcctaagcatccgtatctaataagttaagagtaatttatccacacatagagttttttttttaaaaataattatttattttctttaagtgtaacgactaataaaataagttataattaaattaagaatcaaattctctctatcttttgcactttttcttctttgtctatctctctctctctctatctctaacctttgcttctccgtccttttctctgcttcagttttctcttcctaacaagcaaaacccgaaacagatcgaaccatttttttcctttagaaattaaacaacaaaaatcatttttttgtttgttttcggtttcacctaaccaaattgattctcttacctttttatatcacattgcatctgggtttccattagaaacaacaacaaacgaaaaaagaggcttctttcgtttcagagaggggttcaaaaatg

SEQ ID NO: 16172 - DNA, 3000 bp, Unknown; identical to SEQ ID NO: 12810
  misc_feature (1)..( 3000): 2750-1469P.txt file - cDNA_ID_1379041; gDNA_ID_2214573; Annot_ID_135114

SEQ ID NO: 16173 - DNA, 3003 bp, Unknown
  misc_feature (1)..( 3003): 2750-1469P.txt file - cDNA_ID_1379043; gDNA_ID_1620721; Annot_ID_165832
tacttcttactaatggttatctctctatctttcatctaaaaatatcttaccctttagtgagctcttaaattatgttgttcaattttcttaacaactttaattatgttttaggtattaccgatcacatcattgttcaatagtaaatgttatgttgttccctttcgatccagaacttggtcgtgtacattactaagatacatttgtttttaactataaccagatttgcttatccagatcggaaaatataagtcaactacttgtgttcttgctaccaaaaaaaaagaaaaaaaaaagagctacttgtgttccttcttttaatggaacttataagcacaatcaatctcttaacaatcgttcttctactcttcgttgtttccaagatatggaaagcttgttggatcctccttttgcgtccattgatgctatcaaaaagattcaagaaacaaggaatctcaggaccaaagtacaaaatcttgtacggaaacctcagcgagataaagaagatgaagaaagaagctgacctttgtgttctggatcccaattccaatgatattttccctcgtgtgtttcctcagtatcaccaatggatgtctcaatacggtaccgttttctatccatcttgttttttttttcttcttttcatagatgaggattacttaacacacacataagttgtctatgatatattaggagatacatttctattctggactggaacaaaaccaactatatacatctcaaatcatgagctagcgaaacaggtcttgtcgagcaagttcggtttcactattataccggtgaaacgacctgaggtcttcatacttttcggtaaaggactttcctttatccaaggtgatgattggattcgccatagacgaatcttgaaccctgctttctccatggatcggctcaaggtcttttactcttaactatatacttctcagcttgatttgaaaagaactaatatattgcttgcttaaaaattgtcaggccatgacacaaccgatgggagattgcaccttacggatatttgaggagtggagaaaacagagaagaaatggtgaagtgttgatcaagattgagataagcaaagagttccataaactgaccgctgacattatagcaactactgcgtttggaagtagttatgccgaaggaatcgaattgtgtaggtcacaaacagagcttgagaagtattatattagttctctcactaacgttttcatccccggaactcagtaagtataatagtcacttagtcagtactcttctgctactctcagttaattcgtttggctaaaatattcttgagatttgaagatcgttgtttcttgtgtttcaagataccttcctacgcctaccaaccttaaactatgggagctccataagaaagtgaagaactcgatcaaaagaatcatagattcaaggctaaaatcaaaatgtaagacctatggctatggggacgatcttctaggggtcatgttgactgctgcgaaatctaacgagtatgagagaaagatgagaatggatgagatcatagaggaatgcaagaatttctactatgcagggcaaggaactacttcgattctattgacatggactacgatgttactaagcttgcaccaaggttggcaagagaaactcagagaagaggtttttaatgaatgtggtaaagataaaatcccagatacagacaccttctctaaactcaaattggtaatgttcattttcattgtgttacttgcgggtgaagaaaagggttttcttacacctattaatcttgcagatgaacatggtgttgatggagtcgcttcgtctgtacggacccgtgattaaaatttcccgagaggcaacacaagatatgaaggtaggacacttggagatcccaaagggcacaagcattatcataccgttactgaagatgcacagagacaaggccatatggggcgaagacgccgaacaattcaatcccttgagattcgaaaacggcatttctcaagccaccattcacccaaacgctctcctcccgttctcaatcggaccaagagcttgcattgccaaaaactttgccatggtcgaagccaagaccgttctcactatgatccttcaacagttccagcttagcctctcccccgagtataagcacacgccagttgatcacttcgatctcttcccgcaatacggcctacccgtaatgcttcaccctctcggatagtagttctgaatggtgaggaagagaaaaccaagaatctcaacggatatttggtcacgttatgttctatatttggccttggtcacaaataaagttcagatgatataattcaatagtggataagtcaaattcaaagtgaagtaaggaataaaaatctgaacatgtggtggttgttttagtttcttgattttcatagtcgattctatctaaatttgattatgcttttgaacaaagtatttctccctaatttaatagtgggaggtcgaccatattccgaagtatacaacagaacctagtggattaaaaaccaaatcactcgttgaaaatttcgactctttgggttgttcccacttccactacaattaaatcaaatactaggcgtacaactaaatcaacggcatcagccccattccttcaacgtatggggtcctctgtgtgtctgtctctccaccgacactctctttatcgttgatcactccaacggaccgtcaggataatgccacgtatatttcttctattatcctctgcacttaacacacggtggactacgtactctcacgctgcttcagattcgtacattgcgatttggaatgtttattatatacccaaagagcaaaactttaggtgggccttaaactaattaatggcatttacgcgtcagtgagagtggagtatataacaatctgaagctgaagaagaagaattgagagataacagagagatagtttcttcttcatccaaaagaatccaatcttttcctcaaaagatagtttctggatcgaacgacaatg

SEQ ID NO: 16174 - DNA, 3003 bp, Unknown; identical to SEQ ID NO: 16173
  misc_feature (1)..( 3003): 2750-1469P.txt file - cDNA_ID_1379043; gDNA_ID_2926191; Annot_ID_201064

SEQ ID NO: 16175 - DNA, 3000 bp, Unknown; identical to SEQ ID NO: 5802
  misc_feature (1)..( 3000): 2750-1469P.txt file - cDNA_ID_1379064; gDNA_ID_1620818; Annot_ID_50674

SEQ ID NO: 16176 - DNA, 3003 bp, Unknown
  misc_feature (1)..( 3003): 2750-1469P.txt file - cDNA_ID_1379075; gDNA_ID_1972119; Annot_ID_178878
tgcatgaatcatgatgacaaactgatggaaacaaataatcagctggaaggaaatgatgaggcaaacgactcagggttcagatctagctaccaaaatcacatgtcaatacacatgatcatctaagtaaattttcacaagtgtcttttcaaacagttgaatgagtatgcaaaagatgatgagataacatgtaaagttattgtggtagctgaattagttccagtttatgattagacacatcatcagaaacattattgataaagaggaaaatgacttaccaagtgttgcggagtcgaaagtcttgatgccatcaacgccgttcaaatcgccgctgaggaccgtcaagtctctgccgtcgccaacgagggttaagttagttttcttcttcccgatacgaataacttccttgtataacccttctttgatgtagatgacaaaaggcttcacaccattctctggagctgctgcaaccgcttcattcaccgtggtgaagttgccgctgccatccttggcgacaatcaagtcggctttatccttcaatgcctgcaaattatgtttaagagaaaaaaaaatgaaatagttaataaaacatatgaaagtcaacaataaacatatgaaacatatgaaagtcaacaataaacaacaattcaaagataaaaaaaaaaaaagaacgaatcggagttttaggcttcagatatttgaggtattatctcaaaagacaaatatataataaaacaggaaaattaggtttttacagtgaaacaaactctgtaagaacatggttcgtcggaagtgacaacccaaagctcagatctgatggataaagttaaataacttgttcatatttcaacaatggtgatatttgttttgctaacacaaaaaaattgaagcttttctgctaattagagaaagttggggattatttctttaacaacaaaaaaaagttggggattattttgatcatttcccattgttgatttgttgtccataagtttttcattttctaatcgatttctgttttcaaagctggaactttattagttataaacgctagagagcctaaaagttggattcgcggatacaaaacaaaaaaaaatcgattagcggacacacaaacaaaataaaggttttcctagttacctgatcgggcgtggagatcaaacttgctggaggagccaccgttgccccaagaaacagtgaggctattacgagaaaactcaatactaagagctgcatggtactggtcatcgccattaggtctctaattctctatctctcgaaaataaaaatcagccgaggaagtgtaactgaagaagagagaatgagatgttgcagagtagaacttaattttgttatgacttttgagtcttataattacttctcatacatatagtttatacagattatatataccaagtttaaacgctagtggaacgtctatatatctctgcatgcatgcacgaataaggaatacatcctataattgtccatcctataattgtcatgattgaatggtccatgacgacaaaatttcctcatatgagtgtgaacgcatatagataatacaatattaattaacaataaatattaaaccagacacgaaaccaaatgtttgtgttgttacacttaacatatatgtaagtatattgaagtacatgttctcagcattttatggctttgtatgatgttagaataagaaatgtacgtataaatgactttttcttttttggtcaaatgtataaatgactaatgaaattcattattcattgacctgaggttaggtggaccactgatctatatatagtcacgctcactgcagtgccaggatcaacatatatatataaataataaattgcataaataaacataaattataagtcaacaatgtagttaattgcataaataagaaacaaacaaaagttataattgacaaaagaacaatgtagatgatgttatggagctttttacaaaaaggtaaccaacattttcaatgaattatgtaaaaataaacttggttctcaatttttttgatacctctatctctaacatatgttgccaatcaaatcgtatttcttatccaatcagagaattataaatattcttgtccatatttattatgcacttacactatagtcctctttttgtgtgtggttagatggatgggcttaagatctaacggctatagaggtgggagtaaatctcacttaattaaatagtaccggaaacacttgataattcattcaaaaatatttcctgacttttagggttttctatcgattgaaattgagttaaaaatccctaattccaaagctactctgattttgtaaagtgaaagctatatgccacagagcactcgaagaagaagctagactatggaacgcagaaggagagattagggagctattcaactccatctcagtatcttgttaccaaatttaacaaactatcttaaaacggaaaacacagtattaatggaggtagatgcgactataaactcatagtaattgctaaattaaaaacttacctataaactaaagttgcaatttaaacaaacaatatacgtagtctggagccttaaattagccaaattatctgtctttagaaacgttattaattcggtatttttgattcacacctcttaccatatttacatgtgacaattaaaaaataaaacttgctttttcagaaaattataaaatctaaatataagaattgatacgtatttataattgagcatattggataagaataaacatcaatcactctttccactagacgaatatcttacgtggcaacagctgtaccgttaataatgacagtttttagctgtgtttatgaataattaattacccgccaaatcactaacgctttaaaaaaaacaacaactttaagaaaacaaataaataaataaaagagtatcaaaaggcgttcaccaaaaaaggtacaaagtcctttgggagaagatatcatcaaagagaaaagccctaattaaatctctcatcaatg

SEQ ID NO: 16177 - DNA, 3000 bp, Unknown; identical to SEQ ID NO: 1363
  misc_feature (1)..( 3000): 2750-1469P.txt file - cDNA_ID_1379170; gDNA_ID_1620392; Annot_ID_155644

SEQ ID NO: 16178 - DNA, 3000 bp, Unknown; identical to SEQ ID NO: 9589
  misc_feature (1)..( 3000): 2750-1469P.txt file - cDNA_ID_1379239; gDNA_ID_1972158; Annot_ID_179496

SEQ ID NO: 16179 - DNA, 1256 bp, Unknown; identical to SEQ ID NO: 468
  misc_feature (1)..( 1256): 2750-1469P.txt file - cDNA_ID_1379239; gDNA_ID_1591265; Annot_ID_150751

SEQ ID NO: 16180 - DNA, 3003 bp, Unknown
  misc_feature (1)..( 3003): 2750-1469P.txt file - cDNA_ID_1379513; gDNA_ID_2214519; Annot_ID_134024
ggtacggtgctcaagccgggtaccagggcggttatcagactcagcaacctggtcagggcggtgcgggaagagggcagcatggtgctgggtatggtggtccttacatgggtcgttagattagccactcaggtaattattttcagcttcttttcatctatttcattgatgttctgtatcagaagactttttttgtagttcgcttggttcccttgtgtatttcaagacatggacttgctgtattttgaccttttcatggttactccattatgttaaactttttgcgttgcaagatcattttgttttcaaagttcctgtgactttgttgtgtttctgaagggtgttaggttttgcatcagtttataaaagtcttctcttaatttcttaattcattgtgcagatattccaatacagtactttttaaaattggcctggtgaatcttctgaagttattaaggagctgatgcaaatggagttgtttagtttttggatgaaatgttactctttcgtgtcttcaaaatacatgactcttcaaacctttcaagaagttttagttttcccctacttgttttctcaactctttttatgatatcccaaatacactgttctgatttaacaactatcgtttctgttttaaacttttgggaacgttttcatttgtaaaacttaaacagtgttcctcatggacacacaaacgctttcactatgtttgaatccgtattttccattttctcttaatcagactcgtttttattggttctcgctatgtttcgcggttttgtggaatttttccatgcacgtaattcctcttaagattttgaccttgtgagagtatgatcacacatcactatgcatatgtacataacggcttatcttgattaccacatattatatctgcttaatccttattcctcttgcaggtaatttaagagcaagctgaacggtcaacacttacgcccaacaaaaatctatggggtaccaaatatttgaatgccacctatctgctttttcttttatatatactgaaaagtgaaaagggatgaatctatgaattggtagctttataactaaagaacgaattaagcaaaagttgttttcttgtttaacttagctaggcatctacctgaatccaaaagagcaacttgttttgttttgtactaataagtatcaacaagtcttgacctgcacatgtcaagtttttgacttgatttagagcagcttgtttcttgtgtgtccttggagttctctactgtttctatagctttgaatgagctttccatttgaccacatctcaaaaaatttggtaatgtgccttagaataacaccgagtttggtaacacagctggaattggtgttttgctgtggcatcatgggagctctgaaatgtcttcccagttaaaggtgagtataactgtttgcattgtgaagatttgtattaactatagaacattgaattgatggtgttaagttcttacacaagcgtgcttctcggtttgaactgtttcttttgtatgttgaatcagagcttagtttataggaaccagagtatctacttagtcattctctaatgctaagtgctaaggttctacctagttgccctctaggcccttatgttattgataacttatgaagctatttgaacacttgattcttaggagacctaagttggtacagccagatagagtgtatgttcttgttctctatgtgacaggatcaagctgccacacatagttcaagggtatgctctgtgtgggtttgctcagattgaggacaaatctatacaaggaagtagagtctttgacattttgatgttgtatgataagaagaagaaaggagagtaataaagaaagagaaaagggaaacagaaacacgtgggagaacatcccaaagaggaagcacacgcggatcttcatgcaaagctccccgattctcccatgtggtccctttctccctttgtccccctcctctttcttcttttctcattttactcctttttttaccattatacaacgaatcttttttatcataattttttggttttggtttattttccaataacaccttcttggttacttcccattctcactttttcatataagaaactcactttgggaaacttatgtttgagaatgacaagtctttttagagaaagtgatgtaacaaatctaaagtgattatataataaccttgcacaatgtttttgattttttgtaagattcgaatattaggtttattattcgtagggaataaacttactttcaaaagcgttcataagttaatactttcatatatgatcataagtacggacactattgttttttgtttgtttgtgtttattctaaaagaaagtagcttttaattgaaatgtcctcagaggcacagtttaaagttcgagtgtaacagtttctaaggcaaaataagctctctttctactatttctctttctctttctactatttctctcctgtggagaaactcaggagatagagagagagagagagaagagaagagagcatgtatgtttggttttataatctctctactcataccaaagatttgtctcagacccaccacttggacagagagaacccaagctcctttctctctttttctcgatctactccttcttaatctccttttttgaaacttgaagccactttcaacatcatccttaaacttttgttcccttattcacaatctcctgccacctctcatttctctagttgagttgttatctgcgtttttaagcactcgaatactgcatgcaaattccctgattgtttgttagtaccttagagattctcgattttttagttgtttagattgaaccaggattactaaattgttattgttttctgtgtaaaggctacatatatgggttctattagaggaaacattgaagagcctatatctcagtcattaacgaggcagaactctctctatagcttaaagctccatgaggttcaaacccacttaggaagttctggaaaaccactaggaagcatg

SEQ ID NO: 16181 - DNA, 3003 bp, Unknown
  misc_feature (1)..( 3003): 2750-1469P.txt file - cDNA_ID_1379513; gDNA_ID_2214519; Annot_ID_184549
ggttgggtttaaaccaagcatttgggcaggctttgttggggacattagggacagctagcccaggagctgtaggtggaatgccaagtggctatggtactcaagcaaatatctcacctggggtctatcctgggtacggtgctcaagccgggtaccagggcggttatcagactcagcaacctggtcagggcggtgcgggaagagggcagcatggtgctgggtatggtggtccttacatgggtcgttagattagccactcaggtaattattttcagcttcttttcatctatttcattgatgttctgtatcagaagactttttttgtagttcgcttggttcccttgtgtatttcaagacatggacttgctgtattttgaccttttcatggttactccattatgttaaactttttgcgttgcaagatcattttgttttcaaagttcctgtgactttgttgtgtttctgaagggtgttaggttttgcatcagtttataaaagtcttctcttaatttcttaattcattgtgcagatattccaatacagtactttttaaaattggcctggtgaatcttctgaagttattaaggagctgatgcaaatggagttgtttagtttttggatgaaatgttactctttcgtgtcttcaaaatacatgactcttcaaacctttcaagaagttttagttttcccctacttgttttctcaactctttttatgatatcccaaatacactgttctgatttaacaactatcgtttctgttttaaacttttgggaacgttttcatttgtaaaacttaaacagtgttcctcatggacacacaaacgctttcactatgtttgaatccgtattttccattttctcttaatcagactcgtttttattggttctcgctatgtttcgcggttttgtggaatttttccatgcacgtaattcctcttaagattttgaccttgtgagagtatgatcacacatcactatgcatatgtacataacggcttatcttgattaccacatattatatctgcttaatccttattcctcttgcaggtaatttaagagcaagctgaacggtcaacacttacgcccaacaaaaatctatggggtaccaaatatttgaatgccacctatctgctttttcttttatatatactgaaaagtgaaaagggatgaatctatgaattggtagctttataactaaagaacgaattaagcaaaagttgttttcttgtttaacttagctaggcatctacctgaatccaaaagagcaacttgttttgttttgtactaataagtatcaacaagtcttgacctgcacatgtcaagtttttgacttgatttagagcagcttgtttcttgtgtgtccttggagttctctactgtttctatagctttgaatgagctttccatttgaccacatctcaaaaaatttggtaatgtgccttagaataacaccgagtttggtaacacagctggaattggtgttttgctgtggcatcatgggagctctgaaatgtcttcccagttaaaggtgagtataactgtttgcattgtgaagatttgtattaactatagaacattgaattgatggtgttaagttcttacacaagcgtgcttctcggtttgaactgtttcttttgtatgttgaatcagagcttagtttataggaaccagagtatctacttagtcattctctaatgctaagtgctaaggttctacctagttgccctctaggcccttatgttattgataacttatgaagctatttgaacacttgattcttaggagacctaagttggtacagccagatagagtgtatgttcttgttctctatgtgacaggatcaagctgccacacatagttcaagggtatgctctgtgtgggtttgctcagattgaggacaaatctatacaaggaagtagagtctttgacattttgatgttgtatgataagaagaagaaaggagagtaataaagaaagagaaaagggaaacagaaacacgtgggagaacatcccaaagaggaagcacacgcggatcttcatgcaaagctccccgattctcccatgtggtccctttctccctttgtccccctcctctttcttcttttctcattttactcctttttttaccattatacaacgaatcttttttatcataattttttggttttggtttattttccaataacaccttcttggttacttcccattctcactttttcatataagaaactcactttgggaaacttatgtttgagaatgacaagtctttttagagaaagtgatgtaacaaatctaaagtgattatataataaccttgcacaatgtttttgattttttgtaagattcgaatattaggtttattattcgtagggaataaacttactttcaaaagcgttcataagttaatactttcatatatgatcataagtacggacactattgttttttgtttgtttgtgtttattctaaaagaaagtagcttttaattgaaatgtcctcagaggcacagtttaaagttcgagtgtaacagtttctaaggcaaaataagctctctttctactatttctctttctctttctactatttctctcctgtggagaaactcaggagatagagagagagagagagaagagaagagagcatgtatgtttggttttataatctctctactcataccaaagatttgtctcagacccaccacttggacagagagaacccaagctcctttctctctttttctcgatctactccttcttaatctccttttttgaaacttgaagccactttcaacatcatccttaaacttttgttcccttattcacaatctcctgccacctctcatttctctagttgagttgttatctgcgtttttaagcactcgaatactgcatgcaaattccctgattgtttgttagtaccttagagattctcgattttttagttgtttagattgaaccaggattactaaattgttattgttttctgtgtaaaggctacatatatg

SEQ ID NO: 16182 - DNA, 3003 bp, Unknown
  misc_feature (1)..( 3003): 2750-1469P.txt file - cDNA_ID_1379924; gDNA_ID_2936585; Annot_ID_143844
gctgtctctgagtatatgatcgagcatggttggaccaaatgttactctacacttgaccatttcaactggttcctctgtttcctctacatagctctctatcttgttttagttgagtttatgatttattgggttcacaaagagcttcatgacattaaatttctctataagcatctccatgctacccatcatatgtacaacaagcaaaacacactctctccatttgccggtatgtcaaagctatatgttctcaatctaaattcaagagcttgtatcaatggtgacttctttacttgatgtttttcgggttttcagggctcgcattccatccgctggacgggatacttcaggctataccgcacgtgatagcgctgtttatagtgccgattcatctcataacacatctgagtcttttgtttttggaagggatatggacagcaagcatccatgattgcatacatggtaacatctggcctataatgggtgcaggataccataccatacaccatacaacatacaagcataactatggtcattataccatatggatggactggatgtttggctctcttatggttcctttagcagaaaaagacagtttcaaggagaaagaaaagtgagaatgttcaatgctcacatgtattcttcatatgttgctcttctcgtgactcttattaaaacctttctaatcactttgttggaattaaaaacatgactgcataatttgatgcaaagtttcagacttttattgctaaaaatctctgatgattattaacctcaattatataattgctggatgaagagtttcaaatttggactaaatctgaagggtttaataggtcagttgcggtgtcagttttaccacagaccacagtaatctttgaatcttccaaacttgtaaaataaataattatactcatatggtaggtgaggttgctcaagatatgatgacatgtaagaggcaaagtttcctcttttgtcggttaaggttaagaatttgaatagcaagaacaaatcaaagtttgaaaacataagaatttacgaaaattaaagacctaaaatttattattatctgaaacgtgtagacgcatactctctctttcatccgccatggaagtataagacaccttttttcgcaaccccacacttttttctttttggctaagcatcaaacaattcaaaaggccgagtcgattctaattcagatataaaagaattctcctttttgcttcttttttttcacacgaagcaaatcgactagagtctggtaaattttcttctgtaattcatttataaaaaaatcttcttttgcatatccatgggggaataattataaaggtcgttactttccacatgggttttttttttggtagatatagcgaaacatttatattgcccactcccacttgtttgtgttgattagattgtccctaggagtcactgttatcgctctttcaattactgtaatgttgaatttgggtttcatctactaactaagatgaagtttcttgtctctttctgtctccctctttcttaattcctctctacttttcggttaattgctcctcttcagctaactttggggctttaaagtgataggatggctcgcttcagttttccttgttttccaaattttgggggttttaatcaggtttgttgattcttgtcaatgattttttttcgaaaagatttataatttggtgggttttacttgaatctctctactttagatttgatgtgttccttcaaggtcttgtttggttttatccaggtccaagtaattaggtgaagtttgcctctctctttttttggatctcattggtctgcaatagtctcaattaaaccttctagtttgcatattaccagttgagtgactcttggttccagattcgtttttggtggtcatagtcgcgagtaagaatctcttttgaatattctctgttattctctttttgtggttgtgtggttcgacttctttgcagataagtgatatcttttggtgtgaatcttataaaacttttgtttccagcttgattaattgaacatgcgactagttattatattaggtggttgatatagaagaaagggctttcagatcttacaaaagcaaatacttacggcagatttagcttaccaataattaagtttagttagcttagcaggaaccttttgctccttttattcagtttatgcaggcatgttttagttgcatccatacattattagattggcttgaattaacacaaacatcatgtttttagccttacatatagccgcagttctataccaaaccaatcaaatcttgtgttatttcaatctaaattgcatctgcaatcaaatcgataatttgcatgttcaatcgagtaaagtgcatttggtcaggacattttaggactggtttttccttaatcttgttaattgactattacggggtggtattctttgtctttccctgttaaacttattgcatgtaagagagtgtgatttcttgggatgatcttaggctgtgacaaatcgggggcctgagatttcagaaactgctgataattgggtctcaccatctgacattccactcatagaacctaatagtaaagaggtacccctaattgtttttgtcttcttggcgagtctagtctatatcaaaacctaatcttgtgttgcaacgagtaccataacttagacatcaagtttccataaatttcctgtttttacacaattttggtcgttattgatgagttgaatctaggatagcactgtgatgcagcaggtaaatttttgtagagaactcaatattatactacgaatagcttttctaatgagtccatgaaactattctgacccacaacagcgatctcttactgattctttacttttcacacactaccaagtacctttcttacttagattgttggcttttccatcattgtgtctgcattgaaatataaagatataaaaggaaaattatttgattatggtgtattttatgcctctaagcagcacaggatg

SEQ ID NO: 16183 - DNA, 3000 bp, Unknown; identical to SEQ ID NO: 9730
  misc_feature (1)..( 3000): 2750-1469P.txt file - cDNA_ID_1379940; gDNA_ID_2213619; Annot_ID_180905

SEQ ID NO: 16184 - DNA, 3000 bp, Unknown; identical to SEQ ID NO: 9730
  misc_feature (1)..( 3000): 2750-1469P.txt file - cDNA_ID_1379940; gDNA_ID_1972176; Annot_ID_180001

SEQ ID NO: 16185 - DNA, 3000 bp, Unknown; identical to SEQ ID NO: 9730
  misc_feature (1)..( 3000): 2750-1469P.txt file - cDNA_ID_1379940; gDNA_ID_2213619; Annot_ID_131953

SEQ ID NO: 16186 - DNA, 3000 bp, Unknown; identical to SEQ ID NO: 3819
  misc_feature (1)..( 3000): 2750-1469P.txt file - cDNA_ID_1380010; gDNA_ID_1620721; Annot_ID_165806

SEQ ID NO: 16187 - DNA, 3000 bp, Unknown; identical to SEQ ID NO: 3819
  misc_feature (1)..( 3000): 2750-1469P.txt file - cDNA_ID_1380010; gDNA_ID_1620666; Annot_ID_163956

SEQ ID NO: 16188 - DNA, 3000 bp, Unknown; identical to SEQ ID NO: 3819
  misc_feature (1)..( 3000): 2750-1469P.txt file - cDNA_ID_1380010; gDNA_ID_2926191; Annot_ID_201040

SEQ ID NO: 16189 - DNA, 383 bp, Unknown; identical to SEQ ID NO: 335
  misc_feature (1)..( 383): 2750-1469P.txt file - cDNA_ID_1380171; gDNA_ID_1563968; Annot_ID_148603
  misc_feature (73)..(73): n is a, c, g, or t
  misc_feature (150)..(150): n is a, c, g, or t
  misc_feature (175)..(175): n is a, c, g, or t

SEQ ID NO: 16190 - DNA, 3000 bp, Unknown
  misc_feature (1)..( 3000): 2750-1469P.txt file - cDNA_ID_1380275; gDNA_ID_2926239; Annot_ID_142832
tcctaatgttgtggctttttcaggcagggtatgtgggggtgttacaaggagcagagaggtttgatcacacaaggggttacaagttttcaacatatgtgcagtattggataagaaaatcaatgtctacgatggtgtcacggcatgcaagaggcgtccatattcctgtttgtgcattttgatttttggccctttttgtctcattttcaacaaagctagaacctcacttgttttcctttattgtttctgtttttttggcagtcatcaataatccgaactatcaatcatatacaaaaggctcgtaagaccctgaaaacgagccatggtataaaatatgcggctgatgaggagattgcaaaactaacaggccactcggtgaagaagattcgagcagctaaccaatgcctaaaagtggtcggttcaattgacaagaaagttggggattgctttactacaaaattcctggtatgtctgtttagtttgcttcaatctttggttttgagaaatgtctatcgaacaaggaccaagatttgattagtttaagtttaaatttggttttttggatatgaaaatactgttaccatcaggtttatcataaagattggttcagtttagatttaagctattctttttgttcagtttggttcagttttgagactcaacgtttgttttccgagtatgcaggaatttacaccagacacaacgatggagagtcctgaggaggccgtgatgaggcagagcgcgaggagagacatacatgatcttctagaagggttagagccaagagagaagcaagtgatggtcctacgttatggtcttcaagactacaggcccaagtccctggaagagattgggaagcttcttaaagttagcaaagaatggattcggaagatcgaacggagagcaatggctaaactcagagaccaacccaacgccgaagacctcagatattatttgaatcagtaaaaaatagagatttttggctccaatgactcttatgtcttctgtcacagtgtgattgtgtaatcttgtgtgtttataatagtaacattggagatcctcgagtgtaaaatgtcttgtacggggttgtaaacttatatagttatattacagtgaaaatagatattgtacaagttataaaatcctaaccacttggataatctacacatccttcgattacttttacaatatagctgtatcaattatcttgcatttgtgcaattattatattgaatttcaattgaaccaattataaaatttattatgtaatttagtattatatattttatcaattataaacaattcatactttttgctattatatatataaaaaaattttaatttttaattttactaattgaaaaagattatatctaaccacctaacgacaactcctttctcggatcaagttttttcttggttcttcttttctcggggtacttcctctcggattctctatgtctcttaactcggtctaacccgctaaagcttagctcacatgcgggtcataaaatccgattaccttttgcgaagtatgaccgagagttgaaagaaattcggatgttccttagaaactcggaccgtgagtccttctttctcgtttaacttggagtgttcaatcgtcgggttggaagtgaatcggatgataatcaccttccttctcgtctttgtcctccgttttaagttttttttcttccgtgaattctttttttctcttcctctttcgcgggacttaacatttcgagttatctccgatctaggcttcccgatctttcacttcagcatacgctatgatatcgtttctaaagtcactcattcgtgctctggacggagatgatgacgtcttcgattttgcttttgtggcctcttcggtcaccgagctcccttattttgctacgaggacaaagattgggaagaagagaattgaggaagtgatagattcagatcttcagggactcgccaaatacgaggagagagcgattaaagctatcaagccgagagtgaaagttaccattgagaaagacatcactttgctacagagggtaagtgaatctttcttacatccacaagacatggttctatgtgtgttgtttcatctttctctagacttttgttgctatttcggtttacaaacttttgattgtggtttgatctttctctaaacattttttgctgtatttggttaaagacttttgagaatcttcaaacagggcttaggacttcttaattgtgcctgaattctcagacaaagaatccgtgtctggtttgtacagtttcagagatttgttacaaaaactgatgaatgagttgaagaggagaagagttaaggagtctagtctaaataagttttcaagtttattgtaatagtaaaacctctataaattaatactcgataaattaataatctatataagattaataattttttccagtcccgagttgggactgtaaaaagtgacacaaattgataaattaataaaataataatttttttgaaaatcctatgtaaatatatgatcccatcaatattataaattagtaattgtataaatataaaatatatatatatctaatatattatatgtaagaaatttctaatatttttttgcttaaactcgtatttgttcttatttgaatttagttataatattttactgtatcaaaacttttgatattgttttatagacatgataattattttttacttgcaattggttttagaaagatattctctatgatgaaaaatatcttgtagaaacttttaaaaagttactacattagaaaactctctatgtaaattaataaattatttattaatttattccttaatttgtagatttctgtttggaaagaaattgctaaaaattaatataaaagcccaatgggccgtgtaataagtagacccaaagttattcggtacagtagtgacgaccggttaatcttcgcccgcgctatcgtcattgcaaaaatctcgaaccagattcggacatctcgtcgaaaatg

SEQ ID NO: 16191 - DNA, 3000 bp, Unknown; identical to SEQ ID NO: 9652
  misc_feature (1)..( 3000): 2750-1469P.txt file - cDNA_ID_1380437; gDNA_ID_1972165; Annot_ID_179741

SEQ ID NO: 16192 - DNA, 3000 bp, Unknown
  misc_feature (1)..( 3000): 2750-1469P.txt file - cDNA_ID_1380526; gDNA_ID_2214633; Annot_ID_188039
atacatatcacagggccttgagagacttgtcttattcccaagggacaaaaacacagagatcaatggtccaataacttgagaaggatggcctgttccatcggagggaaaaatgtcacaaagttgaaatctgtttacaaaaataaggggaagaataggagggtatggatgaaaaagagacttacggggcaacaagcatgagatctcattccctgatgaagctcagaggctgatatcaaaagcttctgcaaacggtactctcctgtctgagactgtcctctattctctgcatagcatataacttgtcgctctctcaggtgctcaaatgcctgtcatgtcaaccatttagaccaccacctttaaaccatggcatctcatgagagctataaacatacccttaggcagacattttgtgcgtagtagtctgaggtatgaaaagaatcgtgtatcgccttatactctggaatacacatggaatctcaagtcattttcatagtggtgccatggtttaaaccaaatttacagattacctttcatcacactgatgaagttgtatgagctttgctccttcacttctaacctcctcatacagaccagaagataaagctccagtacggaacaatctgctcaacaaagatagtgtcaatagatattcccaaggaaaatgtatatgcaacaccgcagcttattatacctctaacggcttccaactttggttgcctttgcatacttgaaagtgctgctttgaagttctcaagagagaggaggccagattccaaattcattaaagaaacagcgcagaatctaacatcaagagatagactcaacacagagaaaatgatatcttaaggaaacatctcatgattgtaatcgaagaacttacataaacttcaggaaactgttcacagtagaattagcattaaacaatgtcttaagtatgtctttaaatctcgtgtctgatgttaaattctgcacaataggttttttttttttgaaattggttagtatcagttgttcagaacaagaatcaacatcatctaaaagctaagcatgtcatagtagtaattgggattggatattagaaccttaatcttatcattgaaccgagaaacatatccactggggaagcctgagtctgctggtagagacagcaggtgtacaaacaaactagaaacatagttcctattagttaaataagttgattggaaaaatagttgactggctattacagaaaagaagctgctcattacccgtcaagttcttccctggaaggaggaagaaacaaaaattttctgtgtgaaaagcgagatctcactcttttctccagaagttggtcggcgtcctgtggtgacagattgcatattataagattttgaaccagagtagtattaacaagaaccaaagtcagctgtcatcaaacataaaaatacatacaagaaacagtttgtaaagcccaaagcacatatatctgtatagcgatgctcataccagtcgagaactaataccgacgacaacagcttgtgaggttacagattgcatagcatcgtccagcamactgtatagcaccgctgctttccctatatatatataagcagataatagggtgagtggatagaaaacaccaatgtccaattcctttgttcatcaaaggttaaaagaaaccagaattcttgcctgtgcaaacatgtcaaattcatcaagcacaaagatgatagtcttatgtgctagtccacatgccctgaaatatctctatcagtttgtctgcgttgaatatcaaaaaggctcatttatgtaaaggtaaaaatactgaccgcaacatggctataatgaattgtgaattgtcatcgaatgatgcctggaagtgcaagagagaaagcaagtcaactgagacattggctacacagcaaagagaaagaacattcggagagaacaatgtcataccattttggagaatagtaggtggtgttccatgcacaactgtttggcaatttcctgaaaaatcaatgtaagacggtgagtgaatgaatagattaggtgtaggaaatgagaatggtgggctctctccctctcttagaccttaaaggcacaattatcatcactatgcaagagtccattcaatctgatctgcaatcacattgagatggtagtaagatcataacgatgagattagatataggagatagttccaaatgtataagaaatcagacatactactgatactgaatcaggaaactgctccaataamtcacctasamcgagatccaagacctgaaatcaacccattttttgaaataaaagaagaaatcaracgccaatgacggagatagagagtagaaggaagcagggttcgacatacagcagctttgccagagccgcgagggccgagaagcaacatcgagttgttgcatccctccgtgatagaggttgatacaatgaacttcaatttactgtgtgttgacaaatttgtttgtactattaggttaaaagcaaattcgtttcgagaaattaagcgacaagtgagtgaagcaatcagacctgtaattgctatctgacgaagcggaaagaggtctgaagacataactaggatcacagagtctcccgcgaatcagatttagggatttctccgccggagtctctttgcccatcggactggcgggaaaactgacaagccaagcgagccctctgtgtgaactgtgaagtgaacacccatcatcactactagtataaacttactctatgggccgtagtaatgggccttataaagcaataaaaggcccaataaagctcctttgctttctcctaataacgacgtcgtttacattgtgttagcaagtttgtgatggaagaaggtttaacggagaaaaaaaaaaggattgggttgttttggaaaatatcaaatgtgggcaacgaaactcgaccggaaccaatcgttccttctctgaagctctctttgcaattgaaaatcaacaacatacgatacgagagaggattcttcgagagatg

SEQ ID NO: 16193 - DNA, 3003 bp, Unknown
  misc_feature (1)..( 3003): 2750-1469P.txt file - cDNA_ID_1380539; gDNA_ID_1621183; Annot_ID_57416
cctccaatctatttccgtttttattttcttattattcttaccatttacacatttttaattgtttttttctatccgtatagagagagatgtatgataaattaaatgaagcatctattattatttctacttctagtccctaaacctatctacgtgggcacacaatcttcgtaccaaaatgataaaagttttccaacgtacactttttgttgttgttggcttcaatgtatgcctatgtggaccattatgcttcatggagaagtaattatattttaaaactggatatattgaacaaattaaatagaaatctaaatgttttaagagaaatctaaaaggggaatgtttcaaagctagttgttaaggtaccgtgaattatctagtattttaagagaaatcaaagtctgcatggatgatggatagagtagaaacattatgatcaagtctttgttatgattctcgattataactctagataaacaaacttggatgtctgcgagaattggaagattatgttcattttttgtagctatttggcttttaagttccgatcgaaaagtgatttatctaaatgcaagttgctaacctttttgatttacgattttaaacaaaatatttggatttgtatttgtatttctgtttagtaattttttttcttgtgcaatatttattttagcaattgaaatattaattttcatctttatatgaaaacaaaacatgttattattcactaaacatcacataacaatattggcgcaaatatgaaaaagttagaaatatgtatcaagcacttgttttataaagccttagttagatattctatatatatatatgcaaaagtaacaaatagtttaaatgatcgaataatgaaaatattttatctgaaaatagcttacgcatgataattatatttataataaaaacaaatgagcttttaagattaatgaagtctaattcatttcttaagttaatttttaaaaatattaaacaaaaaataacggcattacgtggtgagataaaaaaatattgatatatcattcaccattgacgcttattagctcttattctccaaaatcattaaagatgaatttaaagtcgaaaatcacattacgaggcctctcgggtgaaattgatgttgcagatgatacaacagtaataaattaaaaatcgtagctagctttgaccaacataagagaataatcattggacttacatcttagtatattttattaatatgcttaagtagatatataaagttcgattatatgtttcaatatccttgtccaaaaaagaatcatttaattcgtcaatactatcataaggatccatgtgacacatttgaattagttctaccgcaaactgtgggtcctttaagtactataattttcacaaacgtaacatctccttatgtagagatgtcttgttaaattcctaggtgtataatgatttggattttgatttgacttaaatatcatgtgacctaaatacctgtataatgtcgttgattaaatccttagcatcatcaatgagattttgattcctaagaccatgacatgtgcataaatcgatacacacatgcctatacatgtatatttttgactttttgtgcaagtaaaagttttcgatttttttttatgtattgaagtatgaattctcgtggatgtaacatcaattttctaactagtaaagtaatatggtacatgcacgagagttcatactttcgagtttcaatacatacaaaaaatttagcaaactttattagtagactgaatttaacttttttttacaagagaattaggaaagaaaagaatagaggtgagagagagaaattaaaacacatgtacaaaagaatcaaaaaaagaggtacagttttcgttaactgactactgaactgaaaataaatgaatgtgttgttggtaaaggaaaaccccaaacctttatttcataggatttgaaattaaatcaatttggcagttttgtcagaaaaataaaacacttatttgaaaatgtattcattaactacatatgattttcaggtaaatagacagtttctcatttagtgtaaaacccaataatgatgaatatggtatctctacattataattagagttcaaggttgacatagtcataaaacttgcaaatttggtattcttggtaaagtatatatctggtccggactatcaatagatttaatgtgtatattcatgttaaaagatcatgtgtagctgaaaagatatcaagtttacatgaggataatctaattgtattttgttaaatataatctagttgttgattgatctgccaatccaaaaatatggcgaacttgatatacagaatatatagagactacgcgatggataacacataacatgtatttatgtctacccatactacaatattgtacatgttgttctattgatttctccttgtaaatacatgcacaaacatgaatctgaaaattgttcttaataatattatttaaattttaactcactagagacaaacaacaaggactatactatagtatactattggagaagttacacacttaaaatggtttataaacaaactaaaaaagtgtcatcaaataagcaatatttgaaatgctattttaaatatttatttagtaagtatcaggacgtctacttagagtttttcatgcgtcataaattatgtgacatttacttacatgcgaaagaaaaaggagtaaataaaacacgaaaaaagtaacgttaggtaaatggctaaacacgaggaaaagccaaaaatataaataattcaatttcttatctccatcaagatttaataaaagtaaataaaaattaagaaataaataatgaaaagatgctttggggagtggatctataaatcttgttatataaaggaggatagatagtgagggttttctaccttcttctatctaaaggaagtctttactcagagaaccaaaagaaaaataaagagaaaagaacccaaaaaaaaaaagccattgtaaattcagaataaatg

SEQ ID NO: 16194 - DNA, 3003 bp, Unknown; identical to SEQ ID NO: 16193
  misc_feature (1)..( 3003): 2750-1469P.txt file - cDNA_ID_1380539; gDNA_ID_1621183; Annot_ID_174340

SEQ ID NO: 16195 - DNA, 3003 bp, Unknown
  misc_feature (1)..( 3003): 2750-1469P.txt file - cDNA_ID_1380656; gDNA_ID_2926086; Annot_ID_196460
actaaggccatgattgaaacaactaaaacttgaatgagttagcttccaatttaaggagatgatgcgaatatcgttgaagaagagatattactacttgtagttcatttccactgatcgcaagccaaaaaagtagttaggttctggtggtgaggaaaagtgtaaaaatgataaataagattgagaggttctgcttagtttaattaaagtagcatttccaaaatactttttttttgctcgagtcagtagtaatagtcttttgtgttttcttcattagacataatcatgataccaaaccaaacacattcctctttcttcggaataactattattttctattttatttttgtttttttctcctcccacagattgtaacctttatcgtcaagttgtaattaaaaagattcctctaaacaattcgtcaaaaagctgaaaagattcctctaaaaaaaatttcactacacttctagattgtctttagactagtacaatctcctgtgttgacctaaatgcacaatagattgttaatttaaaatgaagaaatgcgaaaacatttttaatctaagtttgtggttggtgagtcgaatgttatgaataaaactcatgacttttatgttaaatacgtatgaaaattactatgaagaaaagtaacaagaaaaatagtgaaaagaaagaaaaagagaagaaggcacaatgtgggaaggaagtgcgacgagaagatcactagatttggtcggcacatcactttctctcttaaactcataaacacaaagcatggcccctaccttaacgtacccactttcttcttttcaaccccacaatttctaatatcctcaagctcaccctctccacatttagtgtgctctttttctttttcttgttcttttacaaataaataaataaattattctaatttattttgtacttttgttccccattggattgcaagtctacttagatcttcaatcttcgtggtcgagaggttgagagagagagagagacgtacaagtttcaagtatgagtaaagacttccaaattaagacattggtttgcaagttgaaattcagtcaccactacttcatcatatactttttgtaacccttctctttcaatacacgtatatacttgatcagtctgttctcatcaaaatatatacattgattacaaaaataatttcaattgatgtgttaatttttagatatattggccttaatcgaacatgaaaaatggacactttgaatacagccaaagttgtgtgttggtaattgtaaggaaacatcgatagtgattaacactaccctaagaccgttgaaagaaatcaaaagaatgaaccctctttgaaaaatttaggagacactttagagaacttatgaatagtttaaaaaaaaaaaaactctattattcatttggttctacttgttcaacttggttaaaaatggaggaaagatgaactatgtatagaatccaaaactacaaaatatctaacaatatttatcctaatctagaaaacattcaaccataatatctagatttttctctgcaaatatatctagatttttcgacatgtatatcaagataatcaaagaataggattcttaaaacacttaaagaggtgatgatattttatgatgtttctagagaagctctagaatttgaatttggtccaataaaggataatcggataatgaaccaataattaagtttgactcaaaaattaattcagtttcagtaacactatttgttgtggtcttgtggacacaaacaatgagatctatacaactatgggtgatatgaatcccaagtaacaaataaaaagggcaatgaactgatagtgatttgagttgaaaattcataaaagttaatatggtgatagaagttaaacatacattggcctttaccgactaactcgaactgaaatcaatctaacaaaaaataggttcgattgattcgattggaattttgtcaagaataagaaccattatcttgaatttgtgtgttagcaatgctacatcaagagtaagatagaaattagagactatggattcgagttagatgtcaataaaccttaacaatatggatttttttctccgattaatctaactaattggcacgttaggtgaatttcaactataattggtctccgtttgcttttgggaaagagagaaaaaaaaaaaaaaaaaaaaggcaaactttaggaaaactgaattttcaagaaacttgacttttaatttgtaagcattgtctcgtttcgtataccgaccgtcaataaagtgtaacttaacgaatctctttttgctggattttcctaaaacactgatcctatgacactcttacatattattttatcttttaaatgtaataaaagcaagaaaacatacataatattaatatatgttcatactatggttcatacaggaaaattcgtatcataacattttttcatcatttatttgttccatagagaggctaaagtagggataaaacgtcacctcttattcacttttcttttatttcgtttaccaataaaaataaataatatatgaaagtaacatggtagtataattggagtgaatatgtaagaacattaattggaatacaaatttactacaccaaaaactatttttaaccaaatatgtcaccaaattcaatagaatttacactaatttttattgggaacacatgttcccatcatggcctctttcctcctccactggttattactgataaaataataacattagacacttaacaacggttgattctctggtattaatgaaaaaagaatttcgaaagtgcacaaaatggaccccaaactccacaaaacctgcaacacactcaattatacgcacaacatgcaaacaataataaacatcactgaccatccaagtatttcttctatatatgtagactctcactcttttacgactcaaagagcaaagagctaaagtccaaaaccaaacacaaaaacaaaaatctaaatttctttcttggtctgctttcaatatg

SEQ ID NO: 16196 - DNA, 3000 bp, Unknown; identical to SEQ ID NO: 2804
  misc_feature (1)..( 3000): 2750-1469P.txt file - cDNA_ID_1380688; gDNA_ID_1620600; Annot_ID_161637

SEQ ID NO: 16197 - DNA, 195 bp, Unknown; identical to SEQ ID NO: 433
  misc_feature (1)..( 195): 2750-1469P.txt file - cDNA_ID_1380819; gDNA_ID_1590981; Annot_ID_150358

SEQ ID NO: 16198 - DNA, 3000 bp, Unknown; identical to SEQ ID NO: 6159
  misc_feature (1)..( 3000): 2750-1469P.txt file - cDNA_ID_1380963; gDNA_ID_1620852; Annot_ID_51001

SEQ ID NO: 16199 - DNA, 3000 bp, Unknown; identical to SEQ ID NO: 13728
  misc_feature (1)..( 3000): 2750-1469P.txt file - cDNA_ID_1381022; gDNA_ID_2214647; Annot_ID_188548

SEQ ID NO: 16200 - DNA, 3000 bp, Unknown; identical to SEQ ID NO: 6114
  misc_feature (1)..( 3000): 2750-1469P.txt file - cDNA_ID_1381119; gDNA_ID_2926132; Annot_ID_138776

SEQ ID NO: 16201 - DNA, 3000 bp, Unknown; identical to SEQ ID NO: 6114
  misc_feature (1)..( 3000): 2750-1469P.txt file - cDNA_ID_1381119; gDNA_ID_1620846; Annot_ID_50938

SEQ ID NO: 16202 - DNA, 3000 bp, Unknown; identical to SEQ ID NO: 6114
  misc_feature (1)..( 3000): 2750-1469P.txt file - cDNA_ID_1381119; gDNA_ID_1620846; Annot_ID_170222

SEQ ID NO: 16203 - DNA, 115 bp, Unknown; identical to SEQ ID NO: 12814
  misc_feature (1)..( 115): 2750-1469P.txt file - cDNA_ID_1381793; gDNA_ID_2214573; Annot_ID_186267

SEQ ID NO: 16204 - DNA, 3003 bp, Unknown
  misc_feature (1)..( 3003): 2750-1469P.txt file - cDNA_ID_1381941; gDNA_ID_2214471; Annot_ID_133100
aattgcaaaaaaacaatcagtttcatattttgtcttctaatgaaattatctcagtaaagcttatagattgtcaactcaagaaaatatcatgcatgctacatcgaaaacatcaaaaaactaatgagtaacggagtcatacaagttctagtccagcagagtgagttatcatcaaaggataatcccgacaacatataacaaaagctactcgccaggaacttggacgccttgcttcatcttctctttcttcatcttcttcttagaaacgggtttcttcttcctcggaggtaaattcttctgtgcgtatgtgtaaaggatgaagtttcctacaaggaatgtcagtagcaaccctcctattacaagaaggacgatcagtcccgggtttagccctttgctttcgatttttccctgttcattgtgttcttattagtaacatatattgaaatctagatgcaagaagaaacaagaagatttgagaaatataatatatgaaacttgaaaggacagaacacaaggtatactaactagcttctcaatcttattggcccgtaagacagaacacaaggtatactaactaccaaagaccattactgcaagagtttggttaagtgacagattactgcagattaactaacactgacaagcacgaatatcatgaaacgaataccacaagttataatatccatagattgtacaatttgggaatgtataaaccatcatattcgttattcaccatgaaccttaaactctgaaacagccaaaaatgaaaaaacttgacattccatggcaagatcaagatgaaagtgatgaagttaaccaaagtcctcaaactcaaaatgtatgaaattctaaagaaaaaacaaaactttaccgatccaattgtgctaggtcctaacccatgctaaatttcagagaatttgatcatccatcgttaagaagcgttacaacaatcatacacgtattgaccaaaatgctcgaacataaacaaaaaaagctcgcaatcgcaaatcttaaaccggaacatcatgcatcaaaaccagaagatcagactcaagcaacacataagattacgagccacgcgtgaaagagtagcaaacgattgtaggaaagcagaattgagacagagtcaaacgcagatctagcgattcatcgtgagtaacgaaaaatttgatctcagacaaggaaacacaggtagacaaagagagatattcagagaggggacagaacttacatcaaattctgcggccatggcggcgtttcggagctacgaggttatcagcaccgctcgccggagaaaatatagacagcttgaagacgagttttgccaagaaaagactcatagccataagtaacagcaaggttggtcaatggggttactttgcaaattataaactataggatttgtttctatcttcgattttggcatgcattttacttctacaactgatcaaccccgcttgacaattgaaatttatttctctttgattttggcaaatcattttaattgtagtactaagtaccaaccaatcctacttgacaaatgaatatttttaaatgtattttcaacccttttaatttggtatattttaaaaaaactttatattatcaattcaaatttgaatgatatcgtttggttaaaataaaataaaatttaatgtgatattagactactagtaaaacgaaaatatagcaaaataataaaatggttgacccatttggaataaacatttttatggttaaataattgaaaatatgcaaaatgataacaaatcaattatacaattcaataaaattattatatcatagaaataatttattctcaaacaaaacaaaaaattctcatatgcaattattaaattagagatttttcatcaaaagtaaatacttgtaaatataattcaagatccaccttgtttcaaaatgcatttgaaataccatctcaaaatatttgtatgactttgaactgttattcacttgatctattaaaacggacacatatgttttcactataatacacaattcataagtcttcaacattacttaaaaatcgtctttcataactttacttaatattgtttttggaaactttttttgtgtgatgttttttactttaataatcgattgatttgtttagtttataagaatgttttttgtgatgttttaagttttcaaaaacaacatggaagacaggaatactaactttatagtgaattcggtgttggtcccgaccccttcaccatggtcatgttcaaaccggattttgcaagactagatatggatactaatattgataatgacacaatttctctaatgatctacatcctcgtggaaatcttgttttttaaaataataatgaaaaattatttatcaaatgcttataatcgtttcattcttttggattcaatgccattaaaaatcattcgacaatttctttttggtaacttcttgatgtcatactacataatcatagttgatgagtttgtacaaaacttgaatagtttgatatcgttattagaagtaacacatgtaacaatcttggagatataaaaatgaatataaaaagtgtattttgtaaaatatttttaagattattattgtgacgaaattatttttgtataaaaaggtttagaatttgatagatagcgttaatatcataaaacgcaaagtattatattattgatcacaccattagagtgagtaaatacatatttgaaagaaaaaattaagaatgttcagactaaaaagaaaaggaaaaatgttttggcttccggataaatgttggggtcaatattaaagaaataaaaggtgtgggtgctgatacggaaattagtttacaggctgtaatttttctttcaggctctctctctttcgtcgccgaaccagttccagaaaggctgtagcgattcaaaatttcacaaattaaagtcttcttcctctccgaatcagagattgtctccttcttagctcagatctgggagcttcttgtgatagatttggaagaagatg

SEQ ID NO: 16205 - DNA, 3003 bp, Unknown; identical to SEQ ID NO: 16204
  misc_feature (1)..( 3003): 2750-1469P.txt file - cDNA_ID_1381941; gDNA_ID_2214471; Annot_ID_183040

SEQ ID NO: 16206 - DNA, 3003 bp, Unknown
  misc_feature (1)..( 3003): 2750-1469P.txt file - cDNA_ID_1382080; gDNA_ID_1620693; Annot_ID_48629
catctgtcatccccggaacatcccattgaacacaaaggcgttcccatcagcattttcagatatctgtagcgccgagacagcctgagcagcaatcaaatcagctgatattcccatgttgttatcccaagcacccctcctcgtgaatggcgaccagttactatctcctagtccatagccatttgacacaaacccaatcccttgaaccgcatagctagcacagctttggcgaggaacgtagttagttctttcatctctaaacagatccattgtgaaacccttttcttcaccaaacttgactcgagatgaatcatcagaatcttcgcccagtaggacgtgcagagcaacagcttctgcaattgcagctccttcttcatctaacctttgttgttcttccaatctcttctgcttcttcttttcaagctcagcccggatggctgcagaagtagcaagagctttctccaaacgtctctttttcttctcagcttgtttgatacgatcaaattcatctttaccatgcttcttcttcgctttcctaacgactggctgaacttgcttgcacaccgtgtgatccattattgcttgactataaatttctaactaaaaaactgcactaaactcgatgatgttgtagaggaactcaagaactacacccactctggtatataggaatacctcatggtgcggacaatacaatcccagaaagaaacaacaggagacaactgaagagagaggttataagaattcgcagacttattcttcgaaatcattcgtccaacattcccgcaccccttagactcgcccattttctgcattgacaattacttgattagtttcaagttgcagaggagtagtaacacagaaatccataacatcaaaatctgaaagccaaaacaatagcattcaaacttgtaaaagctaacagttgtagatagaccaccaaccaagcagacacaattgttctaatgacctcgaaagacaccaaaagtcctaaagaagtcaaacaaaatcagccaccaattagattgaagatagtcaacaacagccaaagagtaaaacctaatgattactcaaaccctaatttcccagagtaggagcaaagttgaagaatacaaagggtatccatccatccacagaaagagttaattccacggcaaatttcaggatctctcttaatcctcagctaataactcaattaagactaatggatacaaattacacaaatacagacaccagatctgccgcagaaactaattttcagatcaaaattaacctcaattcaacaagaacaataagagaaacaatcggatttaatccattatgtaggtctaagatccatgaataagcataagatccgaggaagctaatcaaaaagacttttaacgaaataagtcaattatattgaaaagataaagggaaattgaagataaacggagaaacaaagatgatgatgaaatttagatccaaacctcggcaatatggcatagaagcagctgccttcaaagaactcctttaaattaatcggataatacagagagataaacaaaaacgcagaagtaaagttgctgttttgatgcagagagaaagagagaggaatttcgagagataaaaaagaagagcagacgaagaagacgagagagagaggataatagaaggaattataactagtacagagaaagaaacgcagcgcgacttctaatgaaatggggacacgtgtcgaatgatgtctgacttttttttcaagtgtaagttttcaattgggactttggagacttggccggtgcgacttcgtctactcccagtattttgtgggtcctaatgagggctattagcagccgttagatcccccgataactgttttgagatgtttccggttccaacttttttttttgtcgacttccggttccaactttgcaatatttatcatgtaagaaagaaaatttgagcctttcacgaatatgtacaagtgtcatgttaccttacattacaataaaatataagagcttaatttgcattcaaagtttatcaacttgactaagctttgtttgtgctttgagcatcccattcaagattcatccaccaaaatgagactttgaatacacttttgatataacaaaaaacttggtcgaatttctttggtcctaatttatttcctgaatcccatctgttgtactgggcctaggcccaattggcccaatatgtatgtaccataaaaaagaagtcattaagtttttatgattgacttttttacatagaagcaaaattataaatttggtgtatgaatggatggactaattcgagacgaatcagatggctaacgaaaaccagacttgtgtccgttttgcattttcgaaaattatcggaagaatcggtcaattgattaccctcttttttttttgtttaccccattttttaatagtcatgaatcatcttccttggttgtgtcagattacttaagtcattattttgttatagagatgctttactagtatttttgatttgttttggtaaggacacttgtctagctaaagaaatgttagttaaatgaaagaaaaaaggttcagtagttgacccgtttaatcaactgcgaacaacgttcatactaatataatttgttaccataaattcataatctaaacgcgtgcttaagttgtaaacaaaaggaattaacaagggacacgtaaagtagcaattccgcaggaaaagcgagggtaaaattgtcatttcagtggatccccaccaccaccaccaccgccgcaccagtttcttcttcatctcctacgtctgaaattgagaaatcggaagaagaaagataagtctaatcttgtgcctttagatttcttttcggggagatctagtagttgttggattcgttaaacggagaagtggatttggtacgagtctttaggtttccttcttcaccaaaagctctatatagagagaatctgcgagctctttttggtaggaaattagggttcgtgttgcttggtaaatatagaatcaatg

SEQ ID NO: 16207 - DNA, 3003 bp, Unknown; identical to SEQ ID NO: 16206
  misc_feature (1)..( 3003): 2750-1469P.txt file - cDNA_ID_1382080; gDNA_ID_1620693; Annot_ID_164853

SEQ ID NO: 16208 - DNA, 3003 bp, Unknown; identical to SEQ ID NO: 16206
  misc_feature (1)..( 3003): 2750-1469P.txt file - cDNA_ID_1382080; gDNA_ID_2926187; Annot_ID_140854

SEQ ID NO: 16209 - DNA, 3003 bp, Unknown; identical to SEQ ID NO: 16206
  misc_feature (1)..( 3003): 2750-1469P.txt file - cDNA_ID_1382080; gDNA_ID_2926187; Annot_ID_200746

SEQ ID NO: 16210 - DNA, 3003 bp, Unknown
  misc_feature (1)..( 3003): 2750-1469P.txt file - cDNA_ID_1382347; gDNA_ID_2214605; Annot_ID_187191
gacttgatgacactttgatttcgctttgtagcatataaacatatactacatttcaacatttgttcatgaatcatgatattcatatattgactcgttatatatcctaaccatgtgacggtaattaaagcattttactagttttagacaagttatattcaacgctatagttttactaattatatatttacatgcatataaacataaattcgagacagattctattatttatatgaacttggacctttgttgtatctactaaaaatgaatttgatggacacaaggtggtagaccagtctttcctaaaatggggaggccacaaatggttagtgtatgagataggtgtcgttatatctttggttctttggcaattaaggaatgtccatctatattgaaattgtcctaaaatagaaaaggcaaaccatcactaatcactacaataagtgtgtgctctgtaatttatttcagtgttactttattaacctcttaatggtattgttatgtacaccgacgttcgaattttcaagtattaagttgccctatgtgtaaataatattaaggtgaatcataaatcatggtgaatgtgaatctcagtatttttgtcaaaactttcatatatttgatttcccaattcctcgcgccttataatttttatactttataaaagttttgaatttttattaaagggagcagggaacacctttaagaaataaataaataaacaattgatgctatactaagaaaaattaaattgatccaaaacaatatgctaaatatatatatgatggatagtcggtactattgaggaagtgggaaattttcatatatacttcaacctaaaattggatgattttttattaactgggatattatacaaaataattctgacaaaaaaacaaataatttaaaatagtcggtatatataaaagagagagttgttcgcatcaatttaaagtatgaatttaaaccatcatgtttttcacatgtttaacttttttttggcttttcggattgtcccttaatttggaccatacatgatacatcacctatcgactctcttaaaatgaagattaaatttgtaacgttaaccaaatagtctgatctcttgggatttataagtcacttttgcaacgttaagacattaagtggccgaaaagagaaaattaagagaacttctggggaatataacagtactaaatgattgcagtagataaaacattacaatctataggattagtacgaaacaaattaggttagtgtgtttagtacggttggtggagaataaataaaacaatcaaaatattactccaagtctccaacacttgcatatttcaacaaaagttttaaagctggtttaacccaaaaagaacccatatggtttgtcatcgagtttttttttttatggtacgattttcttattttcaaaaactaattacaactaaaaattacgtacccattaggctattatacaataacaactcaaaatgaaccaaatgtggaattgaagcctagacaggcaatggaattataaaggataagtaatacaatcaaaatacaatttaagaagagaggtagagtgtgttctagtaagttaatttcttagataaaaattattttattttgcgcaaggccataggttatttctagtatacatgaattggtaacatatgcgttaattgtgatagaggctcatgttatttttgtgtttccgtacggaatatagggcagtcgatcaactcaatcatttttcaatgaagtctggctaaacatgattggtttggatcaacccaaacaataaatattcaagcaaatgaatagagatatgcggttgtcgtagttgggacagaaccaccacatttcatttgttgttgttagattcactaacacattcttttttttcttttgaagatattttgggcgaaggcttatatatattctaaaacggtgacacacaataatcattttcttatttttctttctcatataattatattaaatatttttggttagttattataatttaaacaacactctcctaaaaattttgttttggcattttcaaatattcaaaaatatttaaatatatatttttcattaaatgtaaaatttattgaacccaaaaaatcgtgtttatatcaagtgcatagtctattttcttacatattactaaaacaatgaaatctacattcaaagtttgttaacttatttgtcttgttagttctagtttgattgttatctattatctatacttattttatttgctcaaattgttttaagcaaaaatttattgatcttgatatatccataatttctttggattaccttaaatcttaaatcttaaagtcaaaccaacataggttattttagtctcttcttcgttttcggtcctcaaactcgagacatttccaactcttctctttaaactggctaggtgataagtcgggtaggctatcaaaaccggatttttctgctcgttttgattgttttgtactaagttctctgctatcacaatttaaatttttaattagtggaaatcagtcggcaacttctacaacaaaaacgcatccacacaccgtgtcaacaaaagtactttggagtaatattaaatagaatgtgatatataatgaatgtgaacctttttatcaagacattcggtacattgtaattgtatattattggtctccaactaacctaaggaataagacaatttctattctaagttttattttttcttaaccatttctaatctatttattatggaagaatgtcaaactcgtgttataaaaaaaagaatgtcaaactcatgtagccactatttatttattttaaaagtttctttttatgatattactattaggaagcgtatgagctaggtatataccccaccgcccaatattctatatatatgagcaaagaacattcataccaacatcacaacgagaaagatagattcatctttcaatctttttttatcttaaaacaaaactttgtgtgaagagaaagatg

SEQ ID NO: 16211 - DNA, 3003 bp, Unknown
  misc_feature (1)..( 3003): 2750-1469P.txt file - cDNA_ID_1382581; gDNA_ID_1971936; Annot_ID_58570
gtgaattcgttgagtaaggctccgtcccgagggacttctccttctcctactttgaattcgtcgaggccgtggaaaccaccagagatgcctggtttctctttagaagctccaccgaatctgaggacgactttagcagacagaccggtctcagcttcaagaggcagacctggagtagcctcagcaccaggttcaagatctggttccatagaacgcggaggtggccccaccagcggcggcagcggaaatgcaagaaggcaatcttgttcgccgtccagaggtcgggctcctatcgggaacaccaacgggagtctcactggtgtgcgtgggcgagcaaaggcaagcaacggcggaagtggctgtgataacttgagcccagtggctatgggtaataaaatggttgagagagtggtgaacatgaggaaactaggtccaccgcggctaaccgagaatggtggtcgaggatcggggaaatctagctcagcttttaacagccttggatatggtagaaacctctccaaaagctcaatcgatatggccataagacatatggtacgatcacgtctcacaattttagtcaaattttctttgttgagagtagagtagcatccgaaaatcttcgattgagagtttctcacaagctcgctatagattaaacattgggcccaagctggatgatctgactcgcaagaagagtgtttcttaaagttctctggtaataataacacaattgtcgatctttggtgtgtaggatataagacgaggcatgactggaaacctccggccgcttgtgacaaaagttccggcatcatcaatgtacagtgtgagaagtcggccgggtagtgtctcaagctctccggtggccacgagcagcactgtgagctcatctgacccgagtgttgacaacatcaacattctgtgcttagacggaaacgaagccgaaaatgatgatcttcttagtgaaagaagctatgctgcttctccgcggaaccagtaccccaagttcacatcttgacccatattattatgtaatctgtgttcttgttttttgttctcacgcttcgaagcaacttgtttctaagtgatcaaccgtataatctataaacctcaggcatcaaatgtcttttttccttcataaatgttctcccaaagcaattgctaaatgctgtgtctgatattttaaaccaagatatagaacaaagtgagaatcgagaaacagaacaaaacatggaaatagtaaagaagacaaaacagagcatagaagaagaatttaacgagtttggtacctaaatctcgcgggacaaccctctttgtaaatccactaaattacttgaaaatttacagcttttggcatgtaccaaaatggttcattccaatatgaccgatacaaaaaaaaaagttgtacgataagaatctccagatatatatttgaatcttttatactatatgaagggacgaaacagagacatgtaaatgggtttcggttttcttacaagtgtaaacaaaggaacatattcataaacttgtctcgttaggtttataagagagtcaaatatacttgaagaacatgtcgttgtgaggatttggattcggtgaatcgtcttcacgtttagagacaacaagaaatcagacctttaagtgacgagtaaagtaagtagttacatgccacaactccaccaaaatcgtgtttatactttttttttttataaatacttttattactacaattttataacgattactatttcttattgaaaattggtcaaaaacattttagaactttattttactttttttgtcaacaaggtggacttttcaagttttgattttgtggcgcaaataagaaataatggaggattttcgtggaacgatgatgtcatgtgccaactgtaaattcaatttcagaccgcaatcgatagaaattaacaaacgattcgttttaagaaagaaagaaagacgcaaggcaatgtgaaaacaaaaattcctttttggatcattgagttgggatttgagaattcgaactttctctttggatgattgaatgtcagcgtagtgatgacgtcaagtaaaagctcgtttgatgacgttataaaatgttggcaaaaatttcttttttaagagaaaaatataaatgcatggttgtctgaacggcgagaagaacttggtcaaattaaatgtgccgtgtagtttggtcaggtaaacaaaactttattagtaactatcgctcttaattcatacgtatgtacgtatgagtctatgagaacctttcttagttaaacggtacgaggacaattattgtaaaatgtaaaaaaaaggtaggtaagtgatagaatttgtttggcgtatttgtgtgacttaaattgtaataaacaggtctataaaatccattgaagttgaattcttctaaccttgccttagttacaggcagaagaaaataattaaagaagaaatctaatcagtgcgacttttataatagtctcgtcgtgtgaaaaaagtaaaataaaatatagtaataaaagtctcgtcgtcgtgtagctgtcactttcgtttgtcactttcgagcatcagcagccgaacataaacaacaaaataaaattgaataccttttagcgtattcactgttcatgagttctgggtttggtttgctttgtatgctcaacaatttattgacatcttcacgaaaaagtttaaattttaaatcagacaaaagcagtctcatgatttctctttgattaactcaatatagatttcttcttcgcactagcaaataaacacattatcttcttcttcttcttctctcatcgttactttatagatttagtatcgaggagacaggtcgaaattgaggttcttttaaagaaaagttccatttcatatctctatcaaacccttttctgaatattattttgcttgtgaatttgaatttgagcttttttcctctgttcttgggaggaatttttgtctgtgtttgtgatgcgttataattgcttcggacttctagatatg

SEQ ID NO: 16212 - DNA, 3003 bp, Unknown
  misc_feature (1)..( 3003): 2750-1469P.txt file - cDNA_ID_1382662; gDNA_ID_1620377; Annot_ID_155190
ttgagagaggttctagatgtttctattaggtgacaagtggttgaaagacaaaattaattaaaattgaggtgacgaaacaggactttcaggtgggagagacagttagaagtttgccgcactgccatcatatgttccacctaccatgcatcgacaaatggcttcgcaggcatgcttcttgtcccttgtgcagaagacatctttgaattgattttgaactcttctttcttctcttctttgtacatgaggtataggcatacacacacacacatatatacacactagtagtcttccttgattttttttagattacacgttacacagattttgatgcaccaatcattgtaacttcactcatctcttggagatcctgtttatttatgctacttattcttggcttcatcattcaaaaaggacatgctgcacttcccaattttagaaagtttgggatcggttttgcatagactaaatcccaaatgaaaaagcatatatacatacatatccttgtcgtcgaaaacaatgctctactcttaagaactaagaagagagataatacattttacatgaactagtccgagtacaaaaatatttggcatgagatccaacatgtcaatagcttcagttttaaattatacatttcttataccaggaagagtgaacccaaaaagacaaaaaaacataaagaaagaaaaaaaaaacacatatctttggttggataaatataactagaagatggatggagcctggttttaaagtttcttaggtaaagtgataccaccaccacggatagaaacagaaggggttttaagagaggaggctctgctgagcagattggtgtccaggaagaggacgaccacagtgatgtcgtcatggaaatgcctcctgactcctctctcaatcttgttgagatcagaatatctcatctctcttttctttgctgcctcctgcagcgcagctttcaccagtctcctcgctatcccctgcatcagcattctcacatttactctttagaaaaaatcatctatatatgtttagaaactgagagtgtctcatacgtttcttgggtggttctgaacgatttcaacagcctcttggttgctaagctgctcccaaagtccgtctgatgcaaatatcagaaactgatcgtctggttggagatcatgcacggttatcgacggttcccaactcaagataggtcttttcattggctcccgcaatcggtactttgtgtacaaaggttccttgttgaactccgatttcttaagatacacgtctcctatggatcgtgatacctgcaaacacacagacaactaagctttcaagatttgacaagtggccaacaataatagcttatccaactcagtgaaggaacatgacataataatattggctcagattttatagcataagaagatctctttgtagagagcggcacctgaataatgcccttaacacgccagacattgtgttttaagacgacaatatgggagtcatcagggtgtaaggagtgcatttcctgcctcacagactctatgctcacgttatgctcagctgagagctgaagcgcattaacctcacctgtggccttgatgacctttcccaaaaccgcacgggagtccccaacgttagctacgtaaagcttcccatcgcagaccacaccgatcaggcaacaagagccaaccgctgctatatgtggcttcactgcccactgcttggccaccacccctagaaacccttcttcggttgcctcataggcctttcttatcacatccacagacatggaatcctgctccgctgcgaatcctgcagacatgaatgttcagttccaatggttccctagctaaataaaattcagtggtgagtagtaacaacaagtagttactcttgagatggtgaaagagatgatcgttgacaaaacgggaggtctcagggcctccgtggccgtcatagacgccaacaaaggttccatagggaccagaagaagagagggtggtcaaaggaccggattcgacctggctctgatcctcgaggaggttgttggcctggacaacggccatggagaaatcaccaaaaaggtggtgagcagagtctttgtaccagagaaggccgtcttgtttgcctttggaatcagaataagtgtgggaagtggtggaagaagagggccagagacaagaggtcaaaaagttgaagaaaagggataacatcgggcctcatctcatatcatccccaaccaccgattgttatgctaaaatgaatgaatgaagtatgttgaaaaaacaaaagaagagagagtcggaaacttccattcattcactcacacaaagaggagttttgtttagtaaaaaaagcaacagctggatggagatctcaaggagatatagagaaactattaagttgtaagtaacatgtgtggagagagatagagtgaaagaaaaaaagaaaagactctctctgtttttgatttcagatatttattaggaacagaacagaggaagcccttttccttgtatatgagaacagaggaaaagaagagagacaatttatggatcacaagatttccagagcctctctctctctctctcaaataactcttcttctatatttgaccatcaaagaaaggacaagaagacacacatacgtgtgcacgtgcactccttaactcctcccatgtgggatttacaaacatacaatagctgttctcattattattatttccttcttgccttgcaccaccattgttaactctattcaattcaaagtttcaaaccctttgaccaatgcatccccttattgggctttgattatatgggccctttctatttgatatttttcaatatatggcccgttaataaatttaatatatagcttcggccttataagaagaattcaagcccctcaccgatactctagtccaagccgtgggcagaaccaaaataagagaacaaaaaaaaagtttgttttctggaatcgtcgcgatagttgctgaactccgtcgcaacttcaatg

SEQ ID NO: 16213 - DNA, 3003 bp, Unknown
  misc_feature (1)..( 3003): 2750-1469P.txt file - cDNA_ID_1383333; gDNA_ID_2214543; Annot_ID_134507
attttgtaaagtaatagacaaaaaactagctgattctgcggtttgagcatagaaatggtatctttatacttcagtcacaaactatcaactttgaaaagaactacttcaaattcctaactaaaaacatacaaaacacagacgaagatcgaaacaaacttaagttagaccataaactaaacaggagcagatatgactttctccaaccatagatcaagatgtaacttatccataagaatcaaaaaacagaaacttttcaatcttctgcaacttcatagttaaccaagaacaaagcttaatcattgggaccatgttgtaaccaatctcttacatcgagtgatcacacatggaaattcttgagctatacgtgttaggatcagctcaaggaccaacaaaacaatagagactatggatcattaatcatacttcactacaagcaaaagtgactaaaaccaatgtcgacgaaactgataaatctaaacaagtagatgaaaaattagggaaatgaattaagacccaattagaccagaagaaagaagaagtgaaaaatctcacctttctctttcatgattttgagaaacgaagacattacggtagagacaggtttcaactccaccgaagctttccctcgcttctcagcattcacgatcgttctcaatgcatcgttcaatattctcctccccattgatcgaaaattccgatttctaatacaaattctataatcgaatgacaacgaatcaaaaagaatcgataacccctaaagttcaacagagcagcaggaaatgggtttattccaacgtttctcagaattgtgggtatttcgacatttcgaaaaacattaggggtattttagacttttcacgttcacttacatgagctagggttttatttttttcagaggtcatatataaatagctccattcgtcttctaacaaagctccggcgccaccattaaaatctctcgatctctatctgcgaaatttcacggtgagcttagtattactctcaattgttctcagttcagtatgtcttgattttcgtagcttagatgatctgattttgtgtagatattttgattcagcgagctctatagtagtagcctttaggaatcgatctgttaatgtatgtgttgttgattggtagtatcatttttggtgtggtgaaggtaggtatttgaaatggcgacagttccaggacaattgatctgggagatcgtgaagaacaacaactgtttcttggtgaagcagttcggtagaggaaactctaaggttcaattcagcaaggagactaacaacctcaccaacgttcactcttacaagcactctggtaaatttgtactcttgtttacgagattctttgtttctgaacgaaatgatatcttggccatttgagaacaaatgattactttacatctctggttggttgatttagtagaatagattgggaactaaagttgttaagaaatgttgatgtgttaagtgcttttggttctatgaaagattgtggattctcgactattagatgattgtggttgaaacttggctgtttgagatcgtctttatgcactattttattgattctcgagtataagcttattttcttatctgttgcaagttgaccgtgaaatgtagtttctttacatttgaccatttgaatctgtattacaattgtgtatgtatcttctaatttaaagacaaaaatggtagtctgagttgagcagacacttcatactatgtattaggttttgttattgtcttgaattaggctaaagtttgaatcttttgatgtggtttcaggtcttgcaaacaaaaagactgtgaccatccaggccgctgacaaggaccaagctgttgtgctcgccaccaccaagaccaagaagcagaacaagcctaagctctctgtcaacaagtctatcctcaagaaggaattccccaggatgtcaaaggctgttgctaaccaggtattactcaatttttattactttagtgttttttatatgtctatggtgtgcttataggtctctatatctagttttgtgtgttattttcacggctatgatctacaattggtttttatgttcttccctctacctgtgagaggagagttaatatgttatggtaaaacgatatgatgcatagctgtgcaaagattaaaatttaacttcatataaggctcctttttgtggcatattgatgaaatattaattttacacttggctattttcattgatctgcttaatgttgctgtttattggtttcatacgtgaatacaatctaaaccaaatgattgtgtaaatgtttaggtggtggacaactactacaggccggacttgaagaaagctgcacttgctagactcagcgccatcagcaaaggtctcagggttgccaagtccggtgccaagcaaagaaacagacaagcttaagcttcttctttcacaatctgttttttttgaagtaaaagattttgttgaacaggttttatttaagttgttgctttgaagttgaaccataatgctattctcctttttcattatccttattataaaggagttagaagtttatcttgttatgcttgatgtttctggtgtgcttgtgttacattttgttagatccttttatcgaatcaagaactttcttaaaatctctattctagattttattagcaaatcaaatgtaatcaacaaccaagtccttatatattatgacttttgaaagcctaaattgactcaaaatagcaaacataaatgtttagatttgttgcatcaaatgtgatgttcttgtggactataatgttgacattttcattagatcccatcaaaaaccaacttgagaattccatcttagcatgctctatacttatccaaaagcccatcaggcccatagacggcccaacttatagcatacggaaaggtttatattagggtttcttagacatgaattaattctgttctcttgctgtggccgtctccaacaccatttcgaagaccagggagatcgaagcaaaatg

SEQ ID NO: 16214 - DNA, 3003 bp, Unknown; identical to SEQ ID NO: 16213
  misc_feature (1)..( 3003): 2750-1469P.txt file - cDNA_ID_1383333; gDNA_ID_2214543; Annot_ID_185291

SEQ ID NO: 16215 - DNA, 3000 bp, Unknown; identical to SEQ ID NO: 10435
  misc_feature (1)..( 3000): 2750-1469P.txt file - cDNA_ID_1383349; gDNA_ID_2213649; Annot_ID_132443

SEQ ID NO: 16216 - DNA, 3000 bp, Unknown; identical to SEQ ID NO: 10435
  misc_feature (1)..( 3000): 2750-1469P.txt file - cDNA_ID_1383349; gDNA_ID_2213649; Annot_ID_181560

SEQ ID NO: 16217 - DNA, 3003 bp, Unknown
  misc_feature (1)..( 3003): 2750-1469P.txt file - cDNA_ID_1383434; gDNA_ID_1621088; Annot_ID_55451
ttcgactcgagtaataatggccaaaatatgaaagtaaattagaaagaaaaaaaaagactcaatttaaaaaagaaaagcaagagagaagaatgttttaagatttttcaaaatgaagttttaagttacaaggcttaacttatcaaagaaaaagataaactgtcgaattagagacatatgattaagaatttggatgatgatatttatatatgtgttagtacaaagcggatttacgatatggcttggggacaaatgaatactcagggttaaattattgagaagggaaaaaatctaaaggagatgacaaaaaagggacaaaggggaacacgttaatgtacaaatatagtaaggagtcaggaacttaggtacgatgtccatacgttttgcggtccaaagactttccatttttgtaaatctttgaaattaaccccacttggttcccaaacatccttcgacaccgacgacacacacaaacacaatttatttcttttaattaagttttactttttaaccttttttggtactatatatcgaaaccacacccaaattttagtacggtcccatttgcaataattcacgttagttaatggagggaccaacgaattattccgacttttcaagttttcatcaatatgggaatcatttccatttttcactttaatttctgctttaaaattgtttcgatgtttcagacaaaataaattaatttataagatgatggacgataggtcgggcctaactgaggcttaggtaagagatacattatgattcttcggtttcaagcttgaagaaaatatctcattatggttagttgacaagaaaacgacagcgtttgatataccattttattttttagagtacatattattatagtatgaaagcaccaaagactatatagtctaatttttagttgatctatagattttttaaaaagtttgcagtcaaaactgttgatatcggaaataagataacacacgaaaccccgaacgttagtcatgggaatctattatcaccaaagtaaaagatggaatgaagtttagtcggaatgatagacactgagacacccaacgatggtattataatagattaagaccttgaatgttttgtacattttgtaagagtttttgggttttgtttttcaaaaacttattttcataccaatcaagattttaaaattttggtttctctatagtttagaaaaactattttgttgtaatttttcattcctcattttagttttttttgttctcttaaaattttgaaaatctagtttatactcaatcaacgttatttttttcaaaaccaaaaatcatttttttgaaattttttaaacaaaaatataattacaaaaatctaaaactaaaatctaaaatctaaatccaaaaactgaatcgaaaatcaacctccattcagggcctaaattgtcctcttacaatacatttttctttccatatgtgatatcataacggataggtaaaaatgaataaaataaaaactttggtaaatggtaacaaaatatcatcaaaattttaccatttaccataccccaaaaagcaacatagcaattaaaaaacaacaaactatcatcaaaggcattataagagaaccctttgagtacaatgaaaggttcttgaatattgaatgcacgaatcaaaaggacaaaatgctaagtctatgtaatttttatgtatttacatttaagtttgaaaacatatcgttaataaaagtattttgtatgataaaaaacttttagataaaaaatataatagcgatttacttaaaactttgaaaaagtttaaaattaaatttaaatacgtgaaaatatgatgaacttatgacaccacaatacttacggaccaaaaggacgggatgctaagtctaaccattttcacgtatttaaatttaacatttaaatttgaaaatattttttattttacaatattaattaccaaacagcttttatttattttgaaactgaaaatttaaaacaaaattattatttttagtaaaatcaattgttatctataacgttaattaataaagaaaccaaaaaaaatatttttaaaaaaaagaaattaagaaaggaacatacctcgtgaaatagggagacgtttgtcatcagggattgttgtttgctaaaaagcccatacgctgttttgcgaagcccatatcatattgggccaagattgcaaattgtagatgagagatctgagtcatcttcatcttctctcctagggcgagtccttaacggtctgattctgagtcattgaaactccaaacctactcgtcggttgttgatgagagtttctttgcgcttttcagaaagaaaagacaggtccgcataagatgcatccatggttggctagaaatcaacatcgattgatcaaacacgagagaccactccaagtggcgttggtatggatatgatctctaaccagtaaccttgtcggattaatcctccatgattgatcagagattgtgaaatattagagagacctctctcgacatggcgttggtaaagatcggcgacgtatatggatcatcaatttcacggtttcgaaatcgacgatcgtctttgtaaaacagtagcagagaaaagaagaattttgtttttttgtctcttaaagaaaaattatgatttcccaacacaagacagatgaatatttataaggaaaggctcacgcaaagaaaaaaaggaaacatcaggttgttttccttttttcatatttggaccttaacaaaaaaggaaattgaatcgcacaattaaggagcgtttacaacggtcttatttttctaatctcaatttgcagatttcgttaaaaggccacgtgttcgatttttttttaacgcataaattgtattgtaattccaaaactacatcgttttgaggtttagccattaaagtcacagtcacactttcgcttttcccaatacgaacaagcggtgacgcatatctcctgtatcatcactcttttacttccggcgatctctctccgacggccaatg

SEQ ID NO: 16218 - DNA, 3003 bp, Unknown; identical to SEQ ID NO: 16217
  misc_feature (1)..( 3003): 2750-1469P.txt file - cDNA_ID_1383434; gDNA_ID_1621088; Annot_ID_170588

SEQ ID NO: 16219 - DNA, 3000 bp, Unknown
  misc_feature (1)..( 3000): 2750-1469P.txt file - cDNA_ID_1383434; gDNA_ID_2926212; Annot_ID_142032
gactcgagtaataatggccaaaatatgaaagtaaattagaaagaaaaaaaaagactcaatttaaaaaagaaaagcaagagagaagaatgttttaagatttttcaaaatgaagttttaagttacaaggcttaacttatcaaagaaaaagataaactgtcgaattagagacatatgattaagaatttggatgatgatatttatatatgtgttagtacaaagcggatttacgatatggcttggggacaaatgaatactcagggttaaattattgagaagggaaaaaatctaaaggagatgacaaaaaagggacaaaggggaacacgttaatgtacaaatatagtaaggagtcaggaacttaggtacgatgtccatacgttttgcggtccaaagactttccatttttgtaaatctttgaaattaaccccacttggttcccaaacatccttcgacaccgacgacacacacaaacacaatttatttcttttaattaagttttactttttaaccttttttggtactatatatcgaaaccacacccaaattttagtacggtcccatttgcaataattcacgttagttaatggagggaccaacgaattattccgacttttcaagttttcatcaatatgggaatcatttccatttttcactttaatttctgctttaaaattgtttcgatgtttcagacaaaataaattaatttataagatgatggacgataggtcgggcctaactgaggcttaggtaagagatacattatgattcttcggtttcaagcttgaagaaaatatctcattatggttagttgacaagaaaacgacagcgtttgatataccattttattttttagagtacatattattatagtatgaaagcaccaaagactatatagtctaatttttagttgatctatagattttttaaaaagtttgcagtcaaaactgttgatatcggaaataagataacacacgaaaccccgaacgttagtcatgggaatctattatcaccaaagtaaaagatggaatgaagtttagtcggaatgatagacactgagacacccaacgatggtattataatagattaagaccttgaatgttttgtacattttgtaagagtttttgggttttgtttttcaaaaacttattttcataccaatcaagattttaaaattttggtttctctatagtttagaaaaactattttgttgtaatttttcattcctcattttagttttttttgttctcttaaaattttgaaaatctagtttatactcaatcaacgttatttttttcaaaaccaaaaatcatttttttgaaattttttaaacaaaaatataattacaaaaatctaaaactaaaatctaaaatctaaatccaaaaactgaatcgaaaatcaacctccattcagggcctaaattgtcctcttacaatacatttttctttccatatgtgatatcataacggataggtaaaaatgaataaaataaaaactttggtaaatggtaacaaaatatcatcaaaattttaccatttaccataccccaaaaagcaacatagcaattaaaaaacaacaaactatcatcaaaggcattataagagaaccctttgagtacaatgaaaggttcttgaatattgaatgcacgaatcaaaaggacaaaatgctaagtctatgtaatttttatgtatttacatttaagtttgaaaacatatcgttaataaaagtattttgtatgataaaaaacttttagataaaaaatataatagcgatttacttaaaactttgaaaaagtttaaaattaaatttaaatacgtgaaaatatgatgaacttatgacaccacaatacttacggaccaaaaggacgggatgctaagtctaaccattttcacgtatttaaatttaacatttaaatttgaaaatattttttattttacaatattaattaccaaacagcttttatttattttgaaactgaaaatttaaaacaaaattattatttttagtaaaatcaattgttatctataacgttaattaataaagaaaccaaaaaaaatatttttaaaaaaaagaaattaagaaaggaacatacctcgtgaaatagggagacgtttgtcatcagggattgttgtttgctaaaaagcccatacgctgttttgcgaagcccatatcatattgggccaagattgcaaattgtagatgagagatctgagtcatcttcatcttctctcctagggcgagtccttaacggtctgattctgagtcattgaaactccaaacctactcgtcggttgttgatgagagtttctttgcgcttttcagaaagaaaagacaggtccgcataagatgcatccatggttggctagaaatcaacatcgattgatcaaacacgagagaccactccaagtggcgttggtatggatatgatctctaaccagtaaccttgtcggattaatcctccatgattgatcagagattgtgaaatattagagagacctctctcgacatggcgttggtaaagatcggcgacgtatatggatcatcaatttcacggtttcgaaatcgacgatcgtctttgtaaaacagtagcagagaaaagaagaattttgtttttttgtctcttaaagaaaaattatgatttcccaacacaagacagatgaatatttataaggaaaggctcacgcaaagaaaaaaaggaaacatcaggttgttttccttttttcatatttggaccttaacaaaaaaggaaattgaatcgcacaattaaggagcgtttacaacggtcttatttttctaatctcaatttgcagatttcgttaaaaggccacgtgttcgatttttttttaacgcataaattgtattgtaattccaaaactacatcgttttgaggtttagccattaaagtcacagtcacactttcgcttttcccaatacgaacaagcggtgacgcatatctcctgtatcatcactcttttacttccggcgatctctctccgacggccaatg

SEQ ID NO: 16220 - DNA, 3000 bp, Unknown; identical to SEQ ID NO: 16219
  misc_feature (1)..( 3000): 2750-1469P.txt file - cDNA_ID_1383434; gDNA_ID_2926212; Annot_ID_202694

SEQ ID NO: 16221 - DNA, 3000 bp, Unknown; identical to SEQ ID NO: 12061
  misc_feature (1)..( 3000): 2750-1469P.txt file - cDNA_ID_1383470; gDNA_ID_2214529; Annot_ID_134240

SEQ ID NO: 16222 - DNA, 955 bp, Unknown; identical to SEQ ID NO: 412
  misc_feature (1)..( 955): 2750-1469P.txt file - cDNA_ID_1383473; gDNA_ID_1590839; Annot_ID_150136

SEQ ID NO: 16223 - DNA, 3003 bp, Unknown
  misc_feature (1)..( 3003): 2750-1469P.txt file - cDNA_ID_1383514; gDNA_ID_2214704; Annot_ID_136943
atatagaaacgtgagtgtgtttcctgtgacacataatcatatcttgctgtggaagcaagtggattgccgtgaagttagaggagatgagtctggtgacgagaaggttgtggaggaagggactggttatgattatgaacaatggggacttgggaatttcttggagagttggcaattatctgacacagtcttccttgttggtgaagaggaaatggatgtccctgctcacaaggttatattacaagcatcaggtaattttcctttgagatcatctgatggggatgtcattcaacttcgtggagtgtcgtacccgattcttcatgctcttcttcaatatatctatactggacgaactcaggtaatttctcatatcctcttcccttgacgtaattgtcccttttgcctggtgaaatgctttgttaggaacctttttatttatttattagtaaacatggagattctatatcttcgtcataatttccttcaaacttttgttttgatgtagattttggaatcagaacttgctccattgcgggatttaagttctaagtttgaagtgatgtcattggtgagacagtgtgaagaaagtatagaccattttaaattgagcaaaacagcatttgactcctgcagaaaagtcaaactcttgtgtcctatttctcacccgttatctggctttatgttcccaagtgctttccctgttgatgttgggaagctggtaaagttgtactcaaccggcgaatatagtgacataaaaatctacctcagtgaccatagtctcactttccaatcccacaaagtcattctaagtctttggagtgttgcatttgcaaaggtgagaatctcttttagtgtcgcagttctgatgtacatgaatatattgattctcaattttcttatttattctctatgaacatccagatgtttacaaatgggatgagtgaaagccattcatcaacgatttacctaaccgatgtatcaccagaagcattcaaggctatgatgaatttcatgtatagtggagagttgaacatggaagacactgtgaattttggcaccgagttgattcatcttctctttctagctgaccggtttggagttgttccacttcatcaagaatgctgcaaaatgctcttggagtgcctctcagaggtaatttttttcttttcacaatcctctagagtaaatgatacgtctcgctgtcattatcatgtttcacttcttttccagtacatctgttacaatatggtttctgtatgatagagagcttaatgagccgtgaagtgggttgcggtttcaagccttctgaaactaaaagagaaaagaaacgaaataccacattcaaactacagagtaaaaagaatattaatattgtgtcatgtatatattacatgcagggatggcgttccgttttggaagaaggtcatacaacaagaataattcttttatgcgagtttattgggcgtgggagcagacaaacttgagtcttttctcaagctaacctctgaactttgttgcaggattctgtatgctcagttctccaagtggtttcgtctatctcatcatgtaaactcattgaggagatgtgcaagaggaagttctccatgcacttcgactattgtaccactgcaagtttggactttgtcttgttagatcagaccaccttcagtgatattcttgaggtgtgttttctctttcgctaacgtactatttcttataagaacatctgaacccgcttggagacttgcccaaataaactgctacaacgtgttgctcatgcactgaccagtgattagttatcgtggaaatatatatgaacaatggaattgtaatggatatcaccaagagtgatgaatgacgtctcctttcgttatggcatgtattaaatcctggaattgcagtctgcagatctgacggtgacatctgaagaaaagattctgaatgctgttctcatgtggtgcatgaaagctgaggagtcgcacagttggggagtaatagatgagatgatgaactatgctgaccccaaaagtttgttcaaagaaaggcttcagtcacttgatgacctgttacctcatgtacgcttctctttgttgccatatgagttacttaaaagggtaagtggatcctgaccctgtatatgctgaatgaactttgtcattttctgttaaattaatttcgctgatgccatctatgctttgatgatgacgcagttagaaaacagcaacctaagcaaagaaatcccagtattcaatcgtcttgtaagttcttaacatcttctatcgatttggggattatttaatttgtcatttcaagactgattttctctccaagccctcacttattttgtcttgtgtacagttgaaggaggctgctagcttcctaacatccggattgatatccccaggaaatgaaccgatgtatgaattacatagtcatgtatcttaggattgtaaacatctccaggtttatatttccagacttctcaattattaaagcttttcacctctagttcaagattccaacatcggagatcgagtttcaaggagcttcagtacatacgtgatggggacagcaatggggtgctgcactttgtgggtacatcttatggtagtcatcagtgggtcaaccccgttctcgcaaaggttaacctcacttttatcttactttctttattcatattgttggaaatccaattaccatgacaaggaattctgctggagaaaaatatttccttatttgagttctttatgttttacagaaaatcaacattacatcgagtagtcccacatccagattcactgatccaaaggctttggcttcaaaagcctatgcggtatggtccacccaagttcgctcggattatatgactagaatttggcttgaactacaaaattgacgaagcataaaattaattgaagtgaaccttctttcctcttagatacagtatttaaccatatgatttcatttttttggcaccagggtacttcctttgcagggcctaggatg

SEQ ID NO: 16224 - DNA, 3003 bp, Unknown
  misc_feature (1)..( 3003): 2750-1469P.txt file - cDNA_ID_1383545; gDNA_ID_1620743; Annot_ID_49652
gttctatctgaaggtaaatcaagcttgatgatgataactaggcaaaaacacgcttgaagcatcatcatatgatgattaataatacagtttgataatagctatctgttgttaacttcagagtctgtcttcctatactaactggtcacaatctgactttcagaaatcatggatcagctcgtgacagaaggtgttctttcgaaaacggggaaggacatgtacattaaaaagagagacaaggtgattcttttatcctgactcctactttggtttcatttacttatgactttcgcctttgcttttaaattttattttctacctacttaccccaaaatttcagacaccagagagcgaattcacctttgtgaaagaggaagccgatggtcaaatttctccagggaaatctgttgctcctgaagactacttgtacatgaaagtgagggagactctgacttcttactctatgtttaacacactagctcaaaggatagatgaatagagatggtccggagatccatgattgacacttggctttttttgttaggctctttaccattctcttccgatgaaatatgtgacaattacaaagcttcacaacatgctggatggtgaagccaatcagactgcagttcgtaaattaatggacaggatgacccaagagggctacgtggaagcttcgagcaaccgcaggctaggtttgctacctcaattcagacccttctctgttaagttatgttggttgttgtgtcattttttcctcactgatgcaatgtttataaacagggaagcgtgtgattcattctagtctaactgagaagaagctaaatgaagtcagaaaggttcttgccaccgatgatatggtaataatacttgaaaaccagaatacctctttggaacagctttctaatgtgaatggtttcacaggatgtggatgttaccgaaactattaacaagacaaacggcccagatgccaaagtaaccgcaggtacactccttatttgcactttgcaacccaagttttaagctgttttaatcgatctgacatatttgaaacaaatagatgtatctacctgtggaggtatccactccataggttcagacttcacacgcacgaaaggaagatctggtgggatgcagcagaacggctctgttctaagtgaacagactatctctaaagctgggaacactcccattagcaacaaggcacaggtagtatgaaatcaccactgagagtgatagacatatcttactgtgtatatgactcttttaagtgtttgctaatttggttattgttgctcactcagcctgcggcttcgagggagagctttgcggtacatggtggagctgttaaggaagccgagacagtcaactgtagccaagcctcacaggacagacgtggcaggaaaaccagcatggtatcttacactaaaccatataaactctctctacgtttttcaactttttagttatttgctgaaagaaactgacatggttcttgtgattgttattcctacaggtgagggagcctattctgcagtactccaagcgtcagaaatctcaagctaattgaagacaccacctctatcagacaccataaccaccttcttcagtggtgatgatattaacctgaaacactcgctttttattgctttatttctcctctgcattcagactattttcatactccatgcttgttattatctctcttaaagtatcatatcttatcgcacttttgggaagataatttattgcatatcaaactttaacacttattagttattactgtgagtattattcactaatgctctacatgcttttatggaacaagtatgaagtataggactatcttcgttttaaattcccctgtcgatcactttaatccaaaaactttaactttagatactaacacgtgttgaaacgtgtactacgccattccacgcgtcaggaaatcgagcaccgccgaattcatctcgccggagcatcaccgccttcgatcagtcaccgccgatccgtctagtagtgatggatagccttctccttgttgtcgatctcgaatccaaatccaataaacgtcgaagatctgccggatagaacaaagaagctgcttcaaaaatctccaagaaacaccagcgccagggaagcttcatctataacgacacccatattggtgaagtcgattctttgctcttcctgagcaaaaggaattgatgaagatattattccttgaacacaacggtgaaaactaagaggatttgtgaagaaaacggcgacatcgacagaaaacatggatggagatctaaaccagacagagccggttacaaaagctgacctaaagtcagattattcaattcgccgtagcgaaatttacagattccgattaacggaaaacaaaagaaaaaccaaatactaatctccgatggagatcggagaacggaggttctctctctctgaagagtacgagaggggtaaactgggccgcttatttcgcatgtacgttattgggcttctctttgtaattgccctaatggactgttttaatgaaagtatttggccgacaaaaaataatccaaaaactttaacgcttatacgttcactactcaatggaaagtatacacgtgttcgtacaagaatcccctagaatattttcgtcattccgagcccacagcttaaaagtccagaaacatccacacacgacacgcctttctagaaacgattctttttttaataccccacacaccctcagatctattatcaaccgttggattacgtggacaagtccaatgccactcgtatttttaaccattcctcacactcctcaacgtgatgtgaagatactttgctgtttcataacgtcataaagaacagtgacaggcgaaatttctcaagaaagcaaatcggaagaactcacaaaaaaaactaaggtaagagattattatcatcacttttgttcttccttcactcaaaactacgatcaaaatcgtgatttcatcgtctttggtgtagatg

SEQ ID NO: 16225 - DNA, 3003 bp, Unknown; identical to SEQ ID NO: 16224
  misc_feature (1)..( 3003): 2750-1469P.txt file - cDNA_ID_1383545; gDNA_ID_1620743; Annot_ID_166526

SEQ ID NO: 16226 - DNA, 3003 bp, Unknown
  misc_feature (1)..( 3003): 2750-1469P.txt file - cDNA_ID_1383728; gDNA_ID_1620721; Annot_ID_49202
atatcaatatgggtaataatgctaaatcccaatttattggcccaaataatgagacatgactcagcccagtaaagtatgcaaaatacatttaggtattgaacatatcggggggagatatgtttgtgaatgtccccaaagcatatcttatgaacgattccaaaatcatgtttggacattcattcacccgaataagttaatttagcaacacttttaaatctagactattacatcatttggagttttcgtagaaacttcaaattacgtgtcttaatattcctgtctcttactctacgtcacattcatgtctatggcggggctttgaatagttgttcgactaactatgagttttggttttaaggctttgtgtgaagacgtatttcttcattggattcaacatgtgtcaaggactgtttctatgttcttttgactattaccttctaatttaattataaaataatggaaccgaatttttgatttaagatttttctctgattggttgttactcctatcagatcacgtttacttggaaaacaaaacagatttttctcgattggtgtattttaagaaaatactcacagattatttagtgtcgtctcctcagcaattacatatccaaatattagtgccattatttcatttcttttgtggaaaagacttctctaaaatctctctttgttgtttttacttgcatcacacactttaagctataaagagaaacatatgcttatgtacaacaaacagtacctccaagaaacattaaacaagaggataatgttgatcgagtcctactgaatctggacatcgatgactttgcgttcgactttggtcttagggatagtgataaagaggactccgttcttgagctcagctttgatcttgtctttctcacagttgtctgggagctgaagtcgtgttccatatgagctaacgcttcttccagaccaagaatcatcactgtcttccttcttctgctctcctttgatcacaagtacgttatcttctacagagattttgacgtcttctttagagagaccaggcatgtcgaaacgcatcttgatctcgtgttcttcctctttgatgtcccacggtgcacgaatctctgacactccacttcctcctctgtttcttcctgagacaggcatagtgtcctcgaacatcctgtccatagtatctaacatttgtcgcatcgtcctcattggtgacaaaggatccaacaatcctgtggttagattaaaacagaacattgtttcagttcaaagcagaggaagagattttcgattgacaaaagctgagttcataaaaacagagcaatgttttaagtaataagcagaggatgtagtttttatttatacaagtgaagtccgtttagttagttgaacgtaccgaaaggagagacgtccatggttaagcgttgttgaggtcttttttcgacacttgatccttggttccctttttgttgtccttgctgaacaacatcaatggagttttctctctggtcttgagccctgatccggctagggatcttccgtgggaacgaaaccgagaacggtgtagcggacttcgatgagacagaaggagatggagcaagaggtgaacatagagccgatgcagcaaatgagagtgtagaagccatttgtttcgagtatgagccaaaaatatcgctgagtgaagattagaaaattctagttctgagtttgttgagtatctactacaattgtagaagtgagtgtatatatgtaggtgaggatgagaaggctctaagtgacaaaaggagaggtcttgaaggttgaagatttgatacgaagtttctcgactcgttttgttttctatctatctattttactatttgttaacctttgtgcgttttctcgtgttttctcatcttctcccgaaccatcttctttttttccttcttgccaatcagtgtttatttgtgatgaactaataaaaacaaaataaacgaaaaaaaaagactagatttctacaattagaaaaaccacgattacgaaaaaaccatgattagatgatatattgtttaaaaaaaataaaaaaatcgaagaaagcatatcatattgaaaaagagagagaaaaaaagcaactcaccaagtcaccattatgtgtgctaacttgcagaaacatatgagaaatggaatgcccaagtaaactaaaaatatatatctacgggagaaattagaaaattttgtctagtttgatcatatcagctacacgtatgtcatatacagtatcaaacaggcttattagcttacgtataaactatctatagcatgttgaattgttcaagtcgttttttttttttttttctttatcacagaattgttcaagtcgttttatataataattgttgtacataaattatacaaatagcatgacatgactctatattaattttgattggtataaaattatacaaaatttaagctctaatctattaatccgcaatccgatcaaatgttcaatgatccaaaagactttatgttttgtgtatagatttggttttagaaacattgaatgatttttctctatattttcaaaaggctgctagaataagatcagatgatgtaatagactaaaaaagaaaaaacaagacacacattgaactgatataagatgatgatgatgcaatagtacctacaaaatctagtggacgccgaacagtactttaattcggttttagaacattctgaattgaaggcctattaaaggcccttcttgacacaatctagttacacgacttacgacggtgcagctaaggctatttcggtaatttcagcttctcctttcctcgatctccaagtattcgagaaacccccaccaaggcaaaagctctgtcgtcgtccacaagaacaaccaaatttgtttccgtcttctgctaacatatcctctttttcatctgggaaccctaatttcttgactaacttagggttttatttatccatttgagatactctgtaattgaaaggttgaatttttagaagagacatg

SEQ ID NO: 16227 - DNA, 3003 bp, Unknown; identical to SEQ ID NO: 16226
  misc_feature (1)..( 3003): 2750-1469P.txt file - cDNA_ID_1383728; gDNA_ID_1620721; Annot_ID_165828

SEQ ID NO: 16228 - DNA, 3003 bp, Unknown; identical to SEQ ID NO: 16226
  misc_feature (1)..( 3003): 2750-1469P.txt file - cDNA_ID_1383728; gDNA_ID_2926191; Annot_ID_141052

SEQ ID NO: 16229 - DNA, 3003 bp, Unknown; identical to SEQ ID NO: 16226
  misc_feature (1)..( 3003): 2750-1469P.txt file - cDNA_ID_1383728; gDNA_ID_2926191; Annot_ID_201060

SEQ ID NO: 16230 - DNA, 3003 bp, Unknown
  misc_feature (1)..( 3003): 2750-1469P.txt file - cDNA_ID_1383836; gDNA_ID_2936565; Annot_ID_194605
ttgagtgtaacgcaaaactcatattaatctgtgaactgtagtattactatttacctgggaacatctaattaaccgtaccataaactcttactttgttgccatttacatgtagtttaaccagattgctcttgaaaataggaaaaactcatgtggttaaacggtccgactatttatgattaacaactgcgattaattatatcttaaggatattaattattattagctgtcataccatatagctaggtgtacaaaaagctttttgtccaaacaaaagctgttgatttcttactcgtcatttcctcatttagcactatcatcatcactcatcatcgattcatcatcttcttcaaattatatactcacgatatgtataatattattattcataagaatactcatcataaatagctttagaaaaccacattcatttaacctattttagaaagttaaaaatatttgatcctttcaaactttcccactgtatatactcccatattcaaccagctgtgtgtagggtttatcagttgtacatttaaaaacaaacaaataatctactcataaatatataaaatttcataaaaaaagaatttgttgtaacacattgattctccttgaaaggtttgtgtcggctgttccaatctatgacaaaaccgaaactcaaccaaaaacaaaaaaaaacattaaagaataaaagaaataaacgaaatatacagaaattgaaataagaataacatttattaagatggacacaaagccgttagcttcgttccgttaaggaacgtctctacgaaacaaattggcgtccaagtctttcgtttttggccactttcaccaacttcgcgtccgacacagctaccttatttatttcatttttcatcatcttctttcgaattctactttttctattatttattacacaacctccttagatcctttgggacatggaatcgacccatcataacttttcttttcattttattgttttgcgtataaatacattttcttcatgtaggtcaaatgaatcacttgattatttaagaaaatatgtttatttgttagtcaactaattggattttttcgttccaagtaaggaaattgggtagtcaccaactggttgttaaggtcctttaatccctcaattaagcaattgagcagacacaacacttcttcctcaaagcaacatttctggcaaatcaaaattctctaggcctagggatactttagtaattttaattactttatattcaatatattgatttgttgacaattctacttatatctttatttttaatatgtaaataataggaagatattgaaaaaatggagttaattagtttcctcttttgcacgtcacttaataagagtatgtgtgtccaatgtattacgcgaagaaacaagtatataacgtataaacagtaggagacctcaaaagatgtttaattttaattttgatcacaatctttttagagagttccgtcgttataataatttaacaattatacatcaaaacatcatagattagttatgaagtatcatgtcacgtaacacatgtttctcgttcgcttataaccagggatctgcaattatgtaaagaaattaataaaagcatctgttggttcagactaacccatgattttatcatcacaaccacaactaatttgagattgcttgagttaatttaatctaacaaagctttggtggaaaattttaatagtaaaaaatttcaacggttgcttgaatttatgtccaagctattaattaaactttataaaaacatagaatacgaaaactcaactcttttcttcattttaaaaaacatactttatttttaattatatttatttgaatataagcaccaagtcaagtcaatgacaacactgcacagtattccttctggttccaataatattcttttgttttatcagataacttgaaatataaatgcatataaaaagtcgcatttgtataaatattctccattatctaacaataatcctatcagagaaaaggaaaaaaaatatgaaaatttccgctcacgcgtgttattctctaaatggttggcacagaaaaaaaaccaacaaaaaattattaattttaatatagaagcttcggttggaatagaaaaacaaacaaaaaagaattactggtagagaatagagattgtcaaatttctccataggttagtgatacactgatattttattaaacattaattaaaaaatctgggtttgttgtcgaggttccaatgataagatggtttggttctgttctttgttagtgaatgccaaataaagttttaaaatagtatcggaatttaataaaaatcgtctcttgggattgggtgtcttctctttctttctctctctttttgtcatcgactgttcgaagttcttcttcttctccctttttatctctctgttccctgattcagccacatccacaatctctctttctcttttgtatagtttatcatctagctctttctcaggtttcatttctttaactataataattcgattgttcttattagtagcttcttgattcaaagctatatgattgacttgttgtactctgtttctctttttacaaaaagatttcctttttcgaattttatcatcatcttcgtctctgttaaattcttacaaaagtatgaaatcatcagaacttaaaaaaaattaactttatatctttcatgatttcaaacatcatcctctgtttttgtttgcgtcactgaattgaagtggaaactttacctagggttttgatatcttcttgacctaaattgagtatttcatatttttttcatttcttgaattcatctgtaattgcggcgtatatagagattaagatgttttaacctctttaaagaattgttcttttatttatccagtttcagtttcaaactcacacgtctctctctctctctttctcttttttcagacaaaacatcaatcggatgaaactcacttaaacaacaaaacactttcgatttattatccaatg

SEQ ID NO: 16231 - DNA, 3003 bp, Unknown
  misc_feature (1)..( 3003): 2750-1469P.txt file - cDNA_ID_1383941; gDNA_ID_1972120; Annot_ID_178930
catgcgacggtaacggagaaggtatcaacgagaacgtgtccgccgtgatctcagtcaatgttttggtgtgataatagaaaaaggagccgtttatttgcgagtgggatccacgcgcctggtcgttgggcaaatatggcgggtaagttttggcggggaaataaagaagaagaagccttatagagtagttaccgtgactttctcgaaacgtggaccagaccaaaccgtcgcacgccagatttgtcggaaggtaattatagtttacttacttggaaaacttttgcactaataaaattaaatcgtgtaaaaatttgttaacattcgtaaaataggaatattaatttatccaaatgaaaaagagggaatataatttttgaaaaagaaaaagcaaaaggttttctagtggttgcaaccacacagacgcaatcaatttattattatgtgtactatagttttcttttgtaacgttacacgatatccaattaatatttagttgaggatttgttatgcttatagcttttgactatgtccattgtccagtgcataacctttgcttttctttcaagttgttaacagcgattctctaggctgaaaaaaccctctaatttgcttactaatttcaatattgacggtctactagtatattagtatgtaagatccgttgaaaattatgtaacaaagaaattgaacctgaaccaccaaaattaaatgttttgtatgattggttgtgagattttcggctaaactgatcgattcagcttgacaagtctgaaaagtagaagccactcatgcaggttttgatatgtttcttgaagggtgttgacgtaaagaaaataaaccatggatgtttggtatatgtaagaagtatattttgtcttcattttaatggaagaattgatctttcctatattcataggagccacctttttggtacgagtttgagtttcttgttttatgagcccatgtgttgatcgtccaattcttgttgtatgaaaagaagttggtgtcggtcaattaaatctgagagactttacagaaatgtgtgtttcgtctagctccaggccggaactattcttgcatagtggaagaaacaaatcctcgtattattaagtctccttgttcccgttattaataagtttcatgtggtatatatcatctcaatattattagaacaatagtataatataactaagaaaatctttccatatgttttatcttgatttgttcagttgttcatattcatgaagattgtatactccactttttatccttgtgatggtagtgtccattttgcctctcaaatatttgaatctctgcttctcacgatttgaatgggtactgtaattttgatttgatgcatgaagatcaaaagctctatattttctcttgattcagtctaataatgctgcatgcaggcaaatactgatgctactcatgtggatagtaagatttttattaattatagcggtcttaactagtttttgaaatgtatcactttaatgtttttttacagttttggaataaaatccaaaattgaaagaacaactaatagcagcaaaccactaacgtgatttagtgatgctgcgtaagtaaattattctttggtaatctcattgtttgcttttagtaccctaaccatatctaaaaccacttggttgttcaagatgtggacgatcatgatgactcattcttgacatgtcttaacgattacttttgtccacaaccacaaaacaaaatccttatattgatattaaaaaataacattggcaacttcatttgaaatctcaattaggcaatgatgcaaaaccaaattgtatttgttaaagaaactttatttttgtataacatttgagagcagttactgtaattgcacaagagttgagacctggtaggtcgacttaagggccattcaagtcacacacagactcgcaagtcacaagaaccacaccctaatcttctaaatttgcggagagcctcatagtttaactttcaagttgcctctatacacaaaactttgtcgtgtattgatgattcaagtggcatttggttggccacataattcaaaaggtatataccggggaccagtcacttttgtgatatgtttgaaggcagatattcatcggggtttggcactctattccaaacaaccggtctgaggaaattatatgtcttatagaaaacgtagttagataagatgtaataggtttatgtcttttcacgtcatatttttagtattcgatttaacataacattttacaatgacaataaatattaatttttaaatttaataaatttataccagatgctattatatgtaaccaaatcacccaattcggtttggtttagactactgtcagttttcttgcaataatttctcgtaggaccgacaaaaaaaaatgaatttaagttttaaatttggttggttcaaaacttaatatcaatttttatggtttagaagaagaattatagctgccaaaagtattttgtccggtaattactaattactctttgtaatctcatttaacttgcccgtttaaataaacagacaaaattaaagaaccctaattaaagtttggcagaacctatgtcccagaaagtaagaaaaaaacaaagtaaactgagaagtcatagtcaaaagacaagttagttccaaccaaaataaaataaaatgtgatatcaagttgaaaaagtgacggatagagaatctatcctttggatcctctcctctatttttagcccttcacttggatctctcttggataactcattaaatgacactatccaatataaccacatgtgtatctgcgtatgtatatgcatgtgtatttatatttagaagcttcctagttttgtctaagaaaatatcttcttgttttgttcctttcagcgctataactcataattctcttccaaagttcttggatttgttccccaaatcaactggagatctaagaagaagaagaagaagagcgaagatcaaaggataaggaagaagagaggaaaatg

SEQ ID NO: 16232 - DNA, 3 bp, Unknown
  misc_feature (1)..( 3): 2750-1469P.txt file - cDNA_ID_1383985; gDNA_ID_1592314; Annot_ID_152243
cgg

SEQ ID NO: 16233 - DNA, 3000 bp, Unknown; identical to SEQ ID NO: 4799
  misc_feature (1)..( 3000): 2750-1469P.txt file - cDNA_ID_1384329; gDNA_ID_1620733; Annot_ID_49426

SEQ ID NO: 16234 - DNA, 3000 bp, Unknown; identical to SEQ ID NO: 4810
  misc_feature (1)..( 3000): 2750-1469P.txt file - cDNA_ID_1384329; gDNA_ID_1620733; Annot_ID_166141

SEQ ID NO: 16235 - DNA, 3000 bp, Unknown; identical to SEQ ID NO: 4799
  misc_feature (1)..( 3000): 2750-1469P.txt file - cDNA_ID_1384329; gDNA_ID_2926179; Annot_ID_140454

SEQ ID NO: 16236 - DNA, 3000 bp, Unknown; identical to SEQ ID NO: 4810
  misc_feature (1)..( 3000): 2750-1469P.txt file - cDNA_ID_1384329; gDNA_ID_2926179; Annot_ID_200055

SEQ ID NO: 16237 - DNA, 3003 bp, Unknown
  misc_feature (1)..( 3003): 2750-1469P.txt file - cDNA_ID_1384565; gDNA_ID_1620409; Annot_ID_156226
tgcaaaagaccgtgccaggaaccgcacctgataaaagaaagtgaagcgaaatcataaacatacatttaaagatgtaatttcggaaattcagccacaaacatgaaatgtctatataggcatttttgagaacatgccttcaagaattactaagttgttgaaactaatagccaggaaccaaaataaaaaatggtgaagagagtaatgtacctgatcaccacaaaagttttctaaaaacttccgtgtgacaaagacttctccagcagcttgctggtaactctttggagcaaccctttgaattaacctcgcgaagaaatcagcaacctaatagtgtatacacgcatacaacagtagctcagtatgcatgttattcagaaaacaaaaccttttgaattcaagactcgagattcaacaaaaaaagtatgtgttaccttaggtaaggcgagcatatgagctgcctttgtcgagatatctccatataaaaggtatctgtagaaaacaagaccattactatccttcatatatgaaacaaaatgggaaatgacaaaacaagaagaaatagcaccaaacctcaaccaaatcatacctctctggagatttgaaagggttatggagaccatgtttcgggcactgggataagctgtccacaaatggctacaacatagaacagaggaaaactgaaagttagaattgacacggataaacaacattgtgatacgatcaacggtttttgataggctcgtacctgagttcctgattcatccacttccgcaactttgataaacggttctccatttagaggatctagaagcgtgttatgatttgacgatcctatccactttccctgcactatagacataacaatgaaagtagaactcagagacttcacaacagcatttaaccaacaagctattactcatttccatagcgtcaacgcacaatcagtgagaagtaaagacataccaaagctctgtacttcagcaggatgagcaccagagagctcctcggcatctacggtagcaaaaggtatggaatgattcaatctgcaagatccataaacacaaaaattaaggcaaaggaacactcttttaaatggatcacattctcagacatcaaagagtaatcagaacacaaatacataaagtaccatttcaaactctaatcagctaacactctcttcattacatagagactgagcagatgcggctactcgatgatctaaatctcaaatttttaatacaccaacttgctaaagttttctcttttatttatttatatatatatacaaatggaaagtctattactttaggcaaaaacatgcaaccccaaaagacgaagagcaatgtttaacacaaaacaagaaataatttggtgagatcaggacgtttgaaaaacctggagagagtcaaagaagcaagcgaggtggatgatttgtcacagagagacttagctctcagtgctcggctcgcaaaaactctatacattgcgtaagatccacaagtaacggagaaagatgagaatcagacgattggatgagaggattcaagaagattggtgataaaatagcgaattctcgagtgatttgtgtttagcagcttattaaagaattaaatgtttttcccctgattgacgagaaatacattaatgatttaaagatatttacagataatttcttatttctaggttattatcttttttaccccatagtttctaatggcttcttataaaccctgatgtgatgagtcatgactcatgaggaagaagaagttgagcaaaaaataaaaataatagtaaatctcttttaaagacctcctctaatcaattcgactaatggaatagtaattagttaaatatcaagggaaactaataatgaaaattggtacaaaaaaaaaaagagatttatgattattatctactgttttactcttttgaaatttaaattggaaaatcaatagtattagtgatatttgacatcaaatccagggatcaaccaaggaattttgtaagatgaacacagatgtcaattacaaaatagataaataaatcttgatagataaataagtattaaaatggtgatagcttgctgagtcacgtccgcttgggccattggcccattgagtaatagacgtatacgtttgtcttttacacgaaccgacaaataaaaaataataatattaaaattgtattaaaattataaaagtcttttttcgtctttggaagaaaatatatatatgtttttttcttctggcaagttttgtattttattttcttaaaatagtatatgattttttcattttaaactttctttgtgttttcttcttctcttcctttatttggtgaagaaaaaggaaagaaaaatctcaactttgattctctctccctctatatatactttatttattctccactcataatagtttcatcatctctttcggtctatgaaaaacattggaaaaaccctaattcctagtgttgcgaatcacttttcattgcagctttgaacttcaggtaattttaggttaatcgagctttttcatttgatgcatgacatcggaagatcaaatctttcataggtgattgtataatctaatcctaaggctcgttgaaatcgataattgtactcttgatctacttaaattcagaatttaaattcagaatttatacacagctactatcgttgagtcgaacttaatttgctagttgaaataatccaagcttcaagctttcttgtctagaagtttggtgattcttgttctctgaccttttgggctatatggttgttgaagcttaagtctttgttaaactatgatgataggttatagaaatgtagatcttggtctctgcttctactttttttgggtctgaaaaaaaattgaaactttaatcagaaatttaaagcctagttcatgcaattgctcttactttgtgacttatgaaatgagtttgtaagagtaaagttgaaatctttcatatttggatgcagtctgtgaatttccaacagcaatg

SEQ ID NO: 16238 - DNA, 3003 bp, Unknown
  misc_feature (1)..( 3003): 2750-1469P.txt file - cDNA_ID_1386598; gDNA_ID_1620704; Annot_ID_48826
gagcaggattttactttccctttacatttttttcagccaattcgtaaacagcttttctctgatttatcttcacaggatttattcactcgagtggacaacatgtctgcggttacaaagcaaccaacttgtaaggaggaaagactgaatgctcttcaggtgccttaactacgtcgattttagttttctttctatttaatatctgatgacatttcattgaggatgtttttgaatctccttgtttttttgtctttgatagcttttattgttaccttataaaacagatagacaaattttgtggaaatgtctgctaggatgtcatagactgagaaatttcttatgaagaaaaatattttagtgagtaaaatttctgaggttgtcctgattactcatggtttcttgattctttcaggccttactatcttgtccgacgggctctattcgcactcaaactccacctgctgacataggggaagctcaagagacctttccacttgtagtggacaaagacacacttcctgtactttttaatcccttaagctttcatttttttaggatggttattaacaagtcaactaactctgattagatcattgtaagcatacgtaggttttgaatagatttagatacaatgaccttaagttcttaactgatttagctccactgaggactcttactaccttgttcttatatgttgtctgctgtccttgaggtttataaagtttgagatttgcattatgctcagggcgtttttcattgtggatttcattccaagaaatcgtatggagcaacttcttacctgatccttcatcgtgagggaaatatacttgttgataggtatatacccttgggaggaggcatcatgaattcttattttctttgttgtttagtatcttatacattgttgatgcaatgtatttcttgatatacttcgttgtggctattaactctacacaactgattaaaccaaggttttgctgtttgctgcagtcctaggtacgtggagaaacttgctggaaagatcgagatgaagggtggtgttcgctacatgtttttgacacacaggtagaattgataacacctaaaggagaaaatccgtgttttctcttgtaatctctgttaatcaggataagcgatttcattgttcagggatgatgttgcagatcacaagaaatgggcagacagattcaagtctaccagaattctgcattctgatgatgtatgtccttgaatttttcacacctctctgcacattcttgataggttttttcaacatctagatttcgtgaaaaatgaaaaagcttgcttacatagttacaagaaccttgggctgcttatatgctctgtagaaaatagaaaaagattatgaggttggataaaagtaaaaagtaaactagccacgcaaacaattttgttactaaacccatctctgatcgaccattaagggaattttttttttgttaggttgaaccttcgacctctgatgtggagttaaagctggaaggaagtggaccatggagtatctatgaagatgtcgaacttatacacactcctggtcattcagaagtaagtttgtccaactgcaagaacatacataaaaacaaatgttcaatttttgttaaaaagaattccatcatgatcttgggataagagcttcgtacaatttgcagggatcagtgtgcatgttccataagtccctcaaggcattattcactggcgaccatgtaataatgaccgaatctggattgagcattttagagcagtacaatcacggttcaggtaaagactcatctgttgaatgtctttgggttaatgtttttgaatattcattcaagaacgtagaaagattgatctaaatgttttttttttgtgtctctggcagtgcctctccagctcgagaacgtagaaaaattgatcaacctggatttcaattggctaataccgggttagtgcactttggctatatatatctgctttactactgaaatggacattttggatgttgatggcggttttgtatatcaggacatggaagaagagtacatttcaaagatggagacgagaaggcgaagaatctggaagcacttgttcagaagcacagagagaaacaacttgtttcctttagcaaatccgggaaagcttaagatatgtatgctgattctaaaccggttaatcaaactaaaccagaccgaatgtctctacggcctgactggtctatgtgtcagttagttcccacgcgagtgatgtatttatttctacgtaacattgtgaacctgcttaaacgcttactagattgaaacgaagaccgtgagtaataaagtctcctctttcctagtgcaagtatgtcagctaaagtgttgctgtgtttttttacgatatttttcatgttattcggaatgtcttaaatcacaaaaaatattcgacttttcacaagcatcggatgcatagttgtttatttgataagggtatctcccatagctagttaaaaatgttatttaatatattcgttttggtaccatatgctacaataatcatattatgcagagatcatcgaataacatcacataaggtaagaaagttcatgtaaaaagaaaatgcactaataatcattcacaaacttagcagtagattagcgatcgaaaattgatgtcaccaaatttaacaatctttaaaatgacatcttttaattaacgacgttcattcggagacaaaatgaatttcatcaaaaatgagtcactaaactatttttcaaccactccactaaaaaagttaaacctcattcaaaaactgccacgaaacattcccaccaacaaaagataacaaataatatagactccctcgccttgttgcttcccactacaaaagtaacaagaaaaattgttacaatactaagcatagtattaacgttatgctatatatacaaatctctcgtcggaccaaatattcgcattcatagatttcattacaaattaacgaactattcacagaaagaaataaaacgagatg

SEQ ID NO: 16239 - DNA, 3003 bp, Unknown; identical to SEQ ID NO: 16238
  misc_feature (1)..( 3003): 2750-1469P.txt file - cDNA_ID_1386598; gDNA_ID_1620704; Annot_ID_165181

SEQ ID NO: 16240 - DNA, 3003 bp, Unknown; identical to SEQ ID NO: 16238
  misc_feature (1)..( 3003): 2750-1469P.txt file - cDNA_ID_1386598; gDNA_ID_2926204; Annot_ID_141663

SEQ ID NO: 16241 - DNA, 3003 bp, Unknown; identical to SEQ ID NO: 16238
  misc_feature (1)..( 3003): 2750-1469P.txt file - cDNA_ID_1386598; gDNA_ID_2926204; Annot_ID_202074

SEQ ID NO: 16242 - DNA, 3003 bp, Unknown
  misc_feature (1)..( 3003): 2750-1469P.txt file - cDNA_ID_1387356; gDNA_ID_1620775; Annot_ID_50264
acggcgatcaaactcaatcttcttcttattcggttagggctcgtttcgagaaaatgataagaactgctcaagataaagtctgtgaagccattgaagcagtcgaagaaggtcctaaattcaaggaagatgtttggtctcgacccggtggaggtggtggaatcagtcgtattttgcaagacggaaatgtatgggagaaagctggagttaatgtctctgtgatttatggtgttatgcctcctgaagcttatagagctgctaaagctgccacgtctgagcaaaaacctggtccgattccgttctttgccgctggaaccagctcggtgagttctctctctctctctctatcagtcgacattgctgttgatatggtctctgagttctttgattgagcttgatcctacattctaggttttgcatcctcagaacccttttgctccgactctgcatttcaattaccgctatttcgagaccgatgctccaaagggtaagaccttaatcctctttgagaagtgtaaagttccaattttttggttggatgaagcatttgatttcatcacttgtagatgttcctggagctccgaggcaatggtggttcggtggtgggactgacttcacacctgcttacatctttgaagaagacgtcaagcactttcattcggtcgttaaacctgatccattgttctgaaagtttgaagctttgtgattatggagatgctgattgaaatatctttctttgtgtaggtttaaaagcaagcctgcgataaatttgatccgtcgttctacccttggtttaagaaatggtgtgatgactacttttacattaaggtctgcagttcctttaacgctattctgattgtttggtgagatcttagcactttgtggaactaaaagaccttagttttagagtcatgtatgtgcaagaatagatttagagcctcaaggttttgtttaggttgatacagtgataagttgtcgcctaggatttgaaaacactaaaaactttacggtcttgcctgcagcaccgtgatgagaggcgagggcttggagggatattttttgatgatttgaatgactatgatcaagagatgcttctgtcattcgccactggtagtgaccaagatataacttgtgacattttgttttaagaaacttcctagttgacttatttgaatactgagatgaattttgcagaatgtgcaagctcagtgataccagcttctatacccatagtagagaaacgtaaagacacaccatttaacgagcaacacaaggcatggcaacagctgcgaaggggcagatatgttgaattcaacttcgtaattggatactactagctttgtttttctttctgtataaatatctcttgaaacctcgtctcatgttttgttgctgatggtaaaaataaaggtgtatgaccgcggaacaacatttggtctgaagactggaggacgaatagagagtatccttgtctctcttccgctatctgcgagatgagaatatgaccatgtaaagtttcttgattcaagaaactaaatcttgtttcatcttagctaatgaaacttaactactgatggtgtttgtctcttgttgcggatgcagaaacctgaagaaggaactgaggaatggaaactattagatgcttgtatcaatccaaaagagtggctttagttaattaattgtggttatttccccaattagctcttttattagttttgtctttaaaagccttaaaagagtaaagagtctaatgaaaagtgagtgagataaagaaattgtaatttggcgtcatctcatcatgagtcactgacaaacaaagatcatgatggttgatgatggagtatatagtaccaatcgtgatgatgatgataaaagtaattaacttttaattttttttactgacacagtaaaaataagagccgttggctcaaatagccgagcctctcggtgcacgcacgcatgccacttgctcggtaactgttcactagacagaacacaacaacactcaaatagagtgataacattgaatctgatgatttggtttagtataaaaatcgtttccaagtttcaacgagtgggacttgtgttaggttaaacaatttcggattaagtaaacgtcactgtctcatttgtcttgatacaagaaacgcccgtgatattttttcttcgatgtcgtccaatggggacaaagaaacaatttagtccccggatatacacacacacacacaaataatacatgggtgttgttattatggcttaccttacacaacacaacttgccaatgtttttaaatttactaaaaaccaaagccagaagatattttattgccacaaattgacgtcacacctgcccatatctaatccatgtctgcaacacaaaaaacaaaaaattgaattcccccaaaaagtgaggagagagatgtaaagactgtgtaccaattcaatatctttttgagcagagtaaaaaaaaaagtttaaaaatttgagcttctgacacaaaaggagccaaatgtaatagctggatccaatccaatgcaatgaaaacatcttagctgtaaaatggtccaatctctctcttttctttctacattattacttccacagaatcaatttatctctcgaaaagcaataaagtctctatatttgtgctcaaagatagacagagaagcataaatacttgtcctctgtgtagtacaaaagtggagccccactgagtgatgccctcacagtaacggctacatttttcttttatctctctgtctctctcttcttttgagtgattttttatgaagatgggttcttttgtccacttattactgtcctgaatcacacgtcgaatcctacgtggcatctctctccattgtatgccagctcactctcactcactcactcacctcccgcctttataaagccttacctctctctcttgtctccttcattgagtcaagtgctcgagactgtagagtgaagtttgatttatttagagagataagttaaaaaaaaaatg

SEQ ID NO: 16243 - DNA, 3003 bp, Unknown; identical to SEQ ID NO: 16242
  misc_feature (1)..( 3003): 2750-1469P.txt file - cDNA_ID_1387356; gDNA_ID_1620775; Annot_ID_167676

SEQ ID NO: 16244 - DNA, 3003 bp, Unknown; identical to SEQ ID NO: 16242
  misc_feature (1)..( 3003): 2750-1469P.txt file - cDNA_ID_1387356; gDNA_ID_2926205; Annot_ID_141690

SEQ ID NO: 16245 - DNA, 3003 bp, Unknown; identical to SEQ ID NO: 16242
  misc_feature (1)..( 3003): 2750-1469P.txt file - cDNA_ID_1387356; gDNA_ID_2926205; Annot_ID_202135

SEQ ID NO: 16246 - DNA, 3003 bp, Unknown
  misc_feature (1)..( 3003): 2750-1469P.txt file - cDNA_ID_1387372; gDNA_ID_2214568; Annot_ID_186074
atcattttgattcaatcacagagctggtaaaagaagttgcaagtagtgattaagaacaatcgccaaatgatcaagtaattcttctctctatcacacggcctcatgtacacaaatgaagagcatagtctatatgcatgtaggttcatatccaatcttcacttcgttacaactgatgatagtaggacatgccttgtaaacttgctgatcatgttatattttgctgtgtgaatgaactatggctagtttcaaaattgtttgtctaacgtgaaattctctaaaacggtgcaggggaaattagagatcagtgagttgtttatagttgagctgatcgacaactatttcgggtttactctcaatttcggttatgttagtttgaacgtttggtttattgtttccggtttagttggttgtatttaaagatttctctgttagatgttgagaacacttgaatgaaggaaaaatttgtccacatcctgttgttattttcgattcactttcggaatttcatagctaatttattctcatttaatacaaaatccttaaattaaatttgtacagtacctttgttttgggtatagacaattacattttaagtcagttgatctgtatcaaatactacacttacaaaatcacaaagtaaaggcagcaattaattttgctttgaattgaaaagctttgagagagtaatcaaatgcttaaatcacgaaaacttacaaatttcaaaattttgtctctccataaattctcttaataaaggctgttgtttttccaatttgaaaattctatttttcaaaatcaagaacaggctatggaatttcaagaagctggttcatcatcaagtagaatcatcttcctctgtttcctctcctatctaaaatctctttagtcttcagaaactgattatactttgtgcagcagcaagagtaaagattgactttgtgcagccgatggcacacaaagagagcaaatggaaccatcgcaaaagcttggcctgggacactgctttttccaccaaccctggtttcttcctatttcctatagattggttttgtgtagaaacaaaatgttaaattatatgattccaatgattttaccactttggtttgtaggagtgttagatcctgaagaattgtttgggagcttaaagattgacgagaatgagattgaagttgaagtaaatcataatcacacacttccttcgaaaaccgatgctcgtccaagttttgcttgggacaatgctttttttaccgatccaggtctcatctttttacttcaaagttctttaccctacttgattagtcaattatttcacactattccactattcctctcatatataacaatcaaaccttataatttagctttgactctgtatattcaaggctgacattgtctatatttatgctaaggtgttcttgatgctgaggagttgtgtcttgtgaacaatggtttcaccagtaacacgcagcttcgtaagtctgctgatacgacgacaactcaaggaagcagattttctgtggccagcattgagtttgatctgttccacgacctgagagcctctttacgtaattcaccgaatgtgaagcagacagtaactcaagagacccatcgtaagttaccagatggtataaaggtaaacggaaaacctcagaaactgtttcaatcatttgctttcatctaaattttacttattaattggttttgtttgtcaagaggactaaaggatacaaacagaaagttcaacctttgagtctcattcctcaaccaaaagtgtcttcttcttcttcttcttctttttctttatcatccatctccaaatctttgactcctagtcaagctatacgcgagaagaaatgtgttgcaagtgaactcggtgaggacatgattgatgatacatcttattctttcttcaaaacgagaagaaaatcaaaacatctttaaaagttgcacatctttgttttattttgaagagaggaataaggaaaaacacaagaatcatggttttgaagaacaatctggatcgaaatctaacataaggtcatcgtattcaagttacgcagtcaaggacttgacatcatcctactctggtctgaggttaccacttccaaagatgggatttttcgactcggtatgcttcctaagaaattcgttttattgaacctagcaaatatcttgtaatgtaagattcctgagatgatgaagaaaaaacaaacttttgttacagcaggagaacggagagaaagaaaacagagaaccaaatgctcttgaagcaaacagaagaagaagacacaaatccaaacttgagacttcttctacaccagaaaaccgcagcattctgggacaacgcaaaacacgaaagtgaaacgggcaatgatatatatgtcttgggtgcgttacaaggcatcgtttgcatgttgagttggataagtcaactgtcttcttttcttttggttgtagtagctgccttttttttcctttgttgctttaagaaatagcccgaaaaaaagaatgttctacatttcggagcagaaaactaaccgaatgagtttttggtcggatcatcggatcgatcagatatattttgagttacgaactgttataaaaaaagccataattttgtgttgagtttgcaaaataccttataacttgttatttgagattgcacctccatatatattaattcgtaagagtatttattaagtaagctttagtataaatccttttttcctttaaagtaagttaatgttctactaaataatagtaaagttgaagaaccgctccgttttacaccatgcacgtgttatctaacaaagaaaatatggtacacctaatggctaatgcaaaggacaacacaatgaaactaacttgactctgtgttatacaaacccatagacatctgcatacatcctagtatttgtataaattggactcaaattcctgaggacaatcatagcaaacaatcacatcatcgcaatatacataaacaaaagaggaagaaaaatg

SEQ ID NO: 16247 - DNA, 3000 bp, Unknown
  misc_feature (1)..( 3000): 2750-1469P.txt file - cDNA_ID_1387497; gDNA_ID_2684225; Annot_ID_191938
aactaatgtatgtaagtaaaagcataaataaaggagaataagtatgcatcatatttgattaaacaaatactgaaagtgttgctgttgataaaaataaaaataaaatactgaaagtgataaacaaccattttggttttaaacagtattttgctctaattataaagtaaaaacatatatttatttccatttgactcctatataacaataaacatgtgaatgccagattagactaaagaagctgtgaggatcattatacatcctagctagcctcataggcctactacacttattattgagggtcaactttgggttgtttgattaacaaaatgtatggcatctttttaaacaaatatatatttacattcacttatcttcttacaatgtgatttgtcccttttaaggaatcttgtcccccataaatcatttgggacaaaagaataaatgaaaaatttctcacatttaaacaaaaatgttaacactaacatatatttaaaatcatattcttattacattatttatttttaaaatcatactatttaaaaatgtttttcaatataaatatattcttattacattatttattaataaaaccatactacttttttttcttttagtatatgatctctttagtttttacttttttgtcttttatgttttgtttaattaataatctcgagttttatactaaactgaaagtgcacatgaatatgatatgtattaagttggatattgaatcccacaaaatcaaaagatttgatgaactaaaaaagttcacgcagcaaatttgtttttcatttgctgaagtttttattgactaattaattagttaactaaaacctgaaagaaaagaaaaaacggaggtaatagtttagggtactgacgtgtgagcttacgcaattttcgaattaggaagtgagctagattctagggctgtgatacgtgaatgtatatactttctgtttcgtgttcaagtcatattttagtttttgttttggtaaaagaagtcatattttagctgtgaaattacaaatatatttttgtgataacattataaatatatattaacatgtggaaccctaattctcattaaactgctcacgttaaagcacatgcagtacaccaaccatttaaattgttttgcttagcacgattttgtttcattcatgattcaaaacttcaatttttcttcgtctgtttttatataaatattcgaaacatttatagaatttttttgtttttaatttgtaatttggatgtggtcaaaaatcatacttggatctatattgatgttatacatttcacgacttcaaaagaaactattgctcgctctatttctgtcattaattaactcataacttaacttacacaaaaattgagatgatgacaatcatgaaactatttaaaaagaaaaagaccagaccggccaatgttagactaggattagtggctattattctagtgacaggggtgcgatgagtaccattgtttttgaacatgtctctttgtcttcgcgatgaaccaagcggtcccaaaagtattggcaatagatagagcctcaatacctttaattaattataaatttccctgaatttatattctccaaaaatgaatgttatttttttcatcaatcaaaaaaagttgttgggttttagtccaccaaaaagatgtttgagtttcgattgtttgtgttcaaaaaatcaaattacataacaaaagccagaacttttttttatatcaaaaagtaaagaaaaaataagaaaaacaaaaaatcataactttttttattgaggtgataaggaatgtaatttattgacgtcttgtgaacccgatataaatctaaaacttgaagtagctaatgaaacataacaggaaatgttggagtggtatagaaattacctttaatttacctttaattgtatagaaattaaagataaaataaaaagataaatctatgaaacaattattttgtctatataccaaaagggttagttttcttgtgtttagttttttggaatggaaatatattatttaaattggaatatttttttggttgaacacaattggaatatgtaaaggttgatttcatgtacttgaaagattatggtcagaagccttctcacacggttaagaaaaataaaaaaaatatgttgtctatttatttggttcaaattaagtttttgtgtgggctttgtgggctagctatttagtatgggcctagatctggacttctgtaaatcttaggactacacttaactctattactctcatagtatgccactatgtggggtctatggccactattgctatcaattattacatatttacattacttacgtacattttcgtatttctaatgtaatttttttgtttagaaacttatataagtgggaagttttagagctaaatctgaattttctcaactggggagaaaaactcccttgtctcatcatcccattccactcaccacgaaaactcaatttgttacattaacattatgtgtaaccttttcgagaatcgcgtttcacaaaaatatctattatttgaccagagtcaacggttacgtgaatctgattccaattgcgttccaacttccaagttccaacacttcacaaacaaaaacaaatatcttccctcaaatctcaatcttcaaaaaaaaaacaaatatctttcacaaaatatgatgacgtggaagaagcgagtggttgagtaggctagatattttctcggaatatcccctggtgacgtgttacaatcgaacaagagtagacttactttttttaaacatacccctgatatatccttttaattacgaaaattgccaccaactcctggcgcgaagacttcttgcctcgtcttaaatataaagggtatattcgtcaataagtcaccaactaagccaagatattttaaaagtttaaacagacacaaaaagaaataaaatatcataaggctgagagcttatcagagaagaagaagatatttctgtaagcgagaaaaatg

SEQ ID NO: 16248 - DNA, 3000 bp, Unknown; identical to SEQ ID NO: 16247
  misc_feature (1)..( 3000): 2750-1469P.txt file - cDNA_ID_1387497; gDNA_ID_2684225; Annot_ID_137551

SEQ ID NO: 16249 - DNA, 133 bp, Unknown; identical to SEQ ID NO: 31
  misc_feature (1)..( 133): 2750-1469P.txt file - cDNA_ID_1387605; gDNA_ID_1201; Annot_ID_144877
  misc_feature (16)..(16): n is a, c, g, or t
  misc_feature (26)..(26): n is a, c, g, or t
  misc_feature (41)..(41): n is a, c, g, or t
  misc_feature (60)..(60): n is a, c, g, or t
  misc_feature (67)..(67): n is a, c, g, or t
  misc_feature (74)..(74): n is a, c, g, or t
  misc_feature (86)..(86): n is a, c, g, or t
  misc_feature (111)..(111): n is a, c, g, or t

SEQ ID NO: 16250 - DNA, 3003 bp, Unknown
  misc_feature (1)..( 3003): 2750-1469P.txt file - cDNA_ID_1387628; gDNA_ID_2926150; Annot_ID_198025
tactcaaataaagagtgtacaaatcaagacatgtcactccaacatgatcaaacacatttacacagtttctagaaatccaaactaaaaaaaaaactatcggatagagtctcacagcaacagtgcttcatcaaattcaccaggcagatttggcagcttcttgcaaacgtctttctcgctcaaggatataagaaacttcctcgtgtatgtaattcttggtttcctgaaaacaattgcaactgcagctgagaaatgtacaataagcagcaaaacagagacatggattttacaaaaaacagaaaaaacatacttttccgaatcatcattggtttcgacaagttgatccatggcaaattgttgttcatttgctatactcatcatacaatgcacaaaaatcttagctgattgaggccaaaaaacaccagtatctcttcttaacgccttaatcaagtaactctacagtagttgtctatagtaaataccgtgaaatatgattcttcgatattacagtaaccaccaataatatctcaactagcaaaacttaaaccacgattcaccaccacgcaacttcatcaggatctagctatatgtacagtgaaagatttcagagaagagaaattacagctcaaagccaaagaaaactagctcatcctaaactcacaaggctttaatctctcgtatcggattctctcacccaaccaaaataaataaaaacctcaaatcgggaaaagatgaaaacagattataacatttctgcagtaatctaaggtcttcgacagctagggtttttagcgctaatggggaattacatggattccagaatccatcagaaaaggataattagaaagaaaaaaaagtaagagtcgccgattctagaagaacaaaaggagaacggagaaaccaattagggtttcgatctgcagaaagataattttgctgttgctgtttgttttgatcgattgatgatgaaaaagagaagatcgaaaccaagtcttacaaagaagagcgatttctctcaaaggggaaggtaaaattgacaaatccacgcgctagcttttcacgttcactcacgcgctacattttgtataatccacaaaactttcaataaattacagaaaaaccttgataaatttttaccataacaacaagatccctgatattattttcaaattgactcataaagcattacaaaaggagatggtttttctgaaacatgaaatggttggttacagaagacgatacatacaataggcagctatgttcatcatctctttccttttcctttagcatcaaagtgatgagactttagtttcttcttccgcactatcgcgcctgtgctgccaccacctccttccctgaaaggcattcccattagagccaatagtttctgtccttcttgatcgcttttagccgttgtgctgatgcatacatccattcctctcgtttttccaacggcatcaaacctagagtgtaataaaccaaccaaccaacatagagtttagttgctcggttgtaaacaaagagtgggactaaagagaaaccatgcttgatcttgttgaaccagcggataacaagttagtagttttgattttgagggtagatacaatagaactaacctgatttcagggaatacaccttggtctttcacaccaatactgtagtttccgttcccatcaaagctactgggactcacaccttggaaatctcgagttctcggaagggctaagttgataagacgatccaagaaggagtacattacctgtcacaacagtcaaaatcacaaaatgttaatacataaataactcaaaaggaaagtttgattagtcaagagaaatatagctcacatctcctctgagagtgacagcaatcccaagaggttgatcttccctgatcttgaaagtagcaatggaagctctagctcgtgtcttaataggtttctgccctgtgataagcgcgatatccttcatcgcagcctccaaacccttgtcgttctgcgccgcatctccaataccacaattcactacaatcttctgtacctttggaacctggtagagaagatgtccaagcagatatacaacaatgatgagattgacaaattcacattcacatttgtaaatggcacatcccaacagcacgattttatcaacacaacaatcttaaatctaggcttcttcactacattttctagaagaaatcaattcaaacttatcattaaaagcaaattaggtttaacattcgctcaaaaaattcgaattcactgagaattagacttcaatcaatcgcaacagaacaaaaactaggtttgagctcagaggggaaggatttggggttacctggtgaatattaacgtacttgaactcttctttgagcgcagggataatcctctcgaggtaagcggttttgaggcgttgagttttctcggcttcagatttctcgaccagtacagttccagacgccgagactttcaccacgtttctgagcggcggagagagcattcgtgcggaggatggagccgctaatggtgagaaacgtccgtgaaacgaagaagcggaagactgcagaagcgaaggagacgccattgtcgaagctccaagtggataaagtgtgaagtgagagctctcggcgttcgttgttgattaaacccaatggcaccttcgtaatttgttgacagtttgaggataaggagttttccgtttagcccctttaaaacataatatttcaactaaggccccaatatttgataatatactattatacttagagattttagataaaatataggggttgtttcatatgggcctaaatctcagcccgtttactatttgggcttctaaggtataacccgtacccgtgtttttgttgttttacatatccacaccgacctgagaagagtcaaaaacgaaaaacctctcttttgtcgttcctctgctttcttcgatttgcttctgctttcttcgatttgcttctgctttcatcgcggttcaggtcactcttttctcagccatg

SEQ ID NO: 16251 - DNA, 3000 bp, Unknown; identical to SEQ ID NO: 7659
  misc_feature (1)..( 3000): 2750-1469P.txt file - cDNA_ID_1387628; gDNA_ID_1621155; Annot_ID_173455

SEQ ID NO: 16252 - DNA, 3000 bp, Unknown; identical to SEQ ID NO: 12489
  misc_feature (1)..( 3000): 2750-1469P.txt file - cDNA_ID_1387805; gDNA_ID_2214555; Annot_ID_134745

SEQ ID NO: 16253 - DNA, 3000 bp, Unknown; identical to SEQ ID NO: 12489
  misc_feature (1)..( 3000): 2750-1469P.txt file - cDNA_ID_1387805; gDNA_ID_2214555; Annot_ID_185672

SEQ ID NO: 16254 - DNA, 1082 bp, Unknown; identical to SEQ ID NO: 212
  misc_feature (1)..( 1082): 2750-1469P.txt file - cDNA_ID_1387935; gDNA_ID_29778; Annot_ID_146765
  misc_feature (1)..(2): n is a, c, g, or t

SEQ ID NO: 16255 - DNA, 3000 bp, Unknown; identical to SEQ ID NO: 2558
  misc_feature (1)..( 3000): 2750-1469P.txt file - cDNA_ID_1387960; gDNA_ID_1620555; Annot_ID_160434

SEQ ID NO: 16256 - DNA, 3000 bp, Unknown; identical to SEQ ID NO: 14455
  misc_feature (1)..( 3000): 2750-1469P.txt file - cDNA_ID_1388438; gDNA_ID_2684120; Annot_ID_190920

SEQ ID NO: 16257 - DNA, 3000 bp, Unknown; identical to SEQ ID NO: 14455
  misc_feature (1)..( 3000): 2750-1469P.txt file - cDNA_ID_1388438; gDNA_ID_2926250; Annot_ID_143017

SEQ ID NO: 16258 - DNA, 3000 bp, Unknown; identical to SEQ ID NO: 14455
  misc_feature (1)..( 3000): 2750-1469P.txt file - cDNA_ID_1388438; gDNA_ID_2926250; Annot_ID_204342

SEQ ID NO: 16259 - DNA, 3003 bp, Unknown
  misc_feature (1)..( 3003): 2750-1469P.txt file - cDNA_ID_1388444; gDNA_ID_2936554; Annot_ID_194155
agatcagctgctggaaatatctccgagcagtttcctcgggcaatcgacctttagcaaccgtgttgaacaactcgccgcctccaacgtactccatcacaaagtaaatcttggacttcgtcgccataacctcgaatagatgaacgatgtaagggtgacggacacggcggaggatagagatttcccgtttgatgtgagcaaccaaaccactcttcataatcttctccttgtcgatgactttaatggcgactttatctccagatttgatgttttgagctaaataaacctttgcaaaggttccgtggccgagaagcttcccaagctcgtacttccccatgagaatgttgtttcttgggctcctaggactcctcggactctgtgggctgatgttaccatctttgtctgtatccattataccaatccggccaagaagatccgccatgtatcgtagagcatacggctttgggtgcggtggtggtggcggcggcggcgggtctgggacgacggtggtgaccaccagtggtggttgagccaaggcttgagccatccgtgtccaaagaaagagcttctgattggtttgggttttgtattcggggggttttggttggtttgtttgtttcttccgtttgagtctccttgtttggttggttgggcaaacgtgaaaacgaccaaaaagccaaaagaaaacagaacgaaaataaaatagggtttggttgttttggccggttgttgatgtttggccttacctaattttgtcttgttttataacggttttggtttaaattattacattgaaatggtctaatagtctttattggaaaatttaatatatcatttgacttcgaaattatcataaatccgttttttgttttgccagcatatttacacgtgttctaattaatttttatcattatagagaaatataaatgttacctaaacacgctatatgcctattacctatacagtatacaccaagacaacaactttaaaataaaaatggttttattttgaatataattttagtagtatatttattcagtgagaaaattaaatttatttctaatgtttgaatatttaaaactgtagaaaataaaataaagatattgaaacttatgatggtgtcgtcttcgttatcacagtacaatttgcaatgaacaatgggttttgtgattttcgctatgatatttctacctccagcagtttattcagtgccagataatagacagaacttatcagtagcaaaaggaacctgatcgatcagcagatcatagataggtattcataagaagttgccatcgtatgacacggtcacgctttactgagttaaattttatttcttttgtcatcacttttaaataatatttataactcttttcttgtgacgacaacctatatgaatcagaaatgtaacgaatggtattgtgggaaccaggtgttgctgcgttggtgcttacgtgagttcgtggacttcacatcgccgaccaaatccgagttcatttttccttacaataattccagttctttctataatattatttccaaagttatatccaaatttggttttctaccttctatatataattctttttatcatgttttctaaatggaatattcttttctacactaaaatccaaatcactaataacatcatatatatattcacattagtttagttttaatgaaatgtacactatttgaaaatcatctagtaaacactaccctagtaactgatataaataactatcgacaatttgccaccaaattaaaactacctttttcttataaccaacatattaattggtgcatgtagatgttgatgttatataaaaatgactaagaaaaaagatgtaatatcaacaaaagaatatacatgtttgaaatcgacttgtgatttggactaacaaaacaaatagttatcgagtaaaagtaaaactaagtcttgttgaatagcttattatatgggttgctatcatttgattatctcaaggaagtgctatttatttaaccctatccataagcacaaggaagaaacacataagcgaaagtcactactaacttcaaacgactctttacaatctataagaaaagaagaaatagttttctaggtatgactacgtaattactgagtatatattatactttgaaattaaatttattcaaaataaggcttttaattaatttaacttgtaacttttcatagaagctactgttcatattttctttgctagtcttaggtctattatattattgactcacaacttaaaaactagaaaaaaattgtataaataataattacaattcagggcaattttgcttaagaactagacaaatgcaaggtagtatgaattaagttgcaaccaattgcaatgaaacaaacaaaatttaacatatttcttcaaattactattatatttttttaaaaactttagaatgtaaagacattaaattgtaaacaaataacaatttttttcctgttttatcatctagttttaggagtttgtcttacatttgaagattaaaaaaaatatccaaaaattaaaagcaatatcatatagcaatctcgcattgttttggactcattgcacaataattttagttattgggcctttagtaatagataaacgatccaatttataactacgtcgttttaaaaatataacatcccaactgggttctgattcggtggatccaagttcgggttgcaattcgattcagaatcaaaccatttttgaagaaccctaaaagttctcttcttcccccaaatttgaatttgttcttgcaatcggattcgaaatccgaaagtcttagtctcgaatttgagctcaacagtttcttatggctccgaagaagtctgaaggaatcgctttgctttccgtttacagtgatgaagatgacgaagagatggaagacgccgaggaagaggaagaagaggatgagaagcagagaaatcaggaagagagtgaaaaaataattgaagaagatcaggtagaagaagcgaattatatg

SEQ ID NO: 16260 - DNA, 904 bp, Unknown; identical to SEQ ID NO: 375
  misc_feature (1)..( 904): 2750-1469P.txt file - cDNA_ID_1388444; gDNA_ID_1564514; Annot_ID_149582

SEQ ID NO: 16261 - DNA, 3003 bp, Unknown
  misc_feature (1)..( 3003): 2750-1469P.txt file - cDNA_ID_1388464; gDNA_ID_1620413; Annot_ID_156325
aatggtggttgtgttgaactggattggttatgttgccgaatataaagtgagatttgatttaaaatggattagaagagttatcatcttaaaaactaagacgaagttaattttgagacgaagttcatgaacattataactaaccttaatctgtttctgtttctgtttctgaagatgattacctaaaatcctaagtctcatacttgatacttatctaaagtatactactagaaaacaaaagtttaccctttcaatgaagatagagttataaaaacgttttcacgagatatcgctttgatgtgagatagcaaagagtcttaagacagtaactcttttgagaaattcctaaatgcctttcgagataatgatttttttggttcatttatcttagagattgaaaacaaattttactttcttgtttgatcaattatatatgtttggtttttgtgagatttgatatcaatgtcatgtagagaatcacgcattccaagttttcaactaagaaaaatacagatgggcttgtgtccataatattctttggacttggaattcttgacactatatctatgtttgtttttaatatctatatatacatttttgcagccattttatgaaataaatcttgtagttgggacttatttacaatggttgccattggattttaatatttgtttttgataattagaagaaaattcttcgaattaaatatttgacatttaacaattttcctaaaatctctctacattaactacacgattggttaataaaataaaactttcaaaatatttaatatcatttaattactacaaaattatcattattgatattgtttttctgcatgactattacaattcaattataatcatcaaaccgcagagatatttgatagcatttaattactacaaaattacaaaatatttagacaatgattcataaacatatgataaataagatcaacattaataaaataaatgaattttttttacgggacgggttagcgggacgggttagcgggacgggtttggcaggttgttacttaataacaattctaaactataaaataaaaatattttataaatagttacatagatagttacaaattgtaaacttttatatatactacctttaaaatataaattgtctccgcggtataccgcgggtaaaaatctagtaacgcctattatggtttgaaatatgattcatcacatattatatatatttttatttgtttgtagttttgtatgttttggggttttggctatgtttttctataaaaatcaacacaatactaagttgagtaaaataaattattgaaccagtcagcgatacaaaaatatctaataaggaagaccaaataatcagcatgaaaggtcgacaattaatgaagaaagtcattttgtagaaatgcaagccttttgataccagcatagcatacgggcttctaaattctaatgctcacataatgtcatttattgtttaagaaatatctaatatcgctcgaaatatgagatttgttgttgtcgaaaaaacataatccaaagagttatcaagaatctaaaatcttgtgttatcaataatctataatctcgaaggaagtatgctttggttcaatcaagtaacacacgtcaatcttaatcctattgaaacaatggtatagaaatatgcaaatacgatcatatcaactaagatataccgaaaccaaatatattgggatctttcaaaaggacacgatcgggaactctaactactgtttgagactttcctaaagttatatcgataactaacggtcaaatacctgcaaattttggatatatataaagatatataccgagtttgtgtataaacatgttgtttctcctaatcatacgttattggaaacattaacgcggtttgctttatgcaactttgaaacatttgctaatttgttgatataaaatttggctatttatactgtttagtttagtaaggaattaacacaaatgttttagcgcattattgcacatttgtgtgaaataatatactattttcgggaaaatcataatcgaaatagaattccaaaatttccacgtggcatattatgaaaggaatattccagctcgggtaagctggcctccatcaccggttatgatgaaaggtgagccgaaagtggagccaacctgagatgccccgcatgagagccatatgcttcttcgacctttcattctatattctttccttttaaagatagcaactattgatcaaaaaaaagaagaaaaaagataggaactatagaactatagtctttttttttcaacgaagaacaaatatatggttatgaactattcttaatggatggtcaaacagattttttgatttttttctaagaaattttgcatgtgaatacataactacagttaattccattcaactgttacttttctttgggtgaaacaataggttggcaacttggcatagatatcaacatcagagttttgaacaaatctatcatcatttaagaaatgatagaaaatcaagtattgtttttcaaatcaagaaatatcaaagaagaattctgtattaagtttagttctcatggaagccatagaatatatcagaagtttgaaacaaacagcaaatatatggaataaaaaacatagttattggaataaatagaatagttatttttttttgtttggcataaaataaagaaaattatttgttcaacaaattgttacagatttcacttatgtatattttgaactaattcttatttttatattaattaaatcaagattttacttttgaaaaataattaatgaatttatgaaacaatctctatgtaaataaaataaagcaaattaaaacgctcacacatgtttacttattcggactagagagcttccgcataaagctgaggaaaaaaaagagagaagacgcacaccgaagaaaacacacaagactccattattctcctgcttcttcgtctcttcaattattttctctgagactagctttgattcaaccatg

SEQ ID NO: 16262 - DNA, 3003 bp, Unknown
  misc_feature (1)..( 3003): 2750-1469P.txt file - cDNA_ID_1388571; gDNA_ID_2926059; Annot_ID_196165
aagaatagtaagatgcgaaccggtgatgaacttcaaggagatcaatctttttcaccattctatcaatttccatcttcagctcctacacaataatacaaccccaaaaatagtcgattaccatctgaattaatacatactgtacattttttttttaaataaatgaagaaactaacataaagaatatatatgaatatagagaatgaacctgcaagtatcgttctacttgaggcctctctgccacatagaaggcattactaaacttgccatatctatctataatcttctccatcctgaaaagttaattcacaagaagatatttgtcagtgatgaatgatgatgacggatcataagattgaaatattatggacgaatattcttaatatatatatatctacatgttatcttttataccgacttagcttctatgatagatttgtccaccaatattttgattaatgtagatgtctataatttagataacactcatacaatcgaatacttttaatttttgcaatcaccaaacctagtgaaggaaggtttttgctgcacaaagattgttaaacatgaaatgaaaaatgaaacaaagggaagttatacaaaataaattatactctgtaaagattgtatagtactaatctttaaaccaattctattaaccacaaaacaaaagggatttataaaatgaacaatgtaccgacctcatgattgtaaatctagtgaaaaagtttggatgcccgagatattttttaaatcttctcatcatgcattatatttacaatttctgtacttaatgtaactacattttcggatattcatttatgctggatattctaataaaaccagatgccaagtgggtgtgtgggtaacagtttaagttccaaggaatacgaggttcactgttcaagaaactttttttctgaaaaccctaatacaatccacttgctcgtgcttgaagaaactctcttaagtagtaaaaattcttaagtttgcttaaataaaatccagaagctaagtacttacaaaacttaaattctaaaattagaatgtgacaaggcattgttgggcaaagtcaggaactagctagcaccaaaagaaagggggccaaatctttagcgcctatattattgcaaaatctctagtacgatttaaccagagatatattatactattcactacagaagttctagatactcaacaaatctatgtgtagctagagaaagattttggaaatagacatgtgtaaatattttgaaataatttgatgaaagaatatcttactgggagctagagtattcgtgtaatcttccgctctgagaaaagacaatggcggctacttgagcatcgcatagaaccgaaagctcatgagccttcttaaatagaccgcttcttcgcttcgagaacgtgacttgtctgctcgtcacgttctcaatcttcttgatctcgatcttccctctcaccattgttcctgcgatattcattccaagattcatcagattgaaaccctaactaaatccggaaggaaattttcactcagacaaaatcaagaaatgatttcttgaaaatcgagaaggagatttcaaagccagaagtcaaagatgataacttgaataatgtaagaaactcagaagatccaaaaccagatttgtctagattcacttcaaaagctacatagaacatacttttttccagacgacaatcaaccgacaaagttaatagttttagagaggggtataatttgcacatcttaactatcaagaaaaaatatatttgcacaaagaaagaaaaggaacaaaagcttaataatggtgaaaaagaaaccctagaactaaaattccggaaagaggcatgagctagatcttatgatgataaactctgtgtttacctctgtgcctctttgtacaggagccacaaaccctaagtctaagctttgctttttgtgttctgattaattggacagagaaaagggaaaaaaaaagaagaaaagagatttttattttcttcttttggtgatggtagttggattaataattgaacaacaatagagagagaatcattcaaaaaaacacaaaagaaaacaagtgagtcccagattctgattaaagaaatgtccatgactttatctgtttttggtaaaattaagaatagagagcagaaggaaaaagagttgattagctaaaaaagaaacgttaattgaatataatcaaggactaatttctaagaaaccggtgattatttgttttttaatttggacagaacacaaagagtgggtgggataataataataataataatacatctaaaagaatagtgttcttcgattggcgtgtcgacatcatcgtacactgacgtgcattgttaaccaaatatatgaagacacgtatgttttccactttccccaaaatcacagtcagcttctgtgcaatgtgacctcgtcttcatcagacaacacacagattcctttttcctcttttacatggttctttgttatgtttagtaatattcctcttttctgttgagtgttgaaagaaatatgataaagagtatgtgtctaaacataacaaaaagggaattcaccattgtgtcctaaatatctaaatcgtgataagggaatatgaattcttctttctccattttgttttggtcgtgggacttgatcaacattgattttcttttatactagatcgtaagtcatgttctttttgttttttgctaagccaaaaccaacgctttatcttttgcagtcatgtaaagtcaaacatgatccataaaagaaacacccttgtagttgggtcatatataattttattgggcttgaatatacaaggttgggctttaacaaacaattaataattgggtcttgagaatgatttttctttttgtcaaaatatatatatttgtcattttgaatttaactaaaataaattattataaatgaatttaacaaatttaatttccctgaatctgatcttaaatcctcctcagaaacccagaaacgcgaagatg

SEQ ID NO: 16263 - DNA, 3000 bp, Unknown; identical to SEQ ID NO: 6726
  misc_feature (1)..( 3000): 2750-1469P.txt file - cDNA_ID_1388618; gDNA_ID_1621102; Annot_ID_55902

SEQ ID NO: 16264 - DNA, 3003 bp, Unknown
  misc_feature (1)..( 3003): 2750-1469P.txt file - cDNA_ID_1388618; gDNA_ID_1620702; Annot_ID_165104
ctgaaccaccagagaaaagaattaagaccaaaagcaaaagaggtacaagcattagatgcctatgttggttccctttaggacttaaagtaatcaaaatcagtaaaacacacaagaagaagcttaaccattttttagcatataccaacacagaggattttaatattcaaaatctcaactttgatcaaaaaaaaaaaaaaaaaaaagatacaatggtctcaggaaagaaaagttgcagaaattggttggctaaaaccacagctggtttcactagacaggtatgtaaagctgattgtatataaaaccccacaagtctcagctaatggggctttaagaaacatcacatgtctaacggtagactgaaacagggatcatctgaaactcctttcacattttttacttattttatcagaaagaagtaaagcaaccaaatctctttctttttttctgtagtccctcaaaccaacttgcatcacttgattagacaataccaactttgagtatctagattctagaagaattaaaaaatgaacaagaaacttcgcatgtctaatggtggcatgaatatagtaccatttttctccccaaattcctttttcgctttccctaggtgctgtgatctttctaacgattcaaacttagccaaatggacaacaaccttgagcattctctctattcatctctcaaagcgtaggtacaaaacttaatatcaggaaaccatatcaaaacaaaaaagaccttgaccctcataagataaagggaaatcagtttgaaaatggtgaatcatgtggcgattggcgaaaacattatttatatccttcaatatctatctctcatttaacacaatcctgatcgagctcttaacattattagaaggtccagagaacaatatccaaagcaaatggaccaaaagaagtaaaagaatcaggacctgacttcttccaatgttacaccctcaaacctcagcaggagtctttgccacaatagagagagcatgtaacccgctcttcaactcatcttgcaacaagtcatatatcagcctatgtctcttgaccaagcttttaccttggaaagcatccgaaacgattcgcaagttgaaatgtgtttccccatcatcaccagcactacctctaacagcggcatgtcctgcgtgctggtaagaaacatcttcaacttctaactcaacaggatctagctccttctccaatttctctcttatcctcatccctctactccctaaagcaacaacatttgacccactctcagaatcatcaatcttttctgttcccaaatcctcaactagatcaggtttagactccaaatccacctccggaacattagcttcgtccttagtctcaggaatagacacaaagctggattctgaactctctccagaacttgaatcttcctcacctttgacttccaaatgaagagcctttttctgcatcagcttaagcatattaagtaatccattgtttctagaaggagacagactctgctgcaacccgagaagaacagcgaaatcaggtgttatcctcaaaatctcagggacaggtcttccagataaacccttgactaatagagcagctaaccctttagtgagaaccgaatcagaatcagcttcatacacaacattacgttcctcatcaaagaaagccctaacccaaacctgagaaacacatccttctactttattctccctcgtcttgaattgagaatcgagaggtgtcagattcttcccgtagaacataagctgctcgtatttagcctttggctcttgtaccgattggaaaagcttgacgatctcttgtagcttcggtggaagctcttcgattggttgaaggtctccatagctcgacggagatgatgaagccgatggtggaggaacaatcccggttgaaattttctggaaagtgatgatcgtccggcgaaaggaaggaacttccgacggttttagtggtcgtagaagaagggttttggccggataatggattgaagaaaacaaggtccgtttgaatgggattaaacgaagcgaggaagcgcaacaagaagaagacatcgctgctgccatagtcgcgaacttgaaacttcgagagagactgagatgatgatgaaagctctccttcttcactttttctgagtcaaaaaccaataccgccaattaggtagtaaccgggaattaaaccgggaatgtaccaaaatccaaaaattagatgtaaaatcaattgtggggttgattatgaataattagaaagtatacgactcttttcataaataaggaaaagaaaaagatatctagattttttttgttttgttttgaagcatcgtcttcctggttcttcgttctcttgcgttcgtcacctcaaacacgctccgccattattatatatcaaatcaatcatgtccgaatccagcttttaccaatgtaagcaattaaattaaattaaataaaaacacttttatcaaatttaatcaaattaaaaaactgtccctttcttatctgagattctattgtttctgtctacttccacagaaagaaactgcatctccgtttttttttctgatttgaggctttccttagatccttgagagcaaaactgaatctgggtaattttaaaaatctcatttttacgacttatctcttttgaacgatctgttttttcatgtaagtacgatttcacctcgagatgatcgatcattgctcttctggttcttccatgtttgattaaatgttataacttgagggttttgtttcttttggattgttctcgcatttgttgatctatggttatcaaaagagtttggatttacagtttttggttgcagctgaaatttttcactcttttcttctctgttttgctggataaagttggatttgattcacattgttgtttagaatctagatgaagttgtaagattccttgtattgtgtttgcttatgcatgattgtgataaagatttaagttattttaccaatgtacaatgtccagaattgtcgtcgggatg

SEQ ID NO: 16265 - DNA, 3003 bp, Unknown
  misc_feature (1)..( 3003): 2750-1469P.txt file - cDNA_ID_1388618; gDNA_ID_2926189; Annot_ID_140936
ccgggaatgtaccaaaatccaaaaattagatgtaaaatcaattgtggggttgattatgaataattagaaagtatacgactcttttcataaataaggaaaagaaaaagatatctagattttttttgttttgttttgaagcatcgtcttcctggttcttcgttctcttgcgttcgtcacctcaaacacgtccgccattattatatatcaaatcaatcatgtccgaatccagcttttaccaatgtaagcaattaaattaaattaaataaaaacacttttatcaaatttaatcaaattaaaaaactgtccctttcttatctgagattctattgtttctgtctacttccacagaaagaaactgcatctccgtttttttttctgatttgaggctttccttagatccttgagagcaaaactgaatctgggtaattttaaaaatctcatttttacgacttatctcttttgaacgatctgttttttcatgtaagtacgatttcacctcgagatgatcgatcattgctcttctggttcttccatgtttgattaaatgttataacttgagggttttgtttcttttggattgttctcgcatttgttgatctatggttatcaaaagagtttggatttacagtttttggttgcagctgaaatttttcactcttttcttctctgttttgctggataaagttggatttgattcacattgttgtttagaatctagatgaagttgtaagattccttgtattgtgtttgcttatgcatgattgtgataaagatttaagttattttaccaatgtacaatgtccagaattgtcgtcgggatgggttctaagtccgttgttgacatgatcgaagctgcctcgcgggcacatttttctggtttacacgtgaatgggcacatgaatgggttggaaccaagtgcacttaaggaaaccacttctgcatcagaagatatccaaagacagccttttgtaataggtgagttctgcttttgctttcatttttgattaatatatggtcgtggataaaaaaagcttgacgaatggtcttgattgatatgttgtgacttgaattggttaggtgttgctggaggcgcacatcgggaaagactactgtttgtgatatgataatccagcaactgcacgatcagcgtgttgtacttattaacctggtaattttgttttgctaataaagtttcatagagctaagtgataaccaccggtttgatttgtgtttcgaatgtatatgaagtcaattgaattccacacaatttagagatctaaaaggagaatattaccagctaataacttatatatggctgaagtttaacattgttcaaccttgtcaccattgtttagatatttatgtcagtctatttatctaattctcaaattcctttggcatcatgataaaccacaaattgctcgacttaatatcctatgataatgatttttggcaggactcgttctatcataatctgactgaagaagaacttgctagagttcatgaatacaactttgatcatccaggtgagaatatatttggagtgtaattgctttctgtaatctactcttgtcaatacatagtgtcatcaggagtaaaaaatctttcctagcttctttggccattttttttttttttataatacttctttgggataattaaggcataactaacagccatattattcagtgatatcttactaattgatgtattctcttttattaaagcaatttcatccctgacagcacattactagttgctgggagttatgagaaaaagtcttgtgcattactctttgtcatccaccgttaatttctttttatccaggattctaatgaattgttgttgtttctgtagacgcatttgacacagagcatttattgtcttgtatggagaaattgaggcaagggcaagctgtagatattccaaaatatgattttaaaacttacaggagcagtgttttcagaagggtaccaccttccctctcagcatcactcattatcatattgttacttgatgtttataaatttgagattcctttttcattttctcactgcctctttctgtaacaatagcaatttcttagatgtcaccactggcttttatctggttggggatttaaggggagatcaatttaatcttatttgatgctaggattttgaaaaacattctgcaggtaaatcctacagatgtaataattcttgaagggatacttttgttccatgatccacgcgtccgaaagttgatgaacatgaagatttttgtttgcacaggtaatttgttgcctcttcccgttataattattgtaaactcttgtttcgactacattccatttcccttttgtagattcacttggctttttttttctacaaaatttcacatgatggaacaacttcttatgctttaagattttgctgtttcacattgcttattttgttttctgcgtagatgctgacgttcgtttggcaagaaggataaaaagagatactgtcgagaatggtagagatatcggcacagtacttgaccaggttagcccgtcttagtattgttactgtatatattatcatcaagaacaacaagaaatggtttacctcttgcattttaaatattacattgctctgatctgtatgtttttttctcatattagttcggcgttttcaaatctatatgtttctacccatattttatatgatgtcaaccttttgatgcagtactcaaagtttgtgaagcctgcttttgatgacttcattcttccaacgaagaaatatgcagatattataatccctcgtggtggggataatcatgtagctattgacttaattgtgcaacatatttgcaccaagctgggtcaacatgatctctgtaaaatatatcctaatctctacgttatacactcgacatttcaggtaattgatatatcaatctcatctacatacgagtaacattctcttaactaccaaacaagatccagaaaattgatttctcttgcagataagagggatg

SEQ ID NO: 16266 - DNA, 3000 bp, Unknown; identical to SEQ ID NO: 10669
  misc_feature (1)..( 3000): 2750-1469P.txt file - cDNA_ID_1388785; gDNA_ID_2213667; Annot_ID_132720

SEQ ID NO: 16267 - DNA, 3000 bp, Unknown; identical to SEQ ID NO: 10659
  misc_feature (1)..( 3000): 2750-1469P.txt file - cDNA_ID_1388785; gDNA_ID_2213667; Annot_ID_182147

SEQ ID NO: 16268 - DNA, 3003 bp, Unknown
  misc_feature (1)..( 3003): 2750-1469P.txt file - cDNA_ID_1388793; gDNA_ID_1971893; Annot_ID_176878
atgtctgccgaaccgaaccaaaccgagaaccgaactccaattataattttgccgatcggtttagccttcccttcatagtcggtaatcggaaccgaaaaaatcggtttgttcggttcggtttgttcggtttaatccgaaatcccaggcctaatgagctctatcaaactcatatcttcctcaacttaagagtccgagtgattacgctaccgttttgtaagtgggccgttattgggctttgagatttaatgtgatttgagttcaactagatttaggatttgcgtttactcgatctctacgtttctctaataatatccacagccatgaacggagaaaagtcaccaccgattacgatgacgtttctaaatgataatggtttctcacattgttttttttttcgatttgtgttacatattttcattatcccaaaccaccttttgtattcgattgtatctttgttgcatgtttcaagagctcatctcgataatggtgtctttgttgcagattgtatcagtcaccaaacgacgcagcgcccaaagctgatagaagacaagtgattggtgtgaaagagtgtggtgaaacttatgttctggcagagtataagcctatatatgttcatcagctcgtccttgtccttgcaactgctatacagctgggattgtgtatgacattgaaggatgttgaatatgaaggaagattagatggaatctttgtgatgttttgaatcttgtttgtagcttcatataaaattatgattatgtaaagtcttatgtgtaatcaaatgtttaactttttcctttattcaacaaaggatttgtatcgataatattttactagttacagaagctgaagaagaaagtattgtaacaagttagggtgtctgaaaccataaaggttgtgtcttgctagttaatttatatataacaaaggctgaaacatgaactttttaagatgattccactctcgtttgcagcattaggagacatagttgataagaagcttgatgaggattatgtaaaggaagaagttgaaatgatgatacaagtatctctgctatccacacaagcagcaccgggagaacgaccaacgatgtcggaagttgaaatttttagaaactcctgcttgtgctacataaactggttttgcaacatcatctccataatatattctaacagtttgcttttgaggattgattcaggatcatcatctatatctgttgtcttcttagtttttactctgtctcgggttatccaaacagcagacttgtgtgagtacacaaacacagaacaacagaaccaaaatctctaaacaagaccggctctctaacaagagacataaccaccaagtagactcttgtctcccttgcactgcattaattagtaatcaccaaaagtctattcctgttttgcttcttctcttataatcatcaaacacacaaaaaccaaaaacgttgtagtagaccatcagctactggaatcagaagcaacgatagagtttgagggtaaccaaaatgtgtttgggagtaagcagagattaaatatctccatcatgtcactatgttgatgggaagaattcgattgattaaaaaaggaatctctgtacaaaagcccatccaaagaaaaggaaattaagatcaagacaaatatctgcttatgtcaaagtcattaaccgactccaacggctatattgaacaaacggttatcattattgatgaagacctaattaacactttgcttataaataaagactcatacacgcagcctcttctaattcttcgttgagagaaaaaatcaaaactctctgattcacattcacgcatcttcttcttcttctttaattttcttcttgagagaatctctttatacagagactctgtgtgaattccgatgatccaattagtagtcattgatcagaagtgaaaagcggatgatgatgatgatctcctctgcaacatgatgatccgtaagagttgatttcacttttttccgatgagtcgcagatggagcaacgacggatgttaacggcggctagaccacgtttgtcctcgacgatccgtacgattacgtctcacgtggcgttctcagcaagccgtctcttgaaaccttatgttgcatatcggcttggattggaggtatgagtttcgctagcacgattgctttgggagataggacgcgaatcagaggaaaacagagaacgaatccaccggtggagataaagaaatcgccagtgattagggtttcacaacctcgaggtataccacttggagagatactagtggtttgtgctgaatagaggaatagtactataaactttcaaaataacctaaaaaaaaattactcatatacaaacaaactacaaaagtttagggaaaatggatcattttgaatgcatactactagtaggttacagatactgaatcactgatccaacacataaggcttagttagagcagaaaatgtttttaccataataggcccaaatcttatatgtgcccgataagagatccaaagaaacccaattatcactgatccaacacattcaatattttactaatctcaaataattatcgttgttttggccttttcttacatttctactacattataatccctataaaaaagacatttaattttgatgctttttttcttgacatgtgatcaccgacagagagagtaactacaagtctaccattatccagctgcaatcacgcaaacgcaccgcctttttctctctttgccaactcgtttatttccaatcataaaatgccacgttaacacactcttgcagttaattgacggaaatacccctcttcacatactacaattacgatattaatgtgttaaaaattaacggtgtgggctaatctcacgcgctttcatcatcttcttcctagattcgctcctccactgtcttaaatttcactatcttcttcttcattttccttccttctcacttcaaatccataatcgctctacttctctctctctctctagattcgaaaaaatg

SEQ ID NO: 16269 - DNA, 3003 bp, Unknown
  misc_feature (1)..( 3003): 2750-1469P.txt file - cDNA_ID_1388852; gDNA_ID_1620488; Annot_ID_158537
cgattcccgaggctcgaaaaaaccctaaatctcttctccgttcactcatccaaccgaagatgcgtgagattcttcacatccagggtggtcaatgcggtaaccagatcggcgccaagttctgggaagtggtttgcgccgagcacggcatcgatccaaccggaaggtacaccggagactcagatctgcaacttgagcgcatcaacgtttactacaatgaagcgagttgcggtagattcgttcctcgtgcagtgctcatggatttggagcctgggactatggatagtctcagatctggaccgtacggtcagacctttcgacctgataacttcgtctttggccaatccggtgctggtaacaactgggccaagggacactacacggaaggagctgaactaatcgattccgttctcgatgttgttcgtaaggaagctgagaactgtgactgtctccaaggttattcttcttcttcttatagatctgtttgattttagtgttgataatgctttactagtgttttgaactgtgagatttccttgtgtagggttccaggtttgtcactcgttgggaggaggaactggatctggtatgggaacattgttgatctctaagatccgtgaagagtacccagatcgcatgatgcttaccttctcggtgttcccttcaccaaaggtttctgatactgtggttgagccttacaacgctactctgtctgtccatcagcttgttgagaatgctgatgagtgcatggttcttgataatgaggccttgtacgatatttgcttcaggactctcaaactcactacccccagctgtaagatttcatttcccaattatgctctccaccaatgttaagatgagttaaactatgcttgaaatgcttggtctacatggtgtttatgttaataattggtatcaagttcagatctgcaagcatctatgtaaagcttatagtattgttactgtttccattggtttgctctttgactatgtcactgttttatatcagaattctgatttgcaagtctctgtgcagaacttatacttttgttactgtttccagtcgttttgtacatatctttagcctcttgttttgtgtgatattgcttctgtttacctattttgatctcatcaccgaagtaggtccttaaactactcttattggaacaatactttctggttaagttgcaagtagaaatctgatacttgatgatcatcagtttgttgagtttactgtctgctttgattcttttctcatcgtactgtttggatatgtctaaagcttacacatacttggattttcttctgtgtgcagttggtgatttgaaccacttgatttctgctactatgtctggtgtgacttgctgtctgaggttccctggtcaactcaactctgacctccgaaagcttgctgtgaatctcatcccattcccccgtcttcacttcttcatggtgggttttgctcctctcacctcaagaggttctcagcagtaccgttccctcacagtccctgagctcacccagcaaatgtgggactccaagaacatgatgtgtgctgcagacccaaggcacggacgctacctcacagcctctgccatgttccgtggcaagatgagcacaaaggaagttgacgagcagatgctgaatgtgcagaacaagaactcgtcctactttgtggagtggatccccaacaacgtgaaatcgacagtctgtgacatcccacctactggtctgaagatggcatcaactttcattggaaactcaacatcaatccaagagatgttcaggcgagtgagtgagcagttcacagctatgttcaggagaaaggctttcttgcattggtacacaggtgagggaatggacgagatggaattcacagaagcggagagcaacatgaacgatcttgtgtcagagtaccagcaataccaagatgcaactgcggatgaagaaggtgactacgaggatgaggaagaaggtgaatatcaacaggaggaagagtactgagaataatttagttataactgctttaaaaacaaaaacaatttagtcgtttgctacttttcttttttttaaaaggaacacctcaactaccagttgtagtttttttctctgcttgtatttgacatatctggttgatgtttctgtacttttgttcttaatcttgttattgcctgtgatgtttctattaatattttccagttgtactgtcttcaatctttggtcttctatcctcatctttctgctacctgactacctcagtacctacttaaggactttaggtttgatctgtttggaaaatagattaaggttcgggatttgtgacctcagggcaagtgcagctccatattagaccccaaaacaaatttatcactgttctgaaatacaaattccccaacatgcctagctttgaggattgattgtttctaagctatttattttctttaccaattcacataaatactttaggataaagtggaaattgtcaatattcaaacacgttctcttccctttgttaacaagcaaaatatgaaaataacatgtgctcttccattatttcattttttgcaacccttatgaatgggcccaaagcctgccacaaacatgtgcacaatattagaaaagaaactctaaaaacaaaaacaaaatgaacattcttttttttgcaatttgtattataatatcaaaataatattttaaaactcaatttaatattggaaaataaaataaaatttggaaactaaacagttaccatagagaaagaaacggaccatttttaaattttgaatttcgagaaaaacaaaatcggcgcctcttattagagataattgggggaaaaaaacaaaaaacaaacacagagagagcaataataaaaactcactcactctcacttttttcatttcttcaacaaaaaaaacctaaagctctcttttctctccagatttcgattcccgaggctcgagagaaaaccgtaaatctcttctccgttcactcaatcaaccaaagatg

SEQ ID NO: 16270 - DNA, 3003 bp, Unknown
  misc_feature (1)..( 3003): 2750-1469P.txt file - cDNA_ID_1389239; gDNA_ID_1620835; Annot_ID_57960
ataatcttgttgaagagtcatctcccaaaactaatgagcatgtataggctcttgttgaagggtcatttcccaaagctggcaaatcataattacataatcttgttgaatggtcatctcaggatcacagtttgtcaaatagaaacaatgtcatctgggttaagaaagttgaaagtggacatgattgacttggcttagatgattgtgtctctatggttgtactttgtgaagccttctttatcattatttgtactatgtaaccttttgtttgtgtatttctttttcatatcttcttgacccgtttttatctcgttcattcagaaactgaagacgcgtgtgattaataataactgtaatccagtgtggaacgaacaactgaccctttccatcaaagatgtgaatgatcctatccgtctggtaagctatcgtgtctattacaatttacgacggtcttctaaagaaaccgattgttggctcatattatggtctgtttatgcagacggtgtttgataaagatagattctcgggagatgacaaaatgggtgatgcagaaatagactttaggccgttcctagaagcgcatcaaatggagttagatttccagaagctccccaatggttgtgcaatcaagaggatccgtccaggcaggaccaactgtttagctgaagagagcagcatcacttggagcaatgggaagatcatgcaagagatgattcttagactaaagaatgtggagtgtggggaagtagagctcatgcttgagtggactgatggtccaggctgcaagggtctgggacgcgaaggtatgttaacaaatcctcggtttttgacttgtgcatatctatgattgcgattaacatgcgagcattggttcttttaggatccaagaagacaccatggatgccgacaaaacgattggactaagatgcagaaatgttaaaacagagaccgtgaagatgtgatggtattttttcgttatgttcatggaaagacgagtttgtctttgtctcatcagagtttaaattgacaaaaaaggctctgctttggtctttagttgtacatgtcgaataactcaacccttatatatattgtatctgtttctactaattgaagaaataaagcaaaccctgaatttctagaacctctttcaatcttatttctctggttctggtaacattagaattagctcacctatatcagtatgtatacaaaattatatttgcagggtagtaccttcttttttgtgaaatgtaatgatgatatttctaatgtcaatgtcagaaaaagacaggagatatttcttatgaatagaatctagaaggtatttgtgtgtgagtaacgcgtagatgataattaaagtgagttagcaggaaacaaaaagttggaaaagagaccttttgaattcacctttccttttcttttttgtttctttcttttaataagctgatttaagtagcatcgttgaatttgagtcggtgattgtttgtaagtgaataagaaaagtagtagagtcaggagacaggtgtgctttctcttcaaagctcagaagcaagatggagaaaacagaggaagaggttgagatgaaggaactggtagggcttgtgagaatcctagtgaagagagggatcgatcttgctcgtcgagacgctctaagcagcgacccttttgtcgtcataaccatgggtccacaggtactttttctctctttctgattctaatctgatttggttctcttctgtttgatgtttctatttctgttcttgagatgtatggtttctctgtttactttcttcgcagatggaagaccaaagaatcgacctttaagaaacatgattaataatcatttaaaaagattttacatttcatgctacaaaatgaaaacaatctatagctataggatgttgtgttgcattcgttctaactgaaattggttgtatctttgaattgcaccagaagctgaaatcttttactgtgaagaataactgcaacccagagtggaacgaagagttgactcttgcgatcgaagatcccaatgaacctgtgaagctggtgagtactagtacccgtcagtaactaccggaatcatgaattttcaactcaaaaccaactgatgataagtggttggttccatatgtttttgtttcgtatgagtgcagatggtgtatgataaagatacatttacagcggacgacaagatgggagatgcgcagatagatatgaaaccgttcctagacgttcacaaactcggtttgaaagaacttccacatggaaaagagctcaagagaattgtgcccaccagagataactgcttgtctgaagatagcataatcgtctccgataatggcaagatcgttcaggacatgattcttctgttgaagaatgtcgaatgcggcaaggtcgagatccagcttgaatggcttaaaaatccaggtggtagtggactctgaaaaaacagagatgaagtagctttatgattttctgtgtgtaataaaaaaaatctcagttaataaaatagaacagagtactactactctgttttgtaatggaaatatatttggttttagatctaaccgaaaccgttttggtttcccgcgagttttctcttcatcacaaaaaagaaaaagtgatatttatgttttatattggtttggtaaacatgttcttggaaaagtcaacggcttaaaccttttgtccatagtcagaaaaaaagaagaatcaagaagatattattaccaaagatgttcgtgagagtaacgcgtagatgagaataatatagaaacaaacacctggaaaacgaaacctattatatagatggtctttattttttgtttctttattcgctctatcgtccattgataagccaatttttaagtggtcctcgttgaatttgagccggtcattgtttagaattaaaaaaaaagaaggtaaaagagtcagagccgcctagagaaatcgatcacaaattcagaagaaaagaacagagaaaacagaggaagaggtgagatg

SEQ ID NO: 16271 - DNA, 3003 bp, Unknown; identical to SEQ ID NO: 16270
  misc_feature (1)..( 3003): 2750-1469P.txt file - cDNA_ID_1389239; gDNA_ID_1620835; Annot_ID_169838

SEQ ID NO: 16272 - DNA, 3000 bp, Unknown; identical to SEQ ID NO: 13825
  misc_feature (1)..( 3000): 2750-1469P.txt file - cDNA_ID_1389401; gDNA_ID_2214654; Annot_ID_188729

SEQ ID NO: 16273 - DNA, 3000 bp, Unknown
  misc_feature (1)..( 3000): 2750-1469P.txt file - cDNA_ID_1389713; gDNA_ID_2684204; Annot_ID_191351
ccaaagtcatcccttttcctcctcctcacacctttataaacaaacccagagaacaaatcatccaagctattgctattatccttctctagggaacaaccatcatcatgacattgaagaaccaaatttgtggaaccatcatcaactaaacccaaatcacgatttttttcatcatcctccttaaataaagcaaacgagcgattctcatcacttacctcgataaaatcggagtcgggtctccgacgagtcatcatcactgaactatcatcgtccctaccaagtcgccgatctttccttcgcttatacttataaattatgggaggaaccatctcaatttatacacagagaatctcctcaaactcttaaggaactgaaacagagaatccaatctcttcttcgccgatacttttgtgagtttgtcgataaattatatccctttttgccgtcagtgtgtaaatttagactctttttgtgtcaattacgtttttgttttacgaattaaattgtggcaaaaatctaaaaaattatggtttttttttttttaattataaaaagcttttgagaaagaaaaaaaattagggttgggaaacgcagtcttcatagcttctctcgcttgtgttttcctcgttaagaccaatcttgcattgcggtttcgttaccaaaggtaaatccttatcatgttttagactcggaatagaaattactacttatcatgttttaggtaacagagtccaatctttgttgttgatgatcatacacattctattcttgattttagtatttggtttgttttctgaatgcttttcttggcagtaaatcatggctgatgaaagtaatgagaacaagaaagaagtgaaggatgatgagcaagaagtaagtttggcttttgacattttgtttttgtctacaaggactccttgattaattccctaaattaagacaatagattttgtttcctttttcgtttggtttgattgttgttgttgcccttttacatcagctatcctttgacccaaccaaaaatgaaaaccaagtaaacagttgtacttcaggatcttgtattaagcatgcatagttggtagatgattctctttggttactagaacgtgcgacttatataaatattgctttggagcattctttccttaagtcaatgcatacttcttcctgcttgttttttttctttttctgatgggaattatatgtacagattcttcgtagggtctttaatatcctgcgtgaaaatagtccggagcttgttggaatttggcttcttacaattatatggccaccacaagttcttcgtgaagagacagcgaaaggcacaaagaagacagtctttgtcaactttatggactattgcaagacgtatgaagaaattaccatatctctgccccttcaaacttttttacttttacttttggaaccattgttactagaacgtagtgagttttcatgtttgtatttggaactaaaactttttcaggatgcatcgaaaccctgatcatgttatggcgttcttgcttgctgagctgggtactaggggtaaacttgatgatcagcaaaggttggttgttagggggagatttacacagagggactttgaatcgttattacgaggatatatccgtaagtaacatttcctctcaagattaggattcaactaaacatccttctgttgatttcttaaagtgatttctctaattgctgttaatttcagttgactacgtcatgtgcattccttgcaagagcacagaggcaattctttcaaaggagaatcgtctcttctttttgagatgtggaaaggtaaaactctacccaattagcttctcttgccttggacaagtttttattttttgctttctgcgtgattgaataggaaagctgcttaagaaaattctcttctcttgatacttaacaagccaatgcctatctttgatgattgctgtttcttttacctagtcaggaatttgccaacattagtgtctgatattacgtagttaagagtgatacaaaactcattcggaggcttactatattgcatcatcttgatgtgatgctgatatctttgcctacgtactgcatgataaaagctaatttggttgagcaagtaaatgagtaattactgtctgaatactagtatttaagaagtatccaattttgttttgctattctgcaaatatgaacgtatggggtttgttttgacagtgtggatcaggacgacctgtggcgccaatcaaaatcaattttggtcgcaggtagctcaagtgattgatatattggtagctcaagtgagtagagagtagtcgtcttttcttgagatgtctaattactaaagaacatgttttggagttgtgaggtcatgcttttcttcttctccttcttattctgctaacttgctaatgctttgacttgacttggattttgccggcacatttatttttgagcaattagcttccctttgaataaacatatgtttttccaataactaaccttctctaaattttctttacaccatataacattcatttaattcgataaacaacattcttaaaagaatatgacccttttattatttataatgtaaattaccataaaccaaaatctatatcaaagtaactaacacattaaaatattagtgtaaattttttaaataattgttggtttccaaatgaaattaaaatgtctattttgctaaacttataacaaaaaataatagtgccggcttagttgggttaagatccggtggagtcgggtgggtaaattagtaaattgggtaaagctgtaagtaaaccaatgacgtctttccagaaatttggttcgaatcggttaggccggttaaggaacaggtcggtgttgtggctcgaccttgtagcgaaaggcaaaatcaatccattgcgtaagcaaaaacttcaaagttaaaaaccttaaaagcggcgagggcaaccgtaaaaaactattctccgacacaagaaacgaattgtctctaaaaagaagaagatg

SEQ ID NO: 16274 - DNA, 3000 bp, Unknown; identical to SEQ ID NO: 16273
  misc_feature (1)..( 3000): 2750-1469P.txt file - cDNA_ID_1389713; gDNA_ID_2684204; Annot_ID_137290

SEQ ID NO: 16275 - DNA, 3000 bp, Unknown; identical to SEQ ID NO: 13823
  misc_feature (1)..( 3000): 2750-1469P.txt file - cDNA_ID_1390897; gDNA_ID_2214654; Annot_ID_136485

SEQ ID NO: 16276 - DNA, 3000 bp, Unknown
  misc_feature (1)..( 3000): 2750-1469P.txt file - cDNA_ID_1390917; gDNA_ID_1971821; Annot_ID_58328
ttctaccattaaagatcaagtatgtaattgtacagactcggaagagctgtgaagagtcgccgcacttgaagctcaaggccaacaacgctatcttctacatgggtttcaagggcagtggtgatcatcatccgagtggtaagcatgtcgagtaccaaacaatagtacggaaagccatggatggaaaaccgggacacattcgtctagaagttgactcttggcaagccataccaagcgatttaattggggaggatgaaccgccctagagtaaacctgaaccggaatgctcatcctctgctgctcaataaaaagttaccgtagggttgacttcaagtcctttgatgacgactatactgtgaatctgtgattacttgttctcaatgcaataactacaagtctcttcttcttcctctttttaaagcttgtcttctacttgtgattacttgttctgaatattgtgatatcaatcaagacaagtatgaaatcaccaagagctctaagaatatatttttttctatcattttattccttggatttttgaagagtaacaaaacatatatgattttcatgagaagttgaagctgagagaataatatttagagttgtattatcgtgaattgttggtaacgatgatggaggctcctgggactagggttgggagatgggagttcacttctattgagagcaagtcggtgaggaggagtttctttgaaacaatgtgataggcggcggcgattttgtatgtgggagacggtgaggggtcttcttcaccgtctcacggtggatagccacaacatcatcaacgtagacattaggttgaaaaattcgacatcttatggtatttaatatgacgattaaaaagagagaaacaagtctatttatcctttgaattgttaatgatcctttttaatttatttttcaaacttataaaactatgaataatagcatcagaaataataaaaaaaaaaccatgtaactttattgcttatgagtcaatcaaagtatatatttattcatgttgtagcttttcaatattattaaccatgtttgttttcattattttatttttacataagtaacatattttcatgccattaaaattttacaacataagataattttattttataatattcaaatttccaatttccaatttcctctttagtcttaagtcttaacatgtcaatttttgtattaaaaaaaaaacatgtcaattttttgtacaaaaaaaataaaaccatgtcaatttaggaggaaaaaaaactggaaaagcctgacaaagaaaaaaaagctggaaatatcaaaaataaaatgataacgtcgcctgagagattcgaactctcgcggggaaaccccatgtacttagcaggcacacgccttaaccactcggccaaagcgactttattgatcatgaatcaatctaaaatatatatatatataaacctatcgttttgaatttttttttttggcaaacagcttttgatactattatatatatatatatatatattatccccacatatctttagctatgtctttttcgaaggaaattttgaagtattaaattaagtgacgatttacacacatatggagtaattaaatcgttttagcatatcttgtaatgttgtctctcttatccaactattctaaagaaagtggtgactagaaaatatagattatatactatgtgaccaactttttagtatatctttataaaaacgcataagatatgtcatatgtgtttcctctaaaacttgttaaagaaatgaaaaatctgttggtagatgtgaatagttatggactagtttggctttaaaaagaaaattgggcccatgtatttctattcatgcattggacatgtacaatgtacaaatatattcatgattgcaaacatgtagtatatatgctgactatacgattgttatttattcaaaagttaagaaaatgcacaagatacacatggacgaaatcgaaactaattgtacaataaaataataattattagtattacgaagggaaaagggaaatggtccgtactagttgtccgaacccgaagaagccccaatcgctgatgcaactgtctaggagccgccacgctgcgaagaagctctagggtttgttcgtcttcttcctcggtttcatcaggttttcatcttctcgattctgatttcggcttctgttttagctttattcggcttattgtgatttaatttgagctgatttggcattattgctgtgtagttaggggtcagggttttaatctgatcgcgtctaggttatgattcttttgatgatttcgatctttagaaagtcaattgatttgtttcttcgtatgtagctcgtttagctgacagatctgcatagtgtcttatcagttactagatctttgtgctatctctcactctgatttctggattttgattccttttttttttttgttagctgacatacaagtgtgagtgatgtgtgtctttgctttgtttccattttagtttagtttctcaaaatggaaatgatgaatattgggggttttcagaacctaagttgtagaaatggtctttttttgttatcacagaactcaaaaggtacttggtaggagcgagaagaaagtttctggagaattgctgaattgtttctttcaatggttttgtttctaaggtactatccgagtccaatgtttctgagagttctggtagcttgttaatttgttatactgaatactaggattgattttggcaaagcatgtgatgtttgttgcaagttcaagcagatgtgtttctttttataaatttagaagaagtttacttccgcagccatctatgattctcaaagttcttagctttgcgtttgattcttttttctagaaaccattggttagctttggataatgagtccttttctgcccatgatgtatttttctcagatggtaatcaagattgttgacggtgctctgaagatctgttgacctgctcagagtttgcttaaaaagtttgagaaaaaatg

SEQ ID NO: 16277 - DNA, 3000 bp, Unknown; identical to SEQ ID NO: 16276
  misc_feature (1)..( 3000): 2750-1469P.txt file - cDNA_ID_1390917; gDNA_ID_1971821; Annot_ID_176165

SEQ ID NO: 16278 - DNA, 3000 bp, Unknown; identical to SEQ ID NO: 16276
  misc_feature (1)..( 3000): 2750-1469P.txt file - cDNA_ID_1390917; gDNA_ID_2926193; Annot_ID_141166

SEQ ID NO: 16279 - DNA, 3000 bp, Unknown; identical to SEQ ID NO: 16276
  misc_feature (1)..( 3000): 2750-1469P.txt file - cDNA_ID_1390917; gDNA_ID_2926193; Annot_ID_201252

SEQ ID NO: 16280 - DNA, 3000 bp, Unknown
  misc_feature (1)..( 3000): 2750-1469P.txt file - cDNA_ID_1391092; gDNA_ID_2213639; Annot_ID_132230
gtgtagcttctgtgttaagccacttaactttctgacaagtcctacaggtacaatgaattttaagtcaaacctaagctttcattctggtcttaatcttgaaagcattatttttattatttttgtttctcgaaaagcgaaagcatttgtttgctatacatcaacaaatagaagattccgaagaaacgtatattttcttaaatggaactttgaaagtaaaaaatcgatctttagtacttggaacttgctagctgcatattacccaattacgaaaatgtaaatatgggatttgacattagaaacagcactagtgtttgattgacaaaatataaagcacattaacgcttaagtgatcggataccatcaccaaactggaaacctaaaccaaataccaaatttcaacaactttcaactaacgtttttggtctaacaaattaattattatgtaccaattaaccataatcgaagacgcttattaaatatttttatttatcgtgcgcgccatctatatatagttggtcatttctttagttccaaattaccttgaatttatattatttcatgccactgtttatgaaatatataatgtgactcagtcctgatattttaaagaaatctagtttaaatattaatgaatatgatatatagtgtttatttatttataatcatttagtttgattcaagataagagtaactaaaaacataagaaaaaactagattagtaatagagaatattaaatttaatctttgattaacttgtttgattaagttctacataccgcataatgcccaaagataaaggaaaatataattaaaatcatttagatttccccaaaagcaatttttaaaaggaaaaaaaaataaaacctattactcctacaagaaagggagaagttacagagtaaccaccacgtggataggctcataaaatatagagatctcgggtctatatatatataggagagtagagaaagtccataatcatcaagatttagtgttaaagcataataaatattttctttgaaatttgaagagcttgaaaatgagtacagccactttcgtagagattattcttgctatcatcttgcctcctctcggcgtctttctcaaatttggttgcaaggtacactatttgcatttttactgcttcttttcattagaaagagtttcttttttaaaaaaatctcataattactcgaattttcagatttttgacttttctttttttgcaggttgagttttggatatgtttgattttgacgctgtttggttatcttcccggaatcctttacgctctttatatcatcaccaagtgatttttcctatctcctctgttctttcctcttgctcctcgtaagctctctttctccacgatctctccccctcaatgtatattaatctaatcatacaaacatacatgcgtagctgtgatgaatatagaacgagatttaagatgaaatatctttgattaactatatatgttttccacaaagaaattacgaatatcttcttaataaaattaaataaaaagaaaaataaattaatgttaggtgaaccacatttttagtgagatattgttataacgattcactttgtaacattttcagaaaattatcgaataattatcaattaaaaaaaaaaggttaaaataacactataagattttatcattttgatttacatttttattagtaaaaggaattgaccaaagttttaactttacatttgttatttgtgtaggaagaacagctgtttcgtcgtgctcttctccctttgggactgattcatcatttattttatgttatgagcaattgtattctcattgttgtatttgcattattgtatactttctgctgatatcaagaaaaaatcgttggtttatgtgaggaatttatttatttcgtttaatttgtacaattggtaaaatgttgcaatgagcaggtttggattccggaccaccattaaaaaaatttaaaaccaacgttatataaatccatggtcacatgtctcgtctcatcaccaacaaatttgcaccataagtactcacgtggtccatgagaaatacaagagaatcatccccaccggttgttaataacccaatgttgataatatacgtttttgtcatctaatagttgacatgaatcagttgaatcgactatacaattaattaaggtcatatctttatttttggaaaaacactagtgaagaaatagagtttttcaaacttaaaagattacctaaatttgatgaatacttaattatcggagacggatacaaaggaaagaaattgtcaggaggcaaacaacacgtatatatccggagatcagtgggatcggattttgatctagattactgttgatatcaaaacaaaacatactatgtggaatgtgaataattatcatatttacgcatgaaaagatatatacatcaaagttttatctatctaatatatgttttgacccaaaaaaaactatctatctaatatgttgtagtcggttaagttacgtaaccacttacgataaacttttgacgtataaaatttgaaattgataaatacatgtattatcgtcgatatcacacgggtacggacctgtgacgcacaaagaaagatgatgatatatggggaaggcaacatagcataataataattactaaaaatgctatttatttccttacattttttcaacacgtaacggatgctcctaatgctaattagtagtggttacgaaagattaagtacctatcttgccaaaaaaatatccctttcgccttgtatgtagaaaaaagaaaagaaaaacaaagtcctcatttagcttaaaggtaaaggaaacaaataaaataaaaagggtaaggcaatacgtggctcaaaaatatctaaaaagttggtctctatataatgtgagagatatatcacaagaagaagatagagtaaagaagataaaaaacacaatttgaagcttttataatattttctcagaaactttcaaagagcttagaaaaatg

SEQ ID NO: 16281 - DNA, 3000 bp, Unknown; identical to SEQ ID NO: 16280
  misc_feature (1)..( 3000): 2750-1469P.txt file - cDNA_ID_1391092; gDNA_ID_2213639; Annot_ID_181159

SEQ ID NO: 16282 - DNA, 3003 bp, Unknown
  misc_feature (1)..( 3003): 2750-1469P.txt file - cDNA_ID_1391361; gDNA_ID_1620316; Annot_ID_153193
agaaggacccatcacagcagaaacacgtccaggtgatagttttccggtcacacatctcataagatgtttgttttttccttttaaagtaattgaaagatctttaaaagcaacttcaatcataggtctctttcttatatcaatatcattagccatagagataactccagagaaagtcaagttcttgttctgctcctgcattgctttttccttttcaatctggccataagcgtacctgaacatctggctctgtgtatgcaaggccttgccttttggagcatgttttttaatgtttttatcaccaatctcaagattaaacccttcaggatcttcagggttttgttcaatgtcatgtaacatctctgttagtttgttcttctcctttttctttccctttttagtgtctgagctgcttcctagcattggtggtaaagcagcatctgatccaggttttgcttggcttaaacctctcatcaaatcaggctgtttcatagatttcctcctcgaaaatgttcgagaaaacgattgttgcagctcggttgcatgcttctttgcaatatctttggcagatttccatttctctcgcgattgcgaatcacgcacactctgcactgctttttctctggattttgcctgccttctttctctcgttgcaagcacttgatcagagcagttgtataagattatgagcaagaaacctagcccggcctacacagtacaataaccaagggtcaaatgatcagaaataaccaacaaaatagatgaaactaaggagagatcaattatgactcacgaaaagcatgattccatatgctgtgatattctgatttgttgatcttggattacacgttgccaacttaaaacaatctgcaaaatattcatcagagaaaagacaccgtaagttctttgcttctccttctttatctctgatataacaagtagtgttgtttggacaaaatacatcacttactcagttctgcagtagaacctgtcctgcagtaatgtctggagaaaacaaaagattagtctacctgattagagaaagatgaatcttcaaagaaagtaatgaaaatcattcttagttagttaccctttagtacaaggaagcttgtcgatagtggaaggacaaaaggatccagctgaacagaaaacttcactactactaccaatatcagcccaaatatcagctccaccacaagtatgatttggctgaccagaaggaagctggtaatgatatctgcaaaaacaataatcctgcagcaatcttaccatatgttcaagacaaacttagaaaaatgagcaaaaacaagacttacgggtcgcataatcctgttgttctgttcagattagcttctggacaataagctcccaaaggacaagcttcacatcatagtgaggaaacaacattagaaatggatcaacaaccgaatctttcatcgtttctgaatgtttaaaggaggttaacttacggatcatgcaggtgataccacgagggcagaagaaacctgcgcaacaaggcgcacattgctgagttctaacaggaacattcttgtcgtctttaaggtcaactttcacatctttagcagtacgacaagcccatccaggctcacatccagacatccatgaagatagattgcagttcttgttcggtttcaagtaattagtagctctctttgcacctcctaataatccattgaagtatattctcacttctgcagccgtacatatcctctgcatcatgtcacctattctcaaaccaaaaacatcagcaaaattaaaatattatttcggcttctgtcaatgaaacagaggatgtataaatataccttttgtggttttaccacatgcgtttaagaaatctggctttgtagagaaattaaaggcttcgttataatcttcttttctgaaacaaagacaataacataaacatcttcaatgctataggataaaggttaatgccattttgaaactaacacattggtaatgcagaatccgagctctcttttgatgtcatcctcaaaaacttcggtgagattcgatattttgtcgaaaacgaattggttatagagacgattagccgcgggattatccaagcttctatcttcttgacaaatcactctttcttgctgaagaatcaacacgataaacacgaagaacaatggaacaaaattccctggaaaatatgaatttctccttcccatccctgaaaattttccaagaaaacaacgttgcaaagaattgtcttgagatcaggatggatcaaggagacattagacaattgaaggagacagaaagagagaattagggtttgtttgttttttctttttttctttttctttttggggagagagagattgttgtgtatcttgagagtcaagaaatggatgagaggaaggcatggcgatatatgaggaggaaagagacgaaaacagattttaatttgaccgtttgactttctctaactcgtgtcatggtaatagattcttcaccaaggaatcatactatgtaatttacagttaaggctctgtattttgataatgtttctactgtgacctctatagttttgacatttttggtgcaatatgtcaaatagaaaagatttgtttttctgaaaaatataaaaataaatttaccaatgtgttctgaaggcaattcagctataaactataaaaggataatgaacaaattggtttattcatcaataaattggtttattttggtttaaacatcggttttgttcgatggtccggttaagacggattgttaattattgtcgttgaaaattcaacaacttttttttggtgagaaaaactgaaagacacaaaatcagtcacgaaaacccccaaatccacagattaattagggttttcgatttctctgatgaaactgagaagaatctctcattagggttcttcattcttcagagggatttctcatatctctctcattgagcttgctaaagctgaaatctgagtttgaaattggaattcagattcccatcccatg

SEQ ID NO: 16283 - DNA, 3003 bp, Unknown
  misc_feature (1)..( 3003): 2750-1469P.txt file - cDNA_ID_1393284; gDNA_ID_1621198; Annot_ID_174793
gctcttaatgctcttcttgcctatataattcaaagttaaatccaaaacctgtttgattactaattaatcaaatgtagttaagggagaattttgctcaccaaatagcctctgaaaccagtttggattacaacagctgcgtaatcttctcttgcggtataagtacgtcttgtaagatttggtaactccttcgttgtcgaaggaggatgagtttccgatgcggcggagacggtggccggcggtgtagatgcgtcgtacctctgttctgtaacagaggataaaacggttgggttgatgatcgtcgttgtttctgtggatttctgcgccggagcgtcttttccgacgccggaggtcttcaccggagagtcatgattcgtagattttctaaataaccaacgtctcttctctttcttctgcagaaacagagcatatgaattatagtaatatacaaaacagagaaacaagaaacagagcatgtgaataaaaaaacaagaattaagaagcaagatctcgagactagagaaagtatacgaaccttgtcttcatcttcgtcgacttcattaccatgagcattgttgttgtgttctttcttggtgggagatcggaaagctcgtttcacggcagtgagccaagaagaagaagaaccgctcttcttacccattggaggttaggtaggatttaagattctcaacagagtcaagacatggtagtagtagtagttatgttcctgttttgggacatagaagagaggatgagagatttggtttagattcttgcgcagaaatgaggaagagagagaggagagtggtgggtggatcttgggaaacagaaatgtcaataaatttggaaggttgcttaagggagacttctgactctgaccacctctttaactgcgaccatgacagcgatgactcttcctcttcatttactttctccacttcatttattttgttatttttgtttaactcatttcactaaactagttatatcacattattattattatatcatgtacctacttgcatttgttgtacattcaattctagaagatttgttgctgttaaattgaaagatagagttttgttgttttgagagttaattttaaacaaatacaatataaactaattctatttcattatgcaaaacaattcttctttcccttggttcgattatgcaattatatttcatacattctaatttttgggttttcttaagatatgcatgaatattattctacttatatatatatatatatactagataaggcccgcctaagatataaatttattcaaatatgtattgataatatttaaaatttgaatggtaaatagtgatccacacttttctaatgttaaatttagtaatttttgaattaaataaaatttcaatcatatacattcaattttactatacattttaactatttcttttatcataataaactgccttttaactctatacactccaacttattgatgatatttgaattttaaatagtaactcatatttttttcagtatttaatttagtatttctttaaaataaattttaatcttacaacttcgattttacaatacaatttaaatattattttttatcataatagaatacaatttaattcgattgtatacaattcaaatacaatccaaattttcaatacaaatacaatttaattctatacactccatcttattgttagttttcctttttaattaataaaattataagttaaatttttagatatagaaatataaattagtatatgtaaatatgtttatttattttttaaagaattttttttgacatatgtcaacatctcaatgatagacctgacacgtgtcatgatctcgtgagttagtaactttcaaaactgtactttatataataagatatatgcttatatgtttcatatatatatatatatatatttattagatcgacaataacattaaactatcattactagtttacttttttaaatatgattttaataagtatcatataaatgtacaaagtgtatacaatacatgtttttatatatatatatatatatatattttttttatatataagcataaatatatagacgaacaaacaatgtagacagacctaggcacctagctatgatctatgcatacggacgaaccctattatacgtacgcatgattattgaatataccttcaaatataaacttgtgagcgtaaggttattatgttttcaatactgacgaatgacgattgtgattcatgttttgaaaaattaataaagtttaaaccatcgaatgcgtaaaccaattattcatcttttaccttaggaaaaagctggatatcattatcatatatttattaagcatattaaaccagaccaatgatttaagtcgaaaatgacagctttcaagctttgcttattggccaataaataacaaactaaaaaaagaagaaattttttaaaacgaactggtgaagtctcgtgttatcacgtgcatggagccagtcagacagagacatcatcaggtgcatgatggaccacggtagtccatttcttccctacaaccatacacgtggcctttttacatttaacagtcaaacatctggtcaacaacactctcatctgggcttccttacatcaaaccctactttttttttgtttatcaaaggcccaattgtatataagtgaaaagtttccaatgggcctttcaaggattattcccagcccaatatttctggagattaggtttatttatcatcgccaccaaagaaatttgagccgaagcttcataatcgtagtctgaggtatttttctcgatcctcaaacatttccaacacctaaaggcttattcgttacagatttctcaccaatcttcggatttattgtgctcgtacgataagcatatattagtaaatttagtggctatttaggaaatttctcgtttgatttcttgttgttgttgagatttgaatctgttgtttatggtttttgtgattacttggttttgcagagacaatg

SEQ ID NO: 16284 - DNA, 3000 bp, Unknown; identical to SEQ ID NO: 10503
  misc_feature (1)..( 3000): 2750-1469P.txt file - cDNA_ID_1393342; gDNA_ID_2213655; Annot_ID_181735

SEQ ID NO: 16285 - DNA, 3000 bp, Unknown; identical to SEQ ID NO: 7616
  misc_feature (1)..( 3000): 2750-1469P.txt file - cDNA_ID_1393632; gDNA_ID_1972143; Annot_ID_179287

SEQ ID NO: 16286 - DNA, 3003 bp, Unknown
  misc_feature (1)..( 3003): 2750-1469P.txt file - cDNA_ID_1393705; gDNA_ID_1620556; Annot_ID_160459
catacgaaccattttccctctgactaccactaccatagctaccaccactcctacttccaccatcatatctactactctcatagctcctaccactatcgtttctaccaccacgaccacccccacgatcactgtcacctccacctcggctatatccaccacctccacgatcattagcaccagaactagtaccagaaggagcaagtgcaccacacttgttacattcaactctccttgcaaagttcacgttcccacaactatacaaacagtttcgagggtaaacaatttcaaaacatgctcccacaaaggaattcaacagctaattcaattcattacatatgcagaaagaatggaatcccaaataatttgcaatcattacctggggttgggacaacgccaatctccatctctgcctccgccgccacttcctcttccaccgcgatcacctccttgatatccaccacctccaccgcctaaatcaaaacgaatcatcgaaatagtgagaaactaaagatttaacaaaagtagctcagcaaggaatggagaaatctaaagaatcataaggttatatcaatcagatctgcaacaatctaaatcacaaacctcgatttcctctaccaccgcctccaccgtaaccaccgcgtccgccgtaactacctccgccagaggcaccgcgtccaccatatccagcatcaccacctccataacctccccctccgccgtatccatcaccaccgtacgacggaataggcgcacctccgccgccgtcttgattgtacatcccagccatgacctagggtttgcgataaacaacagaccaaaactcttaacgaatcgtgtgagagcctttttagacgtagaataaaaaatctcgcgttttatttatatttctctcaaaaatagtggaactttattattgcatttatcttaaatcttaaattcttttacatcttatcttttaccgaccggtttcccaaaataactggacttgctttttttatcaaataagacaacatggttctaaggcccataatcatctaacctttacgaaggcccagcccaataacagttattttttacgtagcccaatacagttttgaaatgtggctattagagagaaattagaggcaaaatccaccaaaattttgctataactacaactttaaaagagtccggacagtaggaacaataagaggagaggccagctctgaaagaaatttggagtttgcgaagatgaatgagaagtgtcaagttgaatcgagaaccggcaattatcctcagaaggatcaacagtagtgatcaaaccaagtccaccaaagttgcagctttctgcactgtgatcattttgctggtacaagctattgaacgcgtatgaaacgttgcctggccatctgatgcctgaacacgacccgccaggaagtatcgatgtacagtccgcaacagcacacgcttctaatgctcttgctgacgcgtttgacaagtccttgttattgttcaccacacaccacttaggaggaaggtactgaacattctgcgcgtttacctgattcttatggttgaaactgaaattgtatttggcttgaccgtcgaaagtgaacactccccagtgcctctcaaagttcccagcagataagtttctctgatcttcgtccaagagactttcaatgtaggtttcaacaggaggacgcgggagagaggccgtctttttctccaagtgaactatcagtcctttaaagaacgcctcagcagtcagtgatgttgcattttctgctccatctgtaggccaaccgatctttgacacaacgatatccacctccgaaaacccaattgtgaacaatgcagagacaagtgtgtcatagcttagatcaaagctgtttctgtaggttttacgtccgtctttgtgagcctttgctgtttctttaaagaggctaaagtcaagggagatgttcttgttctggtgaaagcttaggaaaggagagattgtcacaaaaaaaggagagtggtgctttgtgagaaaggagaggagttcaatcatcgtcttgttgaggtcagccctaaagtgtcctgaagaaggtcgaccagattcagaaagaaaggaatcaaagcttgaggggactacaaccttcacttcatttgccaagttcgccttaactaaagcattttggatattcatagctgccccaatcacaaaaggcttatactgattgccatagctctggagaaatggctcttctccaactgctacatacctgaaaatcaattcttttctttaatgataatttcacaataagaagattggcaatttggcattgaaacaaatccgactcattcacattccataagttaaattccagcttaaaaatcttaaatctatatatatataactggataagcagaagagaaggagaaagaagatactcgattcgaactctgtttccaccgttgaagtaacgagtgacattgtcatgtacccagctctctgctacctttacggatgcattcaagctcttgagcatcgaattttggattccgatagtgacaccaatattagaaccagagagagctcggagaacttttgggtcggcatcgaagagcttcactttgacaatgccgtttgatttcagaagctctacaacctttgaaggcggaagagggtgcgacgcttctgtcccccaatttatgccaactgctctgacggttgttcccgtcaagctcaaccctgccgtgacggcgaggaggaggagaaacagccgacgagccatcaaatccagtgaatctcgtacttccacgataatgtcgggccgagaaattcaatgtttaaaaaaacaaaacactgcgtgccgtttcacgactcagcatctcactgttatttagctatcaaaacgacacggtgtttagaaattgggcttgggcttcacattccctaatcatcatcatctctgaaatagaaattatctgaaacttagagagacagagagagagaaagctcaaattcaatcatcaatg

SEQ ID NO: 16287 - DNA, 3000 bp, Unknown; identical to SEQ ID NO: 15107
  misc_feature (1)..( 3000): 2750-1469P.txt file - cDNA_ID_1393841; gDNA_ID_2910749; Annot_ID_193781

SEQ ID NO: 16288 - DNA, 3000 bp, Unknown; identical to SEQ ID NO: 5490
  misc_feature (1)..( 3000): 2750-1469P.txt file - cDNA_ID_1393884; gDNA_ID_2926140; Annot_ID_197439

SEQ ID NO: 16289 - DNA, 3000 bp, Unknown; identical to SEQ ID NO: 5490
  misc_feature (1)..( 3000): 2750-1469P.txt file - cDNA_ID_1393884; gDNA_ID_2926140; Annot_ID_138981

SEQ ID NO: 16290 - DNA, 3000 bp, Unknown; identical to SEQ ID NO: 5490
  misc_feature (1)..( 3000): 2750-1469P.txt file - cDNA_ID_1393884; gDNA_ID_1620794; Annot_ID_50487

SEQ ID NO: 16291 - DNA, 3000 bp, Unknown; identical to SEQ ID NO: 5490
  misc_feature (1)..( 3000): 2750-1469P.txt file - cDNA_ID_1393884; gDNA_ID_1620794; Annot_ID_168404

SEQ ID NO: 16292 - DNA, 3000 bp, Unknown; identical to SEQ ID NO: 10083
  misc_feature (1)..( 3000): 2750-1469P.txt file - cDNA_ID_1393962; gDNA_ID_2213624; Annot_ID_195772

SEQ ID NO: 16293 - DNA, 3000 bp, Unknown; identical to SEQ ID NO: 10083
  misc_feature (1)..( 3000): 2750-1469P.txt file - cDNA_ID_1393962; gDNA_ID_2213624; Annot_ID_132002

SEQ ID NO: 16294 - DNA, 3003 bp, Unknown
  misc_feature (1)..( 3003): 2750-1469P.txt file - cDNA_ID_1393970; gDNA_ID_2214656; Annot_ID_188772
ccatgttaaaactatgagaaagttgactcttatctataaatggaacatgtttttttttctctctaagagctggtcatgcatgcatatatcccaaaaatatggaaataaataactctaatcactgggacgatccttaattgatctttagaaatagttgtagaaaaagtgattaaaacatgggatatatcatatatcattattatgtgaagtgtatttttaattggtacaaattatgtaaaatgagttattagtacttacttcatatagagaagaagcgcttccacaaatgaaatcggtggctccttcaatatagcagttcttgaagtaatggtttccattgtcgtcaaggagagtgtcttggtacgacgttatcacgcatccgtagaacgctgccttatccgccgccaccctcagtgcaaccgcacgtcccgccgttccaaacttattctacttacaataaaacgaaacacatcaatattagtaactttctttttttgttaattaataatgattcacttacttatgatattttggtgatctactttgaattggtattttataaaatgaatgtatacgatgtatgatgaagattgacctgaatagtgagaaatcggcatacaaaatcggatgcaaagatagtgagagtgggtgattccaaaatgtcttcgccatcgctccatatgagaaaagtgttggaagcttgtgtcccactcaatgttatgtagggtttctccgcaggtatcaccactttttctctgttatcaatgaaatcgctaattctcaaaactatatactttaaaagcatagaataaactaatcatcaataacatatactatttaggaaaaaaaatcataaatatattagtaggtcaaaaaagcctagtacctaatacccagctgataaatatcaacaaaatctaaaccctaaaccattaaggtctaaaaacctaataaaccttaagacgacttaaatatagaaaatctaacaaaatattttatatgtaccggtaaattccaggcttaacccaaatgaaatagagttgagagttgtttagattgggagggatagattcaattgcttcttgaatcttactgaagtctcctttgcccgattgatcaactcttattagaattgcagtcgaaaaatcaatggaagatggagaagaagaagaagccatggaagaagatgtgattgaagagaggatgaaaatattgatgattatgatatgatgatagttagcaattgaacgtttggacttcgttttataaagtcccatcttggcataacccatgtgaggtttcacgtcttggcgattgtgcagaggacaaaaaaaacaaatacaagatagaaataaaaaatgaaaactattgaattcaattagtgaagcaagagtgtgaaaattagaattttgaaaagtttggtttgcacataaaggagattgttttatatacataccaatggttgactaaaaatcaagatgacgtggtgggattggccagcggtcgaattcttatgatcgaagttgaaagattgcatttcgttgacaagagattttttctatatcagattcaaactttaaactctaagacacaagttctatacacacaagaatatatatttgtatatttaaccatggtacataacctagactactctccaaaacttgtataaaaaggattttattgtcatcctacaagactacaacgtgtcaacgtctacaatgacctaattaaacagaaccaaaccagtttttaataatgttgggctgaaattcgatttctaacctcttgaccaacaaaacaatcttccatttgaataaactacacgtttttggttcacttgaaaagtttttatcatcgatacgtcaatttatctacatttatcttacgtatgtttggtaaatggtaattgaatatgaacattaaaaaaaaaaaaatcaaacattaaactatgagttacgtcgttaatatgtaattgcttaccaattttttttttgttaaatttaagtcattagagaatacttaagatatactttacgtgtagggttggcggcttgcatgcttcgtgcattagttttagcaatcaaaaagagatctataatgagtatttttgtatgtttgaatgtaagaactaaggaaaaaaaagcgtgtatctatgttttccgtcaaaggccgaatatatatcccgatatagtaatgggccgaaacccaaaactaaaggcacatactaacaaaactacttctatagaaaattatagatgcactcaacacttttgtctatatactattcccaatagtttgttttttatcactaatggtagtagacatgttgatttgcacattgcagctacaaaactacaaaaaaaaaaacgagccatatggatgcttgtcagattgttactgtcacatgaagaaaaccaaagtcttatcttttatttttatacatccaagtagaacacgacacgattggtaaacgaaacctatatagtcaaaaaactcaaaatcaacggattttgtttactgtttgaattatgttcttgttagttagatttattcttttgtatgcatatgtaacaattttgtgtagggaagaaattatagtcataataactcattaactaaaaataaaatatggtctaatgattagactctaatccgaacaataacaaacaattattttcgtttagtgtctctcttattttatccaagaaaaaagaagtgtcaatttataatatcttctggaaagcagccgacagaaaattgtgggctcacatgaaaaaaatttcaatgatgcgtcaaaaagcaaccaaacgactccaaaataaaatcaaatcaaaaatcaaattctctacacgcaactttctttcaaatacaaaaccaatcatctcgattcatccaacccgcgaagacccagaaaccaaaatcgaagacccaacaaaacccacaagtcgaaatctcgaaatccgttgagagtttgttcctttttttgtttgctcggagatg

SEQ ID NO: 16295 - DNA, 3003 bp, Unknown
  misc_feature (1)..( 3003): 2750-1469P.txt file - cDNA_ID_1393996; gDNA_ID_1620644; Annot_ID_47547
agtttgcttatcttgacatttagcaaagcttcgactttgaccaaaaaaaaaaaagtagaaaaacaaaacaaattatttcttattataacgtaacaaattataagcttatagttgcggcggataaaataatcagatctaacaagaaagaaccgttacttggaagatggaatgatccatggtaattgaatgaaacactcacctagtccgacatgatcgcacttggctatgcaatgggaatgaaactgtgcgttttagctttgccgttttgttctcaaatatcttctccatgcactttttctgatcggccgaattaaccacaatcgccaaactctcacaattgttatctttagtttctttattcccactcttctcggcagaaccgtcgacacactgttcttcttccaccatgaagctagcaacttgcattgaaccgtggcttgacgagaaaatcatgacaataccgagacctagccagatgagaataggaagaatgatcagggacaaggcgtagtagatgatccattggaatccgctatggttcttgccgtttaatgtccattcaaaagcaaaagcaattccggagaaaaatgtggcaaaactgcctataaaaaagattctaacgattctcgggttaggaacgtcgaaaaatgtcttgatgtggttaagccaacgctttggtggttgcggtggtggactagtgttggtggtctttagcttttggtccatgcttttttttcttttctttaagtggaactttgagagtaagcttgagatgaagagactacataagtcgttgaagcttgactctaatataaggagattattaaatttttttcctttttatttgttgaagttgttcaaattcttgcgatttaatgggtgagatttcgaattttgaaattacaataatacaaagtagatgataatgtaactatttacataaaacaacaaaaccaagtcaaaacagtactactagatatttgccttttaacggaactatcgacagtaaaaacaataacgagcctaacttcatctttcattcgacttttgatcctaattgttaaatctaaagcgacaaaaaaaaaatcaaaagggatgacgagagagcaatacttgatatatagtggctactggctcataaatcttggttacttgatagtgatgtagcggttggtgccgtgcctagcccaatagttcttgagatcaaccggagaggaaagctcatgcccttcaccagctaaacgactaagtaacctggagaagacacttccactcattttcctgccgccaactcgggaatgccgcttgtttggcatctgcgggagcggatactcagacaaagtggttgtgcagcaagatgattgccagccgccattgccccacttataacactgacgagcagtcccggtgcaagtgcacatgggcactggcattgtcatctcatcgaacgtgactaggacatcgttactgtcccaatcctttctgcttttctttccgggagaagcaactggacggttcagatcctcgcccattttctttccctgcttgctctctttcttccttttggtcggtctcgtgttggctgcttcaggtggaatagttgatataggggaaggattaggtaagtggctttcttcagttataaacctttgggaaccaccgcgcttggcacacgacaaaatgtagttaagattgttttcacggtatcgaagagcatttaacgcactttctgtctccatgatagcattatctctttcagagagagctttgtcccgctgctcaagtgcttcatcacgagaggctaatgcttccttagttgctgcaaccgcttcgtttctttccttgacagctgcgtccctctcagcaaggatggagatgatcttcttattcatcaccaatgcattatgttgctcctttttcggcatcacattctactgcacacacacacagtttgtacttaggtttcattcaaagtaacgaaaacatgtttttttgttttagtgatctgcttcttcaagtgtttttgcttaccacagattgtgttcctttgtagtaatcgggcttgtagcgcccattttcatactgcccaccactctccatcctcttactttcaactgcaatggagaaattgatatcaaacattgtgaaactaggctgacgagtaactaaaaacagaaatactccaaatcataagcagttccataacatacatttaacccaaataaatcgagaaatcgtatcatatcccacaagtcagcgtaataccatccaaaccaaacgatgaagaaaacaatggagcaagtaagatacgcgggaacatatatagagttcgaatttcaagttaaagcaacgacgagagagctcccagaagaaccaaaattcgaagaaaatgaaaattgtagagagaaaaacttggcatgctgaaattaacagataggtcaagaacacgattaacgatcgaagacttacggatttcaacgagccttcaggagaaacaagcaacggaaatcgagaaagatctgaggatacttggaaatggtgtctgtgtaatgtggcaagaagtggaagacgagccaggtactctcggttcaatttactaatatacccttgtcttaaaactgctaaacgagagcaagcaagaaggttattattgtctatccatcttactcgtaaaaatgcaaagacgtttctgtttcaatctctccaaatataagccaaacaggatatgattttggttctggtggatcattctagtgggccgtatgatgggcctaagaataaggcaactaatctgggtcgaatacgggtagacccgggttgagatcccgacgtgtgcgcttcgctgttgtagtagtagtatatctcatcatcaatcaggcttttgagcctcggaaactcaatccttgtatattcaacggagagagatctgcgagagaaagagagatcagattccggtgttccaaggaagcacatattttaagatccagaatcgcctgagagatg

SEQ ID NO: 16296 - DNA, 3003 bp, Unknown; identical to SEQ ID NO: 16295
  misc_feature (1)..( 3003): 2750-1469P.txt file - cDNA_ID_1393996; gDNA_ID_2926217; Annot_ID_142262

SEQ ID NO: 16297 - DNA, 460 bp, Unknown
  misc_feature (1)..( 460): 2750-1469P.txt file - cDNA_ID_1394255; gDNA_ID_1564366; Annot_ID_149332
  misc_feature (426)..(426): n is a, c, g, or t
ataatagkactctgtacatacaataaagaaaatgaatcaagatattagtaggatacccatacgaatttaggaaaaatgaatcagataacggatataatattbtcttatataagtaaataaaatctgtaaatataatttttttggacggcaaatctataaaaatagctattggataaataaaaattggcatgtgaatgatatttatgaactgacatagccatgtgttataatctcacccacagataaccacaaaaatatataaacccaaaaagtaataaaaaagaaaggaataaaaggaagatattctcccgaaagaaagacagagaaaaaaggatattctaattagaaaccttaagaatattctttttaatcccttttatatctctaaacctcttccccctctstttcttcttcattcatcattcntcacttacgtttcccagaaaataaaagagctatg

SEQ ID NO: 16298 - DNA, 3000 bp, Unknown; identical to SEQ ID NO: 7548
  misc_feature (1)..( 3000): 2750-1469P.txt file - cDNA_ID_1394339; gDNA_ID_1621151; Annot_ID_173258

SEQ ID NO: 16299 - DNA, 3003 bp, Unknown
  misc_feature (1)..( 3003): 2750-1469P.txt file - cDNA_ID_1394384; gDNA_ID_1620327; Annot_ID_153522
catgtggagtttgaacccaccagataaatgactcgagaaaccatccaactacaagctcccaataactttacattatttgaacctatcagatagtgactgggcaaataaaatcctactacaatctccccgtatagttacatgtcccctttttcttttgtccactgctttgcaaaaagctagtttgaaccaaacataacaaggaacaaaaggcactgtcaaatagctgaagtagtggcactttcatgggcgatgtcttaccttcacaaccttggaattggacttgtgatgttcataagtgacaccaaagcattgtttcaggcgttagaaggccatcataagtggcttagaccggagggtatcacgacatagatcttagaggcaaaaggatgacacatcataccatcttagggagcatctctatcagtagtatctcatagagtatttggagattaaaaaaaaaaccaatgaaaaagtaggagtgagagtgtttcttgtttgagaaactttatacatttttatttttttggctaatgattttatacattcaaaagtacgtccagaagggcgccaatcaaattacggatactgtagccaaaaggacctcttatttcccgatttattaatgctattttgtaaagttgtactcccgtagttaaatccactagttgatttggatgtagacaacatttgtattgatgagtaatcttaacgataattcggtaagcacgagacaacaaaaatatatataacaagaaatgataaatatgaaagaaaaaaaacagaaatgaaaattctcatattcatgtaacatatacgaattacaccacgtgatcattacaattcctctatttaaacatctccaactgatcaacgtctaaaaaaatcaaatattggagaagagagagtgaacaactatgaacgtcgaaagagaccaacacatatctccaccgtgtctcctaaccaagaagatccctatcgttgatctaagcgatccaagcgacgagctcgtggctcatgcagtggtgaaagcgagcgaagagtgggggatttttcagttggttaaccacggcattcctgccgaattgatgcggcggctgcaagaagtggggaggcagtttttcgagctcccggcttccgaaaaagaatctgtcacaaggccagccgactcccaagacatcgaaggtttcttttccaaggatccaaaaaaactaaaggcttgggacgatcatctgattcacaatatctggccaccatcgtccatcaactatagatattggcctaacaatccttcagattacaggtattgaacatcattgaaaagccgatatatagtttatagttataaaccttaacattgtataagagctcatgtaagttatataatatccaacaaaatgtatgtaattaaatagtatacaagttacatgaaacttgattgcgttatttcttaccattaaaaaacattcatcaagtttttacattcttcatgatacttaaaatgtttttcggctatatagattattatgtagctgaaaattaatagtattatttgggagtggtgatggtttcagggaggtgactaaggagtacacaaggaatgttacaaatctaacggagaagattgttggttacttatcaaaagggttagggttacggcgtgaggccttgcaataatgtctaggtggcgataaagcacagtatgtgatgaggatcaattactatccgccatcggattcagccatcggagcaccggcgcacacagatttttgtggactcgcacttcttgtctccaacgaggttccagggcttcaagtgttcaaggatgaccattggttcgacgttgagtatatcaactccgctgtcattgtcctcattggggatcagatcatggtccgtttgtgtttggtttttaacttttggaaatgtttttggggtttggtttttaaaatgtgtgaattgcatgcagaggatgagcaacgggaagtacaagaacgtgctacacagatcaataatggatgcgaaaaagacaagaatgtcgtggccgattttggtagagcctaagcgtggtttggtcgtgggacctttgcctgagctcacgggagacgagaatcctcccaagtttgagtctttaacttttgaagactatgtataccgcaagatcataaaggttcttcgtgattgatgctaaacctcagcaaaatcatgtgttgtgataagacagtggcattagccaatagcttaaacaaaaaaaagtactagagtacaacctcttattattgttttcaatgttttgtttttatatttttttcagaataaaatatataatggttcgacgcatatttttcaattttcttttggtttaattaatgataaaatgattgcaactctataaatatacataattgtgaaataaacctaattgctatgttcttaattgtcaagaatttatcttcgaatgacacgaaaatcgaatttgaagtacgagacatgatttgatctgtgtatattgtacatgtcctggatcgataaggttcccagtctagctacgtacactagtttggtcagggatagctttatggtaacgagaaagaaaggaagtgtatccaatcacgatgaatcgttttctaatctatttctttcagtcctattcaactgattacacatgtcacatgtgcgccaattggatgctgttgaaactttgaaaatgcaccactatagtgttaacaatgagccggcgtgataccatgttttctttattttcgaaaggtgtatccattattgtaattttggaccaaagcatatgacattgatgtgtctctgggcctactttaaatcaaatcggacttttctcactcgattattaacgacccgacccgactcgacccggctcggaccggataattacatttgtagctatgagaagaaaaagaagaccacactactctctctatctctctttctctctatctctctctatctctctcatttcttcctgcgtcaatg

SEQ ID NO: 16300 - DNA, 3003 bp, Unknown
  misc_feature (1)..( 3003): 2750-1469P.txt file - cDNA_ID_1394465; gDNA_ID_2214540; Annot_ID_134460
agaagcaacgagacatgcatggctatgtcctagcgaacatagagtagtagtttatacaagtataccaaagctaaaccagtctcgtgaactatatatatacgtcaacaccgaaactttggaaatgtataatacttgtatagttagtctctgtgtctgatattaaattgtacataaatttctttatgattacagtttttttttcccccgatttatttgacacggtttgggttatatatatgattagtcacacaccgacttgtaatatactctccaatacacgcttttaaatttggtgcgttccaaacggatgataagaacaccatgtcacactaatcgggtagggacgtccactaaccatattgacagttgtatcaactacaactacaccatatataacggtagatccattgcattcgtgtggaatctatagtgtttatatttgcatatatcatgtcaaatgatattttgctaatgtaggtaggtgacgccatagaacttttgaatatattaatatggaatcaatgcttttaagaagtggatggtgattatcatttatcactctatcatcccacgtttcatacacgctgcgacttatattttgatttacttttcttatgggtttggtccaattccaccgctaaacactatgcacaagtgcaaacaaatatttaattaaattcaacttccgatttaatcggtcattcaaatgagactaatgagtccaccaaactccacaattagatacccataaataaaatagaaaattcgaggttatcaacgtgcgataagatccactttttgggttatataataactaaataaatgaacaaaacaaaaatagatttgactaaaatttggctataaataaatttgagtttcaaagaagccaaacccgtcaacacatcttctttaagcatctctctcccttcaaagaaaatatcacaaaaatggcaaacgtctccgctttgctcaccatagctcttctcctttgctccacgctaatgtgcactgcccgccccgaaccggccatctccatctctatcacgactgctgccgatccatgtaacatggttagtctgattcacatgccatgcatgaatcaatttccatatataaacacaaaataaccaatatcagagcttctaaatttttaaaaatatttaacacatcgaataggtttaataaattttttgtaatgtatgatgattactttggcaggagaagaagatagaaggaaaattagatgacatgcatatggtagacgaaaactgtggtgcagacgacgaagattgcttaatgaggaggactttggtcgctcatactgattacatctatacccagaagaagaagcatccttgattttcacttactcatttctaacaaacttttgctcaagattatgtaatttatgtcatccttaattagtatttgtcacatacaagatcaagatagttatgattgtgattatttatatgtattttggatgatatattgtagaactagaagtttgacaataaaaagtttatagtgtcgttgtatgtttaagaagtttgacaataaaaactttatagtgttgttgcatatatgtgttgaaaactcattaaaaacacacacacacatgaagtacgcgtatatttataaataaactataaaattgagagtggattcatggaatcttttttattgaaaatacatgttggcttgtttgattagttgagagactgctaaacatttatttcatataactagcaaagatcgatatatcgtcgtgtacacaaaagtactactgtatatgtttgatcgaatctgaagaaccaaatttatattttcagactgattgtgtatatggtctcgtaatatacaatcatatgataattagccatcactaatgtagtcatgtctttatgctgaaagagtgtagagactctgccgtcataatgcagctgttaactacgagagcgaagctaaatatttttgaaaagctcccacttcaatcgaacggagggaaaaacctcttgcgcatggaatagagtagtcaacaatcatttgtaattgtaatagaaaaaactagtttaattagaaattgagcatcaaatttaaacagctctgtaaaattttctaattgtaataagaaatttttgttatatctgtcttaaaatatacaccaaaggtagacacaatatctcctacaagtgcacattcaacttctagatatagacaaagttccaaacttataataagtttttttgcaaagttattggttataattaagtttaattggtttatcaatgggtaaagtatacagtaaactgattaaacctagctatgtgggttatagatctcgaactatttactcgaagtacattaagttatagaactttcatttcggagaaaataaggataaaacttttattttatagacatatgaactagagttaaaatatatgagctctatctactgatactttttatgagaaaatagaccttttttctaaaattatctttgatgaaaattttgtttggtactccaacatgtgtacaaaagttgcgctagatcaaaacatatgtaagtaacacaacttatgacattcttgattgcaaaattagttaaaatctagttgtttttatattattgttgacacaaaaaaaaatgtcagcatatgaaagcctccgtctgaagcagaaggaacgactctggtctaaaactctaaaaaccctatcttcttcgttctaaacccaaaacacacacaaaacaaaatggtgctacttctccgatatcgatccttaacgataaatctcactcctctaatacccaaatctcaaaaattccacactctccaatcatttcgtaaccctaatttcatctccatcccaaaaatctcagcctccacgaacaatccaacaacaacaacgaatcggtcgatctccgacgcgactaaattcgctaagtcagtgttattcatacctcctggtgtagagattgaggaactaacagatgatatg

SEQ ID NO: 16301 - DNA, 3003 bp, Unknown
  misc_feature (1)..( 3003): 2750-1469P.txt file - cDNA_ID_1394502; gDNA_ID_2214505; Annot_ID_133736
aaccacgaatattcttcatttaataaaataaaacactaatattaatattatcaaaccaccatcaatcctgtaaccaattttcacttttgattgttcttccttattctcagctaaccatgaagttcggcaagagcctaagcaaccagatcgaagaaactttacctgaatggcgcgacaaattcctctcatacaaagaactcaagaagaagctcaagcttatggagccacgaagcgtcgagaatcgtccaaataaacgttcgagatccgattccaattctgtcgacacagatccaacggttggtatgaccaaggaagagcttgatttcattagtcttcttgaagatgagcttgagaaattcaattccttcttcgttgagcaagaggaagagtatatcattagattgaaggtaaatcctcaaaaatttatgtggaacgatgcaaaaacttaggttttgatgtagaattgttaggtttgatgatttgggatcaatttgttagttttgattgcatttactgattgttgattccaattcataggattctaagatttttcataagtagatgttgttggaattactattatgacgaatgactccggccaaatttccggtgaagtccgtcaccggaatgaccggagcttggattcctcgtaaatcatctgaattagtagtttcgattcgtttggaaacgtagttgaatgagaaatgagcatagttagttaaaaatttaggtccatgttacttattttgtagcctaaggctagaattattgcgtggagcatttttagtttacatagtgtattcaactctatttcttggtgggaattggtatcgtaggaattgaaggaccaagtggcgaaagcgaagaattctaatgaagagatgataaatataaagaaagagattgttgattttcatggagaaatggttttgttgatgaattatagtgctcttaactatacaggtaaacttttctttctcatgtcatctccatggttattgtttttcgttcttttctcatatgttctaatcattcgtagcccgaaagccgacgttgagtaaacagaacaagctcacatgttggacaattgatagtttttagatgttaaaactcgtttacaaggtcaagctctagtttttagcatttcctagtaagtgaaaccgtgtcaatgggcaatatttttagaagttttgtgaaagattgattagtagggaacttgagttagtattaacattacgtctatgttaagagtcatattctccacgatctttgtgttacttgttaaatagaaatgtgcccacatgaaggaatatgctgtaatttgtttaactggccactcatcgcagatgctttctttatacttttttcttataaataacttgaggtttatgcctttattcttattcgctaaatgtgtagaattgtgttctattggtttacaggattggcaaagattctcaaaaagtatgacaaaagaaccggtgctttaatccgtttaccatttatccaaaaggttttgcaagaacctttcttcacaactgacctactcaacacatttgtgaaagagtgcgaggctatgctggaccgcctctttccgtctaacaaaagtcggaatctggatgaagaaggagagccgacaacttctggaatggtcaagacaggaacggacgattctgaacttcttagagtaccaaaagaactgtctgagattgagtacatggagagcttgtatatgaagagcactgtgtcggcattaaaagtattaaaggaaatccgcagtggtagctcaacagttagcgtcttctcgttgccaccgttaccggcaagtggattagaagatgattcatggaagaagaaagttggtgtccttgaacaagtagcgaaatgaattatgagtattattatttttaaatctctctttttttttgtactttctttaaatagtacaagtaattgtatacgcttacagctgtaaaagatgaatcaaataaaacatagaagtgtgatcatctttcaacatttaaacttggttgcgtgtactttttcttttgctgcatatcatgtatgaaaaatcttctgtaagactgtaacaccactttcaagcagagagaacaatgaaatacatacgccatttcgaaatcttatgtattgcattttagcatctgtgggtcaatcggtctctgtactcctaactaggtgatatttggtccaatttaagggcagctcattcaatcacaaagaatcaaatatgttgcagaggaaactgttctgacttctgtgaatgttgcaagattgtatagctgcttcttgttcggcccttttatatgggctttgtaatatatgggccttttttatgtgggcttagataaggcttcgacaaattttagactacgctttgcgtccctaagtgcggccactcagtaaatcatctacgtcacttattgatcaaactatggctgggcagtgggcaaaacaaacgaaccagaaatcctaattttgtgtacttcaaaaatcaccattttttttttttttttttttactattataacaatactttttgagatcaccaattttcttattttataactaattaattctttcaagaaatatttaattcacttttttatatattttaactaaaaaagactagaagttattactttttctttttgacccatactattaaaaatataactgtcactgaatcggctctaaatctcctcgactttcaactcctacagacattcagacatgtgcaacactcaacgcactgtcgatattacatagacccgaaataaaagctccttgtccaaaaacttcattcaccctctcatcgttatcttcatttggaaacaactaaacaatattctgttttattaatattttcgcctatttaaaaattcaattagaatagtgtatccctcttctctattccttcaagccaactaaaactacattgcgtgacttcttctgtaaccatttttctattccgatcaaaccatg

SEQ ID NO: 16302 - DNA, 3003 bp, Unknown; identical to SEQ ID NO: 16301
  misc_feature (1)..( 3003): 2750-1469P.txt file - cDNA_ID_1394502; gDNA_ID_2214505; Annot_ID_184087

SEQ ID NO: 16303 - DNA, 3003 bp, Unknown
  misc_feature (1)..( 3003): 2750-1469P.txt file - cDNA_ID_1394622; gDNA_ID_1620452; Annot_ID_157502
gagatccttgagactctcaagcaagaaccggatccggtttaccccggcgcgagacgaaccgggagagaacgcagatgggtctgactccatataatgcgggtcgataacaaaaaccggatacataaattcagaaccttttgaggcgtattcaagagccgggttgtcgtgaacccggagacctttccggaaccaaatcagtgaaccggatccagtagccattgatgttatgggattgagacgataacttgaaggtgaacagacgcagaatcgttgcatgaatatgtttgagatttctatagaagtttcttttgagaaattcgcgcctttgaaaagcgcgagagaaggtttcttaagacgaagatgtggttaatatacgcttcttcaactctgtgtttgctaatttgcgcggtaatcagcgtaagataaaagaagggaataggttattatcaacggttatatttaggccacgtcattactaaggagcaacatcatttgggcgatgtgttcaattatccaacatttagtgcttattagtatccatgattagtgaaattaagaaaatttacttcatatatttgagattgcaatcgtaattatatttgtatactaacattttaatctttatacgtgttgaacatatctaccgatccaacagttagcattaacaactgaggaaaaaaaaaaaaagcattaacaactgacaacaaataaaaagctaaactaactaatgatccaacggttcacaataaagcaacatcatacacgatccagaccgtacaaacagaaaacgacgccgcacaataaagcggttcttgagtatcatcgtaaacaaaaagttattcttcatcccataaaagagagacattttaagttcgacgaattattgattatttctggatccgtgacccgatccagttacttcttgacccgaacgtcagacgcgagtcgcgacgcgatcgcagaatggtacataacgtcgtggaatgtagaagcttcggcggttttcctccgcagctgcttagccttctcctccgtgagacaacatcgcagagacctcttttcagctttatccagatctgattccagattcacggttttgttgacgtaatcaggttccgatgacatgccaaaaagaggagcccaccatgaaaccgacgaaacaggtttcttacgggctggatccgattcggaagatgctcggatcgaggaaagagcggagcaggagatgattgtagccattgttaggtaaaatgtggttatctgagagaaagctcaaagctgtttttaggaagaagagaaagattaaggatttgtaaatttttggattaagaaaagaaaatggatatgtagatatttaggtggaatcagctgctatgcggtgtggttttttatagtgtggaatgttcgtttcactggtttttatcaacgtaagggtattttcggaaagagtgtgcaacggtaaatgcgttgtgcactacgataagtacggtggagatgagagcactggattataaaaaaatttaggagatggataagattgaaggcgtggagcagcgttgccaattgtcaaatgtcttcgtcttcacttttcgctttaattatttgttgattaggatatttttgtttggattttacattgcttgtgtgacttgtcgctttgacaatatccaaaatgacgtgtactcattggaaaatagagttcaactattatggaatattcttaaatcaggaataatcgtcggtgatatttgactatatctctttcaacgtatttcgaactcgtaacaaaatgtcagtcttcttttatcaaacggcaaaatgtaaaggtaaatgcatgtatatgatgtgatcatttgcatggaataggagtttttgttagatttacgaatgctgaacgcatataagtcttttaagactcatggtattatactattattgcatgtttcatcagccataaataatgtgcagagaaaaactaactaacaaaacattgattatatattttattgtatctaataagtaataactaaaataattagagctaagtgattgactgatttccttcgttattttgaattcaatttttgggctttttcctatttggcagattcgtatcacattagcaacactagggatttctgttttagttgcaagagaagataaaacgttataaagcccaaaagacccaattggtgaagcaagcccgcataagaaaaaacccaaatgttgaaccaaaaagatgaggatgcaaacttttcacgctagtgtcgtactaacggaaaacttcatatttggagacatcgagtagattttttttatctatgagaaaaataattcatctagaattttattgaggatatgagtataagataataatgaaagaaactattaattgtgtacgtctttatcgttcatatgttttgttcaatggacatatatatacattctacacacaaactactataccacgattttttttatgctaacattacctctagctacagacagaagtagaaagaaaaccaaaaccatcaggtattacatttgaagttttgaattgtggaattctcaacgaggttcgaggaacatgaatttggttgctaactaaagcaacttgcttgtgcctgtgtgcataactggactgaggaaaaaataatccttacatgtccatttcatcataatttcattttgtagtatatgcatcattgtatcattatttccacttgtatcactaattccacttgaaatgtcacacaatatagggtcccctgacacgtgtgtactatgtagtttcacacgtaccggttaatatcgagattccaagtaaaaaagtgaccaattctaaattaagaatctctctaatctcttcccaaagaagaatcatcactgaggaagaataaaacatttggggagtttcttcgctaatccttcaaggtgtgacctgagaatcacaacacaaaacaatctcactcgaaattcctttgactcatcatcatcaccatg

SEQ ID NO: 16304 - DNA, 2247 bp, Unknown; identical to SEQ ID NO: 7814
  misc_feature (1)..( 2247): 2750-1469P.txt file - cDNA_ID_1394643; gDNA_ID_1621165; Annot_ID_57188

SEQ ID NO: 16305 - DNA, 2247 bp, Unknown; identical to SEQ ID NO: 7814
  misc_feature (1)..( 2247): 2750-1469P.txt file - cDNA_ID_1394643; gDNA_ID_1621165; Annot_ID_173816

SEQ ID NO: 16306 - DNA, 3000 bp, Unknown; identical to SEQ ID NO: 6260
  misc_feature (1)..( 3000): 2750-1469P.txt file - cDNA_ID_1394744; gDNA_ID_1621085; Annot_ID_55368

SEQ ID NO: 16307 - DNA, 3000 bp, Unknown; identical to SEQ ID NO: 6260
  misc_feature (1)..( 3000): 2750-1469P.txt file - cDNA_ID_1394744; gDNA_ID_1621085; Annot_ID_170505

SEQ ID NO: 16308 - DNA, 3000 bp, Unknown; identical to SEQ ID NO: 6260
  misc_feature (1)..( 3000): 2750-1469P.txt file - cDNA_ID_1394744; gDNA_ID_2926172; Annot_ID_140182

SEQ ID NO: 16309 - DNA, 3000 bp, Unknown; identical to SEQ ID NO: 6260
  misc_feature (1)..( 3000): 2750-1469P.txt file - cDNA_ID_1394744; gDNA_ID_2926172; Annot_ID_199603

SEQ ID NO: 16310 - DNA, 3003 bp, Unknown
  misc_feature (1)..( 3003): 2750-1469P.txt file - cDNA_ID_1394783; gDNA_ID_2936574; Annot_ID_194872
caaagcttcacccttttttttttttttccttcaatctctttctctcactcagtcactaaaggtgaatcctttttgtttgtcaatcttcttcttcttcttcctgatttttcggtcggaacacacaaattcagctcaccagaattcttcgctatatttattttacatttaacaacttcttaatttttagtaaaatgtatattcttaatcttacttaccaggtggcattttcacttttgtttatatatttacttcaatttttctaatagaaaaaaagtaagcaaatattcatatgtacttttcagtttagtttttggctaaattaaaaaaaaataattctacttttaataataacaacttaacaacttaacttaacttaacttaacttgttctatttctaaaccaaaaaaaaataaactaagatgaaaagctttgaaaagatctgcatgcatccatgggagatcttattatatgatcaaaaccaaaatcctgcagaaattaaaaatccaacaaaaaaaaaaagaatttggaaacaattcgagaccagctagtaatggaaaactataatcaagaacattgtttgtaagaattcttaaatacggtagtagagagactagaataactagtaataaagacatcattggtccgcaggatctaagcaaataaaaagaatttctttttcactgtcttcaacgcagtgactctctttctctctctttattcacacctcttgttaccttcaaaaccttctctcaatctcctccattatccttctctttttctctctccctgcaactggctccatcccaaagtgcttcgttctggtacagcgaccatggcagtttttgttcttgtgatgattttgttggccatggctggtcactcaagtaagtatatcttcgtctcttttcaaatccttctctgtctcatatagatcctcttcttttcttctatggcaaaacgattcttcttttctttgttcacccactctgttttacaacagaacaacatagtcacaaacttcttagctttcatagtttttaatgaaattttccacaaagaagggccatttttgcttttacccataccttcttttcatatttcctttttgactgtggagttcaacaatcttgtcccctcttgaattaaacattaaggtgttccatttcacacattatcagtgaatgagatttgaagaatgctcattgaagtgtttatgtgtgtctttaggtgggacatggtgtgtatgcaaagaagggttaagcgaggcaatgctgcagaagacattggactacgcatgtggtgcaggagctgattgtggacccattcaccagaccgggccttgctttaaccctaacaccgtcaagtctcactgctcctacgccgtcaacagcttctttcagaagaaaggtcagtctctgggcacttgtgactttgctggcacagccaccttctcagcctctgatcccagtgagtctctcctaccaacctcactacattagaattagtgcaaaaacaatttgttcatatttggtaacttaactaggtaaagttaaaagcagtagttgaaaaatggaacccaacttgaaagcaaatcagaaaggctagtttatattaatctaaacttcacatgtttcaatgtgaatgatatgataaataaagtatccattatcttattatatagtatcacaactcaagattctctacacagatttgaaactagattgtagaacatatcatttttattagtaactgttgtctcttgtaccattgtggtcttatgatataggctacactacttgtcctttccctgcaagtgccaggtacacacccttctttctttcttcacttcttatttgttgttttgcaaacaagaattggctttggtcttgaggatctttgcactctagatctttgtttaagctgattgatacaatctgagagatgtgtttgtatgtttgttgttatttaccatttaatgcagtggaagtgggacaacgactccagtgacgacaacaccttcgacaagagtccctacaacaactaatacaagaccctacacaatcacaccatcaacaggaggaggtttgggaataccgtctggtattaacccggattacacagatccatcctttggattcaaactccaaagcccaagatttggattcatagtcttgttcactctcttcctacccttttacttgtttagctaactaagtgatcatgtgagtagtgtgtgtgggtctcaatctaatgtaatgatggaatctatggagatagagacatttttttgttccatctttgtctgtttttccagctgttccccacttgcctctgataaaaattgtacattttgatttcaagtaaggagacggaaatatatttatttaaggttacgttaccttcaccggaattgttatgaccggagataatcaaatctgaatttctgattgtctgaattgaccccaaacacaaccaatcaaaacaaaacacaaaggataaaaatgtcattttgacgggttaatgtatataactaataaagggtaaaattgtcatttgacttcaccaaccaacaaacactcttctcagtggctttttttttaattgatcggatcctccaagcagcagccgaagacgaccgccggcgatttccggttggcaattgttctcatctgatctgctttctcgcggtactgatctctgatcccaatcttacatcgtaaaatctctgctttcgttcgggttttgatgatatagatcacgtggattccttcttttcacaattgactgttacaaaatcacaacattacatttaatctctttcacgtccccaattgttgtatgaaatttgatgtatgtgaggtagaaggtcatgttctataagctcattcgaccaaatttgtgtgtttgtaaacttaactttgatttgttcatctccaaggttctctcaaaatgaacgtcagacttattgggcactcttgttttcttgtagctccaagtttaatg

SEQ ID NO: 16311 - DNA, 3003 bp, Unknown
  misc_feature (1)..( 3003): 2750-1469P.txt file - cDNA_ID_1394832; gDNA_ID_1971889; Annot_ID_58462
agtattagtttagctagtggtttttattttttcttttttattttgtctcgaatgaaatagtggtttatattgaaagtgatggtttttcttatttaagccgaaaatcaggtggcaatttgaaaatgatgggaatcttatccaccccaattttttttcatttttttttccgattactgatatttttctcgattcaattctattttctttgaagaccgtttctcttccttgatttccaatcctaatttcttgacttattgatgttgaactttgtaattgtcatcaatactatcgaaatgcttggaagatattttatcatatttcatttatagaaacccccttgtgttttaattaggccaagggaaccttcgtacttcacttaagttaactactttatcacgaaaatcaatttttaaaacaatgggctgagaaaaatgtttaatgactaaggcccaactataagattttgggccggataatataatcttccaaactcatcgtgttcgaaggatattcttcagaataatgaaatggacttttaacatttattactagaatcttatccgatttttctttacaacaaaaaaatgaaaaaatataggtgtgaatatgatccacatcaaattcggatccgaaacgaaagaaattcccgggtcattggagctccgtgttacaaaaaatctccagatttctccatgactccaaggaaaatctcacagttcgctctaaaaaaatattatgtttgggaattcaaaaatcccaaagaatcaaagattcatctaataaactctctcctccgtaatcttcgatgggtaaaatctctgtaaatcgatcaccaccggagaagccagagaagtcgtcggagaaggaatcaaacccgaaattcatcggaagcaaatccaaaaacgaaaaatcataatccaccgtcgatgtagcaacagatgcagatgtagaaggagactctggtcggatctcggatccgggtactaaacccgattcttcttctcccttgacaatgtcttggaatgtgttagcgaatctagcagcagcttcctgaatctccggaggcgtcaacgacttttctacggagatcgacggtggattattagggaaattgaaattagcatcgccgccgcggagacaaaattgagcggcgtcgaaagcacgcgccgccttctcgggagtgtcgtaagagcctaaccaaattcgttctctgctgtgtggaagtctgatctccgatacccattttccccatttcctcttcctcactcctttgtactttgactgcatcgccgtgtttctcttcttctcctcttccttcatcgcttgcttcaccattggataaaaactccggttcggttcgattcggtttggttgaattggattctgtttccggttcttaactcgagtttcagttgtgtaggttaattctgttatatctggttgatttcgaatttgcggctgtgtgggatttatatatgaagaagtggaagtggcaagtgaggaagaagatcaacgctgactggcgcgtgaagatgggacacgtggcggattgtattgagtggctaacgcgggaatagtgagactgttctgctttgtcgtgttccttgttttccacgtgatttaattcaactctcttttgtctttttgcattatatctgaatgattatctctatttgtttaggcacgtttgttttaaatactgagattttcgtcgcgacttctgtttctagaattttaagactacttcttcttttgtattttagagattattgggcgttgaatcggacacacataagtattgttattataaatgtttgcatcaatggttaggctcatgacatttttgatgcggacactaattaagaagttaagaagcaagtatatgactcactgttttgaagaaagaagcgagtcgtctgttgatcataacttgagattcgtagaagaagaaaggtggaaccaaaacagaagtttcatacatgaacactatttagagcagtagctatctcttttgtttacgcattctgttttccaaataagttaaaaaaagttaccttcttttaatcccacttctcaagatggagcaataattgaattgaaggccagtggccactactaactttcattatactttgctcgagatagccactactaatgaacttgtgacacaaccttgtgtaagaacagtctcccttagattcaataatcaatttccattttgggaaaatcgtttgttactattatttatttgttcagaacccacggaacagattgcccccaaccctccgagttaccaactttataggttttcgctgagcaacaacatcccattagaacggtgaagctcatcatcatgagcatgaaggagaagattcttgttgttgtggtcgccattatcgatcaaaagatcacaaattaagaaaatcgaagaaggaagattgaggaatataagtcgatgagttatttgagtattgatgaggaaaacaaagactatacgaactctctatttataaggtttacggaacctaatccttgccggtttaggattttactcaacgtttggaatatattacatgtttatttcctttttcaattttgattcacctcttatcttgcaaaaaaacaaaacaaaaaagtgacgtttaaagatctctaatccttttctaattaactttgtgtatgatttttagttcttctaatttctatatatttttgttcataatatgaaaatttgatctctgttttaattattttggaactaaatacacatttttaattagattagtaaaagagttataattaaaaaaagttgatctggttggtgtcagcagaacaaggaaaaaagagaggctttttcgttttgatcctcctactcttcttcattagtgaaagctacttataaagtccaaatcttgaagtgcgtgcacggtgcaccacgaatccacgatccagtgagcagcagcaactccatctccggagctctagattcagataagaacaatg

SEQ ID NO: 16312 - DNA, 3003 bp, Unknown; identical to SEQ ID NO: 16311
  misc_feature (1)..( 3003): 2750-1469P.txt file - cDNA_ID_1394832; gDNA_ID_2684202; Annot_ID_191252

SEQ ID NO: 16313 - DNA, 3003 bp, Unknown; identical to SEQ ID NO: 16311
  misc_feature (1)..( 3003): 2750-1469P.txt file - cDNA_ID_1394832; gDNA_ID_1971889; Annot_ID_176812

SEQ ID NO: 16314 - DNA, 3003 bp, Unknown; identical to SEQ ID NO: 16311
  misc_feature (1)..( 3003): 2750-1469P.txt file - cDNA_ID_1394832; gDNA_ID_2684202; Annot_ID_137227

SEQ ID NO: 16315 - DNA, 3003 bp, Unknown
  misc_feature (1)..( 3003): 2750-1469P.txt file - cDNA_ID_1394861; gDNA_ID_1971875; Annot_ID_176681
atgatgcatgcattgttgctaacaagcatgtgcaattaatttatgatttaatacgaataaagaaaagaagctaaggctatacactatagttttagtggccaataaccatatcggaaggtatgacaaagaatataaaaacagttttctgaaaattgtaaattgttatttatggaccagattaaataatacatgtgctaaatactaatgaaggcaacgaatcccacatggaaggattctcgtttccccaactatttctgctctgtgttcccacacataatgccacgcaatatttatacagagtggactgatcaagagattagttaccaaaataaataagaaattctgacttaatcaatcatcaaatttttgtatcaacccctaacaatataccaatattcaatccaaatcagaacaattaaaaatttgtaactaaaaaaatgaaaatgaaactatggttgtaacgaaaaaaatcacacaagaattaatagtcgagtattagatttttaaagataaatcttctttcttgatgacttggtcgtgatcggtcaacaaaagcggttttttaccggtcaacggactcaagatctcttcgtcgacgattggattgtgatgaaggctgagttcaggtaacgccggtaggtttagatcgatgaatccacggtggctcctttcttccgataccgtgctcgacacgcttccactgtgactgattgatttgcttcctcctcctcctccgccgccgaggttgccttcgtagtgacaacgtttgtgaccgcctaaagcttgacccgtcggaaacactttatgacagattgaacactcgtggatctttccggaggcagcaatcggatgtttttctccggcgacgatggagatggtcggagctgttgaatcatcggcggttgttgagattacggttggtggtttgattcggtgacttgctttgtgaccgcctaaagcctgataggaaggaaacgctttttcacagacgttacacttgtacggaaggttctttgattctggcggcggcgttaacgattgcgactgttgatgaaatcgcgtttgcgacggttgatctttagcgagcatgaggagacaaagagcgagatactcttcttccgtaagatcttgattctgggatttgggtcgagatcgaggcggtgaggaagaagacgaagaagggctgtgagaacgctgacgtttggagcgtttgcgtttaagccacggctcaatgaaaacggcgtcgttcatcaaatcttctttcgtttcgattctggtgaaagaagaagttggagtgttcatcgcttcgagggccatgatcagatgaatcttcttctaactgttggatcaaaggatcagaaatttgagagaaaagttgagagtttttaatcgcgaatatggtgagagatagagagaaggaaattagagagtgaagtgcttaagaaatgttttggacttgttgtttttatatggaaaccacgtggcagatgtgtttttaagtcggtcaaatttttatcttctttttttttgtcaatatactctctataagaaacctaacactatagtgtaaacatggaagaaaatttcacaatgtttaaattggattatagtatcaacaaatatgattttattagtattcttattttaaagcattttttgataatatattatctatagcatatttagctttagatatgtgtcagatatatatctgatagaaaattattttagacttatcaaatcatatatattttgttatctaattttgagagatttatggaaataatcacttaaaagtaagtaccaaaccagcaatggtaaaccaaatttgaccaaaaggaataaagagaaatttactgtaaaataccgggttgtttttggtcacggctgacctaataagttttggtcatcaaagagtgagagaccggttcaaagtcaataaccagaaaagtaacaaattggtaaacccgcaaatagattttagcttatattaaacaattaaaaaaagaagcatacctttcccgtggagctgacttatgtgttagctacgcgccacgagtcgtgtgggtcacgccttaaaccaaacgcgtacacgcctaattacgtttttttttggtactaatcttcttgaagatttatcaaattttctagatttttttaaatttattatctcttatcatgaatcatgatcttatcttaattatttattaatcactcttcccatgctaatctatagcaaataaatcgataagattcgtttaataaaacacctggattctacccgaaaaatacgtagggaataaattaacggaaagaaacaaatcggaatttttgttttcagaaaagaaaaaaagaatgttgagctaacttcagtggagttgagtgtaggtgaggtaaaaattgggtgaggcatggcgtaccgtattagtaactaaaacggggcgtgattataggacacgtgggagttccgttaccacttgtaaggcccatgtcacttttgttgttatacccaacaagcaaaaaaagtggacgtaatttatccaaacgcgttggcggagacgtcacgtggcaatttatacacgtgtcacttcgattgcgcagacaacatcttctcaggaaacgcagttttagacgttttctctcattcagattctatactcttcttacctttttgggcttgcaaggttctgtataatatgggctttattagcccaatcatctcgaaatatgtaagtccgtatcagacatctaacggcccatcttcgttgaactcgtgttttacatgattcattttggatcattgaagtttcgaccatttcgctaattcgaattcaaataaaataaaattagtttttctgtttggatatgtagagtagatctaatcgacccttgtacttctgcaatttgaattcaaaatttaaaccactctacttttgaatctctctctcactaaacctagaaagtagaaaaccctagcatttgtgatcttcaacgggaaaaatg

SEQ ID NO: 16316 - DNA, 3003 bp, Unknown
  misc_feature (1)..( 3003): 2750-1469P.txt file - cDNA_ID_1394982; gDNA_ID_2213635; Annot_ID_181008
ccattcatggcgatagaacacaacaggttcgttgattgagttaagttgaaatttggataattgtgcacactaaagctaaaaccaaactatagaaacaacctcgatgatattactgaaatgaactctttaaagatcatcatcagtaagttgttctctgttgactcaatctgattgacttctttatgttgttatgaattcaaaggaaagagaagtggcactgaggtccttcaaaactgggaggacacctattttggttgcaacagacgtggcagcacgtggtcttgacattccccacgtggctcatgttgtaaacttcgatctaccaaatgacattgatgactatgtccaccgtatcggacgaacaggacgtgcaggcaaatctggaatagcaactgccttcttcaacgagaacaatgcacaactggctaggtcgcttgctgagctaatgcaagaagccaatcaagaggtccccgagtggctcacacgatatgcttcacgtgcttcatttggtggtggtaagaaacggtctggtggtcggtttggtggccgtgacttcagaagggaaggctcttacagtagaggaggaggcggcggcggcggaggaggcggcagtgattactatggcggaggaggctatggtggtggtggatacggtggtgctccaagcggtgggtatggtgctggagtgaccagtgcttgggattagccaattaggctccccaatttttcctctttttaacctgactatttatttcttctcttctacattcccaagagagcacgtgtatttgcccccacctttgagatctctcattcaagagatggatttaactaatcttgctattaggtggatctctctgttttttcaggctatttttaggatttgtcctaaaagatagacagtagtttttccgattttgatcttgttcttggtttcttctaacaatttcatttgttagtttgaaatccaatttgtctttttgtttccctttgttgttgacaatctttcttggtgaaatacaatctctctttatatcattttaaggactttgtgcttacattgtttaaactccgttccgttacttcaaaaagataaaatgcaggtacataaattgttgctctgtgtgaattaacatacaacaattagattcaacaactattgctattcagcttcagaatcttcttcaagctcacttccttccacaatctcttcttcttcagagccttcttcctcaaggtcatcctctggcctatcaagcaaaagttcctctttagagaccatgcctagccctctcgcccgataaagaaaccctgttctcatcacatgataaaacttatctcgaagacgagtgagaggatgcggatccactagttttcctcggcgatacccttctttgaggatcacagttgttgtcttacacttcaatgagaggtagaaaatgccggggtatcgcgtgaatagacgagtgaacttgtgcggaatgttgagctccgctctcatgcttctcaagtagttcctcttggttttcttgtggatagtcaagctcaagagctcgtgcaaaacagccacagctcgtttctccatgagatcgctttccggatcaatgttactcgggtcatcgtaaggagatatgtagggaagtttttgaaactcatccatccatgctttgaccttcttctgtgctccatatcctctagggaaactcataggaaaagtcaacgtagactgacctctcttgaactcgcggtatctagactcctccccggaaacatcattgtcctcgtttcgcttctgcagcgccgagaatgcgaactcatcacgccattttacaagctttaaacacgggttaccattagaagccttgacgaagcagaaatgatcagggtatttcatgactagcgtcttttcgtagttatcgggtaaaccgagatcgaatttgagagaatgtagtgatctaagagagacagtttttgatctcatcatcatcagaactctacagagtctctccactgtatcagcctcgtggctttgatgaataatctcttcttgtgagtcaagcattagtgctgtgtccgttagcttgaaacatggtaagcttgcgtaacgagcatgaggaaattcgtgaaacagagtcggatacctgcaaaaatgtcaagactttcattaccattcttacaaaattgatttctttctaaaccgtttgttccagtaacaattgaaattttctctgattgtgatacctgcgcaagaagcggagaacagggacggtgagaccaaggagtttttgccaatcggcgacggattttgcggtgaggaaaccagtgggagatcgctttatggcgtctttgaggatacaagctgctttgagatcggtctcagtatcaatgacgtgatccaggttcttgttcttcacccacttcagtctcacctttgtcattgcacccattcctcgccattgttgatgctggtgaaacagcttactcaccgaaaagagaaagctttgtgatttgacgaacatctaaagagatttgacgaaagcgcgaaatgtggatgatctgtaattgagagtgcaaaatgggtttagggtttagtgttctctcggagtttagttaggacttatcattgaaagaatgaatagagagaagtaggggagagtaatgcagagaaggtgctcgacgaaatgcctgaacgaatctaaaagcgagatttttcgacttctaactctaggcccacaggctacagtcaaagtaagccttttaagttggttcgcgatatgtttttgcagacagaacctaaaaacttggaacttctttttatctgcggtacacagccaaatttgcaaaaataagttccaacgcgtctagactcgattcgtgcgactcgggaagactaggctcgtttaaaggttcacgcttttgatatttcgagctcctagagacctagactctagtcctgaggctgattggtagaggaaattggaaaagcttggattgaaaactatg

SEQ ID NO: 16317 - DNA, 3000 bp, Unknown; identical to SEQ ID NO: 8065
  misc_feature (1)..( 3000): 2750-1469P.txt file - cDNA_ID_1395054; gDNA_ID_1621189; Annot_ID_57464

SEQ ID NO: 16318 - DNA, 3000 bp, Unknown; identical to SEQ ID NO: 8065
  misc_feature (1)..( 3000): 2750-1469P.txt file - cDNA_ID_1395054; gDNA_ID_1621189; Annot_ID_174529

SEQ ID NO: 16319 - DNA, 3000 bp, Unknown
  misc_feature (1)..( 3000): 2750-1469P.txt file - cDNA_ID_1395173; gDNA_ID_1620365; Annot_ID_154799
aataacatccaaatcatgtttcatgccagacacattaagcacgcaatttttccactatacaaatcttagcttactaattcttgttttaatttacgattcaaaaaacattaaaagctacagtgttgaccggaaaaaaataaaattcagaagggttttaaagttttctcttggagaagacgttgcaattttttttatatttttggtaagtaacacgttgcaaactatttgacatttgtttctttccatatacgaaaaataaattttatttttttctttatgacatcaaaagatctaacgtttttttttttttttttttttttttgtagtcacacgagtgtaacatagtagaccggaaaaatccacatatttgatgacgtcagcataaattccttactaatacataaccaacttcgtctcttcatctctactaacaattagcaacaaaataaaagcacacgaattttcaaatctttctcttctctcgctctctcgaattcttctctctgttcctcgtagatcccctctgtttccgttttcgtcttttcgaattccgaagatctcaaatgggtgaggatgcaatctcaggttcgttttaaaatctttctttcttttgttcttgatctgtcgctgtcgaatgatctttataaagctggattcgagttgggtttttcgttttcatggaattaagtatctgtttttattgttttggcttaaagttttgttctttgatcatatatcatcttggggttttgttctatagatagatctctgtttgtttctgctgaagaacgaaatctgtacatgcgacaagtgtttgaatcgaggaactttgaagttgttagatttcgagttttgatttttcatctcttttggtaataggtaatctcaagaatctaacgatcgacacaagagattcagaaactcttgtggtatgtttcggtgaaatgttgattgattttgttcctacggtgggaggtgtttcattggctgaagcaccagctttcaagaaagctcctggaggagctcctgctaatgtagctgttggtgtctctagacttggtggctcctctgctttcattggaaaggtctgattttgatttaccattgatgatcaatctaagggctcttgttttgaatccaatcttagttttaagttttgtttatgaactcaggttggtgatgatgagtttggaagaatgttagctgatattctaaggctgaacaatgttgacaactctgggatgagattcgaccataatgcacggactgctttggcctttgttacgctaagaggtgatggagagagggagtttttgttcttcaggcatccgagtgctgatatgcttcttttggaatctgagcttgacaagaacctcatccaaaaggtagatttttttcatcttttgatccacatttggaatgagactaagtccaatggtttgattttgtttaattacaggccaagatctttcactacggatctatcagtttgattgaggaaccttgccgttctactcagcttgtagctatgaaaatcgctaaggctgcagggagtcttttatcttatgacccgaatttgagattgccgttgtggccatcagaagaagctgctaggaaagagataatgagtatctggaatttagctgatgttataaaggtataatcttttacgctagagtgaaagatcagatcattcttagtacttaaaaatgacacaagtcttgttgagtggttttcagattagcgaagacgagataacattcctgaccggtggtgatgatccttatgatgatgatgtggtgttgcaaaagctctttcatcccaatcttaagcttcttgttgtttcagaaggacctaatggctgtagatactacactcaggtttgcttgtcttttttctttctctaatcttctttaatatcaattctatatcagattgcttattcttgttgctatatgatcatgtaggagtttaaaggtagagttggtggagtaaaagtgaagccagttgatacaaccggtgcaggagatgcattcgtgagcgggttattgaacagcttagcttctgatcttactcttctcaaggtactttacttatctcttaagttttaccttctctggctttttgtaactaagactatgaatcaatgacattatgtgaaaatttgcaggatgagaagaaactaagagaggcgcttctatttgcaaacgcatgtggagccattacagtaacagagagaggagcgataccggcgatgccaagcatggatgctgttcaagatcttctttcttctactcgctcctaaaatgcttcaaaagtctcttttgagtgtatcaattcattaccttttacagtgtttttgtttttttaaatatttttccccaatttgtaggaactcaagaatgttgtgtgtgtttttttagtttgttgttgatctcccggagttttagtattggggtggtttggttttactattatcaagttaggttttctacaaagaacaaattcatgctttgtaaaaactacttgccgttttatgtaacgagaacgacacacactctttaacgcaaaaccattaattgtttagttaaaccggtttacggtttacgaggagtttcccacagattcctcatcgataattatgttgagctgaacgtgatgctcacgtgacaagtcaaacttgattgggattagtgaaattgtgaatagagctgggggtaaaaacgacaatttttataatgttaacggcgttaagaagggaacgttaagttcttcagtggaaacttaacgaacattaaacatttcgttatcaccgtcaaaatcaaaatccgggacgataattctcgcacacgttctccatcactttccctcgatccaaaaccagagtgggaactacacgcgaatcgaatcataaatggaatgtgaattttgaaatcgaggaagaagacgaaatcggagcattattggattgagttttgaagtttttaggagaaggaaatg

SEQ ID NO: 16320 - DNA, 3000 bp, Unknown; identical to SEQ ID NO: 3330
  misc_feature (1)..( 3000): 2750-1469P.txt file - cDNA_ID_1395335; gDNA_ID_1620640; Annot_ID_47469

SEQ ID NO: 16321 - DNA, 3000 bp, Unknown; identical to SEQ ID NO: 3330
  misc_feature (1)..( 3000): 2750-1469P.txt file - cDNA_ID_1395335; gDNA_ID_1620640; Annot_ID_163024

SEQ ID NO: 16322 - DNA, 3000 bp, Unknown; identical to SEQ ID NO: 3330
  misc_feature (1)..( 3000): 2750-1469P.txt file - cDNA_ID_1395335; gDNA_ID_2926178; Annot_ID_140425

SEQ ID NO: 16323 - DNA, 3000 bp, Unknown; identical to SEQ ID NO: 3330
  misc_feature (1)..( 3000): 2750-1469P.txt file - cDNA_ID_1395335; gDNA_ID_2926178; Annot_ID_199995

SEQ ID NO: 16324 - DNA, 3003 bp, Unknown
  misc_feature (1)..( 3003): 2750-1469P.txt file - cDNA_ID_1395753; gDNA_ID_1972144; Annot_ID_179330
gctgtaagtgtctctaatggatcattttttcttggtttcttttccattagtattgcaggcactaatgtctagctctgttgtcttaggttggagtgttccctaaattatccggggatgagtttgattctttcatggcccttgctgagaaattgcgtgctgactatgatttcgcacacactttggatgctaagtttcttcctcgtggagagtctgtggaaggacctgcagtgaggctgttcaagccttttgatgaattgtttgttgactccaaggtaaaggggaaccttttcattttgtacattacatcaatgagaagtcaagttttatgcaataatgtttcaaattatttatttgatttgcgaatcatggattcaggacttcaatggggaagctctagagaaatttgtcaaagaatcaagtatcccacttgtcaccgtctttgacagtgatccaaacaaccacccttatgttgccaaattctttgaaagccctgccactaaggtaattctcagtaaagttattttggatctcactgcagtgcaatacattaatggacgttttcagttatgccttgcatttttactggacaagtattttagatttctgaagatggtagtttagtaatttagtatgtgcttgaaggttaaaagcttttctttgccggtggtagtgttaactatgacaaaagctgtgatatcataaagtagtgattgaatttgggtaatagcatcatagttctctagataattgtaaaagcatttgttctgtttctgaaatttcaggcgatgatgttcgttaacttcactggagcaacagctgaagctctaaaatcaaagtaccgtgaagtagctacatccaacaaagatcaaagtcttgccttccttgttggtgatgcagagagcagccaaggcgctttccaggttactacacatttaagttttgtctcttattatcattttctcatgccaatgttaacacatctctaagaaatttttttcttttcatgtattggtttaacagtactttggactcgaagagagccaagttcccctcatcatcatccagaccccagataacaagaagtatttgaaagtcaacgttgaggttgaccagattgaatcatggttcaaggacttccaggtttcattctcttttgcacacattcacacaaggttttatgaaaaaagaagtacgtataaaatcaatataacctaaacaaacaacatgttttcttcaggacggaaaagttgctgtccacaaaaaatcccaacctattccagctgagaacaacgaacctgtgaaggttgttgttgccgagagccttgacgacatagttttcaagtctggaaagaatggtgagtacattatttgaaaactctaataatggtttcaatttttttgcgaacgcaagactgataaacatcaatttatctatcagtcttgattgagttctatgcaccatggtgtggacattgtcaaaaacttgctccaatcttggacgaagtggctttgtcattccagaacgacccaagtgtgatcatagcaaaattggtaagcctctcttttatgttctttacatgtcaaactataacttgatatactcctcctggattgacttaaccgtgtctgtgtctgtgcaggacgcaaccgcaaatgatatcccaagtgataccttcgatgtgaaaggattcccgaccatttacttcaggtcagcgagcggaaatgttgtagtgtacgaaggagacaggacaaaggaagacttcataaacttcgttgagaagaacagtgagaagaagccaacttctcatggagaagagtctaccaagagtgaggaacctaagaagaccgaggaaacggccgcaaaggacgagctgtagaaatctcatgagttttgtttcggaatttgagtaggagcgtttctcttcttcaccatatccaacagaatcttcttttttctttagcagttttacagttttatcttttttgctctcttgttcgaacccaaaattatccccattaataaaaagttaaacctaataatcatttaatctgttttatgatttgaccatagggttggttagtttggtacgtctatcatttttggtggactgttcggtaaatcgtcctgttgattttgttcgttcaccgatagagccaaactctcaaatctcaatctctgagatagaatcaacaatgtggtcaaatatataacaagtatataaatatgaaaagttcagtttatatacaatgtgattaataggaaaagttgcagtaagaatatgaaaattttagttgaatatctttaaaacgttacttttgaatttaatactgtgtgtgagtgtttctcccttaccaaaagatattcaactaaccttcgaggttaattaaatttgtataggtaaagggcaactttaatccgaatcatatgacaatgacatgacaaatgatgatcgcaatatacataccaacaaatgataaataatttgatatatatattcgaagatagaaagacgacaaatatctactacatattacaccaatgaactagctctgatggctccttaaagtgatagcctgattcatgtggtttcgtggacccaatggtcctgttaatatactacatgatttatttgtgtgtccaagcattgtgtatatcgtatttgacagaattaatagctttcgctgatgacatgtataattttttctaatcatcggaaaattttggattgaagtgtagacatatactgatcagtgcatgttaaaaatcatatattttgaatatgtaaagtgttcaccataatcaggcatatatagttgcaatcgtaaagaagtacttgaacccatcccaacaattcatgatatgtatctttcatttatttcacgaattcccaaggaaactaaaatagtatacgatacacttggcttcagattgtttccctatataatggcactaactctccatgttgaaaccacattaatttcttataaccaacaacaataatg

SEQ ID NO: 16325 - DNA, 3000 bp, Unknown; identical to SEQ ID NO: 6014
  misc_feature (1)..( 3000): 2750-1469P.txt file - cDNA_ID_1395806; gDNA_ID_1620836; Annot_ID_50810

SEQ ID NO: 16326 - DNA, 3000 bp, Unknown; identical to SEQ ID NO: 6014
  misc_feature (1)..( 3000): 2750-1469P.txt file - cDNA_ID_1395806; gDNA_ID_1620836; Annot_ID_169900

SEQ ID NO: 16327 - DNA, 3000 bp, Unknown; identical to SEQ ID NO: 12439
  misc_feature (1)..( 3000): 2750-1469P.txt file - cDNA_ID_1395836; gDNA_ID_2214551; Annot_ID_134681

SEQ ID NO: 16328 - DNA, 3000 bp, Unknown; identical to SEQ ID NO: 8945
  misc_feature (1)..( 3000): 2750-1469P.txt file - cDNA_ID_1395928; gDNA_ID_1971948; Annot_ID_58611

SEQ ID NO: 16329 - DNA, 3000 bp, Unknown; identical to SEQ ID NO: 8945
  misc_feature (1)..( 3000): 2750-1469P.txt file - cDNA_ID_1395928; gDNA_ID_1971948; Annot_ID_177318

SEQ ID NO: 16330 - DNA, 3003 bp, Unknown
  misc_feature (1)..( 3003): 2750-1469P.txt file - cDNA_ID_1396182; gDNA_ID_1620776; Annot_ID_50293
agagattctcagatttatcgaggtgaagaggatatatacattgaagtcctttgtgtttttcatggtttatatttgacattcattagtcagtttatctcaatttcttgtcatagttatttccttgggtttcattatactctcttctctgaatacagaatgctaagttttcacctgaaatgagtcgatagattgtgtagtctgaagtgagtcaatagtaactgatcacaatggacagaacataaggatttttaggatagttatctgacaattagttggtaacttctgaggttgtagatatatgtagtgagtattctaacacaaccatgatgactgcaaacactctgataccattggaatagcattactaactgctgttggaacctctttgttgcgccgcccaggttactgaaattcatacccaggaaacttgtggtttcatttttcctccttataacatttgactccaagcatgaatcctttttatcaccaatgctgctgcattacattctcttattactgtttctctattgtatcctggttcaagctttgaaaaatatcatttggataaactcttatatttacgttcaaccttaacatcaagaatatgaattacattgaatccagttggaagttaatctttgtggtttatcaattgcagggacaacatgaggttccacaaaactttaagaaactgttgagttatagcctgggaatccttgtttctcaagacaaactcaaaaaggtaactagtgttgtttttcttaatgcgcggtttgtcacaagcctatctacttttctccatacccccaatatctatatgacaagatgtagtaataataaacctgagttatattatatgataaactcaaaaattactttataaatgcaggtacgaaatcgttacaaaatctcagttacgaaagcaattaagccaacactcaccctgcgtccaaaagattccacgaagccaccagagttaccaagtacttctgtgatattaacatcaaaagaaacacatgagatagacccagcagcaaatagagaagcagaaggaatgaatgagttggcaaaagaaaacaacgtaatcttactccttttaattacatgttgctcatccaatttacagtatcatagcaacaaaagatatgatcccttgtggttgatcaatttcaagactggtacgaggagcaacaagactttaggatgtttttgagtgagtgcctgataattctcgtttctcaaggcaaactggaaaaggtatatttttcttaattgctcagctatttattgatgcatcatcatctatctataacaagatcatttgtaattcttatgattgattaaaatcagaaaatctcccaaattgcaggtattggatcgctacaagatatcagaattagaaaacaaagtgttggaagtagcaccagaagttgtagcaatgaaactagcagagtcagataacaaaaggttgatagcagcagaggcagtcgaagaagaagaacgaatgcacaagttagtagaagaaagccacacgatgcttcaattatgcttagagatccaccaacaatgtaatctcaacaaaactcacatggtacatcaatccatcatcatcaccatgatcatcactgtcttttgctttgtttcttgcaggtgctcttggccaagaggttgttctactgtaaaagaaaaccaagtatctatctagtttgcttcaatctatattttacttaactaaccacttgagttttgtttttgtagttcttaaacacaggtttatatggttgtaatggtgaactaatgttcactgttttgttcataaaaagatagctttttttttttttgctaaaaaacaatgacgtgtctatggagtcttgtgaatgctttgctacgtcataaagcatcaaaaggtgctggaaagaataagcttttccaaaagaaaatttggtctttttttctaattaaaaagtttggtattggcgtatggaagtacaacactactactcatatttccacttgaaaacaacattttgtgattgtgatttgatattttctggtgtgtgttagtatgcaattgcgattcattattcatagtctcttttgacattggtgtaaaataacttgattggtaacaatattttccctactagtttaggaaaagtataaagaggtgagaaaaatctcaaatcgaaaaggaagaggaaagtgggggtaaagttggaaatataaaaattttggaaaagtagaacaattagaaagaggaaaaccctaaaaaaaaaaagagggggactatataactggctaacacgtattgggttgagtctctctctacctcaatttatattatttgcttcaatcttctctttatcgctccaccagatccaagttcgcgagatttcaagctctctaacaaagttcttcacttttactctcaaagctttcatctttcattcaactacttaagctccaaggttcggaaatattttttttacttttctctgcgatttgttccttttcttatgaacgattggatctcgagtctgatttactctctttgcgatggaatttgttctgggtcgttttcaaaattgacgcttgttaatctataattcgtcatcggattcaattagtccgtgaaacccttcaattcgtttatctcaaatcgatttgggttaggttttgatttcgacacttatgttaaaatcatccaaagcttttatcttcgattttggacaactttgtgtatattatatgctttcatggagagatagatgtttttgaatggtatctgttatgataattggatgaaccatatttcctatatctctcctgacatcgaataattcagatattaatgcttgtgttcctctctatatggaacttcaagtttggctattctgttacattcttacttttgcacaactctctctggctataagatttaagaatcatctctagctatctgggttctaaactattgtttcttttgtgtattgttgtagtatg

SEQ ID NO: 16331 - DNA, 3003 bp, Unknown; identical to SEQ ID NO: 16330
  misc_feature (1)..( 3003): 2750-1469P.txt file - cDNA_ID_1396182; gDNA_ID_1620776; Annot_ID_167730

SEQ ID NO: 16332 - DNA, 3000 bp, Unknown; identical to SEQ ID NO: 15436
  misc_feature (1)..( 3000): 2750-1469P.txt file - cDNA_ID_1396277; gDNA_ID_2926134; Annot_ID_197082

SEQ ID NO: 16333 - DNA, 3000 bp, Unknown; identical to SEQ ID NO: 15436
  misc_feature (1)..( 3000): 2750-1469P.txt file - cDNA_ID_1396277; gDNA_ID_2926134; Annot_ID_138832

SEQ ID NO: 16334 - DNA, 3003 bp, Unknown
  misc_feature (1)..( 3003): 2750-1469P.txt file - cDNA_ID_1396277; gDNA_ID_1972121; Annot_ID_179001
cttcatctctgttatagttgctcgtagctcttcctctttggtctttgcatccaactctagaaataatgagaaatcaagtccatattcagtgtacacaaaacgatgtgagaaccaaacatgtaactagaaaactaaaattcacctttatcactgtatcttttctctgcagattgaagagaagaagaaagattttccttgtcttgaacatgagtttcatccacttgttggtaccatctaacacagaccttaagcttcttgataatatccgtcatttgctcaatcttaccctattagtaccacaatgcaaatacatattaaagtgatttttttcttagaatctcctataatcaaccaattggttattcggttcacaaaccttggtatcaaattttccagctttagctctctcgttaagcaaagccaacacttcatcttttgtaaactcaactttaccacactcctctgtgcttcccacatcgctgttcgcatcttgtctgttcactgtcgaaagcacttgtcttcttccagtaccttgcgtctccttccttcgcttgtcaaaaggaatacttgagagcgcttcctttttcttaaacatagttcaaaaaccaacaaaattaagtaaagccacagacttttatgaatcaatttctcaagagaacccacaagatcttctcaattgaacaaaaccctaaatcaaacaattaaactgaaaaatatcgttatgacttttacaatctccgcttctctcttagaagaaggaaaataaaagaaagaagaaggcttacgacgtttggactaggtaaaggagcgcgattctggttgcgaagtggcatcttcgatggattgcttcaccttaggctcgtcaataggatccaaatctcaatcccgagatcggcggcggatttcttaagaacccgggagaaatcagacctggttttttctgaatctgagatgggaaattagggttcttgcttttttcctaatgggggagattttaagaattgaggaaggaggaaggaagaaggaggagcctgttgtttgaatatttgaaaacagatcggcggactcttgtcaaaattgtaacgttactcttctcctcgattataatattaactttcaggcccatcagcattaaacaataatcttttttttccttagatacttactctcaggccaattgacttaactttcaggcccatcaacattgtaacgttactcttgtccattaatatttaaattattattatataaagtataggctccatttgagccaattgacttaaaactcggtccattaacactagtgatattccatattttgcgtgactttttgttggctaaataaattatgggaaagaaaaaaaagtaagatattaatcaaattggtttctattttatggttaaatctttttataaaattatttttcttttattttgtataaaatgaagggttttaaaagtttcaaattcttgtttttagtttgattcgcagttaatattcgattttgggataattttggagagttattacttactttaactaggattcaacccgtggtttacagcgggcctcggttttatatgttttttttttttttttgtcatcatcatcttattgatttataaatcagcagtgtagtcacaatgtaaagcatagcttattacattaggaacccaaaaatgattaaggaataaagattggttttggagaggagctttagcaagaatatcagctggaacattgtgatgtcttcttatccaattgaaatggattgattcaaacttccttgaccaccaatgaacgtctcgtatccagttgtgaacgccaaaatgtaccttggatccgttgattaggtcaaacagcatcttgttatctccttcaaagcaaacccgtttgtaaccatgactccaacagtgctgcattgaaatgattagcgcttgaatttcactctccagagcattgtccacctttcttcctatagcctgacccgccagtagataacttccattactatcccgaacaacccaacctgctttactttctacatctccattaacgaatgagccatcaaagttgcatttgatccatcctctttcaggtcgtcaatcttatatggtttttaattaagtatttgattatatttatattataaatttataaaatatttcttttattttaaatttttataaataatgattgagatttttattggttagttgttatttagtgattaaaataatgtgttttaatgtgtgtatgtaatttaaatataagtaaagtagtaacaaaaatgtaaaatagtaaaaacggtgtaattttttttgtgattataagtttttttattattattatttttgtgattataattctttttggaatgaaatatgctcatatttagataccaaaatgaagtagtgataccaatattgttgaacggttaagattgtctactttggatgctaaacatgattaggtatttgaattcgtgaataagtgactattattcctaacccacccgaaattaaaaatgtggatcatataaactttaatagattgaattgaccaaattattcttaatggctatgtacaaaatccaaaattgaaattgaggccaaaattatctatttttcaatttgtacttttttttaacaataagggatttcatttatttgtcaagttggattggatttaagttacaatttgcttagatattatcgaaaccggttttcaattaactttgactaggtttaaccgaattggtcaatttccacgtcattcagccacgtgacaatcgcattctgggaacactcgatctcaatcctatgtggcaaaactgagaatcaagaaaccacgtgtcaacatattagtagttaaaaccatatccgagtaatctaagtaacaacgtgaatcagataaggtattctttgtcacataaccaaacaccaaaaattataactcaacacttcactaatcaattattcaaagcagataaaaaaaaaatg

SEQ ID NO: 16335 - DNA, 3003 bp, Unknown; identical to SEQ ID NO: 16334
  misc_feature (1)..( 3003): 2750-1469P.txt file - cDNA_ID_1396277; gDNA_ID_1972068; Annot_ID_178464

SEQ ID NO: 16336 - DNA, 3000 bp, Unknown; identical to SEQ ID NO: 10119
  misc_feature (1)..( 3000): 2750-1469P.txt file - cDNA_ID_1396296; gDNA_ID_2213626; Annot_ID_195881

SEQ ID NO: 16337 - DNA, 3000 bp, Unknown; identical to SEQ ID NO: 10119
  misc_feature (1)..( 3000): 2750-1469P.txt file - cDNA_ID_1396296; gDNA_ID_2213626; Annot_ID_132065

SEQ ID NO: 16338 - DNA, 3003 bp, Unknown
  misc_feature (1)..( 3003): 2750-1469P.txt file - cDNA_ID_1396308; gDNA_ID_1620369; Annot_ID_154935
atgtactattgtagacatcatgaccacatgttttataagagctagatcactagtggccatgaaaagacgaatctttcgtgttataagaaagaaaaaaactctacgtatgaacatgttctataagccgattataaaaagatatatgtccatatataataatgcataccgtcacttgtgctttgatctcttcgtccgacagagtaggcttcccgtcagtgtctttagctattataaacatgtcaagaaaatcttgaggttctttcatcttcccatttcgccattgcatgagtctttcatcaacaaaagggtcgttatacttacttacatttctcattgcgttactcacaaccttctcatggccttccaagtccaagaaccttagccacgggacataatctgacaatgcaaaggcgtaaagatgggttaaaaccgtaaacaaagattccacatgttcaatctcttccaaccctggtcccgatccatcttcacttcctttaccaaaatgccttataccaaacatcatcttccgagctacatttccactgtattgccgtaccgcaagccttaaatcaataaccacaaaagcattaccacggtttttgacactacggttattgatgtaccggactaagttatcagcctcttcggttctcttttgtagcatcatttggaagctcttcttgctcgtcacgtgagatgccaccactctcctcatcttcttccactgctctccttgtggctccaccgcaacggtcaagtacccgcggctgcagtactccgtgcccatcgttagcggtctagtggcgaaaacggagtcttgcttcttcagaatctctcttgcaattctcggggatgtcacggggatcacgtgagtattcgcaagacggatacatgcaatatcggtgttgagttctttcatgagagaatgtatccaccggaacaccggtttgttcctccctagtatttccggtaggtttccgattaaaggccaagatttcggcccgggagggagagagaggtttctcgtagggctaattaacatggttttcttcttctccttacgcttcatagttaatgcaagaagaagcaaacctataataaacgcgagcattggggtggagtcaagcatttttttttttaaatctcaatttggagaaattatttgagttcgaaaaggttttttcttatctatgatgaggaataagctatttatagccatgaaacaaatgcttttgtttaagtgtaatctatggaaaataaatgtgctttaaatgttgaagaaaacaatgttaaatgaatccacgatttttcaacagctcatatgtaagacatgtttttttctttgattattccttatcccttataaatcttgtggatgttaaattggtaatgcatcattatgaaatccttgtcccttttaggtagcgccatcattagaaaaaccacgatttttcaacagctcatatgtctaatgtattacatgttgtgttttaagtacatttctatttaattaccaactttttacttttccaaattcgtctaaatctaatctctaaggataaatttgcttacgattccttaatccttatccctttaaaatcttgttgatgttaaattgttaatgctgtttatgaaatctttatccccttttaggtagcgccacgttaaaaacaatatggacatggagatttgggcttataaaaactgtaaatatttggcccacttaaaaattgattcagcttctgtaaatttaatcctagcagcttccattcggctcgacatgcgtagcaaaaggaatacccacgactatccatcaaccatgaaattaattaggaggcgaattaaaacataatcaaattacataaggactaattaagaaaagctagagattgtgattagagaatagagattataccatgacttgctgaagccaatttttggcactttgcacacattacccaatctctttcagttgtctcttcgatcctttgttcccacttggctcttagtttatgtgtcgaaagatgggcatagctttcaatagtcagtttcgatttgcagcagtaacacttacttaccagttcaaaaatgtgataatgatcgcaatagattgagatatgacttatgagtgatccccaaactcacggcttcgattagtcctcgcttcgatgccataagctgagcctctaaacccgtaatagcggagtcatgaattgatcctttcatgatttgggaggtcgagatagaagagaagacgaaaaagggtttttatacgttactgctttaaagacactctttatttctcttttttttttttttttttttttttgggtctttgtcatcatcagtttactttacgttactgatttcaagagccgttgtggagaaatgtggctgcttctaattttgtatctaatttatgtacgctttgtttcacatttgacatctgatctctttttactgtatcatagcaattctttcttctatctcttttaattattatacttctataccttcatttgttaggtagaatgagtggttgtggactgagtgcttgatccaaacacgtggcttcctggtgggtcgctaacaaacaattgagatcacaagctttggtagcaaaaaaattgaattcataaaaagaatacgtcgtcttttagatcacaagctttgaacgttagcaaaattatgttacctaccaccagtccctggcttattatatagagagagatattcacatttacaatttcgatattgtttctctaagatcgtaaaatagtacaccaagccatttataaatttcttcactctcagattcaaaataatataaattagaaagtaagtcttacactctttgcattcttttttattacaagtttatccactaaagtaagattttcagttctaacaagtttcaattattctcattgtctttttttcaatgctttgtttttttcctaagatttgtgtgttcttgtttatcaaacagtgggaacagagatg

SEQ ID NO: 16339 - DNA, 3000 bp, Unknown; identical to SEQ ID NO: 7308
  misc_feature (1)..( 3000): 2750-1469P.txt file - cDNA_ID_1396358; gDNA_ID_1621139; Annot_ID_172762

SEQ ID NO: 16340 - DNA, 3003 bp, Unknown
  misc_feature (1)..( 3003): 2750-1469P.txt file - cDNA_ID_1396358; gDNA_ID_2926161; Annot_ID_139704
ttaaacgacataactagattttataatgacaacataatttaccaaaataacattattaagtaggatcgtaaacttgagttttataaaccaactgcaccttgagttttattaaccgactcaaccagttgaataatgtttggttaatgacataaaaacctgtctcagcaatgtgtttgtcggacgagtgatatatacaagattatttggggtaattagtatatatcatattatgtaaattgtaattaaaacactaaggacatctccattggttaagatactctgagtatcttagcaataaaataacaaatacttttaatagatttcagttatcaaatttttttgtagatatctttttttccaattttcccttaaattaatatttatttgaaaatcatcaatacaattaaactaaaacccatgtctctcaaacctgacacatcaatattttcgttcaactagaagacataaaaatgtcggaattgtaagatgtaatgaagccaaatttagtttgaaacatcgctacgtaatgttttatctcgctagagagaagaaatttcaatttattggtcatatttttaataattaaaaaataaatcatacataaataaataagttaacgttttaactaattaatatgactaatggttaaaatataattatataaaaaaagacaatggtaaaatttcataacaattcatagtctccaacataagtattaacgaaaaatgccactcaaaacaacttcgtatcaactctacaagaaaaaaactaatcctcttgtttcttttaaaagaagaataagttatagattatgactttacactaaataagattagtactttgattattagaaactcaaacacaatttcatcaaaatactctgcagcataacacggatctttatctaatatatatgaaaattggttaatcctctccatatgaatgtcgtcagcattctcgaaactgtcatgtgtcatcgccatgtcatgaaattttaaacatgcatgacacataatatatagatttgcaaatcataaacatataaaatcttttcctctgctaagaaaataaaaataaattcatcagccaatcaaaaataaaaataaaatcttttcctttcatgagtttttagagcatctctaatgaaatatctaatcaaaatagtttctctaaaataatgataaaatattaaaatgttggagatagaaggtgagagaggttcttaaagttcttatttttgagaacccatgaattctttattagacacactcatgataatgccaaccttgaatgattatagtttttgtttacatatttaatttaaatagataattgaattatattaaaatattaatatttgttagcttaaaattccaaattaagagtcttacccagggccggtccaaccaaatattaatacttgacaaaattttcaaatttatctctatttttaagtttattaattgatgatattaaataaaacaatacattaattagaggtaaaaaaatattgaatattttcttaatatttatgaaaaaattttaaccgacaactaatataaaatagaaataatattatttttatattatggttttagtggaattagctagttaagatacccacaataaaaaaaactcgaattataaataatatgttattgtataaaacatttatgcatagtcctgttttatcaaaaggcttttaccctttcgaaaatatttagtttttttttttgaatcatttgagttaaatgtttgagtcttttttttttttgagttaataacccatgcttatatgtttatatctttgcaaatctgaaccccccaccccacccccaaacaaaaaaaggtttgcacatcatgtcagaggtgtagtggaaattactaaaaagggtaaaagcataacttttttaacagttcccaaaatggataaaatgcttaagatgagatgtcacctagattccctacatcagctacttctgtatatttagtgaattttaatattttttcaaataaattttatttttaaaaaatctcagttaaaaaaaaaatgctcttatgctcttcgataactagagtttgaagaaaaaatgaatttagataaaatacgatcagatacttagaaataaacaagttttgttttgatttttataaaatagaattatttaaaatttcatctacatttgagtcaatcctgttaaaaaccaaagttttcaactttaaagcgtttttttttgtgtggcagtgttcaactttaaggcgattagaattactaatatgaaaacaatcaaattgatgacctcgccaactagagtgcattacataccacttaccactatggtaacaaaaattcaatgttatcactcttttgattaaattgtatgtattcttattcgattttgtctatgttgttttttgatagctagaaagtaaagtttattcatttcatttataaactgtagataacagaataagaataattaaacgtgagggatagcaaagttagaactcaacttaccattatagtttgttctgttcgtataaaaatagaatgtatacttgtttcatctttcttgaagatgtatagtttcactttagtaaagaattaacgcactgcatgaagcatatgaactagcggttaccagaagagataaatattcttttaaaaaaaatggtcatcatctacgtcaatgtcatgatctgtctaattcatcgagaaacttgtggcaatcaaaagagaaacagaagaagctttagttttataaattcgtactttattctaaaattaaataaaatttaaaaaatatatatatatgactagtgaacaaagtctctatatatacaagtttcttctgccttcaatcattcatatacacaaaccccttagagaaacaaaaagaatacaaaaagaagagagagattagttattaacttattcataataagtgtaattacttcgtatttacttttttttggttagcagtcgactagtaatcaataatg

SEQ ID NO: 16341 - DNA, 3003 bp, Unknown; identical to SEQ ID NO: 16340
  misc_feature (1)..( 3003): 2750-1469P.txt file - cDNA_ID_1396358; gDNA_ID_2926161; Annot_ID_198751

SEQ ID NO: 16342 - DNA, 3003 bp, Unknown
  misc_feature (1)..( 3003): 2750-1469P.txt file - cDNA_ID_1396391; gDNA_ID_2214506; Annot_ID_133762
tgcgaataaaaacccacccaaaagatctctcccttcttgaagaaacgaaatcgaaagcaataaccaacccagtagaaatccattatactgaaaatgaatgtgatctacgatcaatagccccggagaccaaatcaccaatgcgcagatcagatttcgtttcaacggttctaattttcgagtcaatcgataaacaccgtagagaagacatagatctgagacgattacgctgattcgttggaagtaaattacagattcggcattgtaatcgagtcctgattgaagatctacgatcctgggatcgacgagacgcgcgaaaattgagaggaagcgttcgaagtaggcgaagaaaggaggatagtcgagtgtccattggctagtctcgtcgaagtaccatttggtaagaggaagagagtttgtgatagcgagccagttacggtggacctcgaaatcggtgcttctggacgacggaatgagaaggagttttacggcggtggctacggcgaagaaccatagcagtagtcgccggtcactcttttcccggtgatccatctcggcaccgatagactgggaacattagcgaccgttgatttacaaaacccattgatatgggcctaatttgggacacgaaccggcccacttagtaactacagaagtttacgtggagttgtagatatggcagtacataattggttaaaaatatatgacatggcattacgtggaactgttcaaattggtttttatatcggattaaaccggtttagctatgaatatttcgttgtgtgtataagtcgtacctacctattacaaccgcccaaaaggaaagtagctattggctatagcgtagagctagaccattcgaattaatcagcggttgagatcattcttcagtaactaaggccacgtgtcatacacgacgaccctaaaagatcaaatagtaaccgtagactcaaaacaacagattttaattcccatgcaaaccttaagacctttacctaacagccacgtagcacgaactcggatcttagctggcgcacgagcgaggatcaccgcacgtgtcaactgcaggtgagtttaaaaaaaaaagaaaaaagtagggcaaacggggtacaagggcagctgtcgtgggcccgggagacaaggacgttgataattgggcctttcaaaagagaggtgattgtgggtcccattaactcattaatctgagtcagctcgacgccttgttgtatcgacagatgacaagttgtgtggtcctaaccaattatgtaaaacctcctttctttttttggaactttattataattgatcacgaaaacaccttttatttttgtatgtattaatacactttaaatatatacatttttaatgttttattattggtttgccgttcgtaatgtgagtcattgcttactcagattcattgagttttcttgacgtgatcttatttaatttaataaatcatgatagtgttttcttacctttgatttaaaaagtcaaaagtctcatgttggaggattataatatgaatcaagagcataaaaatgtgatatttctagtcggtatctgatatttataatagtatacagaatttcacctatgtgacacgttatgtggttttagtattaaaactataattgaactcggactaagaacttaatactactatagtaaatgaataaaataggtcggtcaccctcttattcgttttattacaagtattagcgtatggagtatgtatgtacacattactagtagtagtaaatgtgtaaacgtattcgaattacatgttctagaacctttttaaaaaaaaactttatgactatttagatcgtatttttaaatattattgtttgaacaaagattttgccaaagactcttttacacattttcaactagaggattcttagctatagtattcatatcgatataaaatatagaatagaatagtactatttcgaaagagatttaaattcatccaatgtctttggaatattttttacttggacatgtacatgtgtaccaaaatgtttttgtctcactataaacacgaataaattaattcactctactatagtaacaataaaaaaaagacgttactgtcgatatgtccattgaagaagttaatgaaatacaaataagtacaagcaaagcattaaacaaaacgagaggcgattataaattacacacatgcaatgaaacattgtccaggcgaaatgaatcctaaggaaaagcagagaaagtacacacgagaacagattaataaaatagaaattattttagtagtaatattcatataaaaaattagaaactttctcttttttgtttttttgttaacgaaaatttagaaactttcatttaatgttaattgaatatttgggaaaagtccaccatcatgcgctatgcatgttattgtggccaacgaatcttacaaaacgcaagacttgtttgattctctcgtcgaacgagatccacccaaattattgtattcccaaaataatactaatatatgttctttattgctcttacaaaagaaataaaataattttaaaatttactcgacattcgtaatgtaattgcaaaaataaaaacaaagaaaatagtactcgtaacggacaaagagtttgattcattgcactttaactttatcgatgaggtaaaataatcagaaaaaaaaaaagaatttaccacaacacaaaaagacaataataaaatataataaaagtaatgaattattgaactttaacgtatagatctttcgagatgaagattcggtcacgatgaacggtgaggatgtattgtagagtactgtaactaaagtggtacgtgacacaggtgatcagctcaagtcaagcagaaagtcctaaagccggctttataaatgaacaccaaatcaacctccttcttcctcctcctcctctcgcttcttcttcttcctctcgaatctgcttttcgcagtctatttcgtcatcgtaaattcggaagctttcgtatttaattaagcaaatg

SEQ ID NO: 16343 - DNA, 3003 bp, Unknown; identical to SEQ ID NO: 16342
  misc_feature (1)..( 3003): 2750-1469P.txt file - cDNA_ID_1396391; gDNA_ID_2214506; Annot_ID_184126

SEQ ID NO: 16344 - DNA, 3000 bp, Unknown; identical to SEQ ID NO: 15167
  misc_feature (1)..( 3000): 2750-1469P.txt file - cDNA_ID_1396414; gDNA_ID_2926078; Annot_ID_196272

SEQ ID NO: 16345 - DNA, 3003 bp, Unknown
  misc_feature (1)..( 3003): 2750-1469P.txt file - cDNA_ID_1396500; gDNA_ID_1620555; Annot_ID_160417
gtttaccgatcattaaaggaatataaagcgattatacaaggaggatccaggaacaatcaaagatctgaattaggtatgtgatatagattgactagtttttttactcctattttctatctgagtgtacaatttgtaaaattgaaagtgaaatggatatgtttctaagtttcttatttctcttcttctgttgcttttttctgctctgaagcagagacaccaactaatggcgagaatctaaaatctccacttatctatttaatggattgcacgttgaatgattgcagcttgatcctaaaatcaataaatcaggtacctttgatgatagcttgtctggttcgttttatttattttagtatttgcatatcacagttttgctattgagtagttagagcttatgattgtacacaccgtattctcatttctgaatccagtattcacttgctctatgaatctgtaacattgcagagggaagtgtatccttctctgatattatttccagccgagagaaacaaagtcactccatatgaaggggagtcatctgtaactgacataacagagtttctagctcgccatgcgaataactctcgcgagtttttcagtaagtctttcagttgtttacacatttatgctgaatattatctctaaagtgtctgaccttccagaaaaatactgttttctgcagaatcttaatatgttttacaacttgtgactcaattttttcgtagtaactcgtttttttcctgcctaagctggttactgaggaatgcttttggatttttattattctgttttgatctggagcataataaacaaagttatgaatctttctctggcaggactccttcctactctgtctagaaatggaagaagaaactcaaacaaggtggatcagtcttcttcatctgcggtaaataataaagtgacagatggtgataaacttgttgaggtcgttttaaggaacagagagcccgctgaaagagaggtaaaccacgaccaggtcaattcccaatcgcctccaatacactcgctcacaaacgctccccaagtgaaaactggcacagtcctggtcgctacagaaaagctagctgcctccctaacatttgccaaatcaaagattctgatcataaaagcaggccccgagatcggtttcctgggcctaatctttaacaaacggataaggtggaaatcattccctgacctcggtgaaacagccgagctcttgaaagagactcctctatcgttcggaggtcctgtagtggatccaggaataccactattagctctgacccgagagcgagactcttccacaaaccatgatcacccggaaatctcaccaggcgtgtatttcctagatcatcaatctgtggcccgtcgaatccaagagttgaaatctagagagctaaatccaagtgagtactggtttttcttgggatactcaagctggagttatgagcagttgtttgatgagatcggtcttggagtgtgggatgttgataacagtgacattgactttgcttggccttagaagctcttgcgttgcatctcttgcaatgtttttcttttacgttttgttttagaaagaagaagaaaaagagtagaagatagtaaaacccatcatgtgggtagaagaaatgtttaaactgtaagaataacacttgaaaatgtcttctaaacaaatacaacacagaattagatatcttcttttgagatcattcctcttgcagattacttcaataggaaaacattttaataagcaaaagcaaaggtcagaatcataacaaaagtcattcatctctctttttgccagtcttgttctctaagtagcaaatcttatcctcaggatcagaaaatgccaagaaggcctctctatgagtaacatcagcctgaaaatgagtcaacgatgcacggtataaaggcgaccacatcctaacaccaggtagatcatggagtgccttcattgaatcaaacacaatactagtcttgttggaatctgagggttgcttattgctggttcgtagagcgctaagtgaagggattctagcagcaagaatatcatcgagtccgtctgttaaatcatcatacatctcatcataccactcattaatcatttcagacattagagaatccacaaggttttcttcatcgcttgattcttccgatccgctcgcatcagacatatcatcatcatgctcttcagactctatagaatccaaactgttttccccaacgcttgatcctttcgatccgcttgcatgatcattgtcagcttcctcttgagaaataaccatattgagtgagaatctaccaatttaacaattcaatgttacaacagcatacatatctctaacataacatggaaaatcaaaggggattattcagaaaaaacaaaatctgggactagaattccataatgaaaatctcaaaagccgattacctgatttttttcgggaatggttgtcaattcatcctcttgttgttgaaatctgaaacgaggaattgggaagatgttaaactatttgagcagaaactgattgtgttgtatagcaatcaacgctaaaagagtagatgagtgactagaatggaatctaatgttcgttcgaattactaataaggactcaaaattcaaatcaaaactcagagaagcaaaatgtggaaaaggagacgaagaagaagatatatcagattaccttttcagagaagcgatggagagaagcttttctgggtccgagggttttaagaattgcgcaggtctctttttgtgggttcccagataaaggtaagggtattttggtcataatctcagcttacatacttgtttgacttttttagtatgacttacgacttttgtttctttttttgtaaatttactaataatataagtatgagaagaagacacgtgaagcgccaaaagacttgtggggagtgtataccggataaggtttgcatggtctctaagacctcaggttcttcctcacagtcctttctaaagaatcatcatccatg

SEQ ID NO: 16346 - DNA, 3003 bp, Unknown
  misc_feature (1)..( 3003): 2750-1469P.txt file - cDNA_ID_1396596; gDNA_ID_2213635; Annot_ID_132143
ctagatttacccccaattttctccaaacccgaattttacaacctaaaatttatgaaattgaaatccaatgagtgggatagatttgttcgctacgactaaattaatttccaaagatggacaaagaccaaagaaaaatacttgggttctatattcactgttttagcccattaaaatttaaaacctaataataataataaaagtttaatttaattataaaatctaatttgcctcaaaaacaaaattatatatcgatttgagtttatttgaaaaaatcatggtttagattttacaattaaacaaggttaaatattgatttgggtttagaaaatacgattagggtttagattttatgattaaacgagattaaatatcggttttggtttagaaagtacgattaaggtttagattttatgattaaacgggttaaatattggtttagatttattaacaggtttagatttaacaattaaacaaggttaaatgtcggtttgggtttagaaaatacgattagggtttagtttttttacgactaaatgagtttaaatggcggtttggatttacaaagaagaattagggtttagattttgtaattaaacgaaattatatatcggtttggattataattatagcttcaatttattatgtaatttaaataggatttgacatgacatatttttattagttaatgcaaaaggaggtgaacaaagaggttcatccccctaggaatgaacgcaagtctcgttcaagaccaaatatggactcgtatttttattttattttattttccaaagggaaacaaaaagtctttaatactcttttttctatatacacatatattcacctatttataataaaaaagattgaaacttacggaaaatataatacagtacaaactatatatgtcaactaaactaaataacacttaattaaatgatgtatatagattgcataaccaagtatataatattatatagttaacattataaatataaaatttcatgttaaataaccaattaactctaacgtcaaccggtgttaaccaacaaaaatattcaaaaataaatttttactttatttttaatattaaaaatctagttttactagttattctataatcaaaaaacaatttttacatctactataaaaatattttgcatatatatttaatacattgattcttaaaatatttagctttttttaatttcaaaactaaactaaaaatgaaaaaaatgattaaaatttttaaaacaaaaaaaaaactgaaattaaaaccagaaaaatcttattagaaacatatgagtgaaagaatcttttttttgtattatcaattaaaatatataaacttctttattcattagaaaataaatcattacagaaccaaatacacatgactatataagtttcataagaaagtaatatgaaaaacaattgagtatataactttttagtctaaattttgcacggtaatttttaaattcaaagtaaatgttttttacgaataatataagaaaaaactaactattgattaaaaatatttagcaattaaaaatttaacttcttaagaaactaactattattattattattatgaatagttcatatcttaaaaaaatatttattctcttagtttagttttgaaattgaaaaaataaagtaaatattatatgaattaatgcattatatatatatacaaaatatatttatattggatataaatatatttttttgtattttacaatatcaaataacattaatttttttaatactaataattagttttgaatattttgttggtcaatgctgatcaacgctggagttggtcgaccatttaacccgagattatatgtttatgatgttgacgacttgtataatcatacaatccatatatgttaagtagttgtatgttttttagtttacttgcatttgtggccaattgttgagttagctgacaatatttttttgaaatatatgtatgatgtcaaaaatattttattttttacaaattttcattgtaatattcaaattaggtagagacagataatataataatatagatatttagaaaattatgattttcaatggaaatgaaagtacagactcatatttatgacatttgtttaaaataagttggtatgtaaatacttttgctggcaattaatatctaaatttgtcagtaattacttttgtccagaccacaataaatattcgtctctatccaatccttgctcttcgtgtttatcacgcgctatgttaatttatgacgacacacagttcacttcgttatagcaacgccggcacgcttttcgttgttggaaaacggcaaacaatctgaaaattaataaaataaaaaaacgagaaaggcttttggaaattaataaagttcatcgaaatacaaatatctcttcatcttttctcttttgctcatttcccagaaacctttgtttcatttgcttcgtgtgcgatcgcgagaacaagggaaaattagggtttatatcctcaagctttttcgaacaccattgatcgttgatctaagatttttcttctagtcgagtttcttaaggtctggcttcatatctctctgtgcatggtgtcgttaaatctatgcagcgatgtcctgttcgatttcattttgcttctagggtttaatgatttgtgcatttgttcgttttagggaacgattcttctcagctttgtgttacttcatcgtgattttgttttgttactacgagtcgtttctatttcttagattattcgattagctgaggttttttgaagattcttctacagataactacttctctcgaatcgatttgcatttgttcttcatttttagtatttggatttgttgactctttctctcatttcttacatgcatagctgcaacttatttatggaaaacgaacttgttcgaactgatatttattacgatatccaggggctttgatcaaactcaaaattgaagaccaatactttgaaggattctggtaaagctaagcaactatg

SEQ ID NO: 16347 - DNA, 3003 bp, Unknown; identical to SEQ ID NO: 16346
  misc_feature (1)..( 3003): 2750-1469P.txt file - cDNA_ID_1396596; gDNA_ID_2213635; Annot_ID_181012

SEQ ID NO: 16348 - DNA, 3000 bp, Unknown
  misc_feature (1)..( 3000): 2750-1469P.txt file - cDNA_ID_1396767; gDNA_ID_1620301; Annot_ID_152634
aggaaaaaccggttcaactttccatagtcaatagaatccgaaccgccaattgattttgattgttgaccgggtttagtagaccgaatttagaataggtgaaccgtggccagaattttggcggccgatacacttctttacctcagcctcacattactactctcacaaaagatacacagagagagaagagaagaggaagaaaatgggatctataacggtagctccgggaaccaccgtcttattctccagtcggcggctagatctttgcggtcgtcgccatgagaatctatccgtcgtttcgtcctcacaaccgtctctgatgccaaagcagagatggctttatattcccgagacgaggttgaaaagagaggttttaaagctcgatgtcgtcggaagagctgctgattccacgagctcttctccatcagtagcttccggtgatagaaccttaattcctgatgatgaattcactttagccaaggttttaaatccctaattaaagagtttcttcaaattcattgtgtttatataattaactattcctgaatcagtcattgccttgtccaattttgtgaactgtgtgagatttatggtaaaagtatagtgtctctccaagtaggtagattcgattattagtggtctgaaattgagaattaggaaggatttgatgtatgcaactcatagtttataggtggtattgaatgtgcgttggaataattttggacactgaaattttttccatatgttttgcattgcagatttcatttggtgttattgggctaggtctcggggtttcgctactctcgtgagttttctcttgccttctttgttgctatgggtatatgtgaggtttagcattatggatctgtttaacaggtatggttttggggcctattttactatccttcctggaactgagtggtctgctataatgctaacatatggatttcccctttctattatcggaatggctcttaaggtatgctctttatgctctttagttatctttctcactatcatgtccttgagaaagtggaatgtttcggataactgtaaaattactgagaaaattgacttttgtattagagttactcatttctttctttgagttttcggaatggttaattgttttagtccctgaggatgggttttgcttcctttgcagtacgcagaactcaaaccagttccttgcttgagctattcggatgcggtgaagcttagagaaagctgtgctactcctattttaacgcaggtacgtagtggttctggttactctcgactgaccggagtaccttcaatctgattttagttgttcttcagctcgtctttgttacattaatttcctaaaacatatttatgtttctgataagaggaaggggtgttagtagttttcgtcattagtatttcgaaattcaatctaaacactagcttgatttcagtatcataggttcttttgcagaaagtcttgctcagtttagtttccctatatgacatcacatcgtagttttgtcagtgcacataggattttaaatttacttctcgtgaattgttaatgtgccttcttctttcttttattaggttagaaatgatgtcacgagataccgttatggagatgaacaacatttggaagaagcactaaaacgaatctttcaatatgggctggtaagctattttgttgaaacaaaatgaagcacgaaaacaaaatgaagcacaacacacgcttcttgtacttccgctttaacctctctttctttcgactgttttggtcataagggaggaggaatcccgagacgtagtgcacctatcttacagctgataagggaagaggtacatttcttcacgcgcatgactttacatcatattatttacatgaatcatcaaaatatataactcaatttttacttgcatatgacatggatattgactggtgaaactaaacttaaacggatcatttttgataactcatcatgtctgtaggtcctgaccgatggtcggtactgtgtggtccttgtatttgaggccaaagctctgacgttgtcagattttgaaaaaagacaggtaagagttagattcatatactactaacaaatcagcttggcgcataagaaaatagcttaagtagcgttggttttatcaaatctagtttttaagaagtagcaaaacataaagctggaactaagcataaaaattttgttttgataggcgaaattcacttccttctttggaccaaacatcacggcagaagtcggtaagtagtgaatcaattctccattcatgtttatgaatttcttgttctcggttcttaaaaaattattattgttgttttgctttgaaggtaaaggagaaagtgagaatctctatgaagtaagactgatttccaacctctccaccaactctgtatcttctacctcttgaacatagacaatcatgtatacggcgacgttttcagtcaatgttattttggtcttgtaaatcaattctatataattatcctatgtataaaaagttcatactatttacagaaatgggaattggaactagccttgtcgaatggtaatacggtcggaaggggacaagctacgattgcaacgtgttctagagtaattttgatttgagtaaacaaaatacatatactgtatattattcatatcttggtgaacaatacaaaatatattagtttgttttaaattaccaaactaaagccttaaaaaaagtatcaaattaagcacataagttagaaaagaaaaatgtgttgtaagaaagaaaaaaggttaggaaagaaatatgcgacagaaaaaagagttttatgggcttacaaataagaaaagcccaaatgggccttgagtttgagctttacataaaattcattctactaaacttaagcaaaatcattccttcttctttctctgaaacttttgccttgcttgcttgcccagaaagtcgccgagaaagttaaaagtagaacggcggaggaaaaaaaaacgaagaggaagaggagagatg

SEQ ID NO: 16349 - DNA, 3003 bp, Unknown
  misc_feature (1)..( 3003): 2750-1469P.txt file - cDNA_ID_1396989; gDNA_ID_1971948; Annot_ID_58616
atacatgtttatgtacattattcattaccattgaccaatataaaatcgttacagacgaatatttctaattaattatttataatttattcatctttattattttcgttataggttttgttaagttttttcgtcttacttcacacccacttataccatcgccttgtccatgaaacaatttatgagacctttagtagtttagggcaaaggcaaaccgcgtgagcatattaaattatagtaaccatgtcaacgtgaaatctatttttctttttataaaaggtcaccaaattatagagagatgttcaaatccactactttgtaccttagaaatgtgcaatcatattgcagggatgttcattgttcaatcccatcaacttgtggctatatcctcgtcttgtcttttcaccgtggtcgtattatagaattttgaaactaaagatatagatagaatagcactccttttcttatgtagtcattgtttgttttttatatcgattaatctttcattttcccaaaatgtactataactaaagaaagataacttgtttacattaccaacaataggaatgagactatttgtaactaacatgttaggtctttatctgagaaaattctgactttgacctctttagttctaccggttgctaaaagaaaattaattgacctacatagtttttgttttagaaacaaaaaattcttttaacctttagcaaaacaaaattccattgtgttgttgttaatggagtgatcagtgattcattaaaagatcggaacaaaagttctagtacaacaagagggcccaaaaagcccaagattagaatttaaagcccaacagttttaaaaataaaagataaaaaatttcggattgtccccgaagttattccttttgctgctcttgacttgaaagttataaaccctcacgattcatccttaaaccctaagcctaaagcagaaacgcagaagccctgataatggcggatccgatgaaccatagcaccgggcatcaacaacagcagaagtaccgtcagtacaatccttaccaacaagtcaatcttccgtaccgtaagctctacgaactcccaacttctcctgagtttctcttcgaagaagaagctacgaaaaaacgcttaacatggggagagaacctcaccttcttcaccggttggggttattgcactggatctgttctcggagccttcaagggtacaattgcggggatgcgagccgccgaacgaggcgaatccctaaagatccgaactaatcggattttgaactccggtggactcgttgcaagacgcggcgggaattgcttaggatccgtagggttgatgtttgctgctatggagagcggtgttacgtatatgagagacggagacgacggttcgttgacaactgtgatcgctggtttagccactggtgtgctttacagagctgcttctggacctagatccgctgtggttgccggagctgtcggaggagttgcggctttggctgcagttgctggaagacgcatcgtcaagcgattcgttccaatctaatgaaagtttctcaatctctcaaggttagggtttaagaactagtttaaaggaggggcttttagatagtgaatcattggtactggatttagggcttatgaattcaatttccactgtataaaagttgacatttttattgatctaattgctcaatccgactcaactttttgctgattttgtcgaattcacgaaattgaaatgatctcacataaaaactcaattgataattttacaaaggagaaaaatttgtcaatcaaagaagaagagaaagattgaacttttaacctcacttggtcataacttcaacgccattctttccagcgataatgacagaagtagccattccgagaaacagaccatgctccaccactccttgaaacttcccaatctctttagccgcagcgaatccatccttcaaaggagtcttaaaatacaaatcaataatgtaattactgttatcagtcacataaggcttgccatcaccatcaactctaagctttgattcacatccaaattccttgaagaggtcttgcaatctaatcaaattaaagttccagcagaattgaacaacttccaccggcatagctaatccacttccaccgagtcctgtaacgagtttggtatcatcagccacaacaataaacttgtcagccacagcttccaccattttctcacggagaagagcacctccacgacctttgactaaatcaagattcggatctacctcgtctgctccgtcaatagcgagatcgattctcggatgtgtatctaacccaacaagaggaatccctaacgaccgtgcttgttcctccgttcgtttcgacgttgggataccgacaatatcgtagagttcaccggaagagagtagtttcccgatctgatcaacagcgaaagctgcggtggatccggttccgagccctagaaccatcccaggtttaattgcctccacagctttctccgccgcgagcttcttcaaatcgtcctgtgaaagcgcgacggattgagccttgacggagaatgaaacggaggttcgaggagaagagccagtgctgcgtagggcaatagaaggagtgcgtagcgtaaggtgagaagaggaaacgaaggataaggaagccattggagagagaggattgagaatggttggagaagaaataaaatgaaatcgaaaggtttggtttttgacttttgagtggaagaggaaggtttagtggcaagttatagagttttgtagttggtttgagggtagtattggaatactagttttaaggttgttgtatttgggttggtgaagataataacctgctaaaccaatcagagtgttaaatatacgatgtcgtttttgtttctttgagaacagagttatataaaaaccttttttggtttggtttcgtggagagtctaattattttcttccactttctcgatctttgagatttctttcaaaggaagaaaaaaaaaaaaactcgcgatg

SEQ ID NO: 16350 - DNA, 3000 bp, Unknown; identical to SEQ ID NO: 9372
  misc_feature (1)..( 3000): 2750-1469P.txt file - cDNA_ID_1396989; gDNA_ID_1972105; Annot_ID_178720

SEQ ID NO: 16351 - DNA, 3003 bp, Unknown; identical to SEQ ID NO: 16349
  misc_feature (1)..( 3003): 2750-1469P.txt file - cDNA_ID_1396989; gDNA_ID_1971948; Annot_ID_177324

SEQ ID NO: 16352 - DNA, 3000 bp, Unknown; identical to SEQ ID NO: 14757
  misc_feature (1)..( 3000): 2750-1469P.txt file - cDNA_ID_1397255; gDNA_ID_2684224; Annot_ID_191880

SEQ ID NO: 16353 - DNA, 3003 bp, Unknown
  misc_feature (1)..( 3003): 2750-1469P.txt file - cDNA_ID_1397500; gDNA_ID_2214625; Annot_ID_135945
gcatgtgtaggtcagccatgaaatgcaagccatacatcaatttgaacaggaagaaccacggtggtacccacattgttttcagagaggtcaagggatgaaaggttggaagaagaatcaagaagtgtagagaaaaccatcctcgcaaaatatctatcgaggttgctatcgccaaaatgtaaggaatgtaaggtcctgaaagaaaaaagatgctcactaaaagtaaaatgaagaaagaagtacataataataatattacaacatttatgaagagactttgatagccaaatgagcaaacatttaacaagacacgttttggcatcagtccatatatatacctcaccgacatcaggaatgaaacgaaagcggaaggcgcagcaagtggatctatctcaatgctagatgtctttatacagaaacgttgcatcccagttgtgtggatacccttttcatgaagagaagtgcatattgcactgatggaactcaaagaaagcttgcagtgaataagttcaagcgaagttaatgtttctcggctctgaatcaagagcttgcacaagggctcaacctggagttcatggaacatcagcaataaaattccagctaactaaatctaggagactaaatagagaaagcgtcttacatgcttctcggatctgatccaacgtagaaccaaacttcgcaatttacttgtcctcaataactcctacagtaacaaagcctaaagattatttctgtcctccctctagaggttgaatgattgattcatcaacaaagatacaaatttgaagttctaagagagagataaacatcgaaagcaatacaacatatcacggcgatcagtggatactgaaacaaaaataaaacaaagatgactctatttacaaacacagaaacacatcaaaacgtcagagcatagtttaattacttacagaagtttctgtaacgcatagcacattcagaagcctcagacacctgcaacaggtaagaatgaacgcaaagaagcataagtatgttagagcattaaatcagtccaaaccagatatctcacgcacaaccagttatgagcgatataaaagtaaggcaagctgaaagtagtacagtgtatccgtatatacaaggaaaacgtgaggctatgaaacgattaataatcagacacacatgaaatgttactcaacctaagatatggtccaaaagtttggaaatgaaaagatagttccttgcagacacaattttgacaagtcatgatgtgctcttcatggcaaatgtatctcaatatgttatctgcaatagaaaaatacaacaaaaaaactgaataatgattattacacaactgaaaaaatcaaacccaagaatttcattggaacacataccagatacattaatggaacaaatccgaccactaaatgtcggacgcagagctacctcagctgcttcatcaacacaactgttactcggataaagatacaactcaaaaggaagttacataagcaataaaaaacaaatcatcgatcatttcaatagaattggcatacttttggagatgcttttcccagtaaagctgttgccaatcagctggtgattccacacggtcaacaaaatcaggccaccgcagcttaaacaacaacttccaagagctaccaagtacatcatttctgcagatgaatttaagttaaatctttctcagtctgtcttctcaattcgaataacaaaacagaaatcaaaagaagaattcatcaaaccttgcacgttttctcccagtaatcaagcagcaatcatctccagattcataactatccaagcaatgaaacggcctataccaatagaaaaatgtaaatgaaataagagttgtatcatcttcatccatataattcgtaaccctaactaaacctttcaatttgtattcaaaacttaaatgaaaccaaagagtgtactgacatgttggtctgaaacttctgcaaagcaagagcaggcaagtgagcgacaatgccatcaagtaactccgatggaagctcgtataaatctggaattggattatcgcctggaattacacaaaacccaaactcaaattcagcatattttggaatcaaattggcgcaacaaaagctttgttagaattactttctagaagctgaattttgagggattggatgcagagaaacgcaagagaaggagctttcgtcatccaaacaaagagaagagagtgccaatcgcaacgcaaccaaaacttcccgctgcagctgctctcggctcgctgtttctttcttccaaagagggaagagcaaataattcgttatgaggtctctttcataatgggccgcttagtatggcccaattcataattattcatagataattaaatctttttgtgaccagtaaaaaaacaattaaagttttaaaaactttgtttaaaaaaacatattttcatgagtagtgtaaattattttaaaaagaaatggaattataaggaaattttaatcaacaataattttataatggaatttaaatgttttttttatataaaaaaaaactaattgtgagcattgccatccaaaaataaatggtaaatttatttgtaattaaaaatagaagaaatatcaggatcatataaatcattaaacacatgcagccaaaaacataataagtgtacaaataaaattttaaaacagttccaaaaagcatcagataagagcgaaacaaattacaaaattgaattacacaataatgtcctctaagcgacgactaccggtgaaatattttataagaaaacaaaaacaataattaacaaacaaaggcgacacctttagattcgacaagacgaccattttagaaaaagcttctcaaattctctccttatccccaaaaattcaaacttttttctctttggaaaattctgaggcaaaaatgcggcgtaattgctgccatgtttcatttgcttcaaccctcaagatccttaattttgtccaagctttcattggtgtttcgatcattatctactccatatggatg

SEQ ID NO: 16354 - DNA, 3003 bp, Unknown
  misc_feature (1)..( 3003): 2750-1469P.txt file - cDNA_ID_1397500; gDNA_ID_2214625; Annot_ID_187772
cttaagttgagcttgcacagggactgtaaagactttccagatgacagagaaccaacaacagatttgcagctaaaagtagaaagccatcctgaaatctatatagcatgtgtaggtcagccatgaaatgcaagccatacatcaatttgaacaggaagaaccacggtggtacccacattgttttcagagaggtcaagggatgaaaggttggaagaagaatcaagaagtgtagagaaaaccatcctcgcaaaatatctatcgaggttgctatcgccaaaatgtaaggaatgtaaggtcctgaaagaaaaaagatgctcactaaaagtaaaatgaagaaagaagtacataataataatattacaacatttatgaagagactttgatagccaaatgagcaaacatttaacaagacacgttttggcatcagtccatatatatacctcaccgacatcaggaatgaaacgaaagcggaaggcgcagcaagtggatctatctcaatgctagatgtctttatacagaaacgttgcatcccagttgtgtggatacccttttcatgaagagaagtgcatattgcactgatggaactcaaagaaagcttgcagtgaataagttcaagcgaagttaatgtttctcggctctgaatcaagagcttgcacaagggctcaacctggagttcatggaacatcagcaataaaattccagctaactaaatctaggagactaaatagagaaagcgtcttacatgcttctcggatctgatccaacgtagaaccaaacttcgcaatttacttgtcctcaataactcctacagtaacaaagcctaaagattatttctgtcctccctctagaggttgaatgattgattcatcaacaaagatacaaatttgaagttctaagagagagataaacatcgaaagcaatacaacatatcacggcgatcagtggatactgaaacaaaaataaaacaaagatgactctatttacaaacacagaaacacatcaaaacgtcagagcatagtttaattacttacagaagtttctgtaacgcatagcacattcagaagcctcagacacctgcaacaggtaagaatgaacgcaaagaagcataagtatgttagagcattaaatcagtccaaaccagatatctcacgcacaaccagttatgagcgatataaaagtaaggcaagctgaaagtagtacagtgtatccgtatatacaaggaaaacgtgaggctatgaaacgattaataatcagacacacatgaaatgttactcaacctaagatatggtccaaaagtttggaaatgaaaagatagttccttgcagacacaattttgacaagtcatgatgtgctcttcatggcaaatgtatctcaatatgttatctgcaatagaaaaatacaacaaaaaaactgaataatgattattacacaactgaaaaaatcaaacccaagaatttcattggaacacataccagatacattaatggaacaaatccgaccactaaatgtcggacgcagagctacctcagctgcttcatcaacacaactgttactcggataaagatacaactcaaaaggaagttacataagcaataaaaaacaaatcatcgatcatttcaatagaattggcatacttttggagatgcttttcccagtaaagctgttgccaatcagctggtgattccacacggtcaacaaaatcaggccaccgcagcttaaacaacaacttccaagagctaccaagtacatcatttctgcagatgaatttaagttaaatctttctcagtctgtcttctcaattcgaataacaaaacagaaatcaaaagaagaattcatcaaaccttgcacgttttctcccagtaatcaagcagcaatcatctccagattcataactatccaagcaatgaaacggcctataccaatagaaaaatgtaaatgaaataagagttgtatcatcttcatccatataattcgtaaccctaactaaacctttcaatttgtattcaaaacttaaatgaaaccaaagagtgtactgacatgttggtctgaaacttctgcaaagcaagagcaggcaagtgagcgacaatgccatcaagtaactccgatggaagctcgtataaatctggaattggattatcgcctggaattacacaaaacccaaactcaaattcagcatattttggaatcaaattggcgcaacaaaagctttgttagaattactttctagaagctgaattttgagggattggatgcagagaaacgcaagagaaggagctttcgtcatccaaacaaagagaagagagtgccaatcgcaacgcaaccaaaacttcccgctgcagctgctctcggctcgctgtttctttcttccaaagagggaagagcaaataattcgttatgaggtctctttcataatgggccgcttagtatggcccaattcataattattcatagataattaaatctttttgtgaccagtaaaaaaacaattaaagttttaaaaactttgtttaaaaaaacatattttcatgagtagtgtaaattattttaaaaagaaatggaattataaggaaattttaatcaacaataattttataatggaatttaaatgttttttttatataaaaaaaaactaattgtgagcattgccatccaaaaataaatggtaaatttatttgtaattaaaaatagaagaaatatcaggatcatataaatcattaaacacatgcagccaaaaacataataagtgtacaaataaaattttaaaacagttccaaaaagcatcagataagagcgaaacaaattacaaaattgaattacacaataatgtcctctaagcgacgactaccggtgaaatattttataagaaaacaaaaacaataattaacaaacaaaggcgacacctttagattcgacaagacgaccattttagaaaaagcttctcaaattctctccttatccccaaaaattcaaacttttttctctttggaaaattctgaggcaaaaatg

SEQ ID NO: 16355 - DNA, 3000 bp, Unknown; identical to SEQ ID NO: 8879
  misc_feature (1)..( 3000): 2750-1469P.txt file - cDNA_ID_1397582; gDNA_ID_1971910; Annot_ID_177083

SEQ ID NO: 16356 - DNA, 3000 bp, Unknown; identical to SEQ ID NO: 8602
  misc_feature (1)..( 3000): 2750-1469P.txt file - cDNA_ID_1397711; gDNA_ID_1971820; Annot_ID_176123

SEQ ID NO: 16357 - DNA, 3000 bp, Unknown; identical to SEQ ID NO: 8602
  misc_feature (1)..( 3000): 2750-1469P.txt file - cDNA_ID_1397711; gDNA_ID_2926158; Annot_ID_198552

SEQ ID NO: 16358 - DNA, 3003 bp, Unknown
  misc_feature (1)..( 3003): 2750-1469P.txt file - cDNA_ID_1397750; gDNA_ID_2214537; Annot_ID_134398
attaatacagaggagaggaagatcgtcctcacaagtatttgcaaaaatgatacacaaatcaatgccaaaatgatgacgcagtgaaggtttagacagctcaagaatgatattgcacatcaatcactgattcaatgttttatttttgtcttcttcttttttttttttgttgaatgatactcattgtcaacataatatcataagccttttatcaaaataataataatacataatgtcctgcattttgtctttttgtgatgatttttgctcattatataaattgcaagtaactatgttttgcaaggttttttctgttcgtgacataaattgcgagtaaccatgttatgttattatatatgtacctatggtgcgaaggttagattttacatatggagataataagtattggatttggagataacataatgctacgactttatactgtgtatgttgggatttcataccaaacaaaaaaaatgaaaccaactagccaagaatatgtttacgttttgagttttacagagttcacattatagttgattttatttgtgcaaattatatttactctgcaaaataacatcttactctcctacttcaagaaactttgaagagaaagatatggaatgcaacgagttacacaaatctgttacaagatttctaattaagaacttacaaatctgctacttatcatcttttgaatacgtcttttggtggttaggttctaatttgtctaacagtatatgttttccaacaaaatttgatccttttgaaagcattactcttttttttttttttttttgtcaattttgaaaggattactcatattccttaaatcatgttactaaactcacataaatacgtattaagccaaagacgactcttgacgtgctctaaaatccaattcattctttatagattttaattcttggctctttatcctatttaatatttcgccgaaaaatctttgaaatgattatctgattgtatttttttataaaaaatttgtcataaccaaatttagaattatattttaaaatttaggaatgagtttagttaagaagttggtttgaaggtatagttttttctggaatttaaagtttaactttaaaatttattaacgatttagtattagattagtttattaatttgttgaaaaatctggtctattttgttacttttttcaaaaatatggtctattttcataaaaatccctaaaatatccgaatttatcggataaacccaaaccccctatcgggaaaacccaacacaccgtctctctctcactctcacttcccatcggcgaaaatggcgtcggtggcggcatcatcgtcgatatcattcgctgcatcattcctcaaaatcaaagcattccctctctcccctcgcttcttccccatccgtacactccgttgctctgtctcctcctcctcctctgagcccattgaattcgacatctccttcgctcctcccaaacccaaaccctcctccactcacggcggcgtcacccctcaacaactcttcatcccttggatcgtccgtagtgatgacggcactctcaaactccaatctcaacctcctgctcgtttaatccacaacctcgccatcgatgccactactcaaaaccctaagaagaaagataaatctaagaagaaacaacctcaagctacctcctcttcctccgccaccaccaccgcctcatctccagcttcacactcagaggtaaagccaaagctatccaaagcggcgcgtaggttttacaatgagaattttaaagaacaacctcaacgtttaagcaaagttctcgctgctgctggagtggcatcaagaagaacctctgaagaacttatttttgatggcaaggttactgttaatggtattctctgcaacactccacaggtaaaacaattctcattgtgggaatcaaattttgatgttttgatgataaagcttagcaattttgttaatgcagactcgagttgatccatcaagagacattatttatgttaatggaaatcgtattcctaagaaacttcctccaaaggtttattttgctctgaacaagcctaaagggttagccttcttcatagctttttctcatacctagcttcaggattactatcacagacttgtaacctttgtttgatatttcttgcatcatcctgatggcagatatatttgttcttccggagagaaagagatcaaatctgctattagtttgtttgacgagtacttgtcctcttgggtaagacattttgttttcctgtacataaaacgttgtcttttaaagtatgttagattagaaaacttggtttaagaatcttgtctttgcaatgtaggataaaaggaatccggggactcccaaacctcgcctttttactgttggtcgtcttgatgttgccacaacgggattgatagttgttacaaatgatggtaattgtattaattgaactccatgtgttatgttatatatcttggtttgtacattttggttcaaggaactatgtttctcttcccttcttctaaaaagaatttcaacttcttgctatgcaggagatttcgcacagaaactttcacatccttcatctagtttaccgaaagagtgagtttacatattccttttatataccgttatcactcatgattaggtgatcataattggtaggaagaacctttggttaagtaaggtaaaagaaataggctagttcgtgccaaatatttcttaatgaatacaattcagatagatgtttactgcagagttattttttgagctttggttgctggtagtagtcgccaattccagaaattgtggttttaggatcctctcagttttataaattcaagcagtgattctttccttgaagatttatgttccgtctaagtagttcaaaggttttgtatatttatactgctcttattatctttcttttttgaaattgcagatatattaccacggttgtcggtgatatacacaaacgacacttaatggctatcagtgaaggcacaatg

SEQ ID NO: 16359 - DNA, 1864 bp, Unknown; identical to SEQ ID NO: 12229
  misc_feature (1)..( 1864): 2750-1469P.txt file - cDNA_ID_1397750; gDNA_ID_2214537; Annot_ID_185121

SEQ ID NO: 16360 - DNA, 3003 bp, Unknown
  misc_feature (1)..( 3003): 2750-1469P.txt file - cDNA_ID_1397812; gDNA_ID_2096300; Annot_ID_195671
acgaatacagaacaaacaaaactcatgggacgaatagatataataaagatacaaggagacagaagcgtgtcgatagcagaagcaatggagacagcaaagcactaatcttttgagacaataagccaaaaaaaaaaactagctgaaattcatcctaaagtcttccactatctgatctataaccaatctacttctatatccaccaatatgattacaaattattgaggaatgaaccaagaatgtggtctagtcaaaatgatctttaaaggaattaacagaactattgaatcaatgactatatgtcaagtaacataaccaaaatgtagatatataatgcgagatcaattacctcgtaaagaaagtactacactaagaagatccaacgatgatgttgttgattgggatgaaaacgagcttcacgaagaatccaacgaatcccatcaccacaaatccaatcgccgtacgcacagctactttcgtgaattctgataaccaattcaattacaaatgatatcaaaatttcagaaaaccctaatctacagatcaaaaatcggaaatgagatttttttgagaaaaggcgttacccttgcgatcgggtttgtgacagcgctggacgagacgaacactgctcttagcgaaatctctgagaggatcgattgcggaatcaatggcttccatgacttctttttagatcggaattggtaatcgaaattagggtttcagcaggttcgtttaaggatgaaaattgggttttatttttgacatttggttttatactttagttccgttgactttcgcctccaccataatttctccaattcagatttgattcggtctgaacacaaagtccggtttggtttcttatttgtcttaatatcgattactttccatctataaaatatttttctacaacatcttaagaattataattgagtgatgttgatgctactattttaagtttagaaaataaacactaaaaagacaaatgtctcactcatcaaagtaaaactcttgaaaagtgcaagagctctgaaatttgagaacgaagacaagactccttgtttttttttgtttttttttgctaaaaatttaaatattcattattacaatgaaaatttcggttacataataaatggtaaccaaatcatggttccatgacaaaaaaggataaaaagcatggaagcataccaagactccttgttactacgtcaatctcttttatacgttttcagccaagattccggattatgaaagaatcttgggattctaacactttttctttttttgcttgaaagaggtttacaaattttaacactttttttttgttgaggattttagagtgaaacacatgttttgaactgtcttcaactgaacaattcatgttaggcgtctatataaccgtcggttattcacgaggtaactacacatgaacatgataaatttactctctcttttcattaaaaaaaagttgtacaacttaattacttatgtcatgaaaatagtatatacgtaaaagtagattatttttgtggttttccttttttttactataacaataaataattctatgttacctaaattttcttaggtagtataatggatcaaattgatatggagtaaacaaaagaaaaacttaaataatctggtctataatttgaagcgcttcaagccttcaacatcaatccgagtacgaacaataatatgagatttcatcaaaatattatcctggaaacgatttttcatttatatgcgattatattgttaatgaaagttggaaatacataatctagacacgtaaatgtcgtattgatcatgttgtgaaatgagctgtcgccttggtggcactttttggcattctctatttctctttccacatttaccacaatgtatccaaataggcaaatatataagcttagagagttggctgcacgtttttgctaaacttgataaatgagtcaatacaaccaatatagccaccatccatatctacaaatctacacttatcatctaaacttgaagaatatttgttattttatcactaaccacaaaagacaagactcgttacttaagttaaatgatagtgacatgattaagagaatattagctattaggtcggaaataagagaaataagactggtagtggtatggttatgtaaattatcagtacatgtatataacacttgtccaaataatggctttcacattacaagtcattctttccctgagactactgcaagaaacaaacacggaattctcgtgataaacggattagtacgaaggaaaaagtaaaatgcagtaaccaatttttatatttcaaaaaacaaggcattttggatgcaatgaaatatttagatatataaatttgactagtgacaacaatttaaagttgttagatttctcaaatccaaaaaaaaggaaataaataaataaatagtttatggctattcaaattgtgtattattttttctattggttaaaatctataaaagattttttttttattacttcttaaatttatgtttatagccaaaacatctaataaaatgggacagagaataataactaggaattcaaacacattatcaatgattagcagaataaaagtttggaacatctaaacctaatgactttatacttcccctttttagagtttactttgtatggaaaactttgtaagctaacaaacaaaagtattgaaatcgtgaaaaatagtaaagctttttgagctgcaatatttgatgcgttgaaacgagttggaaacagctttcactacactaaaaacaaacttaatctcaaaatttagatggattaaactcaaaactttttaattaattgaataggattttaggatgatgcagtgaatatagactatttggtgaaaaaatacaacgtaacgtacgtggctgctctaagcctatataacatagcccaagagagtcgtgttctaatgtgattaagtaaagtgagggagaagcaacgagagatagagatagagagatcaagatg

SEQ ID NO: 16361 - DNA, 3003 bp, Unknown
  misc_feature (1)..( 3003): 2750-1469P.txt file - cDNA_ID_1397832; gDNA_ID_1621119; Annot_ID_56262
acaaacttcatgttgtagttatagtaaacttgcttatttacctgcgatagctcctacgcgtttatggtttacgaggcttggatctgcagaatgtatcaaaatgattgaaaatacgtattagtactatctaatagtccctaccaaaaaaaaaactatctaatagtagttaaatagttctcaatagaaattgtagttaggacgaaaagatatgaacatagacattttgacctttgcaataagtagtgacattgccttgtttacaaaggcacaaaaaatctcgtgtcctcgtattaaacccacaaactccaccacctttagtcgtttcttggcaaagaaggcacttcattgtcactggaaattcgtaatcaacccttatcccgtactctggaaactgatcatacggtgcattctccacacctgtactcctccaatacacacttgtatacgtcgcacagtcctgcagcatgagcctaagagattgagtcgctttagggtaatacgaacaacaagaaaccctagatcccaaagcagagccacattcaggcaaatgtctgcatagatagctagaactatcgcaggacgagtcacatctatctggaaacctttcgcagaagagcggttttggttcgacgataactttatcggtgttgcagttgaagaacaagtagtcgttttgaggagagacagtgaagtgtgtacttgaatcgatgctaaaagatctagtgggtcgaaaattgtctcgatcttgacagttccacatgaatggatcggagacaagaaggtgaggatcagagtagcttatagatttaacagggtatttaccagatggtgttctaagttcgagcttggtatcgttgtcggagcaaatgagcatgtgtctgtaataagggctaccacaaccgtcgtcgatggaaaaagggtaatttatcggaatgttgccgcaagaagatctgcagagatttgattgggatgatgttgttgatgattgaagaaggatggtcatgagaagggagaagaagataatgtaagagtgaagtggagacattgttcaaaaattaggagtttagatttgattattgggtagtttttagttatgagattataatttggtggtgtgaagtgttgagtaagcttggaatgtcttgttaaagagtttaagaatcaatcttgtcatgtgcttgttaatattgcttattttaggtttcggtttgtttttaaaatttcacctttctttttagtataaagtattccaagaggactcgtggttttgtttcagattatttgaaatatttacatacaatatgtcaacaaacgtactattcttttttctgatattttacaacaaaatttgttctttaacatgttatctaaaaaccatttaacaaaaaaaataaaatgtatgagaaccttataaaatacaaaatagtaatttcagtatataatagttttgaattttcttttatttagaatttcgtttaaagggttgtgatttgtgaagtaatctttggaagataatctcaatgtaaacaacacattgggcttctcataggcccaatataaacaacacattgatcattatccatgtaaggtgaactctttaatcgaaaccgttcaatttcagtcatctcaatccaacggttagtattccaaggagcacgtaatccactctaaattcgtaaacacgtgatttctcactaaatataaaacttgatacgttacgccttcctatccatccgtcaacgattaaatccaatcgttcaatatagagatccaacggctaataacgaaacattagcccacacgaaatctcctttttttttttgacgggattatacagtgggcctccacctgtaattgtccatttaggagacagcgcggttaatttagcattatccctcctcacagtcatctctttcttcgcaaataaatgtaaccatctctcttctcgttttcttcaacaaaaatcctcatttctctgagaatctggtgctttagctttggtgagctctctttcttatgaaacttatcgattctcttctcgttgattgtcttatacttttagttctctgcttaatttattgtccttaatactcgtggatttgttcataaatcgttttctgagcagttaggtaagagttttgttaccgaatttcatgttcttcgattttgaatctggatgattgtatgatgtgattagtagactcgcttagattttgtgatctgtgtatggtttgtggctaattttggtttcatcggtggtatgaatttatttggggttttaggtttgtttgattacgtaatcggactgtttacttgaagatttatcgattatagttgtgatcgtttttagttgattgagaagaagaaaataaatttcatgctcttgttattgtcgcgattgtggcgattttcagtgtcttatgaatcaattatgttgcatgtgagtcttggtgcaattgagattgtttcctttttttactagattgcttgtcttattgaacaaaactttccatttatgttgaaaaggtttataggaacggatgtttagggttttgttgtaatctgggtatttgctttctgatttcggcaagcaaatgtcgatttcaaggtttatatcactttctctagcaaaagaagtctttagtcatttgcaaagtcaagagagtttttactttatttattgcttccacgctattgcttcgtggctgattgagagagaccaattaaactaataatttgtagtttgtacaatatattgcgtgtaacattgtccttcgttatctgtttgaggaggaggaccgagttagcctatttttagtcactttacaaattttcttttatgttgcatcattcaatatgaactctctgatataaatatatgtatacatactggttgacttttatgggtatggttctctgctttttttctctgtgatggtctcttgattctaactttctttgttttatgtttttggtttttgttgtcaatgaataggtaaaatg

SEQ ID NO: 16362 - DNA, 3003 bp, Unknown; identical to SEQ ID NO: 16361
  misc_feature (1)..( 3003): 2750-1469P.txt file - cDNA_ID_1397832; gDNA_ID_1621119; Annot_ID_172002

SEQ ID NO: 16363 - DNA, 3003 bp, Unknown
  misc_feature (1)..( 3003): 2750-1469P.txt file - cDNA_ID_1397867; gDNA_ID_2214695; Annot_ID_136798
atccacaaatcagaaactgttttgttcggtgttgactcgactaatgaagagcttgcagcaatagttcagacaagaaacacaactacaataatactcccaagtggagttcacacattgcctaaagacggtaacaattctcctctcccgttgattaaccggtggaaaaccggtggagaatgtgactgcggtggttgggacatcggttgcaaactccgtgtcctgtcttataatcatacaaagactcaaactttgtcaagctttcaattgtttgatcaggtaaactaacttgttcacttcaagcagctttcgggtatcgatggtttgagtcatttttcaacaatttgatttgattctcacaggaaagagacgagccagctttcaaaatggtgagccacggcgatgaactccactctgttgagtttggctcatcgatctctctcttggaagcgttctttatttcgttagcagtaactagtcatcagagttggtgtcaggaggaagaagaagaagaagtggttgtgatcggagattgtctgttaaagagagaaacaccggcgaagtacgcaacgaacccaccggtttctccaatcggtcgggtctagaggcagagagagttgggcttagacagtgttggatctggtttgggctgggctttaatataattgtaattaagaattacatggcataattaatcgtttagaatttgggtaatgtacaaaatagtgaaatgcatttatgaataatatagtgcttatggtttttcctatagtcctttgaaaaaaatcgaactgaaattattttcagaaaaactcatttcgagacgttttttcggttgaatcaaaactattttagattttagtatttgatgataaaaggaatagagaggcatgtgaggaagaaaccgtatttgacagacatgcttcgctgcattaccctacgtactcacatgcttctccaaatcatattcctccacgtgtagtgtttttttcttctttctcaattagatatagttaaaccttaattaagttttgttaagatttgcaaattggccacttacttaactctggttaccccgacattaccttcgaaattttaaattaaagcgtcaataacggttggtgggtttcatctcgtgaccactgactactttttagttttacttactgaacaaaaaagctctttatcagaattttgaatataccacttgtttcctatttcggataaattgatcatataaaattataaagtaaaggtttttctcttagaagataaattttttttctccaaatttgcataccatttaaaaaatgaaaaagactcttttaaaacaaaacacaggctgggactgataatatgatattctagaatctttcctgaaaaagaaaacttacatagaaacttcttcttactatgaactttttgtaaaagaaaaaaaaaggttcgaaatgagtgaaaatgattttaacgtgcattaaacttgtttgatatgaatcaattcatgtaataggattgaatgctgatagtaacatcatacttattttctgacaataatttaataaatgagtacacttgttctaaagttctctttgagaattctagaatacaagtctgcttaatcaaaaggctattttaagataaatgaatttttaaaaaggttaagaaaacgtatgaaagacttactgtgatggacatatcaatcgacagttattgggagtttttttttggagtagcaaagaaatgtaagaaaaaataatgagaagaagataaaagccaaagttgtgaggcttgtcggaccaaaaatggccaaaatgctagcaatccttgaaaacaagtgatggtaactggaacaccaaaatttaatgggttgattgaatcattgaaagatttgactttcaatatttttgatattttcctaaggagacttttatgacttttctttcattagtctctctagccaaatttgttttgcacggctcacattttgccttcaacaattttcattacttgatctaacatagttacttcttaaaaaggcaaaacaaaatttactttaatagctgagtttcttttttgtttctttaccatttaaatcatatagaatggctaaccatatttgaaatagtattgaatcgaatgtatctaccattagaccaccatgaatgatttcatttatactcatgtattttacagtttgttaagttgattcatatactaatttaacaactgataattgttacacatccattaagctttcatcaatacttaaattaatagcaaaaatgaataattaacagctaaatacacccaaattttacagaaatattctactcctacaatttctaccagtcactactctctaattttggtataaaaatcatatagctcactatataacagctatcaacctgtaatatataaattctgataattaatattggagaatttagtctaattagctaaacattttattcgtataaagaaactttttttttcctcgtataaattctaattttcgtttcgtggtttgaattatactttttttgtttttatatataataattttcaattcaaccgtttctccgtgttgaactctaggcctttttaatctatgccttcatttctcagattcttctaaagaaaaatttcgcttttctctctacttcaaaacttttgataatcttctttaaactttcttcttcgatctctctttgttaactttctttcgttacgtctctctcgttctcgttatttcttattctcagatcttggattcacgaccatctcgatcgttgaccgtcgaatttgggttcggctaaaaatccaatctttttttttccggtgagaagctcgagagagtatataatttaataaagggtacgtacgattttggttgagtgttttgatgatgttgacccaatttgttggggtgtgaagtatacttatggaactgattgtcacaatacaagaagaacaacatcatcaacaaacaagaataataagatg

SEQ ID NO: 16364 - DNA, 3003 bp, Unknown; identical to SEQ ID NO: 16363
  misc_feature (1)..( 3003): 2750-1469P.txt file - cDNA_ID_1397867; gDNA_ID_2214695; Annot_ID_189506

SEQ ID NO: 16365 - DNA, 3000 bp, Unknown; identical to SEQ ID NO: 13314
  misc_feature (1)..( 3000): 2750-1469P.txt file - cDNA_ID_1397919; gDNA_ID_2214615; Annot_ID_187501

SEQ ID NO: 16366 - DNA, 3000 bp, Unknown; identical to SEQ ID NO: 8341
  misc_feature (1)..( 3000): 2750-1469P.txt file - cDNA_ID_1397961; gDNA_ID_2214705; Annot_ID_189819

SEQ ID NO: 16367 - DNA, 3000 bp, Unknown; identical to SEQ ID NO: 8341
  misc_feature (1)..( 3000): 2750-1469P.txt file - cDNA_ID_1397961; gDNA_ID_1971751; Annot_ID_175291

SEQ ID NO: 16368 - DNA, 3003 bp, Unknown
  misc_feature (1)..( 3003): 2750-1469P.txt file - cDNA_ID_1398124; gDNA_ID_2936555; Annot_ID_194203
cgcatggatagtttggccttcatcatttaaagcattagctttctaagtcaacgggtagcttcaagagtgtaagcctaactatctttgatcacacgatgtggaagactccatccttcttttatcttttcttgatgctccaacgatatcttatattagttttgacttttgtaaagaggggaatgtgtatctatgggtaaaagtaaaactgtaaaagagtcatgtaacggctagatctagcggcccatgtgttgctgatatcgctagcttttcccatggttttgcacatttgtgaatgatgatgatatagctttttctggtgtaaggaagaatcttcatcttttctttcttctcacgttaactctttgaatatgtggaaacgagatgttgatataaggtccgtttagttgtttatgcattatacctcatatccaaactttaattagatgaaagattaaaaaaaattacgatatataaacgcaaattaccaaaatttattctttactagaatttggtaagaattcactagtacaaaccgtcagaccataaattccgaacatatggtttattatattacaatacaacacttattataaatatggtttgatttttactgtaaatacaaaaaagttaaaaaggcatggaggtaaaatgtatgtgcactccttaggtgttttaaattttaacaaggataattgcagaaacaaaacaacgagtcttttttgtcgtgtggcctgtctcctggacggcaatcaccataccctttatacttccgtgcacaattagcttcacatcttaggaaagaacacgtattatttttattaaacatacgcgaaagacacggtacttttccttggactcctattcctgtaatatatcaaacataaaatatgagtttcaatattcaaattataagattgttatgataaaatatagtttatttatttgttgatccattgattattcttgagaaaatatatataggaactaaaaaataattattatatacatgtagtttgaaaactacataggatacctttgaaaaatcatggtatttgtaatattttccatttagaacaaatatatggattatattaaaacgagtttaaatgtaaaaacaaacctaacacaagaatggagaagataagtagaacggctaccgagacttgagagacatttttcatcttaaaatagataaacgaggatgatttttgaagattacaaagaaacgaaaacatgtatttatatatgtaaagttaaagttacatgtatcacacattcaaatatgtctaatttaagtaataaagtaccgatttaaaaggatcatgttttacacaattccggatatgtaatattgaaggaaaaatctaaaataggtttctaattaaagatatatatttattccaaaaatggaagtcaaaatcaaaaaataatttaacatatatcatttagctatgtaatttaatagaatttgggttgtacataactacatatgttcaagtatgaagaaatagatataaaatcaagcatgaaagacaacacaaatgttaaatgagcaaaaccaagaaggcaagaacaaatatagggccttcgtggaaaccttttgtgcgacatatggaaacccattaggctagcgatgtagttggcccaagaaaccggctttgactcagaagatatagttattgattttcggcttcgtcaatcaacaacactgtaattgtaatgacaatagttggtgccgacaaaaaataataatgacaatagttgggcttaggtttataagttcatttttctaaaagttaattggtgaaaatcaattgcaaacaatatattactctcttttcttagtagtcttctatataagattctgtttgatcatgagataaaaataaaaataaatactctttttaatctgtgggtaaaaggtaaaagagacatgttatggttggatctgacggcccacgtgtcgctcgcactccgatctcttttcacttttggtcccagtaaggctgtccgtatggagacatcttcccatgcctttggacatttgtgaaaacaagatattattattagaacaactgaacaagatattgcaagtgttacttttatttaatttcactgtggtaagataaaatttgaaaatttacttgttgctctgatcttgatgcaagtaacctcaagttttgcccattcttggagaatgtaaatataacttcgatccccaaaatgtgcctcctgtcatgttggaataactggtcagattttcaaaaggtgaccatttgtctgtccataatcatcaatcccttatattctattccacttcttaaagtttttgttctattgttaaaacgagttggtttggtttggatcatttgaaatgaatgggtgaatgcatgaattctaagagtttgtcatgatacttaggcttcacataaaattctacatatggttaagaagaaattaggtattctgaatttgacgatatttcaataattaccaatttgttaccttgtgataatttcacgaagctcgaggctagaatactttattttataggtcccacttcaatgactcatcatccttatctagatttgtgtcacattccatctagcacttttttttatttgcacaccctccccactccttttcttttgtgatcctaaaattaagttcaaaaattattttaattttggaatcttcagattataagaagaaaaaaaacattgaatcttacataaatacttaagtagatttgggattaccggattagtagtgacaaaattaactaagaaatattattcaataataaaacaaccagtaaaataaagtcaccaaactttttaaatggcgtggccggtagtgaaaaaacaagaaaaaaattaataatgtaaataaaaatcaagatattttgataaggtgtctataaaagtcatatgccaccaccaaaagtgtttcactgtctacaaaatcattgaagatctacccaaaaaaaaaaaaaaagagatg

SEQ ID NO: 16369 - DNA, 3000 bp, Unknown
  misc_feature (1)..( 3000): 2750-1469P.txt file - cDNA_ID_1398337; gDNA_ID_2936587; Annot_ID_195142
ttccttgcgtacctctggttcctcaggaacttagggtccatctgaaacatcatttcacataaacgcaataatcaaacctccaacactataacccgaatctgaaatcagttaggttagaactgtaataagagacttactcctctggttggggtgtgacggtgtctccttggcttcttgattccgttcttgtgggctttcgccgactggttatgcgccgtgtgattcttcgacttggccatctctgagacacaagaccacaatacaaactattcaattgaataacgaacgaaacaacagggggaaatgaagccagagatcggccgtagatataagaaaagctaacctgagtactgagagagagaggtagatctgctcggctaggtttactttccgcgatacaaatacggcgtctgcaacacaaaaccctaatttctgattgaatttatagtggactttaaatgaccaacgtgccctaataaatcatatatgggcctctaattaatctatctcgttgctaaatcatataagcccattgaatgaacccagagtcgtggccttttacaaattggggtataaataaagcagcaaaccatttttttcaaaatttggaatttctttgactcaaggaagtgaagaagacgagagatagagaagaaacctttctgtttcatcagaaaaatggacgatcaagctactctggtagaagacacagacaaacacgatgatgataaagaagaagaagacttgtgcaggatttgccgatcaccggaggaaccaggaaaccccttatggtatccggtgcgcgtgtcgaggctccatcaatgttcatcaagactgtcttcatatctggctcaatctccgcggatacaagcagtgcgaggttattatacaaacctctttttctctaaagaatgaggttcttgttctatagcgttatgtgacaatttcgttttcgattaaacttcaatttctgcgattttagaaagaatatcaaagttatttactagtattttgttatgagtgatgtttttggggattatatttgtgtcatggtgttgggattttcgatttcttctctgtttcttgtaatatgggtttaagaagaatctcgcacaccaaatgtttgatgaaatgctctctgttttcattgtaggacgctccagagagacttccagttcacgagtttctaatacgtgtttgtgttaatgagagcatcaccttacgtgagaatggttgttccttgggctatggcgtttatcttgaacacatactgcctttctttacatcctttgggccaagaagttgttgttgggttcaagagagattatggaatgtctaccaagtccgcatgtttcttaaatggcctgttatacaacggtcatcttgtgtttttcatgaggatacccatacacgagcccattatcgcgagacatcctgctgggtttcaggctgacatcttgattaagaatgtcttaggagatgggtttgtgcttgttttatggaaatataacaagatcgtttgtgagtggtattattctctattgcaaagcttcttcggggaacctcctaggctagttggtgttgctgttcacgaacttggagccattggacggctgcttttctttctggataacaaatcttttgatgtaagtctaatgtcccttctagttctcttccttcgtccaccctatgtaacttaattaccatatggagcatgttttgaataacaggttctgtttgttatcttatctacaggctcttaccatcagcatatgtgtgtctttcttctttattcttctgccgttttcttttcgctggattgcaatagcaattgtaggaggtggcggtttattcgaaaactcacctgtcattcttggatacatgatgacgctgtcaattccctttgcctacttaggaattttcctcactctgcgtcaaatctcgtttccagccatagtcaggtggttttccttgggatatcacttcataacaaagaaactgtcctgcctcctgagcaaaaatctcgtttcctgtcaactgtttcgcgactaaggcatggcggggaaagttcaagagaatcagaaacgtgggaatcaataagcttccttcaatgtggctgcttcaagatgtgattggttcgatcataaccacacttctagccacactctgcatcccttacttgctcttgaagtctttgttacctctgcttggattttcccgtagcgccaacccagctattgagccgtttatctggccggcgttgttagccttgattgcggtctggttcatggccaagcaaacttatgatctcgtcagttactttcataggttggtcttcgatgatcggtatgtagtcggttaaagagtggacaatctgactgaggatatctcgctagagagaaataactaatccatatatgacaaacaacgacttttcattggaaaggaaaaaatgtataaacacaaacgtagattcaaaactcaaaaagttatatagtaaccaaggtctatatacgttaatattaagataatcgcagtccacttgtaagtcatgaaaacaaaaggatcttcaaattgttgagatataaagaagaatacattagcttgcctcaaagaacacaatagtaaggggctaattatgtaaataacctaattgtggacacctgtttgcataaataaatagtggcaaaactgtaaataagtgaatattttagcaattacagtataaattaagaacaaagattaaaaataaataaaaaagtgctttcattctttggatgcgctgttgtcaacttgtccctcgctgcctctgcttcttaactctttctttatcacttttccactcccaaatcaatttttaggttttttttataattataatttatttgctctcggcaggatctatataatacacagaccagtctttgcgtgtgcttgtgtgcattcattgatcgggtttatatcttttcatcggattttctttgtcgagcaagagccatg

SEQ ID NO: 16370 - DNA, 3000 bp, Unknown; identical to SEQ ID NO: 16369
  misc_feature (1)..( 3000): 2750-1469P.txt file - cDNA_ID_1398337; gDNA_ID_2936587; Annot_ID_143887

SEQ ID NO: 16371 - DNA, 3003 bp, Unknown
  misc_feature (1)..( 3003): 2750-1469P.txt file - cDNA_ID_1398444; gDNA_ID_1620487; Annot_ID_158494
actctttgtccctctctctttctctattactctgtctcctctgttccggcgatgttccaacacgcgccttcttccatttccctcatcatcatcttcctcttcaccattctatcacccgtttcacctgaaccggtcacagtccagccattccgggtcaaatcatccccacccgcaaccatacccgctttcccggagcaatccgatttctccggctgcccactcgatttaccagaagacctcttccacggcatcaagtcagcttgcagcggcaaaaagctccacaaaggaaaatgttgccccgtactaggcgcgtggctctactctgcttactcaaccactgctctaagccgttcgatttccgccgccgcaagaaactcatcctcctcctccgccgcggtaacgactcctgaagaagatatgcctttgcttcccgatgactcggagacttgcgttgacggattagggaaatctctgaggcagagagggattgagctcactagaccgaacgagacttgcgacgtcgtttactgctactgtggaatcagattgcatccgttgagctgttccgaggcttttagagtgaatgatgaagggagactcgttggagacgagagagttgatagattagagactgattgtttgagtggaagccacaacaatgctgatggattctcacctcttcttggttgcaacaagtgcttgaacagtctctataaggtaaagtcactaactttgctgctatatttagaagctgccactgtgaagttcaaatggaattaggttggctaaattggtaaaatgtgtgtgcaaatctagtaacttttagataatctatagataccctgaagcgttgttggtgtttagcttctggattttgtttgattgactgattaagacaattttttggatgagtaatgaggaattgatggactagttatagtagttaactatgtaaggtttagtccaaagtttagaagcccttttttaatgatatttatttggtgtttaaggattagggttttactatatgagtgagtgaagatttggaattatgtagtttaggattctttctgatctatccatcatatggcgaatggtagtaatttgggaaaagttttgttctttagctttttgttctctttctatctgacagtctgacacacatatacgcgctaacagaatccgtgatctccacgcgacgttttgtcttccatcatatgatttcattcttctgcatcttaatcaccaacccaccatagccaaaagcttagcaactagttgccacctttctactttctacaatcctcaatcattactttagtcagcagcaacaaaccctaatcaaaacaaacacttctgcttcattttgcagctaaatccgaagaaaacttcagggacaagaaacccatcaaaggaagaccgaaacagaacagcaaagatgcacaacaaagactgtgtcctcatgggtctcacttggcttctcgctaagaaccgtactgcttatttccccactgtcacttctgtcctccgagccgtcatgctgaaccacgatggcgtgccacgttcatgtgctctcggcagcgacggcatgcctttagccgtcgattcttccgaattctccaacggctcgccaacttcacttcagtatccgcaccacttggtccacttcttactttacagcgttatcacattagtcctaataaggtcgtggtgacgtggcacaccatggttggatttgattgtgacgtggagcacgtggcattacgtggttggttgagagaagtgaaattcagatagagagaaagagagagggctttggttctgtctttgtaaattagttttttggtgtcgttgttgttttagtagccatgttctttaacattttattacatcaaaaaaatcttgttgtattttgtcaattaaatattgaaaaatcacaatttgaaaatatttcaacaatattttcggtcatatcaaattatatgagcgcaatcaatataaatatatcagtttttgggaggagaagaataatagtcagagaaaggcatgtgagtaatggggacgaggtggtgtggctggtttgagagagacagagagacttgtgacagctttgttcttatgtttccttatcttctctctaaccacggatgctcctataacaataatacattcatgattcatccctatcatattctatattttatatgaattatcaatgcgaccaagagatgtaaaaagccccacgactgacactttattttctcatatagttcaaataatatttcattcaataatcgaatgcttccattcgttagatttttcctttgagaaatattatgaaaaagatatttcataacattttttttgtggtagtgattagatagaggttcactaatgcgccaatcaactgctagcgattcattgactttggcattattgcgtatataactgggctgggctaaactaacttgcccatgggccgcacatttacctttttggccaaataacacacccattagtctaatctaaaattacaatggtaaaaacatgagagattgaggaattgattaaaatggaatgaagataatagagaaataatttggttccactcatttctaatttagtagaaaatatataatttttcaaaattgttcataattcaaggtatttccaacaaaaatcaatggaagtttattattcttaatgttatatactactctgcattatgatatgtaagtcttaagaaacaaagtgattagcacaaaactattatacaactacactttacattatttttgggttatctaatgagtttgtgccagagaagtgaatgttgcaacaatgattatcattacattatctttctaattacaacaactaaatattaacaaatgtaatgtcaaacaaaactcaaaaagactcaaatccgtccttccattttcctcgtctctcttcttccccgtaaacccaaaaacaatctctgcaaagtcctcggttctgatg

SEQ ID NO: 16372 - DNA, 2997 bp, Unknown; identical to SEQ ID NO: 14782
  misc_feature (1)..( 2997): 2750-1469P.txt file - cDNA_ID_1398573; gDNA_ID_2684224; Annot_ID_191873

SEQ ID NO: 16373 - DNA, 3003 bp, Unknown
  misc_feature (1)..( 3003): 2750-1469P.txt file - cDNA_ID_1398573; gDNA_ID_1972003; Annot_ID_177779
ttaatattagatggttaactagatccccttgaaaatggctaccacttctttgttctctatctccatgttgggaagtaaaagatattcagtataaacttttgaaatagtgtgtagcatcaagttaagaaacattactagcaaaaaataatgtataggaaaagtctccgcatatgtttcagggacaaaaaaaagattcaaagatcaaaaaaaccctgcagccaaatacacagagaaaaagctttaaggaagacaaaagattcgttatagaattgagcttctctggggatgaaacggtttttcttgatagctttttcaacgaacactcaagccttgaatagctgcagcagatgatgatgatgcctgagaaccttcctccgttaccttattcgattcgatggtagttatgatacttgaaatgttgtcctacacaaccacacataagaatcagattcaggagatgttttgtaataaaattctgtaataagtgaaagcttttgtagttaccttccaagtcgcaagctttgttcggagagattgccattgctttgtcccaaattcacgttcggaagagcggctgtaagatatgaatcaaaccatcaaataatgaatgttgcgtttagataagtgcagagtttcaatagatgtgtgacttgcctgacaattaaaacttggttcatctgatccatcttacactcaatcagttttgcagttattgccttcacgatccataactcgacatcctgttcatttacctgaaaacgaaaagaaaaatgagaaactaaaagggtctcaatatttcatgttaagtgcaagcagaggagagtttttacctgaagagtgtctttaatcgaggtgtaaggtattttgccagattcatctgaggccaaatccactagtgacaacaacctcatcttcgtaacacaatcttcattggaaagtcctagaaacaccacaggattcatcaggagatcatatttcagcaaaaacagttagtgagttaacaatgtagtaccatagctttgcagaaatcccgaatttgcattttggaattccgtgtaggcatttaacctctgagtaagaaaaatcttcagaagttggtaaacaggtgcatatttagcatccttttccaattgtgctacggctggcaagtccaataaatcacactgcaagatttaagattgccatcgttgaaattccaatcaaatataaaagagcagtgtcaggacaagaaagacaaatccaattcacattatgatacctggaaaatactggaagctttgacaaattcgataactgcacgcacagcctcctccttggcttcatccaggacctgagcatcctcattggagaaagttgctaggtacttcgtcaagaacttaagggattcattcaccaagctggagtattaatagaaaaaaccatgaggctattgttatacccaaacggaaacaaaaaaagaaagagacagagaatgactgatgagcatagttataaagtataaattatgtttcaataccttttgttttctttcagcacattagcaatggcaagaaagagttccctctgatctttaatgtcaatattccactctttcagaaagttatcgatcttcttaaaagaagaaactatgtactcagtaaccttcccatcaacagctagtgtaagagctttcatgtatacttgaaatcgagcatacgggtggtcaaccaggttatagagattgaagaggctacacaaagattaagacaaaaaaaaaatgagaagtgtgataaatgagcaaagcattcagaaataagcagaaacgattcatacatcttcaaacgaagtgaagctttgtcactgggttgttgagcaaccttggaagctatagctttcaccatttcaaggacttgctcagggcttttcgcattcttgacaatgctgcaaatgatggtgtaggtacactcaagatctgaattaaaaaaagatgcaaatcactgagaattgaatactcgaaagacatacaaaataaacaggtataagtaagaataggaacacaaacctttctcagatatcttagaagataccaattcagctgaagtgaccattaacgaagacaattcaagccacttctctgctaccattgactcctcagcctccctacagagcctggtaatttctggctctgctgcctaaaatttgaaacgataactagttaagtacaggcaagccttgaaaacttaagaagtcgcttaatgaaactaatcttagatggttgaactaatcggatgcatcagaatcctcaaagattacaaactattctagtccagaaactatcaacaaacccttccataaccaatcagattcttcgaacgaaacaacatataccagatcaaatttcccatctcacttaagatagacattcttaaattcccactataaattcacaaccaaggtgtggaggttacctcgggaccagcatcggcccaggcgagctgggaagtgaatcggacaacagcgagaaagggattttcttcggaggtgggaacaatcgtcgtcatagcttagctccggtttcgaatcttctcggctgcgctgaagaacaaatgcaccacaattacaacttgtttcagcagccgaccagcagagacaagagagagagaagaaaatgaaaccctaaatctctatatttttttcttttccggttaaaggtaaccggaaccgaatacgattcctaaattaacggtttacctatctgacggctaataaattatgagaaaactccaacggtcaggattgagctctagtccacaacccttataaaaatcgatttcttcctcagttaacatttgagaagattagggtttaaacgctgccgtgttccgccggatcgccaccgttgaagtcaagatggtacttttactctctccctctctgtatcctttgttctatctctcttaaatatttccttcgcctgatcgatttcatggtctctgatattagccgtcgcacaagtcgttcatg

SEQ ID NO: 16374 - DNA, 3000 bp, Unknown; identical to SEQ ID NO: 8119
  misc_feature (1)..( 3000): 2750-1469P.txt file - cDNA_ID_1398634; gDNA_ID_1621194; Annot_ID_174673

SEQ ID NO: 16375 - DNA, 3003 bp, Unknown
  misc_feature (1)..( 3003): 2750-1469P.txt file - cDNA_ID_1398698; gDNA_ID_2096294; Annot_ID_195483
aaactagactcctggttttatggtctgccatagaatctcttcacacaacacaaccttttttgtattttcttcttatcgttgataatgttctagaattagggcttttattgggcccagtgcaaataaagtggataatgcataaataatactttttaaacacaaattatgggccttaggattggtccattagaaaaaccttatgatagataaataatgtggcccatcaatgtcacctccatctccatatacatatctctcatcataaacagccgtcaaaacaacatcaatggcaatgcacactgttcgattgtcgccggcgactcaacttcacggcggtatctctagcaatctgtcaccacccaatcgaaaacctaataattccatcgtccgatacggatgcggatcttcgaagcgtttccgtatcgtaacggtcttggcgtcactccgggaaaacgatgcaaacggaagggataactccgtgagagctatggaagtgaagaagatctttgaagactcgcctctgcttcctagtacgaatccccactttcgattcctttgagctgtgtgacagatatcttcttcatttgcagtagacataacgtatatatgtaaatagtagcagctagaatttggatttagtgatgattagttcgtttttgtttgaataatagagccgttatcatcgaaccagctcacggaatctgtctctaatggctcccgcgttcgtgttgcgtatcaggtaactaattcaaaggaactgaattgtttctgagagtcataatgttttgggactttattggctaatgaatgattctccaattagggagtacgaggtgcatacagcgaatcagctgctgagaaggcttatccaaactgtgaagctgttccatgcgaagagtttgacactgcttttgaggtcagaatctcgttcctttactgatcaagactgaaatgatcagtatttcattttcttaagttttggttgccattagtcttgctttgttcttgtttaggcggttgagcggtggcttgttgacagagctgttttaccgattgagaactctttaggtggaagcatccatagaaattatgatcttctgctgcgacacaatttgcatattgtaggcgaagtcaagctagctgttcggcactgtttgttggctaaccacggtgtaaatattgaagatttgagaagggtgcttagccatccacaggtatgccacatacctttgtgcataatcgagttctttttctcttggcactatttaaacccttcttcgttgctttggatcaggctcttgcccaatgtgaaaacacgttaaccaaattggggttggtcagagaagcagtagatgatactgctggcgctgcgaaggtatgttttatgttcctagtatgtttatatattcacactcacaacttacagtggcagctaaataagtttgtgaatttgattcgcagcaaattgcattcgaaaatttaaatgatgcagctgcagttgccagtgaaaaagctgcaaagatatatggtttgaacatagtcgctaaagatatccaggttttaaagactttccgaatgccttttccaatttttcatccatatttttacacttctgctggattatttgattgtgaagttcaatcaatttaggatgactgtgataatgttacaaggtttctaatgctcgcaagagaacccattatccctggaactaacagactctttaaggtgagaaatccagtataacttccatctgcaaaggcaactctaatttctggcaatgtttttttttctctgatggaatgagttactttgattcttgtagacaagtatagttttctcgttagaggaagggcctggagtacttttcaaagcgcttgctgtgtttgcccttcggcaaatcaacctcacaaaggttttgattaacacactcaaaatcttccttcattatgtgcagccttgtttccagtcccttacaatcaattttattgtggtttcgatcagattgaaagccgccctttaaggaaacatcctctccgagcatctggaggactaaagtaatttctctcacaaaaccactgttaagtctataccgtacccagagtgtctgagcagtgatgaaagtgtctctctttctgtgcttgacagatactttgactatcttttctatgtggactttgaagcatctatggctgatgaagttgctcaaaacgcacttaggcatctcgaggtaaagcctttggtcacttgatctgaaaacatgtacatgtgactaagactctggattttgttattggcaggagtttgctacctttttgcgggtactgggaagctacccagtggacactacaatgctctaaacatttcaaacatcttcttggtaaatagttcattggtttgcatttcggatctgagttagtaaaattatatcaagtgaggtgaaatatttgaatagtttgtgacagagatccgcttgatgatatcataatcctggtataaggagctatatccctgaggtgaggtctgagaggagtcaccaccttacaagacattccgctcttgttacaaattctgtttagttttccaaaaaagatcatctttgtttttagtaagaatgtagtcactaagtcagatatcaatgacaaataccaaagaactagtgttttttcgtgtttcatccatacatagatacttatcctgtgtcttttttagaaatttctttttgtatgacgtttcaaaattttgattgactattgttagtggtatatctttgagttaataaacgagatataatctgttttcctgttcacaaaaaaaaaaaaaataaaaaaatcatatatcatccaattttcttttggttcagattttaaaacattgggaaaaatagggactagatgacaaataacaagaaatcagaattttggaaggattaaacaataatcgcttcttgtgcaataagccaaaaacaggattaaacagattcgctcagttctcaaaacgatg

SEQ ID NO: 16376 - DNA, 3003 bp, Unknown
  misc_feature (1)..( 3003): 2750-1469P.txt file - cDNA_ID_1399019; gDNA_ID_2926278; Annot_ID_143590
tattaaaaatcatccacattctccgtgccaatacatgatcggatcaaacaagccgaagcagtgaccataaccgccgcgaaaatcgaaggcacaaacaaatcaaaacgcgatctcttcaccatattagacggcacgcatatactctcccctgcaaaatccatcggaatcttcacgaaaccatctcctcctccgcacgaagacgacaccgtagacacaaaagccatctccggagcaaacgaagcgacggccaccgtgaacattagaagcaccgtccacgtggcagcctgagcgatgaccggccaacggtcagagacactccgtagaaacggctccattagcgatggaagacggtgatacatcttgatcagaagaaatggggattgttttagcgtggatcaaaagaaattaggtgttggtttgcgaggaaacgaaaagattgtgagatcgatgagcaaaaaccagagcttgtttgattggtgcggtttatgtgtttggaaacggaaatgaaaatggaaaggctgcttctttgcacgtttaactaactactcttctttcccatacacacacacagagagttgttaattacgaatttacccttccctttgaactcttctcttcttcttttgcccttccgggtcgtctccttcccctttgacactcccacgttttcagcaatatcaatttttgtttaatcgacggctgtattagttggttgttaagaaatttcagactcgttcctccataattcagatataggaggagaacataaactatattatatgattatggagtgatttatgctttatgttgttcaccaaaaactattcattaaaattaagcgggttcacctaaatctgatgcttatagcctgcttgtggcacaacgataacgataggtaattcaactactaatcttcaattttatctatttcaatgactccaatcatatcataattagactctgttcgttataagaaggtaagaaagcaacatcattgaaggaaaagtaggccaatttcgcgtatcaaataatataaacacacacatataacatatacttcaatagagacacatttcaatatagtgattaggtaaatgaaattgaaatggaaaaaaaaatcgttaaaaatatataatccaacattgaaattcataaaaggaaggaacaatcttctctacttcctagagttacaaagccacaaaatacgaagttaagcgaataatgcatctaatttcctacaagtactaaaaaccaaaccgaaattgaaatccctaaaaaccctaaccgggtctcttcaagagctagtaaacttggtaaccgccttggtaccttcagagacggcgtgtttagcgagttcaccggggaggacgagtctcacagccgtctggatctcgcgagatgtaatggtcggcttcttgttgtacctagcgagtttcgaagattcctgagctagcttctcgaatatgtcgttgatgaaactgttcataatccccatggctttgcttgaaattccgatatctggatgaacctgcttcagaaccttgaagatgtagatcttgtaggtttcgacgtttttcttagatcgcttcttcttcttgtcaccggcttcctttggtggcaatttcttccccgccttgggtttcttctccgccggagccttttcagcagccttgttctcttccaccggtttctcagcggcggtttttttctcggcgggcttcttctcggctcttggtgccatcgtgaattttctttctgattttctcgggaaaaggaagttgattgaagtagtttagtggtgaatggtgataataggtttactcgacgcttttagattttatagagaaggaacaaacgtattctattggatagaaatcttcacgaggatcattgacgtgtatatttctcattcgttaaatttatcaatgctcaaattagatctgacggctgagagaaacatcattcattcatttttacaggttcaagttatagctttgataggcttcaatggtcgtgacaaagaacgccattgggcctgaaatgaagcttgagacgcagcgcataacacatgtcaattggtttctttgattttccctagtataaaaagcgataagaaaaccctagctcaccttctcttcttcctctaattgcttttctccgtcactgagtaccttgcctctcgagctcccaatcttaaggtacaattgatcttcactatagtcgttcagaatctgatctgcttatcgaaatattcagaagtgtgagatagctgctaattggtctttaatttgtcttcttctcttgcttcacatcagaaaatttaggatcttagagcttttttgttgatgtaaacatttcatagtgaacttaagaacgcttttcgaattagttagtcttagctctattttgtctgtgtgtgtattttctgacgtattaaccacgagacctatgtttcaatttctataagtgatttcgttttacattttaaaagcttgatttattcccattgaaatcaatattcatgatgcagaattctgtgcatttgtatcaaattctaagtgctttgcagattttattttaacgcaagctcttgtttgttgtttgacttgtttagtagaggattgagcttaaggcaagatggtaagaaacttaaatatttattttgaatatttgatcaattatctatctttatgaattattgatcaagaaacaaaatttaaagaacatcggggacttgaaaaagtaatggaaatttcacaaaaccgaaaagcaaacggttaattcggttttacaaagaccaaacagaaaattcaataattcggtttggttcggtttaattacacctaacaaaaaagttggtatattcgtttttatttttccgccattcttgtcgatcttcttcagtcgtaaaaccgccgcgtctctgctgaccctcctcttctcatttcatcgacgggagaaaatctcataccatctgagatttccaacagtgaaattaagatg

SEQ ID NO: 16377 - DNA, 3003 bp, Unknown; identical to SEQ ID NO: 16376
  misc_feature (1)..( 3003): 2750-1469P.txt file - cDNA_ID_1399019; gDNA_ID_2926278; Annot_ID_205401

SEQ ID NO: 16378 - DNA, 3003 bp, Unknown
  misc_feature (1)..( 3003): 2750-1469P.txt file - cDNA_ID_1399068; gDNA_ID_2214506; Annot_ID_133757
atttaagtgatctgaactaacgacatgtgtacgaaattaattatctgtttctttatgggtcaaagattaaaaatgctgtgcttctttctctatcagactatcacatggaaagacgaaacgaaatgagagtttttattacctagcagctcacagttatacataattaaattcatagaccgacaaatcacagttttgagaaataagtaaacaaaagtactgaagcagcgagcatttgaaactccaaagaccacaaaagatcacagttagggacaaaccatagctaaaacagagtcttctttaaaaacaatccgatgaagaaaaaaagttgaaaaacaggcaaaaattttacagatggaagacgataactgatcgaatcatgcaaaggggcttgaggacattttttagtagtgtgttttgttgttctctatcgatttgttgttgtgttgttgttgccaaatctaacaagagcatcctcctgattgctgctgagcgagagatgcatttgcattggaagacttgagattgacatcaaccatatcctcttgctttgttgaagacaatgtctccattcccggcaaagctgctgctatcttgcggaagagcgcctagcaatacaaaaaggtttgaaatcataagaaaacaagatttgcacggagtgatagcgttatggatttgcggtaattgtttagagagtatcagtgaaagatccatacaaatgaggaggatgtaataatcagcaggttgggttaaaaatttataagtctaggttaattaactattgaatattgatggaactaaacaaagttagggcttagttgaactaagcagcaagtttttgttgtgcaagaaaccctcagaaatgtgtcaagccaagatctttgttaccttaatgttgaagcccgctttggcactggtttcgatgaacattacattaagttcgcgtgccttagcttctgcttcctctattgacacttgcctgagaaacaaaatatttaatacaaaggcccaattggcagtaacaaatgtagtaggcaccatcaagtgtcaaagcgtgttgactataaagaaaccctgtaaagatatgcagttgagcagcaaatgattttccatttattatcttgtagggtcgtttggcaacatactcaataccaccagaaaagtaagacgtggtttaacaacagtttgtacttgagtaaaacaaaaaagacacccattcgtcttgtcaacatacttacgaaatcagagcgtgtttaaacaaggaggactaccaaatttcagtctcaattgctattgaacagtaatttgcacatcatggtttaacaagaaacaagtagaggaagagatggtagatcattattaccttttgtccactagatcagttttgtttcccacaagcacgactatgacatcactaccacgttctgtcctaacctcatcgatccacttagtagtgtttaggaaggactgcctgcctatatgtcagtggaaaacaaaataaatctcgagtttcacaacgcacaatggatcaacataaagaagaaatcgaaacgcataaattcataagattactgaaaaccacatccccaagatctcagatatgggaaaatattcatgtgtttgagagaacgagtgaaggtacacatacttgcaacatcatacacaataacagcaacggaggaatccctgatatagctcggaattagactcctgaatcgctcttgcccagctgtatccctgtcatatgatttcggctctcgatgttaatcatcaaaaaatgatctgcaatgttattcttcagtattcgaaaattgaaagaggctcaagatcttaccacaactgaagtctgaccgttcgatcttcaaggtacattgtctttgatagaaaatcaataccaattgtggcctgatgattatgaaacaacataaaaactacttagaaaaggaagaacattctgtaaaatgacgataagcaagcatggttcacatattattaggagcttaaacgtaattctcataatcacagaacaagatcagatgctttcattcatcaattgagaactaattcgattagataaacaatgataacatgatcaaagaaacatcctcatattagtgttactgcgatcttctattggactgaattctcgactttgtacaataaacgagagtgagcgattacgatgccaaaatctcattcagctgattgttacgtcctatacattgactaaaacacgatctacaaatcagatcacacataattacgcaaaaccaaacgcccgatcacgtaaacgagtaagaacttcgaactgaaaaacacgattcccgtccatgaaaacggatctcaaaatcaatcaaaccctgggattttcccgactataatccctcaaaatagaagcaaacgtcgtgcatcgtcgagataatacctagatttgaacaatggaaatttacctggtaagtgttgtcgaatttgtcgtacatgaatcgagtaatgatactggttttgccgacggattgatctcccagaaacaccagcttatacttagcgagtgccgagaccggagccatgatttctcaaggatctaactcgccggacggatctgagaaacgtcgagatctcgctttgctgagaataaaagtttccgatatttaccggagagagatcccgtcgctctggaattgcaaatactgtattagtgagagtttgttattcgtaaattgcagtttattcctcgagtgacccaattgggtcatttatgttaaattagaaactatttgagataagttacaaaatatataaaaacttagaagctgattaaggaatttactacattatgggcagcatttataagcccacgtaaggatttgggctagccttatagtagggggcacgtgtcatctcgtatgacctgaactatttttgccccttttggctacttgactcttctgtgtctctctcatcaaatcaaatccctaattctcgagctcgaagaaagagacgaaaatg

SEQ ID NO: 16379 - DNA, 3003 bp, Unknown; identical to SEQ ID NO: 16378
  misc_feature (1)..( 3003): 2750-1469P.txt file - cDNA_ID_1399068; gDNA_ID_2214506; Annot_ID_184121

SEQ ID NO: 16380 - DNA, 3000 bp, Unknown; identical to SEQ ID NO: 11121
  misc_feature (1)..( 3000): 2750-1469P.txt file - cDNA_ID_1399134; gDNA_ID_2214479; Annot_ID_133202

SEQ ID NO: 16381 - DNA, 3000 bp, Unknown; identical to SEQ ID NO: 11121
  misc_feature (1)..( 3000): 2750-1469P.txt file - cDNA_ID_1399134; gDNA_ID_2214479; Annot_ID_183257

SEQ ID NO: 16382 - DNA, 3000 bp, Unknown; identical to SEQ ID NO: 861
  misc_feature (1)..( 3000): 2750-1469P.txt file - cDNA_ID_1399202; gDNA_ID_1620330; Annot_ID_153608

SEQ ID NO: 16383 - DNA, 3003 bp, Unknown
  misc_feature (1)..( 3003): 2750-1469P.txt file - cDNA_ID_1399210; gDNA_ID_1621088; Annot_ID_170569
aatcttttcgacgtgaaaaatattattctaaattatttatcgcaaatatgtttccttttactcttatatataaaccatgagctttttaaacccaaaatatgttagatatccatctctatttccaacgtcggattataagtccatgttttcatattttacatgataattcgactctagacaagttaggctggtgacattggactacttcactaccatgacaaagaaatatatcccataattttgaacaccactaagaagataatgtcatcaatatcttctgttgtcatttaattttccactcttaatgaaaatatattcaaaatacacaattacaaacaactttacaaactaatgttgaaaggttttaactcattaataactacccaaaccaaaaagggtactataaatatagttaatcatctaatagtttctccaaaattcttatacgatcatatatgatatctatagatagatgtaataaatatattagatgacacataattgtcacctctgatcatctagcctcttcccatcacatgccattaatggacctatgcggtgctgatagtaacgtataaccatgacgacgtctgagactcagaggatcttactctaacataattaaaaacataaacttgcactagtgaatttgtaatttcatataaggaaacattttggagcaataaacattatatccttttttcctttccctgtatattgccacatttatgcacataaaatcagctcatatccatcgatcggtccccaatttttcaatgattagtcaattttttcttccttttgataaccgctgtggtccaataagacaagtgaatagggtccatttagggctagcgtacgtggtacatcgcatgttcactatcacttatgagcgcatgcaagtgaaattacatgtcaaaaaaccttacgctatatataagtgtatatggtatctgtcaacattactatacaaaacaaatcttttatttttattgatcacatattttgtcaaaaagtatttgttttgtatcattaggcccaaagaatgtttttgtgtcagttttcttttcctaataaaacagaagaaataaacaataagattcaacttttcacagttaatacagtatttgtaaaaattctgaacaacagattttcaaaactacgacatttaaaattagaacgaagattaacacgcattagtgagtatcaaacgaattcaaaaacttatgtaaatataccaagaatatgtaattataattaactaaacatttttaatttttaaattaaaatgttaaatttcaatgctatttagaacattttggttatgattattaaaatcgtgacacgatggatagtaactaaatgaaagaacaaataggttgaaagctatagggaaataaataaatgaacggtttatagtaacatctttatcataaagctggactgtctcgttgtgatataaaacaacgaagataagtaaggagatttagtactgttgtcattcgccaacgtcaacttcactaatgatcactagtccttttagtttttagagagtttccatcagaatttgcaaacgtaattacaaatattgggccttaatttgaaacctacatagagggccgagtatttgatgaagcccaatcgtctaaagtcgaaaaacatgtaaatagtcaacacacagtgaaaatataaacatatgtaaatacgtttgtgatccaaattaaattacgatgataagatggaacaacagaagctaaccctgagatcatcttctatgacaggtgttacttagaactagtctggatagggagggagatatgtgtcctagaaacttcaaataattcaaactctattatcaaaaaaagtcagaaataaatatagtcttgaatcagttatgcagatctcgtttgttatgtttttggacagtcgacgaaagaactcctagttaattaatattatctattacaatatattctcgcaaaattaagcttatatgtgacagctagagctcagcgttgatattgcctccacacttacattatataattctaacgggaattatatacataaactataatcatgattagcacgaaatgtacgaagaaaagtctgaccaattagttttatcctacacgtgaagacttgaagttgatatgtattaccaatatatcatcaaattattgatataataataagttgttgtttggtcgagaaagcgtgcttgcatgctataatgctaattcatatttaaatgctttgttgctttgattcgctaattaacccaaaattttgaaaatgactcaaaacaaacatacagtttttacatatactattctgttgatcgtgcatgcagagataccacagtttttctgaaaacttcaatattccgctgacaaaactaatatttcacgtgttagtttttagttttttactaattaagacactagactaactgattcctactaataggttttctaatgtaaacaacataagagactctagctagaaaagagaggaaaaacaataaaagcaaatcttgagatcttctcagtcaattgacagatgtctttagaacaagtctaaatagtggattgagaagggaaatgtgtcacagcaaatccaaaaaatccaaactcatcagtttttgaaacttttggacgcaaaactcgcttggctgtgttattcattatttcaaagtccacgaaagaaaataattgtctcgtaaattaattaattaagcttatgacagctcaaggtcgacgacataattgattttgttccttactataaattatctattcaaaggaaaatatatactagctatatatataatccttattcgtacgaaatgtatgaagaaaagtctaaccaaatatttttttcgtttttttaattaaatctatacgaaattgtgcatttatatatcttgacctctatatccaaaactttaccaaaatctcgatttataatcttaactcaaaagaagatcgatcaactattatg

SEQ ID NO: 16384 - DNA, 767 bp, Unknown; identical to SEQ ID NO: 505
  misc_feature (1)..( 767): 2750-1469P.txt file - cDNA_ID_1399782; gDNA_ID_1591502; Annot_ID_151078

SEQ ID NO: 16385 - DNA, 3003 bp, Unknown
  misc_feature (1)..( 3003): 2750-1469P.txt file - cDNA_ID_1408073; gDNA_ID_2214481; Annot_ID_133272
agtatagggtctgagagattcatgttttcctcttctttttcaggctgtaaacttacggacagcagccattcctcgtcctcaggtaccatctgaattagaaaaaaactatctacaaaccattgtttctcgttacgttttatacctcaataattttgtattcgtgttttctagtatctttcaagtagtcaaagagatgccttagctgaaatacaagatgttcttcgaacagtatgtcatgcacacaagttgcccttagctcttgcctggattccttgtagaaaggatcaatctataagggtttctggacaaaaatctggtgaaaattgtatactttgcatagaggagacagcttgttatgtgaacgatatggagatggaaggctttgtgcacgcatgtttggagcattgtctaagagaaaaagaaggaattgttggtaaagctttcatatccaaccagccgttcttttcttctgatgtgaaggcatatgacatcagtgaataccctattgttcagcatgctcgaaagtacggtctgaatgctgctgtcgctataaaactgaggagcacttacactggtgaagatgattacatacttgaactgttcttgcctgtaagtatgaaaggaagcttggaacaacaacttctattagacagcctttcgggtacaatgcagagaatttgtcgaactttgagaactgtttcagaagtggggtcaactaaaaaagaagggactaaacctggatttcggagtagtgatatgtctaatttcccgcagacaacgtcttcagaaaattttcagacaatatcattggattccgagtttaactctactagaagcatgttttcgggtatgtcctctgataaagaaaacagtatcacagtatctcaaggcactttggagcaggtatgtgatttatgcaatttggttattctgtaaattttgtgaaacagttcgttaaactgaacactgatatttttccttacaacttttcataggatgtgagcaaagcaagaacaccagagaagaagaaaagcactacagagaaaaatgtgagcttaagcgctctccaacaacacttctctgggagtctaaaggatgctgcaaaaagccttggtggtgagacttccgcatatttccaagcatgggtttatttttgttagcacacaaactatctgaccctcgacttggattttcttctgcagtttgtccaactacattgaaacggatatgcaggcaacatgggatcatgaggtggccatctcgtaagattaacaaagtgaacaggtcactaaggaaaatacagacggtactggactcggtccaaggtgtagaaggaggactaaagttcgactcagcaactggcgaattcattgcagttagaccttttattcaagaaattgatacccaaaagggtctgtcgtctcttgataatgatgcacatgcaagaagaagtcaggaggatatgcctgacgatacttcattcaagctccaggaagctaaatctgtcgacaatgccattaagttagaggaggatacaaccatgaatcaagcaagaccaggtaagaacttctctatccataaaccatagatggagcgattagaatcttaatccattttcagtttttgcaggatcattcatggaggttaatgctagtggtcagccatgggcttggatggccaaagagtctggcttgaatggcagtgaaggaataaagagcgtttgcaacttaagctctgtggaaatttcagatggaatggatccaacaatccgatgcagtggcagtattgttgaacctaaccaatccatgtcatgcagcatatcagattcatcaaatggctcaggcgcagttctgcgtggaagctcatctacttccatggaagattggaaccaaatgagaacccacaacagtaatagcagcgagagtggatcaacaacgctgatcgtaaaggccagttatagagaagacactgtacgtttcaagttcgagccatcagttgggtgtcctcagctctacaaagaagttggaaaacgttttaaactgcaggacgggtcgtttcagctgaagtacttggatgatgaagaagaatgggtgatgctggttacagattctgatctccaagaatgtttggagatattacatggtatgggaaaacactcggtgaagtttctcgttcgtgatttgtctgcccctctaggtagttctggtggcagtaatggttatcttggaacaggcttatgacgtcgtaagacatagacacacacagttatgtattcccagtgaaagaatgttgtttatttctctagatattagtatgcttataaataggcatgaaggagaaagacaattttggtatagtggagttcagcagaaaatgtatatgttttttcgttttatatgaatcagagaataaaagttggatgttatatctacgttgctaatgttgtacctgctcacccatctttcatataagaaaagagaacacttttagttatccctgtgatgcagaatcgtattctttgttatctctccattcctgtggaaaccaacaaagtcaactaaatttcggtttaattggttggtttttaagtcaacgaggacttgattttagttgggcttgggcctataattgtgttcatcattgggttttttcccccttatcagtttaacgtccatatccatatctttttctttttttaacggcaaagttcatatccatatcttatgatgtgcctaaaagagggagaagatgcgaagacagaattttcatatttgaaagggttcgatatcgatattgggaaacgaatcaaggtcaaaaaactcagtctaatagttgaaatttaaaaattttattaattcaatccgattggtttcgttttgttatggttcggttctatatcatcaaaccaatcggtttggtcctaaagataattataaatattcaccaacaccagtgttaaacacatatcaacaaacctaaagttagataaacaaagagaaaatg

SEQ ID NO: 16386 - DNA, 3003 bp, Unknown; identical to SEQ ID NO: 16385
  misc_feature (1)..( 3003): 2750-1469P.txt file - cDNA_ID_1408073; gDNA_ID_2214481; Annot_ID_183359

SEQ ID NO: 16387 - DNA, 3003 bp, Unknown
  misc_feature (1)..( 3003): 2750-1469P.txt file - cDNA_ID_1411691; gDNA_ID_1620775; Annot_ID_167663
ttggtgaattttctcttcttcttagagtttctttccctgtgtggagcagcactaaacagaccattcaatttgtctctttcaggttcaccctcaatggtatcattgttccttctagaaagattactaacttgatccctcatttctgatacactcccaggaattgggtctgattcacaagcttcttctgtagtacagggagcatacactaaagcactcattgcttcagcagcaatttgagtgttaataccaatgtcaataaagtcttcctcgggttccaagggctcctttggcgccttatcctccaactgagcatccttctgtgagataaacataatgccctcactcaaacccgatgcttgttccatcttgagatgctttgcagaactgttcttcataactctttgtgtgggatgacttgagacttttctaatatcacacggatccctagatcgtttcttcactccaaaatcatcacctgcaacctgatcttctcttatcttggagcatgtaatacttgcacgagtgactggagaggttttagggtcactcacatcacactgatcactactccaatcaaagacactcattttcctggttggacttctgctcataattcttttggccagagattgacatccttttgcacctgatacaggagatgacttccttctgcaactattaaccgggagatcaactggagacaaatttagatctttgtccatcaaaaagtggtcaacaaaaccaagggcatctgcttgtgttgactctcctggttcttgagaatccaaaaaatcaagccctggaccatggctactagcagtaatccgcaatgaaccttggaaaccggtcactgtatcacaatttgattcttgcttgccttgaagaaagagatgtagtaagatttatctgagttaatacaaagaagaagatagaggcaacataacaacacaaggatatgtttacctgtttgacattcgtgatcatttgatccatcagactccaaaagtatatctccagctttcgggcttagctccggcaaacacatcggctcaccagcagcgacacttccatcttcatcatcactatcatccaccaccacttggtcgagaccgtaacattcctggttcagtgattcctcgtcaccacaatttccgttatctactagctccgtatcgtcgtagagcacttgaaatggggtttcaagtaacgagctattaagtactaatgcttcatcaatcgcctctgtatcttcaatttccccacatcccaaaatccgattaacctcaaaccctaagagaatccagaaatgaaattggtactacgaatctatcacctcaaaaatctacaattatcagcaagaaaaagaaaatgtaaatgaatcgtaatctcaaaactcactatgatccgaagaagctgaaggagactgcaaatcggaggcgaaatcttcggtttccataagattgaccatcgaaactcgaatttcaatgctgtccaagaagaaatggaatcgctagaagctcccgattcgtatacggttggaatcagagaagaaaccctagaggttccattggtgctttagtcgaggtgattggcgggagagagacgagtacagagctgtgtcgaatggttttgaaaagctcagttccgtgaaacgatattttagttactatatatatttaattatgtcaaacgatacatcaaatagggcatttggtctagtggtatgattctcgcttagggtgcgagaggtcccgagttcaattctcggaatgcccctctattatcttttgttttttgggacttgaaaattcttacctcattttcttctcagtatttccactatgttcttatccctttaatcttcttcacctatgttgcaggaaaaaaaaagattatatattatgtcttctagaaggaaaccaaactacttattcgacacctcataaatgctttgctatttttctactctttgtgtgcgatttggtgaagaatctttgagaatttggtcaaatgaacatttaagaatgttacaatttatcgacatgtcaaagattggtaacactttggttttcttttccatcccatgaatgtgaacttgcttacttaaaatatttaactgtaattttataacattactttacgatattaattaatttagatttaccagcaacacatggtattaggattgtgtacctttgtaattgttgatatatgagtcacttgttctaagaacacatttcattactttggattttgaaattctaagttgaaaatctttgttttattttcttggctagatttgatgcgtgtcataatctaatccaatttgaaaatatgtaatatgttgtataaaaagttaatatgccaacaaaaggatagatcttagttggtggaatcaacaccattagatatcaaattggtcgtatgcaatgtttctgtataatatatcatttgtctactgaataatatatatcataatgttaattgttagctttctgtcgggttatgaagatggtattggtaggtacgttgtataacataagaattgaaaacgtaaatattattcattagtagacagctcataataagcacacccacacatgcatgccacaagcaatagaggttttttaaaaggttttcttcttttaacaaaagaaaggcctttctttgatttcaaattttcaatgatattaatattgcaataaaataccatgatataacatattttagatttatattaatgatttatgaccccaaaagaaaaaatatattaattaaaatatgtagttcaacaataacctcagcctatatggctattatacaatcttgttttgggaagaaatcaacacatgcttatgaacttttatgttcctttttttgtcttcattagcaaaagataaagggatcaagccttttttacaaacacttgcatgctagtatgcttcaggttcaatcaccgccccattagattctctctccctctctaaagaccacacctttatg

SEQ ID NO: 16388 - DNA, 3000 bp, Unknown; identical to SEQ ID NO: 909
  misc_feature (1)..( 3000): 2750-1469P.txt file - cDNA_ID_1411707; gDNA_ID_1620336; Annot_ID_153783

SEQ ID NO: 16389 - DNA, 3003 bp, Unknown
  misc_feature (1)..( 3003): 2750-1469P.txt file - cDNA_ID_1411786; gDNA_ID_1621125; Annot_ID_172274
agatatcaaaactcctagagagatctaataaaaatgaagtcttttacgttcttgattctctttctctttgcagcacaatctatcagcgtctatgcaggcagcttccacaaagacgttaagatacattggggtgatggtcgtggaaagattcacgataatcaagggaaacttctatctctctcgcttgacaaatcctctggttcaggtttccaatctaatcaagagtttctctatggtaaagccgaagttcaaatgaaacttgtccctggtaactctgctggaaccgtcacaacattctatgtaagtaacatgtaacgttcttgtcatgttttgctatttcataaaatgttcgtaccacttgcttatatgatgttctaatttgtgtagcttaaatctccgggaactacatgggatgagattgatttcgagtttttggggaacataagtggtcatccatatactctccatactaatgtttacacaaaaggctcaggagacaaagaacaacaatttcatctatggtttgacccaaccgctaactttcacacttattgcatcacatggaatccacaaagaattatgtaagtgtcgaaactccttcctttgtaccatacataatatttatgtttgaggatataaactcatgaaccaagaatcttttattctctccagttttaccgttgatgggattccaattagagagtttatgaatgccgagtcacgtggagtcccattcccaacaaagcaaccaatgaggctatatgcgagtctatgggaagcagagcattgggctacaaggggaggattagagaaaacagattggtcaaaagctcctttcaccgcttattacagaaactacaatgtcgagggatgtgtatgggttaatggaaagtcagtttgtcccgcaaattcccaatggttcactcaaaaactcgattcgaatggccagacaagaatgaaaggggtacagagtaaatacatggtttacaactattgctccgataaaaaaaggtttcctcgaggtgttcctccagagtgcagctaaatgattgattctttgattcataaataagttacttgacgttgtctttgtaactcaatggttcttcttatctataatttttcaattcatttgttaccaaatatatgcgtgtttgtgtaagatcttttttacaatgaacaatgagttcttccattctaaaaaccttttaaaacatgtcgttactatatacgtacaacgatacttggggataaattgaataatatataaccttacttgatggataatgaatggcccaaatttcgacctttttctgaataaaatagaattttttccaggttttgtttcaagcttagtttcaagcgcagtaggatataggtatttatactttaataaaagaattcagcgtgaatggaggcgagaagcggtgcgatattttagctgtgttgaacgtccatatcccaccatatcttcatttagcataatgcatgtgagtatgtgacacatatatttatattattgtgcatttgtgcttccatagaggttggcatcttattttgtatgttaatgtgcggatatttagttgattaatcaaaaacactttgaaaaacataatataattaaattttattgatcaattcaacagtctttgtaagaaaaattatttctgtaattggaagtgtttttaaggtttagttaaatatgacgactattatgctcttttgtatcgtttttttttggattgaacgctaaactatacgagtgcatgggtgggtctgtttggtcgtaactcgtaaaataaataaacatcagaaccctctatgcggcggggagggtttgcgcttaagtcaaaagtcagaagccgtgttgacaaataacctcaacgcaggactagcatgtgatatacattattaatatctctgttttgtaacagtaaacgagtaaagaaaactaaatattgaaggacatatataaatgataagcttactactttactagttactggttggatgacgcacgtactggtccaagattcaacatcacaattttttttacagtccaaatttccaaaatatactttatttttgttcaaattaaaggaacatttttcttgatctagatatgtttgttatgtttaaggttcgtttcaagctaatattaagaatggcttgtttcaatgtgaaaaaggttatgctcatttgtaaatggatattgttaaatcagtttaagaaagtttcctacgcactaaacgtgtcaaactaaatctcaaggctataacttattttatgtattttgatcgggtactagctttaatcatgctgttacaagattcagttacattctattacaccgtccaaacttatgttgttatcttcacccaaataaaatgaaatgttttctgctgggagatcgattaaaaccaaaagaaattatatttgacaagactatcagccaaattaaaatcaagattcaactatggaaaacttgtagctatttttcaatacctaagttttaggaaactttgccattatattggtgtttatctaaggattagaacatttattttagttaaattaaatcaataaatcgtaaagttgttaattaggaaaaaaagtattaaaatgcaaatatatttgtcattcgaacctctatgcggtggggagggtttacgctcatgtttgaaagtcaaagcagtgttgataataatctcaacgcgggaccagcatgtgatatacgaatgtctatatacattattttctctgttttgtaacaataaacgagtaatgaaattatattttattggtttcaatttgtaacaaccagcaagaggtctaatgagccaactagaatacagcccacgataaataatcaaacccatgaaacttccttctctctttcctttgccatttccaaacactatataaactcatgtcgcttaactcaatttttcatcaacaatacatttgagatatcaatacacctccaaaatatatacaaaaatg

SEQ ID NO: 16390 - DNA, 3000 bp, Unknown
  misc_feature (1)..( 3000): 2750-1469P.txt file - cDNA_ID_1411786; gDNA_ID_2926197; Annot_ID_141342
tatcaaaactcctagagagatctaataaaaatgaagtcttttacgttcttgattctctttctctttgcagcacaatctatcagcgtctatgcaggcagcttccacaaagacgttaagatacattggggtgatggtcgtggaaagattcacgataatcaagggaaacttctatctctctcgcttgacaaatcctctggttcaggtttccaatctaatcaagagtttctctatggtaaagccgaagttcaaatgaaacttgtccctggtaactctgctggaaccgtcacaacattctatgtaagtaacatgtaacgttcttgtcatgttttgctatttcataaaatgttcgtaccacttgcttatatgatgttctaatttgtgtagcttaaatctccgggaactacatgggatgagattgatttcgagtttttggggaacataagtggtcatccatatactctccatactaatgtttacacaaaaggctcaggagacaaagaacaacaatttcatctatggtttgacccaaccgctaactttcacacttattgcatcacatggaatccacaaagaattatgtaagtgtcgaaactccttcctttgtaccatacataatatttatgtttgaggatataaactcatgaaccaagaatcttttattctctccagttttaccgttgatgggattccaattagagagtttatgaatgccgagtcacgtggagtcccattcccaacaaagcaaccaatgaggctatatgcgagtctatgggaagcagagcattgggctacaaggggaggattagagaaaacagattggtcaaaagctcctttcaccgcttattacagaaactacaatgtcgagggatgtgtatgggttaatggaaagtcagtttgtcccgcaaattcccaatggttcactcaaaaactcgattcgaatggccagacaagaatgaaaggggtacagagtaaatacatggtttacaactattgctccgataaaaaaaggtttcctcgaggtgttcctccagagtgcagctaaatgattgattctttgattcataaataagttacttgacgttgtctttgtaactcaatggttcttcttatctataatttttcaattcatttgttaccaaatatatgcgtgtttgtgtaagatcttttttacaatgaacaatgagttcttccattctaaaaaccttttaaaacatgtcgttactatatacgtacaacgatacttggggataaattgaataatatataaccttacttgatggataatgaatggcccaaatttcgacctttttctgaataaaatagaattttttccaggttttgtttcaagcttagtttcaagcgcagtaggatataggtatttatactttaataaaagaattcagcgtgaatggaggcgagaagcggtgcgatattttagctgtgttgaacgtccatatcccaccatatcttcatttagcataatgcatgtgagtatgtgacacatatatttatattattgtgcatttgtgcttccatagaggttggcatcttattttgtatgttaatgtgcggatatttagttgattaatcaaaaacactttgaaaaacataatataattaaattttattgatcaattcaacagtctttgtaagaaaaattatttctgtaattggaagtgtttttaaggtttagttaaatatgacgactattatgctcttttgtatcgtttttttttggattgaacgctaaactatacgagtgcatgggtgggtctgtttggtcgtaactcgtaaaataaataaacatcagaaccctctatgcggcggggagggtttgcgcttaagtcaaaagtcagaagccgtgttgacaaataacctcaacgcaggactagcatgtgatatacattattaatatctctgttttgtaacagtaaacgagtaaagaaaactaaatattgaaggacatatataaatgataagcttactactttactagttactggttggatgacgcacgtactggtccaagattcaacatcacaattttttttacagtccaaatttccaaaatatactttatttttgttcaaattaaaggaacatttttcttgatctagatatgtttgttatgtttaaggttcgtttcaagctaatattaagaatggcttgtttcaatgtgaaaaaggttatgctcatttgtaaatggatattgttaaatcagtttaagaaagtttcctacgcactaaacgtgtcaaactaaatctcaaggctataacttattttatgtattttgatcgggtactagctttaatcatgctgttacaagattcagttacattctattacaccgtccaaacttatgttgttatcttcacccaaataaaatgaaatgttttctgctgggagatcgattaaaaccaaaagaaattatatttgacaagactatcagccaaattaaaatcaagattcaactatggaaaacttgtagctatttttcaatacctaagttttaggaaactttgccattatattggtgtttatctaaggattagaacatttattttagttaaattaaatcaataaatcgtaaagttgttaattaggaaaaaaagtattaaaatgcaaatatatttgtcattcgaacctctatgcggtggggagggtttacgctcatgtttgaaagtcaaagcagtgttgataataatctcaacgcgggaccagcatgtgatatacgaatgtctatatacattattttctctgttttgtaacaataaacgagtaatgaaattatattttattggtttcaatttgtaacaaccagcaagaggtctaatgagccaactagaatacagcccacgataaataatcaaacccatgaaacttccttctctctttcctttgccatttccaaacactatataaactcatgtcgcttaactcaatttttcatcaacaatacatttgagatatcaatacacctccaaaatatatacaaaaatg

SEQ ID NO: 16391 - DNA, 2639 bp, Unknown; identical to SEQ ID NO: 1185
  misc_feature (1)..( 2639): 2750-1469P.txt file - cDNA_ID_1413191; gDNA_ID_1620368; Annot_ID_154898

SEQ ID NO: 16392 - DNA, 3003 bp, Unknown
  misc_feature (1)..( 3003): 2750-1469P.txt file - cDNA_ID_1440790; gDNA_ID_2684236; Annot_ID_192419
attctctgtaaccctccattgactctcttaccatctgcaccaaccttgtcattatacttccacgccaattgccatccaccgcctatgcttgtagccgtcgctgtctcacccacgtttgccataaacaagctgctctgtcgcctatgcatggtaccaacggtccgctggtggtagtcatccggctcagtggtttgcggagaaagcagaggactgtttaagttttcatcttggtcagaactatcttcattgtttctctctggatcccactgggactcctgccttcccatcattcccagtatacttcccatattggggaagagcatgctgcgggatgatgcgttcatgttctcggaagggagattctcatgaatgctaccaaagagagtgacaagtgggtccatgagggatccgccacgcggtaacatgctgccttgtcgggaagccaatgcgagagaactctgtcctttcactggcttagccatccatgactgtccatcctctggaccatatagttttatctgatctttcctcggcagttcatttccaccctcgttttcctcgttgtctggtccaatcacatattcttctatcgacgtgtcttttcccaccccaagcccttcaaccagcagagcaagctcgcctaaatcataccccgagttagtataagttcaaagatcgataatctagaggtcttagtgttcatcaagacaaacctgaaacatcttctctgccacggagtctctgcagaacctgtctagcttcatccatacggcctttgctgacaagccaccttggagattcaggcaagaagaaagccgcaagtacaaagtaggcaatggacggaattgacaaaacaccaagcatcagcctccagcttggtgattcttgaagcgacatcccaaacacaagacaatacgacaaaaacatcccaccggatccacaaaactgcgggaaagtgttgagtaatcctctgatctcagaaggtgcggtctcagagatgtagattgggacgagagtgacagctaaaccgatcccaaaaccatcaagaagccttgcgaaaaggagaacgtagacattgggagaccaaaacataacaatgctactcagaaaatagagaacagaggagagtataagcattgatcgccttcctactttgtcagagacaggaccagagaaagttgtgatcaaagtggctccaatgagagacattgccacgatcagtccttctatctttggttctttctccaaatgaaattctttcttaatgtaaattacagctcctgccaccaagaatcaacatcaaatcatagtgagatttcgttagtatgcaaaggaaaaagaaagagaaatatagaaagagagatacctgcaatggtggcattgtcccagccctgcaacatattccctatcgcagcggctaaagcaacaagcactacactcctcatctttttctcttttacagtgattttactttccacgaatcaataattctgttgatagaacatcatatgtttctttcccttctgcaatgtcccagattcatttcacaaaccaaaaaaacgagttgttaaagatattttagtgattaatcaaagcatgtagcagtttgagaagtggtaataacggtaggagagtgaaaaagagttggtcaagcagagagatataaggagaaagtgacattgttattttgaccgattcttaagtcttttatataatggaattacctgataaacaaaacaaaaaggaaatattacaacaactacttaaccatatgaggatcacatttcttcttaatcacacaaatgtctaaatacagttgagtttggaaacctctagtcggtccagagtgtcttacgcttttggacctttggtcagccaattattgcaatctttaaaatcagaccggacattaaaaccggtataatgtctaagcccctttaacggggttttacggtttgaagtcaatgtcggttctacactaaaaatcataaaagccaaaccgaactcaatcttcttcccgcaacttcataatctgctttcccaattctctctcgtcggcgaaggtcctgtgaaaccctagacaaatcgcaggtaagttcgactgtagaaatacacactgatatctcaatttatgttctattctctgcttttgaattgagaccatcgaattccattgtttctctgatgcttttttaatctcacaaaattgttaattttgatgatctttgagcagagatgcaagattcaaagattccacctttctctgaagcaaaaagaatgaagattcctactccaaaacaacccttgactcaactaccaccacgtatcgggaaaaaagtttcaaatcggagcaaatcgaaccaggttcatgcgatttcacatcaacttgagatgtctccaaattcagattcatctccaggaaacgagtacagagcactgagacgcaagtatttgctgctagaggaagatagtttcgcgttggagagagagttaaaggaagcagaggatgaggttaaagcacttgaagatgagaaacttgagctcttggacaaactcgttgttatggaaggtttagttgatccttgattctatagcttagcacttgttttatttgccacattcatatgtaaaaaatcgccttatctagtaacattgtttctgcttatataacttataagcttttgttgtgtgttgagagaattggagatggtaaagaaaactgttgtgttcacttgttgtgtctttcgagttaatacaatggtttgggagtaaagacttaaacttgctacagtttttactagattctagtgctaaatttaaccaaaactgtgaccaaatgtcgtttatttgcaccacgtgtccttcatccacaacagaatgatgatggattagatatttctattcaaaaactataacgtgtggctgcaaatcgattcaccgcttcagactctgttttagaccaaagtcgagtgagtgctttcatcttcttcttaagcatctatg

SEQ ID NO: 16393 - DNA, 3003 bp, Unknown; identical to SEQ ID NO: 16392
  misc_feature (1)..( 3003): 2750-1469P.txt file - cDNA_ID_1440790; gDNA_ID_2684236; Annot_ID_137710

SEQ ID NO: 16394 - DNA, 3000 bp, Unknown; identical to SEQ ID NO: 9965
  misc_feature (1)..( 3000): 2750-1469P.txt file - cDNA_ID_1440840; gDNA_ID_2096296; Annot_ID_195560

SEQ ID NO: 16395 - DNA, 3003 bp, Unknown
  misc_feature (1)..( 3003): 2750-1469P.txt file - cDNA_ID_1440865; gDNA_ID_1971974; Annot_ID_177555
ttcttcttcttcttcttcttcttctttcttgatctttttggttgttacgagcttcttcttctctttctcttctcaagctcattagaacatcaatttaaaacagaaacttttactatagaccacgataacaaatctgggtttttgttgttgttctctccatgcagagaagagtttcaaaaaggaatacaggatctgtggcttttgagtaggttaattaattagtcgacaagaaaacaaaggtatgtaaccatttgatcattctccattgcttgttgtctcgcttagatccttatcatatttaaatgctaaaatggatgattttttttgagacttttttatatatatatatatatttataactaaactttgatagataatctagtttagttagtagttgcacaaaatacattttgaattctccgttaaataggcgtttcaatttataagaataagatttatgataattttcgggttcaaacttacatattacacgttttgttatatgttacacctagttaaacatatagtgtttcatctagctatgcataagagtgtctcaccataaatcaaatgggcagtttgtgtttttttttctttatatagactacacagaatatatagtgtgcactatcttacgtttgtccggtgtgtcaatgttgatttttgcatcaagttctccttcgacaaaacaaaatgacgatatatatctatctatatatatatatacaaactgtattggcttcgtactatatacatacgtcagtcttattaattctacaacgcagatcaaaatttgaattttgactaggctttaatgtgtacgattaccttatacaagtgaaaaagggtcaatcgtacgtttacccttaaatttctttttgttagtaacatatcgaaaaataaaccgttttatatatattttcaaaatacttattcttcttgttaatgctgtcacatattataaatcattacaatgttttgacaaataaaagaaaaatcattattacaaatctaatcgttttaaaatcctagggaatcctactagattattattactattgtagaccttgtttcttttgtcacattaattaataacaataaaataatatatatttttaaaaatatttttgttttgttttgcattgtatattatttagctgtagatttgtaatgggccacgtaattgggccatgctaagacccggcaaacccatgtgagatatatgatctcccgcactatagtccacgttatctcactgatatctcattattttaacaataagaccgtctcttaattttattacaagttttcttttactcttgtagccttaaattttaggctgaaaattaaagttttgaaaaaagctatagggagggactatgtaaaataaaaaaatgtacgttaccatcagattttaccataaagagccaaaaataaaatatgcaaaactccactaaaaataatattaattcccctagccaacaaaaaagattcagattcatatcccacgcgctcgttcaaatcctctcattcgccacctgatcaaaccaatctcaatttgaaaattgaaatagacaaaatcgtgacattgggacataaaaaagcactaggacaaaattctagtcgacgcaaaaaaaattcgaaaaacgtgagtcagcgtatgtggtttacacgcgccaaagtgggagcgtgagtggggtttgaatgcacctgaaactgtctggtcaataagttaaagtgcatgggaaaaatcttggttgctgtttcctatatatctctctttttaccatcaacatgttacatatatatatggacaaaaatctgtatatgtgaatgcatataggagtgtgatgtatttatataagttagtaagctttgttctctttctctatttttttggcaggtatataaaattttaaaatggaggaggaaaaccaaaagtcgcatcgagtttcacgtaaagaccagagtggatcccactggagtcaaggagccgatgaagagccgagagccagatgctccgggaaaaggtgccggtcttgggcggcggcggcgatcgctgactgcgtggcgctctgctgttgtccctgcgccgtggtgaacatcttcactctcgcctttgttaaggtcccgtggatgataggccggaaatgtatcggccgtggtggcccgagtaagaagcggatgaagaaaatcaaccgtgaggatcggtttcatcaccatcaccaccacaggaggtcggccgagatggtgagtggtggatgttgcggtggcggagatggagatggagagttcgatgaccatcggtttgtggtggaaagagacgggagtttgaccaaagaggaagccaaaacggcgtcgttaaaagaagaggaagagacgagaataagtgcgagagtggaagcagagagagtttggttagagttgtatcagattgggcatcttggctttggtagagtctccttcactggcattcatcaatgataatagatgaacttttaattattaggcgtatatgattaccaaaactaaaaatagattttgtgaaattctttagtgcagcaagtaagattccacaagtatgcatagaaaaaaaaaaaaagattacacaagtattaatttatagaggttttagtgcaacatgtaactcataaggattaaggaaacaaaaagtatttgtgaaataagagagtacattatattatagaaatgggctaatatacatttgggcccttgttaaagggctttcacatgaaccgcattaaagggtagtttaggacatttacgatagaacttggtaggcgtagctagctgtcctgtaacagaaaaaacctgcgcattttagcatgcttatgaaattcatttgctaaaagacgcatagacacgtcgtgggcgaagggttctttgtcttcttcccccaactgagcaagattgttttccttaagagcttcatcgtcatcatccgagaattggagcagagatacgaagatttggcgaaaaatg

SEQ ID NO: 16396 - DNA, 3000 bp, Unknown; identical to SEQ ID NO: 10989
  misc_feature (1)..( 3000): 2750-1469P.txt file - cDNA_ID_1440942; gDNA_ID_2214470; Annot_ID_133056

SEQ ID NO: 16397 - DNA, 3000 bp, Unknown; identical to SEQ ID NO: 10989
  misc_feature (1)..( 3000): 2750-1469P.txt file - cDNA_ID_1440942; gDNA_ID_2214470; Annot_ID_182986

SEQ ID NO: 16398 - DNA, 3000 bp, Unknown; identical to SEQ ID NO: 11750
  misc_feature (1)..( 3000): 2750-1469P.txt file - cDNA_ID_1441000; gDNA_ID_2214515; Annot_ID_133927

SEQ ID NO: 16399 - DNA, 3000 bp, Unknown; identical to SEQ ID NO: 11750
  misc_feature (1)..( 3000): 2750-1469P.txt file - cDNA_ID_1441000; gDNA_ID_2214515; Annot_ID_184405

SEQ ID NO: 16400 - DNA, 3000 bp, Unknown; identical to SEQ ID NO: 2129
  misc_feature (1)..( 3000): 2750-1469P.txt file - cDNA_ID_1441072; gDNA_ID_1620491; Annot_ID_158617

SEQ ID NO: 16401 - DNA, 3003 bp, Unknown
  misc_feature (1)..( 3003): 2750-1469P.txt file - cDNA_ID_1441170; gDNA_ID_2214589; Annot_ID_135399
aacatcgatgattagaaactaaagtttattccttgatgtatctttagttggtgctcgtaaatcttactactgtttgcttagagcataactatgtttataatctaaagtgtattccttgatgaatccataatcggtgctcataaatcttactaatgtccacttagatcactacccatgttttcctcgtgatgatttataattggtgctcatcaagtttactaacatcttcgtagatcatctcccacatagagtttctttcttgatgaatctataatttgtgctcataaatcttatgttgatttgtccatccctgttcaggttcctttggtagaggtcaaatgcagaaaccatttgaggaagcaacttacgcgctcaaggttggagatataagcgacattgtcgatacagacagtggagtccacatcattaagagaacagcttgaccttatctgatctgatagaaaatgtattgaaggtgcctgcttcgtttcccttctcttcttgaccagaagaacatagaagaagaagaataagaagaatttaattcaaggttattgttattgtggttttgattctgaatctgtctacgaatttgatacaactcaaacatatgataaaatcagacaagctatctcatttcttcttaaaggcttcataagcactccctgtcgtagacagtgacttgtataatcacatttcagtatctttgtcatggtcttactgcaacattctggcatcttgtgtgttgtcattttgctcttaaactcttgatagtctttggctctcgtctccactcttaatatttgagaaatcgtttactgttaggcgtaattcaatgtttaaaccagtttagtaggttctgagcgggatgtctaggtttttgacttttcttaacaacatttaaggttagagccatttagcaattaatctaaacaggtttttattttaaacaagtcatgcagaactccattgtatgggatttaaggattcaaataattttctctagaaaattcgaataaatcggtttattggtttaaattttgagatatatactggtaactgattaattatgtgaagccggttacacttttattgctctttgtagtcaatatttccaagttaatgttacttgttttcttggagtttcaactctatttatacttataaaacaactattgaaatttctaattaaagcatccaaagatgttaaagtaagataattaatgtcatagtttcacatttcattccatataaataatcaaaagtcttattgttgttcatcaatcaaaagcaaatataaccttcagcatatatttggctatactaaggttctttttactcaatttctcattatgtctataaaaaatatgctttcactcctagcggttctatgcatcatcgtttctgtaaatgcttagatgcctcagtttccggctccatttcctttttcatttctattcgaaccgattcctggtatgtcaggattacctgacataacaaaatgttggtcatccgtgatggatattcctggatgcattgtagaggtttctcaatctattttcactggaaaattcggcaatttaggtccatcttgttgtaaagcattgttggacgctgaagtcaattccatgccgaaaattccattcattctgtttttccctccgatgctaaaggaacaatgctcaagaattgtgggtgcaactcctcctataccaaaatagagttttagcttagttttaaaaatctatgatttttttcttttcaacttatttattgaaattgtagcttactctacatgttatactccaaaaagaaaaaaacgatgatacaataataacatagttgtatttgggttcaatacttactcatttttcaattataatgaataacaccttgaaacattaactccgtaattaatttagtcttgcaatttttcataaattgtttatatatgtcgtaacacaaaatttgcgaacggttaataactttactagataaaacctctctaaataggtagatgtgaaaaataaataaatttttgttttaataaatttttcaaatgataatctatatatattttatttaatatatattttctaaaaccaaatttcaatcttaccttttctaaaaccatattgttaaaaactaaagaaaaagttggaccaagcaaagcctctcggtaaatgtggtaaataaatagaacgatataactgagaagaagaaaataaaacaaaattaagaaaataaaaagataaacatatttaagttacaatatttaaaaatattaaaacacttctttttaagaacaaaatggggaattttatttatgttttgaatagatcaacaattattaatagaatgagtttagtttaatatattaaatataaaaaattgaatatataaacaattgttttatgtatatattttttttttgatagggttaaggatttttttctatttttgtttttaaatgtaataaaatttgaaacacatgtaaatatcgtattagtaaataccgaccaaaaaaaatattgtattagtaaatttgacacatatcgcaatttttgtgagctaacaattttaaaaatcaaataagatgacgaacaaagctctggtttaaactttctcccatcaattttttcattaaaccaaatttaaccaattatttggcctaataactgcgtctacgttattaagaataagaacttattttgtgtttcagtagaaaacacactcgttcacaaaatgcctagtaagagtaaaggacgatcaccgccaccaagtgtgtttctcggataaacacatggaatccagccattacttaaacgacacgtgtacgctcatgatttattaatgcacacgtaatcgatcctctgacaaaaaccataacgaatacagaaaacacacgaatacacttccctgcgctataaataagctagcacgaaaaaatttaacagatagagacaagacaagcaaagcaacactttcactaatcctctaatg

SEQ ID NO: 16402 - DNA, 3003 bp, Unknown; identical to SEQ ID NO: 16401
  misc_feature (1)..( 3003): 2750-1469P.txt file - cDNA_ID_1441170; gDNA_ID_2214589; Annot_ID_186733

SEQ ID NO: 16403 - DNA, 3003 bp, Unknown
  misc_feature (1)..( 3003): 2750-1469P.txt file - cDNA_ID_1441174; gDNA_ID_1972143; Annot_ID_179292
tcaaaatatcaaaactttgttctatgtttgtgtcagatagtgattatgtaagagtgaaaccagtatttaagtacccgaaaccagaacggagaccagcgacccagtcttccttgtaacacaaggctcttcctctaagatctgctactatacctctgaatagcctcttcgagctatccactctttcttcctccatatccagaatccctcaaagactccagaactcgtcgcctctggtctactctttatatgacctaaaccacaaaaacaggaagctatatattatgtatgacatctagcaatgactttaaatctagcattttgctgactacatttaatacaaaataatcttcatattatatttttctaaatttgtgacgattccagtctttttccacctctcaatagaaaaagaagcttatagctgttttatcttttgttacttactagtaatgtcaattttctatgcttttatatgaataagaaaacgcaatgtgcccaactcaaatagagaaacatcacaaagcacataaaacaaagcaaaacgtaatgcaaaatttcttcttatgacaaagatctaagtctcctcgtctcctctctcataaagtgaaatttgaaattgcatatgcacccaaaaaaaaaaaaaaaaaaaaagaatccaactttttcaataaaatccattaattaatatccgtcgtatattgaatctacacctttttcatagttttgacaacgaaattagcagtaacaaatcctttcacatctcacaaaaacataatcagacaaaagaaaggattaaacaaaatcagacaaaggagttaacatgcaataactcggaaatttgaggcgtaaggaggagcaaactaccggcgacgaaagagaaaaggagaatagccggagccgagaagtaactgtgtagcgatttatagggtttaggaagatttataggccaaagacgaggcaacgttagcaaatggagagacagggcccatttatacacgtattatgttgggcctacatccacatgtcagtaatcgagtgggtgattctgacatctgtgatcttgacgctttaacactctgtctgttcttttcgtataagaaagtgacatatatatagagaggaacaattcatctaaattaaataatttattattgaaaattttaacttaatatagtttttttgtataatgttgtttcctttagtcttcattttttcttaagttatttccattttaaaaaacataccaatatgttatattctttgcttaaattgctttaacctgtatctagaaaatgtaatcttccatattgttaatttcataaataaaataaatttttttgcaagttattggaaaacgaagttaaaaattaatgctgcaccaagtttgtgaaattttaaaattacttgtagttggagtgggtgtagatgtttatgtgtagaaataggcatgcacacacaatttaatatagtcctagttacttatacaaaaaattcactgctgacgtgatcagtaatgcactcatatatgcatatatcactccacgtcaatggcacttgcccgtgcaaatgcctttattgtgccagaatcttcgaccggtcaaattgcgtgtgtgtgtatatatcgaaatatatgttatcaaaagagtttgaactttgaacccatatctaatacctgagtaaagttttagcattctattcaaagataacatgtagtacatactaaacaaactatatgtatcggttgttatcaggaataataagaattgtataatgcaatatataattaagtggtacttatgattaatacatacacatggatggtagatcgggatttgaaaaaccaattaaaatctagctttgaaaaggactcgagattctaaacgccgtaccaagaaagttcagattattatttcatgatgaatcattgagtcaaacacttaagcatcatatttttaatttcatagtttatacgttatccacatatataatattaattccgtcgacgacagtatttatatcagaattaggacaaactacatgtatatatttagtcaatcttgaaatttaaaaaaatgcctttgctaagaataaaaattatggttaggtgaagttctcacgtaaaactattcaatcctcacgcgattgaggagtgactgaccaaagtttatttctataggggcaatttaataactattgtaaactttcaacgtaaaaattaattactttgaagttatggggcaatatcatcaatagtaataaatataagcccttactcgtaaaatacaaaaggtttatttgttttctgaattgagagcgtgtaactactaccatcgtcgtctccgcgagttcttctctgcgtttaagccatagataacaaaccaaactaaaaaaaaaaagtttctccttttatcattccttctcttcccttgtataggtgtgatcctcttcaaggggatttctctggcgggtcatacattcgcaccgatcaaagtcggattggtctttcttaacgcaatcttgacccgattcaaaaaatttctggtatcctttttaagaaatgaaattaattgattccttgtcttccaaacgagtaaatcgactaattgattagattttgttcattagggtttgttagtgaatagataagaagataaatgggagctccgttagtgtgccacgggcattctcgtcccgtcgtcgatgtggcttatagtccggtgactccagatgggttctttctcattagcgccagcaaaggtatgatcttcgatcgatttgtatttgactatctatgatctttacttggaactgtgcctattttggattatgatttgcatagcgaatgtgctttgacgaatttgattttgctgccttttattatatatcgtctgaagtttgatttgtggctgatctaatggagaaattaggatgataagttgcatacattgttgaactctagctgaggtttctttgacttttgatatttcagattcgaatccgatg

SEQ ID NO: 16404 - DNA, 3003 bp, Unknown; identical to SEQ ID NO: 16403
  misc_feature (1)..( 3003): 2750-1469P.txt file - cDNA_ID_1441174; gDNA_ID_1621154; Annot_ID_173417

SEQ ID NO: 16405 - DNA, 3003 bp, Unknown
  misc_feature (1)..( 3003): 2750-1469P.txt file - cDNA_ID_1441291; gDNA_ID_1620627; Annot_ID_47168
ctctattatcatcaaatctccttcttaaattttttttttttttttttgaaacaaatggattttattaaaaatacaaaaaaaattgtatatttggattacgtcaactcttacaattttgctagtctcatagaaagatgtcatacaatgcttgcatgtattgcttataacagtacgtgtgcttttgttatttcttttctagtattgtaattgcgtcgtacaagaaaacttataagatgcgtcggaattcgaaataaaacaaataaggttggaatgtatcacatgattttcatacgtttttacaatttctgataagtcccccttggtatgatggtatcgactttgttttcagaaagttgagtttgtttcttttccgaaaactaacgatgtcaaataatgtgaattcacaacatatataaaaaaatgataagaagagagcttaattttgagcgagtgttacaaattaattaaaaactgtgtctagtttaacacttaaaaaaattgcaatttaaatgataactacccctggattattttcataacaattttgtacatgaaagaatttaagataatatattattttaccaaattagaaaagctaaaaaaataagtactataatttgttgtatttagtgaaagaataaatgttgctgggaaaaaaagtgaaagaataaatgctttgggtatataccttatattaaaaacaaaacgaaaaaaaattaatgatatttgttaccatatatattatatacaatctataaacagaaattaagataatttatctgaaaagtgttttcaatgaggaaaataacaataaacagaaaaaatgaggtgtatgtacaaagatttgttaccaaatttaaagtattcaaacagaaagtacccatctgtttaggcaaaggattcgatcatcaaacgtcctacaatatcttgttttgcgatctcacccacaaatttatttcctataaattctcttcctctgtctgatctcttctattcaagcccacttcttttctctttctcttgtcttcgtggagttttcggatcttacacaacaatatctttgtcttactgtatttcttgtcctttttcttcttacctttctaacaattattaagaagagtaaagcttgaatttaaataaaaatgatgggagacaatgaaggaagaagaactccgttattgaatcttggggttcaagtatcgatgagagtgttaaccatcggagctgcaatggcctcgatgtgggtcatgatcactaaccgtgaagtcgcatctgtttatggcatcgcttttgaggctaaatacagctactcctctgcctttaggtatatatttttttaaatttattctccttttctatcatcatctacttcttattttatgaaggtgcaatgatctagttattgaaataattcatatatgatacaacgaagcatccatctgcatgaaatgtcatcattcacgttgaaaatatgaagaaaacagatcacacattcggtagaaaagattgaaaagatgaacacatttttctaaaaaaaaacatccctcacgtatgatgtaggaagaacaacatgtgggacaaatcataatttggcatttttcattcatcgatatgatcatctttattgaaagtaagagatcgagtgattaaagtgtatgatttgatgtttgacaggtatttggtgtacgcacagatagctgtctgcgccgcgacattgtttacgcttgtatgggcttgtttggcagtccgcagaagaggacttgtttttgcactcttcttctttgatttggtaactatattacatgtttttgatctaaacattttcatttctatacgtgaatactctttatcttttaatttgaattagcatgttcacaaattatataaataaacgttttgagatgggtttgatattttgatgtacagcttacgactttgacggcgatatcagctttctctgctgccttcgcggaaggttacgtagggaagtacggtaacaaacaggccggttggcttccgatctgcggttatgtgcatggttattgcagtcgtgtcactatctccctcgctatgtccttcgcctcttttatcctcttgttcatccttacggtcttaactgcctccgctgctcgtcattactgattttcttacattttatatcatacaattcaattccttctactccaagataattcagtctttgttatatataattggatttcatgagatgcaaaattgatttgatataatgaaatgaaattgtatgattacttgcatgtatttatctttgagatcacttcttctgttctttgctgtgcttaattagtctcctatttgtttttcttggagaaaatctaagaaacaacaaagtattgacaagaaagaaaacgaaattaagatcttggtaatcggaagagcatttttctaaaacgtataattgtacaataatccttctgccaccaaaagagtgataacatgtttcaaacatgcatagataaaacataatcttattaatgttacatatctcttcacaaaatctattcttccacatatttctcctaaatagggttttagcagagccaacagaaaataaaatgcatacgatctcatcatcactgtatgatggatttccaaaagagaatgttacatatatacatcatcataattcataacatttgcatcagaccaggctcaactagatgcaaaagaaccaagatgggcccgttgaagtaacttatattttggactgggcctgtcacttggcaactgtgggacccacatgaacatgtgccgaagataggcctgaatctccgagaacaaacctccgccacaaaaacagaagacttgttgcttgcgtatcataatacgacgccgtatctctacttgctcgaacaaacccaaaaagatacatatcaagagattaaaccttatccaactaagagaagccatttttattttttttgggtctctgagttgtgtattgagcttcatctccttcaaatg

SEQ ID NO: 16406 - DNA, 2606 bp, Unknown; identical to SEQ ID NO: 3716
  misc_feature (1)..( 2606): 2750-1469P.txt file - cDNA_ID_1441291; gDNA_ID_1620658; Annot_ID_163691

SEQ ID NO: 16407 - DNA, 3003 bp, Unknown; identical to SEQ ID NO: 16405
  misc_feature (1)..( 3003): 2750-1469P.txt file - cDNA_ID_1441291; gDNA_ID_1620627; Annot_ID_162524

SEQ ID NO: 16408 - DNA, 3003 bp, Unknown; identical to SEQ ID NO: 16405
  misc_feature (1)..( 3003): 2750-1469P.txt file - cDNA_ID_1441291; gDNA_ID_2926186; Annot_ID_140812

SEQ ID NO: 16409 - DNA, 3003 bp, Unknown; identical to SEQ ID NO: 16405
  misc_feature (1)..( 3003): 2750-1469P.txt file - cDNA_ID_1441291; gDNA_ID_2926186; Annot_ID_200654

SEQ ID NO: 16410 - DNA, 3003 bp, Unknown
  misc_feature (1)..( 3003): 2750-1469P.txt file - cDNA_ID_1441391; gDNA_ID_1620568; Annot_ID_160796
acgtatacatggatgttagaaaccgcaacctctagaactatatgacacacgaattgcagaacttctaaaagttttactgcagtaaaatatcaatcattaaaccaaaaagtctcctataaaagaaatttgattattgattatatgattttgagtgaaactttcttagcagttagcagtaccttttcttttttcgtaggctaaacttaccaaaataaaaactacatcggttcatgtcaagtcttgtaatatatagctaatctagtactagctataggctacagcaaacaaaaatgtttttattatttgtcacgagaaaacaataaaatgtgttatcaaactaaataaaaaccatatattatactaatcacaaattaaacgggaatcttttatttaattaatagtatactctctcacacagacagacatctctggatttatatataaatacagttcatcttctttaatccacaaactcacacacacacacacacactctgttttcttcgtccattctattaccagaaaacagagtttgatagagagaaaagaatggaactgtcgactcaaatgaatgtgttcgaagagcttcttgttccgacaaagcaagaaacaaccgacaacaacatcaacaatctgagctttaatggcggatttgatcatcatcatcatcaattcttcccaaatggatataatattgattacctctgtttcaacaatgaagaagaagacgaaaatacccttttgtatccttcttctttcatggatctaatctctcaacctcctccattgcttcttcaccaaccgccaccgttacaaccactgtcgccgccgttatcctcctccgcgaccgccggagcaacatttgactacccttttcttgaggctttgcaagagataattgactcttcttcctcatcgcctccattgatccttcaaaatggtcaagaagagaactttaataatccgatgtcgtatccctctccattgatggagtctgatcagagcaagagcttcagtgttggttactgtggaggagagacgaacaagaagaagagcaaaaagcttgaaggccaaccttctaagaatctcatggcggagagacgacggagaaaacgacttaacgatcgtctttctatgctccgatccatcgtcccaaaaatcagtaaggtaaattacaaaatgctaatcttttttttctttcaaaccattaataataattgtagtcaaaatcagcaaaagatttgatcatttttttaatgagtaggttaatgactgtattattatatgtgttcataaagaaaatgacctttttaatcttcttgatttacctcaaaatctaaccctagctaaggtttttgtgttctttgaagatttatttaacatttaattcaaaaaattggtctcaggaaaatcaacaaaagattcgtccttttaaatgagtgaattagttataaaattggtttcaaattcagccttttgtattttaacattatgtgtttgtttcttcttttttgaaaccttagttttcttcttcaagattgtttaattattgtgttcttacttttaagggaatctacagaaccggctgaaaagtgataaatcatttaaaagtgttttaaaataatgattattggtatgttcaaaaaaatcagatggacaggacatcgatattaggagatgccatagattacatgaaagagcttttagacaaaatcaacaaattacaagatgaggaacaagaacttggaaatagcaacaattcacatcactctaagctcttcggtgatctcaaggatcttaatgcgaacgaacctctggtcagaaactcaccaaaggtacaaagatattttacattgctcttgtttttttccttctacatattagcccttgtatttatgaattgttataaacaaaccccctgtctttttaacaaatctttttgtaattctgtttatgttttgcatagtttgaaatagatcgtagagacgaggatactcgagttgatatatgctgctcgccaaaaccgggattgctactatctactgtgaatacattagagactctaggcttggagattgaacaatgtgttataagctgctttagtgatttctctttgcaggcttcttgttctgaggtatcgatttaatataaagtatttatgcatggaatgttaattatatagtattcgtaatgataatattgatgagttttgttgtatatatgtttatagggagctgagcagagagatttcataacatcagaagatataaaacaagcattattcagaaacgcaggttatggtggaagctgcttgtaatgagtcatgattgaaactaataaaccaaaactattgtttatttctaataatactagcgcttataaactttagatgttgttttaattcccttgtgagtttggtttttttttcctaggggaaaacattatgagttcagttgtataaacaaaagaaggaaatttaaaaagagatgtttctcctaaattatatcaaagaacaaattgagatataaaataaaaggttatattatgttgctttgagggaaataaaccacttcgataattgaaattagggttcgtatatgacagtgaccgatgttcgaaggatgcatcatcaaataaaaaagctgtattaatcaaaaagttataaaggctaatcataagcgtgattataatgttaatgactgtgcctccaccaatcaacgcattcatcattactgcggcacttacgtcaacgaattaatcttttatcgataaaattccaagaggccctaacttaggcttaatcaattattgggcctataaagaacggcaactgatgtagatccaaatgggctttatttagtaagcccaaactttatgttttctcttatatcttcctgctctgttattagaaagaatctccgatttagatagaaacaacaatcctccggtggtcactcgctaatctccgtttgatctcgccgacactcgagccttttaccgatg

SEQ ID NO: 16411 - DNA, 576 bp, Unknown
  misc_feature (1)..( 576): 2750-1469P.txt file - cDNA_ID_1441963; gDNA_ID_1620491; Annot_ID_158627
acggcgtgataaacaaaccatgctgatcctcaaaggaacgtataaatgtcttctcttcgatatagaaatcatgattttaatcatcgaaaataatcagatgttagaagttaactgtatcttgttcttagtttcagggacaaagagtttttgttgtcagtaacttcaagctctaagctatggctgtcaccaagatttatattgtgtgagtctttaaagtttaaactaatcagtgccaagttaaacaactggcgatcaatttcccgatcaagagtaatctgcgattttgtactactgactcacacaggacgagattgaatcctcgtaccagtttggttttgacgaaaaattgggttcttggacttttctgttaggtactattccttgcacggccacgtcgagacaatggcacgagaggtacttcggggagtaaactctgttccagacgtggaagcaacactttggcaagtgccagagacattaccggagaaaatattggagaaagtgaaggccgttccaagaccggacgatgtgccggatattcgaccagaacaactggcggaagccgacggattcatg

SEQ ID NO: 16412 - DNA, 3000 bp, Unknown; identical to SEQ ID NO: 14927
  misc_feature (1)..( 3000): 2750-1469P.txt file - cDNA_ID_1441974; gDNA_ID_2684234; Annot_ID_192364

SEQ ID NO: 16413 - DNA, 3000 bp, Unknown; identical to SEQ ID NO: 14927
  misc_feature (1)..( 3000): 2750-1469P.txt file - cDNA_ID_1441974; gDNA_ID_2684234; Annot_ID_137676

SEQ ID NO: 16414 - DNA, 3003 bp, Unknown
  misc_feature (1)..( 3003): 2750-1469P.txt file - cDNA_ID_1442104; gDNA_ID_2214686; Annot_ID_189343
caagtctattgcctaagttactaatgctgcagagtcaattcctagactaatgtgatatccggatggcaaaccgatatagactagaggacatccacgtttccaacataatccattaaggctggagctaatttttctgcttttccttttacctcttcagtaaggttagtatttgtagaggttgactccttgttcatacctgataatgaggccatagtgaaaaagataatggtatttttcttccttataaaaactgaatgaaatgattttctttagagtaaaagggtgagaataatgtccgatgaaccaagtattttacttaagaaggaatgattatacaaaggttggaagaatgctgaggatatctttccaatgatgagagtactactttgtctaaatccgtaaaaagaataattgttggggagaaaaagaataccaaaactatgaaaatggtcgacttaacatggttttgtatgggaatgagtctaaaaagttcttgaatattaactttattgatgagtcctagcaatgaaagcctattagatatagttgtagaatttggtttaaaatttaggatgatgtgaatgcatgcgaataattacatggtagttatgatttaattagaactgttaagcatatgaatttggtttgaatgatcaaggtaatcggctagagaaattgggagttcctgcgtttttgaacttcttccacgaattcgatttttgtgttttggccaaggaaaagctaagtctgaagagttgatatacagtacctcaattttcactgctgtcagctacgatctaggtataggtattagagtctttttgttatttctagagtctttttagagtcttttcagctatttctatgaccgggattggattgaaactaataaagcattttggagaaaaacggaaggagttaagctaaaagacgaatttggagtctgacaaaggcatcataccgacacttccatggtgttgatcgacacggtttgtggcgcaacaagagtctaacggtttaaagatttgaagatcccagaatttacacctaaagatttttctatttacagaattagtccctgcacgtttttgagaacatataatatattttaaaaggtcattgtttagaccaaagctttatttttaggtcttctacttttgccctacaattcaaggagatttttggagagttcttgagagatttcaaaaccttgtagagaaaagatcttttcctaaactctattcttcttttgatttcttatatgcaatcttatacaaacatgttttatgtttcgatgatcatgtttgagtaatcccctagctgggtttagtgtttttcattagggatttagatgaattagtatatcgataacctgttaagatttatatttatagttctttatctttgattgtttttaatgctagttctagagtacctaactagaacttgatcctaagttaataggtaagattcgagaggcatcttattgccggaactagatgggcttaattagctaaatgaggataggtctgatttagatacttagctgaacttatcaaaccggattataatgtttgcttagttctagggatctacatataaagtggggtcaatacaattaagcatacttagtccatgcaacaagagttgattgattatagaattgaggtttgtagttctagaatagtgcaataacaatcctaattaactgctagaactattatttgtctatttcctgagaatttctgaaatccgacgttttaaacatctgaatcttacatcaatttaatatgcttttgtcttttgatatacaattacttttttttttatataattacttgatttagtttcatttctagattttaactttacgtgtgaacaaaaaagatttgtgagattcgacccttaaatactaatgacgatctcttatttgagagagtggtcttaaggtactttgatcacaaccaccttgtgttaactgtagccaagcaattttccaagttcttaaaaatttaattagtccttagtagctactttgtatagctcctctatgatctactttcagtgcatatagttttgtctttatccagctgtttaaaatctatcgcttgcgatttttgacaaaatctttaaaagataataaacagacgatttttttttgtcaactgaattatattagagaaacttgttgaggaagtatggtgaaatacaaactctcaaacgagggaaaaaccgacggatgacgaaaatgtccgcagaaacaaagccaacgaaaaaagaaatttcttcgaaaactaaagtcctaaagaaatgaactaaaaatataactagaaatacaaagcaagaaatatcaaaccaaaatcgaaagaggacaatcattcaagagaaacaaatagtcttgaaacctaagaaacatcttctaaaaaaaaaaaaaaaaaaaaaaaaaaaaaaatgaaacatcttctcctgaatctcctgcaaaagagatttatcaatggtgcacttagccaacccaaagataccatctactatctcccattatgaagacaattgacctctctaaacctagaaaaggatagactacgtccaaataataaagaagagaaaattactacaattaaagaatatataattacttgatcatccaataatagatcgctatacgtgtgtgatgacgtagataagaaaagatctaaaacacttgtggggtttgtgctatttatggtgtttcaaacttattcacagtaaatccaacgaccacccatacgggacccgacaccgtatacatactttgatacttatctccttaccactttgtttttttctatattgtgatacattacttcccttttaacattttcttttattactaaaattctttcgactgtggattagtttatttgacttttctcattccctcgtcctcattttcattataaatagagagcatgcatggggacatattattcatcacaagttttaagcagtatttgtaagaaaatg

SEQ ID NO: 16415 - DNA, 3003 bp, Unknown
  misc_feature (1)..( 3003): 2750-1469P.txt file - cDNA_ID_1442179; gDNA_ID_1620362; Annot_ID_154689
ctttcttttgttttagaaatatatacagagaattgatttagttctatttcagaaactcgattttggatcaaattgctttgatatagttcagttttgattagtatgctgctttgacttagtttgtctgtctagagcttagtatctgtatgtataagtgatcttgatccgtcgtagttcaattctgagattgttccaaattgtttcagtagttggatgcatttggctatgttatcaagtaacctctgattaaatgttggtttggttcacagggaagaccacatttgtaaagagacatcttactggagagtttgagaagaagtatgaacgtaagtactctcgcaagcaagccccatcctgaaatatatcacttgtcattaaccttttttattctcacaaaagattctcatgtgttcttgtgtttttgcagccactattggtgttgaggttcatcctcttgatttcttcactaactgtggcaagatccgtttctactgttgggatactgctggccaagagaaatttggtggtcttagggatggttactagtaagtactttcttctcatacaaatcacttaaaaccgaccttgttaataatctagaatcatctactgtcatgctataatctagaatcttctagtgttggaagcttggttatggtttgaagctcaataagatgattgtagctagcaacatgaaaaactattgataactgttgcaaatagtttgtgtttgatacaataatgtgttctgttttgttgcagcatccatggacaatgtgctatcatcatgtttgatgtcacagcacgactgacatacaagaatgttccaacatggcaccgtgatctttgcaggtatgatgaactcactcacagaaactagcatttgttgtatgtggcaaattgctaaacagaaaatgtcatcaaatttcatggtgcagggtttgtgaaaacatcccaattgttctttgtgggaataaagttgatgtgaagaacaggcaagtcaaggccaagcaggtaacattccacaggaagaagaacctccagtattacgagatatctgccaagagcaactacaacttcgagaagccattcttgtaccttgctagaaagctcgccgggtaagaaacaattcatcaattcaaccctcattgtagttattgtgaaacaacggaaaaatgaaaattgagatgttgcttgtttgtctcagggacgctaatcttcactttgtggaatcacctgcccttgctcccccggaagttcaaatcgacttggctgctcagcagcagtaagttctctaaaactaattttgttttaatttgttgctaaggtttgagttcgaggcttttcttcaattaacgattatatatttgtaggcatgaggcggagcttgcagcagcagcaagtcagccacttcctgatgacgatgatgacaccttcgagtagagaaagagagatgtgatctgtcactgattacccgttagggcttgtctgaacttttttttgttcatggtgctatttttatgtgtccgtactttgaaatgaatcgatgacattagtaattttcatttttaagtttttaactgtcgctatgaaagtgaaaaccttttgattacaaaccttacatgcttcacaatttcaattgtatctctattaatcctagccgcgcaatctcatcaattctccacacccaacacacttaatagtttttttttacatcaatcatttcgaaaccacaagttcttagatactcaacaacatttttttttttttttctgtagccaatcgatgttctaaagatcaagaatgttgtattatttctaccacttatggagtcaccaaggatatgtgaagggttttctttgtttatatatttttttaattgcgttttaggacatctccaatagaagtatctaaatgtagatactgatctctatcaaaacagattatggatatcatactagagtacattaaaaatttgcttctaagattttgagttcttggagtcattaacgcatcgctaagggtattttcgtaactttaaataaccccaaataatattttgcttcctccccaagaacctttttgcctctttctacttccgtcggccggattcagagtcataaataaatatataaaaaaaagtttcgatttttgcttttcttcttcgattcattgcgcgaatcatccgtgatgttggtgtctagggttttatcaagagtttctcgcagcgcaggcttacgctcgtctttctcctccgtcgttactccgaagaggaatcagattccgattgttgcaagccgatttcactccctcgttcacggaacccccaacaaggttaggcttttaagctgattttacttgtaattcgttctggattttatcgtcgggtttatgctagggtttaaggggtttgtctaaacaaaagattgttatgttctgattctattgctctggtcttctttattacagtgtcacgaatttaattgtgtatgtctgaatgttaatgttttgattgctctttcatatgtcttaatttggatgtgaaattctggcaatccttgtgaatttgaaagctgagataaagctcattctaggatttgtgtacagtgaatttacttaatttggatcattttttttaatggcagcttgttgcagttccagtgtcgctccgaaaccatggaactctagatttgaatgttcttcaaaggttcggctttttttcctcttcctcagctgaaccgaagggaaatgagagtaacaccgaagtaccaaagaccggcgaaacttctgagaatgtggaggtggggaaagctacaggtgaggcaaaagattcatgtattttgacttagaataaagagagattactgtgtctaatactgaacgagtttctttttctgagttccagatgcagagattgacttcgacgatttgtcaagagacgatttagtgaagcttgtgagtgagaaggaagatcttttgaaggttcagcagaaagacataatg

SEQ ID NO: 16416 - DNA, 3000 bp, Unknown; identical to SEQ ID NO: 9987
  misc_feature (1)..( 3000): 2750-1469P.txt file - cDNA_ID_1442222; gDNA_ID_2096299; Annot_ID_195641

SEQ ID NO: 16417 - DNA, 3003 bp, Unknown
  misc_feature (1)..( 3003): 2750-1469P.txt file - cDNA_ID_1442233; gDNA_ID_1620510; Annot_ID_159082
ctaggttcttaagccctttcaccttcccccacatagttgttaaccttttgtactcttccaacatctccatcacttctcttacaatcctccctgaccctcttgctatccgcattatccttgactcgttaaacacctttggatttgagctgtccagttctgcacaaccaccaatcagttattgctcaaaactactattacttttacagagaaactttctccaaagaagatattgctctcaccttcattagtcatagagtccatcattgtcatgtatcgctttatcttcgcctggctttctttctcatgtccctctggcatcatttcagcacgcattccaggtagcatggagaaaacctacaaaccaacaccgtattttcatatttttgtcttatcagcatcacgttgtgctctttagcttactaatatttgaccagagattctgacctccttaagtgggcccatgttcagcatgttctggaactggtcgtacataattctcaatgtaaatttaccatgagagagcatttccagaagttcaggctgttgatctttaggtaccacctcttgtagtttattcacgaatccagacatatcaccatttcctattgtacatatacattatcaagattctgagtcaactcctcacaatcagtcaatgccatgatatttacctaagagacggctgacaaacggtttagcatcaaaaacttcaaactcatccatatgctctcctgttccaatgaatatgacaggactttttgtagctgcaacactaacaagatggaaaatagatgagatccacttgcccaattggaaaagcttgcatgattttcatatcaccatttcgagtacatgacaactcagcagctacaagatacttacgcgctaagagtcccaccacccttggcatgaccatccatcttagtaataattacagctcccacagcaacagtttgtttaaatgctcgagcttgttcaaacgcagtttgaccaatactgctatccataacaaatataacaagatctggtttctgtaaagtgaaaaggcagcaattagcgcctccaacataattaaggaacaagaacagaagactttaagataagagagtaaaaccgttgcttcagaaatttgacgcatttcttcaaagagagaagcttgttgtttatggcgaccactggtgtcaacaataataagatcacaattttctttcttgaacctatcaactccctcaacagcaattttcacaggatcggatcctgtgtaactgcaaagaatcacaaatcagtattagcacattctgctatcacagtatgccctggctaatggtttcaatccataagagttttttattttatatatatttcgtcatgttattgacattgaagtaaaaccaaattgacaaattgcaaaatagaaacagaagataacacaagacctcaaaatatccatttatgtatactgtacaaatctatgaaaaagacgtgagatcccttgttacagtggcactgtaaaatgaataccgaaaaaagagcgcaaagaaaaaactggcaaaagggatttaaaggtaactggagagggatatattcagtaaccgtagtggcgtagtcctcgagtgtaaaccaaacaatttcataaatggtgtaccatggctctaccgtcaaaaataaaattacatcacttttgtacgtgagctaatatatttggaaatgcaagcaccaaaggtcttccaagcacgcaggaagaaagctaataactaagatataagattttttaacactgcaaaaagggttgatgtcagtaccttccataataggggatcttagatttggtggcattctgtttcagctgatcaaaagcacctgccctgaaagtatccgcacacactagagctggtttgtacccttttcttctgatgataataagcatacttggtacaagttgtggtttttccagcacctaacacacagtcaaaaagttttggacgattttaacaatgaatttacaactacacaaaagcatagcatcttacagagagatcagatacctcaccttgtaatccgacgaacataactacactaggtttggcctttttgggagcaaatgcagactttcctggatccaacatcttacagagttcactgaagatcgcctgaaagagaatcataagaacttaatcacaaaaaaaaaaaaacgtaaacctatttaatcgaaattagacatgcagaatctgcggtaaagcctaagacctgctcaatgatacgacgcttgttatggccggctgctagatcctcaaggttgacgattttcttaatattggtctgcatctccttcacaagggggaaagaaacatcggactggagcagagcacgagtgatctcgttcaagcaatcattcagagccttttcatcgattattgtcacattgttcatcttctgtatggcgctcataatccgacctccaagctccgccaacaccattttcgctgctctctgtattcttctacctcaaattaggttgatctatatatctgttgtcggattttggaagatctagcgagacgggagaagctgagtatctttttttttttttgggggtcaaacattgagtatcttagattcatttctatattctaaaaaattataaaccggttaggatcaaaacgatgggcttaacatagctccataggcccaatagtaagttgttcccctactgaattgaattagaaccaaataagtgctaaaccaatggtacaattttcaaaaaaattcatcgtgaatacggaaccggcctaattaatttacaaaaccgcgtccgtcttcaatagtaatgggcctgcgaggcctttttatccccttcttaaaaaacgacggcgttacactactctaattccgactacggacgccgtgtcggagtcgtcagattcgaaaaacatacaaaaccaagtcgaagcttttaaaaccctaaatccccaaatcgggaactgagattccgattcgaagatg

SEQ ID NO: 16418 - DNA, 3000 bp, Unknown
  misc_feature (1)..( 3000): 2750-1469P.txt file - cDNA_ID_1442383; gDNA_ID_1621108; Annot_ID_56041
cgaatttttcaaaggtttttaaggtttttgtttttgtcttgatactaaatttatataaaaatatatatgaaaactaatctgattttagatccagcttcggtcgttaacaatttcaaacatttatgtagattttagtatccaagtttttaaaataggttttcaaattttgatattttttatttagatttataaaagtttttaaggctttttttttgttttatactaaatttaaatatatatatatatatatgataactaatcgaaatttggatacgttttgggtcgttagcataccaaacattcaacttatttttatattatttttatgtaaattttattatccatgttttttatttagattataaaaaaagcttttcaaatctttaaaaactagctgtgttttgcatccatcattagtctctagagttcttaatattcaacttgttcttttatcattgttgcatagattttagtattcgaattttcacttttagaatttttaaaacaatatttatcatttcaatagtttctatttgttggtatggataatgtggtgttctggtctgattttttgaaatattttgtttaattttgtctcatttagaattcaaatctctgttttatgcaatttacttgatcagaatttctgaatcgaaaatgtattggctgatactaaaaattaattcggttctcgttttagttacttcggtttaatttgaaactcggaccggttttcgtggattgaactcttccacgtcacctagattttgtgaaacgactactatacccttagaacactggataatttgttcttgtttcgttacttgctcagagaccttttcaaatccaaaacagaggaatataagagattaaggaaccattgtgacgatgcctaacttgctccacaccaatcaatctcacttcttcttcctccatcatccgccaatctacaccgtcagttcaaagacgcaggctttccacttcccgcaatcaatggcgccggtcaacctccgtacgaatctctccgtgcgcaggaccgtacggtgtatggcgaacccgaggagagttaagatggtggctaagcagataatgagagaactctccgacatgcttctaacagacacggttttacaacacgctgtcttacctgaagctgcacttggagctgaccgctacctctcttctctcaccaccattagcgatgttgaagtctctaatgatttgcaggtgatgagaaaccctaattggaaactcttgtgtaatgtattcatgtgggtcttgctctatttatgcagctggagtggaaatttagggtctttcgaaatatttgattccagaattgcttaacttgatcttttgattaaacttatgctatactgtggcttgcacggattgaatcctgattcttttatcagtttttgacagaagcaattcgtattatgtgttttatgatttgtgtgctggacctagccgctggtttgagagtattattacttcagagtaatgttagaagctgaaaatggtttcttttggggttgtaggtggttaaagtatatgtatccgtgtttggagatgatagagggaaagacgttgcaattgcggggttgaaatcgaaagctaagtacgttaggagtgagcttgggaagcgaatgaagttgagattgacgcctgaggtcaggtttattgaggatgaagccatggaaagaggaagcagggtaagggattctaatatatctttcacttaaagtaaactagcgtttaatgaaatttagtcttcagttagtaaatgaatgtctcaatgatgcggtcaaaatctctatcttgcattcatagtcatgagtgttgagtcatgaactagttgatcttgttgattgtcttctctgaaaatcacctcttctgtgctatattagaaaccggaacttggtggatgctgatatagtcagtcaagcaattgtaataccatgtacggttatcactatgagcagaaactgaattggagactgtttcaggtaattgcaatactggacaaaataaaagctgagaaaggaagcggtgaagggaaaacagaaccatctgactcaacagaagatgatcaagattgggaagtggatgaccccgacgaagacataatctatgtaaagtaatggtctgaagccgtttaagcaacgagtgcatattactctgatagaacgctccgcggtaagtcatcatatgtgctcaactcatctatgagcttggtttaggagagatcattcatcttagtgcatgtcagtcatatgaacagaaagcattggataatatatgctgctgaaaagcatctaatagaaacaagtgttaataaatcaacgcatgactctgaagagaatcattttccatgttttgtgtgaagttgttggacaagactaaggcggaatggagaaccggagaagatgaataccgatggtagttactcattatgaagcctgaaagcttctttggtccattactcggggatctctccaacaaattgttattttggataatatcagtgtaagggtttggtcatgagctcaagtttctgcctcgttgtttcaatgttttgtccttgtttggtgttacagttaatgtcagctctcacaatgactcaagtagaaattaaccgattcggtttcatatatgcctagatgagttgtgtacttgtgtcattgggcccgtatctcatgtatgcagtaacattttaggcccaaacaaaaatcagaacctaatccattgtttatgttacttatactacatcggtatcttagaaattgggcttttaatctaaaataggcccaagccaaaatgacgtggtcgtccttgttacagaacaagcagcgttgttcccttccactcatctgaaaacaaaaacaacaaacaaaataaataaattcaacagcgatatatcttcatctctctctctctcgccagattttcatcgactcgatttcagatttaagatctcagatacaaaactccgacatg

SEQ ID NO: 16419 - DNA, 3000 bp, Unknown; identical to SEQ ID NO: 16418
  misc_feature (1)..( 3000): 2750-1469P.txt file - cDNA_ID_1442383; gDNA_ID_1621108; Annot_ID_171695

SEQ ID NO: 16420 - DNA, 3000 bp, Unknown; identical to SEQ ID NO: 16418
  misc_feature (1)..( 3000): 2750-1469P.txt file - cDNA_ID_1442383; gDNA_ID_2926208; Annot_ID_141821

SEQ ID NO: 16421 - DNA, 3000 bp, Unknown; identical to SEQ ID NO: 16418
  misc_feature (1)..( 3000): 2750-1469P.txt file - cDNA_ID_1442383; gDNA_ID_2926208; Annot_ID_202376

SEQ ID NO: 16422 - DNA, 3000 bp, Unknown; identical to SEQ ID NO: 6455
  misc_feature (1)..( 3000): 2750-1469P.txt file - cDNA_ID_1442397; gDNA_ID_1621094; Annot_ID_170865

SEQ ID NO: 16423 - DNA, 3000 bp, Unknown; identical to SEQ ID NO: 6455
  misc_feature (1)..( 3000): 2750-1469P.txt file - cDNA_ID_1442397; gDNA_ID_2926162; Annot_ID_198822

SEQ ID NO: 16424 - DNA, 3000 bp, Unknown; identical to SEQ ID NO: 10387
  misc_feature (1)..( 3000): 2750-1469P.txt file - cDNA_ID_1442431; gDNA_ID_2213646; Annot_ID_132389

SEQ ID NO: 16425 - DNA, 3000 bp, Unknown; identical to SEQ ID NO: 10387
  misc_feature (1)..( 3000): 2750-1469P.txt file - cDNA_ID_1442431; gDNA_ID_2213646; Annot_ID_181447

SEQ ID NO: 16426 - DNA, 3000 bp, Unknown; identical to SEQ ID NO: 981
  misc_feature (1)..( 3000): 2750-1469P.txt file - cDNA_ID_1442548; gDNA_ID_1620343; Annot_ID_154060

SEQ ID NO: 16427 - DNA, 3000 bp, Unknown; identical to SEQ ID NO: 10958
  misc_feature (1)..( 3000): 2750-1469P.txt file - cDNA_ID_1442595; gDNA_ID_2214467; Annot_ID_133048

SEQ ID NO: 16428 - DNA, 3003 bp, Unknown
  misc_feature (1)..( 3003): 2750-1469P.txt file - cDNA_ID_1442595; gDNA_ID_2213639; Annot_ID_132235
acaagaatagaaaaaaagaatgggctttttctgagctaaagaaaccaaaaaaggtgaaataaacgaagaagaagaagaagcagaggaattatttgttataaaaaaggattttctaaaaagagtttcatggctggattcacggttggagttttatttagaattttaaaaattgaatcaaaccactctcttgctcttatacgacaaagacagaagagaccatcttttgtttggttagctagatcttagttcacacttaaaaacgctcagcatcatcatcaaataaagcagacaaaaacagattgtatgaattagcacatggagaaaatgggtccattggatttgatatcttattggctctatcctgatatttccatctctagattagcaattcgattggatgatgtgtataaagctgatcaacttcatgaattgttatatataaaaaaagagataactagctattctttgtgttggtgaaagaataaaaacaaattttcattttacgtcatgacttgagcataacgaaccctaataaattatgatctctcccaactctgctttaatttccactttgggcagaactcagaagcatacgtgtgaaagaaacaatacacaactagtgcagttgggaaaatcataaccctttgtttctctcagaaaccactttgatatttacgagtgatgattgttatgtaacgtctacgacacctacacatatgctagcaatcatgtgttgaaacacgatataaaacattctcctaagttcacgatataactgttttgatttctttcgacgcaatcatgtcaattaatttacacaaactactaatttaaaggaaattttaattgctttaggttttactacttaaagtagtttcatcaatatttttttggttagaggtcatgttgatagatgtcgtataggaaattcactctacaaatgcttactataagtttaggttttaactcaaaatgtttcaacaaaataaaatcatatattttttactatcctattaaaaaagagagagggtctgcctaataaagaaatgcaacaaacataagaaaagaccaagtgtgcgttgaagaacgagaaaaaatggtcttggtctcatgcacatcaccacatgttgatcttacgccgtggtcgtccacttgcctcttgtttctgaatttttgtttagttgtccctgctttttcctattttttcctgtaagaaccctaatgtttccatatgtctcatttcttgttttgcataatttaatgggctcaatgaagttaatgggcctaagagtgctacgacccaatagcacttgaagatatgtccttcaaggacttcctaagctctgttcaggtcaacatgactaactttctgcttcacaggtttatggaaattaatcaaacatttggtgttttaatttgaacttttattttctttagcatgaactcatgagacttcttgtgtcaaagaagcgactaattataaacaggggagggacaaacaacagagattcatatttgagaaaaagaaataaacaaaaaagcatgagaacatgatgaattagtattggctaaatacaggacttaacatgaaggctatggtacgcgatatatgactcaaagaatggtgcagccgcttccactttcataggtagtaacagacacaacatcacaactgttgcagtaaggtggcttgcatacatgctttggtggttcaggtgctggtggaggctttggtttttcaggctctggaggctttggtggctcaggaggttttggtggtggtccaacgctaatgatcacaggtttctgtttaatctttttcagccttgttgctacgcagaccggatccattgtccccaccacggtaagtatactatttccttcatctaatgaaatatgattcacacctgcaccaaatctcatgttcaagatgatatgttaagacttaagagcacatatttcttgagtcttttttcgttcattaccttctatctctgtgactgcttccatgattgcgctgttgcattttccacagtttatatccaccttgatctcaactttctgctcacaaccacaacaaaaactcaaacattcggtgtcggatttgaaaaggaactagtactaggatgtttaccttgacagtcatgatggattagccaagatcgagaaaaatggattaaaggaatgaagaaggaagagaagaagttattaaaaacatgtgaagacaaacagagatgacagattggaataatgttgaagcagttgaggttgtgtttggtcagtattgttaattaaataatcaagagattacaccatctacgtgcttagatgcatgtttttgtataattgaataagaggttttgggaatttgcttagttggtattcagccaccatcttatggacttacttgggacattattgtggatggaatttgtttaatcttgaaaatttatgaatatattattgagtcccatattctatctaattttgtacgttcttgaccccaaatgtttatttatttattttaatattgtatatgttatgatcatgcaaatgcatggatagagaaattccaagccggtttaaggttttggttttatttctatcccggtttggatttagctgaaccaaacaaacctcttgagttctttcaccagtaaacaaccaaaatcatcaatcatttcgagtttggtgattattagagtttgaaggtgtttttgttatggtgagtgtcatcctataaactataggctaattaatgtgtccaacaaaacaaaactctttttaaacaccaaattttaaccaacgatcagaacacctaaacctaattatggcaaaattttaaaattaacacatctatggcccctctccataattatctcttctccattggttttccattggttaaatcttctttacgtagatatataaattgagaaacaatgttaaagtattttctcaaactcatcaataacatcttacaaacaacaacaatcaacaatg

SEQ ID NO: 16429 - DNA, 3000 bp, Unknown; identical to SEQ ID NO: 10958
  misc_feature (1)..( 3000): 2750-1469P.txt file - cDNA_ID_1442595; gDNA_ID_2214467; Annot_ID_182885

SEQ ID NO: 16430 - DNA, 3003 bp, Unknown; identical to SEQ ID NO: 16428
  misc_feature (1)..( 3003): 2750-1469P.txt file - cDNA_ID_1442595; gDNA_ID_2213639; Annot_ID_181165

SEQ ID NO: 16431 - DNA, 3000 bp, Unknown; identical to SEQ ID NO: 9573
  misc_feature (1)..( 3000): 2750-1469P.txt file - cDNA_ID_1442644; gDNA_ID_1972155; Annot_ID_179453

SEQ ID NO: 16432 - DNA, 3003 bp, Unknown
  misc_feature (1)..( 3003): 2750-1469P.txt file - cDNA_ID_1442763; gDNA_ID_1621174; Annot_ID_57307
cttgggtggtgttggtgctgaagctgctacagctgcgggttatccgtatggatacttgcctcctggaacagctccaattgggaacccgggaatggttatgggtaacccgggcgcgtatccgccgaacccgtatatgggtcagccaatgtggcaacaaccaggacctgagcagcaggatcctgacaattagcttggcctaataaactgtgagttcttggtttagatttgtgctttatcgttacatggacacaaaacttgatttgattgttcttgtttgttttccgcagagccgtctaattcgaagctctccccggtggatctactcaagaagaagaatgttaatagaaaactattgcgacataaaaagtttggtgtagtagaataatttctgttttatgatccatggatttatctattgttattcagtttggtttatcttgtcatcaaactgttttcggtcaatgtaacaaattcataaactgagaattgaacttacaaaaggctagattactacttataaagttcaaagctacagtgatattgtaaactaaccagtccttacacatagttttcaaaatggcttagctcgagtttaaatagtccgtacttatccctacccataaccaaaaccaaaaaccgacgcttcctatatcactaccaaacgtttacacagtttgtttctgcaagtttttcattacgactccttcaagaattccatctgttccaaagttgccagaaaactcgtgtggatggacaggaccggggaggcggaacgagacagaaaagttaccgggagggcagagactccgcgtttgcatttcaaacacatgagaataccgtttaactcgcttcccgcctgttgtagtgactcctctaactagtaccttcccattgtcttctacttcacagctaaaatatcctgcaatatctcacactcatcaaatcaagaaactggtttagtgggatgagagatcttctagataaagcaaaaagtaactcactttcatctcttttcacaccaggaagcgatacacggaagagataagcgtcatcacattcaccaatgtccatcagtcccaccattagtccaccatgagcttcagatttcacctcaggttttgcagcaacatcactttcttcaccgctagtgcaagtacccgcattatcctctttcacaggttccacgctctcatcaatctcaaccttaacctcattagctgcaacaacgccgttacttttagttacatcaacactaaggctcaaagcaaagctatccaatcccgtaagccgcttaaaccgcgcaacacattcttctctcatacaagaagtatctggatcattaatgaacacaatgctccggataaacttaaacttatgcctaacatgggtttcagggtgcaattttcgcggaaaaagatccacgaaaagagggtaatccctgttcgaatcattgcgtttcgcattgaaatattcacgtaactttttcggcttcatgactagagacggatcaacatttctaataatgtgataatacacacgttctagctcagctctcttcataagtgagccacttaactcatctaccacaacattcttcaacgcttgaatctgaaaagctgattgctttggacgatgatgttgttttcttaaatctggtccaaagtaagttcctatgatgaaatgtaagagaaacaacttgtcttcttcaatatccaatgaaattaacacactttcttcttgttcttgagagttttcagctactaaaggagacacgatctcaggcattgtatcactcatatcctaaacacacaacacaacatcaaaagtttgattctttatgagtgtttatacaaaaagattgaaactttaatagaaaatttgaaaaatactggacatgcaataagaaattataaccaaattggataaaaattggacacatttcgtatcaaaatgggtgggaaaaaacgaaactttttaaggagatttaagaaattgaagcaaatagaaacataatttgttgataaataaacgaaattgagataaaatgttactaaccaggagtgtaaatttagggttgctgcttagtgaatttcgttgtctctcatcagagaaacagaaagcgacttgggaaaaaaactcaagacatggcaagaagagggtaaaaatggtattctttcggcactgatttgtccacgtggcgattataccaaatgtacatcttaaagaaaattaagagaaaaaaaaaaaaaaatcaacaaagcttctcggagatttttgccggcgacttctgaaacatcgtctccgatgaggtaaagtaactaatttttctcaaaaattcgtcagttttgtttctactcttgctcttatataacccaagtttgtgtattttcgtttgattctgtgaaagatttaatttttctttatgggttttgtacattttcactgattgaaattaggttacttttggctaaaagtctgaaactttgatgaaatacttgtgtgccaaacttattttcaggtttaaaacttaaacttatgtctaagatagtataatattcattacttggctaaacccttgcttacaaaattgggtcagactcatgtgtgtatctaacattgttgtgtaagaccttttcgataacataaaagaggacaaatgatgaatgttgcctcttcgtttgtctaatttgtggtcatgaaagtataagaagtttccgtttgtatgaatattcgtaagcattaatagtggttatacatcacaagacttagcttgcttattggatcttaaccaatatagttcaatctcttgctctcttactgattctagaatctagctacctctatagccttataatgtttcaaagattaagcctttttagtccgctgctgttttaaagaatcgttgtagtttcgtgagtgattctgttatatagcgaatctgagtcaagtgtatgataaaaggaattgttgtgcttcaggtcttcaagtggtctaaatgggatg

SEQ ID NO: 16433 - DNA, 3000 bp, Unknown; identical to SEQ ID NO: 11332
  misc_feature (1)..( 3000): 2750-1469P.txt file - cDNA_ID_1442899; gDNA_ID_2214490; Annot_ID_133446

SEQ ID NO: 16434 - DNA, 3000 bp, Unknown; identical to SEQ ID NO: 11332
  misc_feature (1)..( 3000): 2750-1469P.txt file - cDNA_ID_1442899; gDNA_ID_2214490; Annot_ID_183634

SEQ ID NO: 16435 - DNA, 3000 bp, Unknown; identical to SEQ ID NO: 11096
  misc_feature (1)..( 3000): 2750-1469P.txt file - cDNA_ID_1442932; gDNA_ID_2214478; Annot_ID_183196

SEQ ID NO: 16436 - DNA, 834 bp, Unknown
  misc_feature (1)..( 834): 2750-1469P.txt file - cDNA_ID_1443067; gDNA_ID_1564295; Annot_ID_149194
atacaaggaggaagaggcgtgaagcacgtgcgaatgaagatggtgctgaggagcacgtgcgctgaagaagaagtcacacgtgtgaagtgtatatattgagacttagctttctttagaagatttatgcattttgtttgtaactgcctgtgacgtatgtgtctgggtttgtgagagtaatgatctagatttgtgttttagagctctctgtatcgaacaaattgtattgactatttcagataataagttttacagttttcttgttatcagaagacctgcaatttctagattaattttcatcaattttttctccttttaatattattataaaatattatatatttttatttgcgtgatatggagaatatgatagattagctatgtgttctggtgaatcgattttgagattagctaccagaacaaatagtaaaacaacwtcgtttgcaaagtgttttttcaaatcacgcaaataaagttacatagccacagatgcagggtccgattctggtagctatgtgttttttgtattatttattttaattaaaaaacgatgttgttttactatttgacagaaaatgttattgttgactttatacgttaaattgatctgttagttgattatctaatatcttttatttggcaaaatcgaaaaaaattaataatttactttgatgattttatcattacaggtaaagttgatgctttgtttcgacacttttggcataataattttaatgacattttttcggtataaaaactataataatttaacaatatcaacaataaagtttttatttatctatctatccaattggagacgaatcatatcgagcgatg

SEQ ID NO: 16437 - DNA, 3003 bp, Unknown
  misc_feature (1)..( 3003): 2750-1469P.txt file - cDNA_ID_1443075; gDNA_ID_2214499; Annot_ID_133629
tcaaagctgaaatcaaggtgctgcctaactacgatgttgctttggtatctttccataactttctctttttgtgacttttttttttttttttttttcatttctaaattccttcatttaacttttctaaagtattgtagtattactttaaaatcaaccaaaatttatacagtattgttactatgatgtgtgtatgcatatggggtcaccgcgtttgatggtggcgtgtatttgtcaaaatggactatgcttttaattaaacgttagatctggggttctctattcttcttttttagtcataaatcataatatatacgttatgatataatattgtagcctctatgtttcgatttttgttcctcgatgtatcaatcttgaaaagaatcttagtttcattctaggtaatctcaaggtgtgaaaatcctatgtacataaatatgtaaagaattctcaaccattattcttaaaccaaaaatctctatcaaaaccggtccaacaccagaacatcttgatgatctagacaaatcagtttcttaaaaaaattattgatatgcaccactttactaagaaggagaataacaaaaaaaacaaaatgaaggtaccttgtcggtgtcacgtggggaagaacatgtgaaaacaaacgaacaataattggaagaaaaaaaaatgtgaatcttgtgatggatcaaattaggtatattctttgtagctctttagtgttcgttcactcacagcctcaggccctcagctttggtcttatccaaacgactggcccgcataacagagacattacacaatacgaatgcgtttctatattactgctccatactcaaatcgaatcctggagacagattcttattttttttgttatattcaattgtttagattactaaaagccaaaatcataaaaactttaaacgatttgattattatatcaccaaaatattggcttttaatccatgttaatactgattaacttgaaatatacttatatttttggttattggggaggaaggaatacaaataatctttttcgacactgaatagtttcctttgaatgaaagctgataaaatagtgtataagttcatttttttataacgtaattttttttttggtaatgtgaacaccctaaaaagatctccttctgatgtagaaatattatacccatacacatcgataagttagtttgtggaaagaaaaactaactaacaaaataacaccttcaattcgacaaaagagcataagtttaataaaatacctacagaaatttttgacgatgataccactaccattcgccaaaaccacaataattcaattcttctaaatgtagattctattaatatggtcgattgtcattattccaaataatttatttttttaaatgaaaaattcataactctaaatatacaaaagcaattgctgatttggattcaaattttcaaagagaacttgtagttatgcatatacataaaaaggtaagtcagtttttttttttggctaataaaaacggtaaaatcatgttattgataaaaaatttgaaaacagtaaaagaaatatgaccatatttgaaaatttacctaaaaactataatgatgtaatagtttgatttacttacatttaactaatttttaaggtctgttgatcgaactcgttaccttgaacaattagtaggacaactcaaaccactaaaccattatactttaaggatttatgtaaaatttcaaatatatatagtttagtagatgcacttatcatcacactcaccaattggatgtcaacacctggttctagctttttaattaccaaagtgaaaaaactgactttttctaaaaaaaattcgttctagatggatgctcttcaaattcgttctaaaaaaaactgacataataccatccctttaaaaacacagaattttttttatcatctctgaaacaaatcatttacagtagtaaatgtcaacacaacattaattctgtttgttgttggcatttacaattgcaaaatcattttctcatttattattcgtatttattttgtcaagaacccttgtctctaaaatattcatagaaaaagaaaagagccattaattaatggcttgaagaaagattggtgtataagcgtctacgtgacctttaattaatttacttcccccaaaaaagtcaacattcaacatgtgaataaaaatcaatattggtttctaagtaagtaagtaccatattattaaattatttattttggtaaatacgcactcaatttttctctcaacggtgtatataaacaaaaggagtctcctttggaaaaaacttgcctatcattttgccaacgaacgttctttcttcttaatcacagctcagcctgacgcaaccgctcaggctgatctcttccaatttacagccatttcccagctcagatctctgatccggtgagatctctctcaaggtaatgcccctgcaattttgcttacttctctggttgtgatatgcatgttcttcgaattttcatcgtttgtgatttgaattctcattttgtatttgctgttgttggtttttaattcgattttccggaacagattatgggatttgtattcgaatcttcgatttgatgacataatgtcccagccttttatgtttaatcttgaaatgatggacttttatccgatctgggtttaaagctggaattttgattgtgggtactattaggtttcattgatttattgcttggtccaacatttttagcagctggtattgagctcttgttgtctgaattttggaaagaactatttttgttgtatcgttttgatttatttggatctgaattcattcacctttttctctgattattgttttgtgtcggttgcatccactttgattagatctgaatgaatcatttttttatgtgctcaagttattgtatggattgttctgtttctagcatgttttggttagacattgttaagatctgacgtttgcattttcaggaaaaggagttagagcatcatcaagatg

SEQ ID NO: 16438 - DNA, 3003 bp, Unknown; identical to SEQ ID NO: 16437
  misc_feature (1)..( 3003): 2750-1469P.txt file - cDNA_ID_1443075; gDNA_ID_2214499; Annot_ID_183923

SEQ ID NO: 16439 - DNA, 3003 bp, Unknown
  misc_feature (1)..( 3003): 2750-1469P.txt file - cDNA_ID_1443114; gDNA_ID_1972172; Annot_ID_179884
ccaccaagagcaaaaccatcatgctcctgttgtggttgatgatagagactcattctcaagcattgcagctgttataaactctgagagtcaagtggatactgcagttgagatcgattctatggctctttcgacatcgtcctcgaggagaaggaatgagaatggttcgagggtttctgatgtagacagtgcagattctcgtccgcctaggagaaggagatttacttgagaaacataaataagaaaagctttcaacctggaagctgacgatgatgatgattaagaagaagataagaagaagattgtgtaactttatttttcttgtgttgctttgttgtaatttgtttttgtatttttctcgatagggatggttttttttaatcgaaaattttctttcatcttttttttcttctgacggtaaaatatcataaacctttgaatccaatatggaatgtgttcttgataactattcttataaaacaacaaacttgaaaattttaatcgatttccaaatgataattagatagcttgaaattttgttggatttgaaaatcagtaagaaaatgtagaataaactattaacctttttaaaacaaaacttttaggcaaaatgctaattttattattaagtaacatggtgtgttttttcaactttgtagactaaagcaagttagtatataaatcagttatgaagcaacgtaacaataagacactttggccgagtggttaaggcgtttgcctgctaagtaaatggggtttccccgcgagagttcgaatctctcaggtgtcgtattatttttattttcttttccttgtcccctaacttttttttttgacagatttgtttagaaacgatgattatatggtcgtagaaaaatccaatttttttttgagagtacatgtcacatgcgcacagcgacatccgacacgtctattattttctgttgaatcatctcacttcatatggttttcttcaacaattatttcacttctgattacaacaaaaaaacttatttttatactatcatatgatattttcttggcaatataaaaaaaaaaaacaccgcaaaaatacattcacacgaggggagacaaaaaataaataagaacccccacaaaaacagacatcttccaccattttcaggctttcatcatttattaaattataaagtttcttggattcttgttaacttaaatataagctgccaaatatatatcagcttacacttataatggtcctgttttaattgaatttaaccttaaatctcattggaaagtgattgacaaaattcaaaaaaattatgaggaaaaatgaaaatttgaaaagtgaaaataaaataaaaataaaaactcaaatgatgtgtgcgggaaacgagcgacgtcgcgttattcgatgcacgaactcgagccaataagatgtttttaaatctaaaaatggctattagattcgtcattacttttgtatttttccacaatttaaattgacttttgccggagatgtaacttttaaactattttactacttctttttgtttttactcataaagatcacaaagattcactcacaagcgtatgtatatctgaagcaattaaaaatgagaaaatatttgtccttttacagtttttgtttttcttctctgttacaaaaatgtaattacatctgaaaacaatactagaaaaaagaaagtaatcgagcgttgtaacgcaccataatggagaaaatagtaatacaattatgaagatagtacaaaatctcagatgaaaatatagtaaataattgtaattaaatgagataaaatcaatttctaaaaaaaaagtaaaaccaccttcgtgaattgtgattcggtgtttttaaaaagtggggaataaagacaaaacagagaccaccaccattaatggctttcttcaccgatacgaacaagacaggacacaacaaactcaatcccagcctcctcctcctccgtcttctcccttattcccttttcgtttaatcccccaattttttcaattaatccctccttttctcctcttaatctgaatccgaagcaacgcataatccataacaaagtctggaaaatttcttccgggtaagagaaaacttcttctctttcttttcaatttggggttttttattttgaaatcgggaacaaaagatccagaattacctaattccgaaatttattatcgggttggattatcgtgtgacgacgaatctagcttgctttttggggggggaaatataattctcggaaggtcaatttttttttttgcttcattttgttgtctttgaatcttttggtttatgaatggattgttttgaaattgtttcataggtcaaagagacaaagatattgttgagatttatgatattgggatttgtatttttgaacaccgtttctctatagatttctgctttaacctgatccttttaattgcaaaattgtgaaactttgcttgcacgatctttgtttagctttcacaggttagatgcgttggttcttgttctctagttagatctattttcatgtttatctctgtttagttagattgaaaagagaataggtttttgtttgttctcttggaatttttctcttttgatgtttgatagtcctgtgattgattactgtttaactgttgaagtcattggaatgtgcaaaggtctagctttgttcatagctttaggcctattgctttgtttacctatctgaaagtgcatttattgttttgcttcaaatgtttgattattttattttattctttgttgcttaagaagctataaaaagtaaaagacttgatcagctgaaccaagtatctgccccttaatctacttttttccttctcaatatatcaactatatgtattagccttctcaatataagcttgtattgctaatgattccttttttcctgcaggataataaagagatccattaggagtaaattatctgacaagagaatacaaagggcaatttcattttagttgaattagggatttgggctcgtcatg

SEQ ID NO: 16440 - DNA, 3003 bp, Unknown
  misc_feature (1)..( 3003): 2750-1469P.txt file - cDNA_ID_1443212; gDNA_ID_1621148; Annot_ID_56818
aaatacccaagacaatatattcaaaaatcgtgagatgaaatgcgatacaaaatcaaacaagatatgacatgccaatgatttttttttttttttttttttttaaatcatggtttaccggctgtgtcgaaaatacgagcagcataagcacttatcgccgaactcccacaaaattgttgcaagagcattaggcccaatccaatctaatcgttttcaacgaattaataaacaaacaaaaacaaattaatctttatttatttcactaaacaagttaaaacatttttttccgttaggacttgggagtatttcattcatacgtataggcagaatgttagatctacatacgcataaatacatgtctatctgtttattaagttgatcatcaataggtcacaaaactagataagaactcgatctcttctaaattatttgtataaatgataggtatttgatgagacttacgattaacggatgtgcgtttttcatattgaacaaatcttttagtccacttcgagattctcttctagaggtttccactgtttcctgtttcacattttaaaccgaattaatagttaaccaaaatacgtatatgttagccaaagtagtagtagtattttcggaacaaacaataatactctgatttcagctgcttcttcgagaatatcaccattttctcctcttagcctcttcaaagtaacctcaagctctcgttctctaccatacatagcctaagatgaacattaatatgtagactgtaccttttaaatataatattaccaattaaacaaataaaaaacaaactttaagtgtgtgaattaccagccatctaggtgattcaggaataaaaaataaacatatcatttggataccacatgggattgcacctagtcatagattgaaaatcaagaataagttaaataatgtgaattaagtacacacattataattttttatgatttgagatatagttcatttagagaaaaaatatagttacttaaaagagctaatgttctccaatgaaaaaagtttccggtgaagaacatgagcgatatcccaaaactttgtagaagctgcaagttcaaacgcaagataacaataataaattaaatattctgaaattataagctgtttgatataatttgtttcattcttacttgattggaaaaagagaatcctccacgaaatgctttgggcgtaatttctgctatatatacaggaacctatttgttttgatcaaatcaaatggtgtaaaacgaaattactatatcaacactttataaaagtaacaaataatttgttttcaaaacagatgataaagttaattaccacataactaatgagaccaaccccaaaccccaagaagcctcgaccaatatttaacagcattttatccttgaaaataaaccacagcaaatgaaatgttaactttattaaaaaatactaaacttgtgaaaaataaatttaaaagatggagatttggagaaacaaacatgtgcaaaggctacagcgagccaaccaaagatgcagaaaacatccgcgatccacattgtctgcgatcaaagagatgaacaaatcataacgtgtatattacgtcatcttagaaggtcctacaatatcaaaaacaaaaaaaaaaaaacagtggcataataacatttgaatacgaaacaaaatttaattacctgtcgacgaccaataactgcagcaatttttccactaaacgcggccgtaatcattcctcccaatgtcattaccgatgtgaaaaacgaatactggccaaaatataaatagaccattattttagtaaattaggagtaataattgattatcgatgtaaaaaataaaattagttattgatttggtcacacacatggatgacttacatctgcaacggaaagtcccagttcttccatgattttggactgagcaggcgatgaatatgacatcttcaaattatgatagtgcacaaaattaggccacaagttgacatcaactcaaaatcacataatattcaaataacaattttgagacaaaacagctattgaacaattaccaaattcaaaacagattttgattaaaaaaataaaaattccaatctgaggcatgttagttgagatccatgaggaacactagaaaaccaaatgaaagaaaaggaaagagtgatgatgaaatctcacagcgcagccataaacgaaagagccagtgacagcgacggaggtactaagaagaagaccacaagtgatggaagaagagcttcttgcttcttcttgattattcaccagaggtgttttcatacttccagattccatcttcttttgttccttctcctaattgcttttccctgtatttctctgttctttaatagtcttcactcttgaagcttgtatttggcagtgactcattggtcgtgtcccatgtgaacaactgttatagatatttgttgactatatatagtaagataatagaaatctctttatgtcggctatcgtataaattattgatttattcttgttgcttgatcaataaaggttacatcatagaactaaaatcatatgaaaccgaatcgatcaaccctggccatcttttaaataaccatcaatacattgggatgatcaatccacaataaatgtattgatgtaaattaaaaatatgaacttgtaacagatcaagattcagggtctaaaattatagaaagcttaataatggaggactatttcactaaaatcacttttcgtttgtacattattttcaaaaagtaaaaggagatgtacgaaccatagatcacataataattgaaagggtagatgatctgccacgttggcaatccgtgtgatctaaagtctaacaaatcacaatcaatcttagtagcctatacatatagagaagagcaaaaccctaaagcccactcatcttctcaattcccagatcatctacaatagtcatttctcttcgatttcttcaaactctcatcaaatcgtttatctgttctaaatttcgaagaagacgatg

SEQ ID NO: 16441 - DNA, 3003 bp, Unknown; identical to SEQ ID NO: 16440
  misc_feature (1)..( 3003): 2750-1469P.txt file - cDNA_ID_1443212; gDNA_ID_1621148; Annot_ID_173147

SEQ ID NO: 16442 - DNA, 3003 bp, Unknown
  misc_feature (1)..( 3003): 2750-1469P.txt file - cDNA_ID_1443214; gDNA_ID_2926132; Annot_ID_138794
aaaaaaggcacaaacatatttctcactcataatacacaaagaaagagagtagagatattttgtagtggcgttgacttgacacgactccaagttaagaagaacaagtagacaaaagatctaaagaacagaaaattctgaattttaccttagtaatagcgtcctcctgggtacagttgtttattagataaccaaaagttatggaatcaggtttaacgccagcttccttcatttgcttgacgaccattaacgcactactcacatttttcttcaaaacatacaaaagccatcagctgaaaacgatctaagagacgttgggagctcacagaaacatggacaatctctcaggtcagaatttgcaaacatgaaatgggagcttaagatattacctccctaaaatatccagccaatatacaattgaacatgctagagtttggttccaaattgaagttctttaaattaccaagcatattatatgcaccttcaaactgcacatgaaaccaaaagatatagagaaacattttgtggttagagaaacaagcgaagcagcaactgtaagaaacagcacagacatgtcctcatctgtaacatagggtttgaggaagttacatctttgattcttgtgcacaaacgtataatgctccggaagttctcagtattaggtttcacactctttgtgcacataattgaatggattcttcgcaccttaaacagcaaaagtatgaggaaatccgtttcatatatgagcagagttcaactgtatattgtctggatatagattcaagctaaatgaggatgcacaccaaatcaaactcaagaacttcatcaatggcatgtaacaatgaatgtaggatatctgcggatatcatcaaacctgcttcacccattttttcaactacatcaagagcagtgactacctacggcacagagagaatactcattatatatagcacacgaaatacagccaaatttattataaaacaagcataataggaatacctcattcgagtcacagctatacttaacaagcttttcgtacgatgtagatgaaggcataacatcaagttcttcatgcatcttgttaaattttaagattgtatcctcaacctttaattgtagaaaaccagtaaaacatggacaattaggaggcatcgattatctaaccaaagactttaacaacactaatctgccactaatattcatgagaagtccttaccgttggatttggggtgcaagtagaatagatagagatgagatcagaaacgttcttcactccttcatctacgcatgttaatgagaaacatataaaacatgctataaaaatgatgttctacaggcataaacatgttattggacaatgcagccttaccactttctcttagctcccaaaggaatctactcgcaacagaatccaatgaaaacctcccaagatattcaaatatgtttgccaataggtccgacgaacgaacttttgttatgtctacaatctctaagagcctctcaagatggtacttttggtcttttttacatagtgcaagcagataattttctgtttttttaaggatcaaaaaggttaaatctttcagagtaagagagagccacaaaacaacagagtgcacaaaactgaatattgcttaccttgcaagactgataagctttcaccgttatcaccatcaattgtactgcaaagttcctcaatcttctctccatcaccaagatggatccaaagaagcatttcatagtaaccaagtctctcaacggaaccgggactagcctccctaatcacatccttgaaactatgaaactcatctaccatatccataccaatcaaataaccaagaagaggaccataaactctttcttcaatcaaaaatccacgatctctcatagatttcaaaagctcaaaagccttctcaatatggccaagagcataatctagatcattgcttttctcagcatgctctaagtaaacaccaatcattgcattgtactctgtcacactcatctctttagctactctatcaaaagcaccaaacatagcctcagtgcctaatttctgagcagagtctctaaatatcttagcgaaacgccgtgacagaccgttctgcttgtaaacacgtctctctttcctttcacgagacaactctttcgttcttaacgaaatatcataagggatcttagtggtgaaacttggtatctttaaaaataagttcttctccaaagagcttttatctgatgttgttactgaaatgtgattcaaactatgaatgaatgagagtttgttgaagaaaatagacaaaattggcaacacataccatgtaacaatttcgatactcgatcttgtaatgatgcttcctcaagatctacacacaattttgcatgaaatcaatcgaattctaaacattacccagatacagaaaaatatcaaatttacaacgaattcattctaaagatcacatttttcttatatttgttcatatcagaaaatccgaattacctgaggaagagtttttggaagagagaagatctttgacagcttgagaagttccggcgatgtctttgttgccggaagcaattgaagattcgccggtgggtctaatacgggatttgaagactgaacttaataagcttttgttaacctttgagacaaccatgttcggatttcaagtgagattgagaagatgaagaagagcaagtttataaaaccctgaacaaaaaccccgacagggttgttctatccaattttaaaccttaggggtgataatttaatcaatcatataaattaggggtaatcatgtaaattaacaagattagttgaagaagaatcgtcaaattttgattttgtcttgtggattcttcaattcaaagattataaatttattgatgaacatcgtcaattcaaagattctctttttatcattcacgctacttcttcttcttcaatcgtcaatcgttgaatccgattcgatttgcctctcttccggcgtagcttcgacggtggcaatg

SEQ ID NO: 16443 - DNA, 3000 bp, Unknown; identical to SEQ ID NO: 554
  misc_feature (1)..( 3000): 2750-1469P.txt file - cDNA_ID_1443346; gDNA_ID_1591920; Annot_ID_151694
  misc_feature (2504)..(2504): n is a, c, g, or t

SEQ ID NO: 16444 - DNA, 102 bp, Unknown; identical to SEQ ID NO: 442
  misc_feature (1)..( 102): 2750-1469P.txt file - cDNA_ID_1443346; gDNA_ID_1591026; Annot_ID_150414

SEQ ID NO: 16445 - DNA, 3000 bp, Unknown
  misc_feature (1)..( 3000): 2750-1469P.txt file - cDNA_ID_1443346; gDNA_ID_2926234; Annot_ID_142712
agtgtaacgggttagtacattcgactcgatcttgcgtttttggtgtagctatatgtgtcctaggttcataataatatgaattagcttaagttttgacagaaaccctttatctcaatttgtgaccccagttggttaaaaggttctgaatttgtgattgcagaaagggatcaaaatctggagcctccttgaaatgtggagggtgtcagggatctggtatgaaggtgtctattaggcagcttggacctggaatgatccagcagatgcagcatgcatgtaatgaatgcaaagggacaggtgagaccatcaatgatcgggacaggtgtccacaatgcaaaggagacaaggtcattcctgagaagaaggtgcttgaagtgaatgtggagaagggaatgcaacacagtcagaagatcacatttgaaggacaagcagatgaagcggtatctactctcatacatttactccagctttgattactagtatgtttacttttcttctggagactaaccttttgttttatgtttttgtgttggtgcagcctgacactgtcactggagatatagtgtttgtccttcagcagaaagagcacccaaagttcaagagaaagggagaagacctctttgtggagcacacactttctctaaccgaagctttgtgtggcttccaatttgttctgactcacttggatggcagaagtcttctcattaaatctaatcctggggaggtcgtgaaacctggtacgtattcagatgcatcgtcatactcagattttacagttactataactgtctctgattgaaacatgatcacttatcttatgtgtttgacagattcatacaaggcaataagcgatgaaggaatgccgatataccagaggccattcatgaagggtaagctctacatccacttcacagtggagttcccggactcgttgagcccagatcagaccaaagcactggaagctgttctacctaagccgtcaacagctcagttgagtgacatggagatagatgaatgcgaggagaccacgctccacgatgtcaacattgaggatgagatgaggaggaaggcacaagctcaaagagaggcttatgatgatgacgatgaagatgatgaccatccgggtggtgctcaaagggtgcaatgtgcccagcagtaagtaactccttagagagactttgacccacatgggtttgggctccaaccaatttgtctcttgctttttcattctaagtgtattggagtctttatgggagtttggtacggtttaagaatttgcccacttcggtggaacatcgaaacttgttttctctttttcctctgactttaaaaattaaggccttattacaattttgtgttttttctttatgattaaatttgtagtaatttaatgtctaagaacatatatactgtgtgttttctatattgatatggatttaaaattcaataatttttgtgttcatgcagaacaaatgctgctatatagtctaagatgttcatatttatcctttttgttgtatatgtcaccatgttttgggtgttaactccgatgacatgtacgtacgaactacagtaaaaactctataaattagtaaaaactctataaattagtaaaaaatgtattaataatgttcggacgacgcaattttattaatttatagtgatattaatttattttataaactaatatttattaatttatcttataagttaataaaatattaatttatagaaatatttacgtaaaatataatattatattttttaaaaatgtttcttaatttaattttctatatgctttgttgtttgcatatataattatgtcagctttttatttttctttgacttctttaatttattttttggcaatatcttgtgactgtatatttacgaaattaacgtgaatgtaaacgtaaacataaacatgaaagtttaatccaatttctctttacacaaatcttagcaatgctttctcaaataaaagattttataaaatcaactatgacggatcaaatacgcaaatagttatgtgagtacaatagagatcataccagttgtattttaaaaagagttgtaattgtagcttgaacaaaaattttatataaaattagttttaaaattagcaaaaaaattgtaccaaaccaaaccaaaaattagaaaataaaataaccgaattaatactaaattttataatcaaaagaaccgaactaaatcgataccgaatcaaaatattttgggtaatcgaaaataacagaaataaaaatattttttataactattagttatttctaaactaaataattaaaaatatttaaaaatatatataatagtaaaaatattaaaaataataaaaaatatccgatatatctaaaataaccaaaaatatctaaaatattcaaaaataatcaaaatatctgaaaatattcaaaattaaatagtcgaatgtatattaaatttaaaaccgaaagaatcaaaattaaactgtaaccgaaccaaaatttcaaaataatcgaatagatattaaactttagaaaaaaaccccgataatccaatggtttcaaactgaaactgaatagataacatattaccttgcgaaacttccgtaggtcaaatgggcttaagcccatagaaccatagccacacaactgatgtggtggactggttaatgccgcgtagtcagagtcttttctggttttcgtttgaaaaaaacatcatgtaatttagaacgaatagagatagagaagcaacatggagccctggtgctggaagcagctacagctagtttagtgatgagacacgtgcacctaattctaataaataaataaatcaattcccaataagtcaaaacgactaaataaaaaacattttctctgtaaaaaaatctagaaccgttagattgttagatgtgttcagagaccgttggattccatttctttgtcaaaagactcaaaactacccaaaactcttccatcttcaccaaattctctcaatcactcatcaatg

SEQ ID NO: 16446 - DNA, 3000 bp, Unknown; identical to SEQ ID NO: 16445
  misc_feature (1)..( 3000): 2750-1469P.txt file - cDNA_ID_1443346; gDNA_ID_2926234; Annot_ID_203793

SEQ ID NO: 16447 - DNA, 3003 bp, Unknown
  misc_feature (1)..( 3003): 2750-1469P.txt file - cDNA_ID_1443575; gDNA_ID_1620821; Annot_ID_169465
ctgacaaactcgatccccaaagtgttgcttgcttttttagatatactgctgggcttgataagaaccttgttggggattttcttggaaatcatgacgaattttgtgttcaagttctcaatgagtttgctgggactttcgatttccagtacatgaatctggatactgcactccgactcttcttggaaaccttcaggttgcctggagaatcccagaaaatacagagagtgcttgaggcgttctctgaaagatactatatgcaatctcctgagattctggccaacaaggatgctgctcttgtgttatcatactctattatcatgcttaacactgatcagcacaacgttcaagtaaagaaaaagatgacagaagaggatttcattcgcaataataggcatatcaatggaggaaatgatctacctcgagaattcttgtctgaactctttcactccatctgcaacaatgagatcaggactactccagaacaaggtgcaggctttcctgaaatgactcccagccgttggattgatttgatgcataaatcaaagaaaactgctccatatattctggctgattcaagggcttatcttgaccatgatatgtttgctatcatgtctggtccaaccattgctgccatatcagtcgtttttgaccatgcagaacatgaagacgtttaccagacatgcatcgatggattcttggctatagctaaaatttctgcctgtcatcatcttgaagatgtgcttgatgatctggttgtctctctctgcaaattcacaactctgttgaatccatcatctgttgatgaacccgttcttgcatttggtgatgacgcaaaagcaaggatggctactatcacaatttttaccattgcaaacaaatatggagattatatacgtacgggttggaggaacatattggactgtatcttacggctacataaacttggacttctgccagctcgtgtagccagtgatgcagctgatgaatcagaacattcatctgagcaagggcaaggaaagcccctcgcgaattccctatcttcagctcatctacagtcaatgggaactccgaggagatcttccggattgatgggaagatttagtcagcttctttcacttgatacagaagagccaagatcacagcctactgagcaacagcttgcagctcatcaacgaacacttcaaacaattcagaaatgtcacattgacagcatatttaccgaaagcaagtttctacaagctgaatctttgttgcagcttgcgcgtgctctcatttgggctgcaggtaggccacagaaaggaaccagttctccagaggatgaggatactgcggttttctgtctggaattgcttattgcaatcactctaaacaacagagacaggatcgttctcctatggcaaggcgtctatgaacatatagctacaattgctcagtcaacggtgatgccctgcaacttagtggataaagctatttttggtctacttcggatctgccagagactacttccttataaagaaagcctagctgatgagcttttgagatctcttcagcttgtgctgaaactggatgcacgtgttgcagatgcctattgtgagcaaattgcaattgaagtcagccgtcttgtgaaagccaatgctaatcacatcaggtctcaggcgggttggagaacaatcacatccttactctccatcacagcgcggcacccagaagcttctgaatcaggatttgatgccgtatcctttgttatgtctgaaggaactcacctgtatccagccaattatgtactctgtgttgatgctgcaagacagtttgctgaatcccgcgtgggacagtccgaacgctctatccgtgcccttgatctaatgggagattcattagaatttttggctaaatgggctctctcagctaaggaaaacatgggagaagaagatttcgggaagatgtcacaagatattggggaaatgtggttaaggcttgttcaaggactaagaaaagtgtgtttagaccagagggaggatgtccgaaaccacgctttacagtcattacagaagtgtttaggcggagtagacggaatcaacctagctcatagcatgtggtctcaatgctttgacaaagtaatcttcacggttttggatgacttacttgagatagctgctgggtcacagaaagactaccgaaacatggaaggcacattgcttctcgcaatcaaacttctctccaaagtgtttcttcagcaactccaagagctatctcagttatcaaccttctgcaagctatggctcggtgttctaactcgaatggagaaatacatgaaagtgaaagtaagaggcaaaaaaagcgacaagctacaagaatcagtaccagagcttctcaaaaacatattgctggtgatgaagacgaaaggcgtgctattgcaaagaagtgctcttggtggagatagcttatgggagctaacatggcttcatgtgaataacattgcaccgtctatgcgactggagctattccctgatcaagaatcctcacaacttggtgatgatgaaaccgtatcgaatggcttatcttctcctgaaaacacaactggttcgtgaccttacaagtgagatcattaggtgagtttctttcgaatatccatataagtactgtgaaagtgaaagcttcttatgtaacacctctctacgtttttttttgtaatatataagtctttctaattcagagactcgtattaattaagcaagtttcttaattacgactttgttaatcacggacctttggaacgaggtagaaggtcttgaacatgtgtggaacccaccaaaggaaaaatatcagtagattcaggagagttgttaaattttgcctccacgagtttttttcttttcttcttgttgagtcgtttacgtcacgtcgagaattttctcttttcccgagaaaattaagaaaggatcgtttgattttctaagaagggaaagataaacagtgaattagaaagagaaggaagtttcaatg

SEQ ID NO: 16448 - DNA, 3003 bp, Unknown
  misc_feature (1)..( 3003): 2750-1469P.txt file - cDNA_ID_1444123; gDNA_ID_1620346; Annot_ID_154161
gtgatcaaccattgcgaagaatcgggaatcggtcgagcaatttggcagttattgtcagcgatgaatgaaattccggtgagttctagaaagtaccaagtggttcgatcgttggcggagagactaatcaacgataatcaaggagaaaactcagtcgccttgttggatttgaaccgtagggttttaaacgcgtcgtttcgtacaactctaagccggttagagacggcggttgagcgtaaccctaaccggagagatatagatgaaccggttcgtcgtggattaaaccgggttgtcagagctgtggttagagccgtgggagatgggtttatcggttggggtggagaagagacggcggatcagacggcggaaacgtcggagaaactggcggcggaattgctttggttggcggagaagatggcggtttatggattcgtggatgaagccgttgagaaatgggcttcggcttctaacttagcttggcttgctctttcgtgtgagccacgtcttcaatgctctttgatccaaatctctggtaaatatttatttttaccgcatgattttttaatttttcgtaaatatggtaaatactatatagaataatctctttcccaatctggaaaaaagaaagaaaataggattatactctttttctgttcaggatattctttttttattttgtatgataaaaatattttgactttccaaaacaaatttcatttttactgtgaagccttactattcaaagaagccaaggacattaaaaagggaagcgaagaagaagaaggagaggaagcaaaattgagagagataaagaagaagatgcttatttcgtggattccgttgctgtgccgagccagcaacggagctgataaaccggtgttaagaagtgcggaacgagcgtatctagagaaagtgttggagaagatgatatctgaactaaaagaagaggagcaagaacgagttctctcactctggcttcaccattacacacattgcgcttcctctgactggcctgacctcaacggctcttatgttcgttggtgccattcttctcgccagcttttgctcttaggctagtcgtctcatatatctccttgataaacacaagtagaaagttgctacaatatttgcaatagcattgatcttttgtatgtcttaatcatatgtactaagttttgccctttagaaatcacttttatcaataggaaattacttttgtccacccactgatctcatttatgttaatttcctccagaaatttcttgcatgttttgaaggtgttattataccttagggatcaagcacaaaaatgagttgtgggttcaatgttggacatggcttgataaagggccaatattgataaaatcaggtcctaacgctttgtctgttatcagatccaaatccagtccattcataccaaatttcccttgtgctagctttgggatagaaatcaaactacataatcacttacaaaaaatgaaaattgcataaaaatttagattttcatatagtattttataagagaaaaagggaaaacttaaaattaacaaagttactaaagttactaaactagtacagtaattaagtttccttgtgaaatttattttattaggtgatacttataaatatatatataatattcaatactgcctcattatccacgctcaatggtcgaatcgcacggtttagtaccattcggataacgaaaacgggtggcatgaatcctacaaggaggtagcctggaggagtcaattctgatgaagaaagttgataagacgaagagtattaagaggcaacatactacaattcctctccatgtattattcatctcgtctcaaacaacacgaaaactttttattttctttttcaaattttcttttttctgtttttgttgtttgattttcctaaacagatgattatgtgtttaataagaaatgtaatttactattaatagtctggagtgttttttttgtggtgttttttttgtgctaattttaaggttatgaaataggatgcatggtttacgccttaaacatagtattatcgacgattggttatgaacacaagaagaatattgaccaaaaatctgtaattcctacggcctatcaacaaaaaaaaaagaataagaagtaattgatgatctttcaaatgaatgttaaatgtttccaaaataaatatatataaatgttacagtttcatcgctaaatggcttgcaattcttgtgaaagtcaaagaaaattctagcgggtatcattacaatttacaatttagcctagagatcatagtatttgtgattactaaatacaaatgtgaccttatttacgtggtatgtatataatttttggaatactaaattaagtaaattttatttattttcataataagttaaccactaatcgtctcaccttaatcacatgaatttgcattagaacaaaaaaatattacataaatttttaggaacacacaaaaaaaaaaaagatgaagtatcatcgagatagttttatgtcgcaatagttaagttttaaacttaatttattttgttcattagtaataccttttaactgtaagataattttattaaaaatgaattattcgtttgtgttatgaaatataaatgcttaaatattatcaaaagtcatactttttaattattattttccaaatgataagcttatataataagtttaatggaccaacccaaaattgtaaggaagtgactttagtggaatagatacgcgatagactttgacaagaaaaaaaaaaaaaaaaagatacgcaacagagttcaataataaaataaaataaaaactttcaaagaatcaaattccgttccgaattgattcacataacaacatgcatggaagcttaataacgtggacaaatcaacattccacattttattcttttcgtagataagaacgaataatatcattctctttataaactcatcactcaaatgcatttgttgcaattgcaaaaagaaaaccaaaacaaagctcaatcatg

SEQ ID NO: 16449 - DNA, 3003 bp, Unknown
  misc_feature (1)..( 3003): 2750-1469P.txt file - cDNA_ID_1444196; gDNA_ID_1620441; Annot_ID_157187
attctccgccacttagactgatgtggaaaattgatcccccaattgataggtttatttcgcactttagaaaaagtttggaaagaaaagtagacggaactggccaaccgctgcttatcacaatctctggtgccggtggatcgtcaaaatattggaaagaagttaggggattccggcgcggatgatctgtcttagagggcgcggatgatctcctcccacgtgagggcgaagtcatgactcgacgaggccaatcacgaacgctacaggtgtgggagcgatcctggtcagggaaggctaagacggcgcctcgcatatgggtagcactactcgtactatcttgaatgttgcataacagttagaggcctagctagcattagtttgagcagctagccgaaaatcggacaccaaattattgtagactgccctgccggaagaaaagtaattaagttaaagagtgtcgagtaggaggagtcagcttattctatagatactgtaaaagccaactcatgtaggttatttaacttcacatatagcccatcagcttgtgacttcttacaaaataacaacgggggatcctttatccccctgtcttaggaatcacttccccttcattgaaaacgtcctatccatcgtctcgcaaagagacgcccaagatttatagcaagttttgacttgagcgctgccaccgatcggtggcccgttccaaatgtaaaaattttaaaatcataactttttcaaaaaaccccaaaaatttatcatctactacttttacaatttcatgatctctttcaaacgtttcgtctttactctctataaataaaataaaaatcctacattgaaaaatttacacattctcattaatcatcatcgacataggcacacggcgactccatcattctctcccattaaaaaaaatattcaggtaaaaacttttaaaaaaaagttttttttttctttttttcaattggtaggaggttaattcccaatcaattttaggtttaagcatatatagaaaaagaaaaaaaaaaactcaaattcatccattttttttgtgtttttaaattttttctttaaatgatataggagtgtagatgaaaaaattaaagccattttccaaaaaacaattgatatgcatgaaaatcctggaaatgagattcatttaatttgttgtctatatctcacttactaatcttctcctttttgtaattccaaaccctttttattactttaggttagtcacttactctcggctctctcttttcttagctctgttttttatatctaaaataactttttaaaattgttgtgcttgatttgcagagatttggagaaaaacatgattgttgaaagtttcttataatttggagaagtactatctcaagtttgttaaattagtttataattcaagagttttagaaaaccatattttttccttcatttttgtgtgtataggaaaacatacatttttttaacatagatcatttctcatgtgtctcaagacaaatagatctacaaggtcaagcaatcatatttcttttattttcagtcatcttcttaggctaactcaatttcggaaaggagatttataggaccggacaagaagaatatacagtaaagctaaacaaacaaacagagaccaaactgaatatagtgaagaagaataatgaaagaacaaattttaccgcatgttttttttttcttttgtcaatctaccgcaggccataatgtgactcttatattggcttatgatagatttttgtatgctaactcatttagcaaatcgaagtatttttagtttaattctttaatgtcttataacaacttcattaatgaatttaaatcacaaattaaagttacaattaaatcagttttaagaaaataaaccattttaatataaagtttattgtagaaaactggaacttctagattaatgtttgttaatccaatggaattttacatagttcatcattaacgaatgtgtatgtatatattatcttttaaatccaaacatttataagtaaaatattgcatgtaattaatttgatataaatctaattatccaaaatgctatcatataaataataccaatctaatttttttcccgtacgtcgtacgggtggaatactagttctataataattcaacaaaacattattactaattatttggattaataggtttaatggcggacatcgagaatccaccagtgtgtaggatttgtctagacaagggagatcttatccacctcggctgtttatgccgggatgatatgtctcttgtacataaaaaatgtgcagagatatgattcacacagcaaaatactaggtaaatttatttaataaattatatatatatatatattaaaaatattaataactatttgattaaatttttgaattacaagatttgcgagatttgcagcaccgaagctgcaaacattcacgatttcgtcacattgcgatttcggcttcctcgagagttattattttttaatttttatatttttgtaatttttatctttttctgtttatttttttttgtgttgtttcattttcgtattataactattcagatgtgattgtaaacttattttcttaaacgtgaaaattggatttatacataatgtgactgaaaaaaggttgaaaacatcatttcttaaattgcgtaaaatttatatttttaaaatttttaaaactataattagttaataataattcgatccgtagacggtttgtccgctccgaccaccgtaacaattcaaaaccgaagaaaattgtttatacgaatctattccgtaatatatatatatatatatatatatatatattataagaaatttctttttaaaaaactaatccatttaatctataataaaagtcactcgccattcgacaatatatatatatatatattcttcttcactgccagtctgaggatttccggggaaataaagaaacttgactgctaattgctaaaggtaatgcttctgagaattggaagctaatg

SEQ ID NO: 16450 - DNA, 3000 bp, Unknown; identical to SEQ ID NO: 7353
  misc_feature (1)..( 3000): 2750-1469P.txt file - cDNA_ID_1444414; gDNA_ID_1621142; Annot_ID_56645

SEQ ID NO: 16451 - DNA, 3000 bp, Unknown; identical to SEQ ID NO: 7363
  misc_feature (1)..( 3000): 2750-1469P.txt file - cDNA_ID_1444414; gDNA_ID_1621142; Annot_ID_172855

SEQ ID NO: 16452 - DNA, 3000 bp, Unknown; identical to SEQ ID NO: 14996
  misc_feature (1)..( 3000): 2750-1469P.txt file - cDNA_ID_1444487; gDNA_ID_2684240; Annot_ID_192554

SEQ ID NO: 16453 - DNA, 3000 bp, Unknown; identical to SEQ ID NO: 14996
  misc_feature (1)..( 3000): 2750-1469P.txt file - cDNA_ID_1444487; gDNA_ID_2684240; Annot_ID_137754

SEQ ID NO: 16454 - DNA, 3000 bp, Unknown; identical to SEQ ID NO: 8576
  misc_feature (1)..( 3000): 2750-1469P.txt file - cDNA_ID_1444498; gDNA_ID_1971819; Annot_ID_176073

SEQ ID NO: 16455 - DNA, 3000 bp, Unknown; identical to SEQ ID NO: 8576
  misc_feature (1)..( 3000): 2750-1469P.txt file - cDNA_ID_1444498; gDNA_ID_2926199; Annot_ID_201725

SEQ ID NO: 16456 - DNA, 557 bp, Unknown; identical to SEQ ID NO: 8402
  misc_feature (1)..( 557): 2750-1469P.txt file - cDNA_ID_1444514; gDNA_ID_1971791; Annot_ID_58044

SEQ ID NO: 16457 - DNA, 557 bp, Unknown; identical to SEQ ID NO: 8402
  misc_feature (1)..( 557): 2750-1469P.txt file - cDNA_ID_1444514; gDNA_ID_1971791; Annot_ID_175574

SEQ ID NO: 16458 - DNA, 3000 bp, Unknown
  misc_feature (1)..( 3000): 2750-1469P.txt file - cDNA_ID_1444514; gDNA_ID_2926197; Annot_ID_141341
taaatcgtttaatatgctttgtattttggtaataaacgttttgtaccatatgattatagatttaaccgtctataacttaaaatctctcgaacagaacgcaaacaacacaaaagtgtgtgttttattacccccaaaaaatgtgtatccatcgttgaatcacaatactccaaaccattggtctatataaaaccttcaattgatggtttaggattgaattttgaattggtgataacttactttcaaaaatcaggccataagatatggttaattaccctgaaaatttgaattacatgaactcattaagcactatagtttcaaaaaataaagataatccaataacatttattaatcccggaattgacaagaccagacttagttgtccgaggtatgggttcgttcaaatgacaaatattgttttgagctaatattgatattaggcctttgattaagaattgttgatgaaccattataacattaataaaattaagttcgaaatgatacagctgtaaagtagtgggaccaagttgacgtttggttaggcggtccaaatccaaatttccgtgtcagggaaaaattcatccaatgaatcatatgaatatgatatgtattatgtataattgtatataacttctagtagtaattaatagtgtttgctttaattacgtagcttatcccatctttatggtccatactattacttactcaaaactaaacactatatactatttaaacccaaactatcttctgtacttttctcaagttatgtcactatgtcagcgtaataagaaaattaacttaagttagacaaatgatattattctactacaaaacgtagttcttttatgtgattagtctaacattcgatgtaatggtttatcatttatgttacggaagaaacattcaatatatttttatgaaaacaattttatcattcttatataaactcatcgaactagctttaactaaattattcaaacgtgttagtatggaaagattacatttttctatattctatagttttatgatattgtttggcaatgatgtgaaaactcagtatgattttctgaaataatttagaccacttatttgttattacaacttttttgattggcatgaaacaggagacaaaaatagcaaaaaattagaaatatcaaacattacttgttcctttatatgaacaatgaggatgaaaatagctttggtgcttgaaaacaatacctttgagtttggaccactcatattcattagtcatttccaataaatatcagtagttgccctcatagacaaacattaaatttcttttatttgtggttcctcagatttaattctagcttaagtactgtggacagctgttttaatttgtcaaatgtgtataccaatcaaattaaatttctgaatttgatcaacaaaagaaaaccactctaaccacaaccactaatgcgtgtgcatgcacacaatatattaatatatgattctataaaataaattattttaccttattggttcttaagattaaactgaatatctacatgtatatctcagtggttccgttttttttaaagtaaaacatacaaatattacgtatataattcagctttactttggttcatattctttttttctttgggttcgtattctttctcatacaaaagtttacatcaacaattatatcatttaataggattagaaagaaaacaaataaagtagacctataggtatggttgcacatattgattagtgattaatatagttttgtagtattttgcaatgaaacatcttaattgactcccatcattaattagtgaccaaccaaaagaaattgaccttttgatttagaagaaagagaaggaaagcgtgtgtgtggttacttgcttgcaactttgctaacgcaatcaaatcttttaacccatacactatactcatacttttcttcgttgcatctattctcatttcatttcacacaataatatggagtacaatattattttaatcacatcgatcatagattcatgataatattgccaaacaaaatgtaagcttaaaaacttttaatgttaaaatgtccaaagaaaagctcgacgtgagtcaaagcaagttgtttttattccaaaaccatggtccagttacgaccccataataggatacatacaaacttgaaaagttataaaaaaattcaagaaaaaaagatattcacaagacatattctcttcatatttcaaccaaattcgagaatttgaagtcgaacaattccacacgtaatatccctctagacctctggtttcttctttccttcctataggtctcgccgtagtgatctaagctttatgaaaacatttgaatttcgagattcgtgtaaatacataaataaataacaaaagatgcaaccaattatatagcaaacgatattattaataaagattattaaattataacacaccaagaaaaattattaaagtatatcctagcatttactaatagaagagtctaattttaattttgttattgctcaaacacagtatataattttagagatttctttggtttacgtcaaaaaagtctgtctcaattttaatattttagtcggtcatcagtatcgtccaaacaatcattttacttttgttatgataaaatacggaattcctcccctaatgacaatcaaattcgaattcaaaagagctaaacaacatatttctaacaaataatatgctcatgcatgctaatatttactgtaacatttaaaaaaattaaggatggtaaacataatctgcttaccaaatgatggagatactcaagagtccagctgtaatacatcttgcatgcaatatcttgatattagcctccttttgttcacccactctcttctcttcttcttctcatttatttatatgttaaactctctcccactatatatatctctcccccttcttctctcttcctcacattcctcaccaaaccctctccaaaacacacccacacgtacgcacacacacaaagacaatg

SEQ ID NO: 16459 - DNA, 3000 bp, Unknown; identical to SEQ ID NO: 16458
  misc_feature (1)..( 3000): 2750-1469P.txt file - cDNA_ID_1444514; gDNA_ID_2926197; Annot_ID_201558

SEQ ID NO: 16460 - DNA, 2749 bp, Unknown; identical to SEQ ID NO: 4782
  misc_feature (1)..( 2749): 2750-1469P.txt file - cDNA_ID_1444629; gDNA_ID_1620732; Annot_ID_49407

SEQ ID NO: 16461 - DNA, 3003 bp, Unknown
  misc_feature (1)..( 3003): 2750-1469P.txt file - cDNA_ID_1444629; gDNA_ID_1620683; Annot_ID_48406
aagtaggataggctattacagttgcttcatgtcgtcctccatcgtctggtaacaagggacgcactcggcagaagacacgtatatttccttttaattcctgaatttacagcttctcttagctcagatcaagacagccacatatataagggaaaaaaaaatagtttcttacaagaatagtgttatgaagcttcttccgcaataactctccctcacacagttgatgctccatgtctgcaagccggtcttgtagttcgcacagtagatgcttctgctcctcaaactctgtcctagtaagagatactgatgcatctgccatctgtattcacagttataaatatctatcaaattagctatttgaaatcaagagcatctgaaggtcatgtacatcattaacttccgagataaaattgatcctcctggtaccttttgcctttcattggcgattgctaattgctgctctaacatatttaaacgctccttctgcaacgaacatgtctcctgcagggtaaaactaaatatgagacaggaatgcgaaaaatgcacaactttgaactgacatccaatactaaaacaaaaaaagtactaacctccaacgatcctgattttgctgtcaagatgtctagctcttgcgatgactttccgacattctcctggtacttcctgatctcctcagacagcttctgtgactgtacaacttggcgatcacggtcatcccggacttgttggagctcattccgaagattagtaacttccgaaagcaatgaatccttctgttttatagcgtcatcttgcaacaccttgatcacaaaaaaaggaagaggaacaagttaagaagaaatgagaccaattaaagttagcacgcgacagtaaggccagtggtagagaagaaaaacttactctgcttgaagatagttgatcctgcagcgacttgctgtgtcccctaagtgtactaagattctccaggatgcttgacttctctttttcagcacgtgtgagtgcagctcgaactgtttcaagatcagtctgaagtttgctgttatattgttgcaaacttgtgttgtactcttgcagccttttgtacatatcctcaagtgacgtcacctataaacacaaaacaatttccatattaactaacagatcatgtggaactaacacgagaaacagaaatgaaacacctaagaaaacaccagaagacatatgttatataccttctgcttggcagccattttctcttccttaactttatcaagttcttctccgagagaagcctgcactttttcagctgcaactctagcttctttttctcttctatgacattcaatggcgtcctagtgttcaataagtaagaggaaagcaaagtcaagtaatgaatttcattaaaagaaaacattcacaattagaaaaaccaggcaccaaaacccttgcctgtgtactagactcctcctttgcaagcttttcatgtagtgacactacattctcttccaactttgagatagtggcctgtagctcttcctcttttgtcctagcctccaactctataagagtcaaaaagttagggactaccaccaaatgagtgaataacttgtttcatgtaaaaaaatcgcaagaagaaaataacctttgtggttgtatttttgttctgaagattccaaagaaaccttcaaattttccttctcttggacatgggtttcatcagcttgttggaaccattttacacaaaccttcagcctcttgataatatccgtcatttgctcaatcttagcctgcagggacagagacaaaaaaaaactccttctgagtgaaaccataaatgaaaacatctacaatgcttagagcacagagcaagtgtaactcaatcaatataccttagtatcaaactttccagcttttgctctctcactgagcaacgccaatatttcatcttttgtaaagtcaactttaccacattcttcaatgctccctacatcgctgttcatcgtgacatcttgtttattcacagccgaaaaagcttgtcttctcccagtacctccttgcgtttccactttccttcgcttgtcaaatgaaatgccaccgagaccctcctttttctgaaattgaatcaaaagccacagatttttcatcagtttcataacaaaaccaatatccagctacaagaaatgtagaatcccagaacccacgaccactctaaattctattgataacacccatcagagtaagaaatgcaaagccgatgaagataacaccttaataaattcatctggtaagctcacaaacaaaacccaaaatgcgaaattaataattcgaccagtcctagggtttttctcaaacccatcctccagaacactcaaaagtgacgacgaaatgtagtggaaaagcatgaaaaagggagcttacggcgtttggactgcgaggaggacgattctggttgcgagaagccatctccgagactcaaaattgctacaaatttcttctcctttcgctcgtcaagtgcataaaaatcccaaaatggtagtcttctccctaaattcgggttaccgacaataaaatctccgattgattctcaagatcttagagaatcaaatcgaaaaccttctcaatcgaagtcgagaaactaggattcttactttttcctaatttggggatttttgtgtgtgtgtaagtgtgtgactgaagcaggagcctgtagtttcgaaattcgaacgattttgaaattagatgtggcggacttctggaattatcataacgttatcaatcaataaagtatttaaacatatgggctaactttgggcctacaattcggcccaaatgtttaaataatcttgccacgtggctttaaggcggacaaaaatgacacgtggttttatatgagtggctacaaccatatccaagttatctaaagtacagataaggcgctctgtgtcggagaatgaaaccaaccaatcatataagcataaccaataatcatcggcttcaattttcgtcttgagaaagaaaaacaaaatg

SEQ ID NO: 16462 - DNA, 2749 bp, Unknown; identical to SEQ ID NO: 4782
  misc_feature (1)..( 2749): 2750-1469P.txt file - cDNA_ID_1444629; gDNA_ID_1620732; Annot_ID_166109

SEQ ID NO: 16463 - DNA, 3003 bp, Unknown; identical to SEQ ID NO: 16461
  misc_feature (1)..( 3003): 2750-1469P.txt file - cDNA_ID_1444629; gDNA_ID_1620683; Annot_ID_164553

SEQ ID NO: 16464 - DNA, 3003 bp, Unknown; identical to SEQ ID NO: 16461
  misc_feature (1)..( 3003): 2750-1469P.txt file - cDNA_ID_1444629; gDNA_ID_2926177; Annot_ID_140403

SEQ ID NO: 16465 - DNA, 3003 bp, Unknown; identical to SEQ ID NO: 16461
  misc_feature (1)..( 3003): 2750-1469P.txt file - cDNA_ID_1444629; gDNA_ID_2926177; Annot_ID_199956

SEQ ID NO: 16466 - DNA, 3003 bp, Unknown
  misc_feature (1)..( 3003): 2750-1469P.txt file - cDNA_ID_1444645; gDNA_ID_1620744; Annot_ID_166589
caaccagcagcaccagctgcaatcaaatcctttacggttctttgaatgtttagcgcatttcctccaccggtatcttgaaaagatcaaaagaaacctatgaagagaactataaccaagcaaatccactattttcaaaaagctatgaagagaactataagcaagcaagcgactctaaccaagaaagattgatactttcaatctttggtaaagaatcaacgactcaatgtttttaaatgttttttttccttttttggttttagttaagcttcttgcattctttaatgatgtctttattatactatcaaaattttgcaactttaccagcatctgcaatgatgggtatattaggagctgacgcacacaccgaccttgccgtcgcagccatctccggtggtctaaaacgacgaaagaacacaaataaaacgaaagcatacaaacaaaaaattactaaagaaagaaaaaaaaaaaggtggcgcacgttagcaaaccgaaatcgggttttcccaggagagaagcggataaggcgtaaccggatataaaaccagcggagaatccggtttgctgcacaatagccgcggataaggcatcgtagcatccaggcataagcacaatgccttgttcttcaatcaggcgatgaaaacgtgtttggattctcgctgtcggattcaccaatctcgccgcgcgtgggttccgtcggaatgttggtgaagctgtaaggtttaagctgctacaacagagtgaagttgttttgacagccattaacatcgacattcttcgaagcctcgaacaagttttttcttctctctaatcgagttagactctgacccacacgcttgggattttaatagagagcacgtggttattatatctcggtcttatcttatggtaacagtatctcaaagactcaaaccacaaggtattgtgaaaatgttagaggcaatctaacaataaatgtataatttggttagcttaagctcatcatagaaatgggcctttatgtcaccaaacctatttcacaacataacacaagagcccacaaaacaacgactcctttctccaccagaacaagcacgacaaaggcaagagagttgcaaaagacctataagatgataacaatcgaaaagatgtaaattttgagaaaaatcaaaataaacaagaaagatttcattgtttttcactttttctccatttctactttgattttacatactctatgggccaaccaatttccaacctaatgcttgataaaaaatgattcggttttactatctcaacaaattgggcctacaacatccaatttcatgtagtgacttgtttttgcctttttcacatctcaacaaattgggtcgtttgtatttaagaaattgttacagctttttagactgaattttactttatggctttatgctctctttttccgttttgattaagggtgaatatgtaaactgttgataccatctgattttttttattttttatttttcttgtgtgcaactataccatctgaattcaattgacattttagccaaataaaaaagattggtccacttggatggctgtaaaaaagtttagtggaagtatttatagggcttgttggcaatcttcaccaacggctataatgttgatctttttaaaattaaacttaccgttcgactgtcttctcaacgatttgacaattagccgttagattagtattactgatttattattaacaaacccatttcttttcttatttttgaataagctaaatcaggccaataaaagggacaagtagagatgggctatttctttttttctctttttttttttcttatgtagtagagaaaagcctttattcttagagctatcatttaccacccattaaccagaagctgagaaatgaagcaagccgaaacgaatttgtagttttggacggtgaaattatatcgggcctttaatgggcatgtgaatagagttgagagtctttttgccccaaataatcgtttaagggagtattggctcgttggtttaatattgggccgaaacgagattgggaagaagaacaatgtcggtttaatccggttagggtcgtgggctgattctggttcacctttatagcgtaagcgaacaaacattgaaaatggggaagccaaattagttaccatccctaactcagttttgagacgtagtatgaatgagccacggcagaacctacgacctaactcgataaagtaatggttactcttggagacggaagaaagcacaaagattttgataaggctttctagttggtgaaatggtcaaaatcgctcggagagccatcataggagcggggaggtgctatctgaatatcccaatgcatcaagacaagatggattcagaaaacaaagaaattaaacaaacattttaaaatatgctcttagttttagataatataatgttttcaataccaattatcttacactgatagtggtcaagttactaatcacttttaataaattggtgatagtcaaacgtattgaaaattatcgatttaaaaatatttgaattcaaaaccattttagtgaaagtttgcattgtagttttgattatccgatcaatctttaatataattacgtcaataataactgaaatccttgaattaaccgttacccgattcataagcactactttccgatcaaaaccaatgagataaaataacttttaaaccctccaaataaaaagagaaaaccttaaaaaccaatttctgttcggtggggatgatgatcggactcggaccggtctaaccgactggattaaaaagtctttaacaacgacaagcttaaaaatttgcctcttagtggcttcaaaacgcaatcgtttcgcttaatactattattttctctatctcgtttaaccaaaaaaaaaaacgagttggaggaaaaaaaaaaccaagaaaaaagaataaaaagcaaaaagcattgagcgtctccggagattaggattaaattagggcataacccttatcggagatttgaagccatg

SEQ ID NO: 16467 - DNA, 3000 bp, Unknown; identical to SEQ ID NO: 13298
  misc_feature (1)..( 3000): 2750-1469P.txt file - cDNA_ID_1446584; gDNA_ID_2214613; Annot_ID_187447

SEQ ID NO: 16468 - DNA, 3003 bp, Unknown
  misc_feature (1)..( 3003): 2750-1469P.txt file - cDNA_ID_1447379; gDNA_ID_2926273; Annot_ID_143478
tttcgttacttaagagcaaaagaaaagagaacatatttaggtttatgatgtaaccagaactgctctgttttatctgtcgagagaaggagaacaaagtaagtgggaacttgtttttatttcactgagacacgaaagcaacgacttgtaacttctcggacactgatacccattcacaaccgacacgattgtgttatgacaccgttagacttttacatacacacttaattataggagtataacataaaacggaaattctattacaaactaacacttacaagcttacaaatttttttatgtcttccattaacatgtccatcccatctaggtgaaggatcatcaagaactatacttctataggattccttcatttccaaggtattagccaatctgatgattacaaaaaccacaagaatgcctgcgcttgtagactcggaaatttgttttatcatcgtcggagttttagagtctttgtctaatttgctaaacaataagttaaaaggaacagacattaaaaacatgcaactgaaagaagtattaagacaatatctaagcccaacactaaattatcttcaacttggacgctactagcggagataatctgtaaaaattctctgagaacgataattaacgttaattgaaagataagctgtaacgataatggaaagattcgcataaacaaattcgttccctaaaatcaaaatctcatagcaagttgtaacccatcaaaactagcgaaaacagatacataggttcaaaagaagaagagctttgagttgcaatgcagacaatgaaatggtccttcttgaaggacatgatcaactctattcttctcaagccacaagagtgcttgcagttgtagactcgctgcaaaagcaagaacaagagttggcatcaaaattcaaagtcaagagatgataatcaagaactcttagatgttcaagtacttactacttccagacgggtgggagcttcttggtcttcttgtagtaacgagcaagacgatggattctgctctctacaagaatcagcctgaatttggaatccttatctttcctgttcctctcaagatgcttgcggatagcaacagctttcttgatcaagtgatacagatcctcagggatctcaggtgcaagacctagagagaattacaaaagatctcttagtttcagtgattattcaataagcaaaaaaaaaacaaacacttacaaaagaatcaagagagattgaatagtaccatgagctttcaaaattctgagaatcttgcttccagtaacacttttcacctgtggaattccgtgagagtcacgaagaatgacaccaatctgcgatggggtcaaacccttcttcgcaaatttgcagatggactcatcaacctaattcaattatcaaaacaaacatcaggaccaatcaaagtaaacactttattctcaaagaagtatcaagtaagctaacttggagagtgcaagcaaacacatcaatattgattgcatcacagatagtactcatcaacagattaaatcactaaaacgaactatcacatcaagatcataactctatttcttaatatgtcacaaaaggattgaaactaacaaacaacaaatcacatcaataaaatcaaattcaatgacaaaccaaaactaaaatgcagaagattctcatattccaaatttcctaaccaaaattagaatcaaatcctatgttcagccatgcgagaggtagcgataacattttcgaaacacaaattgaaaatgaaatcaaacagaaatctagattaagtctacgaatcttacatcttgaggggttgtcttgagccagctcggagatgaacgcttgtacggcaaagcagatgccgagatacccttactacagaacacacaacaaaatgtaagagaacaagttttcaaatcaagactcaatcagatacgagaaggaaacgaaccctctactatgcattcgacccatgactgcgacggcgaagtgatcgtcctctcactgagatcgttcttcctcggtttctttcttacggctgctgctgcgcttcagagaatccacaaaccctaaattgcttctttatatatacctcgtatcttatggtcgtgccacaggtctttttgttccctaatctatatgggctttagttttcatacataggcccaattaaaattaaaagtctacaaaaggaggccttgaaactcatgtataaaacaacacatatgtaaacgttaccgtttcgaaaatagataaaaactttcgttagttttaaattagttagcatttagttctttttcataatcagtattagcaggtttaagtatacaattttgttagttgtttattgtgtaatgaacttttaaattgaaactatattattacaataggatgcataagaaagtatccaatcgttctgattagaagtctaatcaagtagtcatcaacctaaggataagtgaacaacaaagacgcattaatagcaaaactcattttaaacaaaaacggaacctagctaaattggtttatgcaataccgatctattcacaatgtatgtagacacaaaatagggataaacgtcattgtatacacattaacctaacaagcacgttacactacatatatatcacagtcccaaacgaatacttaacacattacacatgatcataatcaaaagtcatttaatatgttgcacagggtgtagaatttaaaccctagacctaaagaaataaattcgctatcgacattaaatgttattcaaaacaaaatctaagaatcgaagtgagtaaataaatgggaagatagaagggaatgaaggacacgtaaatgattgggttaaacaaatgtcaacgctaagtccattccttaaagccaaaccacacccatttattaacctaactgcctaaccgtcttgtcatcaccttcctttcctcaacttctctttatatagaaaccctttcttctctcgaaagccaaacatttttatcaagatattaacacaagaatacgatcatg

SEQ ID NO: 16469 - DNA, 3003 bp, Unknown; identical to SEQ ID NO: 16468
  misc_feature (1)..( 3003): 2750-1469P.txt file - cDNA_ID_1447379; gDNA_ID_2926273; Annot_ID_205205

SEQ ID NO: 16470 - DNA, 3003 bp, Unknown
  misc_feature (1)..( 3003): 2750-1469P.txt file - cDNA_ID_1447386; gDNA_ID_1972069; Annot_ID_178546
aaacagggcaatgcagagtagtagttcgaggtttgatatgatcttttcattttcgaaattgttggatgtaacttgaaagagttttagcttttgagaattgtattatgttgtaatttttgtaaactatatatataatttaaaatcttatatataaatatttaaactttaaactttttcgattgattaaataattttagataaattgtcttattttcttaactatacctaatatttttgttttttaagtgttaaattttaaatatgtgtaaactaattgattgtccaattatgtttatttagaattttaacacctatttcatttatcgaaaaacgtttttagtttttagtttatactaatttatatatcaatatttaaaaggtttttcgatgttttccatactcttgatggagtaaactgatggttccttgaaatgtggcatgaaaaaattgcaacacataaaagaatccaaggccataacattcatcattggttcacgagtcacagaatacaaaaatattatataagaaaatgaagtccaaggacaaaagaatacagaaaaggacacaaatagactatgagagagctctgaagatcttgccttggaaacacagtgagctcagcctttgcctgttctgcagtctggctcatatcataacacattgaactttaacttcttgtaacttgaacgtgcagcgatgcgtggacgtgtaacaatcaagaatcacactagtttttaacgtctatcatgtaatccggagagagattcctgaatcagcatggctgcaaatgattagttttgcagattcattgatattaggaatatgcaaaggtagcgatcagcaaatctagtaaactgacgaaaagattacctggaaaactgcacggcggatgtagtgaaagagtggagaccgtgaggtttgagaattgagtcattatttcagtgatcgtttgatgagaaacttcaagtcttacccctatctgattattttctgtctactgatcgttgacccttgtagccttcctgagaaccaactttttgaagattcatcctcttgctttttctgacccccttcaccttttgctcctcaagaagtttctggagcataggatttcctacgaacccctttgatttcatctctgaatagatctctctggccttttcaagccacccacatgacaaaaggccctgtattgtagccaagtaaagagcaggattagccactatctcaaaacgatccatttctgcccagatcttcaaagcattttctggttgctttcccttgaacaattttccaagaataagaagaaaggtctcttctgtaggacctaaatcagagatcttcatttggcctaaaacctctaaagttttctcgaaatttacagcctcaaggaatgcatgaaatgtatcaactgttggactaaggttctcactaatcatggttgccaatacattcctggctacgtccagctttccagcctcacaaagggggcgtatcatcgagttgtaggtcactgaatctggctttaatccttcctcgttcaactttttcataagcttcatagcttcatcaaagcaatcctcacgggtcaacacataaaccaaggaattgtaaacttcaatccctggagccaatccccgtttcttcatttcatcgtatagcctgagagaatcaaaaaggttcccaactttagagaagcaagagatcatgtgactgtaagagtccttgttaggcgtgatacagtaattccccatctctcgccaaatcctctttgcttcagtcacatcagtccaaatgttacaccaaccattaagaattacgttgaatccctcaacatccaccggaaagagctttttgcttgcaagcatgaactcttcagctttttcaatgtggccatgtctacacaatgcacatagcaatccttgaaatgcttcatcataaggagtgtgtttaaacttatccataatatcaaatgtccgaatagcttggctagtatcattagcagcagcatatctacatcaacaccgtcaccaagacaaccaattcaatacctagctagtaaatctttcaatttagcacaacaaaagagaaacttttatcaagaagacgaaaccgaacctgtccatcatgagaaacatggcctttctagtatcctttgaaacattaaacatatcacggatcaaacaccaagcaatgttgaacttttgatgattacccaacacccagatcatcaaatcacaagatttctgatcatcacagccgcgtttctctccccatttgaatgctagaaaggcaagcctccattcatctcttaattcccagattaaggagtagaaagaatcatgatttagatcaaatgatgagtcctccagagaagccatggcatccgcctctgactccagctcagagacctgtctgattaaatcaatcagacccttttctaacggagccaatgctgttaagttgatatcaaatgtttcggagatggttttggtggagaagcgattagaagaggcaaaatgtgggagatagcttaaaacttgagaatgcacatgacctgctcgatgaaatgctgaagagaaggaatgattttgggaaactgagctcgaaaacgacgtcgacactgcacgacgtagcagagattgatgctgaacaatccgccattgtggcgttcgcgcgagtttcctaccaatggcaacgatcgcggccatagcgagtgagtgagaaggcttaaattaatacatttcaaacatggtcttaatgggatgaggatatgaagttaatggggtcaaaaacgaatatatagataatatggggtctaatatggtaataaacaaagtaacactaatatgaatgggcctaaatagggcccattttagatttctttaaaagatccgagagagagagggatctaattcctgataaaccctagaagaagaagaagaagaagaagaagaagaagaagaagaagaagaagaagcaaaacctgtggagatcgagatg

SEQ ID NO: 16471 - DNA, 3003 bp, Unknown
  misc_feature (1)..( 3003): 2750-1469P.txt file - cDNA_ID_1447726; gDNA_ID_2926221; Annot_ID_142427
tggagtggaattgccagagagatgatggacagtatgaactggattggttgttaagcctgtcatcgatgcgaaaggtcccgtggtttgacgcatgtcaaatatcaaaaccattccattttgtagtccagcataaatatggtgagagcttttgagatcccacgagcaagaccaaggtgcagccggtagatcataagataagacagtattgtggctctccaagcttataacagataatttttttcctagagacccaaatactgcaagcccattattgtgaggggaaaggtgaagatctttaattgctctagtggtacgaggcaacaaaatatcatcaatctcacaaggcgaatgtaggctcatctgcaatatattaaaaaaaaaggtcgtatagtgcatcattttactggtataagataaaaaagaaaaatgagaggcaaaacaaaaaagcttacttgcgtaagcacaaacgttccaccaacgcctgagagcctacgggcatataataatatttgtctaccaccatctatgtcaaatatacggccaccgtttattagcagatctccctacgaaaaatggatggtaacgaactttataatttgcataatacacatcaacacaattgcaaaacaaacaatacttcaactaaaccaaaacaatgtgtctgaaggagcactaagccacacctgatgtctgaagctgcaagaaggtgactgtccatgatgctcttggtagatattatgagctgcaggcgtgcacttacaactatttagacgcagagaatttcaagaggaagaaaacaaaaaaaaggggcatgttattgtgtgattaccaggtatatatttctcctgagaagccacattagactggctttgcgaacccttagtcgtactttccatattagctattttctgcaaaaacaaaaattctagccatgacgctaactagagaaacatgtgcgacaattttatgagaaaaaaaaacaaaaataaatataatcttaggttgggagggaaattataatgggaactcttagtcaaactgagctcccttttaagagtaacgaaccaacttaatattccagactcgactagttactagtaatcttaatctgtccaagcacaaaacaaagtgacaagagtgaccacgttacaacaaactcttagagtgtaccttcttcagcttagtaacttctaatcgtagctcagcttcagttattttccattgaacttctttgttactccaactcgcagtctgcatgacaaataagaacatattaaaagctacaatactagtacgacgggctacacacatatgttcctgtcatctaacacagacataacctacatagacgacttatataatgaacacataaagaggttttagtactgaggaaaatcttattgcgaatgatttgaaagcatttcaaataacgaagcccaaaataatgcggactaatactagcaatatcatgaactatctgagcagtaaatttatcctaccttctgttcaattgaccttaacttggcctccagaaataagattctctgcaaatatcaacaaaagaatatcagattttgatactatgatttgcttttacgaatgtatttcggaaaaacaacactcattgtaagaccttgtgtgcttcatcatctactgcagcaacccgtgatgcatagattttccggacatctctcaagctacatattttgttgcacaggggacactacaaaagaagccaatgtgattcgatgagcaagataactatatccactaacagcaaagggatttgaacaacttcataacaaccacaaaccttccctccacttcgtcgctgctgaaaccacttgttgatgcaggaatatccatacaagtgtccacagggaagacaacttgtaccatcacaccagattaaaaaagaaaagagaacattagttgcactcaaaatattagacgtgaccagagtaatcaaatagttaaaagagatactaatcacaatccagttcgaaagttttgtatgacaaaaacctaatcaactaagaactatataattgccagtagcaaattactgtcataattcatcaaaattgatagacctagatcatgagattatcaaattgctaaaacaaaacataatctatacactatagcctctaaagagccaacgaattccaaagctaaattactggaatcgagaataccagacttggtgttggccaccgctggtccaaacttccatacagatagaacaagacaatccctcagtgtcaccttgtttccattcgacatcctcctgcgatccggaagacgatgaacaaacaccttgtgacctattctgattctctatcccttcactctcgttctgtgaaaccctaacaggtgagtctaggacatcgatgtattccctggtttggcgttcggaatcttcttcctcctcttcctcctcgtcttcctcttgtacttcaccatagtcgacatatgcttcctcttcgtcttcctcttcttcgtcttcttcttctccatagtgtccaaatgcttccccaaattcaatgaatcgtgcaattgtacctccgtgaccactgaaggggtaactccggcgaggcggcattaggttcgtttctgttactgtatcagatttcggaagagaagaaggccaaaacgtctcggcagagtcgcagaggtatcgaataagagagactcccggaattaataaaaataatatttaaaagtaaaaaaaaatagttaaaagataaaatattataacaatgcggtgagcgtggatcgaacacgcgaccttcagatcttcagtctgacgctctcccaactgagctatccccgcttgttgttatcatttaatatttaaactttaataatctctaaacgtaagcgtcacgtcaaattggtcgcagtcttcaatgaaatgttcgtgacttttagggaagaaaaggtgtttggagagatatggggagaagcatattttcctttttcactaagaagaaaaaaatg

SEQ ID NO: 16472 - DNA, 3003 bp, Unknown
  misc_feature (1)..( 3003): 2750-1469P.txt file - cDNA_ID_1447726; gDNA_ID_2926221; Annot_ID_203311
cccgatggaagaagcagataagagggtacggacatcagaagttggagtggaattgccagagagatgatggacagtatgaactggattggttgttaagcctgtcatcgatgcgaaaggtcccgtggtttgacgcatgtcaaatatcaaaaccattccattttgtagtccagcataaatatggtgagagcttttgagatcccacgagcaagaccaaggtgcagccggtagatcataagataagacagtattgtggctctccaagcttataacagataatttttttcctagagacccaaatactgcaagcccattattgtgaggggaaaggtgaagatctttaattgctctagtggtacgaggcaacaaaatatcatcaatctcacaaggcgaatgtaggctcatctgcaatatattaaaaaaaaaggtcgtatagtgcatcattttactggtataagataaaaaagaaaaatgagaggcaaaacaaaaaagcttacttgcgtaagcacaaacgttccaccaacgcctgagagcctacgggcatataataatatttgtctaccaccatctatgtcaaatatacggccaccgtttattagcagatctccctacgaaaaatggatggtaacgaactttataatttgcataatacacatcaacacaattgcaaaacaaacaatacttcaactaaaccaaaacaatgtgtctgaaggagcactaagccacacctgatgtctgaagctgcaagaaggtgactgtccatgatgctcttggtagatattatgagctgcaggcgtgcacttacaactatttagacgcagagaatttcaagaggaagaaaacaaaaaaaaggggcatgttattgtgtgattaccaggtatatatttctcctgagaagccacattagactggctttgcgaacccttagtcgtactttccatattagctattttctgcaaaaacaaaaattctagccatgacgctaactagagaaacatgtgcgacaattttatgagaaaaaaaaacaaaaataaatataatcttaggttgggagggaaattataatgggaactcttagtcaaactgagctcccttttaagagtaacgaaccaacttaatattccagactcgactagttactagtaatcttaatctgtccaagcacaaaacaaagtgacaagagtgaccacgttacaacaaactcttagagtgtaccttcttcagcttagtaacttctaatcgtagctcagcttcagttattttccattgaacttctttgttactccaactcgcagtctgcatgacaaataagaacatattaaaagctacaatactagtacgacgggctacacacatatgttcctgtcatctaacacagacataacctacatagacgacttatataatgaacacataaagaggttttagtactgaggaaaatcttattgcgaatgatttgaaagcatttcaaataacgaagcccaaaataatgcggactaatactagcaatatcatgaactatctgagcagtaaatttatcctaccttctgttcaattgaccttaacttggcctccagaaataagattctctgcaaatatcaacaaaagaatatcagattttgatactatgatttgcttttacgaatgtatttcggaaaaacaacactcattgtaagaccttgtgtgcttcatcatctactgcagcaacccgtgatgcatagattttccggacatctctcaagctacatattttgttgcacaggggacactacaaaagaagccaatgtgattcgatgagcaagataactatatccactaacagcaaagggatttgaacaacttcataacaaccacaaaccttccctccacttcgtcgctgctgaaaccacttgttgatgcaggaatatccatacaagtgtccacagggaagacaacttgtaccatcacaccagattaaaaaagaaaagagaacattagttgcactcaaaatattagacgtgaccagagtaatcaaatagttaaaagagatactaatcacaatccagttcgaaagttttgtatgacaaaaacctaatcaactaagaactatataattgccagtagcaaattactgtcataattcatcaaaattgatagacctagatcatgagattatcaaattgctaaaacaaaacataatctatacactatagcctctaaagagccaacgaattccaaagctaaattactggaatcgagaataccagacttggtgttggccaccgctggtccaaacttccatacagatagaacaagacaatccctcagtgtcaccttgtttccattcgacatcctcctgcgatccggaagacgatgaacaaacaccttgtgacctattctgattctctatcccttcactctcgttctgtgaaaccctaacaggtgagtctaggacatcgatgtattccctggtttggcgttcggaatcttcttcctcctcttcctcctcgtcttcctcttgtacttcaccatagtcgacatatgcttcctcttcgtcttcctcttcttcgtcttcttcttctccatagtgtccaaatgcttccccaaattcaatgaatcgtgcaattgtacctccgtgaccactgaaggggtaactccggcgaggcggcattaggttcgtttctgttactgtatcagatttcggaagagaagaaggccaaaacgtctcggcagagtcgcagaggtatcgaataagagagactcccggaattaataaaaataatatttaaaagtaaaaaaaaatagttaaaagataaaatattataacaatgcggtgagcgtggatcgaacacgcgaccttcagatcttcagtctgacgctctcccaactgagctatccccgcttgttgttatcatttaatatttaaactttaataatctctaaacgtaagcgtcacgtcaaattggtcgcagtcttcaatgaaatgttcgtgacttttagggaagaaaaggtgtttggagagatatg

SEQ ID NO: 16473 - DNA, 3000 bp, Unknown; identical to SEQ ID NO: 11702
  misc_feature (1)..( 3000): 2750-1469P.txt file - cDNA_ID_1448051; gDNA_ID_2214512; Annot_ID_133848

SEQ ID NO: 16474 - DNA, 958 bp, Unknown
  misc_feature (1)..( 958): 2750-1469P.txt file - cDNA_ID_1448128; gDNA_ID_1620528; Annot_ID_159620
gatctgataaatcaaatggtgcacgtcgtggtagacaatggagaagccagccgactaatgtctctgagatccctcctcttctgagctctgaggttcacaaaattcataactacgagaagaaagatcataaacaccgacataataaaaggtctccatctccgcaggctcaatctcagaggaaaaggtctagaactgacgactcacggaatgaacaggtctgttattttgttaatttctgttgaatagcaatcaccacgtaatacttggattggaaaattgaaaaaaatgctaaaatagtttattggatgggatattgtgaagacattctcagtgtaaagttttggtcagagggcatctttgcgttctgctttgtatgagactaacaagtcagacgtccgtattactcttatctttgtgttataaggttgccttgttccagtatttgtcctgctgtaaagccaatgtatggatactggttatggttctctgattttgttttctttgacttgtttgatagagggaagctaaacctgatgtctctcgccggctgcttcagtttgctgtgcgagatgctctagctatatcaaggccggcaaatagttcgactgaatcctcattaaaacgtcttcgttcagtggtgtccacatctactcaaaactcatctgaccctgatccagctcggaaaattcgatctgttgctagggttgtgaatcccatggctactgttatgaaagctgtcgccgaagcagccgaagatgccaagaaaccaaaatctgggagaagtgtctttgacagaattagtcattctactggatcagagaccctggaccagaatatggtacttggtgaagtttcccccaaggatgaagaatctaggaattttagccaaggtcaggaagcggtacagcttcaatacacacagagtcttgccaataatggagtgtattttgagaacatg

SEQ ID NO: 16475 - DNA, 3000 bp, Unknown; identical to SEQ ID NO: 10171
  misc_feature (1)..( 3000): 2750-1469P.txt file - cDNA_ID_1448143; gDNA_ID_2213634; Annot_ID_132098

SEQ ID NO: 16476 - DNA, 3000 bp, Unknown; identical to SEQ ID NO: 10171
  misc_feature (1)..( 3000): 2750-1469P.txt file - cDNA_ID_1448143; gDNA_ID_2213634; Annot_ID_180962

SEQ ID NO: 16477 - DNA, 3000 bp, Unknown; identical to SEQ ID NO: 14038
  misc_feature (1)..( 3000): 2750-1469P.txt file - cDNA_ID_1448161; gDNA_ID_2214694; Annot_ID_189463

SEQ ID NO: 16478 - DNA, 174 bp, Unknown
  misc_feature (1)..( 174): 2750-1469P.txt file - cDNA_ID_1448231; gDNA_ID_28141; Annot_ID_146654
  misc_feature (126)..(126): n is a, c, g, or t
gatccggatcgggttgaattaggggtccagattaaaaagtgcgaattaaagcaaacaagggaacgagggtttcagtttccctgaagaaaattgaaaggagcttaataaacagaagccgttctcctnyactttcgttcctctcacttccatacaacatttgaaacctcagctatg

SEQ ID NO: 16479 - DNA, 3000 bp, Unknown
  misc_feature (1)..( 3000): 2750-1469P.txt file - cDNA_ID_1448251; gDNA_ID_2926165; Annot_ID_199036
gcccagttcttttcactaacgttagtgaaacctgcgagtgtatccaacctgtgattaacgcccaatacataaataaactaagggctttgatggattcggctgaacattttggcatatatataagttgggatgaaaatgatcttgatttgtcattaataagcctagaaaaatagatacaagaagactcttctacgacaagacaaccaagctttcaaatatgcaagttgaaactctggtagcaatattttcatagacttttaacatgatcttctttatagggaatatatatctaaatatatcatatatatatgcatcgtgtaatggaagtaagtatatttatgtggtaataatgtacatgactaagaaaaaaatcttcagaaatcttgggagagaagggatatggaatcctgctttcggaaggttaaagcaacaatgggagaaaaaagagaaaggtcggttaagatttggtatatttcaactctacaattatatattcctctctatctgatttttaaagacttctttcagtcttttgttctcagaatataacatatatccaagtatgcccctttttctaatggtattcatgaaccggtgtttgtaagagaacatagcattcgttgtctaccaattttaccaaaagatatttggtttacttattatcgaattatatttcattcatgacagtaaaatatgtggtcactaattggtttgaataaacaatttgtttctctagtcaattggtttctctagtttccactattttccttcatattcaactacacataatgttttaggtacataatattgaaacgaaaattttgattcttttggtctcgtgaagtttttctgtttacaaatggctggcgtctgagtacagtattaaattatttaaaccttctcttctttcttacaagtactaattaagactgaaaccccaccgaaagagtaaaatatttataaaaaatttttgaaagtgagtaaaatatttttctatatattaattttatggaccatgaactaacattcctaaaatatattgtatcatgagattataagattacatttttgattttcatattttactaaattttatcaacataaaaaaatattgattagcagcagattttaatcacatgaataatagcttcaaaagctaaataaaaatcatactagatcatttttgacataatttgtatccttttacaaataatactaaattagagttacaaaagattaagtacttcagcaaaccaaatattccacttaattaattccgggttgacccaaatctatcagatctgatttttcttgcttttaaaccttagttttttacatggaccttatatttttctaagttcttcatctatagtttcggaaattgtaagctttacaagggagatatttcataccttatacacaatttggcgaagatgaatgaacttgttttaataatttcaggttacacgtaatcgattacgttgtttctaactatgtattaaaatccgttgtttctttttagcatattgctacgtgtgagaagaattttgagttaaggataatagataaattcattttcatctttataaaactttttaatgctagaaatgatttgattaccctatttctatggcaaaaaaaaaaaccctaaatattcaatgtttcacttgaaacagtgaaacagatgatcaaattaaaagagtttttgaaatctaacccatcaaaggctggagataaacccctaaatcacaaacgtactgatcattaattaaaaacgattgtgtttcatctttattataaaccataaaaaaaaaaaagaggaagctatacaccgaaaatgaaaaagaagaaaactaaagcaatagactgtaaacgaaatgatacaaacttgctatgtggactcccggaatctatttaccatacatataaaaaatcatatcaacgatccagtggacggtgggtttttaattcattattgaattgataaaaaaatcagtctctctgttaaagaagtttcaacatggcataagataatatttttggttaaagaacttgatatgatatatataatttctaagaagattatcaatcttcgtcccgaatctaaagctattgtatataatttgagatatttgaattcttgttaatattttctaagagataaaggcagaaagattcactattaaacaacattaaattcttggaaaaaacccttaattttaaagaaatcaagttctctatagaaagaagtttcaacttggtatagtataatttcttttcgtgttaaagaacttggtataatataatttaggaaaatatatcaatctgcatcccgaatccaaatatatctttgctttaacaaaaaagcatccaaaactattttataatttgagatatttgaatctttgtatacttttaaaaacagatagaggcggaaagattcattattaaataacattaagttcttggaaaaagcctaaattttatttaatcccacgtgaaagtaatcataaagatcctaagttttataaaaataaaaataaaagacaagtttattttagacaaaaaattctcttatttttagtgggttgtggtattatggtttccttctgatcatttagatgaatttcattaggttacatgttcttgacataaaaaaaaacagagcaaaattttatcatcgattggtaagattttcttatgatcacctattaaggatcgggcagaccgtccaaccgtccgtgatctttgacggatatatacattagtgagggaataatgatttactgaatttgattcaatgtttgtgataattacacttatcatatatacttttcgtaacgaatataacagcacttacaaatttattttaaatttgattccacaaaaaaaaagatcttgttaaaagtttttgctatataaactaaaacggaagatgcatagataacacactaaaagtttaaaacaaaatacctttctaatcctctttaagcttcgatg

SEQ ID NO: 16480 - DNA, 3000 bp, Unknown; identical to SEQ ID NO: 948
  misc_feature (1)..( 3000): 2750-1469P.txt file - cDNA_ID_1450208; gDNA_ID_1620340; Annot_ID_153930

SEQ ID NO: 16481 - DNA, 3003 bp, Unknown
  misc_feature (1)..( 3003): 2750-1469P.txt file - cDNA_ID_1450335; gDNA_ID_1620653; Annot_ID_47775
ggaatctaccatgggatgtggacaatggccgtctagaacagcttttcagtgagcatggtaaagttgtggaagctagggtggtttacgaccgtgagacaggtcgttcacgtggattcgggtttgtcacaatgtctgacgtggatgaactcaacgaagccatctctgccctcgatggacaggtaccctactcttcctcatatatggttatgctaatgcagtcaacatgattttgtgatgtatctcttaatcgacctttcattgtctcttgatttacagaacttggagggtagagcaatcagagtgaatgtagcggaagagcgtcctccaaggcgtggatattaaagctgagatctagctgtgccctctctctctccctatcttgcattttgtttagacgagattcttacactcttcaacgattgtttttggctgaactctgaatgtgaaagttaagctgcttctaaagtaatttgtatcgcttgtttttgatgatctcttattcatagtttaattcctaattgttggagtttcattccctcaatcgcatcgggggatacgacacatttctgggacatgccttgtcggtgacctttagatattagcaactacgaggtttaccccaaaatcggctgagaatgaaaggcttctatagcaaagcacaagttggtcgaggcctaagggaagaagactagaaaggtggtgtcatatggtgagttagtctctgccagtctagaggttcctaaagaagaggattgggatcttcattgtgttcgtaaagggatccactattttaatctcttgattggccactctctaatccaacacttaaacaaaccacacatgaaaaataagtctaaatttaaagcttattaatatggcttacttatttggcttaagaggcctaaactcatgtgatgtatcctagaaaaattatagatatacaaaattatgtatatcacctacgtctagctgaaatcttacccaccaatgccaataaaaagtttgccggagagaatacaagaaattcgtgtacaaatatacacgctccctctttatctttctttcccttgttagctaagaacaaatgataaaaagcttacaccttttatgaaatgctctctcactctcttaccctttcacccatgcccggttcttagtactgggagtgctatggcacatgacccactatgtttttttgtaaagaaaaaatcatttatattctagctccagcttacagtcctgaacttaattgatatgactcgttgaattcactaatctgaatgaaagactcttcttcgagttctgtttgtagcaagtatgtataactccaagccaaatatgaaatcatggtttcacattattagagggtacgtaatacaaactgagacaagcaaaacatgtaatgtaacaatcaaattctaaaacatatagaattagattcaactgatgatggcagagtgaaatatgcatttaaaagacaaaacaataagcaaaaagtctcgatcgtgctcgttgagtcgctttatcaaaatatggaaatgcaacatttgttgggatacacgagattaaatggtccatatattcatgcatgtgtagcaaacagcgtaagaaataatagacgcaatatataaaaccaattaaaaagagaggaaacaaagtgtatgagaatagagcgacactgatgattcattttctaggccagatcttgtcttggaactctcttatcgcccaaccttagccttagcttctcgaccagtcattccaataatttccacacttgtctctttgcttacctctattaattatttttggatccatcgttcaacgttttataaataaaataacattatttaattttcattattgtcactatcattctgcaaaaaagtgtaaaaatgtactaatatttttcttaaacaaaatgataagaatgaagtcgtccaaaatgtgttttaacctattttagtaaacctggacaaaactgacgaaaaaaaaaaaaagtaattggacaaaacaaaaatagtcatttaaaaaaattatatatcatgatatagagctacctaatgcagatacttagaaaactaagattcattattctctgataaagaaaataatcacccacgaaactactcaattataaaaaaactagtccattattaattggaatatacttaagtgtagtttttgttaacataaatggaggtgtatatatagttggtgccggcaagaaaagatggaggaaggattgtatcggtcccctaccccatgatcccgccagtaaattctttctagggcacccaaccatccacgtgtatccctcaaaccctacaacctgtaaatgtaaatccattacattacattgtatcttatttaatactgtacttacccaaaaagtttcttttaaattcaatcttaaatcatgttatagcaaacaaatctagctacacaccaacttgtggtttttagaatcttttaacttgtaatggacttttatgatgatatccatgtgaatcacacatgcatgctatgatttatcatgtgtagtaatatagtatgagaggccaatcacataaactcttaaatacaatgatattggacatgttatgttttgcatttcaaacaaaacaaagaaagaagaaatgtcgttttttgtttgtataaatccaggaataatggttttggtttttagacgcaatagagacagtatcaccattttcgttctggacaaacaaataaaattaaaattttgatacattaaaatatggttagaacttagaaaacaaatttatttaggttcataggccagtgagtctctctctctctatctctaaaagaaagagaagcaaaaaagtaaggaatgtttcctcgcaatcatcatcatcatcaccatcttcgtcttcttctttgaaacctccagcgacttcctcgtagttctctcacttatacacttactaatacagagtaacagagagagacagagtggactcttcttagagtaagatg

SEQ ID NO: 16482 - DNA, 3000 bp, Unknown; identical to SEQ ID NO: 4064
  misc_feature (1)..( 3000): 2750-1469P.txt file - cDNA_ID_1450335; gDNA_ID_1620681; Annot_ID_164435

SEQ ID NO: 16483 - DNA, 3003 bp, Unknown; identical to SEQ ID NO: 16481
  misc_feature (1)..( 3003): 2750-1469P.txt file - cDNA_ID_1450335; gDNA_ID_1620653; Annot_ID_163530

SEQ ID NO: 16484 - DNA, 3000 bp, Unknown
  misc_feature (1)..( 3000): 2750-1469P.txt file - cDNA_ID_1450335; gDNA_ID_2926186; Annot_ID_140785
atctaccatgggatgtggacaatggccgtctagaacagcttttcagtgagcatggtaaagttgtggaagctagggtggtttacgaccgtgagacaggtcgttcacgtggattcgggtttgtcacaatgtctgacgtggatgaactcaacgaagccatctctgccctcgatggacaggtaccctactcttcctcatatatggttatgctaatgcagtcaacatgattttgtgatgtatctcttaatcgacctttcattgtctcttgatttacagaacttggagggtagagcaatcagagtgaatgtagcggaagagcgtcctccaaggcgtggatattaaagctgagatctagctgtgccctctctctctccctatcttgcattttgtttagacgagattcttacactcttcaacgattgtttttggctgaactctgaatgtgaaagttaagctgcttctaaagtaatttgtatcgcttgtttttgatgatctcttattcatagtttaattcctaattgttggagtttcattccctcaatcgcatcgggggatacgacacatttctgggacatgccttgtcggtgacctttagatattagcaactacgaggtttaccccaaaatcggctgagaatgaaaggcttctatagcaaagcacaagttggtcgaggcctaagggaagaagactagaaaggtggtgtcatatggtgagttagtctctgccagtctagaggttcctaaagaagaggattgggatcttcattgtgttcgtaaagggatccactattttaatctcttgattggccactctctaatccaacacttaaacaaaccacacatgaaaaataagtctaaatttaaagcttattaatatggcttacttatttggcttaagaggcctaaactcatgtgatgtatcctagaaaaattatagatatacaaaattatgtatatcacctacgtctagctgaaatcttacccaccaatgccaataaaaagtttgccggagagaatacaagaaattcgtgtacaaatatacacgctccctctttatctttctttcccttgttagctaagaacaaatgataaaaagcttacaccttttatgaaatgctctctcactctcttaccctttcacccatgcccggttcttagtactgggagtgctatggcacatgacccactatgtttttttgtaaagaaaaaatcatttatattctagctccagcttacagtcctgaacttaattgatatgactcgttgaattcactaatctgaatgaaagactcttcttcgagttctgtttgtagcaagtatgtataactccaagccaaatatgaaatcatggtttcacattattagagggtacgtaatacaaactgagacaagcaaaacatgtaatgtaacaatcaaattctaaaacatatagaattagattcaactgatgatggcagagtgaaatatgcatttaaaagacaaaacaataagcaaaaagtctcgatcgtgctcgttgagtcgctttatcaaaatatggaaatgcaacatttgttgggatacacgagattaaatggtccatatattcatgcatgtgtagcaaacagcgtaagaaataatagacgcaatatataaaaccaattaaaaagagaggaaacaaagtgtatgagaatagagcgacactgatgattcattttctaggccagatcttgtcttggaactctcttatcgcccaaccttagccttagcttctcgaccagtcattccaataatttccacacttgtctctttgcttacctctattaattatttttggatccatcgttcaacgttttataaataaaataacattatttaattttcattattgtcactatcattctgcaaaaaagtgtaaaaatgtactaatatttttcttaaacaaaatgataagaatgaagtcgtccaaaatgtgttttaacctattttagtaaacctggacaaaactgacgaaaaaaaaaaaaagtaattggacaaaacaaaaatagtcatttaaaaaaattatatatcatgatatagagctacctaatgcagatacttagaaaactaagattcattattctctgataaagaaaataatcacccacgaaactactcaattataaaaaaactagtccattattaattggaatatacttaagtgtagtttttgttaacataaatggaggtgtatatatagttggtgccggcaagaaaagatggaggaaggattgtatcggtcccctaccccatgatcccgccagtaaattctttctagggcacccaaccatccacgtgtatccctcaaaccctacaacctgtaaatgtaaatccattacattacattgtatcttatttaatactgtacttacccaaaaagtttcttttaaattcaatcttaaatcatgttatagcaaacaaatctagctacacaccaacttgtggtttttagaatcttttaacttgtaatggacttttatgatgatatccatgtgaatcacacatgcatgctatgatttatcatgtgtagtaatatagtatgagaggccaatcacataaactcttaaatacaatgatattggacatgttatgttttgcatttcaaacaaaacaaagaaagaagaaatgtcgttttttgtttgtataaatccaggaataatggttttggtttttagacgcaatagagacagtatcaccattttcgttctggacaaacaaataaaattaaaattttgatacattaaaatatggttagaacttagaaaacaaatttatttaggttcataggccagtgagtctctctctctctatctctaaaagaaagagaagcaaaaaagtaaggaatgtttcctcgcaatcatcatcatcatcaccatcttcgtcttcttctttgaaacctccagcgacttcctcgtagttctctcacttatacacttactaatacagagtaacagagagagacagagtggactcttcttagagtaagatg

SEQ ID NO: 16485 - DNA, 3000 bp, Unknown; identical to SEQ ID NO: 16484
  misc_feature (1)..( 3000): 2750-1469P.txt file - cDNA_ID_1450335; gDNA_ID_2926186; Annot_ID_200621

SEQ ID NO: 16486 - DNA, 3003 bp, Unknown
  misc_feature (1)..( 3003): 2750-1469P.txt file - cDNA_ID_1450357; gDNA_ID_1620652; Annot_ID_47770
cgctggagatttcaccttcctcattggtgattggtttaagcatgaccacaaggtatttctttcttgaattaacaaattatgttcgttttagtatttgtcattgttatacaaggaccataattaaatgtaacattattcaggttttgaaggcaattttggatagaggacacaagctacctttgcctcaaggggttttgatcaatggccaaggagtcagttacatgtcttccatcaccgtccacaaaggttcatcctaaaaacactcaaatactttgattacgaagaaaagcattatattatctcatcatttattttttgttgtggaacaattatcaggtaaaacatacagatttaggatatcgaatgtagggcttcaacacactctgaatttcagaatccaaggtcatcagatgaagctcgttgaggtagagggaacacacacagtccagtccatgtatacctctctcgacattcacgttggacagtcttactcggtcttggtcaccatggaccagcctgaccaagactatgacattgtcgtctccacaaaatttgtcgccaaaaaactcttggtctcatctactatccactactccaactcaagacatagccactcatcttctgctaattcagtccatgttcaacaacctgccgatgaactagattggtctatcaaacaagcccggtccattaggaccaatctaaccgcgtctgggccaaggcctaaccctcagggttcgtaccactatggtcgaatcaagatttctaggactttgatattggaaagctcagcggcactagtgaagaggaagcaacgctacgccataaacggagtgtcgtttgtacctggagatactccgctaaagcttgcggattacttcaagatcaaaggcgttttcaaaatgggaagcatacctgacaagccgagaagaggaagagggatgagaatggagacgtcagtgatgggagcacaccatagagacttccttgaaatcatatttcaaaaccgcgagaagatcgtccaaagctaccacctcgatggatatagtttttgggttgttgggtgagaataattaaagattagctatatctatcgtcctctatatatagtagctagtaataatgcattgcatgcatctgatgtttgtgagtactgtccacaggacggatagaggaacatggtcaaaagcaagcagacgagagtataatcttagggatgctatttctcgctccaccactcaggtacaaatagtttctaactccatatatcttaccaaaaattttaaaaaatcatctcaaaactagtatttggttgttgtaggtatatccagaatcttggacagccgtatatgtggcactggacaatgtggggatgtggaatctaaggagtgaatattgggcgaggcaatacttgggtcaacaattctaccttcgagtttattctccaacacactctcttagagatgaatatcttttgcctaagaatgctttgttgtgtggccgagcctccaataaacacaccactccttaatgactctactcagaccaatcgtcaatggctgatttagggatatgtattttattatattgagttctttattctttataatttcaatagctagatatatgttgcacaattattatatatacttcaaaaattgtaatgtatacccaaatttgatgaaaattttactgttttgtaacggttattgctaagtttgaagttaatttttgtaggcaaatgcaatgttttcatatgaatcaaccaagtaactctaccatatcaccaagcaaaatagtatagtttgaagagagagagtaaattaaaaaaaaaaaaaaaccatacataacatattagaaacattaatttcgaataaacagactttaacgatgaaataaaaatttaaattattatccaccggtagatgtagaatgtttattggtatagaaagttgttctatttggtcaaagtttttgttgaccttgcaattacaaattacaaggctgtcaatcgaatgaaaaacatggcaatggaaaagatttgctaataatgccaagacaaacaaacgtttatttggaaggttaaaagccttttagagaagaaaaaaaaagagcagagagtcaactaattaagccatgcatgtgaatcaacaccaatccatagcatattctagtgatcagtgacattaatattgtagattactatattaacccgaattcaaagggcattaaataggtactttaatgaattgaattaagaagagtaatataatcaacggcttagattcgttgcgtgaaaaaaccataaccgaaaacagcggaatccacgaaataagtaagccaaacgcaatctagaccgtacgatgtgaatactttaatgacgccagaatactatggacagtgtagatcaggcgaatgggcgtaatacacgtggcgtaaaatcacgaggatagatatggtgcaacgtagttcaggccggtgtggtacgagagagtctgatgatccgacaaggaatacttctagtccacacaatgtcagcctttctttattttctcggtcgcttcgagattctcaattctgctctgtagaaaagatcctgatggttcacttttaatatccaacggttgatataacacaagcgcatgctcctcttatgagaacggccgtgggatataatttaatctcgccgttaaaaaatgtgacgaccgtgagttaacggtttatctgttaccaacctcatacctgtccctaacggcagaggataacgccgtgagtatggatggatgggagagaaaagaagagagagagtgtgagtgaggaaatgaaaggagtcttttttatttgttatctctcatctctctctctctttctctctgagctttgctttttatcaaacaagcatcatcatcacatccacttccttcttcttcctttctctgtctgtctcttaacccaaatgtggactctttgagccgttattagatctctgccgcttcaataatg

SEQ ID NO: 16487 - DNA, 3003 bp, Unknown; identical to SEQ ID NO: 16486
  misc_feature (1)..( 3003): 2750-1469P.txt file - cDNA_ID_1450357; gDNA_ID_1620652; Annot_ID_163501

SEQ ID NO: 16488 - DNA, 3003 bp, Unknown; identical to SEQ ID NO: 16486
  misc_feature (1)..( 3003): 2750-1469P.txt file - cDNA_ID_1450357; gDNA_ID_2926215; Annot_ID_142183

SEQ ID NO: 16489 - DNA, 3003 bp, Unknown; identical to SEQ ID NO: 16486
  misc_feature (1)..( 3003): 2750-1469P.txt file - cDNA_ID_1450357; gDNA_ID_2926215; Annot_ID_202921

SEQ ID NO: 16490 - DNA, 3000 bp, Unknown; identical to SEQ ID NO: 8763
  misc_feature (1)..( 3000): 2750-1469P.txt file - cDNA_ID_1450412; gDNA_ID_1971876; Annot_ID_176732

SEQ ID NO: 16491 - DNA, 3000 bp, Unknown
  misc_feature (1)..( 3000): 2750-1469P.txt file - cDNA_ID_1450424; gDNA_ID_2926299; Annot_ID_205638
agagtcgccggcgaagagaagcggtggaggagagcggaagggaggagagcatcggcgacggcgaggaagataggagcagagacaaggagaaaagagaagaacattgtgaacaaaacgaatatagttttgattcctctccatagagatgaccaaagctttctggttttactaatctcttctttgctaaaacccatcgaatcagagaggatttgtttaagagagaagatgtttcggagactttagagagggtttttaaaaggtggacgagacaaagtgacgatgacggcgatgatgatgctaagataaatactaagggattaatttatactattatgatttttccttgttggacttggaatatttatatgaatatagaattttggattagtttggtaatttttatctgtctatatctttttacctatggatttcttctatataatataattattaaattttattctttctataaaaatcttttgaatatttcttttctataaatgttttcgttgttgatttaattttcttgtatgtaaatcatgtttgattaatttttaaaagaatcgtaagatgaatgaaagtcaattcattcgtcgatctatcctaatttttttattgatattgacgattgatacagatccacaatttatatgttatgaaattacatcctcatacataattttgatgaatataggatttgtgggttagttaattattttccactttctatttataaatttcagttgtttctttatatgctgagtaataatacttaaaaacatcaaaagaaagctttttcgtaaatattgttgaggtaaaacttccaaaacattgcttcctaaatactttttagtaagcaaagttttttggtagatgctctgatcttccatcatctgaatctcctaaatgtctcgttaatagataaaacgctctcaaccctcttaaaattaaggatacatgtaatgttaatcataatcacacaaaaatgaggctattcatatttgaatttttatttgtattactttcttaataattttttttgtaaaattatttatttctctcattcacactaaaataaaataaaaattagccaactgaaaaatcttaaatagtaattggaaactgaaacattctagaaaaaaaaatgttgagagaaacttccagctctttgaatcctttgactggtgtattaaattaaaacaaaatagtgttcggagtcttcagatttcagcctccgtgtaataacggtaaaacctaaataacgtgaagcataaacaaaactcgataattggaacattttttctttctttcttgatttcatttgtatataatatataatggattggaatattttaaaatcatcacaatatatgtttatcgttttattaaattgttactagtaaaataatgttagacccatcctctcccgccgaagaaatgaaccgagactcgtttattcgttaacacaaacatatacgggaatggaggaaccgaccgatttcagccatgtgaccacatgcatgccgtttgttaccctaacttatatcttacggtgttatttttttttattttttttttgtttcattgtactaaaagaaacagtgaactatcgtatccaatttttttaataactattttgtgtttgattgtgatctttcattgttttctcgtctaatgctaccaaatataaagataggaaatgattgccttttcttatcaaacttttcaaaacattcgataggaatttaatttacttgtttgttataaagaaagcattgccaagttattacacaaacaaactaataaaaaagtcgtaactctttactttgtacgcgtatatctttgcgtgagtgtatgtactagtcaattgttgatcatttacaatttgtctcgtaaatggaatgatatatgtatatattgactgttaagcaaaaccttaggaaatttcggaaatcaggatatgttctaatagaatttttccaaacttatttcgtttttgttgttttccagctgaacattctaaattagatttagtgacagattattcttacctggaatatataattacaaattgtcaccaaactccgatgatgagaattaattaaccgaacaacaaatatgtgtctctttgcttgttttgtttcttgtgatagcaacggtcagatttgcatatcaataattagagtaggaccatccaaaataaagagggaggagctgaaagtcaagagtttataggcctacgaaactgaccggaagttgaagaaacttctcaagtcaagagtcaagacatatcagctcaccaaaaacatgcactcgtcgcttataaagctttctcctttgattatactccaccaaaatagtggcacaattataaacctaaaacctcacaaaaatattttacatttgtcaaaaaataaaataaatttgatattacattattgctagaattgtttatattagaaaaatattgaggctatattacgagttttatatcaaaataactagaaaagagagaatattttatcaaaatacaataatctccatttttctcacaatcatttctaattatatattacatcttttgttaatatatgtgatattagacaaatgtaatgtataactagcaatgtataaatatcaaaaataattagaaaaagaaacaaaaaattcaaattttatctttattttcatgtttaaaactgtttatcctgaaacaattgttaaaaccacaccaaaatcataattagtaatttagcctaactctatgaattcataattcgtaaatacacacactcgtagttttcaaagaatagtccaacgccagacccattacaagcccaataagtaaggcccacatcaaacaagatccgaatccgcatcttccgaacaaattgaacgcaaatttagccttgtcggaataaaccacttgttttcgctcgctcgctttctatttctcctccgatctgctgaggcgtgcgttcattacgtgcttcctcaatg

SEQ ID NO: 16492 - DNA, 3003 bp, Unknown
  misc_feature (1)..( 3003): 2750-1469P.txt file - cDNA_ID_1450444; gDNA_ID_1620708; Annot_ID_48936
cttgacctttcgaagccattgttaatccgtagttcaacatctcgttctctgtttcgttgactgaatgatccgatgactcggattctttaacgggtcggagcgagaagaagtaatgagactcatcgactttaacggcgggttcgtctttagtcaacggccattggatctcgtcaccgacgcgagcgaaaaccgcgacggtgatatctccttgaacaagacggagaatctcgagatcgccgcaagcgagctctacgctgtaggatttgtcaatgaggtggaccatcgcgccgtggattgtgagaatcacttcctccgtcgcgagaggaggcgctgaagctgagtcagaggcggtgggatcggggaagatattgttgacaagatcattgacattgattgaaggatagagattattattattagtagaagaggaggaggaagaggacttagggagaggagcaacggtggttgaagtgtcgacggttggataaagcttgggaggagttgcagagcattccattatcgccggtgatttaggaggaggaagacgaagggggaatgaagaagaacaagtgtttggttatttatatgaatttgaaaaagatttggggcagaaatagaaaaagtcagaagattagtgatggaagaaagcgaatctagtttgattaactgttaagtaaccttgctgtcggagtctcggagataggaagacgtgggcgttgcgtgtttcaagaggagcatactttttgactatgaaccgggccggtttaaccttttttttaactattttaggagattttcccgcgctttatccaaatattaaatttgtttatatccaaaatttctttttgttgagtgtatattgtacatttgtttattgttttgccaccttttttagtgtcacactaaacaagaattattcaagtaattaagatgtgtaattgactatgataatggtaatctgtattgactttgttttgccaaatgaaattctatttaacagtaggatcttacctaaaccatggaggaaaactttggtttttttttctattagaaaacataaaaggcaaaaaaaatgattaaaaggtataatcaattatgatgatgaaaattttttcttgtataaaaataagaataagatttaaagggatataacacttatactattttttgtataaaaatatatgtctactaaaaacataatattctgtcacatgttattttctattttgtttaagaagaaatcaattgcataatctcatatcactctatgaagtacaattatttgaaaattaaataatagagttttagatgtcaaaaaaaaaatcaatagagtttttagagtaattaaaactgtataaataagtaagattaagaaaatctatagattttaaaaaaaattgtgcaccaaatctaaagagtgaataagatttatttctaacatacagcttttatcccttgacaattgtcatttgacttttgagttatagcagttgtgttgtcatcttgtgtcacttttaatattaaattacaaaacaagtcctcaattttaaaataattaacatcagtgagatcagaatctaaatgttactgtactttacagttgacaatttaattttcactgtactttgtttgacccccaaaaagtactgtgttaaaaaggcaaaaaaaccaaactaaagttcgccgggaagcgaaatcgtcatcttccctgttttgctgtttagtctgcaagagaaatttcagattccggcggagaaagctataacgattcttcaatggatcccacttcttcttcttcctctgctcttagatggaaaattcttcgccaagcgcttctccgtagatctggttgatactcccctactccttctccttcctgcatccacttttcgatttcacacattcgcatagctaatggatcatctttcaattttcctcagattctcaatctcaaactgagaccaaacggatttcaaggaaagcaactcaaggattcaacttgattccttgtcaagtggtggactcttctcctcaatcggataagtctcgtgaagcatccgtttgctacacacttcccatcactggctctcccaaactctatctaacgttaggattttgatctgaagttttcatcaaatgaaacaatgttatgttttgttcgatagatttgccactcctaagagcttctttaaaatatatgcagacaaagagtggataattgtagtgatctcaatgacttcgagatatctaatcgatacaacattgataatactggacttgtctgtaagttctcaatctcactgtatctctctacttgtcacataaattagtgtctttgttggttttgaaacttagtagtacaatgttgctgctctgctctgtgtatttggcttgtttgcggctgatacaatcgctaaccaaactatatctgcttaaacttttagtctgtcaatatacaacgtggcattaaccatgattcaaacaagttaagaataaaaaagatttagttgcttagggaactctaatgctatctaaattgtgattctctgaattcatactgtcgttgttttccaggtcagtggccctctgaagaagtactagcctacttttgcaagtctcagccagaacgtttcaggtttaagactgatttgcatctgtgttctttgttcttttataacttcgtctacttaattttactcggctcattgggatgttgcagaggtaaaagagtaattgagcttggatcagggtatggattagccggtttagttattgcagctgcaaccgaggcatcagaagtggtaatctccgatggaaacccccaagtagtcaattgtatccttcatgttttgtttttgtgttgtgcatatactgtttcattagaattgtcttcttctatggctgaaacccttgagatatggaatctcggtactcaaaacgttttggattcattgatgtacttaacatccagatattaaacgtaacatagaaaccaactccatg

SEQ ID NO: 16493 - DNA, 3003 bp, Unknown
  misc_feature (1)..( 3003): 2750-1469P.txt file - cDNA_ID_1450444; gDNA_ID_2926210; Annot_ID_141946
ttgacctttcgaagccattgttaatccgtagttcaacatctcgttctctgtttcgttgactgaatgatccgatgactcggattctttaacgggtcggagcgagaagaagtaatgagactcatcgactttaacggcgggttcgtctttagtcaacggccattggatctcgtcaccgacgcgagcgaaaaccgcgacggtgatatctccttgaacaagacggagaatctcgagatcgccgcaagcgagctctacgctgtaggatttgtcaatgaggtggaccatcgcgccgtggattgtgagaatcacttcctccgtcgcgagaggaggcgctgaagctgagtcagaggcggtgggatcggggaagatattgttgacaagatcattgacattgattgaaggatagagattattattattagtagaagaggaggaggaagaggacttagggagaggagcaacggtggttgaagtgtcgacggttggataaagcttgggaggagttgcagagcattccatttatcgccggtgatttaggaggaggaagacgaagggggaatgaagaagaacaagtgtttggttatttatatgaatttgaaaaagatttggggcagaaatagaaaaagtcagaagattagtgatggaagaaagcgaatctagtttgattaactgttaagtaaccttgctgtcggagtctcggagataggaagacgtgggcgttgcgtgtttcaagaggagcatactttttgactatgaaccgggccggtttaaccttttttttaactattttaggagattttcccgcgctttatccaaatattaaatttgtttatatccaaaatttctttttgttgagtgtatattgtacatttgtttattgttttgccaccttttttagtgtcacactaaacaagaattattcaagtaattaagatgtgtaattgactatgataatggtaatctgtattgactttgttttgccaaatgaaattctatttaacagtaggatcttacctaaaccatggaggaaaactttggtttttttttctattagaaaacataaaaggcaaaaaaaatgattaaaaggtataatcaattatgatgatgaaaattttttcttgtataaaaataagaataagatttaaagggatataacacttatactattttttgtataaaaatatatgtctactaaaaacataatattctgtcacatgttattttctattttgtttaagaagaaatcaattgcataatctcatatcactctatgaagtacaattatttgaaaattaaataatagagttttagatgtcaaaaaaaaaatcaatagagtttttagagtaattaaaactgtataaataagtaagattaagaaaatctatagattttaaaaaaaattgtgcaccaaatctaaagagtgaataagatttatttctaacatacagcttttatcccttgacaattgtcatttgacttttgagttatagcagttgtgttgtcatcttgtgtcacttttaatattaaattacaaaacaagtcctcaattttaaaataattaacatcagtgagatcagaatctaaatgttactgtactttacagttgacaatttaattttcactgtactttgtttgacccccaaaaagtactgtgttaaaaaggcaaaaaaaccaaactaaagttcgccgggaagcgaaatcgtcatcttccctgttttgctgtttagtctgcaagagaaatttcagattccggcggagaaagctataacgattcttcaatggatcccacttcttcttcttcctctgctcttagatggaaaattcttcgccaagcgcttctccgtagatctggttgatactcccctactccttctccttcctgcatccacttttcgatttcacacattcgcatagctaatggatcatctttcaattttcctcagattctcaatctcaaactgagaccaaacggatttcaaggaaagcaactcaaggattcaacttgattccttgtcaagtggtggactcttctcctcaatcggataagtctcgtgaagcatccgtttgctacacacttcccatcactggctctcccaaactctatctaacgttaggattttgatctgaagttttcatcaaatgaaacaatgttatgttttgttcgatagatttgccactcctaagagcttctttaaaatatatgcagacaaagagtggataattgtagtgatctcaatgacttcgagatatctaatcgatacaacattgataatactggacttgtctgtaagttctcaatctcactgtatctctctacttgtcacataaattagtgtctttgttggttttgaaacttagtagtacaatgttgctgctctgctctgtgtatttggcttgtttgcggctgatacaatcgctaaccaaactatatctgcttaaacttttagtctgtcaatatacaacgtggcattaaccatgattcaaacaagttaagaataaaaaagatttagttgcttagggaactctaatgctatctaaattgtgattctctgaattcatactgtcgttgttttccaggtcagtggccctctgaagaagtactagcctacttttgcaagtctcagccagaacgtttcaggtttaagactgatttgcatctgtgttctttgttcttttataacttcgtctacttaattttactcggctcattgggatgttgcagaggtaaaagagtaattgagcttggatcagggtatggattagccggtttagttattgcagctgcaaccgaggcatcagaagtggtaatctccgatggaaacccccaagtagtcaattgtatccttcatgttttgtttttgtgttgtgcatatactgtttcattagaattgtcttcttctatggctgaaacccttgagatatggaatctcggtactcaaaacgttttggattcattgatgtacttaacatccagatattaaacgtaacatagaaaccaactccatg

SEQ ID NO: 16494 - DNA, 3000 bp, Unknown; identical to SEQ ID NO: 13489
  misc_feature (1)..( 3000): 2750-1469P.txt file - cDNA_ID_1450489; gDNA_ID_2214631; Annot_ID_136049

SEQ ID NO: 16495 - DNA, 3000 bp, Unknown; identical to SEQ ID NO: 14029
  misc_feature (1)..( 3000): 2750-1469P.txt file - cDNA_ID_1450508; gDNA_ID_2214693; Annot_ID_189443

SEQ ID NO: 16496 - DNA, 2514 bp, Unknown
  misc_feature (1)..( 2514): 2750-1469P.txt file - cDNA_ID_1450526; gDNA_ID_2910716; Annot_ID_193522
gcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactggttatgtaagcagacagttttattgttcatgatgatatatttttatcttgtgcaatgtaacatcagagattttgagacacaacgtggctttccccccccccccctgcaggtcgaaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgatgataagctgtcaaacatgagaattggtcgacggcccgggcggccgcaaggggttcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagcttgcatgcctgcaggtcgactctagaggatccccgggtaccgagctcgaattccactcaggcatttcttcgaacaccttgagcgcatcatcaacagaacaacaaccagaatacatctcgataatcgcgtttcgagcgccaacatcacaaggagaaaccagagcaatgatacactcatgaacaactctagctgcttccaaagcttctggtttaccacatagtttagctaaccctaaaagtctaatcaaatccatagcataacccttattctccaagtaatctaaaacctctacagcttctctccaattcccttgaatacataacgaatcaaatgtctcaatagtaacattttgagcaacacttggagaaactgttgttttgtactgacctaccattgaattctgcgtcaatgtgtgtccggctacgtttcgcttataccgattgatcatctctgtgatctctgagctgccatactttttgaggatgtgaagatgatgagagggagctccaccacccgaacagaaccagctgtttctactctgtgtagctaacgctaaatagggtttccaaagtctgagcttcccacaccacaatcgcaccatttcacgatggtaaaactccggtgacggagaacacaaaagcaacgaatcttgcaagcaaaaaatctcagaatcgagtcgaaaccctaaaaagcatatccgtgattttgatttattggtttggtaaaccgggtccgggcaaggggagagagaccagtaatcttcctagacgcagcgttttgtagctgaagtcgtgaaattcactcttaaccaccaattttgtttttcctgattatttgtgtgttggggacagacaaaacactcaccaccctcaccaaacagtctctcttcaactctaaaatcaggttctttcttcttcttcttgtgttgtgtgtttttgattagttgagctactgatttaatacttttctgggtttttactgttactgaatcaatgtttgaaagttttaattttggatttttctgttaatttgctcatcccatatgatgttgtatgaatttctgggttcgatgttgattagtgcaaattagcttaggtggagaatttaggctattaccgtcttcttcaaagctaattgtatattcgtaagctaattagaaaagaatttcagaatcttgttgtatataatcccaaggctaggactaattttgattcatagatagatgcttaggtttcagatttagagaaaatgcaagctcatttacaagccaagacacataactaacctaaggctgatcatagcatattaataaggctgaaaaatctcattttgttgagaacatttctttaggtggcaaaacaaaatcaatg

SEQ ID NO: 16497 - DNA, 3003 bp, Unknown
  misc_feature (1)..( 3003): 2750-1469P.txt file - cDNA_ID_1450549; gDNA_ID_2926231; Annot_ID_203680
acattcgaataaggttcatatcaacaaccttatacctgcaaattcacaaaataaaactaaataaatctacacaatcctataatgttcgttctcggatttagatcaagattcgagttttgtcgaagatttttgggtgagggtttaactcgcaagatagagataggtagcgagtgcatcgcgggaactggtaaaacttattaaaaagtaacggaccggaaaattaaaagacccgtctaaaagcccaccaatagtaatgcatacaagtaacacgtggcaggtatggttgaccgagtgagtaacagaacgtgagaaaaccgacccgctaaataagaacccgcccaatataataagctttctccttaacttctgcctcacgcaaaaaaaaaaacttcctataaaacctcatctcctgcgttctctaactacttctcacctatctgacaagaaaagaaaccctaaacaacataaaaagaaacctaaaatccatacaggagacattcaaagccaatcatgccttggtcaaagttcacaaaggtagctctaggtctaggagctgccatagcggctgtgagatcaacaatgttcaccgttgatggtggccagagagctgttatgttccaccgattcgaagggattctagaagaaccagtaggagaagggacacatcgtaagattccgtgggtgcaaaagccgtatatcttcgacattcggaccaaaccctacaaaatcaataccgactctggaactaaggatcttcagatggtcaacctcacacttcgtgttatgtttcgccctgatgtaagttcccgcgaatatccaaaaaatttcactaataagattttgtgatatatatgtaaaataatatataactgttttccgtgggttcgtgttaggtttcgcgcctctcgtatatataccaaaacttaggtctcgactatggtgaaaaggtcctaccagcgatcgggacgaggtggttaaagcggtggtggctcagttcaacgctgacgagctcttaacagaacgtccacaggtctcagctcttatacgcgaaacgttgatcaagcgagctaaggagttcaacattgttctcgatgacgtgtcgatcactggtctctcatacggtaaagagttctcacttgcggtggagcggaagcaggtggcacagcaagaagctgagcggtccaagttcgtagtggcaaaggctgatcaggagagacgagcggctgtgattagagcagaaggagagagcgaggcggctcgggttatatcgaaagcgactgcaggggctgggatggggttgatcaagctcagaagggtcgaggcggctagagaggttgcgattacgctctctaattctcccaatgtcgtctatttgccaagtggtgggaatatgttgtttgcaatgaacggtccaagcaaagttgttgcttgaattagttgcaaaaatatggtgttcaatggttatattgatttgtgtgttttaagattttcatttttttatatagtttcctagtattggatcaccctagtatactccagttgagactgttcttgcgagtctgagactcgcacacatgacacatgacacatctactgttaagtcgacattgacatcaaattaaacaatcactgtgccaatcaaacttatgcatagacctagagataattaagtagtccaagttcaaaggttgatctaacctggatcagtgcccttggtagctatggcacatacttcctcactagggaaaatgggagctgattatccagcagctttcgattagatatcaacaaacaaaatgcaaattaggttatcttagaaagaaaaaaaaacaagctattcatcggatcacaagtcacaagtgtcacctcgaaagaaacttgggcccatctatattatcttatgggccttatcgaccgattcaaatattgcaaattagtgtcgttaaccttttttgaaaacatacggccattagtgacaatttaattaatattctacaaattcgagcagtgtcttctacatttctttgtaaagtctttggtttttaattttaaggtcaagttcaccatgagcgaccaaagttttgaatttttcaaggtttttattttcattttatcgttgtatggagaaagtttcttatatcttcatttgaacattgaatagaattattaaacattataattcaaggtaggatggtcaaacaattattctagatttccctcttaaattcccaaatttaacataatttaagcttttggtaaccaaaaatctaacatcttacaaaatttaataaatgtttttggcccaaagaaaatttatagtgctggcaaaagaaaaattataatgaatgtgctcttaattaaataaccaagatgagttgattaattatggattttgtaacaaaataaataatttaaggtgctgtcattttgcccacacgtctatgattaaaaacataatgaagtgtcaataatctctatgattaatagttttggaatcttactcaataagttccaatttataaaatcagtgaatagcaaagatatataaataatacgcaaagagaaaagaaagaaagaaaaaaaaaactttcagcatttgtacgtttctagaattttacaaatcacaaaagcaagagagaacattcgtgttacggtaaccgcgtttcagaggatcattttctcatatctctctcgtagccaatgacactttctccacaatcctctctctttcttcttcgtcgtcatcatttgattcttctctgtaaattactctgatttttgtagaaatcgaaactgggcttgatcaattttgactctttgcatccaatttcgattctaatctccgtaattgttctccgaatcgggtcaatttcaagttgggaaacaaaccctagcgaacctccattgatgtgatctctctctctctctcacaacttgagaatcaactctctagaaaatatcagaaaatcgttgaaaaaatctggtcttttctggagggaaatg

SEQ ID NO: 16498 - DNA, 3000 bp, Unknown; identical to SEQ ID NO: 13560
  misc_feature (1)..( 3000): 2750-1469P.txt file - cDNA_ID_1450561; gDNA_ID_2214636; Annot_ID_136139

SEQ ID NO: 16499 - DNA, 3000 bp, Unknown
  misc_feature (1)..( 3000): 2750-1469P.txt file - cDNA_ID_1450610; gDNA_ID_1620740; Annot_ID_166415
ttagtcttgttatggtaaaagaaaaggaaaggcatgaaaatgggaggagcaagctgatcaaggaaagagagatgatgatggcatggaggatgattaaggtttcgaggagagggcttgacgagttcctgagaagttaccgtgatctcaagccccattcttgttttgaaataacttataataatgatgtatgagaactgagcagactcatgcttcgtcagtaagattatataagctaaagttataaggaggtatagtcctctttaataacgtgtcatggtgattagacacggatcagaattagacccaagtgaacaagaaagttacaaattttatacaaagatttggttttggagacttcagctggattattttgtcaacattatgaaacttgatatggggttttggtttaacccagttttatactaacgttaggtggaaaactatatcttctatttagacttgaacaagttaatttgccgcaagtgagttaagcagcttcacaggataccttttccctcaagaaactcaagcttcacaggatgcctttttccgcaagaaactcttctatacaaaatgagtttaggaataagtacaaacaaacaaaaattaaaaacagggattcggttcgtcaacaattatatagtgataacattttcaaagtatatatcatcatcatcattaactagttggggttggtggtcgatggtcctcaacatctcctttagtcctttagactagtccttaccaaaaacgtttgactattcattttagctaaattatatattccgataggctcgttttaattatacgaaattatacttttgtattgccattcataacaaattttattttgtatatatatgtttgtggtcgatatagtcaatggaaccattaggtagaactttaaatcaataaatgatatttttgaattgaaaattagggtacgaattattccaaattcccattcttcaacttaataaatatgggctgttcatctactatgaattaatatgatcattacgaccaatagcaactaaccagaataatactatagtatatattccctagaaaccaatttttaattagtggcattaacatattcataagacaattaatatttttatttttatttatactattcaacatttttcacaaaagaaaaaatcctccggggggaaaaaacatgcttttggattaaatattaaacaaagaaggctcgatctacaatttctaaatctatatatagttagaaatcattgtagcaatagagtaaacgttatttcttcatgctagcttcatacgtcataaattatgttggaggacacaccatggtgttgaattcatcattttctatatagctagttgccaataaaattataatattcgttatggaatttgaaggctgagaaatattgttgctggagagcgagtttagtttgttgtccacgcgaacagcaatgattcaaaacaaaagtaatagtttaacgaaaacgtagggttttgttgagttatgtatctcagctctcaacacgatcaacgtcacgttcaaaacattacatctggatttgattattccaggatattaattaattagggtttatccactatactcaatagaaaacgtacaaacttctgaaatgtttaaagtacaattactatttaattaatcttcttaatcaattcttattacgttgactattgtgactcgtgaaaatagcccgtggactttggatgaggtattttactgcagctcatgacatgttaataggacttatctaatagactaatactatagatgttagaaactctaaatacaaaaggacttatctataaatataatcgaactcaacaatctcagtgtaataccatgaatcaacaatcttagcaacctttataacaccatgaatttaacattatcatcgtagtcaataataaacgtttttttctttttatacattaaaaaaaaaaaaatacaatcgtttaattaatcaacgaaacgactgtgttttagtttccgtctaaaatttaacaccgtttatttgcaacatttgatagattatgcatttaatttgttcaaattttcaagatgaaatgtcaatacttttgagtttatttttttatttatttattttttattaatttttttatacatttttattaattttgattatggacaaactagatttttgtaaaattaacattgcaatcatgaaagtgatattttcaaaacaaaagtacattagtctaaaatgatactgaaatatgaaaaggataaaatatgcactactaatttagtatagaatcgataatgaagagagaatcttcttccctattccctaattgtgttcataattagcataatataataaggaaataatgttggctctgacaggtcacagatattgaagacttgaacaaaaaaaatactttatgaaagaagttgattaaagaaaccaatttggtaacggagacctgccaacagaaagcatataatgttttatagataaggacaaaagctatttctctctacaaacattataacaacaacactcatcatcatcatccaatttctcatcattatgatctttgaaacagaacaccaaaattaaaaaagtttgcaagaacaaaaaaaaaaaaagagataagattcttctctctgtatttttgaaaaaaaatatatataaatttttttcttggctttcacgaagtctctttctctggctgcaaaaatatcatcaatagcgaaaagtcgcttcttttttcttcttccaaaatctttaattttgtgaaaccgaagagataagacgtggagaaaagcagacgtctctgttgtttgtttttgattcatcgggttctaaggatttgtctgtttccaagacacaaactttggattctcttctcttcctgttcgtcttctcttgtcttgatccttttgttatcatcatcatctcttcatcgagagaagagagacgagattagggatttaagttaaggaggatg

SEQ ID NO: 16500 - DNA, 3003 bp, Unknown
  misc_feature (1)..( 3003): 2750-1469P.txt file - cDNA_ID_1450637; gDNA_ID_2214638; Annot_ID_188188
cccaccattcttgtttcatccatccgaagattgagtctagcttcgatgagggaatccaacttaacattaggatacttacccaaaacataaccagagtgtttgtagtagataagattaggagcatctaatgaaatactagtaaacttgcgatcaaatcggatgtgtagtctctttagagatggagaagacacggaacaagtccaatctacacatcgccgctcctcaacaaccagttcttcgagaacaggacagcgagatataagagttccaacaacattatgacctccaacaaaattaactgagtcaagacataatgtcctaagcaaaggaagagaaacatcttgagaaagcttgattgtaaaaccacgtcctactctcagcttaaccaatgtcttgctcttaaagatcattgcaggcactggtggagattttccttttaaagtaatgaacacatcaagatccataacaccatggtcaagaacgttgcaaatccaactttgaatgcgagatgaatcagtgccacctcgaacaccaacatgactctttagagtgagcttctttatagaagaaccacgttgcgtatctagcaatttgtcaacgaaagccatgtaatttctgtgaatctcaatccggttttgcttagtcttaggcacagattgacgatcatcaatatcaagattggaaaccaaaacaaacatgttcttccacctcttagagagtactgaggttgaaacagcttcttttgtggagataagagacagaatacgcccaagaacctcatctggtagacggctgattacatctttagcattcattgataccaaaaccttaaaaccacagcaattggattcagaaacagtaactagacagagttgatgagttcaaaggtctgttctttttcatacaatgcaaagtctaatacaaaagttatcatgtatctcttcaatcacattgattaccatagaaatgaaaaagacgaaacagagcagacaacataccttgctaaagtgctacttgctacagagtcgtgaaagctctccactttcaataccaatttaatcgtgagatcaaaagtgaaaacatcgaatactagggttttggaaagtttaagagaagagacgaagaaactgaaacaacttattataagcaatttcctccatttccacatgaggaaagagtaaagcagaaagactgatgaagaaaaggtaagtagtctgtttgggaaagaaagtcacgtgagagaagcgtgggcctttaagggtaaaactgtcatttaaatagtcgccgttctttacacttaggattagggcttctaacatttaaatagtcgtttcgttctccgtctctcctttcccgtcggccggtgataatttcgcaacccaaattccaaatggtaagtttcagttcttggatttgtatgattttgtaatgtgaatagggatttgaagatttacttacttttgaaattcaggcgtcggagaagaagctatcgaacccaatgagggacattaaagtgcagaagctggttctcaacatctccgttggtgagagtggagatcgtctcaccagagcctccaaggttcctcctgttttttacccattctctgtggttttcactcttgttgtcacttggttataatcgattgattcgtggttacttggtaggttttggaacaattgagtggtcagactcctgttttctccaaaggttagattttttctcatatttgaaagcttacaaatagtctggttgatagatttagtaatctagaagaatttgggaaacatagtttagttaagtctatgaatgggtgcatggtttgatgatgaatttgagattttggaatccagtaagtcccttatctggtggtttgtgataacttgataagcctaccagtccaaattaggagctgttcgtttccccgcttctgatatagttgcgttgtgcactctgttttatatgcatcgcttttggtttgctctgagagacatgatttggtttagcttcttccattgcaattttcaagaacccttgttatgtgtggcttttgcagctagatacactgttcgttcttttggtatcagacgtaacgagaagatcgcatgctatgtaaccgtcagaggtgagaaggcaatgcaactacttgaaagtggattgaaagtcaaggaatacgaacttctcagaagaaacttcagtgacactggttgcttcggttttggtattcaagaacacattgatttgggtatcaagtaagtcaatccccttaaatcatcctgtcataacacttggggttcaccacattcttggtgatactcattgatctttgtttcacttcttataaaggtacgatccatcaactggaatctatggtatggacttctatgtggtcctagaacgtcctggctaccgtgtagcacgtcgcagaaggtgcaaggctcgtgttggtatccaacacagagtaactaaagacgatgcaatgaaatggttccaggtgaaatacgaaggagtcattctcaacaagtcccagaacatcactggctaaaacaattcctcctaactctttcttctgttttagaaaaccctgtctcagttttgtttacttgtctgaatcttaatctttgtactttatatgcattattggctttagtttcagttatttaagtatctaatttcgtgtgaggataagcaagataagaaaattttggcgggtagttgaagcgtgtggagacatataaatccactagctgacacgtgccacggacggctaagcacgctttcgccgatcgccgatcgccgctagattcatctcggattcctccaaataagcttccctggttcttatcttgccacgtcagcatttctccctcgtacgccttaaattcttcacaaaaataataaaaatattaattcaaataaatgttcatcttctcctacgaatgaaattgaaattaatttgagcgatcggaacaggatcgggtcggatcttttgaagttcttcaatg

SEQ ID NO: 16501 - DNA, 3003 bp, Unknown
  misc_feature (1)..( 3003): 2750-1469P.txt file - cDNA_ID_1450789; gDNA_ID_2214520; Annot_ID_134039
tatcattcttgccatctcttttatacttcaatttatattaattagttagttacaatgtatatttattgtataggttcgaggaatttgaagtattttctattgtatatggtataagataccaaaggacacaagtctaatcgcatgtgctcttctcgtttggttaaaaatcgctgtgattgtttttttactaaaaatcaagctagatgtcatattaggaactatatgttaataacttcatattgcggccattgttacgtaggtgttggaaatagacatttttgttatacaatcactagacatttttcttcttcatcttttttttttttgacttacatgaatataacttataagttcttacttcataaattagggtcataagagtgagcagatgttgtttgatataactggatatcttctatatatgattacagggaagtataggaaaatggatacgatgtaattcgaatatacattacgatgacgacattattagcagcataccatatcatatgaataacagcatcaacggataccgatctcttatttacaggtttgattaaaattacattttaaagaatcgatctagttctctatacaaactatgcggtttttggtaaacagtggtgatcacgatatggaggtacctttccttgcaactgaagcttggataagatctcttaattatcctattattgatgattggaggccttggataataaacaatcagattgctgggtgaataatttttacaatttttttttttgcttctttattcattaactcagtcgaatcatgagctcattagtcattttgaaatccctcttacgattttcttggacagatacacgatgacctatgccaataagatgacatatgctactatcaaggcaagtttttttttttgttcttactcttaatgttttttattacacaaatcattttgtttctcagtaactgttttgaggggtttactatagggaggtggacacactgcagagtataaaccagcggagagctttatcatgttccaacgatggatcagtggccagcctctgtaataataagagatgatgatgccctatgccaatgaaaaagaaatatttgtagcatcaacttttatatatatatatatatatatatatatatatgtttacaatttaatctactacaatattgtaaaagaagatcatctttaagaaataaaaatatttttaaaatgggctctcaacaaaacaaaactgtgtaagtccaaacgtctcataaataattaatcataatattcatgtctccaatcaaataaacctgagggagatggaagagatcgatgtttccaaaggcatactcgacaactatgctttcgattttatcaaaaaaaaactatatttttgtggatgttataagttttctttcagatcataatcattgagttcttgggcacatttgcaagcaccacacctcttacaatagtccaatgtttcttgagcatatttggcttcttgggcatgccgatcgctgcgggctagaagaaaatacccgtgtgatcgaagacacaatgccgataacaaccttgctcttgtaggacataaattccttgacacatgcaaaagttttacaaagcttttgcctttttgtatatcccctttttattttacattgttgaccaaatttgagtcaaataggctaatgacaattaatctactcatcaattcttttttctttgttcttgaaatgaatccattttatcaagaatgaaaacaaaaatttgaactaaaccgagacttgccgaaaaacggttaagtcatcattaataaacaacgcaggaagtggatcatatttttttttttttaaatgtaaaatttattcatcaaaaaagatcatagttacaattagtctgttcatttcgtcgccgcgggtacctgcggccactaaacaaacagactatatatgcatctatgatcatcttaatgtctttgatgagtttggcttggtatttcggtaattcaccgtgtctccactggttttgttctcgtcagattgtgtagatagtggcttgaaaggcgtatcgcaaaatgaaacaatgggtgcgactaatactagaatctgagattgctttaaggatatcaccaaactggtacgtgtcagttgctgagatatcccatgagtgagcttgtaccaaatctgagacgtgacattacatgagaagaagaggtgatcacgataagaaagtggatcgtattgtatttttttattccatcctctaaaaaagggtcaaatgatcattaaagaacaccgaaaaaaatggatcatattgtattttatataccaacctcttgatattttaatcgtttgactctttttttttttttttttggcaaattgccatcatcgcctaagataaccagttttccaatttttaaaacaattattatactatctttccgtcgataagttgtagtttgtcagatattttgaattgcaaatcttgtttagttaacaaagtcataaactacttttctcaaaatcatctcttcattccttagatccattataaaagtagagcgtgtaacatgaagtagttgtgtgcgtgtaacacgaaacagctacgtaacacaagaagatgttgattataaactaatagtcttgggattataatcttttattaatttatcgatatactaattgttctaaaaaaataatttaggatcgaagaaatatataaatttattaaggtattaattcatccaatatgatttcaaagatcctcaatataacctactcctacatgtgactattcaacaaaacgtctggaaacctctattattgataatatatggtcctacatatgactattcaataaaacgccagcaagcctcaattattggtaattaattaactaattgaactctacatgtgataattatcttttttttttttttttggattaaagatataaagatccttgtatcctaagatgactcaatctttagaaactaagagagaatg

SEQ ID NO: 16502 - DNA, 3003 bp, Unknown; identical to SEQ ID NO: 16501
  misc_feature (1)..( 3003): 2750-1469P.txt file - cDNA_ID_1450789; gDNA_ID_2214520; Annot_ID_184578

SEQ ID NO: 16503 - DNA, 3000 bp, Unknown; identical to SEQ ID NO: 13854
  misc_feature (1)..( 3000): 2750-1469P.txt file - cDNA_ID_1450859; gDNA_ID_2214659; Annot_ID_188846

SEQ ID NO: 16504 - DNA, 3000 bp, Unknown; identical to SEQ ID NO: 13854
  misc_feature (1)..( 3000): 2750-1469P.txt file - cDNA_ID_1450859; gDNA_ID_2214659; Annot_ID_136521

SEQ ID NO: 16505 - DNA, 3000 bp, Unknown; identical to SEQ ID NO: 3010
  misc_feature (1)..( 3000): 2750-1469P.txt file - cDNA_ID_1455881; gDNA_ID_1620620; Annot_ID_162273

SEQ ID NO: 16506 - DNA, 3000 bp, Unknown; identical to SEQ ID NO: 3010
  misc_feature (1)..( 3000): 2750-1469P.txt file - cDNA_ID_1455881; gDNA_ID_2926190; Annot_ID_200957

SEQ ID NO: 16507 - DNA, 3000 bp, Unknown
  misc_feature (1)..( 3000): 2750-1469P.txt file - cDNA_ID_1455901; gDNA_ID_2214461; Annot_ID_132981
ttcattagtagtgtcagaggattgggtttcaaatctttagcctgcggagatttccatacatgcgctattactcaatctggtgatctttacagttggggtgatggcactcataacgtcgatttgcttgggcatgggaatgaatccagctgctggattccaaagagagtgactggtgacttacagggactgtatgtatcagatgtcgcttgcggtccctggcatacagcagtagttgcatcatcaggccagttgtttacgtttggagatggaacttttggtgctctgggtcatggagaccggagaagcacaagtgttccacgtgaagttgaaagcctaattggactaatagtaacaaaggttgcttgtggcgtttggcatacagctgcagtggtagaagtgacaaatgaagcatctgaggcagaagttgactcttcacgcgggcaagtcttcacatggggggatggcgagaaaggccagcttggtcatggtgacaatgatacaaaactacttcccgagtgtgtaatttcattgacgaatgaaaatatctgccaagttgcctgcggacatagtctcactgtttctcgtacatccagaggacatgtgtatacaatgggtagcacggcttatggacagcttggtaatcctaccgccaagggaaattttcctgaacgtgttgaaggagacattgtagaggcttctgtggaggagattgcatgtggttcttatcatgttgcagttttgacatctaaatcagaaatttacacatggggaaagggattaaatggccagttaggccatggaaacgttgagaacaaaagagaacctgcggttgtgggttttctgagagaaaaacaagtgaaggctataacatgtggatcaaactttactgctgtgatttgtgttcacaaatgggtacctggctctgaacattctctatgtgctggttgccgcaatcccttcaactttagaagaaaacgccacaactgttacaactgtggtctggtattttgtaaagtatgcagtagtaggaagtctctgcgagctgctctggcacctgacatgaacaaaccatatcgagtgtgttacggatgtttcaccaagctgaaaaagtcgagagaatcatctccttctacgccaacttcacggaccagaaaacttttgaacatgcggaaatcgacagatgtttcagaaagagacagcttaactcaaaagttcctctcagtgaacgccagactatcgtctgctgactcttcattgcattacagtgaaagaaggcaccacagacgagacttaaaaccggaagtaaataacagtaatgtcttcccttccatgaatggcagtttacagcccgttggttcgccattttccaaaggatcaacagctttgcctaaaatccccaagaatatgatggttaaaattcctggttccggaatgagctctcgcacaacatccccagtttcagtaaagtcaactagtccacgtcgatcttatgaagtagcagctgcagaatctaaacaattaaaagacagttttaatcaagatatggctggtctaaaggaacaggtatacatcatctattgtcagctgtaaatcacatcaaagcaaaaatgcttctagactaaaaacatgcatctatccactgaacattgtaggtagaacaacttgcttcgaaagctcaccaacttgaagaggaactcgaaaaaaccaaaaggcagttaaaagttgtgactgcaatggcagcagatgaagcagaggaaaatagatctgcaaaggaggttataagatctctaaccactcaggtttgaaaatttccagactctactacacatgtttgtctcttatatctatttctcattatgttactatggttttcgcagttgaaggaaatggcagaaaaacaatctcaaaaggatagtattagcactaactcaaagcacacagacaaagagaaatcagagactgtaactcagactagtaaccaaacacatataagaagcatggtttctcaagatagtcaaaatgagaacaatctaacaagtaagagcttcgctaatgggcataggaaacagaatgataaaccagaaaaggttgtgcaagacgaaccaggagtgtatttaacgttgttgtctttacctggtggtggtactgaactcaagcgtgttcgcttcaggtatatgatttgcttcttatctccacaacatgacatatcatgttacatctcgttgaagctcgctaagactttgtttttgtttgctgcagccggaaacaatttaccgaagaacaagcggagaagtggtggggtgaaaatggagctaaagtgtgtgagcgccacaacattctagtttcttaggactcctatgtcttcttcaatagaataaatagagacatggatgcagatttttatttggaacatgatgtttttctgttgttcatagaaaaaaatgtttgatgtaaattatatatttcattcaattttttgtcttagtattttttatttccttatgataaacaaatatcgaatcagagcaagtacttcattgtcatggttgactcaaaaggtcaatcacacaactaagaaaacagaacaaatctaaattttcgatttttccaaaaaatattatctgactgatttagaaaaaaaaaaaaataccaatttatgatgttggtaatggtaattgactaattgttacaaacaaatattttaagaaaaatccccaaccccagagaaacccttcatcttccatcatctttcttattcaatctgcaaaaattccaaggtatgtggttgtaatttttattttttacatactaaaaaaatctttgttaatcttcttatctttgatttgaagttttacattttggtgtttaaattcgtcaattgttatttttttttccaaaagcttgatgcttacacttccttcatgtttctccaacaaaccctaatttcgatataacttgacgaaatcctcaattcgtgtgtgtgtatgttgcagattcatg

SEQ ID NO: 16508 - DNA, 1150 bp, Unknown; identical to SEQ ID NO: 407
  misc_feature (1)..( 1150): 2750-1469P.txt file - cDNA_ID_1455908; gDNA_ID_1590789; Annot_ID_150073

SEQ ID NO: 16509 - DNA, 3003 bp, Unknown
  misc_feature (1)..( 3003): 2750-1469P.txt file - cDNA_ID_1455932; gDNA_ID_1620716; Annot_ID_49113
ttcgtgagaatttcaagctacttgcttgtgcgtttcatcagcatagcaaatgaggagaaaggtccaaaagcactatcaaccactaacagatatgtctgagctgctgatgacatttacaaggaattgaagagcttatggggtttacgtttacttcactacaggaccactttagattactagaaaaatgtagctaccttgtaaaaaatgacgtgtctcaaacacgataatagtggaattagattaattagagaaagaaaagatagctaccttgtcaaaccggcaggtctcaagcacggtaatggtggaatcggttttttccttaattaaaccgcttgaatgtgatgccaatgcagtcagggtctcagccgcagcttttcgtgttacccaatctgtacttccaaggcaatcatggatgctttctagcaatgactccaagctctgaggtgcaatggctcccacctgaatcaaagtaattgctctttacttctctttttcataaacagatttaaccactaaacctactagcattgaactaccagaagtaaagagagagagagatattaaacccctcaaaatttcactgagacttgtatgctcaaatcaaacaataaacttcagcaacacctaacagaaaaagtgtcggattaagactaaaacctcaagcagtgttatttactaaaactttgtgttctacttactgacactgatattcaaaattcaccatattcttccatttgctgtctatagcatgacaaggaggagattataaggattctgggcaaacctgagagagacttgaaacaactggcaaaagggaagccttagcaaggaaactggaattgctcaatagcttgcaaattctagggcaaagcttttggaaagaagtaactggaggactagcagctgattcaaccatcctagccatacacattgaagctccagattgtaccactttgttctgctctcccattgcctcaaacaatggcttaacgaacaaacccaccgctaacgacgctgaaccagtattagtcccctcttcttttcccttgagataaatcccagacaaagcaccaatcgtatctctacaagcatccctaactccagaatcagaatccttcaaccgtttaactatctgagcgatgattttagtgagatgcgcagccgtcgaatcgcaatggagactacaaacgtaggagagaagatggagacactccttcttcactgcaggtttcggatcggagcacgaatcgtagagacaattgagaaacatcggtagggtttcgggagtgagagattgaatagttttctcgagatcctcgacggcgatctggtatgtatctcgatcggcgagcttagagattgaggtaaggatcttttgcttcagctccaccattgcttggaacgaagtgagggaaccggaattggaacatgacctagttgctaaactcgacgaccgtgctggtctcgtcggtttcgccgccgaaccggaagttgtaggtgtgctcatttctaaatctccgacgagagattagattaatcggagaagaagatagacgagttggagaagaaagacgagatctgacactcgaaagtgtaacagttaagactggaatcagaaatgtgtcgctcaattttattagtatttcactttttcaattttttcaaattttaatattgcataattttcagtatctggattttgcatttgtcgcggaaaatcgggtgtgaaagacaaagtatgaaaatatagtttaaattcgtgatacttcgtttaaattaataatcaataatacgagttctagtgtaatatataaacatccatgcaaataagttcggacattatcaaatttagagacatcacgttctacattatggattgttaatttttatttcaaaatttaagttaaaaaaaataaaaataaagaatctaattattcaaaatgtcaaattggtttcttgtacaaaaacatggcttgatatatggattaaggaattttttacatggtactataagtcaataatgaatggttcaaggaattttacatggtacactaacgaatgctttaaggaattgtgattgctattagttgtttaggttgtcgttaagattgttacgttacgtacactttgttggagttagagtcgagcaatgcacattggagaggcttccgagtgagtccgcatgcatataccattcattttttagcttcaacgactcaaaggccttcgtctggtgtttaatgcacgtgtgtaaatcataaatggatcagaggctggtggttcatcggaccaacaaggtctgcctaaatgacaagttaagacggtaaaatcgataagagacaaaccttaccgatttgatatttattttttttggttcgaatatgtaatcgattagtgtcattttgactatttgcatgttggtcattaaaagatcaaccacattttattattttaagtacaaaataaaaaatacaagaaacttaataaagttttggaaaacgtttaaaaatcatgaaattaaactaaaactatatagttagttcatttgtattaatttaaccataagtacatgtctttgtaatccttttatttatcaactccaccaaaaacaaaacgagtagtagtacgtcgttcattagcactattagaagcctttgaatcatattagcaaaaactgctatacgtcattttgtccaaagaggacgtttaccaaaagaaaatagataacactaaaattaggcatgtgataaacactccaacccccaaaatgtacaccgccctattctcaccaacctcttctgactcttctctcattttctgttgttcacaaataagttaacgtggtaccgaactaccgatttcctccactattttattgaatttctggtcaaaaaacttaagtgttacataacgaatctataaaaagaaccctcactttcaaggtttttgtcagcaaaacatttgtcttcgtgtttgaaagctagataaaagattcactaaatg

SEQ ID NO: 16510 - DNA, 3003 bp, Unknown; identical to SEQ ID NO: 16509
  misc_feature (1)..( 3003): 2750-1469P.txt file - cDNA_ID_1455932; gDNA_ID_1620716; Annot_ID_165640

SEQ ID NO: 16511 - DNA, 3003 bp, Unknown; identical to SEQ ID NO: 16509
  misc_feature (1)..( 3003): 2750-1469P.txt file - cDNA_ID_1455932; gDNA_ID_2926190; Annot_ID_140992

SEQ ID NO: 16512 - DNA, 3003 bp, Unknown; identical to SEQ ID NO: 16509
  misc_feature (1)..( 3003): 2750-1469P.txt file - cDNA_ID_1455932; gDNA_ID_2926190; Annot_ID_200964

SEQ ID NO: 16513 - DNA, 1269 bp, Unknown; identical to SEQ ID NO: 333
  misc_feature (1)..( 1269): 2750-1469P.txt file - cDNA_ID_1456083; gDNA_ID_1563953; Annot_ID_148574

SEQ ID NO: 16514 - DNA, 3003 bp, Unknown
  misc_feature (1)..( 3003): 2750-1469P.txt file - cDNA_ID_1456167; gDNA_ID_1620835; Annot_ID_57958
atatttcttagatagatatacgcaacatttatcatggttatcgacaactttagtttgatttttggcatatacctaaaattttgtaattttctaaggacttggttctaattaagaggctcgtccgctaggcgctaagcatgtttcatgtatgttcttcattgtcttttattaacttttcgaagcgttgaaattcacttctttaacatgaattggggatttaattttggagttaggtggatttaagtcatagaaagaagaaaacctgtcattaatgtgaacgaaaaaatgtaacatctataaaaaattgatttgtataaattggtttgtaagtctctaaagatgaaattgagtcaaatcctttttttagctaatcgaatttaataaattgacaaacgcgttaagtactagagaaacaaaataaacatgattagctagcaacggcggaatataaactctataaagatcacgaatcctttcgcatcgatatcttaattgccgtatgaacagtataattaatcttctcataatatggttattatactaataaattatatgtatagccttgtaggtaaatggaattattatggaaacagaatcaggtgcagagaaccataatgggccatgatcttgaatggtgcagagccaattcaaaatcatattatgactaaagacagagagcacatgactcacggataggaccagaagtatagagaggtcgtaattcagtttaagagaagacagctatcgatctcatttcatatgcattatgatctctggtacatctctatatatatcacctaacttcgtcttatcatatcagctcctcctccatgtcttatcctgagtcgcccattgtgtcacaaaccggttaacctaattgtatgattgatcgtgtttgcaaccatttataccctaaatgttgattacctcgttaataatatgccgtagattttattaatatgtatatgtgtgtaccaaattacaacgctaaatgaattttaaatccttggcagaaaaacagttcacaattttatatcctttgttaaatttaggttgtcgtgtccacattgtatgatctactcataagctcatagcatcgagtcattgacatcaactcattgttctggataatacaattgattatacatgtgtcacacctgatgataacttttagaatttttaaacgtgattttatacggacatctagatttgtttggatttcaatttaaattgttttttttggtttatatatttagttatttacatgttggttagtgttttattttatgtaagatattttcttacaatatctgtatatctatccacatctaatacatttagattttaaaatatcacatacggttaggatttgtattccctcagtcaaagacaaaggagtgggcatatagtatttataccctataagtaataacaggtcatttaaaaatttgaatagcttattccaaattaatttcatccatagaaaaaaacctaattaatgtgacagctgagctgaccatatattgttttttttggcacaaccattgtgtttatataaatcttatgattttatttcaaacgtacgataaggatttaggaaacgaacaaataaaatgggaaacggctcctctttaattattgaccagccattctgtgtctgttcaattagcgactagccagattcccaaatttcctcattgtccattgatttcaattatacgccaactcttctagattcagaggtaggtccatgaacttcaacatgacacacgttattttacttatctcagtctatatcgtaccaattgctccatattatacaatatcttataactctaaatgtcagtcgcatctaagattcgccactagttattatcaattcacccaactagaatcctcagttttcagtcgttctcaaaaaagtataaaaggattttttctattaaaaaatgtatatatatatatatatatatataaaacatgatagaaaatagaaaatttaccgaataaaaaattaaaactaattcagccgtgacaaaatacctaaaaaattatcggttttgtttattactcattctattgatcaaatactcaattttatatacaattattagatttttgctacggaacttagcgtgataaaactaaaatttcaaaatttaagataatcaaatggaatgtttagcccatatgtcacggttttaacaaattttgtttggttatgtatgttaacacatctatgagtttaattatatgtcaaataaatagtagaagtcaaatgattgaatactaaaaatattttcactgaacatgtttctatgaaataactgaattttctaattatattcatatatattaatttaactacttttaattatgtcaaaacctaaaaatttgataaatactttaaatgataaaacaagacattcatattaattaaacgtgaaaattgtataccatatatagtattcacaatatataatataattactttttgtgctttgcttaagatgcagtaaatcgatttgattagtctctaaagaataaatcttttatttggtcagtttgggtctaagcaataattactggtattaactttaaaattataagagtctagggactaaaaaagaaactaaagatatcggcgacatgaatgatgaatgagaaacagagaactctaaagaaagtaaaggagcagcgatgaaatcggttgtccgcaaacaacggatagatctgtcgatgtttgtttttggaactccgcgttgaatcagcgtcgatgtttctcgtaagtttgcataatccaaaaactcgttttcgaattataaatttcatcaaatccccgcttattttgggtaaattcaggcaaaaagggtttttgtgttcttcgatattatctcttattactattaggctattatcatcgccttattggggaaaaagcttcaaacttttatataaagtctcttcctttttctttctttctcggtggaatttgcagcaatg

SEQ ID NO: 16515 - DNA, 3003 bp, Unknown; identical to SEQ ID NO: 16514
  misc_feature (1)..( 3003): 2750-1469P.txt file - cDNA_ID_1456167; gDNA_ID_1620835; Annot_ID_169836

SEQ ID NO: 16516 - DNA, 3000 bp, Unknown; identical to SEQ ID NO: 9687
  misc_feature (1)..( 3000): 2750-1469P.txt file - cDNA_ID_1456224; gDNA_ID_1972172; Annot_ID_179877

SEQ ID NO: 16517 - DNA, 3003 bp, Unknown
  misc_feature (1)..( 3003): 2750-1469P.txt file - cDNA_ID_1456622; gDNA_ID_1620387; Annot_ID_155492
tttttatatttagaatttaacaagatgtatgattatatttattggttataaagatgtatgattatactattattttaagttaatcttagaaaaaaaagtggtgtactatttattttaatcacagaattgggaagttcaatttagaaaaaaactgaaaatgtgaagaagataatatacaataaatttagaaactttaattgaatttagattaacaagtacactcatatctcagttggcatgttttttatggattcttttctaagagttttttgatccggtcaaaaacttcttgcatttcatatagccctataaaatcctatgtttaatccgaccactaacccaattcacgatcaataaatgatcgtcggttcagtctggcccttgatcccgttcccgtagatatttttttctttttggaaaattagttattagtttttcaaaaattaacacatgatatccagattttatcgaactatagccaactaatccggagataagtatcttggttaacacatgatatctaaattaaacctacgtaccacatgaacacaattcatttcccttccgatatttcatattttccatataatataaaaagggtaatactaaaaaatcaacaaactaaaactaattagtttttttttttggttaaatgaattagttccacaattaatgtttagatttgttatttgtatagattagcaaattagttatggttaaatgaattagttacacaattaatgtttagacttgtagataagcaaattagttatggttactcaaatcagttccacaaaaaaatgtttagttttgtatcttaccacatcttgttgtcggtttggttagagagggacctttacatctaacctgtattttttgggcttcttctctttctcaacccattaaacacagaattcttctctttctcaacccattaaacacagaacaagatatgtctcgagagagttatcttaattaattcaactagatgagtatccatgctacgcgtgggcttttgttttaaaagttgttatagcaattctctgttgatagtttttgttgttggttatgttcatttttttatgagcatttgttttaaaaattgttgaaatatctatattggtagttttgttgttaattatgtttatatgttttttagtaaagttagatctacttatatagttataaaactagattttaacctgcggtataccgcggaaacaatttattttttaaagttagtatatataaaagtttacaaattgtatctatctataaaataattttattttatagtttacaaatgttattaaataacgtcctgctaaacccgtcctgtaaaaaaaaaaccatttattttattaatgttgatcttatttatgatatgcttatgaatcattgtctaaatattttgtaattttgtagtaattaaatgctatcagattatatctctgcgctttgatgattataatcgaattgttatagttatggagaaaatcaatatcaaaaatgataattttatagtaattaaatgatattaaatattttggaagtattattttagtaaataatcgtgtagttaatgtggagagattttgggaagattgttaaatgtcaaatatttaattcgaagattttatttttaattatcaaaaacaaacattaaaatccagtggcagccattgtaaataagtcccaactacaggatttatttcacaaaatggctgcaaaaatgtatatatagattagattcatcttggctccagatgacaattaaacatttcttgcaagtgaaactataaactaaaattaaattgtcatcgtggaagagattttggtagagagatcacattgtaaccaaaatatttttcattacttgtctcatgtgtactaccttgaaaatgaaccagaaatatcatgtaatcgtcccaatgttaaaacttttaacacacatttcaattcttaaaatagagcaaaggtttgtagaagagactgtaagatcctcatgactattatagccgcttttgcccacataaaaaaaagaatttttggtgagcgatagatttaatcaatcacataactctcacaacatctagtttgtgctataatcgttgcatggttatgcttaaacttgtgtcatcccaatcatttggtcccggtataccagcttctcatacttgtcatcatcaacataatgattcacactgtaaatgataggtgagatatagatttagatgatatattttcaagatgttaggaacttattgaccacaagattgggcccactaacagaattcaggatatgcataacttattgtatatatgatatataacttcattgacaaagctctattaggttcaaatatttactctttgttttgaagatcaaagagcaagtcaagcatgtaccgttactaaaataaaaatttaatcatataataaaattatagtaaaaatattaatattttttttgtttgagaaactatttgggtttctctttgatggagatgctctttgactatatattttcggttaaattttgccaatttttttttaattttttaatatgctatttataattattttttccaaatacacgtattttttctttaagtaatgaggtgtcagaaggatgaagagagttcaccttctttcatatgattagtctccaaaagctttaatttactgaaagccttaacacaccaatactaagcctacaggctttagtaaagcccaaatcaatacaataaaaatcctaaattaataaacaaagagtcttcttcttcttctaaatcccaacggaaaaagaagaagaatagagttttcgcttaatctctactcaatacgttgaatttgtgaaagcggagatctacaaagcgtaaaagagttcttctgggtttcttctttctccgatcgatctgctagacgatgacgatgagtttccttctataaaaccagtaactacgagatttgatttataacaatcatgaaactctggtcatg

SEQ ID NO: 16518 - DNA, 3003 bp, Unknown
  misc_feature (1)..( 3003): 2750-1469P.txt file - cDNA_ID_1458988; gDNA_ID_1620815; Annot_ID_169207
attaagtctgtgagtaatattggacccactaataaatgatcaaattaatttcaaaaacaataatgaatgcttatcaagtcgaattcaaaacacaaatgccttcaatttattttttggtttcgttggtcttcattatacatggaactagttagttggtcattactcgaatttctcgctgtcgagttattactatatatgaattcaactacgatagtacatggtctatcttgtgaatactatagacatagtatagcatctataatatcgttgttttatgtatatcaaaattgctcgttttataatcttttcctacggattaaaatattatttgagcatgcatcgcaaacatttcttctaatttaacaaaatcacttaagatattttaatccactattttttttttggcagcctgtaaaagaaaaattataaatattgcaactatctacaaattaatgtagtatgatattcatttaaaagatgaaaagcaatataagacggataaaccctaaagcatttgaagatatttatatattttttgtttgtacatgtttatagaagaaacataattatgttagatagtggttgggagataagataatatggttgtgtgaatcattaaattaaatttcacattctagtagccttgccgatatatcatagtcttaattaactagcatgatttttcggatacttgcgctctgccttactatttatattctataattattagttttggaccatcgttatgttctagcattaacagcaacttctctagaaatatgctaacattttgcttttgatatatttttagccacaatactttttcatcgtaaagtcttttttgtaccttttcacgtgtacatatttatagagaaagttaccttcttcacactcagttaactggaaatagtagtatcacctattgcttgtgatctacatctaccctccggtccctacgtcttagttcattttttctttttctaattcgttcttatcatatgattcgctatgtcggttttaatttataggattctaaaatataattaaaactagatattgatttatccaaaaagaaaatgatatgttatgctagagaccaaaaataataccaacaaaatattctatattgctgagcttgatgggctctagaagtcttggttgtattaattatgatgacctacaaatatgtagtttggtaacagtttacatcacatgctcaaagattttaacatgagattcttaaattaaatagtattactaatatcatattttttaacgtaccatgattgttatatgagattctaaatacaaatatctactatatatgtagagtaattaataccataagtttttgataataattgaagttatactcatttgtgcagagatagattacttgtaacaccgatgttatgacttcagaaaacattcaaacactcaagtcaaaatggtcggaaaaaaagaaggttaaataaccgcattattgatatgatatgtagttgtttataactttgtgtattttgaagtgcttttaatttttttgaattttccatgtattatctctcttttaacgtatatgtgaatgtcttctaaattcattggatgttactcaacaagattctgatactgtcatactgagtgtctgaaatatagggccatttagttgtcagtcactcagtctgttgtaggagtcacaaataaagtagatctaccttagttatcctacgaaacagagtatgcattttgattatgttggtgcaatatatttgatgtattatcccaaagagatgcatatgatatgtttcatcagatattgttttccgtggaatggtagtgctagtttttttttttttttttttttttttttttttttttttttgtgtgtgtgtgtggtgattttctggccgaggcgaagattactctttcaaaaatctcttaaaaattcagattttacttatcgcatcataattgacaaaaacctaataactaaaatatagacaatgcaatttacattcaaacgaaatcagttccagtcaaccgaactatgagcacactgacgtaaatatgatatgagcacaaccaaatgtctaaatctacatttaagtcaacgaaatttaactaaataaaaataaataaaagtttttgatgtagccttatttgaagtaaatttagtgtatataataagattaagtaacattttaccaaaaaagtaacaataataaaatatcatgaatttatgttttttccccaaatcaaaataaaacctactcttttatgaaatgactatcttttagtggcaaaaccaaaatatgaaatggagcaagcagagtatttaatgctcctataaagtctagaaactctgacagcgattaactaatcccctcttaattagcgttgatacacatacgcactatatagtaatattacctgtctgtcatataatctgtctgtcacattctgctggcaataatgtatttcgatatacgccctaatagttatgttttgtcaaaagtagtccttttttttttgtgcaccaacctagccaagtatatatatgtgaagaaaaaaaaagactggtaatctggtatggttgagagagagtacactatctaatttaaacaaaaccaaaaaatagagagtagtgagtacactatctcagttttctcgaggattattaacaaaaagtgcattttaattaatactcaccccttcaaattattagaagaaaacacctagtttcaagcagttaattcggtcttgtcctaattaagtctaccggtccacaacatctccacgacccaatgcattacacatatacattataaataaatacatatatcgacatgtgtctatatatataaataagtgtgatagcattgaagagaagttgatttagcctctgtttgtccttgttatgttgttgtaaaacttgaaactttggaagcaaactcatttttataacaaaaggaaatcttattttatacattacattaaagcaacatg

SEQ ID NO: 16519 - DNA, 3003 bp, Unknown
  misc_feature (1)..( 3003): 2750-1469P.txt file - cDNA_ID_1459029; gDNA_ID_1620671; Annot_ID_48156
taaatatagcatgccaatctttttcctaaaacaaatctccaatatttaattgcaatttcggtggataatcggattccacttttgtacttgaacggccagttctttcttactagtaactttcattcatgttttttaatggttaaatacatttcaactataacagaaattgttggcaagaggcgaccaatcaccaacgaaagctcgtgtagattacatccacataaataattattacatgtattgctgtttatattccaactttatcataagtaatctagttaattgaagattagcgacaaaaatatgatattaaattggatgggagaaaacatatatttaattaagcaaacgaacatattcgcaacttgagtttttggggggtgtttggtgacgtacaaacttctcttcttctagataaggaactatgcactacaaattttcttaattatgcaccacaaattttctaaagtacgattaaaaaagaggaaatctaaagccaaagtagtaatcaaccctacaacaacacatgagtcacgactttcagttaactacaattatacaaatattacttgattaagtggtgttatcttaactagtgtaatgtatgtttgaaattaataaagtccatctacaaaccattttatcaaaacaaaaaatccatcaagcaaattgaagccactcttatagccgactaaccgtacctacaaattttctgtttcaaacttatgcatatctatatgggtgcttatgatacttcctattaaatttaataaaattagtaaaaatttccctaccatatatcatattattattttttcgatccaagaaagttactttttaaaatagttttctattttgtgacacttctaaaatattataagtgtatagccatttttccccaaacaaggaatagtctatcagtctatacagtatacacacgatttatttgcaaagaacctacatacacaatttctcttctaccatgttagatttttagtacttgttttactagattatgtatttttgtttgtctatcggtcttttaattttcacttgctggaggtaaataatgaaggaagtagttaaaaattgagataacatagttgtgtagaaattagaatacagtgcagaacttaaaagtatggttacgatcacattgacaacagtcgatattccattgagatcacatgaacattgcttcgttagaaatgctcgtcgatcgcctgaagtaaaccgatttgattggccaccatgttttgcctcttcctgatttcattgatatattttatttttctttactattttaaacaacaaaaaaatttagaatccgtattccaaaagtaaattaaatttttgcatacaatttttctttttctttaaaatatctaggttttaatataatattccataatttgatgaaaagaattaaagagaaagttcaaatcaatccatatagcttgtcctagcctatagccaaaaatattcctatgccgcgattgaacaaccgttttttaaaaatcgtcaaattaaatcaaacctttttccatgacaatgagacttggatatagtttacattagattctgattggcccctttgatataactaggtaaactagcttcttgaataaactgtctcttattttggttttatacaaaaaaaaaaaagcttttggaaaatgatttaaatgtaaatacataatacgtagcgtctaagaagcatatttgagaaaatatggatttatttatctggtatttatccattaatttacctacaaatggaatccaccattaaccaaaaacaaacaaacaaatggaatcccgtgaaataaagtatcatcatatacatatctctcttttatgtttttatggagagaattagtccaatccttcttcactgaatttaccacctgcttctcgtagaatatataaaactacccttaagtctttttctaatgactatgagttgacaaatgagaaaaacaaaaactgcttttgttggtcattaaatattccgtctagatggagttagtgctttcattgtcatattctttgtctcccatcaaattaaagctcactatacagcagattgtacaacactatacactaaagttacatttttgagattttattgattgacaatttcgtttcgatattcttagatacactaaactcaaatattgattttatgggaagagaataaaaaatggattgtgaaaaaggaaaaaaaaaaacctaaatttgggccatatgtgaagaatacttccttaagtttgggccatagtttaaatcaataggcccattagtctatctaacgattctttctcaactcttaaaaatctgaccggcggagatggctctgagttggaccagtcggaggattagggtttcaacggagactcactagtcgatctccgatcctttcttctacccgcccgaaatccgtcgaaacttctcttctttaccattgatttgcctcgtctcagctcaattctcttccgttgctgcttcgtttaggttcgcattatcgcttactttattgaatttttcctctatgtctctggtttcaatttcagctcaattttgtctttttttcggttgaattttctcttgggtggtatcgaattttgctcatgaatgctgtttcttgatgaatcagagccctcttagtttacttcacgtcgttcaattcaaaacttggtgtggtcttttgcaacacaaatcaggaatagttcgttacttagaaacaataatgtcatacgagaagacaaatctggaacagagaattagtaaattgagctggaaagtttcagtagtcaaaattctcgtaaaacttattttggtataattgtgtcatgagtcatgacattctttcttaggtttcgtacaagtttctaatttgaggtagatactagttcagaggttctttattaatgtttgattttgaaaacctttctttacttacagttgttgcttcgcttcagtactctggtggtgggagagatg

SEQ ID NO: 16520 - DNA, 3003 bp, Unknown; identical to SEQ ID NO: 16519
  misc_feature (1)..( 3003): 2750-1469P.txt file - cDNA_ID_1459029; gDNA_ID_1620671; Annot_ID_164109

SEQ ID NO: 16521 - DNA, 3000 bp, Unknown
  misc_feature (1)..( 3000): 2750-1469P.txt file - cDNA_ID_1459029; gDNA_ID_2926200; Annot_ID_141483
atatagcatgccaatctttttcctaaaacaaatctccaatatttaattgcaatttcggtggataatcggattccacttttgtacttgaacggccagttctttcttactagtaactttcattcatgttttttaatggttaaatacatttcaactataacagaaattgttggcaagaggcgaccaatcaccaacgaaagctcgtgtagattacatccacataaataattattacatgtattgctgtttatattccaactttatcataagtaatctagttaattgaagattagcgacaaaaatatgatattaaattggatgggagaaaacatatatttaattaagcaaacgaacatattcgcaacttgagtttttggggggtgtttggtgacgtacaaacttctcttcttctagataaggaactatgcactacaaattttcttaattatgcaccacaaattttctaaagtacgattaaaaaagaggaaatctaaagccaaagtagtaatcaaccctacaacaacacatgagtcacgactttcagttaactacaattatacaaatattacttgattaagtggtgttatcttaactagtgtaatgtatgtttgaaattaataaagtccatctacaaaccattttatcaaaacaaaaaatccatcaagcaaattgaagccactcttatagccgactaaccgtacctacaaattttctgtttcaaacttatgcatatctatatgggtgcttatgatacttcctattaaatttaataaaattagtaaaaatttccctaccatatatcatattattattttttcgatccaagaaagttactttttaaaatagttttctattttgtgacacttctaaaatattataagtgtatagccatttttccccaaacaaggaatagtctatcagtctatacagtatacacacgatttatttgcaaagaacctacatacacaatttctcttctaccatgttagatttttagtacttgttttactagattatgtatttttgtttgtctatcggtcttttaattttcacttgctggaggtaaataatgaaggaagtagttaaaaattgagataacatagttgtgtagaaattagaatacagtgcagaacttaaaagtatggttacgatcacattgacaacagtcgatattccattgagatcacatgaacattgcttcgttagaaatgctcgtcgatcgcctgaagtaaaccgatttgattggccaccatgttttgcctcttcctgatttcattgatatattttatttttctttactattttaaacaacaaaaaaatttagaatccgtattccaaaagtaaattaaatttttgcatacaatttttctttttctttaaaatatctaggttttaatataatattccataatttgatgaaaagaattaaagagaaagttcaaatcaatccatatagcttgtcctagcctatagccaaaaatattcctatgccgcgattgaacaaccgttttttaaaaatcgtcaaattaaatcaaacctttttccatgacaatgagacttggatatagtttacattagattctgattggcccctttgatataactaggtaaactagcttcttgaataaactgtctcttattttggttttatacaaaaaaaaaaaagcttttggaaaatgatttaaatgtaaatacataatacgtagcgtctaagaagcatatttgagaaaatatggatttatttatctggtatttatccattaatttacctacaaatggaatccaccattaaccaaaaacaaacaaacaaatggaatcccgtgaaataaagtatcatcatatacatatctctcttttatgtttttatggagagaattagtccaatccttcttcactgaatttaccacctgcttctcgtagaatatataaaactacccttaagtctttttctaatgactatgagttgacaaatgagaaaaacaaaaactgcttttgttggtcattaaatattccgtctagatggagttagtgctttcattgtcatattctttgtctcccatcaaattaaagctcactatacagcagattgtacaacactatacactaaagttacatttttgagattttattgattgacaatttcgtttcgatattcttagatacactaaactcaaatattgattttatgggaagagaataaaaaatggattgtgaaaaaggaaaaaaaaaaacctaaatttgggccatatgtgaagaatacttccttaagtttgggccatagtttaaatcaataggcccattagtctatctaacgattctttctcaactcttaaaaatctgaccggcggagatggctctgagttggaccagtcggaggattagggtttcaacggagactcactagtcgatctccgatcctttcttctacccgcccgaaatccgtcgaaacttctcttctttaccattgatttgcctcgtctcagctcaattctcttccgttgctgcttcgtttaggttcgcattatcgcttactttattgaatttttcctctatgtctctggtttcaatttcagctcaattttgtctttttttcggttgaattttctcttgggtggtatcgaattttgctcatgaatgctgtttcttgatgaatcagagccctcttagtttacttcacgtcgttcaattcaaaacttggtgtggtcttttgcaacacaaatcaggaatagttcgttacttagaaacaataatgtcatacgagaagacaaatctggaacagagaattagtaaattgagctggaaagtttcagtagtcaaaattctcgtaaaacttattttggtataattgtgtcatgagtcatgacattctttcttaggtttcgtacaagtttctaatttgaggtagatactagttcagaggttctttattaatgtttgattttgaaaacctttctttacttacagttgttgcttcgcttcagtactctggtggtgggagagatg

SEQ ID NO: 16522 - DNA, 3000 bp, Unknown; identical to SEQ ID NO: 16521
  misc_feature (1)..( 3000): 2750-1469P.txt file - cDNA_ID_1459029; gDNA_ID_2926200; Annot_ID_201797

SEQ ID NO: 16523 - DNA, 3003 bp, Unknown
  misc_feature (1)..( 3003): 2750-1469P.txt file - cDNA_ID_1461791; gDNA_ID_2213667; Annot_ID_182144
attcataaccccttccatttggtgtggtgaaaacctctgaatacttgtatttggatactgaatacttctgcctagcatgtcttggtgttgtagaagcgtatttttccaatttgtatcggatccatgaaggccatccatacgttgccctaactgttgctgcggaaccccatcaggacccatatgtgaaacccttgttcgcttattcaagccaggcatagaagacatttgtccttcttgactttctctctttctatgaaaagatgtaccagggttcatactatcagagccataaggcagcatcgcatctagtccaccaggcgaagcgccagagacactgacagaatttgatccttgatcctgcgtgtttcttgtacttccaattcccatgtacctttgttgctgaggtggtaccaaggccagagaggaatttggtgcatcttgcaacggctgacttcttaatcccgccagcatattagtaccaaggttttgaatagcctggttgttattggtttgctgcattatcaaatgccctggcaaatttcctcgctctgaactttcaggaagccgatcaatgcacacctttttcccctgaatcttattctgagacatgactgtcacttctgccatttgccttaatctctttctccgcaaagtagaaagcgacaaatcgagctatcgagtagagaaaaaaaaacattttagacactataataaacaactgagaacagaaagcacaaggagtctttttaatgagatattaccttagcagtcaaaggatttttactcagcctatcaagtctgggtaaaggatccagacagagttcaggttgtaaggcttttaatatcctggactccacttcctgcagttgatgtaaggatcagtacagaagataatagtttcagtgctcagatatacgacctataagccacgagctaccatgattaccatgagatcaccgtacgtccatgagttgtctgacattgatggaatatcttttaccacattctcgagtgacatcttaaggcgcaatttatttatcacaggagagacttgagatgaggtatgtttccgatagtcatgcacctacaatagtatgtgccaaaaattaaagaaaacatgatgatgtaagatggtacacagcagtcaattaaaaattagtataactaggttttttatgtttacttctggtcccagttactccattatgtttcagaaacaatcaaatacatgtacaattgagtttggaagataaacttccatgtacttataattacgacatttttttaatcttgattaagtgtagataatttctgttgagctctttttaaatatatttatatacgtttggactgtttccaagaacttatggaaggctttatcccaaaaaataattgcagataactcacctcacatataaccaccccatccacaaatttgcaaggtatatcttccaaaatgtccccaggaagcctgccagcctcaatagcctataaagcgtacaaagggattaaaaacatttactcagtagaatgaaactcagaaagtgtatttaacaaaacgcgagtaagtagtgcagtgaaatgcattattcgggtagaacaagtggggaaaaaaaacatcatcttcacatttactaaatctaagtactttgaattcattcaccaaaactttgattacatgttcaaatcaagtctataataacatagttcgaaagatttaccgaaaggagaccctctgctgccctatcatacggatgtaagacctttggaacatctcgaaacgatatctgttgcatagcctggtattcaaaaactcaaatttgtgaaaacgtgaaggttttaaaactcaaatacaagaaatcacaagataaataaattcatatagactctcagtacatacctcagaggtttttcctatagagtacccatttggatagaggctcaatatgaaggaaacttcatgatctgcagagaaaccaaaatgcactcaattcaacatagctagaatttagcaaaacattatgtgtcaaagtggttcgttgagatccaaacctggagatatatcgggtaaagatggcttcgaaaacccggaaacatcgccaatattgctatcatcagtggcctgaaccaaacgtaataaattttctatataactttccaaaataagcgaatttagttggaacacaatacaactaaaattctaagttaaattacctttggtttcccagatagaacgattgcttttggggaatcaggagtagccaattcagtagaaatcttaggtcgaaactttctaccaaccttcgatatcttaaacgagacacccatggattctctccagagagatgaagctcaaacctgtctaggtactgtcaataaacgatacagaaataaaaaagacacgagaattgaagaaatcgaagaatgaattttaagaaagctagagaaattgaaaccttatgagcttgttacagagaagatcatcaaacaattggatcggatagaaagcgagagaaatcaaaggtgactaagaatagagcaatgaagaattcataaacatggaatttgtgaaacacaggtgggaaatttttgaagaagatgcgatcggaagagaaaggaagagagattattgttagggttcttcttctaacttcaaagtagcagaaaaagaaattatcttttgtgtctctgtgcacacttggatttcggtttaagacaaaacggaagttgaaccagttattaattttggttagcttcgattaaaatttgggtaaccgagtttgggggtagaatagacattttgcaaattagggttttgcttgatatataaaatccttcacccttataagcctttcgtcgcctcttcgtgtgatttactgagtgaaaaaagcttatcgcggcgattagttcccggcgaagaagaagaagagagataagaaaatggcgactaatggatctgctagctcagcgcagctctctcagaaggaagctgatgtcaggatg

SEQ ID NO: 16524 - DNA, 245 bp, Unknown; identical to SEQ ID NO: 372
  misc_feature (1)..( 245): 2750-1469P.txt file - cDNA_ID_1471083; gDNA_ID_1564444; Annot_ID_149466

SEQ ID NO: 16525 - DNA, 3000 bp, Unknown; identical to SEQ ID NO: 1001
  misc_feature (1)..( 3000): 2750-1469P.txt file - cDNA_ID_1471148; gDNA_ID_1620346; Annot_ID_154162

SEQ ID NO: 16526 - DNA, 3003 bp, Unknown
  misc_feature (1)..( 3003): 2750-1469P.txt file - cDNA_ID_1472778; gDNA_ID_2936573; Annot_ID_194820
gcataaatcagctggatcaaagaaatacctttttggtgaatacataagttttttttccgcagaccacttaggcacttatgatggcctaacatagaaactacacatgctgatcagtgatcaaagacaagatccatagattctccacgtgaagtttcttggccacagtgaagcaacgccctcgattattcaaaacacattgtcccaatgcttatacattgacaaagtccactatgatccccaaatttggaggccaaacaaaattgattatcactgtttgttgtgttaagtttcccaaaaaagagaaatgtgaatgaagagaatgagaattgtttgaatagccaaggagactgcctgacgaccaaccaactctaagactatcgatcgagtgagtctttgatatatatggtctaaaacgcaggcaagtcatccttggctaccacacaagttctcattcttcatgtcaccattttctcttatatgatttatgtatttatgaagaggttgttgatgagtatcccacaagactactatgtgtgttatataggcatgaccgtacgaagatggagtggacacaataagtttgactcaacatgtgttcatggccttggaatatgttcttaaagatttggatatggtcttagtatcaaacacacttggtgaaccttattacaataatatttgtatttagtctttatgtatattactgttaatttttagttagaagaatgttttcttattttatttcgttgtaagagacgtaagcttcaatttttctttaaaaaatgtaataaccttcgtgtgttattgaagtttctctaatttttggtagaatgcatgaaattaaattcaaaactcatatattttcgggtattcttaagaccgacatactagcatatcacacattaatatactaaattgttatttttttctactcttcttccacaagttttttttaatcactcaaatggcacgaaatatgctttgaaacctaatcatctctatcgggtcaatacccttttcttactagttgactactagtgtttgggaccatataggaaagaacatttataaaagtcatgatgccatatgaatttgtgtagtaaacatggaatatattgagctttttgtggatatatttatatgaaaatataacttctggaatgattcttttatctatccacgagagatgttgggaacgaaagctgctgcccatttatataggataatgttttttccctctccgacttttgcatatagggcattatggcttatctgagtaatacgagaacaacaagttagcaacaccatcggtcaattatttagctactacactatttacaccggtaaaaggatgttgtttttgtggtatagtagagtctttataggtatagtcactatgaatgttgcagtcgtctagttgttttaccgcactgattgagataaatcgatcgattattgttgtacacatacgtcaatcaggagagattcaaatgtttaatgggtgacaagtctatacttgtcccatgaaatccaattaccaaagattgatagtccaaaaagtactaaacaaaacccaaaaggtcgatgatatacacttgatggttttagtaatcgaatattcgtgctcagtccagaccgaaccttttacatatggacgacgattctctatggatttgttttagccacatgcttataacaatattcgcacatttgagggtttgagccaatgttgggtcaaacatgttgggctctttaaactccttatctgcccaaacatgttgggctgaaccttttctgagtaactctagcccgttaggtcattataattatagaaaaataaaaagcaaggccactataaactaaaccctagtccgtcatctcttcgctatataaactctttagacaatccagcatccaaaacctcctagatcgctcatagttctcctagatcgctcatagttctttcatcaatttgttcggaagtgattgctttatgtttatcattgttttgtacttgatagattttaagaaattaggggtttatgattggcaaatgatgagtagaatcttatcctacacacagatgtatcagtgttgactaccaatctctgcttattatctgatgccatattctaaaccctgttttcaaaagtttttacagttaatccgttcgttttcaattttgttccagcgtttttttttaaaaaggatcttctgggtaaatgttggtttttaaaataagttcttaattgtaattctctttttattcctgtgaaaatgagaagaaaattagaacaacctaatgaagaaacaatgatgagatacttgcagacgggcggtctgaaattgatgtcgtgttgattgtctgccataagctacataagcattctctgagtttctcattcactcgtgaacacatctgttatgtcttaaactgttgagattgtaatgaaccagtgaattagttaactatacaaagagtagacacatacatctttggacaggtgtaacctcttttaatatgaagaacggctacattgaaaaggatgaactgaagtaaccgtaagccaaaacatccaatgataataagacttttgttctggttattaattagtcttataatcaataattctacagttctttaattttcgtttccaagttccaaagttttaaatcattagactttggtcagactataaaacgtgttcaaggcttgtgtttgtcttttatataaacgtaaagactgtttggacatgaagacttatttatccaccgtctggattatctacacacctaaaaaaatgatagcaatcgcagccataataagagagaacgcgttagtaaaagtcaacacgaagtcaactcctttgtggcttttagcccatcccacttggcgctatttaagtaaaatcccagtattaccaacttcaaaaaagtctctctttcacattgatcctgtgttttataaaaccgaattttgattcagagatcagctcaaaaatg

SEQ ID NO: 16527 - DNA, 3003 bp, Unknown
  misc_feature (1)..( 3003): 2750-1469P.txt file - cDNA_ID_1473029; gDNA_ID_1621126; Annot_ID_56354
ataaagtaaaacttgttcttttaggcaatatattatctctatctaattgattaacgatggccgcagatatgtaaacacacatttttagagatggctataaatgatttcctgaggcatttatttttgatagcttagtttttacaacttctgtttaccgacactattaagttaggtatcaaattatttaaacatagtaaaagtacaaacctgtattggtagtgacaagtgacaacacattacacattatacatcacaccaaactcaatatgcctcctaatacaagagtacatacagctatagctttaaaagtgcttatattatatgtaagagggccagataaatatttgggccaaagtaagaatgataggcctataattcgggtccaggtgactaacaccattcagaaatagtcatgccccattcatcatcgaaaggtatttgaagtcaagtgagagtttatgctgatgaatggggcatgaattgaaacatcaagcccaagaaaaagtactggttgtgaaaattagcaattttggttgttttaaatctaatagcccattacatgaaaatttgtagtgtcgctaaagttatctttggtttgggttgttttaaatctaatagtccattacatgaatgagaggtgcaacttgcaagccctattaacggctagtcatgaaattacaacattaccataaatttatgctatcctgatctgaatttatatagtctaattttcgaagcgaaacagatttcaggtcttggataataatttcatcactacttcgttcatacattagtttagatccaaaagatatacaaaatttatataattagtagaactgttgacaaataattattaaaagtaataaatggtctgttatagaaatttgattttaacttttgttatattagtgaatttactttaaatagtagaacaagttataataaatatgaaagcatataaaaagaataaaatctcatgagattatcttctagcatagttttagtgttttctcataatgtcaataaatatttacaggtcttattatgatttttactaaataaacagcagaaacaaataaaaagaaaaaacatggaagaagaagaagaagaagaagtccagcttcactcacctttcgctttctctatcccataacagaaacccccacattgctcgaacggtcgtcataattccttgaaacctcgaaaatccaaaaacccatatccaatcttcttcccatataaattaagatttttatttatttatttgtttacttatttcaattcccaaaatcctctgcctcatcatcttcaaactgttaccacgtccatagggttgtcgaagagctaggaagagccttaccaagagcttcttcttcccctaacatttaggtatttcattcgtaatttatcttctttttaatttaattattgtcgattaccaaaacccttttttatactaaaaaactgaatccatttttccacactaaaaggagaacacaaaaacttcatttcaagttcatgtttgaaaaactaagaagtgtatggtttgtttgttgacaattaatgagcatttttttcccaaaatacgttagaacttaatatgatagaataaaacttgaattattcatggcaatgagtatagtcatatacaataatggttgatggaaatgaaccttacggtccaatgaaaagccagcttgcgttacttgagcatttttaagccccaaaaaagtttgaaaatatgtataaaggaatattttatatatggaactaaagagtcagagaaccattccggatttagatcatccatctattttaatttgttgtgattcagccatcgcattattagtcttcagaatataataaaattataattcagttatgaatttaataaattgaatgccgacgtgagtagttaataatgtagtcgattgtaagtaacaatgagaaaactcctatactttatttttagatgtatttgtaataataagattacgggtttggactggacaggttggtaggagaagcaaaggaagagatcatttataatggctcctgcattcggaaaatgtttcatgttctgctgcgctaaaacctccccggtaagtcccagcaacaactcaaatttgcttatgagaaaaatactcaagctatttttgaaacttcgagaggattattagattatagtatgtatataaagtgacgaaatgtatatagagaaagtaataattaagtaaactggtgacgcgtagatgccaactggcaagtccgttaaaaacatgaccgtgtcagcctgtaaggcttgccttggttgacttatcctgctttgtcattggccaccggcctatcggaaaagacgcagaccaatttgccttcaccaaaataaaaattactacttactaccatatgctttttgccctgcgtttacttttcaagtcgagatcatttatttggtcaaatgaggtagaaaaaaactattctagtcaatgtagacattcgaatgaaatttgcatttataaaaaaaatgtacttggaaattcaaatgggtttataatttcattttaatcagtaccgagacatacagccacatgcttaattattcctcctcaatcaaaaccatttcaccccaaaattttaaaatagttttatcaaatcaccatcccacaaaaagattttttaatataatataaaccttcccatttttgtggagtttcttttttttttcccttgtaaaaaagaaaatgtaagagtagaaccaaatggcataatagagctctaggcctataaataccaatatccatctctactactactgcattaactgatttcacattcttcgataaggattttactctccagagaaagaaaaaaaaaacctcctctgcttttgtgatcctttaaggtttctctcatcagatccaattttcatgtttcaacatcgtcaaatttcaccgattaaaattacttgttgttgtttgtattcattaggaaaaagacgaaatg

SEQ ID NO: 16528 - DNA, 3003 bp, Unknown
  misc_feature (1)..( 3003): 2750-1469P.txt file - cDNA_ID_1481372; gDNA_ID_1971851; Annot_ID_176385
ggaagtcaattcgagtatatttaaaacctgataatagatttgacgaatcaccctacaagcaggcaaattgatgtctccgacgatcggaaacagagcacaggagaggacacgtggaagactgacgttcagtggcgggtttctatttttttcaaaagcgcgcgaagaagataagaaagggacaaaggcagaccaagtatgaaccaagaaagtttgcaattcgaccctttaatttctgaatatatttaattcacccttaattctcttaaaaagatttcaaaagaccttttcaaatctaggacttgccattttaaacggaaaattgtcatttaatagtctaattttcgattgacaaaaaaagaaagaaaaaaaacaaacaaacagttattaagctttaacagattttctaacatttttaacgattctcttagtcaaaccaaaacgatgtcatttaagctctaatcgattaaaaattagatctaatgcaggtctcgttacgtatattatacaaaaaaaaaaattagtgttatcgttgacatatgtgatagtgagtattttcaatattttagactcaatgtgtgtctcgttacgtatactatataataaaattcgattttattgatgctaatgacagatgtgattttcaatattggagaatcattttattgtaaatatgttgactgaaagttatttgatctatttactcatctacatatacatttttgcagcacttttatgaaataaatcctcaagttgagatttatttaccatccaatgccattagcatttaatattttaacaaatttcttctcaaatccaaatataaatcaattttgttactaaaatttagaattaaaataaatatatcacaacaatcatttaaatctttccaaatctaaaatgtactacacactaatattcttttttaaagagatctattagcattaatggtatattattattgatatattttaactttataaaacattattaatatttatccttataaaaagatattaaaatattatgagacgagttatatagtgggacgggtttgcattgatataacgcgggttaaatctttatttattattctatcatcactaattttttttttacaatattaatataaaattatataattttaatactaaaaatttaaaaccttaaaatttaagattattatatatataaataaaatatttgctccgtggtataccacgggttaaatcctagttccaatataaaattgcatagtgatgttttctttaaaaataaatacaaataacataaataaataaaataaaataaagttacatgtttgagcctctcattttcccttcagtgctataaattcagactccttcgctaaataaatcacaaagcggaaaaaagaaagaagaattgagagatatctagtgttttaaaaaaaaaagaactgagaaatcagcaatggggagcttaagagtgagcacatttgctgttgcagtagttgtatgtctctccatcctcctcatgtctcctacaggtacgtaaatttagttaaaagaagatttagaataaatacatgttaatgaaatgttgcatctttctatatatggactggacacaagtagatgggcgtagagtgtgtgacagcgcagcgggtttatgtagtatgttgttctcttgcaatacacaatgcaattcattgggccgcaattttactggaggcgaatgctcagatgctcgttttcctggtttaagtgtctgttattgctgccataatgtagagagcagtgctgaaatggaaagcatgtgattgcagatgctagaaaacgacgtcgctttgtgtgtgtgagtgtgtgtgttttgctatttgcatgtttatgctttcatttcatcacatcatatgttttgagtgttttgccttgtactctgttgtgcttctgtttgttttgcgttgtcaagtctccaataaagttggagtgtttccgttgacaaacgtttttgttagttcttgttgtatttagctaaccaatgtttttagatttttttttctctttttctttgtgttaaacactaatgtacatgtttttgttttcataaagtttgatgcatattagttaaaaaggggttacttgtttgaacatacaacaaaagttaaaaaggttactagtaagctaactaaagtcttacaaatgtccactctagaaacaaaacccacaaattcacaaaagacggttagaagcccaactagtagagaccaaaaaggtagtaagccccacaggagtaataagccctgtcaagatgaagggagtgacgaggaaacagatagctaagggtcacttgttcatcgaagattttaatcgtggttgaatcaggttgacccaatgatctggtgatttagaagatagtccaacttaacgctcgaatcaggtttaaaaatattggtttatgtagtattttcttgaatcccatatagtatttttacttttggtaaataaatgtattattgaaatatttaacatgagggtctcgttacatatattatataataaaaatattttattgatgctatcgacatgtgatggtgagtatattacattattttagatcaaatgcaggtctcgttacatatattatataataaaaatattttattgatgctatcgacatacagttagtgagtatatttcaatactatagaccaaataataggtaggtgagtggatgcctggattagtggaaatattttaacaattattattctcttacgcgtggaaagttttaaattactaaaaaaggtaaacttggataatcattttattgtaaagatattgacaatttgacataaagtattttgatctatgtacccattccaatatataaaattgcatagtggttttttcttacaaaaaaaaaagagtaacatctagatgccctttcccttggagtgctataaattcagactccttccctaaataaatcacaaagcgagaaagaaagacgaactgatcagcaatg

SEQ ID NO: 16529 - DNA, 3003 bp, Unknown; identical to SEQ ID NO: 16528
  misc_feature (1)..( 3003): 2750-1469P.txt file - cDNA_ID_1481372; gDNA_ID_2926179; Annot_ID_200105

SEQ ID NO: 16530 - DNA, 3003 bp, Unknown
  misc_feature (1)..( 3003): 2750-1469P.txt file - cDNA_ID_1481655; gDNA_ID_1620780; Annot_ID_167915
gtaattaatgaaactaacatattttcctgagttgtttatatttacatttgcgtttccattcacatacttattttagaccacaaaatgctatgttttgcgtatatatattaactagtaaccacaaaagcacttaagacaactatttgctttgcaaaaactctgcactatagataaaaatttatttgttgcgaacaaaccttaattaataaaatcttgatgagcaagtgaaagaagaaaagaagaataccttttcgtcgatgtaagcagcccagaaccgagccatggcccgatcgtaaggatcggaagggagaatggacggtccagatgagctccaagtgtcatcgatatactcaacgatgatgttggactcactcaccggtttatcagcatgaagcagaaccgggatcttcttgtgaaccgggtttgatttaagaagcaactcgctcttagacccaaacgtctcttggaggaactcgtaggggacagacttgaggtttagagcaatcctcggcctcatcacaaagggactcgcccatgcaccgatcagcttcacgtcgctgcttgccattttctcttcaaaatccaaaacagaggattggtgcgtctgaatgtgagagtggaaatgtaatgttttgacacgttgaagcgtttttatgttagatcggtgtattgttacttattatatggaagggaagagggtaggtgaatttgatggcggtgatagatagcgaagaattgccaattataggttgacacgtgtattaaacgggtgggaaaacgttattagtctttattgtggtcgacgagacggcatttctttatatgcgtggcaacaattgaaaccataaaaactccggcagcttcacttagcttgtttaaatttgtatttcatgtttaagaaatttgtatatattattagtactataagttaatatctttgttttaacgagtaacgatgtgatgtttatttgggtttgtttttggcagctaatcaagtgatataaaaccaaagaagtgaaaccactaaatgataattacatatcagggaagacaaacacaaatccacctaaaaaacaaacatgtcatgcatcacaggaccacacgaaatgtgaacattgaattgcagtcacgaaaaaccgcaaaaaaaatattcgtctcagttttgttttgtttgttttcatacgctcattgtttccactcacattttcttaacattaataaaatggtataagtacggctatcatttaaatgtacaaatggattacatgtcggcccctagcgggaaaaaatacaggcccaaaatgatttgaaacttccttgataaagaaaaaacaaacaagatgagaacacttcataagaaagaggtcatacatatcttttagtcattttatcagtatgaaaatgtggtaattagttaagttgttgattctttcaaatcctgagatatactatgattttgaaattatgagttttatgtgacttcagattctggaatattgctgtaaagtttgggtggatgtataatcccttttttatgttcctttcatttctcactagcccattcttataattcaagttttattttcttgatttccaaacacgcaagattgacataattatacaaagttactcttattatatgttatatattccaatgttacattccgaggatggtgtcgctagttattcaagttttacaactttgtttattttggaattagtaatgtgttacaacttacaaaacaaaaatagaatcaattattttgtctcattgcagaatttatttgccggtcgcatctcttttaattattttttctttcttatttttataagagaagcgtcttttcttttgtgtcaacattttaaataaacaccaattatcttatatatacatataaaaagataaattgatcggcttccagaacaatctcatgagaagaataccaattagaataatacctttgcaagatgcattatatattcactagttataattacagatttacattattatacaatgaattaaaaacaaattaaagttgagaattattgaacaactttagcctttaggtttctttactatattctcttgaatctaattcccttatcttgcccgtttccttggttgggtggggacttttagtatgagtgggcacttaacattagtgatgtttttgcaatattattttgtcttctaggccttatttcctggtgagtttgggacacctaaaggcacattttgtctaaataatatactgtgttaaataaacttttatatgcccatacttttcattttgtttataaattttatcattcttatcacttattactcaaagagcctactacaccatcaatttcacaaactttggtcgaataatattctagttaaagaagattgttacaagaacacgcgagtgagaaatattatatccgatccagatcaaaagattactcaaagagccaacataactatctttatccaaatttgcaataacaatatgtagcttaatgggacatttgcattgcccaaactttgaatgccataaactaatataatattaccaattatatgttgtattaattttatataaatcatctccagatatatttttcccaataaaattgttcgtgtatataatcaagcctattattatatgatatatggaattctaatgttatgtgttgtatattattttctatgtttggttttgcacattatctaatgttgtaatccgtcatatgatggtatgtatagataatagacccaaccaaaagaatctaggatttaacaacaacaaaaaaagtaaaaaactatatataaactaatttatattcttatattgacaaaaataaacgcctatgttttgcatataaatgtacattcacatatgcaatttagtatcccgcttagcattgcatctatattaggttacattcactcacacaattcatatatacttcacatcttttctttcacactttccctgaaaggtctagcaaatg

SEQ ID NO: 16531 - DNA, 2046 bp, Unknown
  misc_feature (1)..( 2046): 2750-1469P.txt file - cDNA_ID_1481655; gDNA_ID_2288; Annot_ID_145616
  misc_feature (1801)..(1801): n is a, c, g, or t
  misc_feature (1807)..(1807): n is a, c, g, or t
atcatttaaatgtacaaatggattacatgtcggcccctagcgggaaaaaatacaggcccaaaatgatttaaaacttccttgataaagaaaaaacaaacaagatgagaacacttcataagaaagaggtcatacatatcttttagtcattttatcagtatgaaaatgtggtaattagttaagttgttgattctttcaaatcctgagatatactatgattttgaaattatgagttttatgtgacttcagattctggaatattgctgtaaagtttgggtggatgtataatccctttttttatgttcctttcatttctcactagcccattcttataattcaagttttattttcttgatttccaaacacgcaagattgacataattatacaaagttactcttattatatgttatatattccaatgttacattccgaggatggtgtcgctagttattcaagttttacaactttgtttattttggaattagtaatgtgttacaacttacaaaacaaaaatagaatcaattattttgtctcattgcagaatttatttgccggtcgcatctcttttaattattttttctttcttatttttataagagaagcgtcttttcttttgtgtcaacattttaaataaacaccaattatcttatatatacatataaaaagataaattgatcggcttccagaacaatctcatgagaagaataccaattagaataatacctttgcaagatgcattatatattcactagttataactacagatttacattattatacaatgaattaaaaacaaattaaagttgagaattattgaacaactttagcctttaggtttctttactatattctcttgaatctaattcccttatcttgcccgtttccttggttgggtggggactttttagtatgagtgggcacttaacattagtgatgtttttgcaatattattttgtcttctaggccttatttcctggtgagtttgggacacctaaaggcacattttgtctaaataatatactgtgttaaataaacttttatatgcccatacttttcattttgtttataaattttatcattcttatcacttattactcaaagagcctactacaccatcaatttcacaaactttggtcgaataatattctagttaaagaagattgttacaagaacacgcgagtgagaaatattatatccgatccagatcaaaagattactcaaagagccaacataactatctttatccaaatttgcaataacaatatgtagcttaatgggacatttgcattgcccaaactttgaatgccataaactaatataatattaccaattatatgttgtattaattttatataaatcatctccagatatatttttcccaataaaattgttcgtgtatataatcaagcctattattatatgatatatggaattcgaatgttatgtgttgtatattattttctatgtttggttttgcacattatctaatgttgtaatccgtcatatgatggtatgtatagataatagacccaaccaaaagaatctaggatttaacaacaacaaaaaaagtaaaaaactatatataaactaatttatattcttatattgacaaaaataaacgcctatgttttgcatataaatgtacattcacatatgcaatttagtatcccgcttagcattgcatctatattaggttacattcactcacacaattcatatatacttcgcatcttttctttcacactttccctgaaaggtctagcaaatgagtttgaagcgttcttcttcttctttctttatctntctctntttccttcttcttcctctcttctcatgtctcctcacaagcctgccaaaaaacatgcggccaaataccaatcaagtacccgctcggaaccgggtcaggttgcggtgacccacgtttcacacgttacatcacgtgtgaccctgaccaacagactttgacgctcaccacccacacaggcagttaccctatcacttctgtcgactacgccaaacaagagatctacgtcactgatccgtccatg

SEQ ID NO: 16532 - DNA, 3003 bp, Unknown
  misc_feature (1)..( 3003): 2750-1469P.txt file - cDNA_ID_1532708; gDNA_ID_1620544; Annot_ID_160125
gttgaagtttagatatgatgtatcatgtttacacttatataatgttagtctaaaaaataaaataaaaaaataataattatcactatataagttattgccattctgtctaaattttaacaggtcagtgaattaaattaatattattaacaataagatatgttatcatgtattatcaataagaaatctactaagacatgttatcatgtgcgtaggagttttggcccaataaatgcttgtgcactccaagaacatcacaaaggatgagaatgagatgcattcttgctcttcgatttcttaataaatgtataatattgacttttcttggttcaaaagtttgtttttatctgttgcatcttgagtaggaagagatatttttgctatcttggatccacctaccaatcttgtttctgaccattctttctattcgtttgcaatttggttgctgctaagttggatcaaaacggctttattccatagtttcaaatgcctagtgctactggcaagataaagcgaaggaaagtacgcagagcttagagcttagatcttttcttagttttgtttacttacctatgatggagttttataggagtacgaataacgcatgcaagaaaactgaaccccttatagatataaagatgtacctttaaaaaataaaaataaaagatgtaccttgacacatagactaattggaaaacttacaaaaggcgtttttttctgtgtttttttgattaaaaccacaataccgtaccaatcacaatacttttaactgatttgtgtttttcgaaaaaaaaaaagtttgcgatttaatttgtcaaatgaacaatacattggaacgctttccaaaagaagaaaaactctttacctagcggttttaagtaaaagtgcattccaacaaagagatcaattaattttttaacagctgtttatattattatttttgtgccaatgttgatttcaataatagaggaaactaaaccggataaaccgggtacaaagaaagagataaagaccagtcttagctagtttgttttatttaattaaaaactatgaaaatgcaattacaggaaatagaaacataacaatgcttttagaaattttgacaattattatctactataagcttatatacgttctataatcaatttacttgtaaaaaaattacttgtaaaaatgattttttttttaattttccataatgaaactattcaacggatttaataatatgtatgttaaactttaaaatgtatattttgatttatttgtgtatatggtttataaatatatgttattgtttatttattaacacaaaaaataaataatgattaatatatatatttatatatatataatctataatccgcaccacaaatagatttttcaccaatcaaacattattccgtactgcttattttgtacaaaccacaattgtcccacaaatatatttttcacgcacttaccgcagttaattcgtactgcacggtcataatactttctccgtacactaaaaaccgcggtgaccattcagatccatagaaatcatccatcgtaactgtaacgagacgacgaccaccacttttcatggaccaaacgttttttctcggtatatgggccaatctcgtctgacagttcatttttctggaagcttaaatatttgtttactgattctataattcaccatataatctttttcttgtgtttgttttcactcatacgaactaacaatcgattcacggttaatcacccatcataagtttgctttactttaaatgcgcttaactttagagttttctttagatttttaatcaaaaaaaaaaaatagtgcattttaataacatatatgaccaaatcaatttatttaaattttccttatacaccactatatttcaatataagtagtaatatagaagagagaacaattaatttatgcatgtaaatccacacaatttttactaaaataaatagattagatgagattcttgtaattataaaaatcgtgtttactactacgttacaacaatctagacgtaaaattctactctttcttctatcgatgtgttatagattgatcgacaattataacaatcttgaacatacatgatatagagtttaaactctagacgtagaattatatctggacaagtcaggagctaagccacaatgtgttgctctagttatagttatagtacttttcttaagttagaaacctcaattgcttgaaagctcaagctcttgcccattgcccaatatagaactaaaaatggtttcaatggataaagtcatataaaaagctttatattttcttcttatgaaattctaaataattagtttaaggaatggacaaaagcgtcatcagtgatgtgataagatcgtcttatcgcatcaacagaatggatgggaaaccacaagtgaaatgtttctggtcaaattgaaacttggagaatattaaagtttttgaaacagaaagatttaataattatatcaaatctttttaaataaaaataaaaaataattatatcataagaaaatatcttcataataacatcttaataagtatcctattgagttacgcatctttgtaatagaaaccaaatacaaaataaaccaaatcaaaatttataatatttttttggaaccttgatacattatggttggttcaggtctacatcagattgtatatatatacttaattataaaactgacatattattatattttccttcggataatctaattaaaatacattttagaaaataatattttgataccaaacagtgaccaattattggtgaataaaaactataataatatttgttcttcatcttatacaaactagtataagagcttggttgctcaaaccattttctcttctctctgaaaagaaactcaactttttttctttatctttaacatcaaaaaactttttcgatatctttacaaccattaaacaaaaaatttggccactacaagttgaaaaagttttgattatatctaatcgctgaaatg

SEQ ID NO: 16533 - DNA, 3003 bp, Unknown
  misc_feature (1)..( 3003): 2750-1469P.txt file - cDNA_ID_1533012; gDNA_ID_2684104; Annot_ID_190343
attacgaaaatatagggtcgcttattgcaacatatgaaacgtataggaactaaattaaaaaatacaaataaaggtcttctccttcccgtctagatgtagaaatccctaaaacttgctactgttttgcatacggggcttgtacaaataaaaaccacccaattcctacgctttcctctacaaattgtccccttttttttttaacttttatactttcaattcatctttggttctgtagaattcccaggaatcagcattccactgtaagctactggtttctctaattaactgtagatcgatcgaacttttatagattcgggattgtttctcccaatatttctgtagaaattactacaaaaaaaattagattttcagctactctgagtctaccttgaatcgtttgaaatcgaaaaccctttcctttaatttcaaagagtcgcttaattagggtttaggatagatggagaagaagaaggtgacgattccacaagtgtgtcatggccattcaagacctgttgttgatttgttctacagtccaattactcctgacggtttcttcctcatcagcgctagcaaaggtgataatacttttggtttcttacaaaagtttggatttttttggtcaatttagttactagaactgtgcaaaaattcatgttgatcgaattgagaacttacaaaagtctttgagttttctctgagtaatacttatttcgtagttcatagagttttgagaatactcatgtcttgatggtttagattcgcatccaatgttgagaaatggggaaactggagactggattggtacatttgaagggcataaaggtgcagtttggagttcttgtctggataacaatgcattacgtgctgcatctgcttctgccgatttttcagcgtatgtgtttaattttttttggttcattaagtcattatttgcgtatgttttatgttcttagatacagcacatttatccaattttttgttatcttgttttgttcagcaaactttgggatgcgttaacaggggatgtgctgcattcttttgagcacaagcatattgtccgagcatgcgccttctcagaggttcgttcaacctatttactctctccatatagattctcgatttggtcaactggggttttgtaagatggtaggctaaaagaattggaattatctactgaaatactttaatcctgttttgtctttataggcataagcttttgtatctctgtgttttggattatcggttgtgggcaggttgttatgtaatagctcttattcaggcaactgcacggaatttaagtaaaaagctttgaggatttgtttaattaggtgatagtgaaattgttcttcagattggactattcttaaacatttgttgtttgtggatggtgtcgatccgcttttatgcatcgtcactaattgaatgacatttttctttcactaggatacaaaatcgttgctcacaggagggtttgagaaaattcttcgtgtttttgacatgaatcggttggatgcacctcctacagaagttgataaatctcctggttctatcagaaccctcacatggcttcacagtgatcaaacaatattaagttcatgtactgatattggcggtgtaaggtatgaactaaacaagacacagactaaatacacattgtcgcacataaaaaggcatagtttgatagacgttttgtttgcttttccgtctcctctactgctatcttatacaggttatgggatgtgaggagtgggaaaattgtgcaaacgttagaaactaagtctcctgtcaccagtgctgaagtgagccaagatggacggtatataacaactgctgatgggtcaactgttaaattctgggacgctaaccagtaagttctcattctaggaagagaatcaaatattttctaattaccttttgtatcttgctcaaaccccatctttgccccttgctttttcttccaagttttggactagtgaagagttacgacatgccctgcaatattgaatctgcatcgttggagccaaagtctggtgaaaaatttgttgctggtggagaggatatgtgggtccgagtgtttgatttctacactggcgaagagattggtaagtgactttcaaaacatctatgctatcatattccaaatcagacactgtcatattacctttttgtcgtccaagttaaattccagatagcttcaagcttaattggagtttctgactctgttataaactccatgagtgaagagcttaatagatctttgaagcatggttctttaagctcctgcgaggttttggttttctgattgtttcatttgtgtctgaaacttaggatgcaacaagggacatcacggtccagtacactgcgttaggtttactcccactggtttatcctatgcctcgggatctgaagacgggacaatcagaatctggcaaacaacaccagcaaatcccgaagagaacgaaactagctcgaggagagtgaagcatagcgtggatgaagtttcaaagaagattgaaggctttcacatcaacaaagaaggaaaaaccgcagagaaaccatctgatacttaagctaaactgagcgtacaaaaagcctctatatgtcttagttcatgatttgctatgttttgtttccagactgaatgattatacagagaaaacaaacaaagatctccctctcttcttttgaatcaaaacatgggtgttaaaatttaatagttttctttcaagtgtctttttcaatattgaactaaatttagggacgaatttgtgatttatgattatttgactttagattgggcttgggcttttttcgcaggttggggtataagggtaaaatcgtcatttgacagaccgacttgtctctctctatctggggaaaacgtctatcgggagactcctcttcgagctcatcttcttctctctctttttatctttggttgtgcgatctcctttctctttcaatctccaaggattttactgtgagatatttggcgggaaaatg

SEQ ID NO: 16534 - DNA, 3003 bp, Unknown; identical to SEQ ID NO: 16533
  misc_feature (1)..( 3003): 2750-1469P.txt file - cDNA_ID_1533012; gDNA_ID_2684104; Annot_ID_137104

SEQ ID NO: 16535 - DNA, 961 bp, Unknown; identical to SEQ ID NO: 617
  misc_feature (1)..( 961): 2750-1469P.txt file - cDNA_ID_1533420; gDNA_ID_1592380; Annot_ID_152372

SEQ ID NO: 16536 - DNA, 3003 bp, Unknown
  misc_feature (1)..( 3003): 2750-1469P.txt file - cDNA_ID_1533420; gDNA_ID_1972175; Annot_ID_179987
cagcagccggctaataccgattcttgatagttctgtttttggatatttcagattaacttgtgtcttacaagaatacatgtaaacattgataccgtttatagcgaaaaccgttgctttacatcgaacattgtaaaagcctaaagaaaatttattgattaatgtttctgaggattttgaaggtaatgcatggtatatcactcttacaattattttttcttataattattccatttataaccaagtttttttatgatatcaatatagttgattcgttggggataagaaaccaatttcttagagttttatgatttttctactaacctttgtttagctaaaatatttttgctattcaatcatatttcactattcatctaacatatatgtcaaaactcaattatttcatgtaaaacagaagaagaaaaaaaaacactgtttttccacatttctactgttaggttaggtatgggatatatagaatttagggctcatggatttatggtatgaataccagtgtagaattgtacgcactagtcgcaattcgcaaagcagaccaaggcacgtccaacggttagttgaaatagtgtcattttaaaaactgagactttcactatgtggcccttctttatgaccgttagtgatccccaccacaaactccatcattgacgcagctaactccggcacaactccctctataatccaacggtccaaatactctttcacttttctccaaataaagttatatttctaatcacatttctatttctagattagaagacaattgagaaaacgactacaagttcacacttttttattgaatccaacggtccaaagattctttcacaaatactttgaatttacttgaatcaattaatctcacttgctataatgataagatattcacctccctcttataagataacaaaattagattttataaaaagtgcttaaactataaataaagacaaaactagtaactgagaaggcaacggacacttgtagctttatgcaactttaattattccctacatgagaaaaagaccgttgcgataatataaagtcttcgttcacacacaatctcgaagaaaacaacaacagttttgatcactctgtctctcttactctatcttcttcccaagttcttgtcttttgatggccgaaaccctagaaccctccctcgtcggggaaatcgacacttctgcgcctttcgagtccgtgagagaagccgccactcgctttggtggatttggtttctggaaaccttcttcccttaacatctccgaagcttctcaggtcttatttctctccttctccctcaaagtctctgtctttctcactgatttttgtccatttctttgcttttggggttttagttgaaatgggtttttagattcatcaatttctagatagatcttgtctttagttgtttcttgtgattatgatgcgaaatttcgaatctttggttgcagaacgaagttggtatggttttgaaagcgagtgagttagagaaggaactgattgagaaagaaggagaaactttgaaggtgttgaagtcacttgagtcgaccaaagccattgttgaagagctcaaatcaaagatacagaacaaggaggataaagaaaattgtgacatgaatgttttcaaggaattgaaccaagcaaagatgaatctgtgcaagacgacaaaagatttggctgctattcgcgtgtctgttgggttactaaacaagagattggaagaggaaagagctgcacttgagaagacacgagagagactaaactctgagaatgcagctgaaatgtccatggagattcagagactaagttatgaagctaaggaatttagtagaacaggagagaatgttcggtatgcggttaataaagctgtggctgagattgaacaaacgagaaacaagattgaagctgctgagatgcgtttgatcgctgctagaaagatgaaggaagctgctagagcggctgaagcagttgcaatcgctgaaatcaaggcggttacaagaagaggaagaaggagaagaagaggaggaaatggtgaggagactatgcaggaggagattcttgagacgattgatgaaacagcaagagaaatcagaagcagtaggaggacacttgaagaaggtttggccaaaatggaagcagaagaaggaaattggtggtggacagaacagaggaggagatcatcatgttcggctaagttcaagaaccctccttatatgatggatgtaaaaggtctgaatatgatgatgaatggtgatgggacatcatcctcagttgctgtcttgaaaccaacaatgtctattgggcagatacttagtaggaaactacttcttgctgatgagtcagcgatgatgatgaatgggagagtttcgttgggtcagattcttggaaagactaactttggagatagagagaaggaaaaaaggttcaatgggaagaggaagcggttcggattcgcaaacttgtctgtgatgttaaataaagagagtaagaagaagaataagaagaagaagatagctttgaacttaagttgttaaaagagtgattgaaatggtctaatctttacattaggacttgttgtttgtgtgttatctatttgttttcgatgtgtttattggtgtatgctaaatattgaaatgagatgtgatttgttatatctttatgcttattccaaagtccaaactaattgcatattcgaagataatagccacatgtatgagatgacgtggttggataatagcttgtagtgttaaaatacctcatttgacctttcgacattcatacgcaatcgactcattccacggatctgcttactcattgattctcgataaattgttcttctcccacagacaccagattctaccaatcatttgctcgaaaaggtaaaatctttctctacaatttcggttgaatcttttgataactcgatatatctcttgtaaagactcttgcttgaatcttctgatctttttttctttatcaggaatcatg

SEQ ID NO: 16537 - DNA, 3000 bp, Unknown; identical to SEQ ID NO: 14839
  misc_feature (1)..( 3000): 2750-1469P.txt file - cDNA_ID_1533468; gDNA_ID_2684228; Annot_ID_192135

SEQ ID NO: 16538 - DNA, 3000 bp, Unknown; identical to SEQ ID NO: 1383
  misc_feature (1)..( 3000): 2750-1469P.txt file - cDNA_ID_1534189; gDNA_ID_1620395; Annot_ID_155747

SEQ ID NO: 16539 - DNA, 1407 bp, Unknown
  misc_feature (1)..( 1407): 2750-1469P.txt file - cDNA_ID_1534193; gDNA_ID_27606; Annot_ID_146624
  misc_feature (22)..(22): n is a, c, g, or t
  misc_feature (732)..(732): n is a, c, g, or t
acatgtcacacacttaccatanatakataattaagsatactcgcataaacctatatatacagtctaagatttctagctggtccatatgcatgtgatctaatcaaaagccaaactctccttgtctttgctatattaacaatcatttaatccacaccaccagagatttcaatcttccttttgctactctcttttagatcgttcttgtgaaaatcgcttgcaaataacaagcccttcgtccaatctttattagctcgtaagkttcaccccattgctccttttagggttttttttttgttttgtttctctactcacttcatgcatgaaccagatgatgatgcatcggcgtttgtgttttgcattttaattattcaaagatacatacatattacatgtagtatcgtttcatatcttgaatagtatacatgtgtgtggtcctgttgagattgacccacaaatattagagtaaactgsggaattgaaatcaatcatggtggggatttcgsaatctatgtgtgtttctaagatattattgtttcttggaaattaattgttgttgcaccataatataatttatattatatagatagtctaggaaaataactcaagacaaagagtgtgtaacacactccaacctcagtgacttccacccgtcaagcttttcggctacatagcctttatatacgattattttacatatagttacagatatatacagtactgcttgtatatttntggtcttataatactaccttatgtcattatatatagtacatattatacaaagtttcaatcttttcatttataagcatcgttcggtatgtagaaggcgaaacaaacccttaaacctaatatttttttctggtccaaaaactttctctatcaagcttttgcattttttcttttaaaatagtaacagctcctccattgttgggtggtcccataaaaatacatcataaccatcatcagcaacatataatagcgatagccttaagcttaaagatccaagcttttggatataatatctagttacatgtatatatatatgtgtttgtatatttataggtatatagtatattatcgtgtgcgtccgtgtgtaacatcactatcattacccaacatacagcttttggaatttcattggacccaagagccattcgatcccthtcttataattaaatataacgaagcttgtaataggctttggttttggtcccaaatacaaaactttaaggttgtgccttgtttgtctaaggttttcgcaatagcttccaaaaagacacgcttatgtttatatacatttcattttccttcatatcattctcttctctgccacttctccatcttgtttcttactcatttctctaacaattttccaaattaaatacgtttataggatcattgtggatg

SEQ ID NO: 16540 - DNA, 3003 bp, Unknown
  misc_feature (1)..( 3003): 2750-1469P.txt file - cDNA_ID_1534269; gDNA_ID_2214479; Annot_ID_183265
tgtacttggtgttttgacatcacaagggtccattggtaccttgacgttaacggaaccttttacctcccggggacgctgagacgtgatgctgagttcggtcgtgaaatgatatatgacatgtttgtttgtaaatattttatgttttcgattgatgacaaaggagtcagaaaggacacttgaccatcacggaagcgatgacttccgtcggacggtaaaaagtgatggtcgaggtttggtgagaaatctaaaaatgtgacggtgtttgcttgataaatatctttattttggtgattgtattgaatgtatcgttttgatttctgtttatacttatatcggcggtggaataattacacatgacctgaaaagtatgcgtttgtgtttacttttatgttgtagtacttgttgtgtttttcagctatgaaaagtctacatatttcttctgtgtgctaacttattggataaattggatatttttaagagatctaatgtttacacaaacgtatggtgaacaccaatggggatgtttacacacacttatgatttatgactgaaagagatgttaatcgaagtatatactccattgattaatgttaatcaccgaaagagatgttaaacaagcattaatgtttacacttaaatgtgatggaacgaaaacaaagaataagtttaaatttgttgtcatggtctcaatgaaaaaccgaaaacgttgtgctatcaaattactcaaaacgttgagctagctaaacttggcagaaaagtatcgaatgatgctaaaatgcaaaaaaccattaaacccaatgtacggtttatagagttttcatatgccaagtgggacatccacgtggagatcctatgccacttgtcccctctctgtctctttcatgcttcaaacttatttggcttttacgtggattctcacgcccgagtacgtcgattattacaaaactcacataaattaatataaacactttatattttgttttgacctttttaccccttctcattgctcatcaattttcatagatctaataccaaattatcacacatataggagagtcatctaacaattagcacaagtcatgagtgaaagagactaagcatgaatcataatcatctttgacataggtgctcaaaagtaatcaattttttcaactttactattcaactcaataaaagaatttttaatcaacaattcttttcaagatgtatcccttttttttcttgcaactttttctcaactatattaatatttagtatactgctacttagctactcgatgttttgatgtatcattgatcattattgttgactaataattatttgatacaaatattttaccgacatatgtaagaacaatagtgtcaaaattgaagcatctcaagggtattttagaacagatacccaatttatttatttttataatttgtcaccttgtttttcacacacaaatgacaatatgacgtcattttccttattagaataatttttttaacaaaaaaaagaattatttattttcgtctctcttattgcttgctacgctcaacgctgtgcataagcattctctttctgtggacgaaactaaacctgagagaaaaagccagaagaaccaaactcagaccgagagatagagattgagggagagctctagctctgtagaaaagaaggattcattcatcatatccagaaatggctctaaagtttaaccctttggtggcatctcagccttacaaattcccttcctcgactcgtccgccaactccttctttcagatctcccaagttcctctgcctcgcttcttcttctccggctctcagctccggccccaagtcagtctctttctctccatcatcgtctctcttatctactttcgattctctctgtttcatctttgtttactgtgttctgggttttgcttgttcttatcgatattggatctacgttttctcgattttgttcagtgttatttgcttacatttgcttaatctcgagtgtgatttcaataaaagtacgttcttttaatctgggtttataagaatgggccatcctctgttctcaggtgattcattaatgctctttttcattgaatctgatgtttgttgattgttccctattattctcacgtttctctgagattgccccatctatcaaatcgttgcctttaccatatttattctgcatcagattatgtagattgctcgttgattggttgttagttaagattaacactagttatcttctttatggtataatgatctttagattggttaagacttaacagacattgaggaaagcttcttagtcaaagagaaagttttgttttgttttctctggtttagtaatttttaatggtgaaatgtttatccacttgtttcttactcatttgatgagttttctcttttgtattgacaagagattcttgaacgtatcagtttacgtctgtttatctttcttcaaagacattacgttggatatcacgcttcgtggcctttctctatgcatgcgtacttcgtggcttctctctttagtttgcgtccaaaattttcacacttttctgtaatttattattcattctttctctgttttgaagacatttggctctttatcttgtctttgtctgatcagtagtcactacatttgtttctttcacaatctttcttttttgcttcatattgaactgcaagaccaatccatgaatgcaaatataaaatattgtcttacggttaaccatctctaagtgtttgctagtcatgaattgtgaaattgtttcgcttcaaacatagaattagttgatttggaaatgtagacatgaatgcttatctaaatacaataaactgtgttcttgtttcagttgtgtatcagagatgagaccttgactggtaatttcaatggagcataattaaatgctaatgatacttattttctggttaatgcagggaggttgagagtttgaagaaaccatttacgccacccagggaagtgcatgttcaagtcttgcactccatg

SEQ ID NO: 16541 - DNA, 3000 bp, Unknown; identical to SEQ ID NO: 12962
  misc_feature (1)..( 3000): 2750-1469P.txt file - cDNA_ID_1534314; gDNA_ID_2214583; Annot_ID_186552

SEQ ID NO: 16542 - DNA, 3000 bp, Unknown; identical to SEQ ID NO: 8298
  misc_feature (1)..( 3000): 2750-1469P.txt file - cDNA_ID_1534390; gDNA_ID_1971712; Annot_ID_175123

SEQ ID NO: 16543 - DNA, 3000 bp, Unknown; identical to SEQ ID NO: 8298
  misc_feature (1)..( 3000): 2750-1469P.txt file - cDNA_ID_1534390; gDNA_ID_2926199; Annot_ID_141428

SEQ ID NO: 16544 - DNA, 3000 bp, Unknown; identical to SEQ ID NO: 8298
  misc_feature (1)..( 3000): 2750-1469P.txt file - cDNA_ID_1534390; gDNA_ID_2926199; Annot_ID_201714

SEQ ID NO: 16545 - DNA, 3003 bp, Unknown
  misc_feature (1)..( 3003): 2750-1469P.txt file - cDNA_ID_1534466; gDNA_ID_2214534; Annot_ID_185032
atataatctgtttgtgacaaatgctattgaaaaccccactaaattactttgaacatctcacttctctatagtctgaagatggagctgttaatcgttacctaatggaaagtggtgttgttggtttctgcgttaaacccattgagtttggctctacagaaacaaaaaaagtaagtttctttcgcacgctacttctactcattttgactataaatcaaagaagaataaagaaagcattttgaaacttaatacttgttgttcaggttgctttatacatactcgacaagattatgtcgacggatcaggggctttattactgctgcgtcttggctgatcggttttacgttatcgatgagctccttaagaaggtgctcttctatctttctaacatggtcagacctccttcatccttgttcagccttgttactggttgctacgtcaagctctcccagaactccaggttttcttgctaaacctcgtgataatattttgatattgatacaaatgattaggttttgtaaaagcaaacaacagtttgagtttttggtatatgcattagggctcgtaacggaataaggcgatacacgcctttcttgctgtttgacggcaccttttccagattatatgctgtaagatttcaatctcttgtgttttttggaatttgtatggttttggttcatgcagggaatagtaaagcttatgtgtgtcttgtctgttttttttgtaggaggatccagtggctgctaacaatcgaattcagctgcttcagaatctggacaactaaagcaatgaagtactcgagacactgttttcaatgaggcaatgaaaacagaacagcccccacagagtacgggtttagtacgcctacgcgtaaacgctaagtaataatttactaaagacataaaaactctatgaaaagtcttatgttgttgtttggtttaatatcttttggatgactctcgttactctttcaacattgttttctctcttttggaatacatttcaatgcactttgccattttctatctatctttttcaactggttgatagcaatcggatttagctaatttgcttaactatttgcaacttgatgatcttgattgatataaaaaataagttagggtaatgttatttagatgtaaagcttctggaagttgtggttttgagttcctctgagttagtttaagcaactaggacttttagaaaagagacctgaaggtgagagacatttcattgcatggccagggcccagaggaatattgattattaaggggtcttttgagttagccaaacttgcgaaatcattccacatccatagaagtctagtatggggggttttgtttgccatagttgccccattcctattatgagtcagtaccattgccaagcaaaatcagctagaaaccaatccccaactttggatagaataaacattttaaagaatttgtcacattgaattatggatagtatttactactgactgtgaatgttacccgccacatgcctctggagattagtcggaatttggctccggaatcttttggagtaaaatagtcaaaacatgacggagtaaaaaactaaaaaaagcatattaactcaatttacattttcttaattcttatgggttactttacccaaaattgaaccaccgtcaaaatttgagtgcaacagtaaaaatcagagtctcgaatccattgggttctccaattttcgccattgcaaacagctaaaattccaccaaatcccagctcgaatttggaacccagatcgccgaatctcgtatggtggcgttaaaagtccggcgggcacctcacgtaggcctcagccgtttccgcctcttcgcagactcttctgaccttccccaaaggtaaaatcacaatggcccttgattggtttttgcctcatcggctctaaagtttactgctttcccctgagaaaatgagtaaaattactactttttcatatttggtattgttagcaatttgaaagtaggaatgattagtagttggtttagtttctggtgattgagctgctttagcttgattagggaatgagtttgaatctctctgcataaacaagaattttgcattgtttttgactgttgtagtatctccggttatttggcttgataagtaggcaatgatcagtttttgatatctatagttttgaagatcttagagatgttaaagttttggaggctactgttccttgtttaaacaaatttgagtctgaggtctctgacttgtggtgtggttgagcatcctgttttacttcatgtggctgtcgtggtgacaccgaatggcggtgtatgcttatatccttaatctggtttataggattcactctaatgacttcatggaggttgataatgttgtttaggatgacttgtgatcattgcttatttactatttttgcataattgtttatttactactaaggtcatccccatctcttcttcttcctcttctttattggttggttatgtttttataatatagttttccttcacttttaatattgtaggttcagtgaaccttttgttctgtgtctggccagatccaattctatctcctcccactgtccttggaaatcccaatgccaccaccaccaagtagacctttttctatataaattcttctttttattctttaataagtaacccccttcaatttaggctttgtttctaaggcattttctttcctgtaatctgggtttttgtgggtccaacacactctctctctcttgattttaacaacttggcaacttcattcaatttcaagttccaaaacaagagagagagagagagagagagagagagagagagagagagagagagagagagagagagagagagagagagagagagagataaagaatattttattgtgtccatgagttggttaggtgatcctccaattccaattggctatccatctatcctcttcttttatttatactctcagaaacaagaaatcaaaaaggcagcacaataatactgtctaaatg

SEQ ID NO: 16546 - DNA, 3003 bp, Unknown
  misc_feature (1)..( 3003): 2750-1469P.txt file - cDNA_ID_1534667; gDNA_ID_2214704; Annot_ID_136937
atcggattagaatcttacaatttatgtggaccaagcttttactttttctctcgaagaatattattttgttcaagaatcatgctcagatgaagggtgtgggtgtgagatagcccaaagtggtggggaataagcagagagatatgcttattcttctcttgattgacggtatttttcgcagccacgaaaaagagatcaggctgggtttgatggattggatcgtgtgtgtgtcaacaattaaaaaccctattcttgaaacatgtcactatacaacaagatatgattgtctttgtgagattctctcaatctcacttctgatcatgaaggaataataactcctatcggtttcttactttctcttgtgtgccacttccctttcaacaatttgccaagattctttcccatttaccacttgactaaagtaaaccagtgattatgagatcccatgtcagttgaagtaagcttagacctagagtaatatgtataggacatgaattaatttactaacgccaattgattttgtttaaagattaaggaacttatttggtccaagtaagatatgttgtccttcatagaatgagaacaatttgagttggaccaagacaatcatcacctcgaaagataaggattagagttagaaatccatgaaacttaacatagttacaaactcagcatatatttggaattgatcttcttgattcttatattaattatatatatgaccatctgaatatctatgttaaccccctcttccattaccaccaaaaagtgcttcccgtaagatcggagacttgccctatatagaaatatttgttttggtttggtaaaaagctttctagggattataattaatgattgaaaaagggttagtagctaagtgaggttatatggtcactcacacgatgaaaccttgaagaagtggccataaaagataatggcaggctggcgataatggctactacaaactcccttataagccatgcatgatcatagattcatagttactctttctctccgataaatttatatatttatgtttcaaaagctaataatcttttaagcagttttcagaagtgagttgtttagctttaagaatatacaagaatttgaatatttagagggttcattttcggatatggtctaaagaaatgggccgggtatgcattgtctcgacgactatgaccaaactgagaagaaaattgaacgtgcaacctcctagctaagtgacataccaatgacttatagaaatctcatatatgtttaataagtcataacgcaaaaattatttctaacaaaagcaaatgggttgattttggaactatatttaatggcatagaaaacttcttcgaatcagaaaagaatataaaatacgtgtgagttaggatgtcaccatagaaaatctccacaaaagcgtgaactcgattctatatatataacattcaatcattcttactaaaaacatctatatatatatattttaaacagtatggatccattcattctgatctgtaccagattgcaaaaattagtaagatatcacaattaaataaatgaaatacaaattgagttattttggattttcagatgaaaccaccaaacaaatacaagttgacttgaatgttctccaacgctatttttttctctattatattttataactaattaattcattaaatcacatgtccaaatatttaatgatgaaacataaagtaagtaagctagtgacgagagaaggacacctcattctcattacataatgtgacgagattgagctgtcgttttgttgtaaatatatggtcgggggtcaattattcatatgcagttttaggtcatttataaagaccattaaaaacgtctttaatatttcaacaatcttataattcaattattaagaagcatctagatatggattcacattagagttcgtattctttgacagcaaattcacattagacttttgatatatatattgtacatttgtaatatagtatacgaaaatattacttgaaaactgatgttatgtgttgccatgatgccattggtccatgacttttccacacgaaggccaaagcatactcttatattatatgagttgagtcattcttttttccttttgacggcaagttgagtaattcaattctcttgtcacttaccggtgatataagagttaatcttataaatagttttctgaaacttaatatactataacaatgtaaaagtcgtcgctttgttatttgaagtgaaaattaagcaatgttatgatatttttactaattaactcaatatgaaaaacaaaaatcctcttaactaaaacagaaacataaaagacgacttagtttttgctttagatctagactcataactcaaaaaacaatttcattataaacttttgtagatcttacaattttaaaataaaatgtacattaatgttgaaaagcaaaatcttaaattagtgtatactactactttttttttatcaccgtgatagatcattagatccttaacctcaatccctagagcctgcttattgcctttaagcattgtgcaatcactaccaaacacactcaaaactaaataaatataatttataacttatcaaataaaataaatactatcaagtgtgtatgaaatcgatgacaatttatttattaccttattaccatttgtgtcttgaagtacacgttaagctatttttatgtgttataaaggcttcttcgtcaaccaattacgaaatcaagcttttgaagcttctcaacaatggcggctattccttcccacaacaaccttcttaccatcaaccacaaaaactccataaccggttcttcttccctaaataccaatttctcagaaatcaattttcccgccaaattccgagtagctacgagagctttgtccagaaccgacgagtcgtctttatccgccgtgatttctcgcctcgagcgagaaaggcgggaaagacaaggtttattaatcgaggaagcggaaggagctggagaactatggatg

SEQ ID NO: 16547 - DNA, 577 bp, Unknown; identical to SEQ ID NO: 601
  misc_feature (1)..( 577): 2750-1469P.txt file - cDNA_ID_1534688; gDNA_ID_1592240; Annot_ID_152153
  misc_feature (83)..(83): n is a, c, g, or t
  misc_feature (92)..(92): n is a, c, g, or t
  misc_feature (95)..(95): n is a, c, g, or t

SEQ ID NO: 16548 - DNA, 3003 bp, Unknown
  misc_feature (1)..( 3003): 2750-1469P.txt file - cDNA_ID_1537635; gDNA_ID_2213621; Annot_ID_195719
tactccatcttcagagcagaaagcaaccgagggcactcccgggtacatatatataaactaattttctgttttgtttgtgcttccatgggcaagtgaatcttagatgataaaccggtgtttgcttactaatactttgataggagattcttcagctttcttgttttattgcacgtagttgatagtgagatgatatattggtcttgtggaactaaaatatggcgctttatgttgacgttttcttcttttggaaattgtttcaggagtaccactagagtttcgtcaatccggcaactttctagcaactttgctcagtttaataacctgaatgcttcttcccgccagagaaaacctttgacgataaaggtatactaattaagacgtctttcattgactttagtactctatgaaaaatctccatttagttgttttcctcttatcagtttttgttctgtctatattctataggatgctcaagctttaaacgagtggcggtttacaaagctaaaagagtacagagacagaaacattgaagtagaaaatgaagcttttgatcggtacatgagtaatgtgaatttactcgaagaagcattttcatttacatctgttcctgatgaagagagtcatggaacagcagctcctgagcaaaacaaagaggaaaatattgtttcagagcttaaactgaggctgagatcgaactctgcaagaacagagagctttaagaagcggatcgcggagacagtcaaagccggtttggtgaagcttaagagactggatttaggcagttcttcagatgatcaagatgatatcaaaaggcgggtcaaaagaaagaaatgggaagagaaaggttcagctttgaatgaaataatcgataaactgaacaaagcaagaaccgaagaggatctcaaatcttgcttagagatgaaatcaaagctctgtggtcaagtttctcccactgctgcttccgagaagaacaagatctttccgggtgtagtccgaaaagttgagatgagtgaagaagcacttcaaaaaatcgctgagaatctccaatcttttgacaaagttggaatgttgtgaagtcgagaacatcctgtggatgaactgaaaagtttgagtggcaagaaaatttctagatccttcgtgaccacggtattgtacaatgatcaaacatccctcaaaactgatcctgaagactccaaagactcaagagattcttgtaaagtagtgttgagcatcatttagatattagaactcagccatggataaagctgttgattctatctcattggatttttttcactgtgtgttgttgctttgttagatttgaaattgctcattggattacctttgacttaataaatagttggtttggtttggtattggataaccgctcagtctaattagaccggtttgtttttttggaaaaaaatgaatccatccatccataggccactttcaacacgtatatttgaaaacgactaaaaccaaactcttagattctagttttgttttgctgccccaattccactattgatcaaaacatatccaaaagtttttgtggaactaaaaagtaaaaataacgtttagtttgtttccaatttcaaccatatatatcttattcatatatgcatgttgtggttgtctcgtgtgtgtagtattcatttacattatgcaaaccaactggaaacatgttgaatgggttatgggttggtggttgggacttgaggatcaaacaactcaaatgagctcattataagttaagctctcaataatcattaatttatttttgttaccacctaatatttctacgaagggttggtgtaacaatttttaattgtaagataattgtgtaatcattttcaatattaatttttattatgtatttattttaaaaagttatataatacgtaacacatttagtacttggttttggtagcttcatcaatgtaccatccgaagttccaaaaaataaaaaaaaatgtcgatttcaccgttggtgaaaaagaaactaaattgatatgtattattcattttttagaagagattatgggtttaaatctgaaacttcttagttaaatttttaattaatttatttattttgcatgctttattatatatttgaaattagaatctacatgattaatgatttttttctcagatagaataaaaaatatatttactgataaattattcttttacatctttccggattcgctactaatgtgtttttgttaactttaaccagattgcttatggattatgatatatagtatccattacttaaaaagtaaaagagatgaaaaaccaagaataattaatgtcaccaaactatcaacaacaacaaaaagagagtgtaatattcaagataaacgaatcctattatataaaaaaaggtgggaagaagttgctgtctaatgatgtaattatgttaactagtgtgctaaggaaagaaatcaagcaagtctcacacatacacatgttatgacttatgattagcgacaagcatttcattttattttatttttgctaagcaaaccttttgtttagtaaaatagacaatgtgcaaaaaattccaaacttcttaaattgaaaaaaatactatatttaaatttacctttttaagtaagaaattaaaagattttgtagtacactacatgttttaaaacaaccactatccaaacaaaaacttggtcaccgaataaactgtagaaatatcgatttccgtcatttaaattcactttatttttggttgtttttttcttggaatatgcaagagtaatggcgtggttgaagacacgagagagagagagagaatcctaaagaaaaagccaaagcatattaagaagaagagaaccaaaacgaacaaacccaaccctaaagaaacactattattaaacctatatttatagacatttaaagagagagtgaaaggtgcagaagaaaacagagacagagttcaaataccttaagatcacatcatcatatagcttttgtatcattaaaatg

SEQ ID NO: 16549 - DNA, 3003 bp, Unknown
  misc_feature (1)..( 3003): 2750-1469P.txt file - cDNA_ID_1557475; gDNA_ID_2684118; Annot_ID_190881
cacattcacttgatagcgtaaccattagtcattttagtaccatcaatagttggactgattagtgagattaatgaacggctaagatccttacatgtatataacacacattggtcgtttttttattttatttttctgattatatcgaaaacaaacactttattaaccaaaccagtcaaatagattgatttgttctagatctaccaaaaccggtcaagggaattttttgggtaagagtaccgattcgtcaaaacagcatcaacgacaaaccggttagcagcttcagtatagtgaaccccatcccatacaattgctttggttacatcacgacaaatagttgaaccgggttgaccacacgttgcttttcgatcatagttgttaggtcttcctccataaccgcaacaagccatcaacgggtccacaaatcctgaaacctcataaaccaaataaaccaatcaaaaccggttaactaattaaaataggacttttatagatgcggtcgatacgcaccgtatagtttgaaatcggcggagagtttatatttgatggagtaaatatcaacgtagacgagagtggcgtctttgaattgggatctcagttcgttgcagagactaaggagtcctttgttgaaggctttggcgacttcattgtgaacccggaaacaaccaatcgggtcaagatccgaatcgttatgcaggtgaatcgccaattcttttggtgcacagcccaatgggcctgtgttgtgtacccaaaactttctccctccgtataaatatacagtcttcagtacaacataccaaatcacaaatcagccgtattaggtatggtttaatagtcaactagaaagttttaaacaattgcccatttgccccaagaaagttggaaaatcaaatatgggtagagttttttagttttacttaaataatgtccctgaagtttttagttaccgatttaccaccctaataagtttatgaaaaaataagttttggggctaacagtttacgtatatgtaaaaataaaaaaaaattgtggaagaaatgaagtacctgtatggctttctttatctcaagaagcatggaaggaattttttcgacaacgggtgcataggttaaattcgaatcatatagagcaagtaaaagatcgttttgtccaatatcgatcatgtacaacgcgtttctaaatccattatcatcaataaggtctcttctacctatcaacaaggaaacatattttgtaagtaattaagacgagatatgtataaattgtttgggacaaaagtaattaccggaagagataagttcttgagaacggtttttgaaatggacgaattgacgaatttgaatggcaagagggaaggaaaagatcggaagagcggtggcgcccgagactgcgaaattgactcctcttttgaaatttggtgaaagtgaatccaaatatggactcaaatatgtcatctttaaatgttcacctgatcatatatcaaaaggtttaatcaaatatataacattacatgtacataaaacatatatttaaagaattgaaactcttgttgaaaaaaaagagaaagaattgggactcacagtagaagtcaacgatgagtcgaccgtcaccgagacgaccagtgcctctatggaagaaggtaatgccatgagggagtccgataggaagtccaactccagcaagaactcctccggtgtcggagttagagtcgccgaagtttatcaatataggtttcttgtttgacttgtaactagtttcagagttagagcaaaccaaaagagagagacataaaactaagaagaagcattgtagagaggaaacagtgtaatccatttcttttgaattcttgctactcagataattttaatcaagattcacgatctgaagcttttacatatagtaatgtctttggcttagaaagtcaaattttttgaatgtaagtcaataagtactattgcaagtcgcattatataaatctctaaataatctcaaagtaaaagcaatcaatcaacctatagatccgatcggccatgttctataaggattgtcagaacttgttgagctattaaaatactccgtacaacttatttgattaatatgggccaaatccgaaaataaatggaccttatcgaatattttgttcgaagtccaggcccactaatcgagtgcgaaaaaacaaaaacaaatgcggtgagcgtggatcgaacacgcgaccttcagatcttcagtctgacgctctcccaactgagctatccccgctacttgttatcgaagctaaaataataaaataaatacaaatatttgtaaaagcgagaatttgtgattttttttggcaataagtagagaatagttgtgttccacgattcctcctctcacgttcgaagaccatttcttgttctttggacgaccatcggcgacagtgttaagtctagagtcttcttcttcttcggcgtagttttttccccggtaagtctccgttcatcgccgaatctgtatccctctttctctttttgtttacttgatcgtctctttcgattatgtatatcgcgatcggagtccgtcatctccagatctgtgtgtatgcgcttaatttcgttatggatgtgacatgatttcttgtgattcgtttccttagggttgatagatctgtatcctgcatgatcgttatagatagtgatctagatttgtcttttttcagatcgaaatttagatctcttattgttaatcatgttgattttattgaaacttgctcatacgaatgagatccgagagcatttggaaacataggattgctttgcgttgtaattgttttctcaagtgatggatattgaatctatgtgattgatgcaaaatgagttccagagaatttataatcctaggattgcatgataacttctttgctttgtgattgttttctaaagtatttattccatatgaatgctgcaattgagtatgcgtttagactgaaggtgttatttgaaaactctgaaacaggcttgaaaaatg

SEQ ID NO: 16550 - DNA, 3003 bp, Unknown; identical to SEQ ID NO: 16549
  misc_feature (1)..( 3003): 2750-1469P.txt file - cDNA_ID_1557475; gDNA_ID_2684118; Annot_ID_137179

SEQ ID NO: 16551 - DNA, 3003 bp, Unknown
  misc_feature (1)..( 3003): 2750-1469P.txt file - cDNA_ID_1557512; gDNA_ID_2213619; Annot_ID_180911
cttgttgaacttaaagcttgtatttattcttaaaactctttaagtaaacaagatttccattctactcgtgatattgcttctagttgagctacaaatgacatctagtttgtatatatctttcgagtcttggtcatctaacttattgttttggtgtttgctattcaggttagcgagggaagctggccttgaatttgtggaaattcaaagtttaacagatttttatgatgataacaggttcgaagtctcccatacttgtagattctcaatcttttatcatgagcttttgtatgtcatagttgctcctttcgaaggttgtattacaatgctgatgttgttcaactcttcttgtcagagcccagtttgcaagcttgctgatgaatgctggcccgaatttcgttgaccctaggggaaaacttcttccaagagcatttgatttgttaggtaaccttgccatcatattatgccatcttatcatatctaatctctagttttgatactttatatccttattttgcgcaggtctgtatgcaacattcatatttcagaagcctgacccagatatcgaacctcctctaacgaccccaataccttttgaaagctccaataatcatgatgaggcaagtacctttgtcttgtcatattctcgttctacacaagtataaataactctaaaatttccttttcacttgagaaaaagagtctggctatagctttagtatggactgtatagttttcagtttgtagcacaacagtgcttcagtctcagctccttgcccggatgttattgtagttgatccatttattaaattgtttttgacaactttgcagagagaattgccagttatcacggtgatcactgacgcaagtgcaccagcagaagatccatcacaaggactagggaagattgttgaacaaaaaggaatactgggaccaggccctgctgatttacgtttctctgaagcaatttgatgccttttattttaggaagatgtactgctttggtgatgtagtgaaagttgtttatcagtgccacagatgagctaaaacgagcgtctcggtttgttataatatcaaaccacatttttcatgtgttttaacaaacattttcaacaatgttcaacaacactttactccacgattcgtaaatgaaataagcaacagatttaaatcttgcagaagtggtagctggattttggtacctagccgaccactcttcctctgaagagcaaaatgttccatcctgggacaattcgcttcaatcagaatcagagtcatgccttctttttttctccttcttctctttcttgtgcttctttctatcatctgaatcacgagcgcttcgcttctcatgcctttcgcgtttttcacgcctatcatgtctttcttccttctctctctttgcaggtttcctttcctcacgcctatccttcttttggtccctctcaacatcatccggtccatcttcaacagttttgacccctgatgtatctgctggtaagcgtgctgaatctgcatcttctttctgagaggatgcaagggtgctcggatcttcccaaggtcgtggtgctctgtacagagttggagaaagacatgtgagacaagggacaaaggtaaactaccaataaaccataaagccaccaaaaacattaacatagttaaaaattagagttttttacgaaagaaaaagaacttacttagcatatccaagaccgtgaacccacacagcatcagcattccctgcacctaagtcctctgctgtcgaacccctcttcacaagttcagtaaactcttgcttatcaaggcgatttccttgtggccttgtagaggactttggtgccaagccaagagcctccctcatggcctgctcctcttgttccttaactctttgaatctcttctttcatagcatccatctcggaacccttttgctttttatctctagcataccaatgaagatctttacctattcagttggtgtacatggcaaatgaatgtcagtcaaaactcactaaactgaagattaatctacaaaaatctaaggcagtggatttatgaaaggagtaactaaagtaaaacaaccattgactgcccatactccaatgagattgaacagagcaatgaagcacaaaggaggattatatcgtcaagatgaaaactagttagcttacaaattaacaaccaccgagagtgtacataagaaaaagtacctttttgccatcttccaacaggggctttgatactgtgacccaaatagttctccctatatttatcagccttgacttcatcccaactgaattctgcacatttataaacaaattcaattagtaatagagttctcatcattagcagctcatgttctacatctttgatttgaaaactaattgccaaaaacgatctgttaattagaatgacaaagcttcttctgaatttcagcttctcccacaaattgcttatagacaattcaatcaaacactagatccaacaaaaaaaatcatcaaaatagcagagaagaacgaaaacgttggataatacataggaaccctaacagttgagaattttatgtaggatcttgtaattagaagcaaaatccaaaacgaattataatgaaacttacgatctcgaccaccgcgaacacctcccctcgttggatgatacatcgaaaccctgaaagttgcaaccttgatttttcctcaggaggctaaaagccagaactttgattggatacgaatttctcagatttttggttccaatggagtttaaataaaaacaaaaatacaaaaaacaaactgaagacggtgattattattatgggccaaataaggctttaggcccattagaggttaatagaaacaaaaacttgaaaagacacgtgtgacacgtgtcgtaagcaaagaaggagagaagtggagagaagtgaccaccagacaattgtaaagcctacctaatccacaccgattcaattcaaaaccctaaactcaaaatccgtctcggtggaggaaaaatg

SEQ ID NO: 16552 - DNA, 3003 bp, Unknown; identical to SEQ ID NO: 16551
  misc_feature (1)..( 3003): 2750-1469P.txt file - cDNA_ID_1557512; gDNA_ID_1972176; Annot_ID_180006

SEQ ID NO: 16553 - DNA, 3003 bp, Unknown; identical to SEQ ID NO: 16551
  misc_feature (1)..( 3003): 2750-1469P.txt file - cDNA_ID_1557512; gDNA_ID_2213619; Annot_ID_131960

SEQ ID NO: 16554 - DNA, 200 bp, Unknown; identical to SEQ ID NO: 125
  misc_feature (1)..( 200): 2750-1469P.txt file - cDNA_ID_1557591; gDNA_ID_2871; Annot_ID_146017

SEQ ID NO: 16555 - DNA, 3000 bp, Unknown; identical to SEQ ID NO: 2300
  misc_feature (1)..( 3000): 2750-1469P.txt file - cDNA_ID_1557632; gDNA_ID_1620517; Annot_ID_159326

SEQ ID NO: 16556 - DNA, 3000 bp, Unknown; identical to SEQ ID NO: 2045
  misc_feature (1)..( 3000): 2750-1469P.txt file - cDNA_ID_1557675; gDNA_ID_1620481; Annot_ID_158334

SEQ ID NO: 16557 - DNA, 3000 bp, Unknown; identical to SEQ ID NO: 9686
  misc_feature (1)..( 3000): 2750-1469P.txt file - cDNA_ID_1558032; gDNA_ID_1972172; Annot_ID_179868

SEQ ID NO: 16558 - DNA, 3003 bp, Unknown
  misc_feature (1)..( 3003): 2750-1469P.txt file - cDNA_ID_1565902; gDNA_ID_1620852; Annot_ID_51014
aatctgtaatctggtctatggttgctccttctgagaagcttattctttgttctacacaagttttctgaagacgctgggaagcaacattcccgaaaactgttgaggcttcttcagcggcacctgaaaaggtaatcacagaacgccattgcagagaattgaatttgttgctctagatatccagctggaataacggaaacataaactgataaatacataattcatacagaggtttcacttacctaaactacaaagttctccatatgcttcccaacacaatggatcaaatgacaatgccatcctaaactgttgtattgaacagttcttcctcccagaatatctgcaatcatgtaacagagagtaacacacatcaaacttagataatggaacatatgcagcaaactactaagcttgttacagcatcagtataccaacacagagaagtactaaacattaaagcatgcgagagacaccaatatctcatacagaacttgaaaagtaaattagcagtcacctatatataagaccaagaagataatgcccagctgcaccaccaggaacctgcatgtcaaaaatacagtagtcactagtcagcacttgccaattttcactcccaaaagactagcttgcaaaagatgtgtacaatgcccatggatatggagaatttttataaaagaagtaaaaaagcaatgccatatacttcttcagcataatcttcacagggcaacaatgcagcttcagcctctccaagaagatccaacttaaagcatgagaatgcaaataaataccgagactgaggcgtttttgaaccttcatttcacaatgtaaaacaagtttagtttttccaaacacaaataaaacaatatatgaaatgttcacatatagcaccagtaccgaagaatgtagagtacctttaaggatataatatgcactataagcttgactgttactcaagtaacacctggctaacaattgcaggttcacctgcataatgaagtagttgatcaccaccagattcacataaccaaaaaaatatatcaagggatgtgaaattcgagtaacggtatcaatctgaattgacattggcatacatcaaacagaaatctcaacctagaaattccaggtttggaataaaatcacaaaatcaactcaaaatcataaacatttcagtcaaattgaattgcatcctctagattccgacaaaatcgaaatagagtttgatccttaaaaacaaagcccagaattgaactccgcataaatcgagaattgtctattcgcaaacaactcaaaaagtcacacaacaaaagacagctacgactagaagatcggatcagaccacaagagcaacaaaaactgagaaaacgaaaaaagtcactccacatcttaaaaatgatgtgatcgaaagagacgaagctaagatttgaaaatcgaaatggagttgaatatagaagaatcgaaatcgagatacctcagatggaaattgggcgagaagaagttcgcaaaggaagatagcattggtgaacataaaatggttaaggtttttctggacacaattcgccagtagattctccatcatctgatgatgatgatgaccaaattgacgagacaatcgatgttgttgttgttcctcggaggctgtgtgtgtaatgtcgcctaagtaatcgcgcgccgctaaagtatttcaaaagcctaactttctcacgcgacgagcgtgtgatttttgtgacactagtgccccagatttttttggtggacgagacaacaagacaaggaccgcgtttggcgttttaagaaaaaatcgcgttctggaatagaaatcaagtttcagacaaagaacacaaatgaagtaagattagagtgccccaaatttagatatgcaactgaaattatatagcttaaacattgaatttataactatggaaattcatctataatgtatcttaaacgcaattgcttgttgtaaaatcgttgggtaacaaacgcgacaattttttcaatattcccataacgatcttttatgtgaccgttaaataacaaacgcgataattttttcacaccctaaacgactttttgtataaccgttagataaaaaaacgcggcaattttctcttaaacctttcaaaacgatcttttgtattaaaacgatgacgtattctaacttgagtatttcttcttattttagaaaagtatttgtgaaaacatactcaaaatctctttaaattaagttaaggataagatgagagatattgcattaatgctaatagaattctcacattttaaggatactaattggtaagtatatgctagatatttatgtattgttgaccaaaaaaataataacacaaattagcttacaagttacaaccatttaattttacaccatgttggattgagaattttgatggttattcctttatatgttgaagaaaccttctgggccaacaactttccaaataggcccaattcaaacccattgtacaaatgcaaggctactttcgtcatttttcgtaaggcgcttgaattttgcgttttcagaatcttggtttctagggtttcacttaccttccctccgcgcccttgagctctctacctgagcttctccgggattcctaaagctgaaattcaaacacctccattttcatcctcaaggtttgctctctctctctccctctccatcgatccattagatagtgtgattactcctatttgtgtactgtcttcgatgattggcgtcaatcttactaccttctcgtttaaaacccagtaacttgcgattttgttgaactttttcctcaattttctttcgattaatcctctagaaacccgtagctaagcttagattagtgatttcaatcgcaagattcaatattgatcttgcccaagtgaattaaagtcgcaaaattgatttgtttttgtttttttagctttcttatgtaattttgctcaaagctatatgattttttgtctttgcagggagataaataaaactctattgagtagaaaatg

SEQ ID NO: 16559 - DNA, 3003 bp, Unknown; identical to SEQ ID NO: 16558
  misc_feature (1)..( 3003): 2750-1469P.txt file - cDNA_ID_1565902; gDNA_ID_1620852; Annot_ID_170360

SEQ ID NO: 16560 - DNA, 3000 bp, Unknown
  misc_feature (1)..( 3000): 2750-1469P.txt file - cDNA_ID_1565902; gDNA_ID_1620520; Annot_ID_159434
ctgtaatctggtctatggttgctccttctgagaagcttattctttgttctacacaagttttctgaagacgctgggaagcaacattcccgaaaactgttgaggcttcttcagcggcacctgaaaaggtaatcacagaacgccattgcagagaattgaatttgttgctctagatatccagctggaataacggaaacataaactgataaatacataattcatacagaggtttcacttacctaaactacaaagttctccatatgcttcccaacacaatggatcaaatgacaatgccatcctaaactgttgtattgaacagttcttcctcccagaatatctgcaatcatgtaacagagagtaacacacatcaaacttagataatggaacatatgcagcaaactactaagcttgttacagcatcagtataccaacacagagaagtactaaacattaaagcatgcgagagacaccaatatctcatacagaacttgaaaagtaaattagcagtcacctatatataagaccaagaagataatgcccagctgcaccaccaggaacctgcatgtcaaaaatacagtagtcactagtcagcacttgccaattttcactcccaaaagactagcttgcaaaagatgtgtacaatgcccatggatatggagaatttttataaaagaagtaaaaaagcaatgccatatacttcttcagcataatcttcacagggcaacaatgcagcttcagcctctccaagaagatccaacttaaagcatgagaatgcaaataaataccgagactgaggcgtttttgaaccttcatttcacaatgtaaaacaagtttagtttttccaaacacaaataaaacaatatatgaaatgttcacatatagcaccagtaccgaagaatgtagagtacctttaaggatataatatgcactataagcttgactgttactcaagtaacacctggctaacaattgcaggttcacctgcataatgaagtagttgatcaccaccagattcacataaccaaaaaaatatatcaagggatgtgaaattcgagtaacggtatcaatctgaattgacattggcatacatcaaacagaaatctcaacctagaaattccaggtttggaataaaatcacaaaatcaactcaaaatcataaacatttcagtcaaattgaattgcatcctctagattccgacaaaatcgaaatagagtttgatccttaaaaacaaagcccagaattgaactccgcataaatcgagaattgtctattcgcaaacaactcaaaaagtcacacaacaaaagacagctacgactagaagatcggatcagaccacaagagcaacaaaaactgagaaaacgaaaaaagtcactccacatcttaaaaatgatgtgatcgaaagagacgaagctaagatttgaaaatcgaaatggagttgaatatagaagaatcgaaatcgagatacctcagatggaaattgggcgagaagaagttcgcaaaggaagatagcattggtgaacataaaatggttaaggtttttctggacacaattcgccagtagattctccatcatctgatgatgatgatgaccaaattgacgagacaatcgatgttgttgttgttcctcggaggctgtgtgtgtaatgtcgcctaagtaatcgcgcgccgctaaagtatttcaaaagcctaactttctcacgcgacgagcgtgtgatttttgtgacactagtgccccagatttttttggtggacgagacaacaagacaaggaccgcgtttggcgttttaagaaaaaatcgcgttctggaatagaaatcaagtttcagacaaagaacacaaatgaagtaagattagagtgccccaaatttagatatgcaactgaaattatatagcttaaacattgaatttataactatggaaattcatctataatgtatcttaaacgcaattgcttgttgtaaaatcgttgggtaacaaacgcgacaattttttcaatattcccataacgatcttttatgtgaccgttaaataacaaacgcgataattttttcacaccctaaacgactttttgtataaccgttagataaaaaaacgcggcaattttctcttaaacctttcaaaacgatcttttgtattaaaacgatgacgtattctaacttgagtatttcttcttattttagaaaagtatttgtgaaaacatactcaaaatctctttaaattaagttaaggataagatgagagatattgcattaatgctaatagaattctcacattttaaggatactaattggtaagtatatgctagatatttatgtattgttgaccaaaaaaataataacacaaattagcttacaagttacaaccatttaattttacaccatgttggattgagaattttgatggttattcctttatatgttgaagaaaccttctgggccaacaactttccaaataggcccaattcaaacccattgtacaaatgcaaggctactttcgtcatttttcgtaaggcgcttgaattttgcgttttcagaatcttggtttctagggtttcacttaccttccctccgcgcccttgagctctctacctgagcttctccgggattcctaaagctgaaattcaaacacctccattttcatcctcaaggtttgctctctctctctccctctccatcgatccattagatagtgtgattactcctatttgtgtactgtcttcgatgattggcgtcaatcttactaccttctcgtttaaaacccagtaacttgcgattttgttgaactttttcctcaattttctttcgattaatcctctagaaacccgtagctaagcttagattagtgatttcaatcgcaagattcaatattgatcttgcccaagtgaattaaagtcgcaaaattgatttgtttttgtttttttagctttcttatgtaattttgctcaaagctatatgattttttgtctttgcagggagataaataaaactctattgagtagaaaatg

SEQ ID NO: 16561 - DNA, 3003 bp, Unknown
  misc_feature (1)..( 3003): 2750-1469P.txt file - cDNA_ID_1566217; gDNA_ID_2213626; Annot_ID_195877
gaagccctaaccctaaccctaatttgtgctctactcttctgatttaggacgcgagagccgatatgaatatatatactaattttatttttaaaaatggaaataatcttatctgattttgttttttggggtgttatagtgtgtggagaggtgcatggtaatgactgtggacctaaataaaataaaacgcagtaggcagaaacgcatcagtcatcaccacatgcgacacaccaacaccaatgtctgcttcttctttatttaatctcccattgattcgcctcagatctctcgctctttcgtcttctttttcttctttccgatttgcccatcgtcctctgtcatcgatttcaccgagaaagttaccgaattttcgtgctttctctggtaccgctatgacagatactaaagatgctggtatggatgctgttcagagacgtctcatgtttgaggatgagtaagtctttgatttttgattctctctactttgatttcagtttttgggtgttgccaaaattgtacctttgtctttaagttgtgttctcgaacctggtttgtcttcggcgtttggtcggtgagaaaatggaaggaaaattgactaaattaggttatgggagttggagtttttttcgattaacaatggtttatgaacttaggtgtgttgattagttgactttgatgtaatagtaacttggctccattgatttgttgaccttgatgtaaaagtaaaggattttggatttagtatttgtcaggggttccttttctgattattggaatcaagcaaaaaaagtcaacgctttagtgtctcctgtgaaagatgtcatagttttgggaggaacatagtcaagtttagctatgtttttggccaaaaatggattctttggatatatttttgtttgtctccttttagacttaattttacgattatgatggttgatcttttgctttgatggaagtgtttcctataagttttagacttaattttaccttaatttattgatccatctcttccttttcaatcttgcttgcagatgcattcttgttgatgaaactgatcgtgttgtggggcatgacagcaagtataattgtaagtgaactttgttctagtctcgtcctatcacgtagtgttatgcagtaaaattcatgtgcttgtttgcctttctcctatgactgaactcactgaactggattgctgttttatctttttctatgcccctattcaagatactgataccttatcaaatctgcaggtcatctgatggaaaatattgaagccaagaatttgctgcacagggcttttagtgtatttttattcaactcgaagtatgagttgcttctccaggtatgtacatatgcttgctttgaagtctagataagtcaagtgctgtatacaaatggatcacaggcgtgtgactgggcatggctatgtcatatctagaatcacatttttgaagagaaaattaatttcaaaaatatgggaggttagatcataggcttgattctagagattttcttgcacatgttgggtgttgctatgatgatgggatgctctcgtgatcgtagatggttggtgggttttaataatctggctcatatgtcatctgactggtttcttctcgtttgaacagcaaaggtcaaacacaaaggttacgttccctctagtgtggactaacacttgttgcagccatcctctttaccgtgaatcagagcttatccaggacaatgcactaggtgggtatctactggcaaaacaatttagtacttctttttactatctatgtagaaaactgtagcttttctcaactagtgacctcactgttactcatcaggtgtgaggaatgctgcacaaagaaagcttctcgatgagcttggtattgtagctgaagatgtaccagtcgatgagttcactcccttgggacgtatgctgtacaaggctccttctgatggcaaatggggagagcatgaacgtaaataccatttctcaagactcttggttcccattttcttgaacagaataataaaaccttaagcttcttctgtgttggccttccttttgcagttgattacttgctcttcatcgtgcgagacgtgaaggttcaaccaaacccagatgaagtagctgagatcaagtatgtgagccgggaagagctgaaggagctggtgaagaaagcagatgcaggtgaggaaggtttgaaactgtcaccatggttcagattggtggtggacaatttcttgatgaagtggtgggatcatgttgagaaaggaactttggttgaagctatagacatgaaaaccatccacaaactctgaacatctttttttaaagtttttaaatcaatcaactttctcttcatcatttttatcttttcgatgataataatttgggatatgtgagacacttacaaaacttccaagcacctcaggcaataataaagttttcgtttttatcttaattaatgaatgaatgtcacaaagtttgtgagatgtacaaaaagcgtcgaggaaaaggataacaaggaaacagagtcgaaaccagagaaaaggcaacgcaaagattccttttttcgaagcttaacgacaacccaccttccatctgatttaagtaaagttaaaagtcactaatttaatattattgaacgaccgaaacaagtatgttgatgactttgttctcctttaaattatcatcacttcatttctcagagatttacgcacacagagttctcttcttcgtcctagtttcttctattccaggtaaatgaaataagattcgatcaaaacccagatggattttgaaatagttttcttgtgaattgaatgaaaagtgtgtatctttccttctgggttttgattgattgactgagaatatatatgatcactttatctagactaatctcgatttgtcttttgctttctgtgtttgagtaatttctcgtaaatctcatataatcaaatccccagattacttgttttgatcataattcttgattcaggtgagaagaaaaaatg

SEQ ID NO: 16562 - DNA, 3003 bp, Unknown; identical to SEQ ID NO: 16561
  misc_feature (1)..( 3003): 2750-1469P.txt file - cDNA_ID_1566217; gDNA_ID_2213626; Annot_ID_132062

SEQ ID NO: 16563 - DNA, 745 bp, Unknown; identical to SEQ ID NO: 368
  misc_feature (1)..( 745): 2750-1469P.txt file - cDNA_ID_1566630; gDNA_ID_1564401; Annot_ID_149391

SEQ ID NO: 16564 - DNA, 3000 bp, Unknown
  misc_feature (1)..( 3000): 2750-1469P.txt file - cDNA_ID_1566759; gDNA_ID_2214477; Annot_ID_183168
gtaaaattttctctatgatttatatttatatccaccataagttaacacctattttggcttttggaattcagcagttttggctttagatattctcaagtcttttcttattttgctggatttcaattaaccatatgctaagtcgaaccggttcacatcaaatgacattttttttaacttgaatgtagaaaaaccatcaaaaaagattcgaagacaatttcttgttgtcatgaagttacatgatcaatgttctatgcttctatcatctagaatatttttcttgatttactcttataatttccccaagcttaaaacagattcatgcatggcgtttgatttcatacaagagatacattgttttcaatcaatatacctgactgtagttgcatttccgaggcacttggttcgacattgacttcagtgtcgtttttgttgttatcttcttctcattttgtaggattttttgtttgaccaagtcaccaaggagaagaatctttgagcaacttctactaacgattttaaaataacactcgccacaactaccacgtgaagctagcgacaataacgatatcaacatgacttcagtattcttaaagcagacacgtatgcttgtgcaccataatcaatgtaagactttctagagcaaacccataaaccttgttttgtctcccacaccgaaatatgacatcgagatcggaaatttgaaacatcaatcagaatgttaccacatgtttaagtgatacatttatcttactgttgtttagcagaagttgtgatctccctaagaccctaacattaacaaaatggcccctaaatactacgaagcaattcaataactatctgaagaaacaaggttgagttcaaacttaatattaatagcgcaaaaggtccaaaatatagctcataacaatccgaaaagataagttttaaaacaaaagtgactcattgaaaagctgcaaactaaagcatggtttgttctgaaactggaaaacagagcatagtattaactatcaagcttgttgagcagaaagtctcttcctggcttcctcaatgatggtcaacttaatacctttaccctttggaagggacacccatggctttgttcccttaccgattgtgtacacatttcccaaccttgttgcaaactcatgtcctgttgagtcttgaatgtggatggtttcaaagctacccttgtgtttctcacggttcttaatcacaccaacacgccctctgtttcttcctccagtgaccataactacgttgcccacatcaaacttaatgaactccacaatcttgttctcctcaaggtcgagcttgatggtgtcgttaggcttgatgagcgggtcaggataacggatggtgcgaccatcatatgtgttcaagtagggaatacccttctgaccaaattggatcgatctcactttgcaaagcttgaactgcacaacaacaaaagaggatacttgttggaatatattacaaactggtaatcaacatgcaaattcagcagacctctaatgtaagtatagagcaatgaataaagacttgactttgttttgacagattcagtatatggcaatgtaagagatttaggagaacaaaccttagcctcctcatccttgatggagtggagacggaaacgtcccttggtgtcatacaaaagacggaagttctcatttgttttggggatagacacaacatctgtaaataaatatttatccttagttagatcattgatcacaagaagcataaaaatcaatcagcacaaggactatagccagactctgaaaacgtatcacaacactaacagactcacccatgaaaccagcagggtaagtcttgtcagtcctcactttcccatcaacctgaatatgcctttgcatcaagatcgaaatcacttctctgtatgtcagagcatacttcaacctgttcctgatgataaggaccaagggtaaacactccctagacttgtgtggcccagaagacggcttgggggcctggacagaaatagcattataagcaccgaatcaaacgaaaactaagctctaataagattcaatccaacacaagtgaaacttacaaaggcaccaccaagtttatcaagcatccaatgcttaggagcattgagcctcttcaaatgcttcttcaaacctcttgcctgcaaaagaatatcgaacaaaaataaaaatcaaaacacaataaatgtttataatagctcaatcactaaaagtctcatcactcaagacctcaagtcacagaacaagagaataacgccagggaggtttcatatctgactaattgagtcctatcttttgagatctcaatatcaatccctaacccattttacagatcgcacaaaggaattcactttataaacattaacaattacccataattacatggaaatgctatctagattacaaagagagattttataatcccgcacaaaatgaattcacagatggagacaaactatccaaaaccaaaacaaacacatgacgcaatacgcttgtgaatacgagacttagagaaagagacgaagattacgaaccatgtttgcagcgaatgagttctgagttctccgcggctaagcaagccagtctcaattatatcttctagggtttgagaagaagcgaaacacaaagccctaattttaagtttttaacatgtgtaatccaaaaatccgctgccacacgtgtgacttatgttaagtacaggcccaatataggcccaataagagcccgcttttatttatttttcccactctgaagaagattagaaagcggaaaaaaaaacaaaaggtcgtgaatgtctctgtccctttcttcctcagttctcacgcaagcttcaacgagaaaagatcggaatctcgccgtcggtaaagcgccgccgtaagtaaaagacggaaaaccagaagaaggaggagattgtatttatgtgtagcagcgtttagtgtgaggaaggaggagattttgtatatagttagaatttgcttcgaagacgatg

SEQ ID NO: 16565 - DNA, 70 bp, Unknown; identical to SEQ ID NO: 392
  misc_feature (1)..( 70): 2750-1469P.txt file - cDNA_ID_1566774; gDNA_ID_1590652; Annot_ID_149894

SEQ ID NO: 16566 - DNA, 3003 bp, Unknown
  misc_feature (1)..( 3003): 2750-1469P.txt file - cDNA_ID_1566971; gDNA_ID_1972048; Annot_ID_178303
atcatcagcggttcaataacagtttcagaaactccattctctagcatcataggttcactaactgtctcacgctgttcctctagttcaataataggttcactaactgtctcacgctgttcctctagttcaataataagttcattagtactcagaattcctgtatttacatccgcaaccattacaacattggcagccaattccccataatttacaccgcatgaacttcttcgctctactattggaacttgcctattattactttccaaatcactgcataactctacatgcaaaacaggtctaaatccctctttatccaatgacgttaaatatatcaacacatcctcattatctacaatataagactctctccatgctttacatatcttgtaactcaatttcagattccttttctctccacctagagcaatctttctacagatcttatctattaaatccgcatatgttattctctccaaagatgatgtcttaaacactataccgtatattgaatttttgcaacttcactcatggtctgctgtatagtaccctccatagtcaaagtgtaggttcatctggatcctcttcttcatcgcctcctacaaatataaacactatattagtaccagttgaaccacgagatgtaccagtgtctgattcaatttcagttcgtccatccattgtattatgcaaatatggtttgattctgcttacacattgattcaattcaattacattgtactaactataatacttacaggagatggaagaactaaagaaggatcgtttccagagtagccgcagcaaagatcaataaagaattcgatccaatagtatcgactcacgtagcacgcagcaccggagaaatcgacggccggagaattggattagctgacctagcaaagtttccccagactcgacggagccaatgtcaaaaatcaccgatgttggaagttaatcggaaatcgcctatctcgtcggaattaaatgaattgggtcggaattaattgggttgggtcgggataatttcgatttcgatttggattttgtttttgatttttcttttaaaattaattgatataattcattaagggtaaataggtattatccactacaagagtggcatgcagatcaaaagatggcacgccggattcaaatttccagtttagtggcattgttgattaggactccttcaagttggaataggacggtcggagatcgccgtggtttttaccgtcgctgtcacaatcacagccagagccgcagtcactttgctcattcctttgcaaaaccctaaaaaaattattgggttgggcttttgattgtatgttgggttttttaattgtattgggcttttatattatttgtaatggtttattttagtagggtgaattacaaaaatgacggtttttgaaaaagttattaaatatatagcaccataatgtgtgtaattcatttgatagcacatgtcagttgtgaaaatacacccaactccttcccaacgatgcgcttggagagaaagagaagccacaggaggaaagagaaatatatatgagtaatatatattcacccctcttgattttgtttactttattagtttaacaatattacttggttaaagttaaagatactattgaaaaaacagattttttttttgtttatctaatatgatttgaattttaaaaatcggaaacgaatttcttaaaaaatgaatagtggtatcaaattctatacagatcatcatagaaagatagaatattatatatttgttcaaatagaaacgtttgttccgatgaatccaaataatcaattaaatactttttgatggaaggatactaaaccctaagataatatatagggaacccaagacttttaatataaaacactaatcaaatcacttaatatccttaatcaaaacaaacaattcattttaaaacatatatagtacaaggtatacgtaaatagtatacccaaaaagtacaacgacgccaataaattagagagacccaaaaaaagaaatcaaatgaaggaaacagaaaacagagattgatcaaattcagcgcttattagcgagaatctcgactaattcaatttcaaaaaataaaaccaaagtctcttaaaaaaaaccaaagactccaacaaaatctgaagtcttgcctgtgtaaatcaaaacctctaattcaatttcgagcaaaaccgaaatgtcatttccgaaaattaactgtcttgcttctgtgcccaatacacctctgttaatcgttggcaaaatcaaaagcttcataaacggtggactgaaatttattagagccaaacccatgttcaaaagttaatagttagtgaaagagaataattggttttctatggaagggagaagatgaagagcgtgtatttcaaacagggatagtattggcattattacagaaaatacaaacaatattggttacttttttttagagtgttagttacctaattataatatttttgtaggttataaatgtaaatttcccattttagtattttactagatttgtgtttgtaatagagtaattgtaatatgtaaaccaaaatgaaaaaatctataaaccaagaaaaatacaaaatccagttcatgttcagaacataaattttagctaataaccgatccgaattaaccgactaccgaactgatccgaaccgaattttaattcgagtctattcagtgaaattttcaaaaccctgaattttccttaaaccgaataacccgatccgaccaacccgatttagtcgaactcccgggcctactaacttttgtagcgtttaacggaacaaccggaccggttttagtaatttccctaattcaaattcactcttccctcagtttgaaatctctaaactggtaattccaatacagtcttttcttaaaatcgcactagcttaaaccagtagatcctaaaccgattcatttaaacaacaaaaaaccacttacagagttcgttcgccggcggcggcgagtcatcgtcatcaatg

SEQ ID NO: 16567 - DNA, 3000 bp, Unknown
  misc_feature (1)..( 3000): 2750-1469P.txt file - cDNA_ID_1567007; gDNA_ID_2936547; Annot_ID_193918
tcataaggtgtatatcagaaaaagagtctcgaccaatcaacatcgaataaacagaaatttatcctctgaaagtaaaaacagttgcagaaatactggagaagatgattccataaggaatatgtctccgattaattcctcacgtatcttggagcttcagccgaccttgtctaccaactcagtatcagatagaacgaatcctctgggtaatgaaagcggtcatgtaacagaacaataccagggtcctgagttagtgaaggtgaataacaacacattcaccaatgtaaaaagcaatgaggcgtgtgtggtaccacaagatacaaggtcagctcatgcttttggaagtgcaagtatatcatcatcctcatttccagcttcaaaatttgaggattgtcaagccaatattggtgaggaattgggcatccaagtctctgaaccaccttctacagagtctcagtataaggaaaatactagcgagaaatgcacgtctgtgcaggaatttccagctagttcaaatttaaagctcaacagagatgtaaagatcaacaatgagatggaaaaaactgttgagctgcttggctgctactttcatcccatgcctgtttcatcagtattactcaggactgttggaaatgaaatctatattttggtgttgagctttgctacagaagatagagttaggaccctgtttatgtacaagatgtcagctgaggcaccaagcaaaggattcccgtctatcattggtcacactcctgccatactccccattgtggatgacaaatctagtggaaatgtaaattcattaaactttttcgtagtttcttctcttaaacttgtttttcctctctagttatctaatagttgttagttgttacatttcgtcagggaacactcgagatatctaatttgcacttcactccagacgggctgcatcttattttaactggcaacatcaaaacaccttattgcaggtttggactctttattgtttcatatggtacagagatacagaataaagatattagctaagagattattattttcccttttttgcaggaagagggaaactgattgctcgtgtttgatttgtacatcagcctgttttgaggagaatgcagtgaggattgtccaggtgaaaactggtcatgtttctcttgtgacaaaacttcaagcagatgacagtgtgcagtgtgtggtggtgtgcgatcctaacaatctcattgcagctgttaagagtggaaaccttattgtctgggccatgaactcgcattggaggtactctcatcagagttcattactcttctcttaaaatagttgtcagatccttcttctatttggagctattggatcatcattggaatttttgctaatgttcttgtatccttaatttgcagtggtcctaccgaagaatatgttatactcgcaaatccttgcatatcatcatgcatcatggaactgaagaagataccaaaatgtcctcatctcgttattgggcataatggtataggagaatttacaatatggtattttgctccctctttctctctctccctctatctttagagtttttttctctgcccatctctttgttaaattacagaacactatccgtgctagggaatgatgaggagcagccaactttgcttgatctttttcttcctgtctccattgtttcggcctgctaactttgtttattatcgatttagggatatctcgaagcgaagcctagtatcaagatttgtatctcccagcaatttgatctttgagttcattccgacgagcttgtttgcatggcaccctgtacatagtcattctacaatcgaggataacgttgacatgattttagctgcaacaaaattatggttctcaaaaggggtcaacaacaaaacattggttccagctgaagtcaaagacactgctatttggcttttagtctctactgatcttgactcagatgctaaatgtgaccgtgtagaaagtccagttagatgttggagacttgctctccttgtgaaagaccaactcatattgggaagtcagttggatccgaggtattatcacacatctctttctttacatggatactgtctttctcaggctcctctggtttctccatgttccgagaaattagttttgctttggggattatatgagaagtaaatggtatatgaatggtaacatttctaaatccatggttcattggctatggatttgtggtttacagggctgatgttgccggtacaatatctggccatggagtagcaggcacacttgatggacttgtgtatatgtgggacttatccactggcactaaactcggctctctccatgatttcaaaggtatacactgattgaagttttaactagatatatccatgaaaataacgaagtcaattctcaaaagttaatattgttacatggattttgtcaggtcaaagagtttcatgcatcagtactgatgattccagaaatatatgcatagcaagtgaagatggtcagctcctagtttattgccatccggaaaagtaaactcaaaatcaatcaaggagggtaacaacaaaaagatgttttgccaaaatgacttcaattggcttggttacatttttaagtcaactaagtttttatgcttgtaaacttttaccatatggcttacaagttgagaattttctaatctagttaaaaaaaattgtacgaagatgtaaatgataaatgatgataaataaatcttttatgtatattcgttgctacaacttacaaggcatttctgatttctcagtaattttttattccatttttgctaattttccaaaaaggaattaagaatatgaaattataaataattaaattaaacgacgtcgttgctgagagggctctagctcttattatctttctcctctagtctgctcatcttttcgcgtggtcgaccaaacctaaaacccccaaaaagagaaaaatcaaagaccattcgctatttcgctcgctactcagtttcagaagaagatg

SEQ ID NO: 16568 - DNA, 3000 bp, Unknown
  misc_feature (1)..( 3000): 2750-1469P.txt file - cDNA_ID_1567243; gDNA_ID_2684230; Annot_ID_192210
tataagaaaagagaagttgcatatatatatatacatggggagtgtcaagaaactgtctttgttccctccagactaaacttgaagaacatcaacataacagacaagatactatccagcaaataaatctaagactgtgccttttcatcactctggaacataaaaatcgaacctgacatcgacagaaccatcacgggtatctttgtattccacgttggttatggttccagcctcgtccacgtcttggtactctggtttcacccttctaacaggcaccgtgaccgagtaaatggtcccaaggtcaccgtccgtggaaacatttagctgaactttttcctctgattctatctctacgaaatccgacagtgcatggataatgttgttgacgattttccttttagcttcgtcactaacatcacacctgtcggagaagaggatcatcttgagccgctgctttgcaattcttgcgttggagcttcttcttgatgcgtgagatgggaatattatcttccaagccaagtttaacctgtcaaagaaacccatgttgatggcattatagagaaagctctctatctcttgctctgctgggcttggtgatagttcatagtctccggtgttccttgcaagaaccttcacctgacctcgtgtgttttcgcggctgatcgccagtccaggagtacatttctgagtttccaaactgtttacgccattgcttatgaatcccgtgaaatcaacctgcaaatttacatccatcacccgcaaaaagggactgtaatttcagactagttgcattttgagaactcagtaattgttatcgtacatctataggtaaagcaactataacatcaaagctgacctaaacgtatatgttttctaacaaagtagcaaaacatcaggtcataaacaccacaaacatctgcatatatctaacagaagaccggtctagtctacgtaatccaaggcaccaccaccattgttaaaaagacttaatatgagctacaagcttaagaacatattcactctctttgatcatctataggtaaagaagcaactgtaacatcaaagctcatcttaaacttaatgaaatggttttgtaacaaaattgcaacacatcaggtcatagcaccacaaacatccgcacatatctaacagaagaccggtccagtctcgctctcagtaatcaaagacaccacttccatactataaagacttaatatgagctacaagataaagaaaatatcaaaactacaaaaaaggaggatggtcatggagatggattcgttggctttcctaaaaacaaatatacttaagttttgttactaaaatccttcatttccaagtgcctaagtaaaaacacagaaactggaatgataaactttcaggagctcgcgatgaacaagcaaatctagagctagagagaaattgtgaaattgttccaataaaagacgcatttcagattcttcctaaaccacacagacatagaaacgaaagatcgaagctagtaatctaagttctcctaatttggtggcgaatttcacgagctccagatcccaaattgcagcgaagagaaaatttgaatcgtagagtaagaattataagaaaatcggaccttggaagaagaagaaggtaatgagaggcgattacggtggtgatgatgataaggagatactaaggtcgcagagatcctgagagttccagaagacatcgccattaccgagaaacttgaaattgctcgccggagaagtgaatctttttcgtctcagttaaaagagaaatgagattacgacgactcttcttacaaagtaaaaggctatcgagcactttaagaaacgctgtcgtttaaaggcttgaaacacagcgttttaacaactgcctaaccgatgtcgtatcatctattttaatattaaaccaaaacaacaaaaaaaaactactttgcaacttttggtgtttgaagtttagaaattagaagaatgacgacaatagtaccaactcattcaaaggttttctataactcattcaaaggttttctataagcaaaatgtaagctttataaaaaatcacattattggtaaagctgtaggcaaccacaaataactaataagtagttttcagatttgatggattgtaatatttgttctttaaacttcaatctaacaaaatatccgtaaagatgactatttgcattcttgctgttttattaaaaatatgatcttttgacaaaaatatttcaagttttatagataaaccacgaataagtagtttttagatttgagagatgtgcttttagtcaagtggttaagttcatttgatttcgtctttctatcgaggttcgattccactaagtcgcgttaccctatatagtagagtttgactatatattggaccttctaaaaaaatagtatttaaatttgatggattataaaattattttttaaagtttaatttataagaaatctgcaaaattgactatatgcggggttattggtgttttatcaataattatgatctttttgataaacttgttccaacttttacaaataaatcgcattgatctcggaaaaaaattgaaaccctagagaattttccaatcccataacacttggtaaggactagacattcgtcattcttctaaacttcaaaaaccaaggctacaagattagggcttttctaacttaacatttttccaagatagggttttaggtttttgttttggcttaatatgaaaatgctacaagagggttttaaactttttgaaacaagtttattaaacgaaccgctgtcgttttagttaattaaacaaaaaacacagtcgttttgaaacaagtaaaacgatcatttgattaggggactgtggtcaccggcggcgagaaccaaggcttcttcgtaaccaaatatctttcgatatcaaaagacaatctctccaaaatacaaattgactaatataataagtcgagagattctggtgcagaggacaaaaaatttcaattttgatttcattgaatg

SEQ ID NO: 16569 - DNA, 3003 bp, Unknown
  misc_feature (1)..( 3003): 2750-1469P.txt file - cDNA_ID_1567431; gDNA_ID_1620705; Annot_ID_165273
ttcccatccatggttttccttactattgctctgtgatcaccctccaaacacctagctgaaggagcatcaccatcatacctgtaacttatgtagaatattagcttacaaaattttgtatcatgctagctctttttttaaattgagctttactcttattacttaatttcataggacgtgctcgtgctcgtgttaaggaattctgaaaacgacatctggtagtataaagggaaatagggttacacgcgagtgctttctcatttggcaactttctctgatttttctctacgcgagcggcgattgcgactatcatttccttgtgaattctcgtctgtctccggtaactttctctccattttgctagctctgttgttagcttgttacgcattatgctcgtagtttggcctgtctcagtgcgattagtgaaccagtaatgaactttaagtaacgttttagggttttaatttttccttggttgaatgatgtaaacccttctttaggttaaaggagctattcaacgtttgtttggtttatagtctatagcttctcgctcgacctctgcaacttaaaaatggttatgtttatgtcaaaacttgaaaccatgtttatgcttgatacttgggtctttttggctctgctttatatgtgtcttctttcctctatgtgtttttctgcttgattctgctggattatgaatatctttcttctgcttgcttctacttgaaaccagggataagtgattgcagatggctgagcgattattacaatctatgtcaagggtggctggccgatgtcatccagattgcgtaaaagcaagtgatgagcaagaagattaccgtaaattctcaaatccttttgaactgactcgttttcatatgaataggttcagtatatgaattgactacaacattttcatcttttgttgttgttgtttggcagatgcatctcaaaatgcagctttggtagctgtgaatctgattagctctgcaaggttaatactgaaactcgacgctgagtttactgagtactcagctcagtttttgatggacaatgctggaaaggaagacgacccgggagaagtggatcaacaacgcaatcaggtcacgaccgaaaactgccttcgctacttggccgaaaacgtttggaccaagaaggaaaatgggcagggaggaatggatcaacaacgccctgtgctcactgtcaaagactgcttggaacttgcttttaaaaaagggctgccgagaagagaacactgggcacatttgggatgtaccttcaaggctcccccatttgcttgtcagatacctcgcgttcctgtgaaaggagaagtggttgaggttaagacttttgatgaagcattcaagctgttggtgcatcaacccattggagcaaaactgcatttgttcagtccgcagattgataatgttggagaggttaagtgttgtaagttaaatttcaaaatcttaagagattagtgacaaagttttgttctaatcttgttcatctttttttatgtgtgatagggagtttacaaaggcctcacgacaggtaatgaaacacactatgttggacttagagatgtgctaatagcttcagtggaggagttcgagggagattctgttgctattgtgaagatctgctacaagaagaagctttcatttatcaaagtgtctttgagcgttaggtttctctcagtagcacatgatggtgataagtctaagttcatagcgccaacaggtctgcttgttgacttctgtgtcccgcgcttatctatcaactaaaccaaaagctgagatcttggtaagtatctggactatatgctagatgtggaacttgtttgtggtgctacaataagagttgttttatgagactattttctttaagttaagaagtcaagtatcttgaaaaccatatcctatttgtggaacttgtttgttgtccgacattatgattgtcttaggatgaacttttatctataagttgaagaagtatttgaacttgtttatcattccaaattactgttgcccaaatttgaagggatcttttcaagcttctgaattcataattggatttgctcatagtttagtgagttcttctatatagattacacaataatgattgtattatccgtgtttaccaatataattttagtgaaaaatgcaatgtaaagttttactgagaaatgagaagaattgagtcaccaagctgatggtacatactacataagatagactactaagaattttacattgaccagtagaaatcttcaaatctctataaagtggcccaaaataaaaacgatttaaaattgcataaacgatgttgttgtttaagccttcaacattggcaaatgatggcaatctcagaaaaaggagtcatggcaatctcagaaaaaggagtcatggcaacgaaaattgacaaaaacggcgtcgtattgagggttaaaagttgaagtccctaaaccgtcatcgtattggaactacgctgagggggaaataagctttcgcgaagcttcgagagttaaggcgacatttcactgagttttctctacgcgacgtagatctgtgtctccggtaactttctcttcattttttctttctctgttggattattttacttttttttttggctttgttacggaacctgctcatgatttgacctagtgaactcttagtaacgttttagggttttaactttttttcttggatgaatgatgctgggtccttctttatgttagagttgttctttgtttaaagaagttatcaacgtcagtttgctttagtttataaagcttctcgttcgacgatttttcctctgcaactagaaatggtggttctgtttatgtcaatactagaaaccgtgtatatgcttagctacttaggtcttgttttggttttgctttatagatatcttgtttctgaatgttttcttctgcttgattgtgctggatttgtgaatgtcttcttttgtttgtttctacttaaaaccaggagttcatcgcagatg

SEQ ID NO: 16570 - DNA, 3003 bp, Unknown; identical to SEQ ID NO: 16569
  misc_feature (1)..( 3003): 2750-1469P.txt file - cDNA_ID_1567431; gDNA_ID_2926196; Annot_ID_201475

SEQ ID NO: 16571 - DNA, 3003 bp, Unknown
  misc_feature (1)..( 3003): 2750-1469P.txt file - cDNA_ID_1567442; gDNA_ID_2214638; Annot_ID_188192
cgggattcatcattttttatagggtaaaaaatcaatctagtggtttaatggttatttttaaattaaagtagccgtactatatatctcaaaacataaaaatcaagttgtttctcagtacaacaaatatacaatttaaacattattaagcctaaaattaaaacaataatatctaaaatacggaatacggtaaataaaggcatttgaattcataaaataaatggtggaaaaatcaggccaatcactgagaataaaattaaaaggttaagtcataagattcaaaagtttaaagtaatttgttactgagagttaaaatgataaaaattcaaaaattatacagtaacttctcgaaactaataatcccaacacccacaagtagttgaactcaagaaaaacactcaaactaaagtttttagaggagatagttttccatgagtttgatcagagtaacacattagttgtgcgatactcaaagaaaggaaggagtgaggatgagaagagccttccatagtctcttggtaaacagtaattttgtatttgaaacctttcagaatgatatattatcactcagcgaggctgaagaatacaaatataaatgtaactacttgctcatagttgaagataagtagaagttccaaaacacagaacccatggacatgaacgctactcgagcttgaagcgggactaccctgtaaatttcacctttcatcagacctcaatcctattatacataatcacacaatctataaagaccctctccaaatgacttaatgatagagaaagaaagccataccaaaagttaagtatgctaacgggaacccagaagcgaaatcctgcagtaatcccaagaacagtaaatatttgaacgatgctatgtaatagtaaaaaaattactctctgtaattggtagctcaccataaagaagcgtaggaagagcatctttctgatacttgtttccaagctcagagagctttcccagccacaagttgttccaagcaaatataacagcaatcacagatggaccaaggattacttggttaagcagaacctaacatgggatcagtataagcagtaaaaactatatcacaacgtgttccaagtacaaattaacaaaacacgcctagatttgtaccttaagcactagatttgtcgcagttggtttaggcaaagaatgatcaaggaattggtaccacgcataagaaccaggaccatacaagagaaacccgtaagaactcatccgcagcgcacgaatccagtcatgttctgagaaaatgttccacaattccccctaagtaaaacgatccaatcataaatccttagtctcaagccaagttccaccaatgtacgagaccattttgcaagagagtaaatatgagtcaccccaacaagaattcaaatcaaacataacctaaccaaagactgtcactactcactaaacaaccatactcaccaacatttttggttatgcaaagatccagtttcagtagaattctcactataccacactaggaacttgattcatgtaatatttcaaacaatcaaaacattcactaaaacctctaaaattcaaatctatgactcgaaaataaccaaaacttggtcagagacaaacctcgtcaagctcagaagatgattgtttaagagcggttctctttttccatctccctgatagctgagcaatcgtgtcaccggtgaaagtgagtgctccggccgtcacagcttgcttcaaaggaaaccgataaccgccggcgtctctgctcacatcgacggaatccgacgatccagaattacgtttcttacctctatcaccggaagacttcttctttctccgttgatcgaagccattccatccccagaaaccaccagcgccgccgcaaccacccaatgcgtccattaaaaatgcttccttttgcgtcgaaacagagaagagttttgcctaaatcttaaaaatcgcaaatgagtcctgtccatttgttttttccggtttggttcgattccaatttattggatcttgggttttcggaaacaggtcaaaagtcaaaccaattctgaaccgaacgaatgttatcaaactgaaaggatcaaaccaatttattggatcttgggttttaatcagtattatatctttttgaggtctctatatttatttcactgaatttcgatttattttgttcagtccatatgattcggtataagaattaatctatagtttgagttaatattcggttcatttattttgatttggttcggttttatgcttagtgtacataaaacgatgtgttcacgtgaaaccggtgaaggcgcgatcagacaggcgcggtggttaataaataagttaataacttactcgttactagggccgataatcgtggttttgaacgcgcgtttacgagaattgcgttagccaattgtattcatcatcatcatcgtcatcatcgttggggtgagtatacatacgattaaagaaacccaaaaactccggcgtctgtttaccgctatcatcattcttccgggaagaggaaaaggtttcttcgatcgtcgaagagattctttggacaagtcccctccttcctggttcaatcttcgattcagctctcttttaatttttttggtaacctcctcctctgcatctactgttttcgatttggaaatagattggttcaattgtgaattggaattgagggtttgattgattggatcatctcaattcataaatcaaatcctttgaatttagatttagaaagctctagagtttatgaagatctgcatcgttcttatgagttatatgattgatggattttttagtgtaaaggaacctactttaatgatcaaagctaacgttttgtttaaattttgaggcaaaattcaaatttattcatatgaatattctcataagctgatgaattctgtatctttgtacattagtgatatagtctacttgtgtgtatccttgttaattcatatttaaagtgtgttttttcttgtaggttttgggaagctgctatg

SEQ ID NO: 16572 - DNA, 3000 bp, Unknown; identical to SEQ ID NO: 7126
  misc_feature (1)..( 3000): 2750-1469P.txt file - cDNA_ID_1567547; gDNA_ID_1621128; Annot_ID_172376

SEQ ID NO: 16573 - DNA, 3000 bp, Unknown
  misc_feature (1)..( 3000): 2750-1469P.txt file - cDNA_ID_1567581; gDNA_ID_2936558; Annot_ID_194311
ttttacgaatttgtgacatacgccgtttaataacgtttgccgtcggttctgaaatctttattctttttctcttttatcgttacgcgtaaggaaaacgtgcggtaaattctaaccgaaaatatatataaaaaagtagtccaattttgaaatctggccgttgatggtagacaactaaactgtgccaaacaagaaacaagaggtgaacatatttttatgataagacagggcaataaatttgttgtaccaactcataaaacaatagataaattacttgcacaatgatggattattaacattaattttcttactattaatcatggatgaaaattcctttcttcacactagatatagttctttaactagttaaaaatgcatgcgatggaatattactaaatatgatataatctcatggctttatgtaagatttgttttttggtttttttggttgttgttaataaatttattattgagaagtttaattctattttggtcacaatatattgaaatatttttaagaaactaaaaagttcctatttatttttgttttcattaatttatgagaggctattaaagtcacagaaacttattgggtgaatgagtttataaacacatgagctattgagctagtagcctcttgtactcttccattttacgcgcaatccacgcaccaacaaaaagaaaagaaaagaagagataaagaatatctttaaaaagtaagtgtggagaattctttcttctcaataaacaacaacatgtcgtcgagcaatgaaaatgctaaggcacaagcgccggagaaatctgactttacccggagatgtagtttgctcagccgttacttgaaggagaagggtagtttcggaaacattgatcttggcttataccgaaaacccgattccagtctcgcgttgcccggaaaattcgatccaccaggtacttttattatctctttcttctttcatggccgccacttggtaatagtactttaaaaactcagttctgttactacttgcttttgccagatttactacttttgtattgtttcttcatttgtaagtcagttccttacttcagaaataatttctccttgtaattatgaagacaagtaacaaaaataacgaataagttgatatagaaattgattgagatgtggttaataaaattccaaagatataagatgctatatcatttttctaaagttattatagttcacgaaagtttttattctctttatgcagggaaacaaaatgcgatgcataaggcagggcattccaaaggcgaaccctctacctcatcaggaggcaaagtcaaagatgttgctgacctcaggtctctccttttgttccttgggaatacttgttgtttttggttattggagattagagaaaaggataatcggttaatccggttaaaattggttttgttctgaaatctgtttttggtttgcagtgaatcacagccaggaagttcgcagctgaccatattcttcggagggaaagttttagtatataatgagttccccgtagacaaagctaaagagattatggaagtagcaaaacaagccaagcctgtgactgagattaacattcagacaccaatcaatgacgaaaacaacaacaacaagagcagcatggttcttcctgatctcaatgagcctactgataataatcacctaacaaaggaacaacaacagcaacaagaacaaaatcagatcgtggaacgtatagcacgtagagcttccctccatcgattctttgctaaacggaaagacaggtatttaaccttatcatactttttgaaacttgttttaatgttccaaatttccaatcactctagttagttcaaaactcaaaagtttaaggatcctccctctgatataagttctcctaaattatcctcaacaagcctcgtaatttacgttattaatttttctgttgcagagctgtggctagggctccgtaccaagttaaccaaaacgcaggtcatcatcgttatcctcccaagccagagattgtaaccggtcaaccactagaggcaggacagtcgtcacaaagaccgccggataacgccattggtcaaaccatggcccatatcaaatcagacggtgataaagatgatattatgaagattgaagaaggccaaagttcgaaagatctcgatctaaggctatagtaatatttgctaaatttcttgtaggaactgagtttttagattaacgtttcgatttttctgacttatctaagtgattttattttgctttgtactacagtatgtaatcttattctaacttgaatattcattcataaacacaatagacgatagtaaagttatattataattagttaactacgtacaacacttgggagttaaattacataacgttaagcgagaaatagcaaattagacaagaggaagaatatttaggagttgtgaattgatctgactgcaataacatgaagaggaatctgactgcaatcgtaatgcgggtaaagatggttgaaagtgatcagagctcctttctaatttatttagggtgtaatttatgaaaatgattattattggagtgtatatcaagttttcactaaactcaggggtgtttattgtaattagttgtcaggttcaagttcattgaaggcgtgtctgatttggacagtgattgggcctgagccataagtttaacgtgggacgagttcattggctgttgctttttaaattttcttacagcctgtgactttagctaatcgatgtgtaaaaataataaatccaataaaattcgtaagagccactcgattgcttccttcgctttctatcaagagacttccttttttttttcctgttcttcattttttttttgttattaatattttgtcatttttcttacatttttctcgaacaccgaaaacactttcgaaccctaaaagacagaacactgtgtcaattttcattacctgggaacgaaaagcaaaatcaaagacaataattttttccccgagagagaaaatg

SEQ ID NO: 16574 - DNA, 3003 bp, Unknown
  misc_feature (1)..( 3003): 2750-1469P.txt file - cDNA_ID_1567581; gDNA_ID_2926301; Annot_ID_205716
gtcttttacgaatttgtgacatacgccgtttaataacgtttgccgtcggttctgaaatctttattctttttctcttttatcgttacgcgtaaggaaaacgtgcggtaaattctaaccgaaaatatatataaaaaagtagtccaattttgaaatctggccgttgatggtagacaactaaactgtgccaaacaagaaacaagaggtgaacatatttttatgataagacagggcaataaatttgttgtaccaactcataaaacaatagataaattacttgcacaatgatggattattaacattaattttcttactattaatcatggatgaaaattcctttcttcacactagatatagttctttaactagttaaaaatgcatgcgatggaatattactaaatatgatataatctcatggctttatgtaagatttgttttttggtttttttggttgttgttaataaatttattattgagaagtttaattctattttggtcacaatatattgaaatatttttaagaaactaaaaagttcctatttatttttgttttcattaatttatgagaggctattaaagtcacagaaacttattgggtgaatgagtttataaacacatgagctattgagctagtagcctcttgtactcttccattttacgcgcaatccacgcaccaacaaaaagaaaagaaaagaagagataaagaatatctttaaaaagtaagtgtggagaattctttcttctcaataaacaacaacatgtcgtcgagcaatgaaaatgctaaggcacaagcgccggagaaatctgactttacccggagatgtagtttgctcagccgttacttgaaggagaagggtagtttcggaaacattgatcttggcttataccgaaaacccgattccagtctcgcgttgcccggaaaattcgatccaccaggtacttttattatctctttcttctttcatggccgccacttggtaatagtactttaaaaactcagttctgttactacttgcttttgccagatttactacttttgtattgtttcttcatttgtaagtcagttccttacttcagaaataatttctccttgtaattatgaagacaagtaacaaaaataacgaataagttgatatagaaattgattgagatgtggttaataaaattccaaagatataagatgctatatcatttttctaaagttattatagttcacgaaagtttttattctctttatgcagggaaacaaaatgcgatgcataaggcagggcattccaaaggcgaaccctctacctcatcaggaggcaaagtcaaagatgttgctgacctcaggtctctccttttgttccttgggaatacttgttgtttttggttattggagattagagaaaaggataatcggttaatccggttaaaattggttttgttctgaaatctgtttttggtttgcagtgaatcacagccaggaagttcgcagctgaccatattcttcggagggaaagttttagtatataatgagttccccgtagacaaagctaaagagattatggaagtagcaaaacaagccaagcctgtgactgagattaacattcagacaccaatcaatgacgaaaacaacaacaacaagagcagcatggttcttcctgatctcaatgagcctactgataataatcacctaacaaaggaacaacaacagcaacaagaacaaaatcagatcgtggaacgtatagcacgtagagcttccctccatcgattctttgctaaacggaaagacaggtatttaaccttatcatactttttgaaacttgttttaatgttccaaatttccaatcactctagttagttcaaaactcaaaagtttaaggatcctccctctgatataagttctcctaaattatcctcaacaagcctcgtaatttacgttattaatttttctgttgcagagctgtggctagggctccgtaccaagttaaccaaaacgcaggtcatcatcgttatcctcccaagccagagattgtaaccggtcaaccactagaggcaggacagtcgtcacaaagaccgccggataacgccattggtcaaaccatggcccatatcaaatcagacggtgataaagatgatattatgaagattgaagaaggccaaagttcgaaagatctcgatctaaggctatagtaatatttgctaaatttcttgtaggaactgagtttttagattaacgtttcgatttttctgacttatctaagtgattttattttgctttgtactacagtatgtaatcttattctaacttgaatattcattcataaacacaatagacgatagtaaagttatattataattagttaactacgtacaacacttgggagttaaattacataacgttaagcgagaaatagcaaattagacaagaggaagaatatttaggagttgtgaattgatctgactgcaataacatgaagaggaatctgactgcaatcgtaatgcgggtaaagatggttgaaagtgatcagagctcctttctaatttatttagggtgtaatttatgaaaatgattattattggagtgtatatcaagttttcactaaactcaggggtgtttattgtaattagttgtcaggttcaagttcattgaaggcgtgtctgatttggacagtgattgggcctgagccataagtttaacgtgggacgagttcattggctgttgctttttaaattttcttacagcctgtgactttagctaatcgatgtgtaaaaataataaatccaataaaattcgtaagagccactcgattgcttccttcgctttctatcaagagacttccttttttttttcctgttcttcattttttttttgttattaatattttgtcatttttcttacatttttctcgaacaccgaaaacactttcgaaccctaaaagacagaacactgtgtcaattttcattacctgggaacgaaaagcaaaatcaaagacaataattttttccccgagagagaaaatg

SEQ ID NO: 16575 - DNA, 3000 bp, Unknown; identical to SEQ ID NO: 9130
  misc_feature (1)..( 3000): 2750-1469P.txt file - cDNA_ID_1567735; gDNA_ID_1972003; Annot_ID_177783

SEQ ID NO: 16576 - DNA, 3000 bp, Unknown
  misc_feature (1)..( 3000): 2750-1469P.txt file - cDNA_ID_1567824; gDNA_ID_1620800; Annot_ID_168611
cagatttctgacatcaatgtctgtgtcccgtaggacaaccatctccgccatctcttctgcttttgcttgtcgccactgagaaagctccttagaagcaagttcctcagctgtcatattacataatctctctggagatatctttccggacatgacactttctcttagctcaggattgttcttatccttcaaattgaataagagagaccttcccttctctttgtacttcttgttcacacctccaaatagcttaaaaagttccaactcaattttagatgccaagagctctggatcctcaaacgacttttgagtttcattctccccaaaatctgaaacaggttccaaaacccatgagaggccattaccctgtaaaagttcatcgccagtaaaaatactatcactaaaacgaacatcatcacaggggaaaacctcgtcaaattgagttttctgtacatcagattgattaacataattcatcttggtgtccttggaactctcttgcgacaaagttcttccattgccgttcttctgctcaaaactttcatcccttgtggacattgctggcgtgatgtcttcacctactgtaacactggtaccacaggctgacgcaggctcattactatcagctactggaacacttgcttcttcagtttctgaattctttttctctttcggagactcctcatgctcgtgaaccaaagccaaggcagctgctaatgattccttcattttagacctcaaagactcgttaccatcattcagtgttttcaccgacccttgtgacaagcctgcttgtttcttgttcatcacttgcttcccagatttttgggaagcaggttccatttgccttactttcttagcaggcgttggtagatgttctgtcttggtagaaagagtagcaggtggtggcatatgaccccgctgaatacattctgaataaaattgttctagccatggtctgtggtgcactggctctactcgcttgttagatgcatctaacttctcggaagtagcagaaccactgagagtagactctggtggcgatttccgcttccctgtcactgagttactacatgcagctactgacctctctacagaatatggaagttgcaactgaggcatcaaagactgagtatcaaccaacatagatgattgaaaagagacagcctctggctcaaattggaatgacaaaggaccagagacagatatttccataggctcttgctcaatctctgaaactgagatatgctgaagagaaggaggatcatttgatccaactaactccatcaaattcgtttctccaaaagcatctgaatccgctttcacagtctccagatcaataagctctgttcccatattactggacatgatacgaaaccaccacagctatatccaaacattcacttcaacagctctgagaaaaaaaaaacagaaactttgattcaatcctataacatactccgatcaacacacatctccattttcatcatttccgattaggggaaaaacaaaatcaaaattcaaaattaaacaaaacccatttctaagaagattcaacaacaaccaaatcaaaaaatatacaccaacataaaccaaataaaatccgaaattgactgaagaaaaaaagctcgatctagcgaaaaaataaacatggcgaccatgaaaagtttacctgattaacaacaaaaagatacacaatttcactgcaaaatcaatcggagaagatatgtgcgaaaggaagaagaaaccctaaaaagcttctgaatttggggatagagtttgttttgttgcgaaaaagatttcagctggttcggtgacgaaaacagtttcttctagagattagtggaggatactcttgtgaattgtgataaggccaaaatcataaatgggctttaataataggctcataataataaatgggccttagcgaaccaaattacttaggattcctctctcagacaaatccaacggttggatttacgtgtcaacgtctcatcaaacggacgttaataatttgcatgcgagatgttttctaatttttatattatcggaaataaaactgaaacgaaaacgctgtcttttcgagacaaaaaggaaaaaaacaaaattaaaattaggaaagttaaaataattttcctgcaaatttcttctttctcagaaatctaaaaaaaaacaatgaagaaaacaccgtaacgaatcataaaatttctcaaaatccaaactctgttttttgttcttcctcttccagatttggtttctttttttgaaaaactctctagcttcagttttttttttctctctctctctctctctaggaatgtttttgttcgtggatactggaatcatgagaataagattttgaaggagaaagcaaggtaatgattagggttttcaagtattgggtattataaaagtgtcaaccttttttttttctctgcttcttcttcggatctaaacccacattacacgtttctctgtttttttttaatgtcagatccatgttctttgtcggagaatttagggctaatatgtggatttgagcttctttgattcccaatttgtgaaagttttgaaatttttgggaaagagagaatgtttaagcagtttctgagtaaacttccgaggaagtcttcaaaatctgattcaggagagctgaatcgttcgagttcgggtccggtatcgtctccggttcagagatccggtactagtggtggtggttcgggtccggttcgatctaactcagggaagcgtatgtcatctgctgtgttcccagctagtgttgttgctggtattgagcctttggtaccgtttaaggatgtaccaagctctgagaagttgaatctctttgtgagtaaagttagtctctgttgtgtgacatttgatttctctgaccctggtaaaaactctatagagaaagatgttaaaaggcagacattgttggagcttttggattttgtagcttcagggtctgttaagttcactgagccagctattcttgcaatg

SEQ ID NO: 16577 - DNA, 739 bp, Unknown; identical to SEQ ID NO: 314
  misc_feature (1)..( 739): 2750-1469P.txt file - cDNA_ID_1568384; gDNA_ID_1563707; Annot_ID_148160
  misc_feature (310)..(310): n is a, c, g, or t

SEQ ID NO: 16578 - DNA, 3003 bp, Unknown
  misc_feature (1)..( 3003): 2750-1469P.txt file - cDNA_ID_1568553; gDNA_ID_1620626; Annot_ID_47147
tatggttatcttaatttgtttacaaaatatggttattcagttaaatcaccctatactatattgtccctctacaaaaattaggtattttcttaaatcttgactttgggggagttggatattttcgacgaagaatatcaaaaatctaaaaagacatgttttggatatgtaaaacaaaatttagaaaagtatcttatatataaggtatgttatctccaaaaaaatgtaatagtagatttgcatttctagtcaatatgttgatattaaacaccaataaaatagtcaatgcactaattaagttgccattttcatgcatcaaaacacactatttaaatattgccatccaccataagattttaaaataaagaaaacattcaaaacatcacgttcttagaacttaaaactaaattgacaaacacaaaatttcaagctagggatatgtcggcatcaaaagcaacaatgctcattttgttcgctctctttctttccggtaagtcttgattcctctcatcttcttttatataaatgaaactgattagaaacatagcttgattccagtcaaattttattttaaaaatgaacagacatattgttggtgagcattcctagagctgaagctcagttgatagttccatgcaagacatcagaacaatgtaaatcgattcgatgttctaatggaagcgcacaatgtgtgaacaaacaatgccaatgtccaagcctcaaacagatttactcggtgacggatgtgtcgtgcaagacggtctctgattgtgttgcttctcatcaatgcccgactggtttatctgcttgtattgaaggaaaatgtatttgtttgccttagtatgttcaaattatattatttaatatatacctacaagttaatttttaaaaagtttagttttatagatattaatttgaattcgtttactatggggaactctatcgacataaaaaagaaatctaatcgtagtcaacaaggccagagtatatgttggtaacgtactctatttactttctaatattacacaatcgactactacgtgatataaaagagacatctctacaatgataatgtgaaatattcattgttgatactttacgaaaaaaccatagtttcgacatttatattaattatgtatatattcatcaaagttatgttaaccaacataaatttcagttacaatcaaattttttgttgtaatatctaaggctgggtaaaatacccggacccgaagatccgaactagctcaaaatatctagatgaaaaatactaggctttttcttttgaaaaactaaatcagcgaatgagattaaccaatgctaccgacggctaacttatcgataacatttttcttctcttatctcgatgaaagatgatctctcgaaaccaaatacacaagacttcataatctagtccgtatacgccaaaaaatgaacctcataaaacacttcttgatgcggcgaaaacaattgatgcataatggagcgcctataaaatccttataaaagaatctaatctcaatcagtttcggaaatttggagacaagaagcgaaagctaaccatcttgataaacatcaggaacaagaatgacacttgatcgaccaggttagcatccacaaatggggctttgttagcttaggtaagacaacaaagagtgagtgcgaagacaaaggttggatgaaggctaacgagaaaccactttcaagctaagcctgtggcatcgaaactatagggagcacctaagcgataactagatttgggttgggagaaggcaaatatcaatggctttattattgactaagcacactgtcgatctagcaaatccggcaaatcctcattgcatgagccacaaaacgaatagatatgaaacgcttgaccgctttcgcatagaacacaacttcacaacccaaaataacaagagaaaatctccagacgaatacaaaaaaaacaaaaaaaactctgcatctcctatgatttaaaaccaagaaactaaagcagataagaaaaggagaagccactcacgacattgacgagaatcgctgatcacagcaccagagtgacttcccagccacaaaactggaaatgagctaggattctactgttgtttgagtgaaagagcacacactttggttaaaatgacattagatcatcgttctaaccacctgccattgctcttttaattatataattaaatttgatttttataaaactacaaaatctcttgtaattttcaaatttattacctttttaatccaaagcgatccaaaaataaatgtaaattgaagaatagcaccaaaaattgataaaattataataatttcgtaatttaaccaaattatcaccataatcactttggtaatttctaaaaattactttaacttcgataacataattactaacatacaaattaaaatcaaattttgtaaagagtatcaatcttccattacaactttagacttcaaccattaccatacaaccaaatgaaactgaactatttgtatataaaaattattctattttggttccaatataaataaaatatctagtttacattttttctgtgtttcttctaattatatagatttagttctataaaaatacaaaacctctaagtaattttcaaatttattatatttttacccaaaacaaccctaaaataaatgcaaattgaagcgtggcactgaaaataaaataaaaatatcttaccatatttaaaacaaataaccagattcagtgaattaacagaaacggatggtcaagtcgacaagacaaacaagtgctaaaagaacacaacataactcttttgcttaagcctcaaaaaattgtcattaacccaatttcccagaaacttcaaaaacagttgggggaagaagaagaagatgaaacgacgaagaacccttttataaagtctcaatcttctaatccaagatctgccctttttcagattctatctcaaagctttcctcgatcttgtgatgtattgaagccggagactgagagagatg

SEQ ID NO: 16579 - DNA, 3003 bp, Unknown; identical to SEQ ID NO: 16578
  misc_feature (1)..( 3003): 2750-1469P.txt file - cDNA_ID_1568553; gDNA_ID_2214651; Annot_ID_136419

SEQ ID NO: 16580 - DNA, 950 bp, Unknown; identical to SEQ ID NO: 414
  misc_feature (1)..( 950): 2750-1469P.txt file - cDNA_ID_1568887; gDNA_ID_1590844; Annot_ID_150148
  misc_feature (1)..(1): n is a, c, g, or t

SEQ ID NO: 16581 - DNA, 3003 bp, Unknown
  misc_feature (1)..( 3003): 2750-1469P.txt file - cDNA_ID_1569164; gDNA_ID_2926056; Annot_ID_196142
tttttccctttattttattttttgttgtttttttggtttgaggaattataaagtacacacagtaacggctcatcccgtcaaataagggaacacgtgtcataatcgtagtcgacacgctcgacccaactcagactcgcacgcgctttattcactttcttttcaaccgtcagatcttaaaataagtgttgagctaatcgtgatcgttgattacttcgactttgttaacttttttgtttttttgctctttatttataacctctcgtcacgctcttcttctgcgaccatcattacttctcgtgttcaacggtcaaacttcacgttctcaagacactacttaacttttgttttcgtatgctaatgactactattaattgtttttttagtagtattagatttaaagtttgaaaaagattaatagcagttacgtttgagacagatttaaattaattccccaccagttgaaagaatctacgcattacgcatatgcttggtttttaatatgtttttgttggttcttaaatgtttgatggcataatatatctttcatttaatatatattgatgaacattaatgcaccttatctaccaatttgatgataatgtagggaaaaaatagcatcataatagataatgataatatctgacctttttcattggaccgtcttgtgtatcaaattaaaattattaacttgcttttacttaaaagcccataataacaatatttttttggatccgaatattaatgaaaagcccatatctaagttttatgggccaaaacgtataaatcgaataaataaataggaaaaaaattgagtattattacttttttttttcttttttttttacgacagtattattacaaaaacacttagaaaagaaagtgccacatttaaatggggtttgttcctttttctccaaccgaaaacacaatgataatgcttaaaccaaacagtagtacaactctttccatgtttgactccagatcttatgatcaattgctaatccatgtttcggttatttttttgatagatcctgacacggctttttaattataaatttaaattccatacaacatttatataaatcatgattaagtacttacgtcagattatgtaataattagtacgttcatatagtgccgggaggtttattagtaccatttttactctctctctttttcttcaattacacatttactttaaagtcgattatttgattggatgctaagttttagaaaataatgtcaaaaattctggttctcgagaggctacaaaattttaactctcctctctttttttttattaccgtattttctgtaaccatcatatctcccacccatagtgacttttttacatgggactatcaattttacttacaaaagttactggtttacaacggcgaccatggtttgaattcagataaagataaagaaggaaatgcagagaggtggggacaaattacaagaaggaaatgaaaaataagatgtgaaaggtggaaatgagaagtcgctattaaactttgtagtaatctctctcagattcaggcttcgtttcgcttgttaccaatggcttctttcacatctttccctctcgtgatttacttatatcttatctttatatgtctgtcttgactcttgatcatgcattcaatacaaataacatccaaaatattacttgtgtgtttctctttcttttccaataactaacatggagtactaataatattcagattttaacataaatagtactccctctgtttcataatataaattattttggaccaattttttgtttcacaatataaattgttttcaagtttctatgtaaattatatattattttattactttatgattatatatattaatatgcagtatcttttatgattggttgaactttttaatagtaaatattcttaatctgcgtgcttttatctaaaacaatttatattgtaaaacggagaaagtattaatttgatttgttctttctttcgttttcacttctttcatttgaataatatcctttgttgttttgttcaatctttcatttttgtattataacgaaactcaaaagaaggtattttgaccactaatgttgttgttaaagttttaaacatcctttttggataatttaatttttattgtaaaggcaagaaatacataaatatttaatctgctaatcgccttttttttcttgcctcgaatccgaattttaacatataaagaagcgagacaggttcgaattaaataatctctcttttaaagagatctttatagaatacataaaaaaaaatcaaactatttatagaaaaaataaaataaaaacgaatttttgctttcaatttatgtacattggaccacagaatctgcaaagctatgtatgtatcaagaaagacgtgactataataaataccacgaacaataaataattagattcttattacgaatcttttatgtattcccctaaaaaaaaccatgtcataattagtctcattaaaatacgattgtatgtaaaaaaaatcataccgtatgtagaaatatggacttcattctgtaaataaaagaaaaattaacgtgtcaagatctttgttaatcagtaattaaaatctaaaatgacttaactcaatccgcaacacataggactgggagcgtaatcatcacgatccgatcgggacatatgtttgtctccatcgtacggatagggtatatgagcgtgtttttcacgcgcatcattcgcgtgaactaagaatgctaatgaattcgttaattcgttaaaataaaataaaataaattatattagaaattaaaagaaaagaaagaaagaaaaaaaaaaaagacaaggcgtgagataataaaaccctttggctttctcatagagatttgtccggtctcttgttcctctttctcctttcttcactgtagaatccgtcgaccaaacaactagctccaatggcataatgagcattgtagtttgcaatttcttcttccgtgaagaagaagaagatg

SEQ ID NO: 16582 - DNA, 3003 bp, Unknown
  misc_feature (1)..( 3003): 2750-1469P.txt file - cDNA_ID_1569187; gDNA_ID_2936587; Annot_ID_195130
tctccaagaggaggtaacttatcagtcttggaaacactagatacccatggttttctcctcccgactatgtcaagggcccagcgacgagcagtggttactaactccgcaggtggcaccacagcatcaataagacccaaagaatgaccttcctcagctttaactggcttagatgtctatatgtttcaacaaaagagatgctattacactttaaccaaggcacgctaatgctaccataagaataaggcactgacataccaaaatcatttcaagggctttggtgagaccaacaagacgcgggagacgctgcgttcctacatcaatccaaaggagtataattagcattataaacgaaagtgacttgactcattcaacaaaaaaaatgaaacgaagatcctcttcccatcctcagctcagtattatgcattgagaatgccttgacttctccacgagttttaaaccatatattgatcagagaattcaaggacttcacagtcagcgaagttgaatagatacctccaaaaccaggaataacaccaagttgcagctcaggcaagcctaactgtgcagcaggagctgatatcctagcatgacaagcctggaaacaaaccatacaactgtatcaccatccttcctcctcaaaaggatttctcgtgaaggtaataaataacatagaaactcataccatagcaagttctaatcctcctcccaaggcaagtccatcaatggcagcgacagacggtttcctagcagctaaatccaaggaaagaaatcaaatccctcagcaacacaacttacacaagtattccataaatcaaataaagtgggtttaagtagaaagatcaccttcaagcaagtcggttatgatgtcaatcgaaatgtaaccagcctttggctctttgactgagaaaattcataacaccagtatacgttactaactagatcaacacataccacactgattcaataaccaaagatacaaaagagacagaaacataccattccccttctgcatttcaccaaaaccagatatatcaaagccaccagagaacctcccctttgcacctgtagttaaataaaaaggaacacaaaagccattaccagatcatctccaaagttttcataaaaaatgttgtgtttttagcgaggaagagaatgatctccagaaataccagtaataacaatagctttaacatcattcctgctcaaggcctcctcgtaattacttttgagattgtatagcactgtacacaaatatccaaaaacagagtcacatacaaagaaaattcacataaacagatcataaattcgatcggaagctcaattacaatcggcgatatttacaaaaccaaatcacgaagcgaaattgacctaaatctgaagaggtaaaatccagtaaattccggatcataaaaataaaatgaatctgagagtacgtaccgtcgaaggatagagaattgacgggaggattgatgagtgttatgacggcaacgccatcgccaccaacttccatcaccgtcttccccttggttcgtgaatccattttcgagcttcgttgagattttgcgagtcaaaattttcggaattaatgaaaaagagaggagacgtgagaaatcagatgattatataattgcaaaagatgatgacgtcagtgataatatggtagagtggcacactcctcaaagcaacggtactttgataatgttttcgatatgtgaatttttatttgttattcgtatccaatttatgtataagttgaattaatcacgaattaggaacaaaatatttgcatttaaactctgcggatttattactaataaatatgtttggctggtcatagtcctgcgactaccaaacttggcggatcttatcttgatactacggatttgtaactaagcgaccctatataggattttacagttgtaaataaactttactagaaagagtatctctttttttttttaacattattagttttttttttttgcgatttatttatgacatataatcgatcatgctgaatattatatcttgtaatatatgttaattctaccatgacatccgttttttgtttaatcagattaaaaaacaaatgtaaatgcaatcaatagttttagacaagtattcaaaccataacttgttttttattctctctatttatggtccggtgaaatatcttttcacatgactaagtatcaactttcatacagttaaccataacagtaataaaacgtctaaaacttaagacttcactaacaatgatggatttgcttaaaacttaaaggacgtaaacgaatatcttccaagatcaaagacggttggcaaaactcaaaagacaaaagacgtaagttagatgtaattttgggttggtaggtagctcactttccaaagataatgttaggcgtttagtgatgaaatagattgtattttggaagtagcctcacattcacatctctaacttgtttgttcatttttaattgttcaaacttcaaagtgtaacaaagaataatcaagtgcaatcttatgttggttaaggttatctttcttgctttaatgaattctgtctatgagaaaagtgtgtccactttgtaagtctggccttttggcatttttcttttcggctttagtggatctgcttgtaaaaggctttttttgaagtcgatatatatagcccaccatctgaaggaaaaaaaaaaagtgatgtacatgaggatacgcgtgtaccgttgatcctctccgtgatattgctgatgtggcatagataagccaatccgatagttttttttctctttttcttttggtactaatccaaatagttattaatactaatcagtaccttagtcttaatccggatactcgaacagaaacaaacacacgggtacgtaacatttatctttttaagctctcttcttagaaacatcttccatcaactcaatctgtttgtctatttcttctcccttgtactgttttttgttttttaccaaagaccaaccgttcataacaatg

SEQ ID NO: 16583 - DNA, 3003 bp, Unknown; identical to SEQ ID NO: 16582
  misc_feature (1)..( 3003): 2750-1469P.txt file - cDNA_ID_1569187; gDNA_ID_2936587; Annot_ID_143874

SEQ ID NO: 16584 - DNA, 3000 bp, Unknown; identical to SEQ ID NO: 13783
  misc_feature (1)..( 3000): 2750-1469P.txt file - cDNA_ID_1569191; gDNA_ID_2214651; Annot_ID_188645

SEQ ID NO: 16585 - DNA, 3000 bp, Unknown; identical to SEQ ID NO: 13783
  misc_feature (1)..( 3000): 2750-1469P.txt file - cDNA_ID_1569191; gDNA_ID_2214651; Annot_ID_136428

SEQ ID NO: 16586 - DNA, 3003 bp, Unknown
  misc_feature (1)..( 3003): 2750-1469P.txt file - cDNA_ID_1570116; gDNA_ID_2214570; Annot_ID_135048
taaacagtggacgtggcaccttaagttttgtatcggatttcagttccatggtcttctctaggatgtttctcgctgagagatatgttgcacccatcttctgagtggtacctccagcctcgccttcttgtacatttcctgtgatgtaatctaacagctttgttttaccagtatcgatatgacccatcatacagcaaatgggagaacggactttgtcttcctcggagagcttattacgtctagagtgttcatcgccaacaatttgctgcttatcatctccacctcgagcactcggcttcttcagatccattgctaaacaatcgaataagctttaccttatatgggagatgacttgatcgacaaggttgagacagaaaacgagaattagctatgattttttctttgtgaaacttcctatacggtggagcaaacacgttgtgtagatatataccgattctaagtatgtaacgatgctgcttaaataatttctagaccatgcaagatataattgttttttctcggattaagattcatttacataaatgattttaaatggaatgaaatctactatatattaaaaggtaaatttttgtaaatctttaattattattcatatccaatgccattaatgtttttatataatacattttaaagatttttctaacttacttaaaaggataaaaaataaaaaagattacacatatagacacaatctagctactgcaaaaaagatttttttaaaaagcataaatctactttatttactaattataaatttaatttgtttcacttttattagtgataacaagattaattgttttgtttacacaaacaatattgttttatgatttcacttatatgaacattattatcaagagttataaagtttgcaaaagaaataggtttttattgactgaagaattgagaaattttctcatcacctttaaaattaatattgggcctagcgatgaaccgggccaacgcccattaaacatatccgataatagtttaaacccggagagactcaaagtagagaaaaccctaattgtatataaactaaaaatacttccttaattcttcacttcttcatcgccgtctgcacaaaaccctaatctcacaatctcctacgagatctatcagtctccacggtaaacgacactaatccatttcaatttctccatcgtcttctccgatcaaattctccatttacttatctgttcactatttttccagaagatgaaggttgttgccgcatacttgctcgctgttttgagcggaaaagcttcaccaaccagtgccgatatcaagactatccttggatcaggttcgttttgatgaatcgcaatcgatttcattacaatatgattagattcgttgtttgagtcgctggagaattcgatttgaaatctttattagatagttgagaacttgcttaagctgaaatgatatgtatattagggatttttatggttcctatcgacttaaacggtgtttatgatagtcgagatgcgtaagtattgttaagagtaatgatttagtgaacaatgggatacaataatgagtttgggatgattgatggaatgtggcattgttgtttttgtttggtgttgcagttggtgctgagacagaggattctcagattgagcttttgttgaaggaagtgaaaggaaaagatttggctgagttgattgctgctggaagggagaagttagcttcagtgccgtctggtggcggaggtggtgttgcggttgcttctgctacatctggaggtggaggaggtggtggtgcttctgctgctgagtccaagaaagaagagaagaaggaagaaaaggaagaatccgatgatgtaagtttactttccttctaacaaaagtcttgatcttaatagtagcttgaaatttaacctaaaaatgatggctcacttgtgtgtgtttttgtttttaatttgcaggacatgggtttcagtctattcgagtaagctggtagtagcatgaaaagtccggttttgttgtcctcttttaatattgtaaccttttgaaatctatatgttgttgttgtttagtttgtattcgatcatcttttttagacattgctgaaattctcaagagtttttgacccgaatgtcatttgcactttgttgttagcatttctgcttctatctcaatcgcctttgtcactctggagtttttagtagccaacaaaagcattggtcctagtcatggtcttaaatcttgactcgaatggtgatgagatacctctagccttgactttgctaatgatacgttgtcgttcatttggaacctagattcagattcggcttacgtatgacttcaagaatagtattattgtaagaaaaggataaaaaaaaaattctagtcttgaattgttcccccttcaatgccgtccaatatgtaaatacatcataattcgtatgagaaaataactagactatgctaaaactttgacaccacaaatttattagtaacttgcaaaacatatcacttgtcaactacatataccgagaaatgccatacgcaggcgatgtttcggaaacaacaggtgtagagttgaagctacttttgatgtcatcgaccaagaaggtgctatagaagacgaggttagaggtgaaatcccatccatcaaacaaaataaaactagagaattgtataatctggtcgttctcttctcaacatcaatattacccgtcaatcgaaatattgagcccatataaatatgggcttgaaagaactgggcctaaataaaattttaaattcggagatacattgataagattaaaaaccctaagcgtatataaatcatatagttttcattttttcgtacttcttctccatcgccgtctaaaaaccctaatctcactccgcctcctgcgagatccatcaacacttccgcagtaagcgcctccatttccatttctctctccttcttctcctacgtaatcgtactatgtttgatttttgatctgtttttgtttttcttcagaaaatg

SEQ ID NO: 16587 - DNA, 3003 bp, Unknown
  misc_feature (1)..( 3003): 2750-1469P.txt file - cDNA_ID_1570138; gDNA_ID_1621201; Annot_ID_57657
ggcggcagtggtgtggatcttgttttgagttgtgtcgataactatgaagcaaggatggctgtcaaccaggtagctgttacttctttctcgaaaaggcttttttgttacaaattccacagttcttacttcaccatcgagcatttttgatcttacattctacataattcaattagttgggaatggaaaatatataaaatattctagattggctctgatttgagtttattcttatgaaatataggcatgcaatgagttacgtcaaacatggatggagtcaggtaaatagtatgctaataattatatgtacttctttttttcatttctcttttggctaacaaaaaaggtgatattttgtgcaggtgtatccgaagatgctgtttcaggtcacatacagctcttggttcccggagaaactgcttgttttgcttgtgcacctcccctggtatgtttttttccttcttatatcactcttacaactctaacctataatgccctgcattaattagtgcttgaggaatgtatcagtggaatatgggtggttttaaggattctgtgatccagggtattgttaatactactttttggattttctctaagcaatctctttactctgtggtaggtcgtggcatctggaattgatgaacggacacttaaacgggaaggggtctgtgctgcatctctgccaactactatggtaaatttcataccaccttacaatacagttcaaaatttggctatgttgactatttatcaagttttctgctattgcttttgtttatttaagcgctatctatatattttaagactcttgtttgattgtcaattcagggtgttgttgcggggcttttggttcaaaactctctcaagttcttactaaattttggtgaagtttctccatacttggtataggctttgcttcctccagctctcctcacagttaacactttatagtttatcacagaatgattataatttgaatcagttaaagcttactagttttatgcccgttacttgatcccacagggttataattcactgaaggattttttcccaaccatgaaaatgagaccaaatccacaatgctcgaatgtagcttgtctagagcggcaggtaacctgattaaatgcaaccacaaaactatctcagcttgtctttgttttgcgccttttgtttccatccatgttctggtgaaaaagttgaaatcccaaaatgcagaaagaatatatgcttgcaaaaccagaaagggatgctgctgctaaagctaagatggaagctgatgcatccacaactatcgatgaaggtccactccatgatgataatgagtggaacataaggtaataactcagtgaattagttaaaaatcaaaatttgtatttttgttatcatattttctcctttccagccatatttgcaacaagaaatctgatgtgtatctcatgtctttttatcagtgttgtcgatgatgaaaatgagaaggatactacaaaagctgcctcaagttcaggttacttaaacttgggactctatgtgctatccatgtgaaaatgtatcaaatataagtcctgttcttctgactgttatctaaattgatcctgtgttatgtgtagatacattacccgaagggcttactcgggagcttccagttgcagatgagtatgagaaagcaatagccatagcctcagggtcaggagaaacagaggaggaagatgaccttgaagatctgaagaaacagctcgaagctctcaacgctgcttgagtctttatgagggagaaaaaatagttgttttagcatatttatacatgaaagaggctacaagtgcaattgtgtatgcaaaaagagtgtgttaggattggtaaattggatctcatggacatataaacgtttttgatgatgacttctcccgtttttttagttgttaccaaagacaaaaagatacaattttgaagatgtttcatggatttattgtcataatcatccgaactagaacttagaaattcaaattagaaaaagattttgtccaatgatgatgatccaagtttggtttgtaatgtgtaaaccagcttttttggaggtaagatattaattgcgcggggaaatcaactagatgacgtgtgaatcgcgaattacaattacgtttttggatggagaactgtcttttttttcctttttatatccctaaaatacttttttgtacattcatttatatcaggaaaaacagagttgtaaccaaattattacagagatattcaaagatatttcaacctatcaactaaagatgacgtgtatattgagaatggcaattgcgtttatgagtgggaaaccaaattatttcattaacatgatctttaggaataccgctaataagagattactaatcactatttgaggttttaatttaaatctttgtagtcctgattttgaatatttcgttttagctaaatcagctccaatttttcccagttatcgtttgtcgaattcatattactgttaatttagttaacttccgaagactattagtacatgattcttcaacaaagcaaataaagaaaagaatcttgatgtcgttctctcaacaattcaacaaaacttggtctcgacgactcgaccgtgtgagatgtttgagaagtcagaacaccacacgtgtcgacataaagcccgcaccacgcacgcttttcgtctggatatatccaaattactttacagaaatcatttgtattgtttgttaataaaaactttgaaccactttgattactatattatttttttggaatttattctggtgacattaatgttctatcctccacgcggttctcataaaccgacttggcttctttatttttcctttatctttctctatatatttacacacacacgcatttgtgcagagatattcaaagattagaaacattcttgatagatacaaaaaacatttttcagacacaaaatcataaaatctttgcctttagtagatcaaagttctttacattaatcgttagaagatg

SEQ ID NO: 16588 - DNA, 3003 bp, Unknown; identical to SEQ ID NO: 16587
  misc_feature (1)..( 3003): 2750-1469P.txt file - cDNA_ID_1570138; gDNA_ID_1621201; Annot_ID_174902

SEQ ID NO: 16589 - DNA, 3000 bp, Unknown; identical to SEQ ID NO: 221
  misc_feature (1)..( 3000): 2750-1469P.txt file - cDNA_ID_1570138; gDNA_ID_30942; Annot_ID_146843

SEQ ID NO: 16590 - DNA, 3000 bp, Unknown; identical to SEQ ID NO: 14171
  misc_feature (1)..( 3000): 2750-1469P.txt file - cDNA_ID_1570474; gDNA_ID_2214704; Annot_ID_136939

SEQ ID NO: 16591 - DNA, 3000 bp, Unknown; identical to SEQ ID NO: 14171
  misc_feature (1)..( 3000): 2750-1469P.txt file - cDNA_ID_1570474; gDNA_ID_2214704; Annot_ID_189790

SEQ ID NO: 16592 - DNA, 3003 bp, Unknown
  misc_feature (1)..( 3003): 2750-1469P.txt file - cDNA_ID_1570595; gDNA_ID_1620627; Annot_ID_47167
cagctcaacaagaatggataattgtactggagaaaatcccatggcttctcagttgaacattctccgatgcccgttcttgaggaacatcaatgagcccactaacctctctttctcttcatccttgccttttcccatccctgtaagtaaccgtctgttggttcactccatattgacatttcttatagattctgatcttgtctcatcatatatataggcaagagctgggaaaggacctatatttgaagatggtcccaattttgatacggcgtttaggcttttccatggccaagatggagttgtccctctctctgacaccgctcgaactgaagcccagaagcctgtgcctgtattccatccacttgctgctaaggcggccactattagtctctcatcctttggatctggagggccttttggatttgatgcattttctgacatgtttaaaaatcaaaagaagaagtcagattcatccaaaaataaggtaaaggttttatgagtttcttgctcaacatttatcttttaaaactgatgtgcataggtaaagaaatgtgtctaaggaaatagttaagcttctaagattgcttaagtagtatgcaatgtgttggcttatgagatagaaaatcatgatatttcttttctcttagagcaccgcttaattgttgtttctctttcagggaggaaaccacgaagccatgggcgacgaatggcttaaaacaggaaactgcccaatagcaaaatcatatcgagctgtaagtggtgtggcaccacttgtggcaaagatcctgcaaccccctccaggcatgaaatttaaatgccctcaagcaatagtcacagctcgagcagcgatatcaaaaacacctttcgccaagaacctccgtccacaacctttaccagctaaagtactagtgatcgggatgctgggcatggcgttaaatgtgcctttaggggtctggagagagcacactgaaaagttttcggcatcttggtttatagctcttcacgcagcggttccattcataggaatactgagaaagtcagtgttgatgcctaaaacagctatggtattcaccatagcagcatcagttttgggacaggtgattgggtcaagagcagagaggcggagactcaagtctgtagctgagaagaagttgacattggaggtaccaaatccgtcttctgttgaagcagatcagatgcaatttgccggagtttcatcagatggaagatgcggtgataaagtggtgatgaagtggaatcccatgatgcttgatgttgcaagccctgtgtcttccggagcagctactgttgtctgctaaaaggattttgtaattctcttcgaggatttatatatataattgtttttcttgtatttttttcggctgattgtatttaaaaagtttcttaatgtttgagaaaaacaagaataaagccattttttaaactgttaattgtattttaatgtaaaagacttgtttgattgaataaaaggaaagagaagttggaaatttggtgtttatgcatctcataggcaagttttcaaatatgaacaatgttaaatgagtcgttcaatagtgcttatgatatcgtggttgcaaaacatcagttatagagtggttgatggtgtagtgattaaacattgcatttcgtgatcacttgtttgggtccactcttgcatccttgctaaacctactccaaaattggtaaacctactctgaagtttgcagaactagtctaaaagattttcttaaaaggcaggccactagatagaagagaaatcacttacaagagtttcttaaacttttctttttaaagataagtgattatggaacattaaacttaagtttactctcataacctctattatcatcaaatctccttcttaaattttttttttttttttttgaaacaaatggattttattaaaaatacaaaaaaaattgtatatttggattacgtcaactcttacaattttgctagtctcatagaaagatgtcatacaatgcttgcatgtattgcttataacagtacgtgtgcttttgttatttcttttctagtattgtaattgcgtcgtacaagaaaacttataagatgcgtcggaattcgaaataaaacaaataaggttggaatgtatcacatgattttcatacgtttttacaatttctgataagtcccccttggtatgatggtatcgactttgttttcagaaagttgagtttgtttcttttccgaaaactaacgatgtcaaataatgtgaattcacaacatatataaaaaaatgataagaagagagcttaattttgagcgagtgttacaaattaattaaaaactgtgtctagtttaacacttaaaaaaattgcaatttaaatgataactacccctggattattttcataacaattttgtacatgaaagaatttaagataatatattattttaccaaattagaaaagctaaaaaaataagtactataatttgttgtatttagtgaaagaataaatgttgctgggaaaaaaagtgaaagaataaatgctttgggtatataccttatattaaaaacaaaacgaaaaaaaattaatgatatttgttaccatatatattatatacaatctataaacagaaattaagataatttatctgaaaagtgttttcaatgaggaaaataacaataaacagaaaaaatgaggtgtatgtacaaagatttgttaccaaatttaaagtattcaaacagaaagtacccatctgtttaggcaaaggattcgatcatcaaacgtcctacaatatcttgttttgcgatctcacccacaaatttatttcctataaattctcttcctctgtctgatctcttctattcaagcccacttcttttctctttctcttgtcttcgtggagttttcggatcttacacaacaatatctttgtcttactgtatttcttgtcctttttcttcttacctttctaacaattattaagaagagtaaagcttgaatttaaataaaaatgatg

SEQ ID NO: 16593 - DNA, 748 bp, Unknown
  misc_feature (1)..( 748): 2750-1469P.txt file - cDNA_ID_1570595; gDNA_ID_1620658; Annot_ID_163690
gaattcacaacatatataaaaaaatgataagaagagagcttaattttgagcgagtgttacaaattaattaaaaactgtgtctagtttaacacttaaaaaaattgcaatttaaatgataactacccctggattattttcataacaattttgtacatgaaagaatttaagataatatattattttaccaaattagaaaagctaaaaaaataagtactataatttgttgtatttagtgaaagaataaatgttgctgggaaaaaaagtgaaagaataaatgctttgggtatataccttatattaaaaacaaaacgaaaaaaaattaatgatatttgttaccatatatattatatacaatctataaacagaaattaagataatttatctgaaaagtgttttcaatgaggaaaataacaataaacagaaaaaatgaggtgtatgtacaaagatttgttaccaaatttaaagtattcaaacagaaagtacccatctgtttaggcaaaggattcgatcatcaaacgtcctacaatatcttgttttgcgatctcacccacaaatttatttcctataaattctcttcctctgtctgatctcttctattcaagcccacttcttttctctttctcttgtcttcgtggagttttcggatcttacacaacaatatctttgtcttactgtatttcttgtcctttttcttcttacctttctaacaattattaagaagagtaaagcttgaatttaaataaaaatg

SEQ ID NO: 16594 - DNA, 3003 bp, Unknown
  misc_feature (1)..( 3003): 2750-1469P.txt file - cDNA_ID_1570595; gDNA_ID_1620627; Annot_ID_162523
tttcagctcaacaagaatggataattgtactggagaaaatcccatggcttctcagttgaacattctccgatgcccgttcttgaggaacatcaatgagcccactaacctctctttctcttcatccttgccttttcccatccctgtaagtaaccgtctgttggttcactccatattgacatttcttatagattctgatcttgtctcatcatatatataggcaagagctgggaaaggacctatatttgaagatggtcccaattttgatacggcgtttaggcttttccatggccaagatggagttgtccctctctctgacaccgctcgaactgaagcccagaagcctgtgcctgtattccatccacttgctgctaaggcggccactattagtctctcatcctttggatctggagggccttttggatttgatgcattttctgacatgtttaaaaatcaaaagaagaagtcagattcatccaaaaataaggtaaaggttttatgagtttcttgctcaacatttatcttttaaaactgatgtgcataggtaaagaaatgtgtctaaggaaatagttaagcttctaagattgcttaagtagtatgcaatgtgttggcttatgagatagaaaatcatgatatttcttttctcttagagcaccgcttaattgttgtttctctttcagggaggaaaccacgaagccatgggcgacgaatggcttaaaacaggaaactgcccaatagcaaaatcatatcgagctgtaagtggtgtggcaccacttgtggcaaagatcctgcaaccccctccaggcatgaaatttaaatgccctcaagcaatagtcacagctcgagcagcgatatcaaaaacacctttcgccaagaacctccgtccacaacctttaccagctaaagtactagtgatcgggatgctgggcatggcgttaaatgtgcctttaggggtctggagagagcacactgaaaagttttcggcatcttggtttatagctcttcacgcagcggttccattcataggaatactgagaaagtcagtgttgatgcctaaaacagctatggtattcaccatagcagcatcagttttgggacaggtgattgggtcaagagcagagaggcggagactcaagtctgtagctgagaagaagttgacattggaggtaccaaatccgtcttctgttgaagcagatcagatgcaatttgccggagtttcatcagatggaagatgcggtgataaagtggtgatgaagtggaatcccatgatgcttgatgttgcaagccctgtgtcttccggagcagctactgttgtctgctaaaaggattttgtaattctcttcgaggatttatatatataattgtttttcttgtatttttttcggctgattgtatttaaaaagtttcttaatgtttgagaaaaacaagaataaagccattttttaaactgttaattgtattttaatgtaaaagacttgtttgattgaataaaaggaaagagaagttggaaatttggtgtttatgcatctcataggcaagttttcaaatatgaacaatgttaaatgagtcgttcaatagtgcttatgatatcgtggttgcaaaacatcagttatagagtggttgatggtgtagtgattaaacattgcatttcgtgatcacttgtttgggtccactcttgcatccttgctaaacctactccaaaattggtaaacctactctgaagtttgcagaactagtctaaaagattttcttaaaaggcaggccactagatagaagagaaatcacttacaagagtttcttaaacttttctttttaaagataagtgattatggaacattaaacttaagtttactctcataacctctattatcatcaaatctccttcttaaattttttttttttttttttgaaacaaatggattttattaaaaatacaaaaaaaattgtatatttggattacgtcaactcttacaattttgctagtctcatagaaagatgtcatacaatgcttgcatgtattgcttataacagtacgtgtgcttttgttatttcttttctagtattgtaattgcgtcgtacaagaaaacttataagatgcgtcggaattcgaaataaaacaaataaggttggaatgtatcacatgattttcatacgtttttacaatttctgataagtcccccttggtatgatggtatcgactttgttttcagaaagttgagtttgtttcttttccgaaaactaacgatgtcaaataatgtgaattcacaacatatataaaaaaatgataagaagagagcttaattttgagcgagtgttacaaattaattaaaaactgtgtctagtttaacacttaaaaaaattgcaatttaaatgataactacccctggattattttcataacaattttgtacatgaaagaatttaagataatatattattttaccaaattagaaaagctaaaaaaataagtactataatttgttgtatttagtgaaagaataaatgttgctgggaaaaaaagtgaaagaataaatgctttgggtatataccttatattaaaaacaaaacgaaaaaaaattaatgatatttgttaccatatatattatatacaatctataaacagaaattaagataatttatctgaaaagtgttttcaatgaggaaaataacaataaacagaaaaaatgaggtgtatgtacaaagatttgttaccaaatttaaagtattcaaacagaaagtacccatctgtttaggcaaaggattcgatcatcaaacgtcctacaatatcttgttttgcgatctcacccacaaatttatttcctataaattctcttcctctgtctgatctcttctattcaagcccacttcttttctctttctcttgtcttcgtggagttttcggatcttacacaacaatatctttgtcttactgtatttcttgtcctttttcttcttacctttctaacaattattaagaagagtaaagcttgaatttaaataaaaatg

SEQ ID NO: 16595 - DNA, 3003 bp, Unknown; identical to SEQ ID NO: 16594
  misc_feature (1)..( 3003): 2750-1469P.txt file - cDNA_ID_1570595; gDNA_ID_2926186; Annot_ID_140811

SEQ ID NO: 16596 - DNA, 3003 bp, Unknown; identical to SEQ ID NO: 16594
  misc_feature (1)..( 3003): 2750-1469P.txt file - cDNA_ID_1570595; gDNA_ID_2926186; Annot_ID_200653

SEQ ID NO: 16597 - DNA, 3003 bp, Unknown
  misc_feature (1)..( 3003): 2750-1469P.txt file - cDNA_ID_1570716; gDNA_ID_2214566; Annot_ID_134961
gaagaaaacgaacttgatcaggttttgctctatttcattaggcttgcttcttctcattgaatcatcagcatgtgattttgtaaattgccacggtttagtaattaaccaggctttatggtggtttcagggtttggacgcgggaattgatgcgcctccacttgcaaaggcttatgaaggtgttttctacaattacttaagcataggtttgttgaacttctctttttgatatcctaaacaattttcacaattgtttttctgaccagattcttgtgtttgtctggtttgtttaggtatggatgctcaagttgcatatggcttccaccatcttcgcaacactaaaccatatcttgctcaaggccctatttcaaataaggtttgtttattatatttgcacctaaactttggactcattatttgtctttgttaaaagctaaagtagttatgttggttttgagaaacgacattaccaaccacacaatgtttgcttttgcagattatatattcaagttttggttgcagtcagggttggttttgcacgccttgtgtcaacgatccaggtttaaggttcgccatttcgactcttattgtgtagttgaacttgtgtgtaagtctctgcttaagccctttgttgtgttgttgaccccttgtttgtgctatatgaatttgcaggggacttaggaacataatgaaaattcacatcaaaaaggttaactgctctcagtgggaagagatcgcagtcccgaaaaagtaaaaaacagttttcgatatatgatttatgtattacaatctttgatatcaatgcttaaaacctgatgctatggatttctcttgtagtgtgagatcaattgtcgcattgaatcttcacagctatggaagtggaagccatccttggggcaatctaaaaccggactatctagagaaggtattgtttctgttccatttcatcatatatgaactcagttctctgatgttaacccgaatgttttctttggtttttctcagagaggctttgtggaagcacattgtgatgatggtttgatagagattttcggttttaagcaaggatggcacgcgtcatttgtcatggctgagctcatctctgccaagcacatagctcaggtaacttcaaaagacactggtcaatgtataatctttttagccatgtgtttgactgtttcattttggtgatcatttcaggctgctgcggtaagatttgagctaagaggaggtgactggagagacgcattcttgcaaatggatggtgagccatggaagcaaccaatgagcactgagtactcaacatttgtggagatcaagaaggttccttatcaatctctgatgataaataatgaatgattgagattcaaagctggattctttgtacaaagctaattgttttgtatttggatttgattcagttagtcatagatatagcctaagctttttagtcttcttttcttttaaatctgagattgtgaccatttttctctttttaatttctgcttattgttggttttgtacatttttgtgttgtgaggaatgaagtttgtttatttataagaatgtgggaagataatatttggtcaaatttcaatctctcttcaatctttgtaattctagcattgagcacatagatgtgattctttgtcatatttttatttattttaacactagttcgactgagaaccaatttatcatcgacaccaatttctaagtaagaatatttttaataattatcattattagtcgtatatttttaccagaataataaaaaattaaaaacctaagttaataaaccacacaaaaaagtttttctctcttcgctctctcgtagtttgtaaagatagaaactgaaatttcttttgtttttgttaaccggatagttttccggtgagtcgccgtcccgtttaattcgggctttcgtccgacatcttctagctacgttagtggagatggttggctttttgtatggcatcgttggctaacttagcgacgttggccagcttccgtacggcagcgttgggcttacactaacagcgttggtcatctttgtttttgttttgttacttcaaaggtttgatgatgaagctttatggcatgcagaatcgtcagatctgaagagggtttctctttacaagatctattctccttctgttttgtttagcttcactattgggttatgcttttggctctggtagtttttcggcgatgtgtgcgtttccagcaattaccctcgtttggatctaccatatttaagacagtttcaattttattttcgcctaagattgggttaaagcttctatcctatgcaaatttgatatgcctttagtgcttttgcaagagagttcgaagattcaatggttggacaagtttgaactactcaatttttttaatttctttacccgttttgatgaattatttgtgattctagcaaccatatgagattaggaaattgatgtttgttctataacatctaattgccataatcggtgatagaaaaaaagagtttcattgctcggtgctttcccggcgatggttctccgattcaccagacttgagtctcatccggtggaggttgtggaagattcacgtgtccttagcttattattattggtctgacacgtcttaagcttatctcttttttgtgacgtaaaagtctgttgtggacctcatatgtagactgtcttgagccttttatgttgtaacactgagcctcagtatattaaaaataaatctttctctgaaaaaaaaaaaaaaaaagttaaaaacctacgctaaaaaattctaggtcttggaaaagagtatttgggccaaatgatcacattaattagttatgggctgaaataacattctgaagttttatgaggaccgagagaactaagtttaagaaaaatgttgaaaaaagcgtattagcagagggacaaacgctttttagggttttagatttcctctgagagagaattttcgaaagcttgagagagatttccaactacgttagccatg

SEQ ID NO: 16598 - DNA, 3003 bp, Unknown
  misc_feature (1)..( 3003): 2750-1469P.txt file - cDNA_ID_1570735; gDNA_ID_2214491; Annot_ID_183669
ctccttcttcttcttcttcttcttcttctcttctctgtttcttctctcctctgctttaaactctgatggagttctcttactgagtttcaaatactctgttcttcttgatcctctctctttattacaatcatggaactacgaccacgacaatccttgttcatggcgaggtgtgttgtgtaataacgattcaagagttgttactttatctctcccaaactctaacctcgttggttcgattccttccgatctgggtttcctccaaaacctccaaagtcttaatctttccaataattcactcaatgggtcattaccggttgagtttttcgccgccgataagctccggtttcttgatttatcaaataacttgatctccggcgagatccctgtatcaatcggaggtttacacaacctccagacgttaaatctctccgataacatcttcaccgggaaactaccagctaacttagcgtctcttggaagcttaacggaggtttctctgaagaacaactacttctccggcgagtttcccggcggcggatggagatcggttcagtatctagacatttcttcaaatctaatcaacggttcactcccacctgatttctccggcgacaatctccgatacctgaatgtctcgtataaccaaatctccggagagattcctccgaatgttggtgccggttttcctcaaaacgccaccgttgatttctccttcaacaatttaaccggttcaatcccagattctccggtttaccttaaccagaaatcaatttcgttttccggaaacccgggtttatgcggaggtccgacccgaaacccgtgtcccattccttcatctccggccaccgtctcgccaccaacctctacacctgcactcgcagctatacctaaatcaatcgggtctaatcgagaaaccgaaccgaacaacaactcaaatcctcgaaccgggttaagaccaggagttataatcggaatcatagtcggagatatcgccggaatcggaatcctcgctcttatcttcttctacgtttataaatacaaaaacaacaagacagtggagaagaagaacaatcatagcctagaagctcatgaagctaaagacacaacttcgttatcaccatcatcatcaacaactacatcttcttcatctccagaacaatcaagcagatttgcaaaatggtcatgtctccgtaagaatcaagaaaccgatgaaaccgaagaagaagacgaagaaaatcaacggtcaggagagattggagagaataagaaagggactttagtaaccattgatggaggagagaaagagcttgaagttgaaactttgcttaaggcttctgcttacattttaggagccactggttcgagtataatgtacaagactgttcttgaggacggtacggttctcgcggttcgtcggttaggtgagaatggtttgagtcaacaacgccggtttaaagactttgaggcacatattcgagctattggtaaattggttcacccgaatttggtacgtcttcgtggattctattggggcaccgacgagaaattggtcatttacgattttgttcctaacggcagtctcgtcaacgcccgttacagtgagtcaaaatcatctctttcacatttcaatctttttcctcgctttatgataaaggcacatgttagcataagatcaagtcgcacgctagcatcaccagggttttgctactgtgttcatattagttggtagtagttaaattacacctgtattaataaagtcaacggctggtcaaattttgattctttgtgctattggacagggaaaggagggtcttcgccgtgccatttaccgtgggagactcggctcaagatagtaaaaggtttggctcgtgggcttgcttacctccacgacaagaaacatgtgcacggtaacttgaagcctagtaacatactcttgggccaagatatggagcccaagatcggagatttcgggctcgaaaggcttctcgccggggatactagctataaccgagctagtggatcatctcggattttcagtagcaagcgattgacagcatcctcgcgtgaatttggtaccatcgggcccacaccgagcccaagtccaagctccgttgggcccatatctccctattgcgcacccgagtcgctccgcaatctcaaaccaaacccgaaatgggatgtgtttgggtttggagtgatcctcctcgagctgctcacgggaaaaatagtgtcgatagacgaggtgggggtaggaaatgggctgaccgtagaggacgggaaccgggcgctaataatggctgatgtagcgatccgctccgaattggaaggcaaagaggactttttacttggccttttcaaattgggatatagttgtgcatctcaaattccacaaaagagaccgaccatgaaagaggcgttagtagtgtttgaaagatatcctattagctcatcggctaagagtccatcgtaccattacggacactattaacgtttgatcttacactaactctagtctctaagcgtttctctatggccaaagtatatacacatgatgcaaattgttctttcttgttgtttgtccacttgagtttttatatatgattctttaggatactaccactaggttagcttggtttgtaatcgttttttgtttaatttagtgtaagttcggtttgtgttggagacttggagttggctcccatatacttaaatcttcaaacataagttaatgtgttatactatattttcaaccagtagaccaatcatataaatcgtttaataatttctgaaccactaaacccgcaagtaaaccgatagattgatcgtataatttcaaccggttcggatagtaaatagtagatcttccgtaaaccggatatgatctgatctgatctcccaaaaagtcccaaatccaaatctacgaatctccgtctcctccgtcgcattttccgaggtagagagagagatcaaaccaaagagacacagagagagtatccaccgatg

SEQ ID NO: 16599 - DNA, 3003 bp, Unknown
  misc_feature (1)..( 3003): 2750-1469P.txt file - cDNA_ID_1570779; gDNA_ID_2926274; Annot_ID_143505
tgtccctccaaagaagccacctctcttaacttagcctaaaagagagtttccaagaatatatttcaacaaaaagagagagtgagaattgttatatgaaatcaagaattgtagaaagtaacctcattagccaaactaacagctgcagcaagattcttgtcgaatttactagcgaggtcacggaccgaaagccgcttgtgctgatcagacaacaactcgctctctttctcgacagtctccttcacagatggacctttttcatcttcctttggttcctctactatctgattatcaggtcctaatttatatgttggaaagtgatcagaagcaaagctcacatctactgatactggaaccactgataaagataatgtcccttctatttcaggacacactttcgtcattttatctccggatctttatctgtttcaacaacaataaacaaagagcaaatcaaaaaatcattagatgatttgaattggaaggaagattactagattagctctaatctagttcataggaaaagatttaaggcagaacaagaaatgcattatactatcgattacactaaatgagaaagaatcagaacatcaaagggcagttaaaaaaacagaacaaacattttatatatatttttaaaaaagtggagaatttctaactcatgtaaccaaacattgatgtcatgaaacagtatacgacaaaaatcaggagaaatgaaagtagaatcaatcaactcaagaaaaacacaaacaaacttacggataaactcaagaccaagaaacagagaatctcaagagtgaagaaggaagaaggaagaagaagaataaagacaactggttctttagtctatctctctctagtcttcgtcgtcgtttggcatcttttttcttttttagcttttacaaaagcgtcaaagacgacaggataaatgggcaatgcagagaagaaaaaagagacacttttgttcctctctctctctcttcttgaacactgcttgttctctctctctctttctttcacgccatcatcgttagaaaacccaaagagtgcaaaaagagaaagaagaaaacgattataatttgttgtcaatgcctggtctcgtcttttgtttgctgggatgaaaaaaagtgaccacgcgctgttacatggtgtttgaaccacacgctctggcgcgagttgtcgtcggggcccgaccgaccctttggctccactggatttctcttctttttctctttttcacattattgattttgtgttttctagtttagcttttcgtgtggatctaattatgttcctttaacaaccattattatttcttctcaatcttaagcaaactatctaagaaactaaactttcaaatccaatatatgataaagagttaatgtagagatacatgttatatgactctaagctacaaatactaattttttaacaaaatgtataaaaagaatcagatacaaaattcaagaaaaacagtggatatatgtgtccaatccttttacaacctgtaatactacatttttagatccattactaaaattaggatatctcaatttcttaactaaccaatcaataatatgcaaaagcttatccaaagttacaaacattattgtattagaccatcttggagagtggtgagagatactgtaacatttggcgtgtagtcatgagtactacatttggtggaatctatgtttttagttgaaaggtcaaactcaaattagttttcctcctaagagctatcaaatgcgttaacatcacgattcacgagttacatatatagctagtatataattagtactataagttacaattgttttcgaattacattaatttcttttttcctagtcgaagttcacgaatctttttatcatgaccggagtctctaagattcgaatacagttttttggagcataatcttcttcgaatgacaataatagcaacaagttttttcgttacagtttcatttcatcaattcgtatggcataataatcacttatacactaatgtttttgctaaaatttatccatctcttttcatattaagattgaatgaattaaacaattagttaggttgatatttatcaattttcgtggtccatggttgtttaattcaataactcatcacgcattttatcatgtttggacaaataaatagaacaattggacaaattatcattaaagaccagtagagtgggtctctctagaattataatactttaatgttaaggaattttcttaattaaattccaagaatttaatatcctagcctcactaaagtgacaaaaaaggctaagcagagcatgtgatatttcaggtcacgttaacatgaatagatggttcaaacatcataatcgcacttttactttctgtttgtggtataacaagagagtactctgtactataatgagagatgcatttgactttaattagataccaatcactttagttataaactaattttcgtaagctgtaaagcatttcttacttaattcttagataatacaactctactttgtgtcttaatgatgtgtttgtgttatccatgactataattaactctgagcattaagcatatgcaacggggtccatgtagaatccaatgataccaaacctactcgccatcactttttttcacttcttgtctcctttttccttattttgttggcttttacttatttagttaagagtttgtagtgaatgaacagacgtttactagtattatctagtactttgtgggttaattgtggatgaagacaataattttgattaggcaataaagaaatgggtttggtctttggtgggctagtagtaagcccataaagaagaaagaggttcagacaacggaaaaataagggtatgacgtggcaagatatcattggttggaagaaagagattggcgggtgaagttgtttgtgccgtctacgaatttagggtttaatttgtgttaatgagccaccgtgtttcgattctatcatctcatttctcacctgcctccgccgtcatg

SEQ ID NO: 16600 - DNA, 3003 bp, Unknown
  misc_feature (1)..( 3003): 2750-1469P.txt file - cDNA_ID_1570779; gDNA_ID_2926274; Annot_ID_205253
tccgtgcgtcctctcatgtattctaaagcatcccttagcttcttcaacataacatgtccctccaaagaagccacctctcttaacttagcctaaaagagagtttccaagaatatatttcaacaaaaagagagagtgagaattgttatatgaaatcaagaattgtagaaagtaacctcattagccaaactaacagctgcagcaagattcttgtcgaatttactagcgaggtcacggaccgaaagccgcttgtgctgatcagacaacaactcgctctctttctcgacagtctccttcacagatggacctttttcatcttcctttggttcctctactatctgattatcaggtcctaatttatatgttggaaagtgatcagaagcaaagctcacatctactgatactggaaccactgataaagataatgtcccttctatttcaggacacactttcgtcattttatctccggatctttatctgtttcaacaacaataaacaaagagcaaatcaaaaaatcattagatgatttgaattggaaggaagattactagattagctctaatctagttcataggaaaagatttaaggcagaacaagaaatgcattatactatcgattacactaaatgagaaagaatcagaacatcaaagggcagttaaaaaaacagaacaaacattttatatatatttttaaaaaagtggagaatttctaactcatgtaaccaaacattgatgtcatgaaacagtatacgacaaaaatcaggagaaatgaaagtagaatcaatcaactcaagaaaaacacaaacaaacttacggataaactcaagaccaagaaacagagaatctcaagagtgaagaaggaagaaggaagaagaagaataaagacaactggttctttagtctatctctctctagtcttcgtcgtcgtttggcatcttttttcttttttagcttttacaaaagcgtcaaagacgacaggataaatgggcaatgcagagaagaaaaaagagacacttttgttcctctctctctctcttcttgaacactgcttgttctctctctctctttctttcacgccatcatcgttagaaaacccaaagagtgcaaaaagagaaagaagaaaacgattataatttgttgtcaatgcctggtctcgtcttttgtttgctgggatgaaaaaaagtgaccacgcgctgttacatggtgtttgaaccacacgctctggcgcgagttgtcgtcggggcccgaccgaccctttggctccactggatttctcttctttttctctttttcacattattgattttgtgttttctagtttagcttttcgtgtggatctaattatgttcctttaacaaccattattatttcttctcaatcttaagcaaactatctaagaaactaaactttcaaatccaatatatgataaagagttaatgtagagatacatgttatatgactctaagctacaaatactaattttttaacaaaatgtataaaaagaatcagatacaaaattcaagaaaaacagtggatatatgtgtccaatccttttacaacctgtaatactacatttttagatccattactaaaattaggatatctcaatttcttaactaaccaatcaataatatgcaaaagcttatccaaagttacaaacattattgtattagaccatcttggagagtggtgagagatactgtaacatttggcgtgtagtcatgagtactacatttggtggaatctatgtttttagttgaaaggtcaaactcaaattagttttcctcctaagagctatcaaatgcgttaacatcacgattcacgagttacatatatagctagtatataattagtactataagttacaattgttttcgaattacattaatttcttttttcctagtcgaagttcacgaatctttttatcatgaccggagtctctaagattcgaatacagttttttggagcataatcttcttcgaatgacaataatagcaacaagttttttcgttacagtttcatttcatcaattcgtatggcataataatcacttatacactaatgtttttgctaaaatttatccatctcttttcatattaagattgaatgaattaaacaattagttaggttgatatttatcaattttcgtggtccatggttgtttaattcaataactcatcacgcattttatcatgtttggacaaataaatagaacaattggacaaattatcattaaagaccagtagagtgggtctctctagaattataatactttaatgttaaggaattttcttaattaaattccaagaatttaatatcctagcctcactaaagtgacaaaaaaggctaagcagagcatgtgatatttcaggtcacgttaacatgaatagatggttcaaacatcataatcgcacttttactttctgtttgtggtataacaagagagtactctgtactataatgagagatgcatttgactttaattagataccaatcactttagttataaactaattttcgtaagctgtaaagcatttcttacttaattcttagataatacaactctactttgtgtcttaatgatgtgtttgtgttatccatgactataattaactctgagcattaagcatatgcaacggggtccatgtagaatccaatgataccaaacctactcgccatcactttttttcacttcttgtctcctttttccttattttgttggcttttacttatttagttaagagtttgtagtgaatgaacagacgtttactagtattatctagtactttgtgggttaattgtggatgaagacaataattttgattaggcaataaagaaatgggtttggtctttggtgggctagtagtaagcccataaagaagaaagaggttcagacaacggaaaaataagggtatgacgtggcaagatatcattggttggaagaaagagattggcgggtgaagttgtttgtgccgtctacgaatttagggtttaatttgtgttaatg

SEQ ID NO: 16601 - DNA, 1577 bp, Unknown; identical to SEQ ID NO: 4420
  misc_feature (1)..( 1577): 2750-1469P.txt file - cDNA_ID_1571642; gDNA_ID_1620705; Annot_ID_48854

SEQ ID NO: 16602 - DNA, 1577 bp, Unknown; identical to SEQ ID NO: 4420
  misc_feature (1)..( 1577): 2750-1469P.txt file - cDNA_ID_1571642; gDNA_ID_1620705; Annot_ID_165236

SEQ ID NO: 16603 - DNA, 3003 bp, Unknown
  misc_feature (1)..( 3003): 2750-1469P.txt file - cDNA_ID_1571642; gDNA_ID_2926196; Annot_ID_141265
acaatttaagggatctggaaagcccctgttgtatctcttgcatggtcttaatactgacagcagtaacttctcaaaacctgccagctttgaggttttgacatttcatcctttcttcttcactttctctggagatttggtcttatgtttgtcttgtcttgatgctgaagatgaattatcttaccgcatgtcttgtgatctagaatttcaggattctgatgctcgtactgttttcctgatatttggaatctcatttgtaattatttctttttactgttgtcctgtcttatttcaggggatagacaagtttgagactgatttgactactttacatcctattttggcggaatgtcgagttattaaatcaagtttggagcttcaactaatacagtttgcaaatgatataagttctgaagctcatatagaggtgtgaatttgatttcctaacatgttttctctcgaattgttgtttgtctttttaaatggtatgcttagaccaatgaatgaaataaattgatgaaacgattttcttatctgttggcttgttcacaatctgtcgtttttgtatcatcttacgacttaggtttctgacctcaattcttcttatccactccatgtagacagtttttttcttctctttttgcaattctcttacatctttccaactttaaccatgtgttttttaatccacattaaggttatgaggaaagtcacaccgggcatgaaagaatatcagatggaaagtatgtttttgcatcacagctacatgtacggtggctgtaggcattgctcgtacacatgcatttgtgcaacaggggataataggtaagtttggtggataaatcttgttattgctgaatatgcagaaatattccttttcaggtgtttgtactgaaaaactaacaaaacgatgttaaattgtttgtagtgctgttcttcattatgggcatgctgcggctccaaatgatagggtaaagggaacacacattcctcgcttttttagttctctcattattccctgtttgaaaatgttttaatacttgttgcagacttttgaagatggagatttggcattgcttgatatgggtgctgaataccatttttatgggtctgacataacatgctcattccccgtgagttcttctagcatcaaatctattcttaattttcctctgaattgtctttgcaccgcattgacttgtgtttttaatcttgtttacatgaacatcataatttgctgaatgtagttatctagagaaagtggtctctaatatttatcaattggtgtgcaggtcaatggtaaatttacaagtgaccagagtctaatctacaatgtaagtgccttacaagattggtgcaacgtggatgtattagaaatgtgtgctctattttttgtcttcgcacaatccagagtttggtgagtctcttgaagctttacatctgaataagtttctctgattttgccttcctttcaggctgttctggatgcacataattctgtaatctctgcgatgaagccaggagtaaactgggtggatatgcacaagtaagtcttactgagatgctatatagctctgttctactatgcatgcagatgcagtaattgggattgacaatgtaagcgtaaactcagttgctttggtccattttgatttatcctcttgttagggagataaattgaaatacatctccatatggttattcagctttctttgtcgactgaagcaaattaatgtacaggttagctgaaaaaatcatccttgagtcactgaagaaggggtccatactcactgggtaattctctctgtgttagacatttcaatactcttctctaaaggttaattcattctcatggtttcgttctctgttcctagtgatgtagatgacatgatggtacagcgcttgggtgctgttttcatgcctcatggactaggtcacttcatgggcatcgacactcacgatactggtggctacccaaaggtacatcaaatcttttttcaacccaatagtatcatcacgtaaataaaaccacagtccctgtgtcttacccgttgctttgatctttcattcttttagggagtggagagaccaaagaaacctggattgaagtcattacgaactgcaagagacctacttgaaggaatggtaagggccgattgtttcaagtagaaatgcttttggttcttctcatttatcgtctctgttcattgtcctaatcgtatttatgtcaggtaataacggtggaaccaggatgctatttcatcaaggcattgctgttcccagccatggcaaacgcaacaacctctaagttcttcaaccgtgaaacaatagagagattcagaaatttcggaggtgtcagaatcgaaagcgatttggtaatgtcaaattcatattcactacaacgtctacaagttaaaacactctcaagagtaatgtcatatacaataatctcattttgttgtatatgtgtgatttcttttttaggtcgttactgctaatggctgcaagaacatgacgaatgttccacgagagacatgggagatcgaagctgtgatggctggagggccttggccaccgaccaagtgatcgtagctactcttaggcagcttatggaaattaaaaacttgataagtaaaactcaataatacaacctttatttttgttaatgggaataaggaaaaattgcctgtgttttactaatcttgtacatgtagtttattttgtttcagtgtcttgtttgtgtggttggatattaaaccgattgaatgttcaagtggacagataaaatctaaccggtttggtgcttgtcgacgaaaaccgaaccggtacagaaaatatcttgagcacaattttagttctaatataaaattcattaacaagagagaaaaaaaaaacttcaaattaaaagcttcgtgtcttcataaaaccctaatctcgcgacttcgtctctatccccaaaaaccctttcctctcttccttcttgtgtgagaccgagaaaaaaagatg

SEQ ID NO: 16604 - DNA, 3003 bp, Unknown; identical to SEQ ID NO: 16603
  misc_feature (1)..( 3003): 2750-1469P.txt file - cDNA_ID_1571642; gDNA_ID_2926196; Annot_ID_201445

SEQ ID NO: 16605 - DNA, 3003 bp, Unknown
  misc_feature (1)..( 3003): 2750-1469P.txt file - cDNA_ID_1572180; gDNA_ID_1971889; Annot_ID_58457
agtaacgctataccacgaatccatgagacaattgttaaaaaactgaagttttaacccttcttaaaacagtatattaataatattttaaaattttataaatattgattcaaatacatccaccatataacccaattccaaaataaaacccgttctgtaatttctttacctgtcccgtgattttttttaaagtagtaatttttaaaatttaagaattatttattatatataagagttttataaattgcatcattctctaatacatttatattttatagtttaattttatatatagtaacattatacataccacataattttttggttttatataaccttttctaaattaggatgatttgatatgtttaatattagtggtcttaaaaaataataaattaaagatttaacccgtattgtgaattaattatattttacctttttattattgttgattcaaaaccccatttctccaaatctgtcttgccaaaaagccatttatttaataatattaattttatttatgatatgactctaattataatctaaatattttagctaataacataggagtgcaccatatttatttaataggagaatgtaccatatgacccgaatgcacttttaccaaaatccaccaaaaagtcttgcaaaaatactatagagataagaaacgatagtcggttttgataggtataagattaacaaatatattaattagcttaaattagttaaagagtacaaattgaaaagttatattacactttattcgaatatattatcaaaacttatataacagagagatttgataaaattgtaattgttgaatactttttttttgtgctaatttttatgtaattaagatttaattgatttcgtatataaaatattaaattgttttacgaacttatttgtttatatttggtaagagataaatatttgaatattcggtatattttgattcagtttagaaaatctttgatgacccgtctttagatccaataagccctataattaagaaatgaatattgtcgttaaatgaattttggtaaccttaataacgtcattaaaagattttgtttttgattaaatttttctaatatcattgtcatgtaattaattacaaaaattaaggttacatttcaaatgtactttccaaaataatataataggatttctttgggtacaaggtgaccaatgatcatctagaatcccgcaaccgtcaaaatcacaagttttagcgtaaacagtttatggattgtttgactttaataattggacaaatgttgtaaacaataatcactactacgtgttttaacgttaggttgggcatttttcaagtaacaatgaaactaatttatttattttggtagggataaaacaaaatttaatgcaatgttcaatatgtattagtattgtttttgatcgagtactaaaattctgtaattcgttcacttaatttaaaggtatagaatcataaaacgataattatttttggtaaacaaaactattagtcaaaagtcaaaactgacatttaatttgaattgaaaccaaggaaataaactaattttatttaaattatgttattaaatctttaaaaatcatctgataattacatgaaggaagcttggtcagccataagaagaataacaacttttttccttttttttttgttttgttaatccgttagtatataaacaacagtattcctagtttctttcaccgactcttctaatctctgcgatcgtacatcagaaacctctatctcatcgccgaggtaaatctttcagacgctgtcccttctcgtaaaaatcgaaactttgaatcaaatctacgtgaaatttttgtatttctctgcatgtttgatcaattctatatgaaaccgcgtttaagggttttagagtttttcatctcattcgttaatttcattgcatgtgtgcaggaaaaaagatcttacaatggctattaacaccatcacgaacgaagaagatgatgcatcaaacaactttggatgcaatatctgtcttgaattggcaagagaaccgatcgtgactctatgtggtcatttgttctgttggccttgtctctacaagtggctccattaccattctaaatcaaatcattgtcctgtttgtaaagctttggttaaggaagatactttggttcctttgtatggaatgggtaagccatcttctgatccgagatcgaaactcaatagtggtgttactgtccctaatcgaccagctgcgactaggactgaaacagctcgacctcgtcttgaacaaagacatcatgggtctagtttctttggtgggcattcaagttttgctgccatgccaactggtttacggttttcaaatttcttgttgtaatggaaagtatcttttgatgaatctgagtctgtttttttgacaatgtttttgaaactattattatacattgtctacgatttttgttattttgacaattaatgtttagagctacttttacattcttataaaaaatttgcatctgcttgtaatatttgattctccaatcttccgctttgtgaaaaatcgtcataagcttgttctcgtgctacatctgcagattgatcaacatgaatgctgattatagtatatgatccttaatatatgattatcgcacagatgaatttaaagcttcacatttaatcgtgtaatttggagtagatggcaaaagaacatggaaattaactaaatgacaatgatgtgatgtaaatttttgttttgaccattttgtttttgttaacatatgtaacgaatctacacagagtatttgtgttttcaagctccttgttaagcccaatgaaggtttttaatgggctctaatgggccgattcaataagttggaaagctcatgaagcgagagggaccgtgcctaatctcatcttcactctgctcgttatcttcttcctttttacctgttcaacgaaactcctgagctcagcttcactttgctcgacgttatcttcttcgttcagcgacaatg

SEQ ID NO: 16606 - DNA, 3003 bp, Unknown; identical to SEQ ID NO: 16605
  misc_feature (1)..( 3003): 2750-1469P.txt file - cDNA_ID_1572180; gDNA_ID_2684202; Annot_ID_191247

SEQ ID NO: 16607 - DNA, 3003 bp, Unknown; identical to SEQ ID NO: 16605
  misc_feature (1)..( 3003): 2750-1469P.txt file - cDNA_ID_1572180; gDNA_ID_1971889; Annot_ID_176805

SEQ ID NO: 16608 - DNA, 3003 bp, Unknown
  misc_feature (1)..( 3003): 2750-1469P.txt file - cDNA_ID_1572338; gDNA_ID_2214575; Annot_ID_186311
gatagaaaaaacgtacgactctgagctttacaacggctatttggcaatttacaacggatatggcgacttacgctattttactgtaaagattgaaaatgatatttgtgtgtcgttaggtaaaacattagtgaaaacaaaaggtggatagacaagatatggtcatatctatctaaccatacacagagacgtttgctgccatgcatgcatgatgcatatatatatatatatgtggatataaaatatatttaatttatatacacatagtccatagatagatagataaatagacgtagagagggagagagcaggagacaagaagagagtaagcacgcagagctttcgagcatgagcatgctagaaaaagagccatgtgtgctcactctcttctgtcgccttcgttattgctattcccttacctcctttagttgacttgcttcatcttcttgcatgcatatgattttgatgttatattagcctcggtccctaaaattactatatgatatgatgatatgatatgaaacagtttgtctgattttagggtctatatataaggattgctagggtctatatatgatgatgcatgcatagatttcatcatcatcatccactgaccactagctacgtttaatttatagaaagattccgccggattaaactcttatttcctgtcaatttgagcaacaagattctctcttttcaattatatatacataacacatgtctataatatacgtacaaaccaataaaattggactcttaacaaaattttgagagtgagagatcccacttaaaacgaaataaactatttgtttggtcattgcatgcgtaaacgaccacttgaacaattaagtatacataacataggtctagatctatgtgaaagattcccaaacttaagatctctagctagaacattcattgatcctccaatcaaaaaccaaaggaataaaaagtaatctttgtaagggcgaatgtaaaaccgaaacgtaagctagaggaattgatattaaaatggaagtaaaagcgaatattactaaaggttttggagttaattaaataaagacaaaagatgcaaggacaacgaattatgaacatcttcgaaatacgtttttaatattgttttggcatttgatttgatttgattctccttccacattcccttgttcatatgtgtttgtgtctcacgcaagcactacataagcggtccccctaaatacgtttctagaaacgtcaacgtttattcaatcataccaaaatttacatgtgtattcatcaatcagccgaccataaactacatggtccattagtcattacctatactgcaatttttctagcttttaacagccattatgtacttcacagtttggaatactggtatgacgaagaaaagtcgaggtaaaaaacgtattagaataaatgtttatcgtccaaagatcgcaccagcaaagaataagaaacctaaaccaacaaaggaacaattaatggaccctgaattttctgatgaagacgtacttaccagcttgggttttgatgatggcggttacataataccactaccgaaaaaatctctcatgttgattaatctaccagattcttttcgagatgagttgcaaacgatgcatgtcagtttttatctccgagaagttggcaaacttatgtttgggtgaggacaaatatgctctagtgaatagtactaagaagttgatgcttacagatggtctaggacggcttcatttgttttggatgaattcaattttttttccgaatcagtatttgcgaatgagatttatgtagccctagatgtgagatttatgaaagctggaagtgccaaaaagaaaggtggagattttaattgtaacaaaaacgcacagagtcttctttatgattttttcttggtagatatagatgaggagatatatgggtcaaaatttgaagagacggaagaccaaaagaagtggaacaaaaaattttgaattgatttgtcttcatcatattgtgctattaacattaaacacgaaatagagcatctgaatcttgaattctatggaatctctaaaacgaatagacagatctccgcggaggaagtgaaattctctactcatactgcattcaaaattaattgagtttttcaattacattggaggtttatcctttgatactttcggtttggtgatttgaatgaaatgttggttttgacagaaaaatgaataacacttgcattaaaatcatcaaaaattgaataacactagaatctaaggaggtgtattcgatcttatattttaagttatttgagtttttatataattttgattttttaaagaatttggatgaatttaaggaggttgttatgatttatggtaaaatcctctcaaattccacctaaaaccatgagatttaaaattatatatttttaactaagaaaatccacttaagtctcttaaagtcactaaaatccaatctttaaaatgttttcaataacagaagatttttaaggagattttaaaatcagtaattcaatagcattagatttcatgatacttttaaaaattcataattgaataacataggatatgttagtttgaataagatatcctaggtgttaatttactatttttaaaaaggtaagattttttttcatgtttttaaaaaatgtgagagtttttttacctatttttctattaaaatgaaatgtataaaattaaaattttgtttttaaataaaattactaaattaaatattacaaaatatgtatatattactatttagaattcaaatattatcgatacaaaattaaatttatttcttcaattcgtctatttaagcaagctagtaatttgatcgacaaaaaaaaaacaagctagtaaaatataattaacagaattactaaatcggccggtttagggattgctttctctcagtcgtcaattgcactaaaccactggtggtaatatcgctggcgtttcgcaagtatcaccgggaattgcaaagaagcagaggaccatg

SEQ ID NO: 16609 - DNA, 3000 bp, Unknown; identical to SEQ ID NO: 5982
  misc_feature (1)..( 3000): 2750-1469P.txt file - cDNA_ID_1572397; gDNA_ID_1620835; Annot_ID_57966

SEQ ID NO: 16610 - DNA, 3000 bp, Unknown; identical to SEQ ID NO: 5982
  misc_feature (1)..( 3000): 2750-1469P.txt file - cDNA_ID_1572397; gDNA_ID_1620835; Annot_ID_169849

SEQ ID NO: 16611 - DNA, 3003 bp, Unknown
  misc_feature (1)..( 3003): 2750-1469P.txt file - cDNA_ID_1572587; gDNA_ID_2926300; Annot_ID_205657
ctctattattagtttctacattttaaaaatgatagtgttagtttcttaattagtttatcaaaaacaattcaccaaacattattgtcacattttgtttttcgaaaagtagccaaacaaaagtttattgtgagcatgagatgtttatatggtgtgtttcaattttataatattgtagccaaacaaaaaaccatcttattatcttacccataaaaccccggaaattaatggaggtctacacacctaaatttcgaaaaataaatttgcatttttaaggcgcatatgagatgtttatggcaaaagttcaatttcagaagataatagccagacgagaaaccgtgttagagaatttcctctttatttaaccaatgagaaccccgaacaattaatactggtctacaaaaggctcctagtttttttattaactcgtacttttaaatgcttagacgagatatttatggcaactcaaatctcatcgtatcattttgtaaagagtaactatgctatgtaaagttacccctaaaaagctaggtccagcgtccacagaagttctctgaattttatttaatgatttgatttcttttgatttgtaaaattatttgaaaatgtgatgttatcgttcttaattgtatttaatattacatgtggtgaacctataagtaatatataaacgagagtacgaggaaacatttcccttgcaatttgttttgaaaagtttcttacaaaatggcattttggttaagtttgatatttttctgcttttgcacatttgcatcctcaactccaccggatgatccggtcaagtgtgagtcaggaaacaacatgtgcactgtgacgaactcgtacggagccttccccgaccgttctatatgtgaagcggcaaaggtggagtaccccaagaccgaggctgagttagtctctatagtggctgcagccactagagccggccaaaaagtgcgggttgtgactcggtacgttcacagcatcccaaagctcgtttgtactgatggaaaggacggtgttctcataagcaccaagtttttaaacaacgtggtgggaaccaatcccgaagccaagactttgacagttgagagcggtgtgacgttaaggcagcttatcggagaagcggctgaattggagctggctttgccacacgcaccatattggtggggactcacggttggaggattgatggggacaggtgctcatggaagttcgttgtggggtaaaggaagtgcggttcatgattatgtgagtgagataagaatggtgagtcccggtttggcttctgatgggtatgttaaggttcgggttcttagcgagacaatagatcctgatgaatttcgtgcagccaaagtttctctaggcgttctaggtgttatctctcaagtaactttccagttgcaaccaatgttcaagagatcgttaacctttgttatgcaaaacgattcggatttcggagatcaagccgtgactttcggggaaaaacatgagtttgcagatttcttatggttaccaagccaaggcaaagtggtgtatcgaatggacgaccgagttccggtcaacacttcaggcaatggcttgttcgactttttcccattccgtccacaactctctgtagcgttagccatcattagatccttaggtaaatttattctttgtttctcaagataactaatacaaaatatatttgatcatttgcatagtttttttggtaaaaaatatttgatttgcatagttataatgtttcttataaacaactgcttcatgatatgaagaggagagtgaagagtcatccggagatgcaaacgacaagtgtgcgagagcagagcaaataacgtcgtttttgttttccatctcctacggtgtgactaacaatggtaaaaatattcgttcacttacttatgcatctttctattgtttccatatgtatgagactttacaactttctatcacatattcatttgtaatttccacgggcaggtatggaattcacaggctatccggtgatcggaaagcaaaaccatatgatgtcgtcgggtacatgtctagacagccatcaggacggactgatcacgtcttgtccttgggatccacggataaaaggccaattctttcaccaaacagcattcagtatccctctcacacgtgtcaaaggtttcatcaacgacatcaaagcactcgtaaagattgaaccgaaatctctctgcgcccttgaacgcagcaatggtatcctcatccgttatgtgacatcctctcctgcttttcttgggaaagaagaaaaagctttagattttgacctaacttactaccgaagcaaagatgatcccttagcaccacgtctctacgaggatttcatcgaagagatcgaacaaatggcgatatttaaatacaatgcattgccacattgggggaagaataggaacctagcgtttgatggcgtgattagaaagtacaagaacgcaaacacgtttttgaaagtaaaagagagatttgatcctttagggttgttttcgacggaatggaccaaccaaattctaggtttaaaaggaaacgtgacgattgtgaaagaaggatgtgccttggaaggactttgtgtttgttcggatgatgctcattgtgctcccaagaaaggttatttgtgtcgaccaggtaaagtttatacaaaggctagagtttgtactcatgtaaaatcagtaaatggctatgacgatcataccaaatttaatttgatgtttaatcgtatatgagaaaagtgaaaacagaacattttacagaacaacgtcttttgttcattatgacaagcttaacaagttttatggtcggtcacacgggcctttgttgttgggctttagccggtttatttggttcaattcggtttacatggttagtcctcgaataaaataatttcggtttaagatttgttacggctcctccgtcaatgtatcgtcgttgatcccaaatttcttctgaacaatttcgattttgaattcgcgctgagtgatg

SEQ ID NO: 16612 - DNA, 646 bp, Unknown; identical to SEQ ID NO: 21
  misc_feature (1)..( 646): 2750-1469P.txt file - cDNA_ID_1573308; gDNA_ID_818; Annot_ID_144538
  misc_feature (199)..(199): n is a, c, g, or t

SEQ ID NO: 16613 - DNA, 3003 bp, Unknown
  misc_feature (1)..( 3003): 2750-1469P.txt file - cDNA_ID_1580298; gDNA_ID_2684204; Annot_ID_191363
catcaacaccagaaccaatagcaccatctccaacccccaaaatcgaaaccgtctgaggagcaggaacaaccttaggaaccctaacttgaacggtacctccaataaaaacattagaagaaacagcaggatccttgagaaactcctccactcgaataacctctttcaaaaacttatgtttcgcattggctccacggagatcccgagaaaaccctaaggagcaatggcaaatccgacgactacaacaaaagagagtcgattaaacagagaagaagataatagtgaagcgttaaaggaatagatagatagagataccatgtaattggacaagctacgtgaaaggccatcccatatatcctcaccccaacaaaaattattcctctcgcctccaaacggaaaaaaaaaaaaaaaaatcgagattttgatttttagagatcgcttctttctcttttttttttttatatttaatataataatataaggatcggtaatgttaataactctattagtattaatgaattaatcagtagtttctttgtgtagtagaaaaagggtcgtctcttttggtgagctctgtgagttttggtttggacgcagagataaggtgcttttctcatctcaaccttaatcaacgatgtttttaagatgcagccaaagaaaccgagtgcgtgttgcttcttccaatcaaaagcttccacgtcacatcacaattgtgttcttcactatacaatattggaatttttggatagacagctgttgcatttttaacccaaaactttcctaagtattttaccaaataatcatatatatatagaagagaaaaatctgtagagcaataaaaacttagaaatccaaaatctttgacttggtaaatttgttattgtctaaaaacaccgatggtgacattgtaacaatattttttacgaaatatgccatcacacagttttgcttatttgtgcacaacagaaaatttaatatgcaatttatctatttaatgatctaatgactacaaatgatcttgatttttttgccaaacataaatctccccgaaacgttagagtagccaagtcttcctttacgataataacaccaaatctaaaagaagacgagagggagaaactcaagtaagaatttgaattatagtatcaagaacctttctcgaccagccccactaaaacgagagagaagatgatcgaaaaacatttgttctccaaactggttttgggccaactttctatgatttaaaattgggctcaaaacttttatcaatgaaaggtaaaatgatacatttgggctccaaactagttttaggccagctttctatgaggtaaagtcccatacaaattattattttttgttgttggggttgattattcaatgtagacatcaatgtacaaactacccaactacaaagcatctttactttaaactcaactactctctcttatttaactaaaactactaaattaattgattagtatatcatagcttacaaaacatgtttttaggttttatattcccgagcaaaacacttgtctaatctagtgtgtgttattatggttacaacttacaacgagttaatctgatcaaaaataagagaaggcaagtgaaagctagacataaccattcgtaattaataattgcaacatggagcaatcgcggccgcatgggggcaaatgtatcgagtggataacataaatagatagaaaacgccaaggaccctacacaacacgtaatttagtgatgtgtttattctattattcagctgatagccacatgcattcgctgactataacaagcctatagtcataatattgcacatgcctctgattttgtatagatagagatattcatttaaaatgccaattattattggaaccagccaaaggcagaattgccaacgccttctcttcctccataattacctttgcatctgccgcaattcccgttattacgatcaacaaaaaaagagccaacaatctgatgatatcttgtgcaattcttatacgatcttgtcaagcataaacaatatgaaaaagaatctgattttgaatgtgcaattaactttatgccaaagtaaatgatactttaataactcggtaatcgttattaataatatacgtgtgttttatagatgctgccgcctgccgcctatatgtgacttggttgttcattaccgatgttttgagatttataaactaagttagtggtatattttgtgtttttttacatgttagaccagttcttttttaaaacgcttatatgatgaggtagagtatatttactataatgtagtagtttaatattgaagtcttgagaatatttgctctgtttagttagcacatcgataatttttgacatcagccatatctctacgcatactaagtatcatttccaagatagtttaccatcaaagacgacaaaattcccactagctttgttatgaggaaacaataactctatgtatatgcatgcatgaaaacatttttagatttatgtagtaaaatttcaatatctctacagtaacaagcatatatcaataacactaaccaaggaaaactcattctctaattatctcctctcatctttgatcttctcaatattgtctcatttagctaactttagttcctctcaatttctcttattaccatacaaaatttactaattactgtacaaaaattaccaaataaaaggccacaaatatcttaggaagaaatgaagcaaggcacaagtgccaatacgagattagagagcatgaattaaggagaaaagtcggtttcggttcagtaagacagacagacaaaatccatcgttggggtccagtcacattacctctttctacgtgatttcctctctctccactcgcttttaatcctttcacttgtataaagtcgtagcatctcgagatcgtcttcctctcacaatctcaaattcttcggaccttttctctctcccctgaagctcccctcactcactcttctccgaggaagaacaacagagacaatg

SEQ ID NO: 16614 - DNA, 3003 bp, Unknown; identical to SEQ ID NO: 16613
  misc_feature (1)..( 3003): 2750-1469P.txt file - cDNA_ID_1580298; gDNA_ID_2684204; Annot_ID_137302

SEQ ID NO: 16615 - DNA, 3000 bp, Unknown; identical to SEQ ID NO: 15143
  misc_feature (1)..( 3000): 2750-1469P.txt file - cDNA_ID_1580305; gDNA_ID_2926059; Annot_ID_196166

SEQ ID NO: 16616 - DNA, 3000 bp, Unknown; identical to SEQ ID NO: 13062
  misc_feature (1)..( 3000): 2750-1469P.txt file - cDNA_ID_1580388; gDNA_ID_2214595; Annot_ID_135467

SEQ ID NO: 16617 - DNA, 3000 bp, Unknown; identical to SEQ ID NO: 13062
  misc_feature (1)..( 3000): 2750-1469P.txt file - cDNA_ID_1580388; gDNA_ID_2214595; Annot_ID_186879

SEQ ID NO: 16618 - DNA, 119 bp, Unknown; identical to SEQ ID NO: 311
  misc_feature (1)..( 119): 2750-1469P.txt file - cDNA_ID_1580388; gDNA_ID_1563642; Annot_ID_148043
  misc_feature (28)..(29): n is a, c, g, or t
  misc_feature (36)..(40): n is a, c, g, or t

SEQ ID NO: 16619 - DNA, 3000 bp, Unknown; identical to SEQ ID NO: 11178
  misc_feature (1)..( 3000): 2750-1469P.txt file - cDNA_ID_1581498; gDNA_ID_2214482; Annot_ID_133297

SEQ ID NO: 16620 - DNA, 3000 bp, Unknown; identical to SEQ ID NO: 11178
  misc_feature (1)..( 3000): 2750-1469P.txt file - cDNA_ID_1581498; gDNA_ID_2214482; Annot_ID_183401

SEQ ID NO: 16621 - DNA, 3003 bp, Unknown
  misc_feature (1)..( 3003): 2750-1469P.txt file - cDNA_ID_1582322; gDNA_ID_1974077; Annot_ID_180419
gtgtcgatttcttgaataaacaggtcctggagcgtcttgtttcaactctagatcgatgtgcatcacgtacatgctcattgcctgttgaaactgtagagctgatgcctgcccattgtagcagattttccttgacatgcttacaaaaattgttttccttgagcaggtaataacacgttgagcatgtcatgtccatgattatagcatagtcctttactctcttgactgcttcatctgcaaaggcactagcattttatacttgataatgtactagctcttgctcctcatatgagtccctaatcaactctagttgtgtattttgcatcaagcacacatagcaatatgcatatatatcatagagagagtccgcaggcacattgccatttctgctgcagaagattaggaatgtccatggatttggtacccattcctgctccctgtttaacatactgatatcaattaattttttagtttcagctctgaaaccgagaactggcactccacaagagcagaagtgagcaagatctctatcaccacactaatggccagatgtgaattcattttgagtagatttttaatcgacgaaaataatctaggtaaggctctccattttcttataaactccaacatctttttcgcttgccattccttaatcagtggttatcttttggcaggcaaccgtccaatcccaacagctagacttgaagagattatctttaccctccaagaactttaccgcctcagcattcatcctgaggttgcatctgttcttccgttgcaaccctacctgaaaaacgttctacgcgaagataaccgtgacacccgtgcacacctacttgtcctttttccctctctgtgcgagattgtgttatcaaggtaatataacttctacaattattgttttgtgttcgaagcacaaaagggtgacagcaaattctctgtatggaccctatcaagttaagattttgagagtttttttttcaccagggaaatgcgggtgagagagctggtgcaaattttactacgagcagttgctacggaactaggcctagaaaaggttagtctatccagttgatggcaatagatgggaatgtttctcagcagatttgagttcttacattagattcttgagaaattttggttttataccatataggttgtattctttgttttagcgtgttctgaattactctgtgtgctgtattctacaatacgccattctccgagattttatgttggtttggttcaacaaagtactctgttaactgattctgagaaccacggttcgatcatcaatacagtctagaccatcctaacctgccttcgtgtacttggtccattgacgatgtttggttaacttgtgctatttcattctgatcttgttgaaaataaatttgtgtttcaactcgtatatgcctattttaattaggtaaaattaaaaacttgagaatcttatatagatcaacatatatacatttgtttaagtttatataaacttgcttctcaataacaagaaagaagaattgcatcatttggactgattgatccgagcggcggcagcgacagaggcagccacaccggttgggtatgtagtgagatgaggatcgttcctcatctcggcgccagtcactccctctgcgtcctttctcgttgctgctttatccgatggtaatttgctactcgctccctttcataatcattgtttcccaaaatcgaaaaaaaacattagaacccgaaaatgaaagaaataaaactagatattggattcaagcattttatgtatcacgtcttatgtgctattacttacagtgagaacgtcggctagcgtagtcttggtatcgtcagagccgatacgagcattaagagtggcggctgattgagctgaagccgcaacaccgccgggcatgatattggtccgccccgtagctctaacctcggccgcttgaatggcggctgcgtcactccactccaccggcttattccctgccgtgagaaccgctgcctctagagcctctccaattgttatggttccttccgatttcagaggattagctaccacctttttctggttaacttctccctccgcctacaaatttaacgttctaattatacaaattatgatattaacacaacagcgatgatactagcacaaaccactagattatatagtcacaaatcaacctgttcaccggaggcctcggctacaacacctttctctttgtcctccgccgccttaatgcctccctccgttgtcgaaatcttctctgcctctccttttacatcagcacaatctataggtttctgcagctgttcttcgctcattttttggggtaactctttctctcttttcctttttttctctaggcaacaatatttataaatgtaatggtcagaatttatataagttttgcattagccattcaattctgtgactatcttacataaacaacaacaacggctctcctcaactttctctgattttccctcttaatttagccaataacaatcaaacatatgaatgattcggttcggttttcactgaaccgaagaaatccaatcgatttcgctttggttagaacaatcaaaccgataattgaaccagttaaatactatccggtttagctaactcaatcaatcggttagggtcttttaattagggttttaaagtttcagtctctctcacttcttctttcactcacataacaaaaaaaaaaacttcgttcacttgccgcaaagtcgccggaaccaacttacttagctcaccgtctcgccggagtttcgacaatcaaaggtttctcttctctccctgtttcacatctcacgacggatcaaattagggttttcaattgaatcagaatcagtgctggctctgtttgaatctattgttccgaatttgtgatttaatcttctaattagctttgttgtatccattttggagcaatcattcaatttcataatatctcaaataccttgattgatcaatagcgagaagaagcacgaagaatg

SEQ ID NO: 16622 - DNA, 3003 bp, Unknown
  misc_feature (1)..( 3003): 2750-1469P.txt file - cDNA_ID_1582349; gDNA_ID_1972122; Annot_ID_179027
aacatgaagatggcattaagactggcaagtcaagtaaaaaggagaaagcagataatggtttagcaaaaacatctgcaaagaagccacttgcagaaactatgatggtaaagcccagtggaaaaaagttagtccattcagatgctaagaaaaagaattcagaaggtgcaagcatggatacgcctattccccaatcatcaaagagcaaggtaatcagttatttgaaccatgatttcgcttatctgtatataatatactagaacttccttaaacttataatggggtaactgtgcagaagaaggattctcgtgcaacgacgcctgcaaccaaaaagtctgaacaagctcctaagagccatcccaagatgaaacggatagcaggagaggaagtggtgattattttgttgctttctctgtccatgatatgaggcattgacttctcacctgtattcatatggtatagattcctcttttcaggagtccaatacaaacgagcttggtgaagaactcgttggtaagagagttaatgtctggtggccactcgacaagaagtaagtttattgttaaacttactaacttcatttttgatactatatgatgaatgatagcaatcttacgatttgtatttgcacaggttttatgaaggtgtcataaaatcttattgtagagttaagaagatgcatcaagtgagttaacttctctatttggtattttaaaattctctatttattgcataactggtttatatagaattttcccactgatggtctcgcaggtaacatattctgatggcgatgttgaagagcttaatctgaaaaaagaacgttttaagataatcgaggataaatcttcagccagtgaggtgaaaatttcttacattctatcattcaccattctttatatttaccaaaatttcaatgtatctggtttccctaataaaatctaagcaggataaggaagatgatctgcttgagtctactcctttatctgccttgtaagtgaaacttccatagttctatgataacccacaatttataattttaatttagctttagtcttgagttttttgctgttatgtgcagtatacaaagggagaaatccaagaagaggaaaattgtgtctaagaatgtggaaccgagtagttctccagaagtcaggtatgaaagtatataagaattctagttttagttgtttgaaagtttgatccgtgagtgaattagttcacaattatggatgtagatcctctatgcaaacaatgaagaagaaagactctgtaacagactccattaagcaaacaaaaagaaccaaaggtgcactgaaggctgtaagcaatgaaccagaaagcactacagggaaaaatcttaaatccttgaaaaagctgaatggtgaacctgataaaacaagaggcagaactggcaaaaagcagaaggtgactcaagctatgcaccggaaaatcgaaaaagattgtgatgagcaggaagacctcgaaaccaaagatgaagaagacagtctgaaattggggaaagaatcagatgcagagcctgatcgtatggaagatcaccaagaattgcctgaaaatcacaatgtagaaaccaaaactgatggagaagagcaggaggcagcgaaagagccaacggcagagtctaaaactaatggagaggagccaaatgcagaacccgaaactgatggaaaagagcataaatcattgaaggagccaaatgcagagcccaaatctgatggagaagagcaggaggcagcaaaagagccaaatgctgagctcaaaactgatggagaaaatcaggaggcagcaaaagagctaactgcagaacgcaaaactgatgaggaagagcacaaggtagctgatgaggtagagcaaaagtcacagaaagagacaaatgtagaaccggaagctgagggagaagagcaaaagtcagtggaagagccaaatgcagaacccaagaccaaggtagaagagaaagagtcagcaaaagagcaaactgcagacacaaaattgattgagaaggaggatatgtctaagacaaagggagaagagattgataaagaaacatattcaagcatccctgagactggtaaagtaggaaacgaagctgaagaagatgatcagagagtgattaaggaactggaagaagagtctgacaaggcagaagtcagtactacggtgcttgaggttgatccatgaatgaaggattgttaggtaaatgttaatccaggaaaaaaagattggttcttgtggtttaggtaacttatgtattaagtgaagctgcttgtttagagactaatggtgtgttttatgagtagattcttctgacctatgtctcgttatggaactagtttgatcttatgtcaccttgctagcagcagatattgatatttatatatttaagagacatgcgcatgagaatgagggtatggaaaagtccatatcagatgacacaaacaatgatcgtatgtgtagtcacttgtgcatttccagttttggacataaaattctgatattgcatagaaatgtttttaaataacactaatccaaacctaaataaaatatctctatacatcatctagaaatgtatggcttgatcaagaattgtagataataataccctgagttaaatgattgtaggtattatttcagttttcaaaattgtccaaatttatgagctatattaaagataatattttcaataaggtgtgtagttctaaatgtttcttcttcttccaccaacccctctttctatatgtatgttcttttttctaaaataattgtttgttcttttttagatatatcaaattaaatataaaaaatattgacaaaacttatttaccattgttaggtgaacttggcaagtgtgtaaatataaagataacattccttttcgttctttatatatacgaaacgtaccacaaatttctaactaaagcattcatagtctctcgaaagcctcttttcagaaccgaagctctttactttcgtccaccgggaaatatg

SEQ ID NO: 16623 - DNA, 3000 bp, Unknown; identical to SEQ ID NO: 1408
  misc_feature (1)..( 3000): 2750-1469P.txt file - cDNA_ID_1582551; gDNA_ID_1620397; Annot_ID_155811

SEQ ID NO: 16624 - DNA, 3000 bp, Unknown; identical to SEQ ID NO: 11072
  misc_feature (1)..( 3000): 2750-1469P.txt file - cDNA_ID_1582654; gDNA_ID_2214478; Annot_ID_133161

SEQ ID NO: 16625 - DNA, 3003 bp, Unknown
  misc_feature (1)..( 3003): 2750-1469P.txt file - cDNA_ID_1582835; gDNA_ID_1620304; Annot_ID_152754
attcctcatttaatgggcctttgtaacgtttcatctatagttggtttaaggcccatatatttgtctggcctgatgtagtacaataattaacggcacaataattaagtagtcacatgactaccaaaattagtgtggtgagtgggtaaactgtgaagtttcagttcccattgtcccgtagtgagaaagcaccagtccgcacatgactagccctcactttaaccattcccccataagaaattactttttgagaatgattcggatctagttcatggcctattagtaactttcaaaaaaaaaaaaaaaaaatcttgctttagcttatgttattaacttattattggccgaccattgtccctcgttaatttaatattcgactgcactttttttgttttattgtgtgtggtgcaattcatcgtttatactttatccacacatccttgaccatagcatctaactaataaaatacgatggagactagctcttaccatagcatctttttttttttaatactaataaattgtttaaaactcgatgtttagttgagtacactatgtggccccaaaaagaaaccctaacgaaacctacacttgaatctatatatatggagtcatggagaagtagctcttgctccacttacgtttttagcatttaacaagcaatcaatatcattaggattatatatggagaacaagtttttcgctgcattcttcttgcttcttgtcctcttctcatctcgtaagtcttttccttctatatatatgcattggtccatgaccatatttgattgacaataaatatatatatatatgatatatatgtgaagtcagtgttacgtgatctatctccattcttatgtgttgcattttatttgtgtaattaaatagaggagatcattgggggtgaaggaaggacatgccaatcaaagagccaccacttcaaatacatgtgtacgtccaaccacaactgtgccatagtttgccgtaacgagggattttccggtggtcgctgccatggcttccatcgccgttgctactgcacccgcctttgctaactagtttattttccattaatccatttaaatgtactttttctttctttttattttgaatactaataaagttcatcttcttctttttctcgtttgacatctattgttgggtaaatctcgattctagaggaacgaactgagatatatgtattaataaaaatctcacgctgattctgaaacaagcaatgtactagaacgttgtgtcatgtgtgtttattgattaactagagttaaatttgatttaataaaaatgtcatttgatctatgttttgaatcagcactccaataaagattatcaatatcataaagaagtttctcttaattatgagaatatttataacaatatacatttttagttatcattttaacccaaagtccacattttcttttagtcagttattatccaaaaaatcgtttatacttcccggccaaaggtttccttaaagggattttcaacaatcattttccaaaaacatttgaagaagcatatatatacacatttctatggaaaaaagcgttcaagaaatcacatacaacatctaacatttatgcaaactattttttcatataaaatctgataatttttatacacaatattctgtttatttttacacaatgttctgaaatttgccgattttgattgagtttcaaatgaccaaagttaacatttgaccaatttcaagtatggatttatggaaatgtcataactagagcaagagagacataaaagagaaatagtactaagaaaaatggaaaaagtacatcatcaacataagagcaaatgtctcaatgcattattctatatatttttttttatctatcggttctgttataatagtcaagagaagtaaaaataataggagtatgaagaatgcaacaacccacactaagatgtttataacatcatatgtacacgatgaatgccaaatgaactaatttgcggtctaagtcatcatcatctgttaccattgaatcacttcaactttgtgtcaagtccccaaatccggattgttccatcatcacttgctgaggccaccatatagaggttagtcgggtttcaactgacacacttcaccgatcctgagtatcctcgcaatacactacaagattacgtcagtgttcttcgtatgacccatatgtatacctgacacatcaaagaaatattactcggaagactctaaaagagattgataagaactgttttcccccatatctatgtcttttttacgttgtagattaattattcttgatttgggtatcataaatttaaattaaacaatctagttaaaaatgatgagatctatttggagtgaaattaaacaattttaataaaaatgtatgtgttatatgtatatatacatatatagattaagtggagtgaaaattaacttaataaaaatatcattgatatatgttttgaattagcactctaaaggttatcaatatcataaatgagcttctcttacgagaatatatatatgtaagaatatacatttttagttaattcaaaatttcattcgattatttgtttgaacccaaggtgcacatatgttcccgtaagccgatagtcataacatttgaagcattaacacatttctatgggggaaaaacgttcaatcaaccacataattgtaaacaactaacatttatacaaacgatcgtctgaaaaaaattgattcatataaaatctgataactttagtttatagtatacacactgttttgaaatttgcggatttagattgattcaagttcaaaaaatttgaaaatgtccaaagtcaacatttgaccaagaagtcgagtgttgtttttaatattgatggctaatatgattttaaagcccatacataaaagcccaaatacggcccaataaaggaaaagactcctctgggaagaagaactaaaaaagaaactgggattttggaagaagtggtcgagagaaaacaaacgataatg

SEQ ID NO: 16626 - DNA, 3 bp, Unknown
  misc_feature (1)..( 3): 2750-1469P.txt file - cDNA_ID_1585658; gDNA_ID_782; Annot_ID_144518
tgg

SEQ ID NO: 16627 - DNA, 2754 bp, Unknown
  misc_feature (1)..( 2754): 2750-1469P.txt file - cDNA_ID_1585780; gDNA_ID_1028; Annot_ID_144734
aacatataaaatagcttttgattacatttaactatttaagaaataagaattaagatagaataaaaaagctattaactagttcttcatcacctttaattaaatagttatttagaataaatttattttgagaatcagtacaattgcataaatgaatacaattatgtctataaaaattcactcttattagttatttcaactcttttaggcataaagcttgtaaaactttttttcttctttaaataataaaatttggaccctttaattttttataattaatttcctgtagatttaaaaccaaatcttgataacagtcgtgacagatctttaagtagatcatcattatctatgcataacacgaactcgagtatgaagaatgaacctctaactggctgagctaaataaacttgactattttactctatctttgaatacgatattgtttcaagggtatagtttcatattaaaacacttcaatgtggctgcttcttaatcaccacaaaaacaagtacttagttagtagtgaaaaactaaaaaccagtttaaacaggtagatatacaacactgtttagataaccgagatggttggcgaattaaacatagttttattaataattgaagaaggaaaacgacagatcaccaaagtagggactatgacattaagaagggaatcaaaacttagtgtttggttattcatgggtttgtcctttttctcttgtaattcagttcctctttgtcgtcttcagttactcttattacttctttgggggttaaaatgtgaaagcctattcatatcaaatcatggatatgacttatgcaataatggacttgttggataacagtaagtgggtgatatgttttggaagtagtttcagtttttttcctattggagaaagagaagaggtcaaaaaaggaatcataacaacttgatttggaggaggaagactttaaagagtgatagacaatggtattaaataagtggggaagagtactatatactgatgagataatcattaattgataaatggaattttcattgcagagtggcacatgtggttaatttaaagctgaagaaacttgtgagccccatattcttcattacaaaaccatttatgtcttattgtagtgtagactgtagagtacatacatgtagacggaccatcgaattttgaaattcagatttggtgtacctttgaaaattcatatcattatgactcaagagtctacgtatctctaaaaatgttcttgtcttctgtgatactttttttttgttagccaggcaatacaaccatcaaaaactaaaagcaataagaatggttggtgcgtttctacttaggttgtatctcccacgctaaactagtgagcacgagttagtcatttaagtatagctccatctaattatagattgtgtccgaacttcgcggttcaaaatcagtgtttcttcttcgaacttctattggttgttatcgcttgtacttttttgtcgtgcttttttttagtcatatttgttgtaaattttggattttctatttttttattttttttataacctttgtccaaatataaaaatgatataaacacttaacagttatcaaaaaaaaaaactaatatactaatgcagaatttatatcaaaagtattttatttctttatgtctttcatagtttattagttaaccacaaatatactaatgcagaatttatatcaaaagtattttatttccgtaacattcaaattgaaagtaattaccttttgtcataaaagtaattatgttgtggcagttataagtggttaactacttacattgtcgaatcataaaaaggtaaattccatatacattacatgcaaaacaggagggtttgaaagaaagcatgggcttaaaaccttacttacaagctatttattgggccgattatttaactcatcaattggttgcaatttgagcacttacgtaataatcatgtggtgaagggttcgaatcctcacctctacatttaccatttttgtattttattcttcacaaatagtgggcttgaaagccatatatgatcttcatttcttgtaagttgtaactcaaacgtactttattcaaaagtgatattgggagataaatctccatttagccatagtgtttatttatttttgataatcttcatttaatcatagttattaacttaatatggtaaccgatattcaaccgataaaacaaaaaaaagatccaagtcaataagaaaaaacccaaaaatatagtaactgctaaaaaaaaaacttaattttgcgatacagaaatattttctcaccccaccccagattcaccccattaaccgtttcaaaaggaaattaaggagttgttcatagtttcgtttgtaaattgcaattgtaagtttgtaactgtaatagaattagattatttagggtttgcttgatcctcgatctgtgatcgattgatctcgcttcgcacccagcaggtatcatttttattccattttctctccggccgtgtagttaatttgttaatgcattttatgtttgcatggtgaatctaacgattttttggaattgttttatatcaatccgaaacaaaaatgattaatatttttcgagacaaatctttgcgttgatttatgatatacgaacaaaaagaagaaacaaaccgtattacagattttatcggagaaagtttgcataacaaaccatatgtatacagatgttacaatgaaagtgatatttcaggtttatttaatgagcgtgaaagatg

SEQ ID NO: 16628 - DNA, 3003 bp, Unknown
  misc_feature (1)..( 3003): 2750-1469P.txt file - cDNA_ID_1585796; gDNA_ID_1007; Annot_ID_144573
  misc_feature (2208)..(2208): n is a, c, g, or t
catggtcctaaaagcccatttgacatccttacatgttcttcatctgttggaacccaatcatattcgagtcacccgtcatctgtcacctcttcctctagttttccctcgaggaaaatatctggtatcgtttcaacgagttgaggcagatcatcaaatggatcgtcaagaatatatgtgtgctgtattattatgtttttaaagggatcaacagaaactttggctatcctagttagagtgtcaaacccctcggcagtctccccatacacctgaaaaagggcctagtaatttgatatatacacaaaacaaagaataggtagatcattaataactagcacttacattgcgttttcgatcgacatggtctagaccatcactaagtgtaatatagaattaaaaatgaattaaacaaatgacataagactcggcttttacagattttttgagatggtcgttggtctggtttgcttcattatttttctcagttcttaggatcgattgcctacaattctagtttttgtttgatctttcattttttttaaagttccacaattcttagttgttatggtctttttgtgccatgtattgtatcaagtgcttcttgtgtatagtgatttagttttcgagaattttttgtttccgcagatattagtatttcaaaaacgtattgatatccattatttcacccctaatttatataatcaaaaattcaattaaaaaaaatatggtgtgtatcgccaacgtagaatttcaatatatataatattacagtctttttttccgcacataatattacagtttctacttaagttaatgatatgaattatttaggtatttatataaaatatttaattatatttttacacactaaaaacaaataatgttaattattaattattattatattaatctttaaatgatacatgaataaacgagacaatgagtaaataatatattttggaaaattgagacaaaaagggacaggacaaaaggaagctgtgcaccgccaactggaccgtggctgtagtcttctaccttccactgtcatagaaacagaataatactctttgttctttgcttcttccatggaaactctccacttactagaaataaataaacctacttttcgttaataacttaggccaaaacaaagattaattatatcaaaattttactagttaattaactttaaaatatactttttaattaggttaaaacgttctttagttgaaatttgcaagtgattagttatattagcttcaactaatggaaacatctcacaatttgtcaaaaactcgtttagaaaacaaattgaagtctagtagccttattttacgtggaatagactttatatatggtaataaaaattataaatattcttgcaatgaattttattttttctgttgactttctcaaatttgagtactgatttgatttgttgcacaaaaaaaaaagagtacttatttctgaattttgaaatcatcttagaatgtataattgtattattaaagtttttgagttttttttgtgaaaataaagtttttgagttaattgtgatcatacatgtatctatgtgtaatcttaaaactatctaatcatattcactactttctttttttatatttatcaaccagaaattaaattaagtaaataaccattaaattaagtacaatagaaagttatgttttcagattttcttgtgatgtttgtcggtgcttcaaattttttctcttctttgaaaaattgataattatatagttttctgactttttcttgtttgtcggtagaataagagaattcggatgagtaataatggatgactataaggttaattcgttcattttacattagcaaatgcattagtactcatgatagtagtttaagtatcatatgaaagttacacaacaactaagctgtttttataacttgaaaatatcataacactattcaatgtttaacaaacggagccggactccatttgcaatcttttaaagtaaaactagaggatcatattctcaatattaaaattaattttaatattccaacaatgactctttgtgatttgccatctcaacaatgaccgacaatttataatttattttagttaatgtcgtttatcaaaataaaatatcattctttcttgttaacattaattagcagtttcgaagtaatatagaaagacgaaattgtgaacttcacatttttgtaacnggtaccaaagtagataagacttcttttacacatctacttaagttccatatatctcttcttctaattactacactaaaatataaaaagaaaaacttaactatcaagcaactaaaagaatgaaaagtatttgtacattgtacatgaggctagatggattagagatccatgttgcaattcaataatggcattcctcaaattagctttccaaactttcatttatgttatttggaaagaacataatcgcaggttttattctcgaataactagatttctatcggcttgattatatatatcaaaaacaccattcgttactagctaaagccttaatagttacctattagatcaattgacttagaaaatcttagaatatgttataaatttggtttatttttatgttttacgggcgaattttttttgttttttataattgcttgatttttaaaaaatgttgtatttttttaatgaaaaaaacaaattactaaccgatttcttgtccaatttttcagaaaataatttttaagttgagaaatttactaaaaatataaaaactactaaatatattaatttaagactaattttaaagacaataataattataaaattgattaatgacgtacgcgtttgtgtaaatttaccaaaccatacccttcaaaaacccaaccacaaaatttgacaaactcatcgtttaacaaacatttcactttcctcttctcccaccattttcagagctcagagaaaaagaaagaaagaaaaaaagcttcgtgctccttcaccttcccaaatcggaaaacaatg

SEQ ID NO: 16629 - DNA, 5 bp, Unknown
  misc_feature (1)..( 5): 2750-1469P.txt file - cDNA_ID_1586187; gDNA_ID_1336; Annot_ID_144994
ttatg

SEQ ID NO: 16630 - DNA, 868 bp, Unknown; identical to SEQ ID NO: 34
  misc_feature (1)..( 868): 2750-1469P.txt file - cDNA_ID_1586207; gDNA_ID_1303; Annot_ID_144969

SEQ ID NO: 16631 - DNA, 1100 bp, Unknown; identical to SEQ ID NO: 51
  misc_feature (1)..( 1100): 2750-1469P.txt file - cDNA_ID_1587274; gDNA_ID_1775; Annot_ID_145354
  misc_feature (624)..(624): n is a, c, g, or t
  misc_feature (647)..(647): n is a, c, g, or t

SEQ ID NO: 16632 - DNA, 2984 bp, Unknown; identical to SEQ ID NO: 47
  misc_feature (1)..( 2984): 2750-1469P.txt file - cDNA_ID_1587391; gDNA_ID_1731; Annot_ID_145324

SEQ ID NO: 16633 - DNA, 2503 bp, Unknown
  misc_feature (1)..( 2503): 2750-1469P.txt file - cDNA_ID_1587654; gDNA_ID_655; Annot_ID_144494
  misc_feature (356)..(356): n is a, c, g, or t
accaccgaaaacaaactcagcttcttcttagctaagcaggcttaaggggcggctggacttatctaataataaaaatttgagtatctaaacgaataaattggagatattcttttagtgttatcctaattatagttataaaacaattataaccttagaaagtttcttggaaatttaatggtaatttcattaccgtaaatagtttttctttcttcttcacgttttttttttttgtttttgtcaaaactttcttttctcttttctctataaaaactaaaaaggcaaactttcctcccttttttgggtacacttgcccaaatgctcctctcagggctcaaattaaaggggggaaaaacagncaataaaatattaaaaatcatgaacacgatcttaaaaaaattatcgtgttttaagaaaaaggttaaatctttacgaatattcgaatccaggtcactctcttcttcgtcttcttcctcattcactcctcaaaagttcgacgtttttctaagcttcagaggcaaagatactcgcaagaacttcgtcagttttctctacaaggcgctagtatcaaaagggattcgaactttcaaagacgacgaggaattggagagaggccgtccgattccgccggagcttctccaagcaatcaaagggtcgagaatcgccgtggtcgtggtctctgcaacttaccctgcttcttcctggtgtctcgaagaactcagggagattctgaaacttgagaagctgggtttgctcactgtgatacccattttctatgagattgatccttcagccgtgaggagacagagcggagtagtctcgaaacagttcaagaagcatgagaagagatatagcagagaaagagtcaaatcgtggagggaagcgttgaccaaattggctagtctctccggcgagtgttcaaagaattggtataaatctccgaaactttcttaaagattgaagaatcgggtcgataatttcagattaagatctcttgtatagtttctcaaagttttgatttttttctctgtttctcaaatttaaggtctttgtctctgtttctgttttagggaagatctgtcgaatcgtttctcaaagtttcgatttttatctctgtttctcaaagttaggatcattgtttctgtttctcaaagttagggtcttcgtctctgtttctcaaaattaggatcattgtctctgtttctcaaagttagggtctttgtctctgtttctgttttagggaagatgactcgaagctggtcgatggaattactgagaagatatcaacaaagttgttctcggaaaaaccaaggaatgataatatcctaattgggatcgaccaacacatgggggaattgtatccactatttaacctgaattcgaatgaagatgttcaagtcattgggatttggggaagaggaagtaatggtagatcagcactagcaagccacgtttaccaaaacatcaaacatcactttgaagctcattgttttctcgaagacgtgagacggatttcgctacatttccgtgactctcatttacaagacgagcttctttcaaatatgcaaggagaaggtttgacaacaaagaactgtcataggtgtcttaagacgatcaaagcaaggctaaggaacaagaaggttcttcttgtggcgaacgatgtagacaagcttgaacaattcgatgcacttgctgaagaatttagctggtttggtcctggaagcagaatcatcataaccacacaagatagacaattgcttatttcatcagtagtgaggagtgtctacgaagttaagctcttgaggtgttacgcagttcgtgagctctttaggtcaaatgccttcaaagaaagagaaagagacgatactgttgggttcgaccagtctacatatcgagccatgtatatttcaggtcatgtgtttttgaccttgagatatattttcactttgttgtgtgatagaggtcaacttagagaaaggataaatgcaatagtacatagtctttagattcattaatccttttaggtacaaagtgttgtatttaggttgaataagttggttagattcaggaatattaacttgatgtgtttgtttgttctatagtgaatgttacgccattttttttacatatggatgtgccacttgtgtatggatttgtgtactatccatttggtaaactattttattcttaagacggttcacaacaaattcatttaaacttgtaattgttttataaattatctatatcaatctcgtccgacagttgacttagttgtaaccaccagaaaagtaagatgataatttatgtttatccatgttcattttcttattttggcggctcatcttctctttctgagtagtttagtgaaacagaagctgacaaacaaaaaatgaaaatgccaggaaacacactagagcagaagactcctagttcaacttctcttgtgttaatgtgcctataaatatcctttgagatattcatagagtatcagaaataaaaaaaaatg

SEQ ID NO: 16634 - DNA, 23 bp, Unknown
  misc_feature (1)..( 23): 2750-1469P.txt file - cDNA_ID_1593869; gDNA_ID_1590659; Annot_ID_149904
  misc_feature (8)..(8): n is a, c, g, or t
gtcgcggnggttcttctgccatg

SEQ ID NO: 16635 - DNA, 3 bp, Unknown
  misc_feature (1)..( 3): 2750-1469P.txt file - cDNA_ID_1594736; gDNA_ID_148; Annot_ID_143950
ctg

SEQ ID NO: 16636 - DNA, 1166 bp, Unknown; identical to SEQ ID NO: 48
  misc_feature (1)..( 1166): 2750-1469P.txt file - cDNA_ID_1595874; gDNA_ID_1738; Annot_ID_145335
  misc_feature (33)..(33): n is a, c, g, or t

SEQ ID NO: 16637 - DNA, 67 bp, Unknown; identical to SEQ ID NO: 44
  misc_feature (1)..( 67): 2750-1469P.txt file - cDNA_ID_1596062; gDNA_ID_1579; Annot_ID_145191

SEQ ID NO: 16638 - DNA, 1185 bp, Unknown; identical to SEQ ID NO: 401
  misc_feature (1)..( 1185): 2750-1469P.txt file - cDNA_ID_1596076; gDNA_ID_1590766; Annot_ID_150020

SEQ ID NO: 16639 - DNA, 927 bp, Unknown; identical to SEQ ID NO: 399
  misc_feature (1)..( 927): 2750-1469P.txt file - cDNA_ID_1596099; gDNA_ID_1590760; Annot_ID_150006
  misc_feature (13)..(13): n is a, c, g, or t

SEQ ID NO: 16640 - DNA, 3000 bp, Unknown; identical to SEQ ID NO: 5755
  misc_feature (1)..( 3000): 2750-1469P.txt file - cDNA_ID_1596158; gDNA_ID_1620814; Annot_ID_50647

SEQ ID NO: 16641 - DNA, 239 bp, Unknown; identical to SEQ ID NO: 395
  misc_feature (1)..( 239): 2750-1469P.txt file - cDNA_ID_1596158; gDNA_ID_1590743; Annot_ID_149977

SEQ ID NO: 16642 - DNA, 3000 bp, Unknown; identical to SEQ ID NO: 5755
  misc_feature (1)..( 3000): 2750-1469P.txt file - cDNA_ID_1596158; gDNA_ID_1620814; Annot_ID_169187

SEQ ID NO: 16643 - DNA, 2024 bp, Unknown; identical to SEQ ID NO: 3
  misc_feature (1)..( 2024): 2750-1469P.txt file - cDNA_ID_1596316; gDNA_ID_141; Annot_ID_143938
  misc_feature (20)..(20): n is a, c, g, or t
  misc_feature (391)..(391): n is a, c, g, or t
  misc_feature (587)..(587): n is a, c, g, or t
  misc_feature (709)..(709): n is a, c, g, or t
  misc_feature (1094)..(1094): n is a, c, g, or t
  misc_feature (1306)..(1307): n is a, c, g, or t
  misc_feature (1309)..(1309): n is a, c, g, or t
  misc_feature (1336)..(1336): n is a, c, g, or t
  misc_feature (1727)..(1727): n is a, c, g, or t
  misc_feature (1864)..(1864): n is a, c, g, or t
  misc_feature (1967)..(1967): n is a, c, g, or t

SEQ ID NO: 16644 - DNA, 58 bp, Unknown; identical to SEQ ID NO: 35
  misc_feature (1)..( 58): 2750-1469P.txt file - cDNA_ID_1596332; gDNA_ID_1330; Annot_ID_144987

SEQ ID NO: 16645 - DNA, 356 bp, Unknown; identical to SEQ ID NO: 388
  misc_feature (1)..( 356): 2750-1469P.txt file - cDNA_ID_1596933; gDNA_ID_1590610; Annot_ID_149852

SEQ ID NO: 16646 - DNA, 35 bp, Unknown; identical to SEQ ID NO: 608
  misc_feature (1)..( 35): 2750-1469P.txt file - cDNA_ID_1597137; gDNA_ID_1592312; Annot_ID_152242
  misc_feature (6)..(6): n is a, c, g, or t

SEQ ID NO: 16647 - DNA, 394 bp, Unknown; identical to SEQ ID NO: 624
  misc_feature (1)..( 394): 2750-1469P.txt file - cDNA_ID_1597184; gDNA_ID_1592452; Annot_ID_152489

SEQ ID NO: 16648 - DNA, 1867 bp, Unknown; identical to SEQ ID NO: 610
  misc_feature (1)..( 1867): 2750-1469P.txt file - cDNA_ID_1597200; gDNA_ID_1592316; Annot_ID_152249

SEQ ID NO: 16649 - DNA, 1727 bp, Unknown; identical to SEQ ID NO: 391
  misc_feature (1)..( 1727): 2750-1469P.txt file - cDNA_ID_1597200; gDNA_ID_1590645; Annot_ID_149888
  misc_feature (447)..(453): n is a, c, g, or t

SEQ ID NO: 16650 - DNA, 1032 bp, Unknown; identical to SEQ ID NO: 6
  misc_feature (1)..( 1032): 2750-1469P.txt file - cDNA_ID_1597245; gDNA_ID_226; Annot_ID_144017
  misc_feature (69)..(69): n is a, c, g, or t
  misc_feature (369)..(369): n is a, c, g, or t
  misc_feature (450)..(450): n is a, c, g, or t
  misc_feature (604)..(604): n is a, c, g, or t
  misc_feature (606)..(607): n is a, c, g, or t
  misc_feature (609)..(609): n is a, c, g, or t
  misc_feature (802)..(802): n is a, c, g, or t
  misc_feature (805)..(805): n is a, c, g, or t

SEQ ID NO: 16651 - DNA, 3000 bp, Unknown
  misc_feature (1)..( 3000): 2750-1469P.txt file - cDNA_ID_1662819; gDNA_ID_2926261; Annot_ID_143224
accctttccctctctctctacattgatttttcattttcggtggttctttgcagttttatttgattgattgatttttgaaaaggtcttctttttttggttgtatgattcacgggaatgattgagatttctagtattgtatctgcaatgatccgtgggaacaaacgtgtcatctgatttgaattccatgagcttgatgtaccatttggctacattcttctccttgctggatttgtattgcatttgatgattacttctttcgtgtggattgttcagttctgagataatcctttgttttactaggaaagtttcctcttttcggtgcgttaatcatagtatgattcaccactggcttcttggtttttgaaatttgatcttgtgtatcaatccttttgagttcttcattgttagggacatggatgttttaactgtatactatgtttgtaggatttatagctgtttaaaggcatgctgaggaacttgcattctgaaatttatgttttcttaaccaaagagctttgtttgttcttagcattggaaattttgttgtgttttaagcgtttctgtaatatacagcatctgatcaatatatttttttctcttggtttattacgttggttttagtatttaaggtttcactgaatttgttattattgatttgtttggatgaatttggtatacttggcttctctgattcattctttcgtccagaaggaaatgaacatttgagtttattgatggattatggattgacctgtttagatgtaattctttggttgatgactaaagctccttgcttgtaaatcattggaatgcgttatccatagtgtgattcacattggcttctagattccaattttttgttcttctgtttccatgttgatcattgaatttgttctcttgttttttttatggagattatcgtatttaagtttccactccccgagtttgatacgatggtttgaattgtttggatggatctcatacttcatggaatccgttttatgtacttttgtttttccttagaagattatacatcaatggtcacatcttgattgtggtagtcctgtggcttattcttattcttgtagaacacttgaccaagtataaagtttgcctttgatgtgaaatattaatgtttcatgctattttcaggcttctcttctcaagtccttgctcaaggaaatgagataggttttggttcagaagtcccagccacagtcgaagctgtcaaaacgcctaactcaaagattgtctatgatgaccataaccatgagcgttacccacctggtgaccctagcaagcgtgcattcgcctattttgtcttgtcgggtgggaggtttgtttatgcctctgtcctccgcctgcttgttttgaagcttattgtgagcatgtctgcaagtaaagatgtccttgcccttgcatcccttgaggttgacctagggagcatagaaccaggaactaccgtgacagtcaagtggcgtggaaagcccgtcttcatcaggcgaagaacagaagatgacatcaagctggccaatagtgtggatgttggatccctgagggacccacaagaagactcggttagggtcaagaatccagaatggttagtggttgttggagtgtgcactcatttggggtgcatccccttgcctaatgctggtgattatggtggttggttttgtccgtgtcacggatcacattacgatatatctggaagaattaggaaaggtcctgcaccatacaacctggaagtaccaacctacagcttcctggaagagaataagttactcatcggttgattaataaaagcacaacagtcaagagtctggatctgaatgatgatcttcacttgttctttttttcttttaattaatattttccggcatgttagagcaagattgacttgtttttgctgaataatacaaacttgtgatttttgtttgaagtatactcaatcttcgtttatccatcgctagtaaaagacgactatgttcatagtctgtgtttattatttaacatgcctatttgtcctatgtatgagtgagattcctttcgtatctcataattctaaacatcgtcattccaattaaaaagttgtatttacatttgagtttcgatagtatctcaacgttcataaaagaaaaactaaaggtatgagaaaaaccaacgtagaaacaaacaacaaaaggtaatatatcagctttgattgatagtttacaggaagataaccgaataagttcaaactgtattcgtaagacatcccgtgaatgaatattcaatcatccaaaagtggcatagctagattttttctagattggctaagaacacaaaaacataatattttattctgtttaatcttttttagttaagaaaaaatgtttgacacacaaaagccaaagtttgatttgggtaaaaaccattgtgggagatgaaaatgttaaaatcttgtttgttttggtcaccaacaacggccatgaactatatgggaagtgacttatctcttgtaagttgttttccttttgggatatgggaagtgacttctccgacccttgcaaactaacaacggccattacacactaattacaagccaaaggtcctcactaagcaacctctcgtgtttatcataagacaccgctctatctcttattattttattcattgttttctaatttcagactgattaatcatacattagagaaagtttattaaaaccatctgatgtaaaaaatcacatttatctaaattaaataaatttgttatctagtatataactatttattgttttaacatttggataaattgtaagaaattagaatgtaaaataagacagaaaatggtcaactatgagcatctatcgccatcatgatatagtttcgtcgtttgcgttcccgacctaactcaaaacttcaccaaccccatttttaagcccctttctttgtttttatcctccgatcgatcaaaccaagaaaaaacactttcgtatttccctcgacgaaaaaaatg

SEQ ID NO: 16652 - DNA, 3000 bp, Unknown; identical to SEQ ID NO: 16651
  misc_feature (1)..( 3000): 2750-1469P.txt file - cDNA_ID_1662819; gDNA_ID_2926261; Annot_ID_204742

SEQ ID NO: 16653 - DNA, 3000 bp, Unknown; identical to SEQ ID NO: 6166
  misc_feature (1)..( 3000): 2750-1469P.txt file - cDNA_ID_1662829; gDNA_ID_1620852; Annot_ID_51008

SEQ ID NO: 16654 - DNA, 3000 bp, Unknown
  misc_feature (1)..( 3000): 2750-1469P.txt file - cDNA_ID_1662833; gDNA_ID_1971851; Annot_ID_58408
ataagaatctatataacgtttttgttgttttgtgattacggttgggcagaaaatctatacgatgtgtttgtgaacataagagatgatgaagcagaacactgcaagacaatgagagcttgtcagactctaggcagtctgcgttctccacactccattttagaagatgatgatactgaagaagaatcagggtgtgttgttcctgaggaggctcattgcgaaggtattgtagactgcctcaagaaatccattacaagttaataaattagaaagtaaactaaaaaagattatttgtatcagctcatgaacaatagatataatcccatatacttgggaataaaggaataatgtgaaattcccatcgttgtgctagtgtgtgagagaatcaaataccctaatgatgtaaatgtactttgatgagcttaagtcgttgtagaccattttatccatactactagcctttgtggttgcattgtcggtttcttcaattcttatttcacaggagtaaaaaaaatgtttaaaagtacaaaatcattgaatgtatcattctctcaaaaagcatattggtattagcgtttagaatctctatatcccacacttttatttttattggttttgttggggagagtgtggcgcaaagacgacgtcgtctatgcgaacatttcacgtgggaaaagccttgattcatgcgccttctttaatttttcttctttttttttttttttttttgtctcttctttgcctttcactttttaaaatgattttccgcgggtttaataacaaaaatgttttcccgccagaaaggttttaccaaaaaaccatgttccggttatagcacaggtaagagaattcatcagtctagtataattagcagtaatcaaattcgaatactttgatcgtcgcttttatttcagagttagcgttacattaatagtacctttattcgattgatgatttgtttaatctttaatagggtttgaactccgatggaggaccttttttgttggtaatattcccttcgtttcacaatataagttgttttaactaaaaatacgtatattaagaatatttatttttaaaatgttcaaccaattataaaaaaaactgtagaatataaataatcataaagtattaaaataatatataatttgcatagaaacttgaaaacaacttatattataaaacaaaaaatttggtataaaacaacttatattatgaaacggagggagtataaacttaagtactaattcgattttgtttctattcgagaccttgaagacttttttatttaattttaaaactaagtcgtacagttacagaaacagcattaaatttttcctcttaagtaaatttattttttctctttctatcagaaattcagaagaactaacattatagttgcccccattgcgtacactgtacatcatttctcggtaaattacacataattataagttgattaaccttttaagttttaaacaatgatgtaagtaacttattaaaaattggtttttaaaaattgaaagttatatactcaagttggaaaaatattttacaaatatactcgattccactactactgtaattttgtgtggaataccagtcaaacagaatcgttataactgttaaaaattagtaaaactgtataaagtaattttaattcgcgggaaatcaatattcggaagcaactttaacaaaaaaaataaagaaatgtgaagagaaaaaaaaaactctgaaaacttcctttataatgtcatcatcactgcgagacccaaagatctaaacagtttctctctctccctcacagggctctctcatggcggagctaatctgtctatttcactggtgattctgtttcactatctgagaatttgtttagagtttccgttaccgagtcgatgatgagtgaactcgatctcggaacgagtcagaggatgacggaaacacaccgcacgacgacgacgtttcttgatttgctccgacgacagatgagcggtcacgatctcaccagaaggaaacggacgttaaaagaacggttgagattcaaatgcatcggatgctgtggtccaacctggaatctccgtctaactaacaacaccactcttcacagtccaacctcaagagacgacgaaatcgaagagttacaaattgaaaccggactcgttctcgaatcggatcatggatcgggtacgggtatgaatctcgcgacagcgttagaagcggagaggtataaccgtggagaatcgacggaggcggaggcagatatgacgccgaggagagtttcgttgatgagattgttggaagagacggcggagaaaatcgttgatgacgacgggaaagaaacggagatattaacggcgtctattgggacgttaacgggtaatgattcggtgtgttgcgtgtgtatgggaagaaagaaaggcgctgcgtttattccatgtggtcatactttttgcagagtgtgctctagagaattgtggctgaaccgtggatcgtgtcctctttgtaaccgtccgatcattgagatactcgatattttctgaaaacgatcggacggctaaaagttctcgatccacgtgagtaagtgaggtgatccctagatacgtttccaaagttttaactacggtttgtgtactttgtacgtttcttttggttattgaagaagatgatgtaaatgcaaaaaagaatacaagaggttttttgttcacgaggcccatttagtctattcaagcccagtaaaccgttattttggattttatctagcctaaacaatgctcgcctcacaccgtcgagtggattcttggccgttgatcttgtctctcacgtggcagtatcgtagtcgaatgtacatgatctatgtggaatagtcgatattatccctcttggtgtgagtttggtagttgatgaaagcaaaacatttacgtaacaatgtctataaaatcagtacaggtctattcttgttcactagcttcgaaattttagtcgaagaaacaaaaaaaaatg

SEQ ID NO: 16655 - DNA, 3000 bp, Unknown; identical to SEQ ID NO: 16654
  misc_feature (1)..( 3000): 2750-1469P.txt file - cDNA_ID_1662833; gDNA_ID_1971851; Annot_ID_176393

SEQ ID NO: 16656 - DNA, 1066 bp, Unknown
  misc_feature (1)..( 1066): 2750-1469P.txt file - cDNA_ID_1662833; gDNA_ID_2926179; Annot_ID_140493
acggaaacacaccgcacgacgacgacgtttcttgatttgctccgacgacagatgagcggtcacgatctcaccagaaggaaacggacgttaaaagaacggttgagattcaaatgcatcggatgctgtggtccaacctggaatctccgtctaactaacaacaccactcttcacagtccaacctcaagagacgacgaaatcgaagagttacaaattgaaaccggactcgttctcgaatcggatcatggatcgggtacgggtatgaatctcgcgacagcgttagaagcggagaggtataaccgtggagaatcgacggaggcggaggcagatatgacgccgaggagagtttcgttgatgagattgttggaagagacggcggagaaaatcgttgatgacgacgggaaagaaacggagatattaacggcgtctattgggacgttaacgggtaatgattcggtgtgttgcgtgtgtatgggaagaaagaaaggcgctgcgtttattccatgtggtcatactttttgcagagtgtgctctagagaattgtggctgaaccgtggatcgtgtcctctttgtaaccgtccgatcattgagatactcgatattttctgaaaacgatcggacggctaaaagttctcgatccacgtgagtaagtgaggtgatccctagatacgtttccaaagttttaactacggtttgtgtactttgtacgtttcttttggttattgaagaagatgatgtaaatgcaaaaaagaatacaagaggttttttgttcacgaggcccatttagtctattcaagcccagtaaaccgttattttggattttatctagcctaaacaatgctcgcctcacaccgtcgagtggattcttggccgttgatcttgtctctcacgtggcagtatcgtagtcgaatgtacatgatctatgtggaatagtcgatattatccctcttggtgtgagtttggtagttgatgaaagcaaaacatttacgtaacaatgtctataaaatcagtacaggtctattcttgttcactagcttcgaaattttagtcgaagaaacaaaaaaaaatg

SEQ ID NO: 16657 - DNA, 1066 bp, Unknown; identical to SEQ ID NO: 16656
  misc_feature (1)..( 1066): 2750-1469P.txt file - cDNA_ID_1662833; gDNA_ID_2926179; Annot_ID_200112

SEQ ID NO: 16658 - DNA, 3000 bp, Unknown; identical to SEQ ID NO: 16654
  misc_feature (1)..( 3000): 2750-1469P.txt file - cDNA_ID_1662833; gDNA_ID_2926180; Annot_ID_200150

SEQ ID NO: 16659 - DNA, 3000 bp, Unknown
  misc_feature (1)..( 3000): 2750-1469P.txt file - cDNA_ID_1662911; gDNA_ID_2936584; Annot_ID_195017
attattgttagattacgtacactaatttataagcatttggaagcctaactcttaagttgccatcattgttttaccaacaacactgagcaaacgtgacaattacttgaccaatgacaatctttgttgtgaatcgaaaagctgaatttccaacccatgatttgcctaggtttaataccagcttttcatcatacacgtgaaaaataattactcctaaatctatagtgggaatccaattcgaaagcaagactcagtttctcacaaaaaagtcatagactgaactatacaaacgccacgaaagtaagcaagaaaaatgatatagaccattgattacgtaatacacaaaatatggtcattaatcaatgtcaagacacaaggacaagactgattaagagaaacaaacaaaactcttctaattggtttccactaatttaaatcactaagccggatttttctttaatcacacagaaactttacttcaaaagtaaaccaacaagagctgcttctctttaatacatggcatatattagtatattctctggtgtttagtggcctactactatattaatctccagtagaaaagccaaacaccagtctggattattctgtcattcattttctatatacaggactagtttctaaatcctaatctttgtaccattatccataatggagaataaacctaacctaatacctcgaagagtttatcctaatagttgtgaaagatcaaatcaagtaattacccaaaaagcttaacaggctggactttccataggatttgtctggcttaatatacaaaaatgtaaagaacagcttgcatgagaatggaaacaaaggctagcacatgtcttggtaagatctatataacctatcgatttgagatgcacatagaaacaagcatgctatatatatgaagcaaataaattaggtggggttgcattacattgtatcaaacagagctaagaatggaacacatcaaggtatattagaacctagcaacttaaatgctacagaagcctatgtatcaaatgtgtgatggagagaagactttgcatttggataacacaagtcaccatagatgagacgatcaagtgtcatatcagttgtgccaataaaattttagggatcaatcattggttaggacttaggaatgagactaactagctgcttatgaggcctacttgcaaactcactctcaacctaccaatggatctagtgagagactacttggtttgggcctagcatgagctaaatttaaaacattcaatcagaaggcttaggaagtttaacattcaacaaaaaggacacagagagaagaaggtagcatttcaaccgcataagacttcactgagatatctgtacttacttttactagagaacgtgtgttgcagttatttttaaagagtgaattctaaaaaaaaaataaaaaacaatgttagaactgatctttcctttggtagacacatcccagtagttgaaatatgttaatagtgttgaagttcaagaggtgctaatagccaacttaaactaaacagctgtgaccttcattagcagagatgcaacataaaatgacaaacaggataaatgtgctattgaaggcagatcagtatacaaccccaatcttatgcaacgttgaaattattattgttatcatcctatgagaaggaaaccagaatcaatgtgacaaaggtaagaaacgtaaagtgaattaccttgaagaatcatgttggaagtggtccacggtaagcacgttcctctcctgagctgaagaagaccacaatcgcagctaagatagcccaaagaatgaaactcaaaagcacaatgcggaatttcacagtaacaactctatcgacccagttaatttctgcagaattgtcaactgaacagatcagttttttcagctcattgatctccccacgcaaggattgcacagaagcgggcaagtccacaatcgactggatccgatcagtagaagacgtgtcaatacgagcctccacactagtaatggttgaaactggagaatcatcagccggaagacaaatctctggggttgacattaagtctaggctcgatccttgaataacactctgaggagagaacaacataattcgagccagtaatcagtacccagacacataatggctaaaattgaggtttaatctttccaattcgtcatcaagcgcagacaaaatcgattcaattttcgaaaatttaacatctaatcttaacggatctgagcgtttacaaagcaacacaacgaaaaacttcgatggaaactaaacctaactaaaacattggagcgaagcatatacctcagcctcggaatcagagatcgcaccagaaatctgagagatcggactaaaatccatcggatccttcgtgctttcaaaagatacgtcggaaaatgttgcgatctgtctcttctccgtcgtaaccttcagttcagagaagcattgattcgaatttgagtagaacgatgtgggaagaagaaaacaatggcgattttaaggatcgatctaataaaattaccttccgattcttcatctcaggatccttgagtctcttagctccgagttctgatgagcgcgcgaagcttttcctgggaatttgaatttccttcatctctctccaatgttttcaaatttggagcttgtcagttttcgaaaatgtgaaatagtgagtgaactacaaaactatcaagcaagataattttatttgtagtacgcttcttacatgggcttaagggccgataactatttttattcaaggcccaatatagatcgttctcgctcatcgcaaaattaacctactaaaccggaattcggttcggttgtggtattgtttagccggtttggttccagcctcacccgatagaattagcctttagggtttctaacgtcgaagcttgaaacactatcgaacctcaaaatctctgttgccggaaattttcttcaccgaaactgaaagaagtcgaaagagagaagagaagaaattgaagcaatg

SEQ ID NO: 16660 - DNA, 3000 bp, Unknown; identical to SEQ ID NO: 16659
  misc_feature (1)..( 3000): 2750-1469P.txt file - cDNA_ID_1662911; gDNA_ID_2936584; Annot_ID_143809

SEQ ID NO: 16661 - DNA, 3000 bp, Unknown; identical to SEQ ID NO: 9156
  misc_feature (1)..( 3000): 2750-1469P.txt file - cDNA_ID_1662981; gDNA_ID_1972015; Annot_ID_177882

SEQ ID NO: 16662 - DNA, 3003 bp, Unknown
  misc_feature (1)..( 3003): 2750-1469P.txt file - cDNA_ID_1662993; gDNA_ID_1971819; Annot_ID_176081
tttgatggcaacaacatcgatcctcctctgcgctggtctagctgcggttttaagcagcacatatgcagtgaagaagcctctaaacgacgctgtttttggagctcgcggagagttcatggtggctctcaagtacgtcacgatactcaccatattcctcttctccttcttctctcactctctctcaattcgtttcatcaaccaagttaacatcctcatcaacactccttttcctcctgaggagttggaggacgagatgatgatgaccgcggaggagtacgtggcggagttgctagagagagggtttattttgaatactgtggggaatcggttgttctacgcggctttgccgttgatgctttggatatttggaccggtgcttgtgtttttgtgctcggtcgtgatggttcctctactttacaacctcgatttcttcttcttcggtaaagaaagaagaaaacttgatcaaaagtctagttttggatctgtgtaaaatcgagttctggtcagtagaacaagtgatttgtaattaagtgatatcatcgtcctctttgttaaatcctggactaccgatgaacgcatgaggactttacatggaagttgaaaagttcgaagatcatagtttaggtttcaattctagatcttccgattaagaaaaaaaaatgtaattaaataacgcattataattttcatatattagggtttttcggccgtatgtatttggtgtggtgtaatatatgtcacgttttggtttattgagcgttattattggcatttccatgtgggtgactttataacgtatcagcatatctcacagctctcttggtatgtacgtttctcttttttctttttctttttctgttagtgtttatatgcatgtggcttacgttgggcaagaaacgggacaaaaaatgtgatgttcacatctattccgtgcattagtatctgtcttattaagttttgttgttatgttatgtgttaggaaccagtcgtcacgaggctatttaaatcctccctaagacaatgtagaaatatacctacacggttatttttctgtgtagtatgaaatcaaactgtttagaactcgtttagagatgacaattcagattatgatgttagctaattatatccgaatctagttctgaagcccatgttcgcctagattaaaattgtatcattgtatgttaactaactctatttttcatatatatattttcaattttggtttagattaggtaaacaaaaagctatttcatgctacaaacaaatacaattttagtgatgaaaattttcgtagttaaaactttagtttcgtacgtagctaaatagctaaacgacagttgctaaataacttactcgtgactatccgttgatacacaaatttcatggataatagctactgaccatttaacaacgagatagccagagatatatcatagagatagccaattaaactgttggcaaaagtaccatgggctgtccttaagtgggcctaaatctaataaaattataaactgtggcctgttaggcatgtgatatttttctctttttcttcaagcctttttataaaaataaatgtcaagagatgatgaaggcatttgcacttttgaagaattgaagtaggagctcaaagcgaaggattacgatgatagacatctctgtaatgatttaacaaaactcaaatacaacatcaagtttggaagatcactggactgttttgtgtttgatcatttactcacctgtaattcttttttactaatatataacttataagaaatcataaactataatcttttttttttttgggtttaatgagacttttttctgtcctttttttgaacacctgtgaatcatagactataatcgaacttcatccccttttttttttttttgggaaacttagagaagaacaaaacatttgtgaggctgatgatttgatgagaccgcaacgttggagaactttggagtatattaataatatacattttcaatattatcagtatatgcattttcaactaggccttgctttatacaccggagattataattaatgaaaagatgaattacgttaatgtcattgcttctggtttgagttggcaaactccacgtaccacgtacatataattattattgagtagttgctaattaattatacttttgtcttgttaaaactagtattataaattggttaatgccataaagcaaacgatagaccagacacatctctgataatccagcggtacttatttgtcatgattctgtgatccaatcaattaatcgtatagatttagctatcgcgaatcgtgattccaacctttacataaattctttttaaattagggcaaattgtgttggatcaagcatagtaataacataatacgtacttataaaattgttaacgtgccggtgttgtttggagagaaaaacaaagattcttagctctcaggcaattaaaaaaacgagtatcgaaaaattcagaatagaagttgcttagttaacgagaaattaaatggtgcatcgaatatctaatggtttaatctggatatagtaaaattagtactccacgattagttagcaggcaagtagatgaatgtcattaatttgatgatctgattgaattgctttcgaaaaaggacaataataataatatcgactggttaattggttgtcatattttacccaaaaaggatcaaccattggatttacgccacgtcattaatgtgaaaatacaaaagtggatccgatggatgccgcgtgtcatcgtcggtcacgacatacccacgaagccatttacctcacgtttagtaccatctatctctctctctctcgtcttggcacgctgtttctttttttcctactggttaagaaatttctacggtccatggtcaaaaacacaccttcataaatatacagagagatcgtgagagagcagagaggaaacgtttctcttgttcgttggaatctccgtccctttttgttgatcgacggtggtgaatcttagacatg

SEQ ID NO: 16663 - DNA, 3003 bp, Unknown
  misc_feature (1)..( 3003): 2750-1469P.txt file - cDNA_ID_1663020; gDNA_ID_2213660; Annot_ID_181845
tcgacaaaatcctgcatttttaaagtaccacgagagagaactagttagtttcagatcacaaaaaccattgcaagaaaggtttcttatataatcagtggcattgagaagttgaaggtaatctgaaaaagtgagagaaatggaactaactggctgagattttcatcattgaccttcccaagtttcgctacaacaccaacaacaccttttgtcaacatcaactgagaagcttgagcaccatgaagagtctcaaccagacttaaaactccagcagctgagttttcgtggcgaaggatctgtgcattgatatcttcaccctgaagactgttatcagagttttcacttctaggagtaggagacgagttaagcttactcatatgaactgcagaagaaacgaaacaaagacatattggataatctcaatcaacataaatcactgaaacgtaaaagtctatgatatctcagaaccttgcaagtcgacgatagcttcatccattttgtttttctgagacttgagaaacttgagattatcctcatgctgtttgattttgttacccatagcttcaagatcagattcaagcctcttggaattgaacatagcaaactcagcgtgagcaatgcctcctccattctgagtttcatttcttgcaactggtgaagattgatccaaattcatcatccttgttggatcttgaacattcaacggagtggtctgaaacgaaatctacaaaattggatacaaaaatgactcaaaaactattcctgtataaaccctaactcttaaaattcgtaaaaaactgaaacacaaaccctcaaatttaatccaatgtggtcgcatgcaataaaaaaagaaacaaaatgtcgagagtagatacatcaataaacaataaagcacgagtcttttctccagattcacagaaaaattcagagagacttcatcgtttaagagagatcatagactaaagttcgttcgttttttcccaactaatctagttccattttgcaattgaactgagtttttttcaaccaacctgttgaccagtcggatacattgctcctcagcttcaatgttatcaccggagaatctttctgcttcaatgttatcaccggtgaatctctctctctctctttctctctgcttcttctccggtctctgtgagtgtgagggtttaatttttgtctttagtgttcttctggagaaaaacagccaattgttgtgaagtaattaaactaaattaaaatacaccaataataaaaggaacgtattttgccaaaaatgtaagaaaagtttccttttatcattcaattatattttctggccttatttaaggcccaataatcttcggagattccaagtgggctttgtgcttcatacctccttctgagcctgactttctcactttgtagcatattagtttgataatgaaaaaacccgaaccagaggtaatttctcgtatttgagttcgataccgatacatgtcaaaccagtttttatcttacaaattcaactagttctgtgtcatgcgttaggttcgttaggaaaacgactctgtgtatcgatattgtcgaacgccgtactggttttctattaaaaaaaaatcatgtgacatgatgttatgtttttgcctaaacattatcatttataacatattttataaggaatgttgaatttaagctttgattacattagaaagaaaaaaaaaatgaattccagctttgtttatgcttaaaaaaaaatagtttagctactcgtgtggatgtatgagactctcaatgagtagtgaaatcgaaaggtggtccaattttggaggtggtgtaggtcttgggtcctcataaagaaagttaggtcgccgttattaaaacaactgcacattttcatttttgtgtttttttttctctcttttaatttacatcttaagacaaatgatcggcatcatttgatattttaatatcaaagttttgtagttcttgagtaaattctgtatgtatacctaaacgaatgaaacctttaaatttttcgttcattctttaaaatgtgtcggataaatattgcttctaaactcatgttaccaatgttaatcatataaatcagaactttatgtataaatgcatattatatgcatgtgaccaatagtttattttaagctcgatataaaggaaggataaatctcatgaatatatatatttaaaaatattttgttaagtagcatatttaaccatacaaataaaagtattattaaaaactgaattttatcaaactaattagtaaataagtaaatttatttatagaatatagtttttttttgtttttaaatatataaattccaaagtatgtattggcttcaacttgaatttcctcagattacactagtacatatatattcgaaatatggcatcttctcatcaaaaatatgtaaacataataggtccacaagtccacaaaatttaagaaaaagtcaaataatattttatataggatataacaaatatgtaaatacagaattcgatcattacaaatgtcagaagactttataacaaatggaaataaaggcgattggcgttaaaataagagaagacaaaagtagaaacctcgtgaacttcgtaaaaacacttaacggcgtttaaccgaaccccacgtgactccgttaatgattttcattttatcggtggtgaaatgagtgagacatcctctccttctcaacttaagtctctctgtgacttctctctctcacctcttcttatctctctcgttctctttctctaaacttcaacaatcgcttctaatcgtttgatcacattgcacaaacatgtaagttcctcaattaacatatatgtctaacttttatgcatgttgttgtatgtatgacaatgttatacatttttggttttggctacaattggaattggttttgctattggtgtaattacagctatttttgggaatctttaaacataatgtttcagtattaatagagcttatgatcaaagagtgttgccggaaatatg

SEQ ID NO: 16664 - DNA, 3003 bp, Unknown
  misc_feature (1)..( 3003): 2750-1469P.txt file - cDNA_ID_1663090; gDNA_ID_1620392; Annot_ID_155640
taaaacaaaaaattgtgttgcctttgttaatcctctttacttactcatatctaaatacaaacacaaaatattggcatttaaaacaatcaagacatagttctttgcttatatatgatatattgattgttgtataattagtatatatataaacttacgagagaaaccgaatcacgagccgctaaggccaagatatcagcacaagagacaacaccaggacatgctgcctcgagctgcctcttggcatcgtcaatgacctcaaaaccatggaggttaacgtttgcgccagcggttctttcagagttaggtcccgataaaagcaccgaaccatcacaaccttggacaaagcaatcatggttgtgcattctcagtaacccgggtgcaacctttggatctgaaccaaagtgagatgccacagtggtccgaacaattgtctcggcattagggcacgtagtcgagtagaacccgatcctcgtaccttggccataaacggcgatgagacaactaaggaagactatgaccaaagcaaatgatcggaccaagcccattttttctttttgttggtttgtgttttagataagaccgcaagtgtgtttcgagttagtagatagagtttgttttagatgcatggaaagtgatacgagaacgtgagtaacttatagagggattgagaagtcaaatggtgatgttgaagtcagcgaaaggggctagagtgttgaggtaatttgacaaaacgacgacgttgtaatccaattcaaaactgaaaaccgcgttatgtgattggtcatgagctggcttcgcgcgttgacgattgcagatcatgttgggtttgttttttctcttttgttcgtttctatcaaactaattcctaattaatagtgtgtaatcatttataatgaatgtgattatagaatattgttttagcaggcgttaaactttgattcaactctaattctttattaaggaaactcgtattagtgcatgatattttcatctacaatgcaccgactttggactggttaatcgaataagtgttaaaatactttaggaaaagaaaaagtgttaaaatatccaaaacatgaacatccactattcaacaaaagttcactgaccgtctcacaaaagtgttaaaatatccaaaacatgaacattcactaatcactattcaacaaaagtccacggacatcactattcaacaaaagtccacggaccgatccatcgtgagagattagtgtattgaccggaacatatagatagtatagtctttaacaaacaaacaaataacaaaatagtatagtgggttttcttaataattaagctttgtttctttgactggttcggtttgttttgttcgaattttagtaatctggaaatggaagaatgatgtcgaatttttcagttcgattttttggtaaagatatatatttcggataaagatcgggttctacccgcaccaggtttgctatatagaatgatgttgtgatgataaagattaattctatacgtttactttcataacagattaatgactaatggcgacacgttgattggtggtgatcactgatcaatagccagaactcatgctgactaagactaaccatcgttgttggtccataggaattttttctgcaattaatttttatttgaaacaataaaaatttgtaacagaatagtgacatataacaaataaagagttttctacttgtccctttaggatataataaagtcagatgttttaaaaagaagagttttctatgaattcctgtttcttaaaataatttttgtcaatatagatgttattttcctataaaaatccatgcatgacgttaacaaagactagaaaaattcaaaaattgaagattatcatatattatatcttgtcgtcgttgatgtatattcatcgaccaaattttggtctctacacatatgtatatattggcgtcgaagcttaaaagaaaaaaaaagtaaaaacccttatggtctatatataaatcttgtttttatggtaccaaaaccatattctaactaatcgtaacgcaagtgatcgtctttgcttcaaatgtaaagctagataacctgaacgagtttggatgctggcatgctgcgaccttgaagtcggtccattgggtttttatttgtacatacggacaacattaattgcccatgagttgctaaaatccttctctgggtcttgttacaagcaccctcttcaaattagcctctatatattttgcatgaaaatagtctgagatttccccgcaaatgatatttgaattggaaataatttttctctaacccctaacccctaaaccctaaacactaaattgcataatctcaatttttctgttgagcacatctatctaaagatgttaattgagctgttcagatctaaatgggtgaagtccaaatatgaacaaaactaatgatacaaactcaatagcaccgtatccaaatatgaccaaactcaatagcaccgtatccaaatatgaccaaactcaaataagacaatgattaattagacagtgtatggaacctaaatatataatataattttctattttccgcaaaaacacattttctctcaaactcaaagaattgcatattttttaaattacattttttttttgccaaaattgtaaaaatattttttggagttaaaatgtcaatgtaaactccaaatagctagaaaatattttgaaatagacaaatttagtgggagctttgaaactttttcttttggtgaaaatattagttggggtattcggcttaaatacattttgctaatcagtccggtttaatattttctcgaaccggaaccggatcaatccacaattgactccaattacgtggcgaatcgtgaaaagatcatctatggaactgttcaaaaacgtctctttattttcttaaagatcaaaaacaaaatttctaatcatggactccaatttctctgatcattccctctaatttcggatttttgcatcttctccgatcatcttcaccactatg

SEQ ID NO: 16665 - DNA, 3000 bp, Unknown
  misc_feature (1)..( 3000): 2750-1469P.txt file - cDNA_ID_1663139; gDNA_ID_2926261; Annot_ID_204733
tcgctaggcttgcacagaggattgacattgacacccatgaaacattcagagctgccataccacgatgaaatcaacggaagaccaccgccatagaattccagcaacggaatgtactgtgccatggagcctgtaacgacggcttcgacgcattttgcttttggccaaagtctcttcactattgcctcccatgaggttttactgcattcttgctcgataaggctcgctaggtccggatttggagcggtgaggaacttactaatccctgagacacattgagggtctgtgatccagtcactgagacggccagtccttatgtttgagcataactcttgccaatgaccttccaagtacttgattactctgatgaagacagaagcaaagggtgcaccgaggcgagctacattatctcgttgtagaagcccacaaagcaattgacagtacatgctctgagtagtgtcttcacaagtagaaatttcatgcgggcttatctgtaatctatccctgcaagtaatataacaaacacgaaaaacaaacagtagtaagcaccaatgagcatgttcacaaaaaagtgaattgtgtaatgtaacgtggggaaaaagtttttgttaatttaccaaagagatgagttggttttgtttacgcttttcaaaatacaagttatcatagtcctgatcagtatcccagaggcagtctctctttcagggttcacgaaatagaacgtgagagactttccttctctaatcccctcgacgtacctgcaattacaatgaatgtttcttttggtatcacatcaataaaacaaacccacgttggagtttagaaatatttacttatagagtaaagatctatagagagatccaaacataatcctctgttccccatcctctgttgtcaaaggaatcaaattttgaattcctgctgtagtaccagagctgcaaaacatttaacttccgttatatattcttcacttcaattttaatgtacatcattaaagattaacgactcaagtatcaacaagtttcaaaccaaatttcctatattaatcttttttgtaaacaagtggacggacttatgaaactccatgtgcatgtgtgtcaatctcattttatgatatataagccaagattccaagtctcttctggaaattctctaatctataaatttgtctatatccctccagatcttgcatatacaaagctttgaaattattttggttatcctgcacagatccaaaaaaaaaggcggatcgttttgaaggcacctcatcacaagtaaactgatgggtcgatcacagatgagatcagacgcctctccattagcgatacgattgatgtaaggcttaatatcttcataggtcacaatgggtacgttcttcttgaaggtttgcttatcaacttgaccgttgaggaaacctttaagatactcggtatgagcattacgtgaaagtactgcttccaagatggaatcttgaatctgcgttacgttggtggtcacatcctcaagaagagacaggctagcttttgggtctgttagatcaaactttggcaacatgcttgcttttgattgtctgccaacaacaaaaaaaaaaaaccttctaagtcgtatcacgaaattgtttacaaaagagtgaagagcaagcaaacctttgttctggcgaggtggatggatgagctttggcctgtgtctttctatgcttgaaagctttgtaaggagagattagaaaaagcagtcagtcaaatggtgtggtgtgacgatatgttcgttgccgtatgatttgttcttatttccataaatagaattaactgacaaagcataagtaaagaaaatcccatttttagaaagataaatttattcattaaccctaattaattaggataatttttttttgaattaaaccgcaaacaaggtcggttcaacttgcgtctgtccggttaacaaaatattgaaccgatcgataaatcgtacgagagcagtcgcataaaaaagctccgaaagagagaaatcaatttgaccaatcaaataattgcggtggtgaaaatggctcgaaacgactcgcgatctaggtcgccgtctcaccgccgacggtactctcgctcgcctgtgactcatcgtagcagccgtcgtaccaggcgcgaccgcagccgctcaccctacacatcaaggtctgcaacaatcttccttgcttaatgtggagaaatcgaatctcgtatcttatggtgatgtgggggaattacgtttagatacttgggattagagaataggattagggcttagagaataggtttagggtttagcgattttgtcgagaacaaatttcaaatttgttacttcactttggatcgttgctgttttgcaaacgaatttctatggacattaatgttcgatgtccagctgctagtgaagaaggagctgctttagttcaacacattttcataagagtaggtttccaatttttgtaggcataagaagagcagatctcctgcaccaaggcaacaccaaagggatagaagtagttcattgtctccttccgagcatagaattgcgattgaagtgaagaaagaacaggaagacaaggcaaggtaattgattaaacattgtctttgtctttcagattgtattatactttattattttgtgtatgaagcaatatagttttccacattaggggaatgtattttgctagtgagcaagttgacatgcacgaaagggcaaaaatacatttcttgaattatcgcctctgtgattgttgatcaacctctttgtttccttatctaaattgaatactgtttggacatgaatagaagaataactgatcaatttgtgcgtttatatgatcttgaaaagtttttattggctagtgttatcagtcttatcttctttctaaatcttttttcccttactaaatgtagattgcagcatgaggcggagctcaagcgactagaagaagagactgcacagcggattgaggaagcagtaaggaaaaatgtagaggaaaggatg

SEQ ID NO: 16666 - DNA, 3000 bp, Unknown; identical to SEQ ID NO: 16665
  misc_feature (1)..( 3000): 2750-1469P.txt file - cDNA_ID_1663139; gDNA_ID_2926270; Annot_ID_205104

SEQ ID NO: 16667 - DNA, 3003 bp, Unknown
  misc_feature (1)..( 3003): 2750-1469P.txt file - cDNA_ID_1663143; gDNA_ID_2213665; Annot_ID_132672
ggtttacaattacaagctcgaagaggctttgaaacatggaagcacgaaggttactgacaaagacatgacaagctctccttcttcacctctgctaacttattttttgtttttaaagattgattagttttggtttttgtcaggtagaatcgtgcagaagcgtatttcccgctaattgttcctcatcagactcactttccagtctatacgaccaattaatttagccccaattgactaaattttttatacttaaaaataataaatattcactctgaccaacttgcgaccgaagaaatcaagaaaagcaaattaagatagtttaccaaacataattatttatatttttaagacatcggatgtcgtcaacaataaatttctgaaggagacaattgctcctaacatgatcgttcaatgattcagaacacaagacaacaaagaagtacataacatatattatatatatggaagctagagagtatatataatgttgcatgactgatataagaaaatatataatgtgtatgtaaagtggtttatgattcacaagttagttttctacttagtaacagcttcttcaagctctcttaagccaccaaccttctgttcaatttcttcgataagttcttcacgccatagctccgctcttgctttctcttctatgtcttcttgctgcatcatataacccaaaacacaataacaactctatccaatcttataatagttgtacacattgtgaatctgtgatgatataccaaaggtcaatggcccgagcaagcccagcccgacccaacttaggatcaatgttacctaccatcagatctgttaacgtttgaattattatatcaagcccaacccggctcaaacttactaagcatgattgatctatcaataggatggatcaatgttacctaccatctatcagattgtgactttcgtttagatgatcaaggttgtggattcatatttttgggtgcatatataccaacggtaaacgctaacctaaaagcacctatttttctttgtttagggaggtttatcgcatgctgagacacatggaggagtactcaaaaccggctctgaacaggtctacatggcctactaagaccaaggtgggatagtctgaggtcaaactagatctgaactggtccacagggtctagtaagaccacagcgggttggtcggtccattgcaacatccctagttataatttgtatgcatttctaagtttttttctttctttcctaatagtattagaaagggagagatacatacagtttcatagacccaatatccagttccatcccctccatctccacggtactcctctgagtcgtagaatggatcctgtattgatccaatatcacaaagtactattaagatcccaatgcagcaaatgtatcaaaagattcagtttgagttgttgttttcatacttttgctgaaccgaagtacaaacatccccaacaagtgaacatgatgtagaacatatctgccatatcaagatcaatatcaaaacataagaaaaagaagaaaaaaaagtctaagaaagaaaataaaatctctcaagaaaccccaagtgtttaacttacaaacattcttgatagctttatcacttagatgccacacgtgtttctctgtaatgatatcacgcattccttctatttgttgaaccatcacagccattaatggcaaatcatgtggcaatgcctttcttacacataagcttcctctcatcaaattcctttccctcttctcattaacattcttctaatttttcaaattctaagacgtaaattcacaagaatatggagattttttttctaattttagtcttagttagagaaaattacttacagatagccaatatccatgattcggtcctgaattctgcttcggctacaacacaatacacaattcttaaactttttttcgtaatgaaatatttttggtaagaatataaaataatatgtaccgagtgattgtaggaagaaggaatatgaagatttgtgaaggtgaaacttgtgaaagcttcagccattgttacttcttgatggtggcaatggagaagaaaaaaaaaaaatgttggtgtaatcttttttattttttcatttattttaatctttaagattagattttttgaggcagaaaatgtgtggataagggaattggtatcgtccactcttcacttttgtgataaacaaaataaaaaaataacgtacgttagcaatcacatcgcataacactttttttgtcttttaaaagcccaatttagacaatcacagtacacattttagccttctaaaacgctcaggttgggaacaactatttgccttaaagagtggtaaagatatttccagcaaaattcaactacaaactttcgtattttacccgtccaacaaactttccattcgcgcaggttagcaatcactaaacacgttcactcctctagacgtgcaagttagtaaccacactaaaattgctaataaatctttggttggtgaaattcaaactttccgcttatgtctcttcccaaatacatcatttgttgaatagcgtacgttggcaactattgccaaacttttaatgatatttccatctaattcaacttcctatgcgcgcatgttagcaatcatcccaaatacatcattcgttgaatagtgtatgttctatttgccaaactttcaatgatgtatatccatctaaaccagcttttattcgcgcatgttagcaatcacaataacacgtctactcttcttagcgactagtattttgtcaaaagtcggaagaaaatctccggccaagtcaacttctatcgctttaaaaagcgcatgttagctattaaaaagcgcacgttagcatcattttcgggaaattgctaatcaaactttccactttcgtcttcttcccgtgtatatctttaatctcctctgtttggtgactattatccaatttccaccgatcttctcctcataaaaacacctcttcctcaacgaattttttatccatg

SEQ ID NO: 16668 - DNA, 3003 bp, Unknown; identical to SEQ ID NO: 16667
  misc_feature (1)..( 3003): 2750-1469P.txt file - cDNA_ID_1663143; gDNA_ID_2213665; Annot_ID_182076

SEQ ID NO: 16669 - DNA, 3000 bp, Unknown; identical to SEQ ID NO: 1894
  misc_feature (1)..( 3000): 2750-1469P.txt file - cDNA_ID_1663168; gDNA_ID_1620463; Annot_ID_157806

SEQ ID NO: 16670 - DNA, 349 bp, Unknown; identical to SEQ ID NO: 404
  misc_feature (1)..( 349): 2750-1469P.txt file - cDNA_ID_1663178; gDNA_ID_1590770; Annot_ID_150034

SEQ ID NO: 16671 - DNA, 3003 bp, Unknown
  misc_feature (1)..( 3003): 2750-1469P.txt file - cDNA_ID_1663221; gDNA_ID_2214652; Annot_ID_188674
aaagtgttattcttgcaaatgaccttataataaaatggacactcttgtgaaaaaaaaataaaaaattgagatatgtcatgttccaaaaagtgatactgagaccatatctgaactcttattcaaactgttaacttcaactgtaacatgaaaccatgtcagttgtaaataaaaaattgacagaatcaaacgagtgatgttaacgtttttttaggaggtttcagaatacctcccatgtttagatatgtttcttgttgcttgttctgttctgaatccttttcacgttgtaggattatcatgtttttgcgtttggatgagtcgccaaggtgcaggttattgttggaatccctatcctcaacacgtcttgatgattctcctgtttcataaacccgtctgactcctggtgtgggcgcagcaacagaggattgaagtctgccaataccactttgagtagtaggatgagtgtaaggctggaaggctgcagttcttgaagatgagaagtagggagtagcagcagctaacctgattacatctaaaccggccaaatttggttcctttttacttttttagtatccggtcgctacttttggttgtgactattccggttcctcttgaaattagtttcctaaattaaaacgttcggaaaaattctaaaccggatagccaaaaatcgaagtatgccaagttttggccacccataatttcgaaaatacaatttgtcaattgcaaagcatcgttgcctgagtctcccattagccattagaccatttcgattttgcatacgcttttcacaagtaaattttagaaatgaacaaaattgcaactaaactgaaatggacatctccaaatgttagaatgagttccaacttccaacacactagtttttgtgcttatggatctgttatcttcttattaagcctaataaactaccactatctaaactactataccctaccggacactgtaacaaaacctctcttaatagctcagggcagataaacatccgatacctacactgtaacaaaatctgtagacgattaagagcgcaacataatacgttttatgtcacttcttagaatgatatagtaaggcagagatcctcaccttttcccttctgggacatacacaaaaataacttctggcaacgctaacagctcaactcagcttgtattttcttcttttactacacttttaagtttacactccttctgtggattttttcgtttcgcttgaatatgatgcacaaacgcagctactataacatggagctttgggggaggcttgcttgttgaagagacattatgaccagcatcctttaaagctttagccacatgcttttgggctttctggaagtgtatattacacagtgcaggaacagtcgacgcaagtgttggttttccacaaagtaatggtcctgctggggctctgaatgtacaatggaaacaatgcagagttaggtgagaattgcttaaattatcattatatgctaattacaaaccagcatacaaacttacctatatatgaaatctaggttgtaaaaactcaaatctgaaacttggtttatgttttaatactaccacaatgggactattctaacacaaatacattttcaaagggtgatatagttatgctaatactcatatcctgactattttacaaatacacatcaaaacagacaacttcaagcatctgcgtcagttatgtgtatcaaccagaacaacaaagcacatagagcaatattttaacacaaggcaactactgaatctataaatgattaccgacgatcactatctcgatgtccaaagctaagacttctcccaaaccctatgaaaaactttgaaaaaaagtcaagtgtcaatcccaaatcctttctgcaaacttgaaaaaaaaagagaaacaatctcttggctcactacataacacaaaacagctttgcagtttcaattcatcatcactacaacatcttcaccaactataatatgcaaagaacacaacttgaagcatcaattactttggtttatacgagaattttaaaaccaaataaagggaaagtgaaacaaaccgtttaatgacgtttgtgcaaccagtgtagagcttctgcttactatccttgagaatatgcaattgacagtatttcgtaagcgccatagctttagctttgcatccatacatacaactcccacaattactattcgcatactgatcactcttaacaccatcattgttagtaacattgtctccactaccttcaacagcatcaccaccatctccgatatctccctcttgaccaagcctccgtctcttattcgattgattattttcgtctttaaactgactaatcccatacttccaccaataatccctgtgttgtgccttgacatcctccattaaagcccaataattgtctctataacacttggccagctgcttcaggttgtgtgatcggcgtttgagaagctccgaccgggttatgtgactggagcgtgcgaggatttcatcttcttgtgacatcgtaatcggtgaattcgatgtcgacggtaagccgctggtgctagggttaggatttaaggtagagtttcgaattaggggctcggctgaggtggaagccactgcggttgttgatgcagcgccggaggaatacggaggccgtggtggtttcgaggagaaagggttttgctgaatgttcttggaagctgacgccattgccgtcgtcggaaaatgacagagcttcaaaatcagatgttcttgtcgggaatgaaattattaatttttaaaaaataatattagtacttaaattttaaaatatattaaagcccataaaatgtccattgggctgacatattcaacaaataggcccaaactcaattggatgtgagacctaagtttctgaattaggtcaatataaatactaaaatcatatctgataacgaacacgagcttaccgattctcttcgtctcaacatttagggtttcagagatcggctgattttcacatccacaagtatg

SEQ ID NO: 16672 - DNA, 3003 bp, Unknown; identical to SEQ ID NO: 16671
  misc_feature (1)..( 3003): 2750-1469P.txt file - cDNA_ID_1663221; gDNA_ID_2214652; Annot_ID_136447

SEQ ID NO: 16673 - DNA, 503 bp, Unknown; identical to SEQ ID NO: 281
  misc_feature (1)..( 503): 2750-1469P.txt file - cDNA_ID_1663334; gDNA_ID_1563335; Annot_ID_147489

SEQ ID NO: 16674 - DNA, 3003 bp, Unknown
  misc_feature (1)..( 3003): 2750-1469P.txt file - cDNA_ID_1663368; gDNA_ID_1620372; Annot_ID_155028
atgacaaagtcccaaacacttacaggttgcaaatccccaggacattttgatattttccaaggcttctaagaagggtcggagcgaaggtaagggcattggtgtactagtaatttatacaattttgtttggattagattgatgcacgtgcttttactctaacttgtaatagcttatctggcaaaaattacggttaagtagtgtatctgagatatagtaatgtagaacaatatgggcctatgataacctcctttgttgttttattgtcggtattataattctcgtcatatatatcatgactactaactttctgttgtgtggagcttgatattgatgtattgagtgttaattttctttctgttccacttttcttgttatagttcatgtttcttcgtgtgtaacctatagcatcaaaattttgcgaatcttatggattatctctagttagtatatattggaaatttgccattttgataatttttttgtctagtgaattgaatggcaatgatgcatgtcctgatggttgtccagtgatccagttatgatatatttcaatcttccatttcacagccaacatcgatgattctgagcggcttcgtccagaagaactgaaccagcagaatatagaagctttagtagctgaaagcaacctggtacatcctgcaaccttctttccttatgattgtgttattatcgtcaacccctgtagaactttgccacagaatgatatagacttgggtagttaccaaatgggcatgagtacactatgggatgatcattctattttcttccgcagaaaatggagatccttccagttaacgatctggatgttgctcttcacaattttgtgaacaaggatgataaactagccttctactcatgcgttcagtacaatcttcaagagactcgtgtatgtactattttttacttcaccattcaatacaaagttctgcataggatattatttttatttcgtagcacgtccttgttattgcttttatgatttatctcttccctctttttgtacagggtaaacttgcaaaggattcagatgccaagaaatttgaggaagatgacttgattcttaaagtgggagagtgcttagaggcaagaagatatagattcagttagttctgccgcagattatgagaaccagcagaatattgatctcacttgcattattgttcgtgcaggaacgcttgaaagataggtccactcgacccactggttcctcacagtttttatccactggattgacttcagaggtttaaattctcttttttagattttccttgcctctgtccttccgttggtttctcacagtgctattttctacctgagattggtacagaatttgacaaaaggaagcagtggcatcgcgaatgcttcgttcagtgatgatgaagacacaactcagatgtctggtttagctcctcccactagaggacgaagaggttcatccactgctaatacaactcgtggtagagctaaagccccaaccagaggacgaggccgtggtaaggcctcaagtgcgatgaagcaaaccactcttgatagttctcttggtttccgccagtctcaaaggtaactttttgacagcacatttaaccagtttagggtaggattcacggacgtgcaaggaaatgattggcatcactagctagctaatgttatgtccctaatttgtctttcatagatctgcttcggctgctgcttcagctgccttcaaaagtgcttccaccattggagaagatgatgtagattctccttcaagcgaagaagtcgagcctgaagattttaacaaacctgacagcagttcggtatggactattccttacactgttattcatttgttcactaccataagaaagcccatgtaaaaacttgacaacatataacttttggcattcttatttctctatttgaagtaaattttgcgtttttacttttcctgattcttgtttgatatccactaaaggaggacgatgagagcactaaaggcaaaggacgtaaaagaccagctactactaagagaggcagaggtagaggttctgggacttcaaaacgtggtagaaaaaacgaaagctcttcttcacttaataggctactcagtagcaaagacgatgacgaggacgaagatgatgaagacagagaaaagaagcttaacaaatctcagcctcgggtttgttaatcacatctattttcccttctttcgctgcttattagcaggttttagtaagttgttgttaaccatttgagatcaaagctcacttaatagtacaatttgaatatgcaggttacaaggaactatggagctctaagaagataaatacatatcaaaccccaatctctgacatcacaacgaagcttcatttttctgttattttctagcgacctctcaagcggaacaacttctgaagaagagaaattagtactaacaagagttctgtgagatgatgtacagagaattttgtagtgtttttttttcttgctctttttaaggttacgttgttgatgaatgaggcaatatgattaacgtcagtaagaagtctaaaactgtagtaaccaacaagttacttagccaataatttaatccctaattttacatttgaaattcaaataatttgggacaatctaattaatattggaaattcgaataatttaactaatattacattttacatctaaatcatagtttataggaaaaaaaataaaacattataaaataaagagtaaaaaacttaaatgggcaaccagaaaagaaatatggataaaaaagagatggaattagagatacttcaaatccaaagctgtttcctgattggctaatcccaacatctcactctctatctatatcccatctctgattctcccacctctcttctcatccacaaaatactaacataaaagtcaaagtccctgagaccaatactttcaccaaacagcaaaacaagaagaacaacaacactaagcaaaaaagaaaagctcaagccgagagagacaatg

SEQ ID NO: 16675 - DNA, 3003 bp, Unknown
  misc_feature (1)..( 3003): 2750-1469P.txt file - cDNA_ID_1663391; gDNA_ID_1621111; Annot_ID_56088
ggcacactattgattggacttggctatggtgctcactgggccatcgtcccagccactgcctctgagctctttggtctaaagaagtttggagctttatacaatttcctgacgctggccaacccagcgggatccttagtcttttcggggctgatcgcaagttccatttatgaccgcgaagcagagaggcaagcacaaggatccttgttcaatcctgacgatgtcctgagatgccgaggttccatctgttacttcttgacgtcactcataatgtctggattctgcctcattgcggccgccttgagtatgatccttgtgcaacgtacgaagccggtttacacaaatctctacggcaaaacccgcaactgattttaagataccatattacgaaaatatcccaccaagaaaagaagctgggttctttgagtttcatacctatatatatgattgtgttcatcatcttattctttggcttggtcttccacttccccatacatgtgtatttggttatgtaacgattttttgtgtccggtgttgtgtatggattttgaattcgcatttgtaataattgtattcacattattcatattctccagctacaaggtgtctttgtgtgtagatgtcaaacaaagacctaatctgtgtctgtctctgttttaagtgccagacgccataagatcttggcgcagggaagactcgtcgtcctcaaccaccatccacggcaatataggtccctatacaaaccaaccacacggtcaagttaaggtccttggatggatgaagcacagaatgtttagataatatattaccttcccttcccttatgaccttgggatatggtcctgtcatatccacgatggtggatggttcagccactcgtatacctccgtctaccacaaaatccagaccctgtaaaaggaaaccgaaacagagaatagagcaaccaaagatgttctttagtcgctgagaaagagtgagagctataaatacctctggtccatatatgtcacctattgcggttgggtcgatcaataggtccctaggaaccaatagtaagtaaaaagcaaagtggtaaacatacaaaagcgagattattctcaagtctcatttcaatgtcaaaactctctcttgtgtgctaagtaaacagaacctgtgtgaaagtaaaacacctctgaactcattttcactatctcacaaacctgcattatcgatccaattctcccatcttatatcttcttacatattaaggatcagagaaggtgatcaaacctgataattatgtagatgtagctgaagctaagatataaggctcaggaaccacaaaaacatatcactgaatatttcaaattagcttcagcattttatgagtcaaaatactaagaaacaatgcaaattctctcatgaaaaggctctcacattgcttttgcattctccgcaattatgatccaaaccttaaccaaaaacaactaccctataagagtataagaccatgtctgcagaaatcagtagtaacacaagaatttcatgagatattaaagaagaagaaaagtaggccacacaatagaattgaggaatcaagaaaacagatacatacacttgggaaggaccagcacagcagacgtctgttactactaactaactcagacttgtcattgaactatattatatacggctcacttgttttgctgcagtaactggcttatcttcttttctggcttgcgttaataacatgagtagagagaaaacacgacttccgtcgagtagattcctatcaaacaacaccggttctcgaatctttcgacaagccaagcaaaagtaggtgggcatgaaaatttgttccccatgaaacagaggacattcgttgttacctattctaataaccgattcaaaattccgaatcgcagacttaataaatgtggacaattaaccaaaccgtgcattgctaggtctaaaccgcattggtttatgacccaccaatcaaggagcgatgggtgagaaacctaataacactgctgctgtgactttatcatatccttagtccaattgggatcttcgtctgcgtgagacgcgttcacacctgcgacagatgaaatcacggaaataccactgcccaacgtgttcgcaataaaagtcctctgatgcctaatttcgtcaatttactgaagaaaattcaacatcaacgccctttttgataatttccccaaagttagtgggccctccacacgaagcatgtatcctccaattgcatattgccaattatttcctaataatattgaaggattattcttttcccatctatataccaccaaccctaagatccgaacgtccattttaaagccgtgcgtttaatcatgatcgtcaattatattggcaaatttgaccacacgatatccgtcatctaacggcatctacagatctaccagaacgttctcattcatgactctatatatttcgcatttcttctcctcaacgctctcataaaaagtagtactcgtgtcttactcgtgccagccactcgcatttctccagattttattatccttcctcgaaacaaggtatgacggaaactctctctctccctctctgatccgtcgttgctgcttccattttcatcttgactcgatcggatcattgttatgcttggcttgatctgtgcttaatgatgtgtttttcgtagtagatccacgattcgttgctgcgatcggcgttattatcgtcagctctctcgtttctgttctgtggttcgatattgctgagtttctaggctaatcttacgaatctgtgaaagtttttgagagatttggcttctgtagctcactcctgcttgatttaggttttttttttttccactcgtatgaagctgttttagaggctgttgttgtttatgattctcagcttgttatgtatagttggatttcgtgagttttggatttgatctgtgcgtttatttagtagtgaggctcatgtatatatatctgtgtatttgttccagagcttagctaagatg

SEQ ID NO: 16676 - DNA, 3003 bp, Unknown; identical to SEQ ID NO: 16675
  misc_feature (1)..( 3003): 2750-1469P.txt file - cDNA_ID_1663391; gDNA_ID_1621111; Annot_ID_171798

SEQ ID NO: 16677 - DNA, 45 bp, Unknown; identical to SEQ ID NO: 27
  misc_feature (1)..( 45): 2750-1469P.txt file - cDNA_ID_1663391; gDNA_ID_1067; Annot_ID_144765

SEQ ID NO: 16678 - DNA, 3000 bp, Unknown
  misc_feature (1)..( 3000): 2750-1469P.txt file - cDNA_ID_1663391; gDNA_ID_2926298; Annot_ID_205578
catttgcagagtgtatgtacttaaggcctctcaaaatttggtaaaggaagtactggagacaacaaaaaagtatatcaaacaatgctaaatgttaggaaacattatgtaaaagctctaattaggaatgtgtccactgatcatcacctgacaatggtcatcagttagagtttgagtggatctaatgatctggtgcaaatctgtatccatcaactcataaacaatatatacatcttcgaacctttctttctctggtagctcaattatatctttaattttgataacctgtgtagcaatatgaacgtaataagccaactatatgagtgttcatcaaagtgaagaagaagagattacattgtcatgatccatgtgggaaaggagcttgatctctcggagagttcttttagcatcaactctgttgtcaaacgcgtttgctatcttctttatagcaacctcttcatttgtctctgagtttgtagcacagctgtaatcataaaaaaggatttgagattaagattgtattcaagaatggtatgtttttttattgaaagtgataaagacttaccagacaataccataagcacctcggccgatgggttcaataggagggatgtattttgaagatagctcgaaaatgttaccgagtacattgtacataacatatctaccatcatatgtcaagatccctccatcttcccttttctccatctcttctttggaagaagaactcggatcaagacaggttttaagattaaaaaaggaagcaagttttaaaagactgtttctcaagtagctgttgttgccgttaaaaaggcaaagcagtgagtaagaggagagaaaatggtggcaccttttgcttttggtgggccaaatgaagacaaacttttttatttgatccgttgaacttcgaaatttgaatgagaattattattacaaggttaaaacttgacttctgcatcattaaagaaaaattcaaaagaaacaaaagagaagtatactatagaaaaagctatctcattgtggatcaataggtccctaggaaccaatagtaagtaaaaagcaaagtggtaaacatacaaaagcgagattattctcaagtctcatttcaatgtcaaaactctctcttgtgtgctaagtaaacagaacctgtgtgaaagtaaaacacctctgaactcattttcactatctcacaaacctgcattatcgatccaattctcccatcttatatcttcttacatattaaggatcagagaaggtgatcaaacctgataattatgtagatgtagctgaagctaagatataaggctcaggaaccacaaaaacatatcactgaatatttcaaattagcttcagcattttatgagtcaaaatactaagaaacaatgcaaattctctcatgaaaaggctctcacattgcttttgcattctccgcaattatgatccaaaccttaaccaaaaacaactaccctataagagtataagaccatgtctgcagaaatcagtagtaacacaagaatttcatgagatattaaagaagaagaaaagtaggccacacaatagaattgaggaatcaagaaaacagatacatacacttgggaaggaccagcacagcagacgtctgttactactaactaactcagacttgtcattgaactatattatatacggctcacttgttttgctgcagtaactggcttatcttcttttctggcttgcgttaataacatgagtagagagaaaacacgacttccgtcgagtagattcctatcaaacaacaccggttctcgaatctttcgacaagccaagcaaaagtaggtgggcatgaaaatttgttccccatgaaacagaggacattcgttgttacctattctaataaccgattcaaaattccgaatcgcagacttaataaatgtggacaattaaccaaaccgtgcattgctaggtctaaaccgcattggtttatgacccaccaatcaaggagcgatgggtgagaaacctaataacactgctgctgtgactttatcatatccttagtccaattgggatcttcgtctgcgtgagacgcgttcacacctgcgacagatgaaatcacggaaataccactgcccaacgtgttcgcaataaaagtcctctgatgcctaatttcgtcaatttactgaagaaaattcaacatcaacgccctttttgataatttccccaaagttagtgggccctccacacgaagcatgtatcctccaattgcatattgccaattatttcctaataatattgaaggattattcttttcccatctatataccaccaaccctaagatccgaacgtccattttaaagccgtgcgtttaatcatgatcgtcaattatattggcaaatttgaccacacgatatccgtcatctaacggcatctacagatctaccagaacgttctcattcatgactctatatatttcgcatttcttctcctcaacgctctcataaaaagtagtactcgtgtcttactcgtgccagccactcgcatttctccagattttattatccttcctcgaaacaaggtatgacggaaactctctctctccctctctgatccgtcgttgctgcttccattttcatcttgactcgatcggatcattgttatgcttggcttgatctgtgcttaatgatgtgtttttcgtagtagatccacgattcgttgctgcgatcggcgttattatcgtcagctctctcgtttctgttctgtggttcgatattgctgagtttctaggctaatcttacgaatctgtgaaagtttttgagagatttggcttctgtagctcactcctgcttgatttaggttttttttttttccactcgtatgaagctgttttagaggctgttgttgtttatgattctcagcttgttatgtatagttggatttcgtgagttttggatttgatctgtgcgtttatttagtagtgaggctcatgtatatatatctgtgtatttgttccagagcttagctaagatg

SEQ ID NO: 16679 - DNA, 3000 bp, Unknown; identical to SEQ ID NO: 7210
  misc_feature (1)..( 3000): 2750-1469P.txt file - cDNA_ID_1664727; gDNA_ID_1621133; Annot_ID_172550

SEQ ID NO: 16680 - DNA, 3000 bp, Unknown; identical to SEQ ID NO: 2744
  misc_feature (1)..( 3000): 2750-1469P.txt file - cDNA_ID_1664939; gDNA_ID_1620585; Annot_ID_161286

SEQ ID NO: 16681 - DNA, 3000 bp, Unknown; identical to SEQ ID NO: 13614
  misc_feature (1)..( 3000): 2750-1469P.txt file - cDNA_ID_1665243; gDNA_ID_2214639; Annot_ID_188236

SEQ ID NO: 16682 - DNA, 989 bp, Unknown; identical to SEQ ID NO: 15
  misc_feature (1)..( 989): 2750-1469P.txt file - cDNA_ID_1665243; gDNA_ID_703; Annot_ID_144503

SEQ ID NO: 16683 - DNA, 1008 bp, Unknown; identical to SEQ ID NO: 119
  misc_feature (1)..( 1008): 2750-1469P.txt file - cDNA_ID_1665314; gDNA_ID_2825; Annot_ID_145966

SEQ ID NO: 16684 - DNA, 2568 bp, Unknown; identical to SEQ ID NO: 174
  misc_feature (1)..( 2568): 2750-1469P.txt file - cDNA_ID_1683704; gDNA_ID_24396; Annot_ID_146434

SEQ ID NO: 16685 - DNA, 717 bp, Unknown
  misc_feature (1)..( 717): 2750-1469P.txt file - cDNA_ID_1683727; gDNA_ID_24410; Annot_ID_146440
aaaaaaaaaaaaaaaaaaaaaaacatttttcaaaatcctcttcttcgtttcttcgtgttagatctgatggtcctcatagatagacgatagacagtcttctttttgcaagtctaaaaaaaaaatttcgtcttggaagaataaacttgtcctgttacaagtaaaccaaaaattactcaatattactattactgacacacatagaatagaaaggtagagagagaaatagagagatggggaaattacgtaagtgattgtgctaattattagaaaaacaaaaatctcctaagaatatcaatcaaaacattagtacttttggtttcttatcatccattgtttcttgggttataaaccaaaatttagactttgtttctgcgtaatcatatgttttatatatttatcatctattaaggattacctgattatagtttctgtaatgtatatgtagatattgtatatgcctataagaacacaaaatcttaggacaatctaattagggattatttcttagtttaaatgaatatataggtagtaggatttttttttaataataataaatatagacagaaagggagagtacaagaaacaccatcatttctcaatgatgaaatggttttggtcttacacagagtcacagtgagagagagagagagagagggtttattaacttaaccatggttccacttctccatatgttgaatgggctagaatttaaccatg

SEQ ID NO: 16686 - DNA, 82 bp, Unknown; identical to SEQ ID NO: 177
  misc_feature (1)..( 82): 2750-1469P.txt file - cDNA_ID_1683740; gDNA_ID_24421; Annot_ID_146444

SEQ ID NO: 16687 - DNA, 129 bp, Unknown; identical to SEQ ID NO: 179
  misc_feature (1)..( 129): 2750-1469P.txt file - cDNA_ID_1683806; gDNA_ID_24689; Annot_ID_146454
  misc_feature (1)..(2): n is a, c, g, or t

SEQ ID NO: 16688 - DNA, 98 bp, Unknown
  misc_feature (1)..( 98): 2750-1469P.txt file - cDNA_ID_1683946; gDNA_ID_25377; Annot_ID_146503
actggtccattgttgactctggaagtgcaagactgttggcgtgggatacatgtcgagacagatttgcgattctagaatctgtgttacctcatagaatg

SEQ ID NO: 16689 - DNA, 122 bp, Unknown; identical to SEQ ID NO: 100
  misc_feature (1)..( 122): 2750-1469P.txt file - cDNA_ID_1684034; gDNA_ID_2570; Annot_ID_145791

SEQ ID NO: 16690 - DNA, 2342 bp, Unknown; identical to SEQ ID NO: 102
  misc_feature (1)..( 2342): 2750-1469P.txt file - cDNA_ID_1684091; gDNA_ID_2597; Annot_ID_145807
  misc_feature (581)..(581): n is a, c, g, or t
  misc_feature (596)..(596): n is a, c, g, or t
  misc_feature (700)..(700): n is a, c, g, or t
  misc_feature (1851)..(1851): n is a, c, g, or t

SEQ ID NO: 16691 - DNA, 1261 bp, Unknown; identical to SEQ ID NO: 187
  misc_feature (1)..( 1261): 2750-1469P.txt file - cDNA_ID_1684123; gDNA_ID_26042; Annot_ID_146532

SEQ ID NO: 16692 - DNA, 3 bp, Unknown
  misc_feature (1)..( 3): 2750-1469P.txt file - cDNA_ID_1684200; gDNA_ID_26300; Annot_ID_146545
acg

SEQ ID NO: 16693 - DNA, 1612 bp, Unknown; identical to SEQ ID NO: 105
  misc_feature (1)..( 1612): 2750-1469P.txt file - cDNA_ID_1684224; gDNA_ID_2637; Annot_ID_145834

SEQ ID NO: 16694 - DNA, 63 bp, Unknown; identical to SEQ ID NO: 107
  misc_feature (1)..( 63): 2750-1469P.txt file - cDNA_ID_1684386; gDNA_ID_2693; Annot_ID_145865

SEQ ID NO: 16695 - DNA, 841 bp, Unknown
  misc_feature (1)..( 841): 2750-1469P.txt file - cDNA_ID_1684431; gDNA_ID_26984; Annot_ID_146581
acatgttatctcatcttagacaatgtataatgtttttattctatttatatatttgatgtttggaaatcatgtgttgcgaatcttattctcattactatataaagaacaccttagagacatataactcaatcgttttcataacttaaaaatctcttacatatacatattttctactgctttcttttgggagataataaaagcctytctcagacaaaagatctgctattgttttgggtaacattttcatatcgaatttattcgtataataaactattaaacgatgttagtttagttttaaacgttaagtttaaaaaattaaatgcatgacgttatggaatgaaatgacgaagttacccttaaatgcaacgtattgtggtaatcagtcatgtgcctatcaaaaacggaaacataaggtcaaatatggtaaacgacaagcgtcaaagtatttactatattaacaaatatttgagagaagaatttttgattataaattaataatcaaaggcatcaaggaaagcatcaatggcggaagaagcttacttgtaatagccacgagtgaagaagaagaagaaagccactggaacaaataaggaagacgatacactcacagagagagagagatacgtgtttctctgtgtgtttctacgctttttggcttttcttcgcggcttccacgaagaagccgaacggcgtgattcgcattgttctccacattgtctcatcttcctccgattttgattccaccattttcagatatattactctcttccggatctgaattgtgttggaaccaattggttctgatttcagatttcgaatttttttaatttgaatccaaatg

SEQ ID NO: 16696 - DNA, 3003 bp, Unknown
  misc_feature (1)..( 3003): 2750-1469P.txt file - cDNA_ID_1684431; gDNA_ID_2926308; Annot_ID_205928
aaaatgagggtaaacatcatttattgatctatcctgcttaagaaaagtctttgatcaccttccgttcttaacatactatacatcaagcataaaacacgagaaagcatatatctaagttttctcatctcttcttacactctatcgacatgataaaatatatgttcttaagagacaagacatttgtttagattatcagaaggaataaaagaattgtgccatattttctccatttgttcatagattcctaagcatgttagactgcttttggtttcaggctgttcagaaagaaagagaagacaaacttgctcagattcttaaggaccgcctcaacctatatatgacgaacaaagatgaatttactagcaatgctgaagctgaagtaacaagactctcaaatgcaggtacggtgttttgtagcatattgttcccctttcatagtttatgctttctctttcaatcaatgccatatctgtggtaaaaaaactcaaacttatcttcttttttgtctatcttcaacagcatacggggtggaaatgttgaacacaatcggatatatatatgtcagacaagcggcaaaagagcttgggaagaaagctatttatctcggtgtgccattcgtagctgaatggtttaggacgaaaggtcacttcatcaaatcccaagtaacagctgcaacaggttagtgacttaggtacaaaggcgacctcaacaacatcatgttcatatcatatgctagaagaagtagtatgggttacataaggaacattttatttcaactactgaaaaagaaaacccaagaacactctcctagctttctagaacttggtctcctctctaggggggtaatatttagtgacttttctttatctgtcgtcctaggtgcatacgctttattccagctgcaagaggaaatgaaaaggcaactaagtgctgaaggcaattataccgagaaggaacttgaagagtacatgaagacccataagaaagtaatgattgattctctgtggaagctcaatgttgctgatatcgaaagcactatctcccgtgtttgtgagcaggtagtccagctacaactgttcactagttgactgaagtagcattttggtcaatttctgttgtgaccactctatgattattttttggcttaggtacttcaagatcccactgccaagagagaggagcttcgtgcaagggccaaggggttaaaaactctgggaaagatcttccaggtaaatcttttttcattcccttcttggagaatgtagcgcatatttattccaaatatagtttactaaaaaggaagcactgattgcaaaacgctttatttttgtggttatatagaagaacaagatagccagtgagagtgatcctttagtaagagccgaacttcacaaactaaacggaaatggtcaagaacatgatcattcatccacatcaccaaaatctgatgaagcatctcgctctaccgttggacctcaggtacatctccttcctctttagccattcatctactagtatgtttcacataaagaaaaaccaagaaacataaccttgtgtaatctaaatatcttcccttacattaccctcatctttggaaacctttttcacacatcgtgagacacagctgcatgtttgtatgtgatagacagatagagattcaggaatgatttagggtatgttgatggtgtgtaattgattgaaacttgtctatgttacgacttatgagagatcacgagatatgattgtcgggaatgatttagccagaagtagaaactgtttcactcgtagtaacttacagatactaaaaattcttggatgccattgtgaataactaatagccacttaaaggactcatgaaatgcaatgtacacggcattcttgtaggaaccgcaaagcccttatgtggaagcaccgaaacttggagaagagcaaatcaactattacttcccaaggcctgcgccgcctccaggagcacagagacactcttaaactggcaatggattgattcacagatgaacgaaaaggttattttttcctttttttgctatataatataagtctttatgcatatttgatatatttgcaggcgttggtattaccattatgtaatttttattattgttagaagaagaaattattggatctttgaaaaaagcacatgttatctcatcttagacaatgtataatgtttttattctatttatatatttgatgtttggaaatcatgtgttgcgaatcttattctcattactatataaagaacaccttagagaaagagacatataactcaatcgttttcataacttaaaaatctcttacatatacatattttctactgctttcttttgggagataataaaagcctttctcagacaaaagatctgctattgttttgggtaacattttcatatcgaatttattcgtataataaactattaaacgatgttagtttagttttaaacgttaagtttaaaaaattaaatgcatgacgttatggaatgaaatgacgaagttacccttaaatgcaacgtattgtggtaatcagtcatgtgcctatcaaaaacggaaacataaggtcaaatatggtaaacgacaagcgtcaaagtatttactatattaacaaatatttgagagaagaatttttgattataaattaataatcaaaggcatcaaggaaagcatcaatggcggaagaagcttacttgtaatagccacgagtgaagaagaagaagaaagccactggaacaaataaggaagacgatacactcacagagagagagagatacgtgtttctctgtgtgtttctacgctttttggcttttcttcgcggcttccacgaagaagccgaacggcgtgattcgcattgttctccacattgtctcatcttcctccgattttgattccaccattttcagatatattactctcttccggatctgaattgtgttggaaccaattggttctgatttcagatttcgaatttttttaatttgaatccaaatg

SEQ ID NO: 16697 - DNA, 121 bp, Unknown; identical to SEQ ID NO: 231
  misc_feature (1)..( 121): 2750-1469P.txt file - cDNA_ID_1684752; gDNA_ID_75764; Annot_ID_146974

SEQ ID NO: 16698 - DNA, 74 bp, Unknown; identical to SEQ ID NO: 138
  misc_feature (1)..( 74): 2750-1469P.txt file - cDNA_ID_1685057; gDNA_ID_3142; Annot_ID_146121

SEQ ID NO: 16699 - DNA, 3003 bp, Unknown
  misc_feature (1)..( 3003): 2750-1469P.txt file - cDNA_ID_1685621; gDNA_ID_2684256; Annot_ID_193122
tggttaaaggttgttaatataaaagacaggagatacaaaccactccatttttccaatctttgttgtttatgtataattttctcatcaaagattgttaattatgaataaggttccattttatacggatcggaacttgcattacaatttaaagatatttctttctgatcgattagataaattgtctgtttttgattatagtcgacgtttcttaaagaagaaacacaattagaatagaaaaggcatcatgaattaaaaaagatatacaatcagttacatgttatgaacgctatattatgaagttacaattgtcacaaaaacttggagcaatcttgagagcttgtaacccttctatggacacgccctcctgcaaaaaaaagaattgagaacgaaagtccagatgtgatacaagatcatgatatcgaggccttcatatatagtcaagcaagatgattacattgggtaagctttggagcccaaaacaaaatataggctacaacaaaacaacccttcatatctccgttcttagatgcaatcatcaggctcctaaagaagtaaggtgatagaaaccaaaatctaaaaaaaaaaaacgaatcaagaatatgcctcagaggtagtgacaattgtgatataattcatcactatgaaaatctgatgaaaacacatcaatagatatacatcaccggcacaaaacaaacatcattaacaatttaaaaggtgcatcagagagattcccatctagacttaatcatcattatacttctcccaaaggagaatctgatgtccctgtctttttatcatcacttgcacacacactaaacttgtaataaaaactagaaaaaataaacctattcacatccaaacttcaaactggatttcataaccaaagaaaaaaagaagattctaaatgcctcagatttgttttgttttcctagagacaaagctctcaaagtatatttaataccatcacaggcatcaaaacaaacatacaattaaacagaaataaccacgacacagacaaaagactgaatctttggaaagccctcgaatcgatgagacaatttacagagatacaagactagggtttcaagagaagtggctcccattggagctttaatgaaacgcgatggctttatataagataagcagaggcggcgaaaattagggcaaaaataaggaactgaaaagatatgactgggctcgtaggtaaatatgaatagcccattagataaatcaaaaaggcccaataaaataaaaaagaccattcgtttggataattaattaaacgaaactgcctagttgattaaaggcccaataaaagaacattctctgttttcttcctttacagtggtttctctcttgtctaagagactctgtcattcttgaatcttgagaagtttatttttaagctgttgtatcgtttgagcatacatttttcctcaaatctcaagtacatatgaagtcatgtacttatgttataaaacttatatctttttgttttgaacttagccgaaaacttgagagccttgaggtaactctcttcctttctcataatattattggttttgggaaacatattgagctgaaacatttacttattgtatagggccataggccctcaagaagacttttatgaaaatggatcgtgatgttaatataaatgagttcttcttaggtgcaaggtacttgatacatgagttctatctatgtaaccttaaattcagtaaactatttgtcccgtttggaaaacacttgaactgtggtccttaatttgttatcctgaaggaatcaaactattgaggtaaggatgatggatcatcatgattcttttggatactactaagctcttgacttttgatagctaaaagtatgtattgacatttcatgaacagggtctgactaaccaagtagcattttctcttgttcaggttatggagtgtcataggagactgaggtggaacttttcggttttaattatcattttttttctatacatttgcgtttcaaccgtcttaacttactatggatacctattgcgtcttcttctgttgtgtacttttcagtttttaggcatttggagcatttggaagaatcattgagaaaatcttttgaaagagttaagattcacaaggtatgtcatgacttgatcacacacacacactgacacatatatgaacatgttaagagttaccaatggaggcagcatttgtcttgcgggaacatttcagaaaaaatcaactcacgtcattagaatgtacaacaacacaggttatgtataagttataacagttgcccttcttttctctctcacattcttaaaccagaccaaacattctcatgcagtttcagagcgggctatcatcacctttggtaataaacggtgttcaagaaaaccatttaatctcatggcttcctattaacaataaccagcaaatgatcatacctgctgactcaagttttcatcctcatccgtgagtgaaaactgttaatgcacttaataattaatatgctttggacttatatgctatattcaattgaaagttttatgatcagcagaaagatgaaaccggtttttgagttctggttaaacattagttttgagtaactgtagcaatgtgcacgctagttttcttgtatatacagtgtacctgtctacgtatgtgtgaacctacatgatattcagcagatttgtatatatctttgtgtcagtgtgtgtattgtataatacaacactagtgaataaaaaagaagagttttaattgtgatgagcatcatctgatgtctccaactcaaaaggcttatttccacaatcaacggtagagatctaaagataatgagaaaatttgcacaatcttctttaatatcgatatcttcttccacgataatcttacagatccagaagaagatcacacatggtttttgtataaattagacaaagctttacttgcagaacagagcagaaacagaacatatattctctgtctttttttgtggcaaaagtaaatg

SEQ ID NO: 16700 - DNA, 742 bp, Unknown; identical to SEQ ID NO: 20
  misc_feature (1)..( 742): 2750-1469P.txt file - cDNA_ID_1685621; gDNA_ID_813; Annot_ID_144531

SEQ ID NO: 16701 - DNA, 3 bp, Unknown
  misc_feature (1)..( 3): 2750-1469P.txt file - cDNA_ID_1685648; gDNA_ID_928; Annot_ID_144661
ggt

SEQ ID NO: 16702 - DNA, 42 bp, Unknown; identical to SEQ ID NO: 262
  misc_feature (1)..( 42): 2750-1469P.txt file - cDNA_ID_1685745; gDNA_ID_93838; Annot_ID_147290

SEQ ID NO: 16703 - DNA, 1223 bp, Unknown
  misc_feature (1)..( 1223): 2750-1469P.txt file - cDNA_ID_1685753; gDNA_ID_93839; Annot_ID_147292
caactcccaactctagtatgcgttgatttagcatataatttttttttctccaaagaagcaaagacacagaaattcacaagttattaatgaatttatactatttacattataacctctataaattaatactcgataaattaataatttttataaattaataaaaattttcgatcatgagttgggaccagtgtaaaaaatgacacaaatcgataaattaataagataaataattattttaaaattcctatgtaaatatatggtctcattaataacataaattaatagttgtaaaaacttcttaaaatatatatatatatatataaaagttatactcactctattcctttttgtttgattgtttagaaaaaaaaattgtttctaaaagattgattttttaagttttccatgtaatatttattggttagtattgacgaattgtaattttcaagaaaaatagttaattattattggtttaaagttataaaaaactgtaaaacactaaaaataatacatttataatcaacatttaatatgttttcttaatatgtgtgttttttctaaacaatcaaacaaaaaagaacagagggagtatgttagaaatattagtaaaatatgaatctgctattatttttatttttattatactaattcttagtaatgttcaattttaataattttactacatcgaaaacacttttttgttattttatagacacaataatttagtcttatttgcaattacttctagaaaaataatgattataaataaaacaaaattaatttaaacataatattttttttaaaattacaaaattagtctaaactctctataaattaataattattaatttattgataaattaatacctctataaattaatagaaatttatggtcccaacattattaatttatagaggttttactatggaataagaagcaaatctaaaaaatttataaattaatatcaatatttatgctattacttcttcattttttaaagtcttgttatttacttaagtaagcctaaatttttaataatgatcttatcttatgtaattgattaaaaaatcgtatagtagactattcaacaaaacgtgaatcatagtgttgttaccaaaacccattagtgtagcgacaactgtcctttcacatccttatacaaattctcttccctccggtcatctcggaaacttgtatcatcgacaaaacataaatactaatg

SEQ ID NO: 16704 - DNA, 3 bp, Unknown
  misc_feature (1)..( 3): 2750-1469P.txt file - cDNA_ID_1685795; gDNA_ID_94265; Annot_ID_147314
tgg

SEQ ID NO: 16705 - DNA, 477 bp, Unknown; identical to SEQ ID NO: 272
  misc_feature (1)..( 477): 2750-1469P.txt file - cDNA_ID_1685961; gDNA_ID_99301; Annot_ID_147365

SEQ ID NO: 16706 - DNA, 1297 bp, Unknown; identical to SEQ ID NO: 274
  misc_feature (1)..( 1297): 2750-1469P.txt file - cDNA_ID_1685987; gDNA_ID_99850; Annot_ID_147376

SEQ ID NO: 16707 - DNA, 1602 bp, Unknown; identical to SEQ ID NO: 275
  misc_feature (1)..( 1602): 2750-1469P.txt file - cDNA_ID_1686020; gDNA_ID_99880; Annot_ID_147392

SEQ ID NO: 16708 - DNA, 640 bp, Unknown; identical to SEQ ID NO: 169
  misc_feature (1)..( 640): 2750-1469P.txt file - cDNA_ID_1686532; gDNA_ID_3616; Annot_ID_146397

SEQ ID NO: 16709 - DNA, 196 bp, Unknown; identical to SEQ ID NO: 10
  misc_feature (1)..( 196): 2750-1469P.txt file - cDNA_ID_1686587; gDNA_ID_546; Annot_ID_144103

SEQ ID NO: 16710 - DNA, 3000 bp, Unknown
  misc_feature (1)..( 3000): 2750-1469P.txt file - cDNA_ID_1686621; gDNA_ID_75762; Annot_ID_146966
cgcttccaatttcaaacccctagtttctcgagaagcatcctcatcgttcgtcactcgctccgccgccgagccacaagaaagaaaaaccttccatggactgtgctatgtcgtcggcgacaacatcgacactgaccaaatcattcccgcggagtttctcactctcgtcccttcgaatccagaggaatacgagaaactcggttcttacgctttagttggtcttccagcttcttacaaggaacgattcgttcagccaggtgagatgaagacgaagtactcaatcatcattggcggtgaaaactttggatgtggatcgtcacgtgaacatgctccggtttgtttaggagcagcgggagctaaagcagtggtggctcagtcttatgctagaatctttttcaggaactctgttgctactggtgaggtttatcctttggattctgaagttagggtttgtgatgagtgtacaactggtgatgttgcgactgttgagttgagggaaggagatagtattttgatcaatcatacgactgggaaagagtataagcttaagccgattggtgatgctggaccagtgattgatgctggtggtatatttgcttatgctaggaaagctggaatgattccatctgctgctgcttgattttgacttcaggtatgattctgtaacttgatgatgatgatgatgaggattggtaataggttaggattgagatcgaatttgtggaatagtctaggaagcttgacattgaattgaacgatgcaaaacatagttttcaatggttctagttagagaaagagaacacagtagttgggattctagttttgtgttgtttaaaatgtgttggtttagtttttgtgtgagattgataatgacttgttattctttctcttcgcttaagacttactttatctttccattggttcaattagatacaaaaactttgtacatctctagattgtagttgttgggagggtaaaagttatgatgttggctgatcttttccatgctcatatccattaagacttgagtgtccgatagtagaacaatacttcactcttattttgtctctaagactccttttttttttcctttttttgttctatttgttttgcaggtgtcaatggaagtgcatgagagtcacttcaaggatcttgatccaataataagaatatgtaatgtttccaaaagcttatgaacctaatctatgttttatgaatatatatgactatcggctttagtcttcagtatcagtttcttgtttacatttggatgtatcagctgctaaaaaaatgcatagtttcccatcccatttgaaacgacgttttctctcatgtcttccactaatataatcttctggtcatgagaacagaacaggagctctgtttttctcacacaatgatcgaacacacttttgtcataaagtatcgagaaatattaacacttcttttaaggcatccgtttctagagtctttgtttcactgtgacctacctaagtatatcaaaacgcacgtttggaattctgaatggcactttcgtaaataggagggtacaaacatttctccttttaaattgttttcatcgtgaactctctcactcactcaacaaagtaaagaaacaatggcgtcttctcttcctacatttccccaagccttaccttgctcgtcaaccaaaacttcttcctccttggctaccttccgatctcctttcttaagattcaatggtgccacttccttaatcccctcctctatctccatcacttcacgtggcacatcctccccgaccatcatcccacgtgctgccgcctcagaatccgactctaacgaagccctagccaacacaaccttccacggcctctgctatgtcttgaaagacaacatagacaccgaccagatcatcccagcaggagccgcttgcaccttcccatcgaaccagcaagagcgtgatgagatcgccgctcacgctctctctggtctaccagacttccacaaaacacggttcattgagccaggagagaacagatcaaagtactcaatcataatcggcggcgaaaactttggttgcggatcgtcacgtgaacatgctccggtctgtcttggagcagctggagctaaagccatagttgctgagtcttacgcaagaatctttttccgtaactcggttgctacaggagaggtgtttccgctcgagtcagaggttagagtctgtgaggagtgtaagacaggagatacggtgacgatcgagctgagtgatagtggtggtttattgactaatcacacgaccggtaaaaactataagctgaagtcgatcggtgatgctggaccggttattgatgctggtggtatttttgcttatgcgaggatgatgggaatgattccatcattagcttaatcctcttccataaccatgatggtgttcttgtatgcataactatttgatgaatatttgtgttttagagttttctattttcttaacttttttatgtttgtttgatttggtattgttgttgttacctaaagaataagaaatcaaaagcaaaatagaccgacatgttccaagatatgtgaatatggtgagtgtttactaaattatgcgaatattgttgttgcaaccttattttcttccaagttgggcatcaatttccctttttgggcttagtcttcttttgtttgtaaatttagtttgttttagtttattgttggcccatttctgtagggtttggcccgttaagtaagtaccatgtaaacccagaaaatttacaatgaaaaccctttagcaaaaaagtaataattccgttggtaacttttctcattgtagtacatggcatattttacttactctactaaccaatttggtttggttattgaaaatttggcggtttaaacaaaccgatataaaataaccgttaagcggtaaaagaaaggacatcgctaaacctaaatttgcgactcctactttataacgccgctcttcttctccattgtttgtatactctgaaaaacatg

SEQ ID NO: 16711 - DNA, 3 bp, Unknown
  misc_feature (1)..( 3): 2750-1469P.txt file - cDNA_ID_1686649; gDNA_ID_75765; Annot_ID_146979
act

SEQ ID NO: 16712 - DNA, 1355 bp, Unknown; identical to SEQ ID NO: 233
  misc_feature (1)..( 1355): 2750-1469P.txt file - cDNA_ID_1686700; gDNA_ID_75772; Annot_ID_146994

SEQ ID NO: 16713 - DNA, 10 bp, Unknown
  misc_feature (1)..( 10): 2750-1469P.txt file - cDNA_ID_1686762; gDNA_ID_76061; Annot_ID_147020
  misc_feature (1)..(1): n is a, c, g, or t
nccattaatg

SEQ ID NO: 16714 - DNA, 130 bp, Unknown; identical to SEQ ID NO: 238
  misc_feature (1)..( 130): 2750-1469P.txt file - cDNA_ID_1686778; gDNA_ID_76066; Annot_ID_147024

SEQ ID NO: 16715 - DNA, 665 bp, Unknown; identical to SEQ ID NO: 240
  misc_feature (1)..( 665): 2750-1469P.txt file - cDNA_ID_1686824; gDNA_ID_76078; Annot_ID_147046

SEQ ID NO: 16716 - DNA, 1534 bp, Unknown; identical to SEQ ID NO: 248
  misc_feature (1)..( 1534): 2750-1469P.txt file - cDNA_ID_1687027; gDNA_ID_77070; Annot_ID_147139

SEQ ID NO: 16717 - DNA, 347 bp, Unknown; identical to SEQ ID NO: 252
  misc_feature (1)..( 347): 2750-1469P.txt file - cDNA_ID_1687073; gDNA_ID_77251; Annot_ID_147160

SEQ ID NO: 16718 - DNA, 119 bp, Unknown
  misc_feature (1)..( 119): 2750-1469P.txt file - cDNA_ID_1687093; gDNA_ID_77269; Annot_ID_147173
tagagatccaaatscggatttgatagctgatatagcagacgacggagaatctttagtgttttacaataatatttctcaaggaggagtaaataatcaacacacgaaggagttcaataatg

SEQ ID NO: 16719 - DNA, 1012 bp, Unknown; identical to SEQ ID NO: 254
  misc_feature (1)..( 1012): 2750-1469P.txt file - cDNA_ID_1687158; gDNA_ID_77498; Annot_ID_147197

SEQ ID NO: 16720 - DNA, 8 bp, Unknown
  misc_feature (1)..( 8): 2750-1469P.txt file - cDNA_ID_1687179; gDNA_ID_77852; Annot_ID_147214
taaacatg

SEQ ID NO: 16721 - DNA, 225 bp, Unknown; identical to SEQ ID NO: 140
  misc_feature (1)..( 225): 2750-1469P.txt file - cDNA_ID_1687366; gDNA_ID_3196; Annot_ID_146151

SEQ ID NO: 16722 - DNA, 2452 bp, Unknown
  misc_feature (1)..( 2452): 2750-1469P.txt file - cDNA_ID_1687382; gDNA_ID_3207; Annot_ID_146154
  misc_feature (5)..(5): n is a, c, g, or t
cagtnaacacaaaacaaatctaatgagtccagcaacgtgaaaagccacgtactgagtaaaagcacaattttcatttctatataaacaagacagtcttgggccaacaaagtaaacaaaacacacaccaaagaaaagaaaaacaaagataatgaggtcgaaaattaagttatcactcatagctaataagacctcaaggagaaccacattcaggaagaggaagggagggataacgaacaaactccatgagctgacaactctctgcggcgtcaaagcatgtgcggtaatctccagtccgtacgagaatccagtggtgtggccgtcaaccgaaggtgttcaagaggcggtttccatgtttatggagaggccggcgacagaacgatccaagctgatgatgagtcaagagacctacttgaaggacaaaattaccaaagaacaaaacaaactggagagtctacgtcgtgaaaaccgagaagctcagcttaggcgatttatgtttgattgtgttgaaggcaagatgagtgagcatcagtatggtgcaagggaccttcaagatttaagtctttatattgatcactatatcaatcagcttaattcaagtgtaatgctccttacaaacaatggtgcgtcttcttcttcctttcctcctccgcttcatacttcagttgcgggtgcgggtgcggctcatcttgctgttgtgggtgcgggtgcggctcctcttgctgtggcgggtgcgggtcctcttgctgttgcgggggctggtgcgtctcatcttgctgttgcgggggctggtgcgggtactcttgctgttgcgggggctggtgcgtctcctcttgctgttgcgggtgcgggtgcggctcctcttgctgttgcgggggctggtgcgtctcctcatgctgttgtgggtgcgggtgcggctcctcttgctgttgtgggtgccggtcttcatatggatcagaatcagtatgagccgattcagccctatatccctactgcttttagtgataatatccaataccaagctcctgtggattttaatcatcagatccaacatggaatctatgataatctcagtttggatccaaatcatcagtattcgtttcaagatgatccattcatggagatgttgatggaatatccttatgaacaagcgggttatgttggagagcatgcacacatccctttcatgaacggaaactactacaactaccaccaaccaccaaccgttggtcatactactaccggtcacatgccttccaacaacgccaccaccaccaacaccaccgatgtgtgatgtgtttcagtagtttgcatttgtgttttgttcatttcaaaagaccaatctctaattatatcttttcttttcagttaattgttgtatgaattgaaggttttacctttaagtcagttctatttttatgtattgggtaatgtatttctgtgccgttgagccgaatacttcaattaagtcatttctgtttggtcacaaatatgtttttactagctttttgttcttaaaatattaagagcgcctaaacacttcattgtattcaattcctaggagcctcactgttcttatgttttttgtttcaacattgtagtagaaaatgtagaagggtcgaaaatcgaatgacaacctctttggagccataatgatctcaccagccttgttggtgcctggaaatgatatttcagcacactcaacatcatcccaaatagaggagggaaacacccaagtttgctttgaccattcatgtttctcgacgtcttcatctagtatccataaatcgaactatggaaccgatcatattaatggtcgctctcaatggaagcaagcttccctttgtattctatgaatactgattcccttccccattgcacaaaacccttaggtgcattgataaaactcaatctctcagatctagctaacagaaaacaatccaaaactgtctctttagttttggttaagaaagcagcatagtagagaaaaccgttgatgcatacactcgcttgatgactcgccctataaggtaaaggggtatctttaatgtgtatccatacttcaccatctccctatgttcataacttgttctccagatgaccactagatatcatacctttttctcttccaggataatgctttgtattgatcatcaataggatcgtatcccacgaaagcagtggtagcaggtaacttaacgaatttctccgtgctagggttacacattaaccacttagagtctgcttgaacagcgagaatgccatgtaaagaagccaaagagtgtgatatttaagccagtaaagctgcatttgggaattgccatctcgaagttgggaagcaaagaagaagacccctatccctcgtcgtgtgaaaacgagaagaagaaggtaagtttctcagaagcgactaattaactgcgattgctccgaggacatagagaagaagaaatcaatg

SEQ ID NO: 16723 - DNA, 3 bp, Unknown
  misc_feature (1)..( 3): 2750-1469P.txt file - cDNA_ID_1687407; gDNA_ID_3219; Annot_ID_146162
gtt

SEQ ID NO: 16724 - DNA, 1407 bp, Unknown; identical to SEQ ID NO: 142
  misc_feature (1)..( 1407): 2750-1469P.txt file - cDNA_ID_1687439; gDNA_ID_3242; Annot_ID_146175

SEQ ID NO: 16725 - DNA, 3 bp, Unknown
  misc_feature (1)..( 3): 2750-1469P.txt file - cDNA_ID_1687504; gDNA_ID_3274; Annot_ID_146204
tat

SEQ ID NO: 16726 - DNA, 1687 bp, Unknown; identical to SEQ ID NO: 149
  misc_feature (1)..( 1687): 2750-1469P.txt file - cDNA_ID_1687639; gDNA_ID_3320; Annot_ID_146239
  misc_feature (466)..(466): n is a, c, g, or t

SEQ ID NO: 16727 - DNA, 36 bp, Unknown; identical to SEQ ID NO: 153
  misc_feature (1)..( 36): 2750-1469P.txt file - cDNA_ID_1687697; gDNA_ID_3347; Annot_ID_146256

SEQ ID NO: 16728 - DNA, 552 bp, Unknown; identical to SEQ ID NO: 154
  misc_feature (1)..( 552): 2750-1469P.txt file - cDNA_ID_1687739; gDNA_ID_3397; Annot_ID_146273

SEQ ID NO: 16729 - DNA, 3 bp, Unknown
  misc_feature (1)..( 3): 2750-1469P.txt file - cDNA_ID_1687846; gDNA_ID_3451; Annot_ID_146312
atc

SEQ ID NO: 16730 - DNA, 85 bp, Unknown; identical to SEQ ID NO: 162
  misc_feature (1)..( 85): 2750-1469P.txt file - cDNA_ID_1687850; gDNA_ID_3452; Annot_ID_146313

SEQ ID NO: 16731 - DNA, 244 bp, Unknown; identical to SEQ ID NO: 202
  misc_feature (1)..( 244): 2750-1469P.txt file - cDNA_ID_1688325; gDNA_ID_28291; Annot_ID_146664

SEQ ID NO: 16732 - DNA, 3 bp, Unknown
  misc_feature (1)..( 3): 2750-1469P.txt file - cDNA_ID_1688361; gDNA_ID_28303; Annot_ID_146672
ctc

SEQ ID NO: 16733 - DNA, 3 bp, Unknown
  misc_feature (1)..( 3): 2750-1469P.txt file - cDNA_ID_1688369; gDNA_ID_28304; Annot_ID_146674
cat

SEQ ID NO: 16734 - DNA, 2557 bp, Unknown; identical to SEQ ID NO: 124
  misc_feature (1)..( 2557): 2750-1469P.txt file - cDNA_ID_1688573; gDNA_ID_2871; Annot_ID_146016
  misc_feature (1874)..(1874): n is a, c, g, or t

SEQ ID NO: 16735 - DNA, 2195 bp, Unknown; identical to SEQ ID NO: 68
  misc_feature (1)..( 2195): 2750-1469P.txt file - cDNA_ID_1688608; gDNA_ID_2099; Annot_ID_145538

SEQ ID NO: 16736 - DNA, 340 bp, Unknown; identical to SEQ ID NO: 73
  misc_feature (1)..( 340): 2750-1469P.txt file - cDNA_ID_1688809; gDNA_ID_2234; Annot_ID_145590

SEQ ID NO: 16737 - DNA, 1781 bp, Unknown; identical to SEQ ID NO: 76
  misc_feature (1)..( 1781): 2750-1469P.txt file - cDNA_ID_1688863; gDNA_ID_2273; Annot_ID_145608

SEQ ID NO: 16738 - DNA, 298 bp, Unknown; identical to SEQ ID NO: 77
  misc_feature (1)..( 298): 2750-1469P.txt file - cDNA_ID_1688872; gDNA_ID_2279; Annot_ID_145611
  misc_feature (191)..(191): n is a, c, g, or t

SEQ ID NO: 16739 - DNA, 3003 bp, Unknown
  misc_feature (1)..( 3003): 2750-1469P.txt file - cDNA_ID_1688917; gDNA_ID_2214466; Annot_ID_182838
cgtggatgtaatgatgtactattggttaaagtaggctcagctttaaggttgcaactagaactaaccacagctctataaaacctaatcaataattcattactttgttttttctataaatggggggattcatgaatggtccagaatgagaattttcaaagggtttttgatcaacaattatgtatagcaggagagtgtattttatacaaaataaatgagagtggttccatggtatagaacaagatggtgtatcccgtcgagcaaatcagctctacatgtcggccacggaggatccaaatccaatatcaaatgagaacttgatgcaagttaactccttcttgcgtccatcaagcatcttcatttttagtgagtatgaaccctatgagaaagaaaaggattagactggtccttccttagatgcagaaacacaaaacgaaagtttggtatgacaaacatataactatagaaaccataaccagcaaatcttgacaacaagaaggttaaacttcttcactttagccgcttaatagacataatacttccacatggaactcataatatgctatcgaaaccaagttaaacctcttctcagtctatttcagttatccaactaaacagattcgattacactaggcaatttgttatgactgcaatagaattacatcaacttcaaatgagcataatgcatcatcatgtcattatatccaaaatgcttcgtattaatcaacaaaacccgcatagataagtagaaaaaacttacaggaggggtatatccgggaagaacttgcgagtgcgctaccaagaaatctccaatggccacaggacaacttgtctcatcacaaagatcatgtgtctcagaatgaatatgccatccaaagtaggaaacttcgatcaccaacttgccgctcgagatctcagtgtcttcatataaaacaaacccaaataaaaaaacccatcataccagtaaacccattacatacatcaaatgcaaaactataaacacaagtaatagcctcataggtaaatttgagtatacctgtgttagcagaaattctgaaagtagctggctcgcctctagctataggataaggagttatatcaactccttgtacttttacttcatactcttcgttattatctgcaaccaaacaatcaaaagttccccacaaatcgaattcattataacgcaacaagaggtcaaaatcaacattggatctttctatctaaatcttatcgcaaaattatagctaactcaatcaaaatactacaaggaaacaattggaaatcatgaatcaagttaggctttttgggaatcgaaagacgaaacataccgcagtagtgaacatcggtggctgcaacaatcgttgaaaccaagagaaaataagagatagcgagagatgagaatcccgtgaacttagacatgattgatgataattagattttctatcgaagaagcaaaagctgcgaattctcagatgatgatgattgaggacgaggaggagaggagagactaaacaagcaagagacaaagacagaaatgcggaatcgggattctcaaatcgcaagaaatgtcggattgatcttatccgttcattaacgtgggtccatgattacttaaaataaacggttcagatttcgtaattaatctgttacggtgtggttaatgacataggattagcagtgaacaaactgttaggtgggatttgtttaacgatttcaattcaagttacccacttggcaccaaaataataattgtatttgccagctcagatttgacgctatttttataatacagcacataattgaacattgtttttggaaaataaaaaacaaatccctaattcaacgaatctacttctcttatccaacacgaaatcaagagttttaaaaatatgaaaaatctaaagaaattattcaggtttcaataatatctaaattagtgcctctaagtatatttttatataattaaaaaagcatattttgttttgggccgcatgaagtcaggcccaaatatttaaaggcttatttgattaatgatatttgaagacatgtccttgaatcggagttttcgaaaattttgaagggagcttttctgacagatggctagattctttcttctctgttgcctcttcgcggcggtgctgacgtcatcattgacggaggccggcgacaataatcaagtctactcgccttgttcagattctactgttgcgatcggcgatggattcactttcggcattgccttcgctgcgaaagattctttcttcagtacaaatcgatccaaatccgttcagtactctccctgcgatcatcgccatctctcgctcaacggaaactctgaggtcgccgtgttcagacctaaagtcgatgagatcacactccttaccatcaatacctctagttcctccagtttccgcccggttcgttctcatctctggtttatcttggtgaattagggtttcgattgcaggtttttgatcagattagaatggattaggtcactcttaaggaaatttagtatagatcggaatcatatgcccagattagttgacttgtctaaatcctggcttagaatgttagctctggaattctaagctaattgtcgagattacttggattggtagattcaattttcccgtaggtaacgaaggtttaggttttaagctctgttcttggacgatctggttcctttctgcatttgtttcagtgagatgaaaggttcaaaacagagacttgccatgttagattcctatagattaagagtttggtttctgacgaagtaggtggaaatcaggttaacttgtaatgtgtatatcattagactttcagtgtagatacctctggaaaaagtgattttagtagtagcttcgtcacagtttctcccgaacattactatacgatttttgtttatcctcggaagtagaggtcatgaatgtgttagcctatcaaattatttgtttgtctgatgatactttgtgattccaggatgcttccaagggatatatg

SEQ ID NO: 16740 - DNA, 305 bp, Unknown; identical to SEQ ID NO: 78
  misc_feature (1)..( 305): 2750-1469P.txt file - cDNA_ID_1688917; gDNA_ID_2301; Annot_ID_145626

SEQ ID NO: 16741 - DNA, 3 bp, Unknown
  misc_feature (1)..( 3): 2750-1469P.txt file - cDNA_ID_1689076; gDNA_ID_23524; Annot_ID_146415
gaa

SEQ ID NO: 16742 - DNA, 1569 bp, Unknown; identical to SEQ ID NO: 86
  misc_feature (1)..( 1569): 2750-1469P.txt file - cDNA_ID_1689086; gDNA_ID_2364; Annot_ID_145671

SEQ ID NO: 16743 - DNA, 233 bp, Unknown; identical to SEQ ID NO: 89
  misc_feature (1)..( 233): 2750-1469P.txt file - cDNA_ID_1689176; gDNA_ID_2399; Annot_ID_145697

SEQ ID NO: 16744 - DNA, 1565 bp, Unknown; identical to SEQ ID NO: 95
  misc_feature (1)..( 1565): 2750-1469P.txt file - cDNA_ID_1689243; gDNA_ID_2423; Annot_ID_145717

SEQ ID NO: 16745 - DNA, 3000 bp, Unknown
  misc_feature (1)..( 3000): 2750-1469P.txt file - cDNA_ID_1689328; gDNA_ID_1592327; Annot_ID_152271
tctcctatatgtgccatgtttaatggtttttttcttttgcctctctactcttctaatgaatgtcttgatgaacggtacagatcatacggtgcccatagatgatcaacgatacaaggcttccttgaatctagtcttaaccatggcttcccttttccactccagtgaagaagacttatcggtcccggatgcaacgttctacatcttccttcgaaattatcacctcctagaccatgctggttccacctatgattaaccgcttttatatcaccggcgaatatcagcagaaacggaggtaatgatcccaaatggtatatcctcttctgcttctgaattgtcatccactcttctaccttctgtgtatacattcctttcctccatttgtttacatccacaaccatcacccctgtgttgaaataacacggacgttttccttcaagaactttgaccaataccgggtctgaccagaaagttcttgtgaaataatgggtgaagtttgcgtggcagtactcgggagcagccaccactttaccttccatctccacatgccacagcttctctatgtcgtctaccacaacgaggtctgagtctaagtagatgatcctgtcaacgctgctagggatgatatccgcgaggtagattcttgcgtagttaagaggctgatcaagggcttgcctgatggatttcgatatcttgctgcggacgaggtttggatcaaactgataaatcttgaagtttaggtaaggaaaggttgatttgatgctggtgaaaaggtcgttttcgaaatgaggaagggacaggaaatgaaaagagaggttttcagggcaagtggaatgttgaaggagagacaaaacggcagccattgtgccacggaggtagtttgtgtcgagtgtcatggcgatatgaatctgatcagcctcacgagtcccgcattgatcaccgtttcgaaaagccggggcttctctgaaaacaggaagagttggagcagaaggcttatgaagaatgactccaacacgaaccgccatagtggtggttgtgaccaagaggaggataaaggacaggaggcctaggagttgtgtataggaaaggctccttgaggccatcctgaacctaattttcaagtaaactcttttattattattttcmcttttttttttaattttttttttaaaaaggtttaaacattacaaattaaaaagattgattagttaatagagccattgttagggaaaggctagaataaaggatttggggagaggcttgttttatgagcagtctaaatgtggggaagagattgaacttcggactgtttctcacacaaatctttgtctccaaaaaaaatccatttcctatgaaataggaacaagacaagtctgttgtccaatgaaatcggagtgaatttttagattttgtttcttcttctttagattcttagaaactggtttatgtttttttttggaaacaaaaattattgtttatttttaggacaaaattggtctgatcaatttgctttgctgtcatttctttttacmcttgawtgsgtcggcgggtttttttttttcctttttggaagtaccaaaattagaatactgtaacaaactcccctaaaatgtattaatgcatgcttttcatgcaagaaaataatgatttttatgtgatcaaatccctgataacatcatacgatctcatcatatatatagtggtactggtaaaatctgtaattccaaaagttaagtaaaatagtaagaaactaacttaagaaagtgtgtgttactccacgtttcaagaaaagaaaaatgtcttatatactccaatcttcatgcatggctactaagacagtcgcgtgtcaatcggtcattctcatgcctaatactaatccatatatataaataatatatgaaccagagagaagatctcttgaaactctttcgattacaaatatttgagttcaaacttattctttcaccaatactagccatttgcagataagacaaatagaaatcgagtcgaatctttcttgcttgagtggtagaagatttctttctctagttccatgtaattggtctaaatcagtgaactcataatttcatgtacacaaaaaaaaagactgtttcataaacagtggatatatggattggactcaccatgtcatacatggtctcgaggtaaattacacttactaagtaatcctttatattttacattttttaccatgttgtatggtaatgtgatagctacctaattcacagggccttaggcccattaggttttcaatattttcatggattatcgggtcgagaaaatgttatgatacccgacccgaaacggggagaaaataaacgagaaaagtaaggaattatctcgaggaaaagaaagcatcgataatctcaaaaagtttttggtttgatttgggaactcgtgcgcggctgtggcagaggccaaacccacccgtgtactccatccgtcggatccaccaaaccaatattctttcatctctctctctctctctctcttcttcttcgtcttcttctctttttattctttcttcaggaacaaattcctctgctttggcattttagggtttctcaaatttttgacgctttctcttaaaagggttgacgaaataaccctttaagggaaaaaacaaaggttgaggaagaccaccaaggtgaaaaaagaaagaagaattcgaacaacagcagcaacaagataaagttacgaatttttcctcttttgtaacctttgtttctcttcttcctcttcctccatttttttccattaaagattctgcctttgggttccaatttcgtctttcctttttcgattttgccgcgtttaacatgacattcgcaaaaccctacacttttctggacgccattgttgaatcccacgaatttcgtttccctagagattgcttgttctagccccagcttgaagctaaagatttttcaaggaaagcacgtttttttgtttgtgcaatcgaatctgtttttctgcgttatg

SEQ ID NO: 16746 - DNA, 1142 bp, Unknown; identical to SEQ ID NO: 615
  misc_feature (1)..( 1142): 2750-1469P.txt file - cDNA_ID_1689439; gDNA_ID_1592352; Annot_ID_152322
  misc_feature (1)..(2): n is a, c, g, or t
  misc_feature (27)..(27): n is a, c, g, or t
  misc_feature (51)..(51): n is a, c, g, or t
  misc_feature (177)..(177): n is a, c, g, or t

SEQ ID NO: 16747 - DNA, 3000 bp, Unknown; identical to SEQ ID NO: 616
  misc_feature (1)..( 3000): 2750-1469P.txt file - cDNA_ID_1689470; gDNA_ID_1592358; Annot_ID_152339

SEQ ID NO: 16748 - DNA, 651 bp, Unknown; identical to SEQ ID NO: 578
  misc_feature (1)..( 651): 2750-1469P.txt file - cDNA_ID_1689767; gDNA_ID_1592093; Annot_ID_151958
  misc_feature (17)..(17): n is a, c, g, or t
  misc_feature (27)..(27): n is a, c, g, or t
  misc_feature (33)..(33): n is a, c, g, or t

SEQ ID NO: 16749 - DNA, 98 bp, Unknown; identical to SEQ ID NO: 579
  misc_feature (1)..( 98): 2750-1469P.txt file - cDNA_ID_1689783; gDNA_ID_1592099; Annot_ID_151966

SEQ ID NO: 16750 - DNA, 44 bp, Unknown; identical to SEQ ID NO: 581
  misc_feature (1)..( 44): 2750-1469P.txt file - cDNA_ID_1689794; gDNA_ID_1592101; Annot_ID_151970

SEQ ID NO: 16751 - DNA, 2157 bp, Unknown; identical to SEQ ID NO: 583
  misc_feature (1)..( 2157): 2750-1469P.txt file - cDNA_ID_1689853; gDNA_ID_1592122; Annot_ID_151995
  misc_feature (1428)..(1428): n is a, c, g, or t
  misc_feature (1570)..(1571): n is a, c, g, or t

SEQ ID NO: 16752 - DNA, 1169 bp, Unknown; identical to SEQ ID NO: 586
  misc_feature (1)..( 1169): 2750-1469P.txt file - cDNA_ID_1689901; gDNA_ID_1592139; Annot_ID_152019

SEQ ID NO: 16753 - DNA, 59 bp, Unknown; identical to SEQ ID NO: 591
  misc_feature (1)..( 59): 2750-1469P.txt file - cDNA_ID_1690007; gDNA_ID_1592169; Annot_ID_152051

SEQ ID NO: 16754 - DNA, 3000 bp, Unknown
  misc_feature (1)..( 3000): 2750-1469P.txt file - cDNA_ID_1690084; gDNA_ID_1592188; Annot_ID_152078
taaaatccagtggcagccattgtaaataagtcacaactacagaatttatttcacaaaataactgcaaaaatgtatatatagatacctttaaattaagtgaacgagttacagaattttagtactcgatcaaaaacaatactaatacatattgaacattgcattaaattttgttttatccctaccaaaataaataaattagtttcattgttacttgaaaaatgcccaacctaacgttaaaacacgtagtagtgattattgtttacaacatttgtccaattattaaagtcaaacaatccataaactgtttacgctaaaacttgtgattttgacggttgcgggattctagatgatcattggtcaccttgtacccaaagaaatcttattatattattttgggaagtacatttggaatgtaaccttaatttttgtaattaattacatgacaatgatattagaaaaatttaattaaaaacaaaatcttttaatgacgttattaaggttaccaaaattcatttaacgacaatattcatttcttaattatagggcttattggatctaaagacgggtcatcaaagattttctaaactgaatcaaaatataccgagtattcaaatatctatctcttaccaaatataaacaaataagttcgtaaaacaatttaatattttatatacgaaatcaattgaatcttaattacataaaaataaaaattagcacaaaaaaaaagtattcaacaattaaatttttatcaaatctctctgttatataagttttgataatatattcgaataaagtgtaatataacttttcaatttgtactctttaactaatttaagctaactaatatatttgttaatcttatacctatcaaaaccgactatcgtttcttatctctatagtatttttgcaagacttttttggtggattttggtaaaagtgcattcgggtcatatggtacattctcctattaaataaatatggtgcactcctatattattaggtaaaatgtttagattataattagagtcatatcataaataaaattaatattattaaataaatggctttttggcaagacagatttggagagatggggttttgaatcaacaataataaaaaggtaaaatataattaattcaccgtttcaatacgggttaaatctttaatttattatttcttaataccactaatattaaacatatcaaatcatcctaatttagaaaaggttatataaaaccaaaaatattatgtggtatgtataatgttattatatataaaattaaactataaaatataaatgtattagagaatgatgcaatttataaaaataataaataattcttaaattttaaaaattactactttaaaaaaaaatcacgggacgggtaaagaaattacagaacgggttttattttggaattgggttatatggtggatgtatttgaatcaatatttataaaattttaaaatattattaatatactgttttaagaaaggttaaaacttcagttttttaacaattgtctcgtggattcgtggtatagcgttacttaataacaattataaactgtaaaatataaatattttataaaaataaaatttgtaagttttaatatatattacctttaaaaaataaatcgtcccgcggtatatcgcgggttaaaatctagtgattatatattatgaataaaataatttagataaagttagagatcaaatcctattacatccagaaaaataccagtctatatatttgtgatttttattgttgtaacaattgtggtgattagtttacgattttaaacatatcaacaacaaaaataattcagaaaagaaaacgcactcaattaatatagtttttttatagaatgaaacttgaacctttttacacgtataaaatgctttttagtgtaacggttaagacttcatcttcagataaatattttaggaccttaatatataatggtaactttaaaattgttctagacgacggtattattaatattatcaaatacttagtacaacgaatcaaattgactggaactataggaatgttcgaaatggaacatgatccaacaaatatcatacgtggtggattaacttgcttcacatataatttgtgctgaagtccaaataataatatacatggattctggaagtattatagttgggtataaagtcttgttgcatttgcatttatttcttgtacgcaatgcggctaagcaactttcattatcttaccataaaaagaacaaaaacaatcgtatcatattctcactctgcacgaaaagtcaagtcacgtaaattgttaaaagattggggatttgaatattgtatcagaaaaatgttatttaatctacaattttaaactatattaaaacacataattaactaagaaatcctttgtaatctcttaaagtcactaaaaatctaatgcttaaaatatttccaatcmcaatgaattttaaagttttttttaccaaatcaattgttctatattactatattttataactttttaaaactctatggttgaataacataatattttgttttaacacaaatcattttaaatggtagattgaatacacttccttagttttgaaaaaatacactaaaagtatgaaatgatgttttttttttaattacaaaacgataactcgaaaacgatggtttaatgaaattatttgatgaaataaagttatcataaacatccttaatctcttcttatacatgtcaactttgaccatgacatgaatggatcgcattcccaatttactaacacaaaaaaaaatgaggaaatacgaaaacagtagtataaaaatagagcaaagccggtgagaaaaaacaagaaacacagaaacagaacataaattaaagaagagtcacattcaagaatctctctcttctcctcctctcattctctcagcggcttcttcttcttcctttttctttcacatcacacaacacaaccactgtgatcttgatttgttaccaatg

SEQ ID NO: 16755 - DNA, 124 bp, Unknown; identical to SEQ ID NO: 323
  misc_feature (1)..( 124): 2750-1469P.txt file - cDNA_ID_1690084; gDNA_ID_1563797; Annot_ID_148312

SEQ ID NO: 16756 - DNA, 3000 bp, Unknown; identical to SEQ ID NO: 7252
  misc_feature (1)..( 3000): 2750-1469P.txt file - cDNA_ID_1690145; gDNA_ID_1621135; Annot_ID_56537

SEQ ID NO: 16757 - DNA, 1297 bp, Unknown; identical to SEQ ID NO: 594
  misc_feature (1)..( 1297): 2750-1469P.txt file - cDNA_ID_1690145; gDNA_ID_1592197; Annot_ID_152094
  misc_feature (512)..(513): n is a, c, g, or t

SEQ ID NO: 16758 - DNA, 3000 bp, Unknown; identical to SEQ ID NO: 7252
  misc_feature (1)..( 3000): 2750-1469P.txt file - cDNA_ID_1690145; gDNA_ID_1621135; Annot_ID_172622

SEQ ID NO: 16759 - DNA, 3000 bp, Unknown; identical to SEQ ID NO: 595
  misc_feature (1)..( 3000): 2750-1469P.txt file - cDNA_ID_1690169; gDNA_ID_1592205; Annot_ID_152105

SEQ ID NO: 16760 - DNA, 391 bp, Unknown; identical to SEQ ID NO: 602
  misc_feature (1)..( 391): 2750-1469P.txt file - cDNA_ID_1690266; gDNA_ID_1592244; Annot_ID_152158

SEQ ID NO: 16761 - DNA, 442 bp, Unknown; identical to SEQ ID NO: 603
  misc_feature (1)..( 442): 2750-1469P.txt file - cDNA_ID_1690312; gDNA_ID_1592255; Annot_ID_152176
  misc_feature (17)..(17): n is a, c, g, or t

SEQ ID NO: 16762 - DNA, 1752 bp, Unknown; identical to SEQ ID NO: 208
  misc_feature (1)..( 1752): 2750-1469P.txt file - cDNA_ID_1690464; gDNA_ID_29526; Annot_ID_146727

SEQ ID NO: 16763 - DNA, 357 bp, Unknown; identical to SEQ ID NO: 131
  misc_feature (1)..( 357): 2750-1469P.txt file - cDNA_ID_1690518; gDNA_ID_2963; Annot_ID_146062

SEQ ID NO: 16764 - DNA, 929 bp, Unknown; identical to SEQ ID NO: 133
  misc_feature (1)..( 929): 2750-1469P.txt file - cDNA_ID_1690682; gDNA_ID_3004; Annot_ID_146092
  misc_feature (115)..(115): n is a, c, g, or t

SEQ ID NO: 16765 - DNA, 975 bp, Unknown
  misc_feature (1)..( 975): 2750-1469P.txt file - cDNA_ID_1690727; gDNA_ID_30110; Annot_ID_146813
tgaaagtttaagcatatttttataacttaawactggagttccataagtttattgatgaatgtgataagtttgtctcaatgtagaagctatgtcctaragattcactcaatgtaacagctcgagatccmctcaatgtagcagctatgttctccarattcattcgtatttgtaaaaaaatgaaaactaraggtggcttgattgttggaactcgacgagtattgttccaggaagcagccgtcttacttcttttcaataacatatgttaaataaatcgacattgtttgttcaatcatagagagaacttattattattattattttttttttattgtagtagtaatcatgttcattcaaattgagcaattatttgctttctatctacgcccaaaaaccaacttctcaaatgcatcgacatgtaagaaaaattgcttttatgttttaaagttgtgtaacatttctcttggaactattgattgtctcaacgttgcaaataaagtaataaaatccyacaagatactaataatatccaaactgggcttataatcctaaaaatgacttccataattaaaacgaatttagtttattaattagtgtaatggaatattttgtcaataaaataaataatcwcgaaggattatataaaggaagaaaaaaaaaggaaggtgggaattttaaaagggaaagacacctgtctctctgacccacccacccattcatttctgtggctactctatcgtcgtcgtctccacaccgtcggtgccctcacggatcaatttctagagagagagagagcgagagagacgattcgtttttctagattctcgtcaaattttttttccctccttcgatctctcctttttccttattcagcatttccccattttttcacgcaagatccgtgattttccagggattgatctgattgggggatcgtgaaattcgtttgtgttttctgctcgattaaccggagaaatg

SEQ ID NO: 16766 - DNA, 22 bp, Unknown
  misc_feature (1)..( 22): 2750-1469P.txt file - cDNA_ID_1690771; gDNA_ID_30665; Annot_ID_146831
tgctctgaatctgtatgtaatg

SEQ ID NO: 16767 - DNA, 417 bp, Unknown; identical to SEQ ID NO: 220
  misc_feature (1)..( 417): 2750-1469P.txt file - cDNA_ID_1690779; gDNA_ID_30666; Annot_ID_146833

SEQ ID NO: 16768 - DNA, 210 bp, Unknown; identical to SEQ ID NO: 222
  misc_feature (1)..( 210): 2750-1469P.txt file - cDNA_ID_1690797; gDNA_ID_30942; Annot_ID_146844

SEQ ID NO: 16769 - DNA, 2534 bp, Unknown; identical to SEQ ID NO: 134
  misc_feature (1)..( 2534): 2750-1469P.txt file - cDNA_ID_1690969; gDNA_ID_3113; Annot_ID_146096

SEQ ID NO: 16770 - DNA, 784 bp, Unknown
  misc_feature (1)..( 784): 2750-1469P.txt file - cDNA_ID_1691109; gDNA_ID_1592492; Annot_ID_152550
gaggatatatcacttagaccgttagacgtcacgtgtaatcgtgtattaatgcttgcaaaatgtggttcaatcaaatacccaattaagggataggagaactaatacaaaaatgtggttcccgtaaacaatgcatgagcaagcacatgactgacatgagagatagaccagcgaataaaggtttagtattgacgcaccatgcaaagcgtaacggtgaactggagctctactggctgagataattcacaaggtgaaggtgagatatattttaggagagccagaaaggtagaaccccgagacgagagagaccaagtgagttttggactagtgtttttcaaagaatgggtctagaactatttattaagtgccaaaaaaaaagacaaataaaagkacgatttttctatataggactactcgattaatyttaacaaaaaggcgaataagaagaaaacatatatgtttgttttttttaaaacaaaaaccgtggaaatcaaaacaccagaaaaatgtggtagtgaagaaaattacaagagagrcagtaaaaaaaaaatgaaccaaaaaggcaaaaattgaatacgtggcttcaatgtagacccagatgatgaacgtcgcatcatcttccttacgggggaaatctcacattttgaaattacagaaaactccaaagaacccaagattgaatattgaatattgaaaattgaaaaaatctctctttgaagaattgaaatctctctttgaagacgaacgaacctcgttgattcctccattcctcttcggctcgtccatg

SEQ ID NO: 16771 - DNA, 62 bp, Unknown; identical to SEQ ID NO: 45
  misc_feature (1)..( 62): 2750-1469P.txt file - cDNA_ID_1691191; gDNA_ID_1665; Annot_ID_145267

SEQ ID NO: 16772 - DNA, 525 bp, Unknown
  misc_feature (1)..( 525): 2750-1469P.txt file - cDNA_ID_1691222; gDNA_ID_1815; Annot_ID_145376
ccccccgtccattaagaattaagaaatttggttaattacaacatttgtttttatgtttaagccttttgttcgtaactgagctaatactggaatcactgatcaatgatgaatttggaaaaaaagatattttgaggaagacagagacagactctcttcgaccatgggacctgaacttgtcctaaagttggtaattactaatttgtgccatcggcagagtccacgagctttttggctggatccgggcgggtccaactttctcgacatttgtttgatctctccgttttgaaattgtttttttttagtccttaaattcaaggttttatactatttttgacccaatctgactaccttaaatgacaactttacccttgcccgcttttcaactttttcttctcccatgtccactttagtcctcgttttgttctttcatagtcttctagatctgtagtttttttccgcgaccgcccaaaaaattctctgatcagacggtcgattggatcggagatttaaggtaaagaaaaaatg

SEQ ID NO: 16773 - DNA, 1131 bp, Unknown
  misc_feature (1)..( 1131): 2750-1469P.txt file - cDNA_ID_1691266; gDNA_ID_1872; Annot_ID_145395
  misc_feature (942)..(942): n is a, c, g, or t
cactgtttaaagaacatttgggctctcatttgacacatgtctagattagggatcattacattctgtgaacaagtaaaaagcttttgattctgctttttttctagagataatcataaagtttgaagatatcagcttcattgtctggttcatgaacttgttgatctttgactgtacataaatgtgctataatgttatcgccaatccataataagatgaagttcttgtgaaacttgcaggatatacaagtgacactaagggaagagatcaaaagcgcttgcgagtaccgtccctttgagaaatgcgattacaacgcgagaatagccaatgagatctgcttccagaagcttgaatatgttctcacgcagcttgaagatctgaaacaaactgctgaccggtatccttcttctgattgatattggtattcataaaaaggttacttgaagagctatactaaaccatcggttgtgatatagtttccagatgagttgtagacttgtaggttatcccattaaagtatgtccggtttttacgaatgagtggcttgttgcaaaagtaagatattatcctacttactatattagattttgcaaaaagattaggtgattttggttagaacattcacttgcaatgaatctgttccaagaatattagatacattacatccactgggagttatcaatttcagcttatggagaaatcgaaccaattttgggccagagagaaacggaccaattttattgcggtttaatgtatcgatcaatacttggaaccaaatgtgctaacgtcaattacgtatatgaatcccttcattcatatgtggtttaataaattaatagcatcaacagctgaaattcccggttagatgtgataaaaccaaagcggttaaaaagggttaatgagaaccaatattgccgggttggcggttacgccgttttgtgctcntctgttttagttacagctcaagagacgcgttgattggagaaggtgatagaaatctcttgggtagagggagaaaattagggtttagagttggagatgagaagaggaacgacgatctaaggagacaaaagagagtagctagatcaggacgaaattccatatttccttcgtttctgtttctctctgagaatg

SEQ ID NO: 16774 - DNA, 274 bp, Unknown
  misc_feature (1)..( 274): 2750-1469P.txt file - cDNA_ID_1691340; gDNA_ID_1925; Annot_ID_145428
aagattagcctttccttgcattaagcacaagttaaaacagtgagcgttaccacatttcatttacaagtgcaaaagaaaatttcaaaaaaatcctttccttttaccggatatatacacatcaccacatttgttaatattcaattggcgatactatattctttcattgcactaaccaaccagtctcctttatcatctctccatctcatcatcctcctccatttctctcccattttttcttctgtgtatctgcgggagagagtgaaatagagagatg

SEQ ID NO: 16775 - DNA, 399 bp, Unknown; identical to SEQ ID NO: 66
  misc_feature (1)..( 399): 2750-1469P.txt file - cDNA_ID_1691556; gDNA_ID_2079; Annot_ID_145510

SEQ ID NO: 16776 - DNA, 960 bp, Unknown; identical to SEQ ID NO: 1
  misc_feature (1)..( 960): 2750-1469P.txt file - cDNA_ID_1691857; gDNA_ID_52; Annot_ID_144096

SEQ ID NO: 16777 - DNA, 3000 bp, Unknown; identical to SEQ ID NO: 8895
  misc_feature (1)..( 3000): 2750-1469P.txt file - cDNA_ID_1692104; gDNA_ID_1971919; Annot_ID_58537

SEQ ID NO: 16778 - DNA, 3000 bp, Unknown; identical to SEQ ID NO: 8895
  misc_feature (1)..( 3000): 2750-1469P.txt file - cDNA_ID_1692104; gDNA_ID_2926147; Annot_ID_197807

SEQ ID NO: 16779 - DNA, 3000 bp, Unknown; identical to SEQ ID NO: 8895
  misc_feature (1)..( 3000): 2750-1469P.txt file - cDNA_ID_1692104; gDNA_ID_2926265; Annot_ID_143303

SEQ ID NO: 16780 - DNA, 3000 bp, Unknown; identical to SEQ ID NO: 8895
  misc_feature (1)..( 3000): 2750-1469P.txt file - cDNA_ID_1692104; gDNA_ID_2926147; Annot_ID_139141

SEQ ID NO: 16781 - DNA, 3000 bp, Unknown; identical to SEQ ID NO: 8895
  misc_feature (1)..( 3000): 2750-1469P.txt file - cDNA_ID_1692104; gDNA_ID_1971919; Annot_ID_177167

SEQ ID NO: 16782 - DNA, 154 bp, Unknown; identical to SEQ ID NO: 406
  misc_feature (1)..( 154): 2750-1469P.txt file - cDNA_ID_1692104; gDNA_ID_1590785; Annot_ID_150066

SEQ ID NO: 16783 - DNA, 3000 bp, Unknown; identical to SEQ ID NO: 8895
  misc_feature (1)..( 3000): 2750-1469P.txt file - cDNA_ID_1692104; gDNA_ID_2926265; Annot_ID_204899

SEQ ID NO: 16784 - DNA, 3 bp, Unknown
  misc_feature (1)..( 3): 2750-1469P.txt file - cDNA_ID_1692403; gDNA_ID_1590901; Annot_ID_150226
caa

SEQ ID NO: 16785 - DNA, 840 bp, Unknown; identical to SEQ ID NO: 422
  misc_feature (1)..( 840): 2750-1469P.txt file - cDNA_ID_1692410; gDNA_ID_1590903; Annot_ID_150230
  misc_feature (11)..(11): n is a, c, g, or t
  misc_feature (565)..(565): n is a, c, g, or t
  misc_feature (607)..(607): n is a, c, g, or t

SEQ ID NO: 16786 - DNA, 2321 bp, Unknown
  misc_feature (1)..( 2321): 2750-1469P.txt file - cDNA_ID_1692457; gDNA_ID_1590913; Annot_ID_150242
  misc_feature (47)..(47): n is a, c, g, or t
  misc_feature (1902)..(1902): n is a, c, g, or t
  misc_feature (1912)..(1912): n is a, c, g, or t
  misc_feature (1967)..(1967): n is a, c, g, or t
aaccataacctggggaatgttggccagttttgggcaagctacaaaanggatatatgcaaattaccaacttcagctaacagactcgagaaaatcgaaaaacaacacccccatgaatgtaaacaaaagaactaatcatttggacaaactcaacacagaagattatgagaaaactcacctgacatcaaccagtctatatcaaccatataattcgataagatcgcagcaacaacgtctccctgtcatttacaaatacaatctttagcaatgatatctgaacaaaacaaatgaaataatatgcttagcatgagactaacctcaatgacatcattaatggaaacacaagaagtattagcccaatcaggcaatgcatcaacactcaaaagccgaaatgttgaaggtagtttctcattaggtggacaaaaacgacgaatggcctctacatcgtcttcagcctaaaacagttccatcacatcaaacaaagcctcaaagaaacaacaaaaaaagcaacattctttggttaagccaaataagttacctttcgagctttcttagcagctcttccattgagcaaaactagcttgaagaaatggtgaccagggatcaattcaataagatcatcattacatactgaaacctcttcactaggtttcactttctttctctctcgtcaccggaagacctaataacaaccggatttgttccgtcctacccaaaagacacaaacttgacatgattcaattcgataagaagccaaagttataatttttaatgttgttatagttattaccactgacaacgaagctgagccagaagtggaaacgataatggtgatgtgtttgcgactgagacgcttatcgacgattgaaacgttgccacggccaatgatgtttggacttcggataaagttatccttggagatgaattgtcttcctttaaatctgctttcaatggaatcaaataagcaacctgcaacagatacataaatcagagcaagacatcgaattttctgtaattggaagaaacggaaattagggttttgttttgaattacctgagagtgagccattaaggaagacaagtgtctgaggttgaattgaaccaaggaagaagaagaagatgcaaaacgctgcgtttcagtgaactaactagcgaaaattttgggatgtttcaatggagaataatgggcaagaaattcatagtaacggtaacggttctcccaccggcggcgacaatcagacaaccgcatcatcatcagccgatgggtctttggcttgtgaagttgtacaatatattaatttaagaaacattgtcatcaaagtctgggtggtgtagtcggttatcacgctagtctcacacactagaggtccccggttcgaacccgggctcagacatttttttttcttcatttttttcaattgacacgtgtccgaaccttgcccaaaaataatagtatgattaacatattttatcttcccattacgttgaaatgttacaatcgaatattcgaatgagtgtgattggaattggatgaacatgcagattgttacgtggacaaaataattgtgatcaagtccaaagattaaacaatgtagtttaactccaaagagtttgtaagataaaggatattgattatattatgttaatcaaatttttaagatgtattattttgttctcctaccgtattattgtcacttttcagttgcgaagtcaaatgtcacaagcaatattgttcattgttaatcctcctacctaccagtcattgtcacgtgtaaattagatagctatggaccggcttgtgttccattctaattgttatacgtataatatagttttttcttgtggtttacttgtcgatttcaagttagttatcgacaaattaccattattcgttatcaagtgtttncttattcgtnacaacacctagttgacgaaaagatctgaatattgccaaatttcaaaaacttattnaagtttgtgttggttatttttttcattgtttaaaatcattggcaccctttttctggtgtaaatagtaataaacatcaacgaagacgataagccataaacaaaggacagctatatatattccacaaacaacaatataaaattcaacaaatttacaaaaaattcctatatctttgtctttaaaattcaatgatgtaaccacgaacactttgtatttttgtatttcaaccttaaactatagtactaacaagttccgtgacattattacataagcacgttagtataaataacaacaacaatattaactcaattagtatcatcgatcatctgtcaaaaagaggagctaataataatatg

SEQ ID NO: 16787 - DNA, 2103 bp, Unknown
  misc_feature (1)..( 2103): 2750-1469P.txt file - cDNA_ID_1692472; gDNA_ID_1590917; Annot_ID_150247
  misc_feature (1102)..(1102): n is a, c, g, or t
cagtattgcgaacgagccaatgaagattttcgtttaagctaatgggatggtaaaaatcacgattgaacgaaaaagagaaaggaaaatggatagtgttgagactccacaaccgtgtctcttacgaatatatctggactgaaaacttattttcgttattatggatcttttttgcctttcatcaaacataacaactttgtaactcaaaacgacgccgtttttagtttgtgttactattcccaagggacagaaaaaattatgctcgagagcacgacgattgatttctaagcattgatgtgaaattggattagctaggtataacgattgatcctgaggatagactcgacatcgatcaaaataaaccccatatcggtgttgtaagcaacaactttggcttctcggtatatgttcatttcgaatttatcggtcataaaagacgagatgtaagagtctatggtacgattaaatccccaagtgttgcatctatgatgagccacaagttctatcttgtaacgcctacacatgagcgaccatgaagaagaatggtgcagagacatgaacatgacacgaaaatgtggagactcgataatagatttccactgcttacaaaccagtttagaagtcgtgatcatttttagtggtaattgtgcaagtataattgtccatagatcatctgtgaagaaacccatattcttattcatatgtgttattgggatttacttaggtgtatttaaatactaaatttcacataaatttatttctcaataatatctagcttttgctgataaatctacgtaacataataaacagtaagagatttgatcaaattatatcttttcatgctattcagtattgtaattttctgaaataatcaattatcctaaaacaagttcataaataaaaagttaatatcctaaacaatatttacgtttaatatattttctctattaatactagatttgatggaaattttatctattttagttattttatataaaaagtttttttggttaataataatgaaaaacgtgattaatgataaaatcataataagagcgaagggcccattataacagcatttatttgggccgttgttggtctcagnttcccgctcttttttatcgatcgaggcgccaaaacacaaagaatcgattatttgttgtcatctttcagattgtcaattcaaagaagacgatcagatctaattgactcgagagagagagagagagagacgtatgtttgggaggctgagaccaccgcgtcgccgccggattgtctggagagatatccggcgaagatcatcaaagacgatcctctctccgtctacggtataataaatacacactctttccattttcatgtgattctgattgtccaatagaaatctctaggttttgaaatccttggtttcttttgatggcattgtagagtcaacactgttgaaacttaagcaagggtcaacaagacaggacactacttcatcagaaacagaaggtgaagagaatttgtcatcaacatcatcgtctcatgtcttgtcttcggatacacaattaggagacactcatgatgcaatggctatagactcgtgtgaaagctcgaaacagataaagagcaagaacccatcagtactatccatgtttagcaagtacaagaatcaagctcaagcacgaaacatgaagacagagactcaggaatgatttgtaaacaaatgtatcccaagttcatgtgtgttgtactttgattatgtacaatttaactacattgttagtaaggagtctatatagatgcctgtatcaaaacatttctcaatcatgtgtttattactttagcctaaacaagctttatgatctttaaccaacggtgttgatagtactggtcatgtaggggttcatccataactgaacgtctaaaccttatattaaaatgggtctaactgatcaatcaaaaacatttggggtcaaaacaatatattggataaatataagggttcataaaaaaacttaacatttcttcttcactgtaaaatgaaataaagcttatccatactcaacttcttcactctctcttaaaccttcaaaaaccctgaagagtgacgaatgaatcatg

SEQ ID NO: 16788 - DNA, 7 bp, Unknown
  misc_feature (1)..( 7): 2750-1469P.txt file - cDNA_ID_1692605; gDNA_ID_1590947; Annot_ID_150304
tcaaatg

SEQ ID NO: 16789 - DNA, 930 bp, Unknown; identical to SEQ ID NO: 431
  misc_feature (1)..( 930): 2750-1469P.txt file - cDNA_ID_1692672; gDNA_ID_1590962; Annot_ID_150335

SEQ ID NO: 16790 - DNA, 755 bp, Unknown; identical to SEQ ID NO: 444
  misc_feature (1)..( 755): 2750-1469P.txt file - cDNA_ID_1692880; gDNA_ID_1591037; Annot_ID_150432

SEQ ID NO: 16791 - DNA, 784 bp, Unknown
  misc_feature (1)..( 784): 2750-1469P.txt file - cDNA_ID_1692929; gDNA_ID_1591050; Annot_ID_150447
  misc_feature (161)..(161): n is a, c, g, or t
tagatataaaatcagttaattcttttttttttctttctcatatatatttatgatttcataacaccaatttgactttaagaagatatctattgaaattttcaaaacaagtttaataggaaaattcaaaatatatagacagcgccatattctagaatattaanactcattatgaatttttgaatgttttgatttatagacctatctatgatgttgaattgagtaaataaaaagtttaagtttaatggtgcgtttgatctcacccatttttttctttattcagtattcaatctttataactctaccttattcgaagagatgaattcatctagctataaacacatcagtgacaagtttaaaaaaaatatctacacgttcgatggtcttctgtatttcacatggtaccatccatgtgaatgtgatgggaaatttcgcagaccctaatgccggccataaattggatttacaaaactaaacaatgtaatacaattttcaaagaaaccggatctaattatcttattgtcacttaataaacaaactatataagagaaggggaggaatatatgtatacacttttttatgactactaggatggtaaccaaagtcatgattccatagtaactccggtttaattgcttcaaaggccaaaactaagctctttattaagtaacatggattagtttcttcataaagataaaactaattatttaaacaaagtcaaagctagctttagatgcgtactagagtgaataatacaaatagtaaacgatattctgatcagaaaatg

SEQ ID NO: 16792 - DNA, 3000 bp, Unknown
  misc_feature (1)..( 3000): 2750-1469P.txt file - cDNA_ID_1693072; gDNA_ID_2936586; Annot_ID_195111
ttgtgtctgcgttcagagagcttaacgagatgagtgatggagtaaaaatggacagtttgaaagaacctatcttcaatctcgtccctgtccttggtgctggaaactcttctgcttcactcgacaacataatcacctgtgaactatttgccctaaggtcgtagctttcctgtttctcaaggaacacaaaggtttacttacttgatcttggggtcatcaaggtcatcaagggccatttgattttgcaatgggtaagccaaattgaacggccctatgttttaggcggacagttccatgccgttttttttgaataccttttccatttgcgaaagaacaacacgtagttgttttgttccaaatggaaacggcacgatgtttgttattcttttcttttctttttttccagttggaggtgcaaagactgattactttttgccaaacccagtccaaatggaatttatttttatcgaaaggcatgatattattggtcaatacattataacaatatgaatattatttaccagaaatatttaacttggatttggttttaccacatactgtatgtaactttcctgtcacaggtcattattattaaacgtattttagaatttaatgcaaagaatgtgacatgttacacgacaatatatatctcagaaaggtgtgttttttgattaaagattattagtctttttcacgaggatataataagaggagagattccaaatgtcaagtgctattttcaaattgttaaacagagattgaagatctttagcataaaatgttaactatgacttgtctattcacaaccaaagtcttacctcaatgtataaaccgacgtctttccaacataacacatttgtattctcatatatttaaataaaagtgaagcttttctttgatctagatcgtggttattttaaaaatataataaaatcaaataactatggttacttaccaaagtaaagtggggttattttttgctgtggtgatgttttatgctttgtataagacacttttgcatctctagtttatttctaagcattttggagtaaagagagaacaaaaaacaaagtataaaaatatccaacaagatgcttttgggggaaacactgcattgtggtctgtggggacaaatttgctggcacaaaaattctgcagaagaaaatgaaaataatttgatatcactataggatggtccaaaaaagtactaacaagtttaaatatttaatttgattcacagcatcctttttagcaccgtaaatttgagtcttatgtagtactgattattaatacaaaactaacaagattatatatcgataaatatgaagcatcctattcctatggttgattatatgaatcttttatgtcacacaccctattacgacaggttttaatgatacccacatcacacgtgtataagttaaatgcaatgataacatcctttactctgaatacagatacatttgtggctaaaaaattgtaaatgcaaatctttggactttggttcagaaatgaaaacaaatgtattttttattcgaaactgtgtcttaaaaagaatccaaagtggaaatgtccaacctggaaattcagacgtaaagcgaacccaaaagaaaagaaaaaatgaaaaatggtaaaaccgtaattaagtgtaaagtcaagggtagttccatatttctcccttgttggtcgagcgagaccagaaaattcgcagagagagagagagagagagatagatctgagagtagtggtggtggcattaataatggcgtaagtggaagaaaggaacctagccgttagatcttctcaatcgctacaaacattcattgttcaccgatcgattctctctctttcttcttccccattgctccttccttcgtacccctctctctgtcttttgaggtttccgggtcgggttggtgagaaaactccagcggcttaacggatcttccactggtagttttctgttcctcacaaggaaatcgaaaatttgataaagcgaaagtgaaaaaggcgtgtgttttctttgtaaaggctccaacttttttgatgaacagcttgtgcttgttgtgaaggttgttactttttgtgtattggaatttgggttttttctttatgttctgaggaggagaaaggaggaagctttcttgaattggattcaaatttgagctcatatggtgagtttctagggttttgtttgtgattcctggaagaatctgattccttttctattagggttggagagaagtaaagcagaaaagcttttttgttttggagcttagtgagtgttgtggataaacaatggaagattactccaagtatactcatagtcctgctcatttagctgttgtgcttcgggatcatgctgctcttaggcgaattgtttcggatcttcctcggttagctaaggctggtgaagttactactgaggctgagtctatggagtctgagtctcgtgctgattctgtttcagctgtcattgatcgccgtgatgttcctggtcgtgaaactccattgcatctcgctgttcgtcttagagatcctgtctctgctgagattttgatgtctgctggtgccgattggagtctacagaacgagaatggttggagtgcgttacaagaagcggtttgcacaagagaagaggccatcgccatgataattgctcggcattaccagcctcttgcttgggctaaatggtgtaggagacttcctcggatcattgcgtcagcatctcggatccgtgatttttacatggagatcacttttcattttgagagctcggtcattccgtttattggccgcattgctccttccgatacttacaggatatggaaacgtggttcaaatctccgtgctgatatgactcttgctggttttgatgggtttaaaatccaacggtcagatcaaacatttctctttctaggggatggttactcgtctgaagatggtaaaatgtccctatctccgggctcgttgattgttctttcgcataaggaaaaagaaatg

SEQ ID NO: 16793 - DNA, 1770 bp, Unknown; identical to SEQ ID NO: 453
  misc_feature (1)..( 1770): 2750-1469P.txt file - cDNA_ID_1693072; gDNA_ID_1591090; Annot_ID_150501

SEQ ID NO: 16794 - DNA, 677 bp, Unknown; identical to SEQ ID NO: 454
  misc_feature (1)..( 677): 2750-1469P.txt file - cDNA_ID_1693098; gDNA_ID_1591092; Annot_ID_150508

SEQ ID NO: 16795 - DNA, 3003 bp, Unknown
  misc_feature (1)..( 3003): 2750-1469P.txt file - cDNA_ID_1693098; gDNA_ID_2926257; Annot_ID_143130
attcactttctttagaggtttttgggtagcatgttcatgggtcagcatgctgtctccattatctttttgatgtatatttaggtttcattgtgggaattcaaagaaatgttgttacctggtaattagaatcacaacaaaagtaaatatggtgaattatcaatttggaatcacgttttcaaatatcaaacctacaagatttttcttataaaaataacatctgcaagatttgcattctaactagagagagaactagtgtcatgtaggtatatatatatataacaaaatatagtgacataaacaacactcgcacttttttttcgtcaaggtatacatattacataaaaacaaaaacgtattttttttttatccagacaaatcatacccccaaggtaactaaaatattgttgggtaattaaaatagatatttccgtttgctataaatgagaaagcacttacaacatacatacattctctctttctctctctctctctctctcatcccggcccagttatgtggtcggagagaatgatgaaggtgtgtgatgagcaagatggagaagcagggcacgtgcattactagctcatatatacactctcaccacaaatgcgtgtatatatgcggaattttgtgatatagatgtgtgtgtgtgttgagtgtgatgatatggatgagttagttcttcatgtgcccatcttcaccatcatgaccactccaccttggtgacgatgacgacgagggttcaagtgttacgcacgtgggaatatacttatatcgataaacacacacgtgcgtgtttgtgtgtacgagctagcctagatcgcgtattttgaggaagtagataccctctgcaaaagtacctatttacgtacgtacgcaaaggaagattagtcttgcgaaatagtatcaggttagtctaattaacaaagctatatgtgattatatatatgatcacgcatcttgatcagcgtcgcttatatattatatataatttaatgttcataaaccatatgtgtcataatgaacatagtttcggttagcgagtattagacaggagatccaactatacaataatacaagtctttttcttttaaatgaaaatttacttatggtgctaattctattgtcattaaccgatgtttcatttgagtaactgtcaatctgtcatatcatttcaagcaaagggtaaatactaaaacccttttggttgccccttttttagttattaatgaggttaatagagataatcaaacgatatgataaatgtataagattaccgagtaaagatgagtaatttaatcgattagtggagcatgcgttcatttttttaagattatacttgctcttgctggttaccaccttgttcgctcttttacgggcttaaataacatacacatattatacgtatacactatcaagcgtgcgagatagaccaagttacatgttaatcttaattgttgaatcacacatttcaggttcgtaaggtcataccgctccttatcaaatggtattcagttttatctctctgatctccctcttcttttaattgtctaataaattaaaatttgaattagaacacattaattggcaattacaaactattattctattcaagtgttttttttcaaacagttttacaattataaatatgttatcggaacgtatgcatatataataaggatatttcagtcgaactaattattcttttatgttaaatagttgattataaatattcagataacttctctgaaatgtataatttgtatttaatctgaaaaatacagtgtgtaaattaccgttttcgatacatatattgtttagctcaatgtcaaaatgacattcatgtcgtgattatttactttccaacaaaaagaagagcttagcttattagttatcattatattttagattttttttttgtagatgacgatagctccttttagatcactattagtaatcgcaattaattcaatttggagagaacaacacagcaagaggcatgaagaaactccaattccaccagagcgttgcttcaaagttcgaagtctcaacaaacatgtttggaaacacatctcctctatacataagcaatgagacaacagatatgttagatgtatgcaagttttgtttgcttcaagataaacacaaaagcagaatagttttgattggaaagttgtttatctgaaaacgattaatcgagcgatgctcttatgttgtcagtgggcttagaatatatctccctaggccatatactgggcttcactaatggcaacaatattaaatagtcagttgcctcaatatcaacgagtgttaggcgggcccttaaatgatttgaacatttgatagattttaacaaatgttatttgggagaccacaattggagtttttttttcttttcaaatttgatttcaattctgtagcaacatggaaattaattagtatgaaatcttcgatggttgaaaaaaatactaatttgtaaattatatggaaaagaatccaaaaaaatatgatttgacccatacgtcggtgtttgttgagtaaaaatcttcttttttttccgtgtttaaggtaacaaaacgcgtcgtcacagatttggaccgtattaaaaacaattgacaaccgtgtatcctcccttaatttatcaataatgcaacattttgatatattcgtctacttcatcaataagaaaagtgtaacacgggaaataattaaatagtctaaattctcttctgttttttttggtttgttcttagaggaaatctttatcttggaatctttaatctatctagaattaaaagtttatgctcgtaggattgtctacttttaaaagtcaacatattcgatacagatattttgtatatttatataaagtcgaagaccctgaaacttatcttcacggcataataagaccaagaagaaaaagaaaacattaatttcaaccaaagcaaaacagagagaaaaaaatagagagagtgaatcaatttcggtggagaaagagaagaatg

SEQ ID NO: 16796 - DNA, 3003 bp, Unknown; identical to SEQ ID NO: 16795
  misc_feature (1)..( 3003): 2750-1469P.txt file - cDNA_ID_1693098; gDNA_ID_2926257; Annot_ID_204587

SEQ ID NO: 16797 - DNA, 2146 bp, Unknown; identical to SEQ ID NO: 457
  misc_feature (1)..( 2146): 2750-1469P.txt file - cDNA_ID_1693205; gDNA_ID_1591117; Annot_ID_150547

SEQ ID NO: 16798 - DNA, 95 bp, Unknown
  misc_feature (1)..( 95): 2750-1469P.txt file - cDNA_ID_1693298; gDNA_ID_1591147; Annot_ID_150587
caaaaaaaaatggagtgaaaaagatgaaatccctaaattgaatcgcaaatcgcaatttgaaaaaaaaaagatctctctctgaagaatccgtcatg

SEQ ID NO: 16799 - DNA, 41 bp, Unknown; identical to SEQ ID NO: 459
  misc_feature (1)..( 41): 2750-1469P.txt file - cDNA_ID_1693332; gDNA_ID_1591156; Annot_ID_150599
  misc_feature (5)..(5): n is a, c, g, or t
  misc_feature (15)..(15): n is a, c, g, or t
  misc_feature (23)..(23): n is a, c, g, or t

SEQ ID NO: 16800 - DNA, 692 bp, Unknown; identical to SEQ ID NO: 464
  misc_feature (1)..( 692): 2750-1469P.txt file - cDNA_ID_1693546; gDNA_ID_1591237; Annot_ID_150704

SEQ ID NO: 16801 - DNA, 294 bp, Unknown
  misc_feature (1)..( 294): 2750-1469P.txt file - cDNA_ID_1693717; gDNA_ID_1591284; Annot_ID_150780
  misc_feature (2)..(2): n is a, c, g, or t
cncaaataaatgagaaaaagcaaatcagtaattaaccttaaaaaaatgcctaataaagcgtcattaaagaataacccattatcgcctgtcactcacttttaatcatcaaaacacgccacgtgccaaactctccactgaatcaaagtcgccaaacgcttcagtcgctatttcatgatcgacacgaaggctctcttttggcgattgcaaccaccacctaagaagaacggctacgtaatttgactgtacgacttgcgaaaaaagtcgaaaccttttaacgaaccagacctaaaaatg

SEQ ID NO: 16802 - DNA, 219 bp, Unknown
  misc_feature (1)..( 219): 2750-1469P.txt file - cDNA_ID_1693833; gDNA_ID_1591311; Annot_ID_150825
cagcttggtgttcccgtcagctgacactcgagctggtggactgtggtagctcatgggtgaagaggtgtctcgaccaaaaggtgtaaggtcgagcgggtagcaacgaacggttgcatcgccgaaagggtggatcagggcgagcagttacgaatggaaagatgcaactcttccgaaggatgcaaggaacgaatgtgaccttatggaaggatgcaatgaatg

SEQ ID NO: 16803 - DNA, 56 bp, Unknown; identical to SEQ ID NO: 480
  misc_feature (1)..( 56): 2750-1469P.txt file - cDNA_ID_1693928; gDNA_ID_1591354; Annot_ID_150867

SEQ ID NO: 16804 - DNA, 471 bp, Unknown
  misc_feature (1)..( 471): 2750-1469P.txt file - cDNA_ID_1693932; gDNA_ID_1591355; Annot_ID_150869
ttccttataataaatgagcggmygtttttgtatatagttgtatcctacatgtaaaacaaattggataatttttaaagaaatgattaactgtatctcgtaaatattttactagatggaatttatatacataatcaaatttcaaagaacaaagaaaaatcgtaataaattaaacttctctttggataacatttcagcgaaaaaagaagaagcaagttaaggtttgcttcttgagaatatattgttgaagtgttttttatttgaaaattcccacaatttattaagaaaaaaattaacgatttgcacccgaacatatctagtcctcataatcaattcctccgagttttattagtagattaccgtgtctcaatttttgcatttttttcccccaaaaaaaatagacatggaccagtttttaggacaagcttatttggaggaaaagttataatttcgactgatattgggttgaacatg

SEQ ID NO: 16805 - DNA, 3 bp, Unknown
  misc_feature (1)..( 3): 2750-1469P.txt file - cDNA_ID_1693975; gDNA_ID_1564383; Annot_ID_149362
gtt

SEQ ID NO: 16806 - DNA, 322 bp, Unknown; identical to SEQ ID NO: 482
  misc_feature (1)..( 322): 2750-1469P.txt file - cDNA_ID_1694019; gDNA_ID_1591381; Annot_ID_150901

SEQ ID NO: 16807 - DNA, 712 bp, Unknown; identical to SEQ ID NO: 483
  misc_feature (1)..( 712): 2750-1469P.txt file - cDNA_ID_1694031; gDNA_ID_1591383; Annot_ID_150906

SEQ ID NO: 16808 - DNA, 172 bp, Unknown; identical to SEQ ID NO: 488
  misc_feature (1)..( 172): 2750-1469P.txt file - cDNA_ID_1694109; gDNA_ID_1591404; Annot_ID_150939

SEQ ID NO: 16809 - DNA, 1839 bp, Unknown; identical to SEQ ID NO: 489
  misc_feature (1)..( 1839): 2750-1469P.txt file - cDNA_ID_1694121; gDNA_ID_1591406; Annot_ID_150943

SEQ ID NO: 16810 - DNA, 1735 bp, Unknown; identical to SEQ ID NO: 491
  misc_feature (1)..( 1735): 2750-1469P.txt file - cDNA_ID_1694223; gDNA_ID_1591434; Annot_ID_150981

SEQ ID NO: 16811 - DNA, 747 bp, Unknown; identical to SEQ ID NO: 494
  misc_feature (1)..( 747): 2750-1469P.txt file - cDNA_ID_1694307; gDNA_ID_1591445; Annot_ID_151005
  misc_feature (563)..(563): n is a, c, g, or t

SEQ ID NO: 16812 - DNA, 1950 bp, Unknown; identical to SEQ ID NO: 495
  misc_feature (1)..( 1950): 2750-1469P.txt file - cDNA_ID_1694325; gDNA_ID_1591458; Annot_ID_151013

SEQ ID NO: 16813 - DNA, 3003 bp, Unknown
  misc_feature (1)..( 3003): 2750-1469P.txt file - cDNA_ID_1694329; gDNA_ID_1591458; Annot_ID_151014
  misc_feature (605)..(606): n is a, c, g, or t
atagtccttttcaaagacattgcgtaaatcatctgagaagcctgcaggttgacacatacaggcaataatctttcttcaaaaacaaagggaaaaagaaggcaaaactgtcgaaaataaaataataatcaaagaaagttaccagtaaacaagggctcattgaaattttgatccttccttgactggttattcattctccaaaactttaatttggatgaaggcatcttctttctcttacgtagagtatcactaggatccttaagcctttcacttatgttcctgttcaaactatttgatcagtacggaacagctaatgaaataatcaaagccacatgaagcaacggaaaagttattacttgttggttaatactgtgacaccatcaaagttcttcctcttccttgcccttctttgtggttggggaggagatggctgaagcaccagttgaggtgatggatgcacttaacataaagaaaaaagtgttttaaatagataataagagagagaatgtagtggttaagcttcaaattatcagactatgttgctagctcaccaaaatctgcacgttcttcctcagaaccagcagaagaacctggagatcctgagcgannaaacgcagaatgccttccagaatttaacatttcttcatcaatactagggatagtgggttcttctcattcaaagtttcatccaatgactcagtgcgttcaactctgacatcctgttgttgtgcagcaaatgatggatgggacgtggggcttagatcatgtgcagcgtcacgcattctctcaatctcgggaacagttccaggagaagtggcatcgtttctctcggaattgggaatgcgctcttctgtcaagttactttgtctaggatcctggacttcagtgaattcctctgtgacgttacgaggactataggttccagtatcgaaagcaatattggagtctcttggctcattgtctggtcctgtctcatgagccgtttcaacatcaatttctccggtatgcctacgcacaggttctgttgattggctgctcaaagcataaaaatatgtaacaacattattaaagaagatcaactaaacagataaggaagattaagagcaaggtgtagtaaaggaaatcaaaactctatgaagagcctcactcgacatccatcgggatagattctgagatgatgtcctgtaagaaaggcatacaaactttcattcaataacaagtgctcggagacatgggaaacaagaagtcagaatcaacttcaatgtcataagaagcaagcagtaatctcacctcgtcgaatgttacagcaacataaggatcaatgccagtaggaatttgatctgaaaaataagcatcaacatcataaacacctcaaaatcatggtatgctgcatctagaaccaaggaaaaaaaacacagacaaaaggtacctgtgagagtgatatcttcctcactccgagtatgattatcgaattccctagaattcacaagaaaagaatgttaaagatgagtcaggctttagaacagataaaaactcaaataaaagcaagaaagaagaatacatgtcgagagtgtcatcttccaagtcgaactcgtccagatttagtgcttgaggcaaagtaacagactcaggcggggcctgtctggcatcctcaggcaagttaacttgagtagaaacgaaagccttagctacccaagtattaaggagattccagtcattgtaaagataatccactttctttgaatatattcgcactaccccaactagaaggtgacttgacgttctcaatgccaatggtacttcaggaaacattatattatctgcaaagccaattgcaaaattctcgaaaagtcagaaactttattaaagcagagaatttcaattactacaatgggttatatataaacaacaaaatcggaatttgatgaatgcccatgtaaaaattcgtattgcctttttgaaatttcgaattggatacaatcaaaggggattcaaaaaaaaaagaagcgaactttggatcaaaaagcgaaaattgaagagaggaaagacgaaccaacagtgtcggggatgttgatggaggtgtactgagacttcttgaggcgttggtgcacatgagcggcgcaccacaccgtccccaatggaccctttcgagccaaaagcgtatgtgaataaaacattttaattccttcgaacaaggagccctaaagaagcagagatggagatactaagttgatttgagagagaaggattatcgawtcgaaggtgttacattatttagagaaaccaatcaattttgaataggaaactgcagagcgaaagagagagagacgaagcggtagggttttgtgtgcttttggagagaggaagaagtgtttttttagtggagcgggaaaaaactttttgtggcgctaatgttgaaatcataggcaaatagacgcaatgacttaaatacccttttcttattggatccgagttttttgaaatttgccaaacaaaacaacttgggccactaaacccaatggccaacttttcggattaatgggcctaaggggtacatttggaaattcgcgtatatgagagtctagggttttcttcatatttaggtttctctatttctttcagacgctgggttcttgcttttgctgtttgttctcttgagtggaagaaagttgcagccactaaatcagatccgacaatggtaaagttttcttcgcctctcagttttattattctcaggaggattattgaagctaaatattatttgtttgattatctgttctcacgactaggattttagtaaagtttgcatgattgagctgaaagtaatcaatctcttattgtgggtttcttgtttggttactgataatctagtagataagagtcttcctcgtaattgacccattggtttaagtttcatcttgaaatgtatgaagtgttcatcatgcagtaacattttggtcgaagtcttgttgtgtgttctgttttgttttgtattgattgaaaatg

SEQ ID NO: 16814 - DNA, 3000 bp, Unknown; identical to SEQ ID NO: 14479
  misc_feature (1)..( 3000): 2750-1469P.txt file - cDNA_ID_1694329; gDNA_ID_2684121; Annot_ID_190971

SEQ ID NO: 16815 - DNA, 2247 bp, Unknown
  misc_feature (1)..( 2247): 2750-1469P.txt file - cDNA_ID_1694338; gDNA_ID_1591461; Annot_ID_151016
aacttatcgattgtttttttttttgctacaacacatttggataatgagattggtaaaaatggatagggtacattttcaaatggaaccgaagttgcagtgaagagactgtcgaaaacatcagaacaaggtgacacagaattcaagaacgaggttgtagttgttgcaaatcttcggcacaaaaatctggttaggattcttggattttctatagaacgagaagaaaggatattggtctacgggtatgtagaaaataaaagccttgataacttcctatttggttagttgcatttgatgaattatttcaagtattcgttaaccagtcctgaaacatggttagagctaactactattcatggatgttcacagatcctgcaaagaaaggtcagttgtactggacacagcgataccatatcattgttgggattgctagagggatcctatatcttcatcaagattcacggctcacaatcatacaccgtgacctcaaagcgagtaacattctcctggatgctgatatgaatcctaaaattgctgattttggaatggcaaggatctttggaatggatcaaacccagcagaacacaagcagaatagttggtacctagtaagtcttccacttgactactctctcacatgttgaacattttattttgataacatattaaagtttttgatgtggatatccagcggttacatgtctcctgaatatgcgatgcgtggccagttctcaatgaaatctgatgtctatagtttcggagtgttagttcttgagattataagcggtaggaagaacaacagctttaacgagacagatgacgcacaggacttggtgacacatgtaagtttaaaggaaaggagttatatatatgtacctctcctcatcctacaataagcaatagttgcaataactgtttgactgattgattctaggcttggaggctttggagaaacggaacagcgttagacctcgtggatccattcattgcagatagttgccggaagagtgaagtggttcgatgcatccatatcggtcttttatgtgttcaagaagatcctgtaaaacgtccagccatgtcaaccatttccgtgatgctcactagtaatacaatggctttaccagcgcctcagcaaccagggttttttgttaggagtagacctggaacaaaccggcttgattcagatcaatcaacgaccaacaagtctgttacagtatctattgacgattcatcgatgtctgatttagatcctcgttgaatatggtgttattatatcttacgattgaaatcaagtttaattaagcctatatttacatatttctaaacttgatgaaccatgttgatcctttagtttagatttggtttgttaaaaccacatgtaatttggtttgattttttttccaagaataatcaatttagtctcagctatcagcatcaccaccgattgaaaaattcattacctaaatgagaaggagatgacacttagaatgttggcattagagtttggttcatttcaacaaaagaatcgctttagccatacctccaatgattttgtgccatttgattttgaaaacagagggaaaacagagtacagtgggatggtgatttgcatgatttgtaaagtggtgaaataaatgatatgtgaaccatctaacacgtcaaagtttttttctttctttcgttgtaaagtaaactagttgaatttctaagttttgacgcctatcaatctatttccgagaaagatataaaataaaaatattggagttgaatattatgtaataggttgatgattattctgcttggcgccgagactttgggttaataagacagtaccgttaaacttccttaacagacaagtaacaaacgaacagttattaagtaaaaacagtaattacacaaccgtagtttgattcagaatcagaaccaatcaacacgctcagtggcaggttaacttgtaaagattatctttgaatttttattttagggctcttccttgtttaactttacaactgtgtattagatttttaaagtcattttttgaaacaaggaactttacttagatcagtcccaatctctcttttcctcacaatttacgacatttaaaagaaaaaaatcgcttacattgactactgacttagtcgtaacaaaccatcgtatacttcacgttactcagtactagtcagagagagtataatggaagctccacgatgtgaaactcaaatcaaggaactcgagaaaaaacaaaaccatg

SEQ ID NO: 16816 - DNA, 74 bp, Unknown
  misc_feature (1)..( 74): 2750-1469P.txt file - cDNA_ID_1694368; gDNA_ID_1591467; Annot_ID_151033
ccmacgttatgcdctagaaagagattgrctcacttaaatgatcaatccattttcccgacgatttgacagtaatg

SEQ ID NO: 16817 - DNA, 1558 bp, Unknown; identical to SEQ ID NO: 500
  misc_feature (1)..( 1558): 2750-1469P.txt file - cDNA_ID_1694410; gDNA_ID_1591485; Annot_ID_151046
  misc_feature (1261)..(1261): n is a, c, g, or t
  misc_feature (1284)..(1284): n is a, c, g, or t

SEQ ID NO: 16818 - DNA, 2832 bp, Unknown; identical to SEQ ID NO: 502
  misc_feature (1)..( 2832): 2750-1469P.txt file - cDNA_ID_1694416; gDNA_ID_1591490; Annot_ID_151052
  misc_feature (8)..(8): n is a, c, g, or t
  misc_feature (353)..(354): n is a, c, g, or t
  misc_feature (1176)..(1176): n is a, c, g, or t
  misc_feature (1192)..(1192): n is a, c, g, or t

SEQ ID NO: 16819 - DNA, 25 bp, Unknown
  misc_feature (1)..( 25): 2750-1469P.txt file - cDNA_ID_1694566; gDNA_ID_1591526; Annot_ID_151114
cagcaacagccaacagaagaaaatg

SEQ ID NO: 16820 - DNA, 948 bp, Unknown; identical to SEQ ID NO: 512
  misc_feature (1)..( 948): 2750-1469P.txt file - cDNA_ID_1694638; gDNA_ID_1591549; Annot_ID_151148

SEQ ID NO: 16821 - DNA, 858 bp, Unknown; identical to SEQ ID NO: 517
  misc_feature (1)..( 858): 2750-1469P.txt file - cDNA_ID_1694796; gDNA_ID_1591582; Annot_ID_151212

SEQ ID NO: 16822 - DNA, 3 bp, Unknown
  misc_feature (1)..( 3): 2750-1469P.txt file - cDNA_ID_1694803; gDNA_ID_1591585; Annot_ID_151218
gga

SEQ ID NO: 16823 - DNA, 336 bp, Unknown; identical to SEQ ID NO: 519
  misc_feature (1)..( 336): 2750-1469P.txt file - cDNA_ID_1694818; gDNA_ID_1591589; Annot_ID_151227

SEQ ID NO: 16824 - DNA, 16 bp, Unknown
  misc_feature (1)..( 16): 2750-1469P.txt file - cDNA_ID_1694927; gDNA_ID_1591617; Annot_ID_151270
kggtaaggctgaaatg

SEQ ID NO: 16825 - DNA, 2128 bp, Unknown; identical to SEQ ID NO: 524
  misc_feature (1)..( 2128): 2750-1469P.txt file - cDNA_ID_1695023; gDNA_ID_1591639; Annot_ID_151305

SEQ ID NO: 16826 - DNA, 2088 bp, Unknown; identical to SEQ ID NO: 525
  misc_feature (1)..( 2088): 2750-1469P.txt file - cDNA_ID_1695097; gDNA_ID_1591653; Annot_ID_151332

SEQ ID NO: 16827 - DNA, 121 bp, Unknown; identical to SEQ ID NO: 526
  misc_feature (1)..( 121): 2750-1469P.txt file - cDNA_ID_1695124; gDNA_ID_1591660; Annot_ID_151346

SEQ ID NO: 16828 - DNA, 1028 bp, Unknown; identical to SEQ ID NO: 531
  misc_feature (1)..( 1028): 2750-1469P.txt file - cDNA_ID_1695180; gDNA_ID_1591679; Annot_ID_151381
  misc_feature (4)..(4): n is a, c, g, or t
  misc_feature (22)..(22): n is a, c, g, or t
  misc_feature (25)..(25): n is a, c, g, or t

SEQ ID NO: 16829 - DNA, 17 bp, Unknown
  misc_feature (1)..( 17): 2750-1469P.txt file - cDNA_ID_1695405; gDNA_ID_1591755; Annot_ID_151471
attattatcagaaaatg

SEQ ID NO: 16830 - DNA, 498 bp, Unknown; identical to SEQ ID NO: 539
  misc_feature (1)..( 498): 2750-1469P.txt file - cDNA_ID_1695417; gDNA_ID_1591762; Annot_ID_151476
  misc_feature (32)..(32): n is a, c, g, or t

SEQ ID NO: 16831 - DNA, 18 bp, Unknown
  misc_feature (1)..( 18): 2750-1469P.txt file - cDNA_ID_1695476; gDNA_ID_1591793; Annot_ID_151514
gtcatcaagaaagaaatg

SEQ ID NO: 16832 - DNA, 76 bp, Unknown; identical to SEQ ID NO: 546
  misc_feature (1)..( 76): 2750-1469P.txt file - cDNA_ID_1695594; gDNA_ID_1591833; Annot_ID_151567

SEQ ID NO: 16833 - DNA, 173 bp, Unknown; identical to SEQ ID NO: 550
  misc_feature (1)..( 173): 2750-1469P.txt file - cDNA_ID_1695743; gDNA_ID_1591866; Annot_ID_151626

SEQ ID NO: 16834 - DNA, 159 bp, Unknown
  misc_feature (1)..( 159): 2750-1469P.txt file - cDNA_ID_1695799; gDNA_ID_1591884; Annot_ID_151649
taccgagtaagtaaagtactagatgcagtcttcttcatcaatggaggtttttgattcgccccaagctctcgcgattcctgatgttcttcagtaatttcttgcaatccttataaacaaagagcgtggagaatcgtttcagaggaaagaaaactaaaaatg

SEQ ID NO: 16835 - DNA, 3000 bp, Unknown; identical to SEQ ID NO: 557
  misc_feature (1)..( 3000): 2750-1469P.txt file - cDNA_ID_1695956; gDNA_ID_1591939; Annot_ID_151733

SEQ ID NO: 16836 - DNA, 3 bp, Unknown
  misc_feature (1)..( 3): 2750-1469P.txt file - cDNA_ID_1696080; gDNA_ID_1591976; Annot_ID_151782
car

SEQ ID NO: 16837 - DNA, 2585 bp, Unknown
  misc_feature (1)..( 2585): 2750-1469P.txt file - cDNA_ID_1696143; gDNA_ID_1591990; Annot_ID_151805
  misc_feature (50)..(50): n is a, c, g, or t
gatttgtcattyttattkgctaggtcgtcaagggtgtagtggaaagtctnaaaattattacccgtaaggcgagtatgagagttgccgagtatgcctttctttatgccaagactcacggaaggaagaaagtttctgcaattcacaaagccaacattatgcagaaaactgatggtcttttcctgcaggtcagctcattttggaactcagaatacattagcacttctcaattaggggaacatagcaatttttctagtctctcactggcttctttttcttaacctttgttctgagacaagtttttatttgcttcctgctttgcagtgttgtgatgaagttgctgcgaagtatcctgagatatattacgagaaggttgttattgacaattgctgtatgatggtaagctataacatgatatccaccctatcttttgttccaaattatgtaaaggtcaatctcattgttaattaagttagtatttgggataatcttgttgattttgaaggttagatttcccagcaacccatacttgggtctgcttttcgctaattttacttatggaacaatgtgggattgataatccttaattctgacagcttgtgaaaaacccagcactttttgatgtcttggtgatgccaaatctctatggagatattatcagcgatttgtgtgctggacttgttgggggactaggactgactcctaggtaacatttgtttcttcgtctcacagattattgtctagtatgaaaatgaggcaatcatcttatgctcttattatgttttgttccagtatgaatattggggaggatggtattgcccttgctgaagctgttcacggctctgcacctgatattgctggaatggttagtcatcattcttagatgttatcatcgttctaaattcgtttgatgcatagagttgttgttaacttgttaaattattagagtaaataggatttagacactgcattacagattttgacaaatttaagtgaacttgcctacttttaccctaaaactaagtatgatagaagctgttcctgagagaagattctccattactctcttctatgccatttcttggttgaacattcagaagctttcattgtagaatggattattgtctagtttatattgtagaatggttcttactggatgatcgtgcttgtagtacttgaatgatgttaataactggccaacctagcattgagggttaaggagtctaataaataaatcatgttttcaaatacagtgggtttagatattatcttgccactattcaatatcagaacttgattcgatttttagcttatgatccacatgtttgttattctttgctggtgttgtgtagaacctggcgaacccaacagctttgctactgagtggagtgatgatgttgcggcacctgaagctcaacaaacaagcagagcaaatccacagtgccatcatcaacacaatagccgagggaaagtatagaactgctgatctcggaggttcctcaactacaacagatttcacaaaagccatctgtgatcatctctaaacacccgtgaaaaaccataattctttccttacttacttattggatcttcctcttggattttcactccaaaatttttctacatattgatcctcttcctatgaggagaaacaaagccgccataggctttagacattgacttgtgttttccttagatttgaagttcttgcagagctgtattacttcttctgcctttaagatccataacaaaagaaggatacagatattggaagaatccatcaaaaggttcacatttacagtttgtggattttgcctgaattgtttggcgttatgtcttattctctgtgaattttcaacaataataatatcgtcccttttgtccttacctaaattgtttgcctattctctgtgaatgaatacatataactctcaaaccctgaaaagtgaaaactttcaatgctgaaacaaaccaacgtggatgattcaggacttttcaatgccaccgacaaattcaatctttttcctattcattttgtaagttgcaatgctgtcacatttggttttctcattgtttttaactctctcttaaagaaacaacttaattagaatttttatgttcttacaacaagatccaatagacttttggacatgtgttgacacttttctcaagtgggttggtgggataggaacttaatatagctgcattagacaacaaaactactctatttcatcaatgattttgttactcataaattttgtttcagttaacttttctctacaaatgaagttgaatgaaatgaactatactaaaatttggttgaatatagaaattccaatggcaaatttatgcatgattttgagctaatatataaatatacatcattttgcccaaaaaaggataaatatgctttaaaaataatatatataaaataataggaagaagaagaatctatctttggtatacctactttggtttcagagcttataaacacaaacacttcactcacacaaaacacttgctcctccatttaccagatctgaacctcttccctttcctcgaaaatccttctcacatcatcatccatg

SEQ ID NO: 16838 - DNA, 284 bp, Unknown; identical to SEQ ID NO: 571
  misc_feature (1)..( 284): 2750-1469P.txt file - cDNA_ID_1696306; gDNA_ID_1592018; Annot_ID_151852

SEQ ID NO: 16839 - DNA, 1747 bp, Unknown; identical to SEQ ID NO: 572
  misc_feature (1)..( 1747): 2750-1469P.txt file - cDNA_ID_1696402; gDNA_ID_1592038; Annot_ID_151886

SEQ ID NO: 16840 - DNA, 204 bp, Unknown; identical to SEQ ID NO: 573
  misc_feature (1)..( 204): 2750-1469P.txt file - cDNA_ID_1696416; gDNA_ID_1592044; Annot_ID_151891

SEQ ID NO: 16841 - DNA, 285 bp, Unknown; identical to SEQ ID NO: 574
  misc_feature (1)..( 285): 2750-1469P.txt file - cDNA_ID_1696434; gDNA_ID_1592049; Annot_ID_151899

SEQ ID NO: 16842 - DNA, 3000 bp, Unknown; identical to SEQ ID NO: 9346
  misc_feature (1)..( 3000): 2750-1469P.txt file - cDNA_ID_1696434; gDNA_ID_1972097; Annot_ID_178622

SEQ ID NO: 16843 - DNA, 44 bp, Unknown; identical to SEQ ID NO: 575
  misc_feature (1)..( 44): 2750-1469P.txt file - cDNA_ID_1696439; gDNA_ID_1592050; Annot_ID_151901

SEQ ID NO: 16844 - DNA, 1775 bp, Unknown; identical to SEQ ID NO: 577
  misc_feature (1)..( 1775): 2750-1469P.txt file - cDNA_ID_1696594; gDNA_ID_1592089; Annot_ID_151948

SEQ ID NO: 16845 - DNA, 810 bp, Unknown; identical to SEQ ID NO: 463
  misc_feature (1)..( 810): 2750-1469P.txt file - cDNA_ID_1709992; gDNA_ID_1591235; Annot_ID_150700

SEQ ID NO: 16846 - DNA, 1618 bp, Unknown; identical to SEQ ID NO: 224
  misc_feature (1)..( 1618): 2750-1469P.txt file - cDNA_ID_1710110; gDNA_ID_30980; Annot_ID_146890

SEQ ID NO: 16847 - DNA, 3000 bp, Unknown; identical to SEQ ID NO: 6558
  misc_feature (1)..( 3000): 2750-1469P.txt file - cDNA_ID_1710920; gDNA_ID_1621097; Annot_ID_55735

SEQ ID NO: 16848 - DNA, 3000 bp, Unknown; identical to SEQ ID NO: 6558
  misc_feature (1)..( 3000): 2750-1469P.txt file - cDNA_ID_1710920; gDNA_ID_2926165; Annot_ID_139877

SEQ ID NO: 16849 - DNA, 129 bp, Unknown; identical to SEQ ID NO: 201
  misc_feature (1)..( 129): 2750-1469P.txt file - cDNA_ID_1710974; gDNA_ID_28160; Annot_ID_146657

SEQ ID NO: 16850 - DNA, 351 bp, Unknown; identical to SEQ ID NO: 434
  misc_feature (1)..( 351): 2750-1469P.txt file - cDNA_ID_1711067; gDNA_ID_1590986; Annot_ID_150363
  misc_feature (73)..(73): n is a, c, g, or t

SEQ ID NO: 16851 - DNA, 3003 bp, Unknown
  misc_feature (1)..( 3003): 2750-1469P.txt file - cDNA_ID_1711228; gDNA_ID_2214487; Annot_ID_133393
ccggaggaatgatcagatgggttttgaagataagaaacaaagattgagtttttgtgggttatgttgcttgaggtgggtgagagattatggcagcttaaccgccgaaacgagagagagagggaaaatttggagattacaaaaaggtttttcgttgtaaaaagagaaaagagagactcggagacattgctaacaccgcaagccattccctttttcaatgtcatcattttaactaaaagtgctaagagaaaattacgaaaaagggcttggagcaaaaagaaaggtacccataacctacccatatggagcgaatcatgatccaaattagtcatttgttacttacataatttcccgaaaataaactttagtttttataagaatttgttagtgctaaacataaattatttaaaaagaactataaacatttttagtcatgtgtataacccctacttgtaatactatatttgtatgcttaagtcatctaatgagaacttactctgcttaatcttctactactagctactaaaacaaaaaacttctactacttgtaatattatatcatatacattttgcacaaatatggagtataaaactagaagttaaagtttggatcattgaatgagcatttgaagacttctattataaaatagaaatgcgttacagtttagatagcgttaaagtttgaatcattgaatgagaatttggtcgtttgcgaggaaatagacttgttgagttggctacatatttattggagaacaaaactcccataaatgaggcatcaatacatacgtaacacttgtactcaaactctatagctgtgatttgtttttgtttttgacaccaactatatatgaatgatgatggtacaattcaaagattttcataatgaatctagtaaagcggaagtgtatgtattgccgtaatggtgtgcctctcgcatccttgatctatacaatcaagtttgatgttacaagagttgcataatatcttccatctacacacgctgcgtagtgtgtgcgcgtgtgggtgaatgtattcatacatctatatcttacactacttgaggacttgcacacatgcatgtggatgtgtgacttactccatcctcgtttaggcatatatacacaataataaatcatgcacaagcattttagatctgtgcttctagagttttggatctggctcccattaaccaaagcaatttatcaactcgaattcttttgtcgtttttcttgatactaacatataaatacattttatttataaactacagttcagacatatggatcgaagatccacagtactactccagtactccatacaagctaatacacagtattagaagtaatcaattcttatggtccttggtaggtatagtattattaaataagtgatgcgattagatcaatgcatgacttttagctggtcgtctatttatggatgctacctaaacataaatttaatcacatgtcatttattatttattattactcctaaattgttctgtccattaaatattttataagttgttacttgctactcctatcaaccattaatggtaatctttgacgcagattctatgagctatactattgcattgttttccatcatatattatcaatcacaagtaactcttcacaaaaaatggcggtcaataaagtgacacttacaaaactcaatggtttaaataaaaactacaacattgctgaaaaatatacataaattttaaacacgaaattggttaacaaaacaaaattggcggtcatctcatgtttttttttatatcatagtaaatctcgaaatgtgctttgattaaagatcagaccatcgaatggtgcactagcattctcatataatttgacatataaaatagtataagtaacaatatactaatatagtagtagtatattaatcatttgcataaatataaaacaagaattggtccaatgacccatcgatggcatcaatgccttgttcttggatgaaacgtggcatatacagtacggtgtcggattaagacatgataccataattagatatcgtatttttcgaaaacgtcaatatgttgttagttgattttatgagaggcaggtttttccaataagataatctttcttttatttaatcagaatccaactcattgactttgcaattgctgataatttattcacgatagaagagtattgatctgaagcaattacatagtgataaatctagtagtcattctaaattattaagatataaaatcaccaaactggaaattgcttcttctttttcttgttaacatcaaattggaaatagctataagagaagagtatagctaggaggacccatcacccatccatgatcaggctttaaatataatttcgatcccttcatgctgatggaccacactcttcccatggttttggataatattctagttatagtccatatcacattttacaccaaaaaacaattcttaagatttcaaaaaccattttacatttgagcccatgattattatatgtaaacaaaggttcagaatcatgcaagttaagatcaagtaatatcaccaagctctacgtttattcaacacaacattggaccttaagaaatctttatgatcttgtaaggtgaattatggattcatactaattaactaaaagagagtttgtatacgcgctaagttatcaaatttagagaacacaaacaacaaatgaacaaacacatttgtttggaaatctctaggcccaaaccaaacccattgaaagcccataagctcaacatcactgatctatttcttagtattgggctaatatagtcatatgtcaccaaagtccaaacaaagaaaaatcttcaagccgacaacccgatttccataaccggatagaccggattgtgggtaaggagtttatgcgggttgacccgatttcacaagcgtatctgtcttgtttaatttcgttactcgtcgtcgtcccttaactcgagaaaaattagggttacggattccgattagcaagcatg

SEQ ID NO: 16852 - DNA, 3003 bp, Unknown; identical to SEQ ID NO: 16851
  misc_feature (1)..( 3003): 2750-1469P.txt file - cDNA_ID_1711228; gDNA_ID_2214487; Annot_ID_183550

SEQ ID NO: 16853 - DNA, 3003 bp, Unknown
  misc_feature (1)..( 3003): 2750-1469P.txt file - cDNA_ID_1711638; gDNA_ID_2936569; Annot_ID_194718
tattttctcacgtagtagagatttgtgttttgtttactaatctagtcaaaacacattaattttgactaataaactaacttcaataattccaccaccactagacttttacgctccttttatatgatatgctcgaatttcaagtctcgtgaacttttacgatttcaagaaagatttgtatacaaaaatgggcttcatctagaaagaaagagttgggtaatggtattactcaaatcagagaatattacacgactacacgtaatcttgaaaatgacatgtgaattgattccttggaatgacgacatgttatgttaatatgtaccattcgatcagatttttcttcttctttcactttttcgttttctcaatcataaaaacgattaatgcaatcattaaaaatatactggcatgttaactaacaaagaaatgaatgcttagcccgttcgagaaaaagaatgatcctaaaagacaccaatacaaaattaggcatggttggtcacaagaattgttgttggatatcacatatccatccatattagtaaaaaccaatctatacatctgtggtttttttaaagaattgacaagtttttgtttctgttttttggtaatgaaatcgaacaaattcaaagaattgtgaagttaataactcccaaaacacttactgcttctgtacatgttcatccttctggatgtccccatgagaagtattgttcatgttggccgtatcttgattaagcagattagagaatccatttccaatcgatttccaccagctcgaccgctctgaggtagtttgatcccactggtcattactggtgcttgaggacagttcgatagatgtggctgactcggtctgcagctcagagaatctcacagctcctagtagcttttctggaagctctgcttcggtctgactctcaatgaggaacgcaagatcaactgtcaatgtagtaacgtagccaaatgcgagatgaacaatggcactagcgaccattgaagaaccaatatcgacatcaatctccacaaagttttcccctgaaacatatttgcaagagagtgcacgtccaatcacacagatcgcttgctctccaacagcttttctaacaatccaagggcctttgacaatgtttgcaatcagtttaagcctcgatttcttgaacccatcatctcctttcaaaaaccgatccatcagggagccttcaaggataggctctgtggtaacaaagtaagccacagcactgtaattgtctttgtgaggaagctggagattgaatgcccagacaaaaggcttagttccatctttttgaaactcctcatcgataactttcctgattcggctgcttggataactcaggatctcagaaagctttttaggacctttaatccaatcaaaacccagaggctttagaaggaaatcaccagcaggtatcttaactttgtcagagaaatactttggtcctctaaccataaatgtgtcaggagatggcgtcgtccaaccatttttgcagttgtcgtctggcttaagacatggaacagctccctctaatttcactctcttaatccattctggctcagtttcctcaccaacagagccagccatatcttgcgaaaacctgcaacacagagcttaaatccttgagtaaaactgagtgtggaaaacaatctcatggattctacttagtgaatatagcaaacaagaatatgccatcaagaagaccaaaacatgtgatcagaaaacagaaccatgtatgtctgaggctctatctattcctcatctaatttcccataggattcatactatgccacaagaactttttaaaagaaaagagtgaaacaaaaattgctcaaagaaacaaaaactaggagctggtaactccggttcaagtcatagctacaccggaaactagaataaagttagtaaattgactcaaattctgagtaatgacatcaaaattcagcatacacgattctgagattttctacaaacctaagccctagattatctgaaataacatgcataccattcaatagacaaagcacagagacagagcccagataattgaattttacattcatctacaacacataagaagaaacggaaaaaaaaacgtttttttttatcaacagagcaatcaaaacccagaaacgattaacaagtttcagaggttcaagaggaatcagctacaataataaaaaggaaaaaatcaaagttgagagatacaaataacaaaagactaattcaatcgcaggacaaggagcaaacaataaaccttttgcagccgaagaagagaagaattgtccaaaaaccctaattcaaaaacgaagacttgtcaagggaaaagaaacaaagaagataatccgattttgctaatcttcttttgttgtttggatttagcgttgaaacggatgctgcgaacagatcctaaattcttccgtggcgtaacgctttagttcatatctaattaattaaacttccaactggaaataaggtccaagtccaactagtaattattattaatagaattcaaaataaaaataatattattagtttggatttaacaaaaatttatgattattatgacaaaaaaaatatatgattatttactatgaatattataaaataaaactatataccatatgattttttccctaatcaagtatgagattatataattcaaactataagatttttttcccttaatttttacacctaatcaagtaaaaaggaaaaaaattagaaaaagaaaaagaaaagtaatgttagtttttactttttcctatttttttttgtcaaaaatcgtcaaaataaccaaaaaacattaaaaaaaaatccaaattaaaataaataaaagaacttttgttttgggctttccacatcgtaaactataatcggcgtctctccggactcacacctcatcgaaatttggccatctcatctggcttcttcccctccggcgttggataaccatcattacttctcgcgccggcttcgagtggaacaatatg

SEQ ID NO: 16854 - DNA, 403 bp, Unknown; identical to SEQ ID NO: 620
  misc_feature (1)..( 403): 2750-1469P.txt file - cDNA_ID_1711751; gDNA_ID_1592442; Annot_ID_152473

SEQ ID NO: 16855 - DNA, 3000 bp, Unknown; identical to SEQ ID NO: 1944
  misc_feature (1)..( 3000): 2750-1469P.txt file - cDNA_ID_1712019; gDNA_ID_1620472; Annot_ID_158034

SEQ ID NO: 16856 - DNA, 3003 bp, Unknown
  misc_feature (1)..( 3003): 2750-1469P.txt file - cDNA_ID_1712051; gDNA_ID_1620362; Annot_ID_154679
cagtcaacggacaaaacgttgactatttttattgacgccgtggtggatctctgtctttaaccggtatttaaccgcgaaccaggttggtaggccgggttgggttttaagagaattcatgcacttacgaaatttattaatttacctagttaaataaactaaatttggatgtcttttgaatgaaacataatcccaacatatggcagataatgaattcatgaatctttgaatgaaacataattccaatatgtatatgtatgtatgtctatataaatgtacacccaagaccaccacaaatcattctcaataagtattaaaatattacaaatacaaaaggtaagttaaattacaaatatttagaatatgctcctcttatactagattttcgtttttgttttaacaataactttgaaactcgattttagtaggttttgctttttcctgagacttaaatactatagtttgagaaggagttatagaatcctctacaaaaataacaaatgacaaccaaaatggtttcatctcatcgactactcacgttgatggtgtttgctctcctcctcatacctatgatttctggtaacatgtttatttgttatatatattatattttttttcaatatttgttcattttttatcttaaaaataaaactctaaaatattaaattggacatttttgcttttaaattttttgttgatgaatttgtttatgaaccgaataggacaatcatcaaaatgtacaaaaggatgtacgagcacaccagaatgcaatataaaatgcatgaagaaaggcggagggcattgtcaagcatatataggcagaagtcacggccgattggctattgaaaattattgttgctgcaataattattcaaattctcccatctccagtccggtcatgaattgattgatctcttattctatatgtactctcgattataagaatcaaaaacgtatgttcaaataataataactgatattatctcatccccccccctctcatcatgttgtttgatgtacatgtataagaaaactacatcgatcggctcgacttatagttttgtttattgtgtcatcaggacatcgattttgtcttacctctctaatcttcgcaaccaaaaaaactacttctttcaatgttcacttccaaagatgattttgtaaatacgaaaacttatgcatgaaactgtaaatacaaaatcaatcgccaagcataatataagatcatgtatttactctttttatatcaaggtacatatatatttctgagattcctacgttttcatggaatatagaaataaattgactatatatatatacaataagataatattttggggtgttttctttatatgtagagaggatgtgcgagtgggggggagggaagaaggaagagttccttcgacggcggaggagttcacaagacaaggtgttgctagccagacaatgatgataagagattgtagaaggtttatgacggagctgcagcggctgcaaacgtctctggtgattctgagatggaggtggagaaagtaaaccgaacttgtttaaaggaaacgaatatctagtttgttttgcacaagtacaaacgtcccatgtctttgaatcaaaattactgctagaaagaaaaaaaaaaaaatcgacaacatctccaaagttttatttcaaggacccgaaacgacaatgcctaacttccatggattggtggacaaggctaacgaaagaagaaaatattgattagtggagaaattggttgtcgttcccaaaaaaagttagtaactcttacgatatgagaagaaaattagtacctcttacattttttttaacaaagataaatgttgtgattagttctgtttgaaaggactaaacccttacatgaaaagtttaacatgttctacatagtttggatttgtcacttaaaataatattggtgcttaaactcttacttttgtgataatatttttctcgagattgtagtaaaagatgaagaaaggatatcttgtgtaatctggatacaacacaatctggatatcttattgtcaatctctatgtattgtgagaagttgatactaacaagatgatttgtgcaagtagatacaaatcttgcatgtgtaagttgatactcgacgataccttgaaactgattgactgtttgttgatcggatcataaccaaaaatttggataggcaacaacactgaactatagactttaccggctatctcgacaaaatgatcatcatgacgagatcaacatggatcataatcaaagtatacgtcgtcgtaccgttcaactgccaccgtatcctggagcttagcttcgagggtcgaaataaagtgctctatttctgtcttcttgagcttttaactcttccaattaccgaacaatttccgacgaatctccgacgtccgactccatcacgacaatgtttaaagagccaatagtagaaccctagaggttaaagcagcaaagaagacgatgtcagtcaacgggacaaaacgtacgttgactatttttattgtcattaaccggatttaaccgcgaaccagattggtagaccggttgggtttttaagagaattcatgaacttacgaatttatttatttacctattaaaataaactaaatttgaatgaaatataatcccaatgacagataagaataaataatgaaacattttgactaaaattattatctgacccaaataagactataaaaaagaagaaaaaatccttgaataatatggaagatttattatttacatatatatatatatatgtatatacgtatgtctatataaatgtacatccaagaccaccacaaatcattctcaataagtactgaaatattacaaatacaaaaggtaagtcaaaaataatataaaatatttagaatatgttactagatttttgtttttgttataacaataactttgaaattcgcttttaataggttttgagaagcaggtatagaatcatcttgaaagaataacaaataacaaccaaaatg

SEQ ID NO: 16857 - DNA, 3003 bp, Unknown
  misc_feature (1)..( 3003): 2750-1469P.txt file - cDNA_ID_1712122; gDNA_ID_1620526; Annot_ID_159579
cacttttgacttcacattcacaaagctatggatctttgcaaaagtagagcaacaaccaccattactctctcatgtctcatcttctttgtttcttcattctacacaatctccaccgctaaatctgtcacgaatccgctctatcaactccttctgttcatcggcttcttcctcgctgcagccttgtcgcttgttttactggtggcagcagcacgagccaccatggttgcgtggataacggtcctcgtcttactggccttttcgggtacacgtcgccgtgttttagcgcggagggggaagacgatcacggcggacgtggcgatgagcttgttcagggttctgattagagaagcaaatcctcgtggttagtctcatgaagattgtttgttgttagagagtatttacatatcacttttgtatataacaaaaatatatgtatttttgtgaatgatttttccccttttgtgtatttatttattcgaattttaattttaatatatacataatgtatgtgtgctttaaatgtttattcaatacttctatagttacaattttctatagaattaatctttagatgttaaaaaaatgttttaatctttctaatacgaaaaatatttattgagttatttcatatcataatcggggattctgatcgcaattttgatattaaaaatggttaaggaaataaaaccaaaaatgatcttaatttcctgccactgcatatttcactataaataaatgggatcagaaagtttacagttttcttctctactatactacaaaattagtttagctttctaaaataaaataaggaagaaaaccttaagtaaaaccaattacatgtctaaaatatacttacaaaagatcctcaattataaattttaaaaaggttgttgtaatatctcatatccatttagatgacgtcacatacaatttgctacctcttgtcactcatttaaacatacaatacgttgtactacgttgcgacactttcactagactggtgagatatttagaacaaatacgtcagcccgataagaaatatgttttatattcttttacacaaatctaagaatggatttgttaacttgagatatcttatggtttttgtttatgatttatatcataaacacgcttaagttacatcttcacgaagatacaaatctgaacaatgtagatgatgatatgatgcctcttttctcacgtcatggattgattctgcgattaaacgtaaggtacaacatcttcatgtttgttgtccttcagatggtatttgtaatatccccatgtttttctagctgcaagactcgggtatccttaaatctcgttgatgtgaccatggatgatgccgagttcgtttctttaccttatgctgttatgcatttgtaacgtatttggtctcccagtgaggccacctttgcaagacttgtctcttgctatcctgtattggaagagttaaatattgttgaatgttggaatcttccggaagtcattccggctgaatttttttgtcactgatcaagagactcaaaataaagctatgcgattctacggttgtacaagtacatataaagataaatatggagttgtgactgatgctcctcttttacgcgatttgtttattgatgatgaccaagctggaagttatttaataaacaatttgagttccactgccaagttaaatgtttatctcgcctttggtttggacagttttgatgaagcaacaagggtttcatcgaggagaagtagcatccacaattttctgctcgggatttcaaatgtcggggaaatgatcatatatctaaacactttaaagctatatatgtcatgtcaattccagtataagacatgtacgttctctatcatgattcatgaaagtttatgacctacattacttttctttttggttcgagatcatctatcaatactcaaaattagaaccgcttcctcggtttggttacatgtcccacatgtatgctgatatttatgtacctaattggaaatggttaaaaacatttcttgggagttgcccaaacttgaaaatccctcatcttggtaatgatctgctaaactctagctagtgtgaatcaactagtgttcatgtgttgttgtagcaaagcttctctgatgatgaaatgcaaagaagaagctacagaactaaagaagaacaatggaagcattataggtgtgtatagtactaatgaatctctttgcttttgaccacaaagcaacctacttggttcatgttacacaatcaaatttggttccaaatgtcacatataaataataattaagcataaaaattccctatttatagccaatatttgcttctgaatattactcaaattaaacctaaaactcagaagaatgttttgagaaacaaaagcaagaaattttgaaccatgtgatatgtttcaccaatcaatcatataaacttcttctggtttatctttttattatcctatcattaccactccatactcataactctctctgtctctctatctccctctccacatcaagaagaagtctctgctagttccaaaacagaacaagtgaatccctcaagtttcttattacaaaacccaaaaaccaaagtgaaccagtgttgttgtttgtactcacagatccattctccactgattcatttcttgctctgcttcttctctcttagttttgttaagaatcttctcttatccattgtgttttttctattttataaatacatatataattttagttgggggagagcttgcctggtgtcgccttcttctctctctaagacttgtgcttaatttacggacatgtgaagatacttcgcttttgcctcatcgaagggcatgttagctatttacttatctcttctcttctcttctttgtcttgtgagctctcaaatcttcatagatacaaatcaagaaagtgatcaaacaaaaaaaggacaagtctttttggtatttcagatcgagaaaaaatgtggttgcaaggtttgaagtaatcttgcaatg

SEQ ID NO: 16858 - DNA, 288 bp, Unknown; identical to SEQ ID NO: 84
  misc_feature (1)..( 288): 2750-1469P.txt file - cDNA_ID_1714593; gDNA_ID_2353; Annot_ID_145664

SEQ ID NO: 16859 - DNA, 3000 bp, Unknown; identical to SEQ ID NO: 4421
  misc_feature (1)..( 3000): 2750-1469P.txt file - cDNA_ID_1715104; gDNA_ID_1620705; Annot_ID_48855

SEQ ID NO: 16860 - DNA, 3000 bp, Unknown; identical to SEQ ID NO: 4421
  misc_feature (1)..( 3000): 2750-1469P.txt file - cDNA_ID_1715104; gDNA_ID_1620705; Annot_ID_165237

SEQ ID NO: 16861 - DNA, 3000 bp, Unknown; identical to SEQ ID NO: 4421
  misc_feature (1)..( 3000): 2750-1469P.txt file - cDNA_ID_1715104; gDNA_ID_2926196; Annot_ID_141266

SEQ ID NO: 16862 - DNA, 3000 bp, Unknown; identical to SEQ ID NO: 4421
  misc_feature (1)..( 3000): 2750-1469P.txt file - cDNA_ID_1715104; gDNA_ID_2926196; Annot_ID_201446

SEQ ID NO: 16863 - DNA, 3000 bp, Unknown; identical to SEQ ID NO: 7153
  misc_feature (1)..( 3000): 2750-1469P.txt file - cDNA_ID_1715200; gDNA_ID_1621129; Annot_ID_172422

SEQ ID NO: 16864 - DNA, 3000 bp, Unknown; identical to SEQ ID NO: 960
  misc_feature (1)..( 3000): 2750-1469P.txt file - cDNA_ID_1715364; gDNA_ID_1620342; Annot_ID_153999

SEQ ID NO: 16865 - DNA, 3003 bp, Unknown
  misc_feature (1)..( 3003): 2750-1469P.txt file - cDNA_ID_1715608; gDNA_ID_2213642; Annot_ID_132285
actaagaatgtgactgaacaagtaagactacttgcaatggatgaagacgagaacctcactgagccatacgatataattcctccatatgatcaagcaaaagcccttggcaagacaaacattgacagtgatcggattgcttctggattaccatgtggtagtgaaggattccttctgatgtttgctcggtggataaaacttgctagggatctctacaatgaaagaaaagagtaagtttatcatcggatttggattttagcgatgcttctcaaaattttcatctctttgtttccagtaaagttttgtgagtagcactgatagttaattttaattgcagccgatttgacatcacacagattccggatgtttacgattcatgcaagtaagttgtttttagtgtatctctagatttacacctagctttagttactcgtttttgaataagccgtaatatgttattctcaccaggtacgacctgttacataattcccatctcgatctaaaaggattagatgaactcttcaaagtagcacaggtaaacaaactgaaattcctccttccctttcctgaaactttaatcatagtttgcactgaaacaatgaactttcttgttacatctctaaaatgtatggttgactgtgctcgcttatagctaagttatgtgttatgtggttgcagttacttgcagatggtgtaatcccaaatgagtatggcatcaatccgcaacaaaagcttaaaatcggttcaaaggtgacaatctaagataagagtagttattttcctctctaacaattgtttttccaggggatctcacaacttatcatttctataatttttttccaataaaacaaaagattgctcggcgcttaatggggaaaatcttgatagacttgaggaatactcgagaagaagcactgagcgttgccgagttgaaagaaagccaagaacaagtcttgtcattatccgcctcgcaaagggaagatagaaatagtcaaccgaagctatttatcaatagcgatgaattgagacgacctggcacaggtgataaagatgaagatgatgataaagaaaccaaataccgattagatccaaagtaatagtctttactttctctctcactcttatatagatagttatttcggctactaattggtggttttcatttcgcttttaggtatgcaaatgtgaagacacctgaacgtcatgtgaggactcgactttacttcacatctgtaagtttcctctttgctccattgcttgtttaagtctgtctatgagtgaaactataatgtttatgcctggtatgatttggaacaggaatcgcatattcattcgctcatgaacgtccttcgatactgtaaccttgatgaatctctcctaggagaagaaagcctcatttgccaaaacgccttagaacgtctctgtaaaaccaaggaactcgattacatgagttacattgtcctaaggctctttgagaacaccgaggtttaacattacattccctttgactctcacacatgcttcaatatatgtatatgctctctcagtgtctgactctagacgtaaaaaacggatgcaggtatcacttgaagacccgaaaagattccgcattgaacttacatttagccgtggagctgatttgtctcccttaagggtaagagcaaaggatgtctttaactaattagaggaacatattataaacttttggtaatattgaaacatgatgcagaataatgacgacgaggcagagacattgctaagggaacacacacttccgataatgggaccagagaggcttcaagaagtaggttcttgtttaagcttggagacaatggagaaaatggttcgtccatttgctatgccggcggaagatttccctccggcgtccactccggttggtttctcgggttacttctcaaaaagtgctgcggtgctggagcgactcgtaaacctcttccacaactataagaactcttcttctaatggaaggagctaagcagagaccaattgttttttccacttatatatattttgctcatgcttttttctatgtgcagtttttaatcatcttcttgtttttctactgatgttttaattttctatgtgaaattgtgaaagggactagtgcagttgggtttgaataaagatatgattacatggaacataaatgagtcacccgtgacgttgtctagtgtttacaataggactcatctattataactcaagaaatgatgatgagtcttattgtaaacactgtgttttcatatcatgctgttacgttaaagttgttgcggatttgttggaatttatatataatctgcaaaagaataggctgatgatatcggataaacaaataccgaatctaaaacaatctaataatcggtggatttttcgttttgggaaaatctcaagacattaaattgataattgaaatacaaattattattattagtaagaatagtactaattgattggaaattgtaataaacgacttaatatacaaactgaaaaataacaaatgatcatgaaaaacattttaaaaaatgaccaaatgaaggagatacatagatagttttatcaaattttaaaaaatgttggtaatgcaattagggaacatttgtccgtgaaggaattaattagtctctgtttaaaaaactacgaaaaatgcgttttgtaactgttgttgagaagagaagagagagttagcaaacaaacacatatatatttacattattattgcccaacaaatctctctctcttgcccgcttcgtgcccgtctcttctctcttcttcgtattctctctccacagacatgaattccctttttgactaacctcctttttcccctaataagtgaatcttacttcttcttctcgccaagatcaaatttctgggattcttcttcttctctctaattcccttgcgtttgtttcctctgatcaagttccgtcctttttcctttttttgttcttgagttctcgtttgagctgctttttgggggagatg

SEQ ID NO: 16866 - DNA, 3003 bp, Unknown; identical to SEQ ID NO: 16865
  misc_feature (1)..( 3003): 2750-1469P.txt file - cDNA_ID_1715608; gDNA_ID_2213642; Annot_ID_181286

SEQ ID NO: 16867 - DNA, 3003 bp, Unknown; identical to SEQ ID NO: 16865
  misc_feature (1)..( 3003): 2750-1469P.txt file - cDNA_ID_1715608; gDNA_ID_1972053; Annot_ID_178371

SEQ ID NO: 16868 - DNA, 3003 bp, Unknown
  misc_feature (1)..( 3003): 2750-1469P.txt file - cDNA_ID_1715684; gDNA_ID_1620806; Annot_ID_168861
aattagataaggccaaagatctcatcaatcacgagcatctctgatacgattgatgtatcaagaagaatgtgaatgagagaaagcaaaagaagacacgtgcaagtgaggaggcacgtgagaagaaacttgcttgaagaagaagatatttttaggatctaaaaatatcttgaacaaactcagttcgagtataaataatggctctgaatgtttagagaggtttatgttgtttgttgttgaatggtatgagagacttaagagcagagctagtgatgtgctagtctctctcgtatggtgtattgagagctgagctagtgatgtgctagtctctctcgtgtttggtgtgttagtgagtactggtttggttaaggaataaaggtatcgatattgaaaacttaacaatctcgaaacacttgtaaattgaagaaacctctcaaagtctacaaaaatgctactgagagtgaaatcaatatcagaagaaacaacaaccattttccactgattaaaagataagtttttaatataccttttgaacagacaagactgatctatcgtgctcttcattttcaaggtgagattttgtagaaaacgaaaggcataacacgttagaaacagatcgatcatatccaattaaaattgcaagattcttagataaatggtacaagaaatctaaaagaaacctgcactcgctagacatctagattcagatgcaaaacaaagcgcaaaagtaagagcaaacgtagttatcggaggatccaagtctcttcaagatgataggaaaaatgcaacgcaactcacaatagctgcaaaatggacgagatgcactattattgagcaccacctcatatgatttttcccaagggtttattgtgcttcttggcatgagcaatgaaagggctccgaccacacactctatatgcaaactagcctggtagtctttacacgtgtagaaccatatctctggattggtttctttttcacaaatatcacaccaatatttaccactagccttttcgccatagcatagtgagagaggatggtcgtcaactctatgctttaccacttgtggaaaagttgcgcatttgaagcatatggcaaatctgcaatcatcttcaatgcatcctagcacatcatagaaaccatttttgcagccattgcaaatcttaatccctccatctggtaaagtgtgatataagggatgatcgggatgactcggatgaagaaatggctcagcaattgaaccgcaccgaacatcgaatgtgatgtttccttgatggtatctgaaaccattggaccatctatcacaagcataacacctaaagggttcagcttcgtttataacaagagtaagacgttcattgtgtagcacatgccatttcattctacgaaatccagcgcagttttggtggagaatgaagtcacaatccatacagccgtaaaaggactggagacagatgggatgggtgcatgcactgcaccacttgttgtcgtcacaaagaacaccattaacatggagtcgtaggtaatgctctttgtggctgaaatgttgtattgtgttttcatctattaccacatatggttgtatatcttctgtttcttcgggtactccttcaagctctttcccattccacacatcttttctagtagcacatttagaatgaacgacatagccatgacacctctgacaagaaaagcctccacaagtccaatccaccttctggtgacaaactccacatacagacttgacaacaccaagaacagatgttcgagaaacacggtgatcatgccgattaatgtttataacgcgtggaaggtcaagacagtcttgatgaatcataaaaccacattgaaaacatacataagggcttcgatctcccttcagcccacaagcattacatgtgaaagaatcgagccttgggagaagggtgagttggtggtcatgagctttcaaattcagaagagattgttgtggtggatttaaaacacatcgcatatccaaggtgaagttacacgaagaacagtgataaaacaatctatcaccaatatatcttccgcaaagacgacattttctgtcagaatagtccggtaatttacctcttacgagcttaagagggtgtaaggagtggtaaaaatggtttacctctaacgggagatttgactctgatgggcgccatgcgcaatcaacatggaatgctaaatcacattcttgacatttgtaagaaaactcataagaaagtttcccacatttatccccacagtcgatataattcggcttcttgtaaaggttgagcttgtggtgatgcgtctcggaaatgtcaataacttgtggtggtggatacttggcacaatacatatgcacgttgaagttacagatctcacaattatagaatagactcttgatagagatgccacataagttacagttacgtgtatgacctggtttacgtagaagctgaagagcgtgacttgggtgagatggatgctcgatatattcggaggacctatcgccacagctcttgtggacgaaaaaatcgcaggttttgcaatagtagccatcactgatagcttcaaaacgtctacaacaatcacctttcctcatatcattccaaggcaacatatgatgcttgtggatcaacggcagtgacactccctcagaatccatggtcaaaaattggatctgaaatctcaaaactcaaaaatcttctctcggtaatctcaacgatcgatgctcttataaaattaatcggaataaatataaatggaagaagaggtctctcgtcactaatgagaggaaaaggccattgggctagaggttaaccaagcccaaaccgaaacataatctaaacaaacctaagttcagttatctataatatcggtttagtttagattatgtttcggtttgagcaatttcatttcggttagagtcagtttaattcggtttgtttttcaaaaccatttcttcaaacaattccttcaatttttttgtatggataaaattggaaaatg

SEQ ID NO: 16869 - DNA, 3003 bp, Unknown; identical to SEQ ID NO: 16868
  misc_feature (1)..( 3003): 2750-1469P.txt file - cDNA_ID_1715684; gDNA_ID_2926172; Annot_ID_199575

SEQ ID NO: 16870 - DNA, 3000 bp, Unknown
  misc_feature (1)..( 3000): 2750-1469P.txt file - cDNA_ID_1715780; gDNA_ID_2926226; Annot_ID_203488
gccagattggttccaatgggaaataaacagattgagggagaagattatggagagactttctctcctgtggtaaagatgggaacagtgagattgtttcttgacattgctgttaaaaaagggtggattatacatcaaatggacgtccacaatgccttcttacatggtgatttagaagaagaggtatatatgaagttgcctcctggttttgagtctgttgataagaataaagtttgccgattgcgcaaatctctgtatggccttaagcaggcacctcgatgctggtttgcaaagctctcttcagctcttcttgagtatgggtttcagcaattacgcagtgactactcattattcacttatgcacaaggtactactcgtctaaatattctggtttatgttgacgatttagttatcgctggaagtagcctgaaagctacagaatcatttaaagcctatctctcttcatgcttccatatgaaagatctaggagaacttaaatattttctgggaatagaggtggctagaaatgcatctggcatatatctttgtcagagaaaatatgcactagacatcattactgaaacagatcaactaggagcaaagccagcacactttcctttggaagcaaatcacaagctagcactctccgagtctgttctattacatgatccgaaaccatatcgtcgtttgttaggacgtcttatttacttgggagttacacgtcctgatctcgcgttctcggttcatgttcttgctcaatttatgcagaatccacgattggatcattggctcgcaactttacgactcgtacggtatttaaaatctgatccaggacaaggtatcttgttgcgagccgatgggaattttcaagtcactggctggtgtaatgcagactgggacaactgcccgataacacgttgctcagtcacaggctatttgtgcagctaggagactctccgatcagttggaaaacgaaaaagcagaaaacggttagtctttcatcagctgaagcagaatatcgggcacttgctaaacttgttcaagagcttatttggatcaagatgatgcttaaaactcttggggttgttcatacttaaccaatgttagtgcaatgtgatagtaaatctgcaatctacatcgccacaaatccggtcttctacgaacatacgaaacatatcgagattgatctacattttgtcagagacgaagttctaaaacgagagattcagctttgtcatgtggattctttttcacagcttgcagacatcttaacaaaacctattgggaaagatggttttcgttacttcaagtccaagctgggaacactaaatctgtattctccagcttgagggagggtattggcgaatggtttatgccggttcggcttggttcacacttggtttatctctctgagaatatactctattagatgctgataattgtatagttacggatagcttttagatcttctcaactataggaattttcctagattcacgacgtctgttgtatagtcgatctatatatgttgtatgcttctcttgatgatcaataacacatatacattgtcgaactctgtattcctttaaacatattaaaaaaaataagaaagaaaaaaaacattcaaatgcaaatcgaaagagtgttaaaaatcaaatttctcatacttcataaatatataaattttgatttttctcatgtgtgaattcccatattcaaattaatgttatcatcttcatacatgacatgagatgataaggtagaatgagctacctcgcagctactcagatgatagaaggcattaaaacatgtacatattcatttgttacctaaagcaaatgaaaatatctgaaagcaccagagtgttttgcaccaatctgactgactcgataaatctatgttcaatgcatacaagaaaagttatttgaaagcactagactgatttatctgattaagttcaaagcatgtaatctataagacaatcttaagttacaataataaaagtttttgcctatatcaatataagatgttgatataaaatttcacattgacaaaaattttgagataatatttattccgggacagtatccaatatatacataacactgttgcactacctaaacattacaacaaagaagaaaaaccaaaatcaagggacaagaattcatagaattgcgcttcactactataccctagttacatatataaatctattcatagatgcaattatattattaaggaaagataatttggcaaagtagaacgttaaagcgacctaacaagatgagactgttacaggtcactttacaaattgttggcaatttctgactcatcttcttcatgacttgtccctctactcgctactccattaatgtgcaactatattttgtgtaatttaaactgtattcatgtatcgattattcatgacattttcaatagccaatcatcaatataaatttttaacaaacttcagattattggggttggtgattttgatattgctagtatttttgagctaaatactagcaaaaaaaacaatcgttttgtacatatccaattttttttctttttccaaaaactaaattacataggataaatttctctcaaaaatatcatagtgaatctttcgagcactataccaccatcatgtactccgatttcaattattttgacaatctatggaccggtttagatgcaaaccaataaagaaaagtttcgaatatagaatttccctaaacaaaatagactttaggagaatgtgagtggaaaaaaaaaaatagactttagatttggttttggttttggtttagattcggtttgttttctcggttacaatttttccccccgtccctaatttgatttgtgcgaagaaaaccaaacgtgctgaaacgttgtcgttcggatactatcagcgattgctaaaattgttaagaacgagaaaaaaccaaaacgacgtcgtttcttatatcgttgccagagagagtttgacggcggagagatatg

SEQ ID NO: 16871 - DNA, 3000 bp, Unknown; identical to SEQ ID NO: 16870
  misc_feature (1)..( 3000): 2750-1469P.txt file - cDNA_ID_1715780; gDNA_ID_2926275; Annot_ID_205304

SEQ ID NO: 16872 - DNA, 3000 bp, Unknown; identical to SEQ ID NO: 833
  misc_feature (1)..( 3000): 2750-1469P.txt file - cDNA_ID_1715938; gDNA_ID_1620327; Annot_ID_153517

SEQ ID NO: 16873 - DNA, 3003 bp, Unknown
  misc_feature (1)..( 3003): 2750-1469P.txt file - cDNA_ID_1806994; gDNA_ID_2214478; Annot_ID_133178
atccaccaatcaagcaagagcatcaaaacagcgtgagaagaaacaataaaacaagacaattattcgagatctattgattcaatggacgagaatgacgaatctaaggctgatctctaacggggaaggagaaagatcgtacctttgcctgagaattgaaaaaggtgggatggatcagattctgctactctgggattgtgttcttcgctctctggagttagaaatttctctttctctttaaacggctctcgttttagaaaataataattgtgttaaacgcctaaaacgtaacggaagtttctgaaaagccctaacatttagtatctttcaattacacccatttcatagaaaatgtagaaaacacacagttttattacatgcttgtcctgcggaccggtcctgacatatgaagttacatttgttgttgtaggtgtttcatcttgatatatgagattctcaagtggataaaatttgaaaccaaacaaggctttataccgaatttttttagataacaaaataaaaagtgaagagattatgtcgggtcagttgggtctatagtactcgagtattgccacataatagtttccatttcgtttgttgattttccaatcgcttggtcaaaactttagcatgttagttcattatccatagattctaggggttggtttgttttcatctaattaagaccgtaactcaaataaaatgatagttcactttgataatattttgtgaaattgtaataacctggattagtagaaatatcctggattagtagaaatataaacgagtaattgactatcacaataaagcttaacaagccgagtgagtaacaagtatgagcaagtaaagtatcatttcttgacatgtaattttcatttttcgtaactttctctacaacccaattattgaccgcaactaaaaataatattatgttgagacatacaacaagaacatatggaagagaaaaaaaaaaaaaaaaaaagtcgatatggatttcgttgacgacaaatccacattgtattatttggacaagagacatgacctttaccttctcctcacgcaaccggcatttgttgaagtctcccattgtccctcctttgggccctacctttaatgccaaactaacccattgtatttggtattctacataaaagttgtacactaatgtacgatacgattcaactacattaaccgtatgttaaattatatagtattcacttgttgataaataaattatgtttgaacacaacaaaacttagtttctatatccgctgctgttttgttatagtcgtcattcgtacgagtaattctttatgttccgcactaatcacgcttcttttgtaccacttagtatgtgattttctcattcgtggtctttgaattgtattagaggcaatttagtcttttgtgagattaggaggtgtgtacggaaaagtgtgtgagacaaatgaagttaatgtggaggagatctatagtgggacaaagcaattgaaagtcgctttagaagcaactaaatgccctcttgacttctccattctccttgcgatttacgcatttacctaattgcatcttttacttgtttagcttgttaagttcttctacaacattaccacttttgctctcttaagttattgcaacttgacaatttgttataccctttatcaaaaaaaatacctggcaacttgtttgagctcctgaattaatcacatctcttaaaagacgttttgcgagtataacatgagcttttctttttatagattcattcaccaatcaaatataaaaactataacacaattaaaatgccatgtagctaggtatattagcaagtcgtagaacagaaatggaaagacttgatgaaagcacgtcaattcaatttcatctcctataaataaattgttgtaggaagccaaccgttttggaatttcttttctttcgttttacgtaagactatatagattcaataacgtgttggtttagaaacccatacttataatggttgacaaaaagaagaaagaaaaaaatataaacatatacgctaaaagtgtttaccaaataacagggttatgtaatttattatctggattaggaaaagatgattggaccatgcgatggagtagaggaatctgcagggcatttgtcactttcatggaccccatgaaatcacatctcttttaattgaataatcgaaatccagttgcatacgcatctttgtctacgattggtcgtagcacatatacgacatatgccataactacaaactaacttaatcttctaataatattgttaacgatcgttaatactaaaaattactaatatattagtcgtgttatctatgtgttatgaggtgtgttaattgttgatgcataatgaatgaacatgatctctaatttgtttacctcacactatgtgattcaagggtggaagtcgttggttagcaaacattagtgtctcaggacaagatagctcaggacaagatgtccgagcggttcagaatcagtaatgtttttttccggagactctactcgttgagtttttgcttgtactccctggtgtttgtgttgtgatgtagttttgttgttttacttagtttttgatcttttatgtaatttgtatttcgctgtaacttcggtaaaaaacttgtgaaaatagtataagtacttaacattgatacaaaaaaaaaaaaaaaaaaaaaactcatgaggtcttgttatatatatggtgatcacatctttaaagaaaatgttatagtatttgttttagtttaaacaattttttatgtgccaaaaacattattaaaaagagagcaataccctactctaaaatagtaaagctaccaaattcaattcattacgacatggctcaaaagaaaaagtatttcgaatattatacgatatcaaccccattatcattgctataaaataagccaaactttacctctccattttcaataatctctcatcttctttcgtctctctttctacggttcaaacattaaaaagatagatg

SEQ ID NO: 16874 - DNA, 3003 bp, Unknown; identical to SEQ ID NO: 16873
  misc_feature (1)..( 3003): 2750-1469P.txt file - cDNA_ID_1806994; gDNA_ID_2214478; Annot_ID_183212

SEQ ID NO: 16875 - DNA, 3003 bp, Unknown
  misc_feature (1)..( 3003): 2750-1469P.txt file - cDNA_ID_1806998; gDNA_ID_1620698; Annot_ID_48720
tccaataattctatcagagattatcatataaattatactattacttattagtacaatgaaaattaagagtatttattatattcaacaactccttctttacgaattacgacccagtagaatttgtcaataattatattttttatatatatatttcacttatgaactttgagagttatcgtcattcaaagttataatttcatttggttttagtttcatatctctttcatgttaacttcttttgtctgcactaaaacatatatatattttttttattgtccgcgtggtctttgatatatatagtaatcattttcaaagccgtcaaatttttcacttttgattttgaatatagaggaacctgttgacccaaaaaaacagattatgaaggaacttaggaaatttcatacaagttgatcttaaaaattaagcaagaaaaaagaataaattaatgcagtcattccttaagcctacaatataaatgttcacactcccttgttctatctccaacacaacacaacacaacacaaaaaatccaacccaagaaccacagtgagatctttctcagaagacaaaaatgggaacagcgtcgtctaagtctaacatcaacctctcgcaggtcctcaacactgaggagccgtacagctccgtgatgctggccgtcgctgctctcttggccgttgtatgctacttatggattcaggggaagtccaagtccaaaaaggaacctccactgcctccgggaccttggccacttcctatcgtcggaaacctcccgttcctaaactctgacgtcctccacacgcaattccaagccctaaccctaaaatatggccctctcatgaagatccacctcggttccaaacttgcgatcgtcgtctcttcccctgacatggctcgcgaggttctcaaaacccacgacatcactttcgccaaccacgatctccctgaagtcggaaagatcaacacttacggtggtgaagacatcctctggtctccttacggtacccattggaggagacttcgtaagctctgcgtcatgaagatgttcactaccccaagtctcgaagcttcctactccactcgccgggaagaaacccgacaaaccattgtccacatgtcggaaatggctcgtgaaggatcaccagtcaacctcggagagcaaatatttctttccattttcaacgtcgtgacaagaatgatgtggggcgccactgttgaaggagacgagagaacgagcttaggaaacgagctcaaaaccctaatatctgatatctccgacatagaagggattcaaaactactcagatttctttccgttgttctcaagattcgatttccaaggattggttaagcagatgaaaggccatgtgaagaagcttgatctcttgttcgatagagttatggagagtcacgtcaaaatggtgggaaagaagagcgaagaagaagaagatttcttgcaatacttacttagagttaaagatgatgatgagaaagctcctctgtccatgactcatgtcaagtctctcctcatggatatggttcttggtggtgtcgacacatcggttaacgcatccgaattcgccatggcagagattgtgagcagaccggaagtgttaaacaagatccgactagaacttgaccaagttgttggcaaagacaacatcgttgaggaatcacatttacctaagcttccttacctacaagcggttatgaaagagactcttaggcttcaccctacgcttcctcttcttgttcctcacagaaacagcgaaacctcggtggttgcgggatacactgtgcctaaagactccaagattttcatcaacgtttgggcgattcatagagatcctaagaattgggatgaaccaaacgagttcaaacctgagaggtttttggagaattcgcttgatttcaatggaggtgattttaagtatttgccttttgggtcaggaaggaggatttgtgcggcgataaacatggctgagagacttgttctgttcaacattgcttcacttcttcactcttttgattggaaagctcctcaaggacagaagtttgaggttgaagagaagtttggtcttgttcttaagttgaagtctccacttgtggctattcctgttccaaggttgtccgatccaaaactctacacagcttaagtaagaaggatgttgaattgagttttcttgtttaaagtttacttttctttatctgtgtctggagttttgatgctttgtataaaagatgtgtcaagttacatttttgataacatttaatataacaaagttttacttacaataataacgcctaatagtcgatgccaaagctataaaactatattgtagttatatttttggcaagtcgattaaaattcttgggtcaacaaattacaaattagtatgaaggttacaaattaaaattgtaattatttaaattaattaatgtataattatatcacaaatacttcacgtcacactaaatgagtccttcttagcggcaaaatatgcgttattgggctaggcccatttataaacgacgccgtttacacagtctagaaactcaacatcgtcgtttctctcccggcgactttatcgccgtctttttcttctttaaactctctggctaatttcgttttgctttgagcttgtgagctacttctgattccggccatcacgcagcttcaggttagtttttgatttaaatcaaacaacagtacatgggttcagtgtgttgtgtctcgaatggaattggtttctgtgtttagattagggtttagggctctttcatctaaggaaacgaaacctaggttatacgaatctctttgttgggtctctctcaataccaataccaatcaacgaaaggattaattttgttcatcatcttcaacgtctaaggctataatttgtgttagttcaaattgattcagaataaagtttggatttttacttcacctagtcctgaatttgttgttctctgtgtagaaagtttctgtttttaaatcaaagaaatg

SEQ ID NO: 16876 - DNA, 3003 bp, Unknown; identical to SEQ ID NO: 16875
  misc_feature (1)..( 3003): 2750-1469P.txt file - cDNA_ID_1806998; gDNA_ID_1620698; Annot_ID_164956

SEQ ID NO: 16877 - DNA, 3003 bp, Unknown; identical to SEQ ID NO: 16875
  misc_feature (1)..( 3003): 2750-1469P.txt file - cDNA_ID_1806998; gDNA_ID_2926180; Annot_ID_140540

SEQ ID NO: 16878 - DNA, 3003 bp, Unknown; identical to SEQ ID NO: 16875
  misc_feature (1)..( 3003): 2750-1469P.txt file - cDNA_ID_1806998; gDNA_ID_2926180; Annot_ID_200206

SEQ ID NO: 16879 - DNA, 3000 bp, Unknown; identical to SEQ ID NO: 5730
  misc_feature (1)..( 3000): 2750-1469P.txt file - cDNA_ID_1807002; gDNA_ID_1620813; Annot_ID_50619

SEQ ID NO: 16880 - DNA, 3000 bp, Unknown; identical to SEQ ID NO: 5730
  misc_feature (1)..( 3000): 2750-1469P.txt file - cDNA_ID_1807002; gDNA_ID_1620813; Annot_ID_169139

SEQ ID NO: 16881 - DNA, 3003 bp, Unknown
  misc_feature (1)..( 3003): 2750-1469P.txt file - cDNA_ID_1807006; gDNA_ID_1620647; Annot_ID_47632
gtacacactgcagatttttgagaagaaaatgatacagagcttgagagaggtctaactataatctgtgtatatagggtttatatatatatctaagtcccctcctttttcctttgacaaggatgagactttccatcatatatatctcaagattatggcgtataagtcagagaacccattagagccaccagaaaacaacaatcactagtagcaagagggagaatcccatcgcctgcaacatcaccagattttcaatttttcatcattctctccaaaaacgtatacagtaatatgagatagagaaaaagagttattacagtgattgcggaagcagcaaggccggctctttctctaggatccttgcggtagtagttcccgaaatataaaagtgttgcatagtaccataagaaagggaacacaaaacccaagagaaagctgcaaaacaagaagatagcttgtaaatctaaactgaatatagagaagctgcgttgacttcaactcaaaaaaaacttaatactctctactcacgagaaccatccgattccacaaccaaagcatggaagaggcttgtcatacactccattttccacctcgtctacgtcttttacaagcgtatatcttcctttcccacacaccatagcatctatcatacaaagccaatgtgtattagcttatggaaaaggtgcaaaaatcaaagtgcaggagttccacacatgaacaaatcttttaaagagaaggcttgtggagaatagtggtagtagtacctttaactgcagagtaatatttagcaactggtctcacgagaccggcatgcttatcagctacggatttaaccagctctgcacttccatcaccacgctctttaacagctgcaaataacagataagatttaatccaaagaggactctacttggacatcatgagaaggtacagagttaacttaatgttatctcatctcaagaccatgcccccttgttcctaaaacaaaaatttatgatctttgactgttggtgaacaatcacttccagctagtcaacaacttagttgtgagatttagatgatcctctattctagtaacaagaactaacaaagcacatatcttttgaggactaatatgaatcgaaagagataaaaagggaggaagatgattactttctcccatacgttcttcagcagatgatgaaaatgctaagctcttgcttataagtttgtgtcgtgacccacaagatcttcaaattgcctgcaacaaaacattaacaatatgaatgaatttcagaaaggaaaacatagaaaacagagacgatttcagctaaaaccgtagcagcaatcaaaccaacaagaaattgaaatcagcgtaacagaagcatgaaaaagtctgaatcagattatcttctctatttggaaaaagaacatatatgagacaataggacttcaaattcatcggaagaatgaaatccacacgaaccggagactgctccgggaagtaaaaggaaaccgatggagatgaataacttaccagattataatttctagagcacaaattcgagaagagatttgatttcaagggcagagggaatataaatatcggatcaagaaatctggaagcgagagagtcgtcgtgcttcgtcttcttcttgtgctgcttgtttcaacttcgtcagcgtgataaatgcgtagagagcggaagatgcaagaaaaatgaaagtctattttttcttttgcctaaagcaagtttgtctcttttctagtactattttgcttaattaaatacttttaatgtcttaacaactatacgagtatttaattcttccactaatcttttgtccttttcatgatttatattatgtaatcaataatgatgtttttactcacataattttgtagtgaaattagctctaagaaattacaatttttctatttcttttttttttttggaaaaatgaatggacttttcttaaacaacactttttcaaaatgaaataaacattattttggtattatattttttatatatatttttttttgtaattcagaaagcttcgacactgttagatttagaccattctagatacgttaccagttaccacttaccagtagccacataacagtactagttcatatatagcataaatagttaccagattttgatgttttcaaattaaatatgcgactaaaactctaaaatcattcaaagttattattatttatgagtttagttttcttcttttcctttcgtacaagttagatatcatgtataattaaccaactgtccatcataatctcatatattctggatcaaatcgtccgtttaatatagttgaatatgtctctataattattttaaaatgttacttgtgttatttaagtaatacagaattatgtaatagataaaaaattgtttgaccaaaaaaaaaaagagattaaaaacaatgttaacttttcgtccaagtagacaccacataccaagttaccaacaacacttcacatttgatcattttagttgatctcttccatccatgtggtattaatctaaaatatccaatgattatgacatcttattttattttggcaacgatcgagtattaccattaattaaaatcaacatgctattaaataatccaaataggcaaaaacttcacaatcaaaagagaagaagaccattcgtcgaagaaaattactcacaagagtataaaactatatatatgatcagcctattcttaatgtgaacattgagaagtggggaggttaaaatgcaatgattttgatccaaagttattgttgacaaagacaattaaagaaggaaaattcaaaggagagatgagtcaaggacaagtcaacgaccatttcgtcttcgtcttcttctttatactcattagctacacgacgtcgacggttcgtcattcttcctctaagctttatctttctgatctctgaccttgtgtctctgtgcatgtgtgtttatctgctactgtgttttgtcggtttgatctccaaaaaccagacatg

SEQ ID NO: 16882 - DNA, 3003 bp, Unknown; identical to SEQ ID NO: 16881
  misc_feature (1)..( 3003): 2750-1469P.txt file - cDNA_ID_1807006; gDNA_ID_1620647; Annot_ID_163287

SEQ ID NO: 16883 - DNA, 3003 bp, Unknown; identical to SEQ ID NO: 16881
  misc_feature (1)..( 3003): 2750-1469P.txt file - cDNA_ID_1807006; gDNA_ID_2926188; Annot_ID_140893

SEQ ID NO: 16884 - DNA, 3003 bp, Unknown; identical to SEQ ID NO: 16881
  misc_feature (1)..( 3003): 2750-1469P.txt file - cDNA_ID_1807006; gDNA_ID_2926188; Annot_ID_200803

SEQ ID NO: 16885 - DNA, 3003 bp, Unknown
  misc_feature (1)..( 3003): 2750-1469P.txt file - cDNA_ID_1807018; gDNA_ID_2214517; Annot_ID_133972
ccaagaccgtcattgaccatgtccgtattgtgtataatgcaagctgcatgaattaagaaacaattttcagcaacgaggaaaaaaagacttgattttgttttcataaacttggaaacttacaatgatagctccaactggatcaatccaataatcaatgtaattggccaggattactgcaatgagtccaatgatgtttgtgatgacgtcgaagaaatgatcttgagcataagctttaacgatctcgttagtgaaggatctgcagtaaagaaccagaagcagtttgaccaatgtaacagaaagcatgatcccaactacccaactctcttgctcttttgttaggttgaactccttgtgctgtatgaaagagatttcgtgaataatgtatgactttcaaagctctagaccaaagctaggtgatcaagattcagacatacgctggataacattgtgcgaagagattccaagataatctgcaatccaagtgttgccatcactgatgcaaagactaggattccctgaaaggatttgaaccaaaaatcacatattgagaaatcggaaaaactttattgacttgtcgaaggtgttaatagttgcacagagatatcaatagcagaaaacaagcttgcttaggccgattcaataacataacatataatagaaatatactaatggaagacagatcatgtgcattagtctttaaaaggatgatacaaaccagtggttgcatgcgtttcttgccaatgggatactgatacgggttgggtgtctgcatggagaaggcggtaaaccagaggatgaagccagaaagaagatcaagaagagagtccaatgtagaggcaatgatagctaaagagccactagtgacagaagcatagactttagcagcaaaaagaagcatgtttgcaatgtttgatattctaatcgccaatgtctcgcttttagccaaattatcctgctcttcctatgtacacaaaacacaaagaaattcagaaaagtatcaatcaacaagaacaaatgcatcatggtttcaacaaatgtgacaagtagtagcctcatttaggctaacctttgacattccaggaacaaagccacgttctgcaagttcatccatttcagtaaagccctcaagcatctctacttgctgctggtaataatctgccacattgtcttccggacctgaaaacaccaagacacatagcttcacaaaatcatatttgatctcttcacaaaatcatatttgatcacaaaatcatatttgttgacattacttccacatccaaaagaaagattagagacaaaaatcaaggatcgggattaatgaactctagactaatcaataccaagattcaactaaatctcaacttcataacaagagtaaaaatatatctttgaagaatcaaaaatgctaaagatagcaaacaaaagaggccgaattcaaatgttatcagctgctgctaaagattgaaactgaagaagacgataagaaaatggaaatgcggagaggaggagcaaattgtttacccaaacaaccaagacagttgtgtagtttactcggagatttcttctccttgtgttccggtgaaacctggaaatcatcgaaatttaactgccaggaacggtcaccgttaccgtgaaactcgagcagcgagatcccttcgtcggaatctggactagctggctcaaccatttttccggcggcggagagagactttgtatttttttttttttttttttgagagagagagagagtggtaaggaaatgggaaatttgaagagacggcgagggtaaaatcggtaattaagaaagattgaggctagctactacgactgttgtggtagtaagacattcctccacagagatacttggaccagcctttagaagagacgtctctgctaattatccacgtggcgttctctcaatggatttgggatctcgcacgtgattggaggagtcatcatacacacgtgtacagttgagattcaactgcaattaaacgaccccgtgacatgacatggttatgagtcacatatgtgccctctcaaactctattatgtagtataaaaactgtattagatacaaccgacccaagatatagaagaacctttgaaaaatggtagaagccagttcagctaaagctttcttcttcacaattatcgtaaaatattagacatgtagagcaggcttgttgttctcttattgtcaagcgtaagtaaatgattattgtttagtttcgtgaccaattggtttgttttttggttagccattgttcgatttgctttggtttggtcaaagattgtatgctttcaagtcaaaccaaagctgactaaattttattctgtaataatttactttggaatggcaaaaccaaagaaaggtcatagacacaagagaagaagcaaatatgtttcttacgccaaaagacacgtttgtatggtaagacaaaagacacgtttgtatgtttcttacgccaataccattacgttaaaaataaactagtaacttaaatttacgctcactttctatttgggttttacatgatgattttggtcaaaggcctatttacaatgttgcaagcccatattatcttttaagtatctttttgtgcaaccaaaagaatcagtgatcttatgctcattttcatttttttctaatgaaatttttcgtcacttatggcttatgcgtccgatggacgattatggtaaaaggcccatttattcaatccaaagcttactgggttagatgatgattgtggtaaaaaggcccattatagacccaactaagtatcttagggtttcagtttccactataaaacttgttgcggcgtaagttagggttttgagaatcagcggcttcacctctccaggttcgtgtctcgattttgcaaactatctctcgaaatcgtcctacatttctttcttcagattcattactgagcttcgctttctgggtttctatctaaaaatttcacagatttcgtgtgtgaagaatcatttcaagccatg

SEQ ID NO: 16886 - DNA, 3003 bp, Unknown; identical to SEQ ID NO: 16885
  misc_feature (1)..( 3003): 2750-1469P.txt file - cDNA_ID_1807018; gDNA_ID_2214517; Annot_ID_184476

SEQ ID NO: 16887 - DNA, 3003 bp, Unknown
  misc_feature (1)..( 3003): 2750-1469P.txt file - cDNA_ID_1807028; gDNA_ID_2214528; Annot_ID_134211
tatggctacaaatctcgactcagctttccatatttcacagcttgcgcaccctttgttgaaagcctctggctcagggagcattgtgctcatgtcctctattgccggagtcgtgcatgtcggtgttggatccatctatggagcaacaaaaggtactgtatatactctttaaaacaatatttctttacattatgatttatatgcaagtgtatataaaagcattttttttcaggagccatgaatcagttggctagaaacttagcttgcgaatgggcaagcgacaacataaggactaacgctatttgtccatggttaatcacaactcctttgattagtgatgtaaggacaatttccttagaacaacggcgaaaaaaaaataaaaaataacttttgattctaactttttaacttatttgaaaatccctcagcttctcagtgttgaggagatgaaaaaagaagcagaggaaaggacacccatggggcgtgtgggagaggcaaatgaagtctcaccgcttgtggcatttctttgtcttcctgcagcttcttatattactggtcaagtcatttgtgttgatggaggtctcactgttaatggcttctcctatcagccacatgcttgagctaggtctgtgttgtgtgtattgtccaatgaaaacagtaaaccaaacaataacatcggaaaatgaatgatttgaatatttaggttaagccttaaaactaaattcattttggtatgttgacatattgtaaaacgtaatgaacaagaaaccttaacagaagatgtttcttttaagagtacacgagccttgcagaaacagaacacaagttgaactcaaatgagaagatgggcttcgacactcatcaacttacaatgctcagttgatcaagcacaaagacagaatcatgcaatgatgactcaaaaggacagatggcttcactgttgaagattttgactatatgtcattttttgcttgggacacttcgatattttagtcatgttttctaacatacgactacatagtttctcaacatgccacgtacaaacaagacaacaaactcattaattcatacttatctggattctgatccacatttactgtatacataatttgtggcatttctggtcactgctagtaacaagcaagaaaaatggataaaagatggagtctacaaggaatgactgctcttgtaaccggtgcagccagcggtatcgggtttgtttttttctgttctctatatcatcttttgaatcattgttctgcttatgtttcaaggaatttaatctatgtctgtggaatgttttagttatgccatagtagaggagttagctggttttggagctagaatccatgtatgcgacatatccgaaactctgcttaatcaaagcttaagagaatgggaaaagaaagggtttcaagtgagtggttcagtctgtgatgtaacctctcgtcccgagagagaaaaactgatgcaaaccgtctcttcgcttttcgatggcaaactaaacattcttgtaagtaaatgatctttatatagaaacaactaagcatttcttttagcaaaattttctaaagagaaatcttctttttgttcaacataggtaaacaatgtgggcgtacttcgcgcaaagccaacaacagaatatgtggcagacgatttcacttttcatatctcaacaaacttggaagctgcttaccatttttgccaactttcacatcctctcttaaagacttcaggctatggaagcatcgtgttcctttcctctgtttctggggttgtgtcaataactgactgtggatcactttatggtctaacaaaaggtaaccacaattactacaaatctgactaatcaacaaagagtttttcacttccttattttttagtggtttgttgacttcttttgtaggagctctaaatcagctagctagaaatttggcatgtgaatgggcaaaagacggcataagagccaatgcggttgcacctaatgttgtcaagactgctcagtctcaattcgtaagaaataaattttaattttttttttacgttttggtgttgttgttgtgaatttaacaacctcaattcctcttattatctctaaatttttgtttcttaaaagtttcttcaagacgtcagtaaaaaggagggattgtttagtagaactccacttggtcggtctggagagccgaatgaagtagcatcactagtggtcttcttgtgtcttcctgcagcttcttatatcacaggtcaaaccatttgtattgatggaggcctcacggtttacggtttctcctctcaaccacaggcttgaaaatggtcttgtcgtttcttgtctgtttaaatattctctccctaataaaatctctcatcacgctatgagtttatgtcccttgtacaaaaacacacaatgtcaaattgttgctctttagtcttgtaagagaaatgagggacttatctatatgaaggatcaattaaactagtactattttatttgtttggttaaactatccttctctaattattgcaacttatgtgtctatatatggattaatgtcataagtactagatggaatcaaagataacactaaatagcgttagtcatagaatcatactcacaagaatgagtcctctaagttcaatggaccactccgaagtccatcatgagaacaagaccaatcaataaaaatgtccttttgttatctaaattagcaagtgtaccaaattttgttcaccattctaacttataatttcagttttcttttgtgagtgaagttattgaaaaagaaaaataagaaagtattggtcaaagattttgacaacaacaagttattttcttgaggaaccaccaacttagatattttagtcatgttctctgttataagtcctactgctactacataatgtttccaccacacataaaaaacaaactcaataattcacacttatctgatccacattcattgtatataatcttatggcatttctggtcatttagtctcaagcaaaatg

SEQ ID NO: 16888 - DNA, 3003 bp, Unknown
  misc_feature (1)..( 3003): 2750-1469P.txt file - cDNA_ID_1807032; gDNA_ID_2214544; Annot_ID_134554
cgttccgccaaacccgtcccgtaaaaaaaaaccgcagtacaccgctaatttaaatatataatgaaaataaatgttttacgggcttgcaattgtattttagtttgtcaaacaatattttgttttaaatagttgtcgaaatctagttcaaattttggagaaataagtttagtgaattgataagaaatgtatttaggtgtgttttgcttattttaagggattgcaattgtattttggtctgtcaaatattttttgttttaaatagttaccgaaatctagttcaaattttggagaaatttgcatgatatatgagattgaaatatatttggaatgttttttatttgttaattaatttattgcaaaaaaaaaatcaataattaaaagccaatagcagccattgtaaataagttccaactccaggatttatttcacaaaatggaagcaaaaatgtatatatagattttgaacgggtcagcttcatcgttgctgatttttttatgggccgatcactattttagtggaccgtctttgcattgggctgattatctcttaatgggctgtcttcgtcttgaaacgagtcaaaaggaagggtgttaattccatctccaacatttcattcatctatcttacacacacacaaaaaaaaaactgtgatttgttcaattttttatattttaataggataaagatctatttaggagtttggaggttagttcctattgcatacttcatcttcggtaaaactaaaccgcctagaggtatcgatctctggcttgaagagagagttctcgaggaacattaatagtgtgtagaatggtttatgtaaactgagaatcaattgtgactacccttggttaaaccggaaccttcttctataaaaagaggttttcattgtaacaaacacttaaaagaataacagaataaacacaatcttaaatcatcgtttgtatcataaacgtcattaatctcaactaggtcgtctctataaatttgcatctatctgtcctatcgtatttcatatctcaaattagttttttcttggatttataattattttcaatatttaactataaatctatattattggattattattattattattagattttgtttgttattgttcaagaacatgatgatctgagcacgagtttagatatagaagctcttagaaaaaaataagctgagctgagctaacttatgaaatatccgaactcattatgagctgactaatatattgaagctaactcacagaaaaagctatcaagaaattttaatatgaaaaaactaaaaaaataaatgaaagtaatatttttttctgaacacaaaaatgaaagtatttactatatatatactcttgaccaaaaagagaaatgatatttttactcacgacattacgtcgattagagaaagtgtggcgtaaatcacgtgagatcaaaataggaaactcagcaagaaacctattattcacttatattgatatgacctgcagtgaggttacttatttgatttaaaaaaaaaactgatttatttggtgtgcataatgttttttgttgttcactgcgggccggtcgatgttttttaactaagaaaattaaattttaagttcttgctaaaacaattttgaattttatattttatttattttgttacagtatttaatattatataaatgtattttgagtggtaattttaggattttacatgcgctataccattccaaattaatatcgacccaaacttatctcacagtataaccccattatgtgaaattaaatatcactttattatttttcattccaattatacttttatttaaaacacatattcatgagtcacccatagtatgtttgcttatattgtgaccataatattcctttcgttgtgatccatgttgccaaaacagacatcaattaatgaaattgtgtgtatttcgtccatgtttactcaaaaaaggtcaatatctttaatgtgatcagcaatgtgacttacgaattccccgaattccaccaaaacacctgattgcatcacttttttaatgtttctgaagcttacaaatatcatgggcaaaactccagcaaagccataaatggttggagaagaaaatctagttacatctaagggatggtccgataggtacacaaatgcctctatcatagaacttatttcatctctttcactacttttaaataaacatctaagaacaccttctacgtcgaaaacctacaatgtggcttaaattattgtacgtaggcaatatatcttctgaatttgcattctccgaccaatctatcatctgctggaaatgaataacaagctccactgaaatctcattgaaattagaaaatactctatccactttcatcattgagctgccgcaaccttgactaaaagcaaagaaatcgttttccaaatctcgagcttaccatatattcgatacattcatgagataaagcttcattgaagccaacatccttcaagcctaatcaataaaggccacacaagttgtagttttgtcctccattgataaaacaaattttatgataataggaataaggtacaaaaatatattttttgatgcaatacatgttgccaaaacgtatatcaaccaacgaaatcttatgtactttgtccattaatcagtatgattcacaacttccttaaattccaccaaaatttcggactttggcctattcaaacccattaatgactgtttaaaagctttggcctaaagattaatgttaagatgttgtcatctttggtttccattgatttaatcatttctttctttattatgcacacttggccaagtgttatcattttgagcaaaaccaactataccggttttctcctaaccggaataaaccgaagtaaaccggatatcacatcatccgttcactctctttagctcttaaggcgaaaaaagcttatcttcttcatcatctctttcctcaatcggagtgagcgcaaaaaatcaaaaattcgccgagagcacaaaccctaatg

SEQ ID NO: 16889 - DNA, 3003 bp, Unknown
  misc_feature (1)..( 3003): 2750-1469P.txt file - cDNA_ID_1807035; gDNA_ID_2214563; Annot_ID_134903
agcaacccatgccatagaggcgcaaaaacatgacggtaaaccccagatcgcggaagcccaagttgaggccaatgaccctgttgtagagccccagcaagactggggtggccgtggtggttgtaggtggggatgttgcggtgggtggtggcgtggacggtgcagatactgttgcaggagtcaagccgaggccagcgaggttgtggaaactgttgagcccaacgatgttgagcctcagcagggtggccgtggtggtggcggtggtggtggcggaggccgtggtggttgtaggtggggatgttgcggtgggtggtggcgtggacggtgcagatactgttgcaggagtcaagccgaggccagcgaggttgtggaaactgttgagcccaacgatgttgagcctcagcagggtggccgtggtggtggcggtggtggtggcggaggccgtggtggttgtaggtggggatgttgcggtgggtggtggcgtggacggtgcagatactgttgcaggagtcaagccgaggccagcgaggttgtggaaactgttgagcccaacgatgttgagcctcagcagggtggccgtggtggtggcggtggtggtggcggtggccgtggtggttgtaggtggggatgttgcggtgggtggtggcgtggacggtgcagatactgttgcaggagtcaagccgaggcaaacgaggttgtggaaactgttgaggcccaacaagctaagccatgaattgcgtgtaatacaaactctctatgtttgtatgcatgcatagctaattaccattacgtacgtatgtcaaaataaagcaaaaatagtacctaagaaggtacctagaggtcaataaaagaaaacgtaggttcatataatatgtattttgttatgtagtgtttcttttctcgtggatgttataaataataacaactgttttttaatttattttttgacaaatttcgagtcataaccaattcatattatacgggtaacacaattgagttaagtcaaattccgataggaaaaacggaataaaatggacttaatcatttgagtaaagaaagatccccaaataataacaactgttttaataccatggattataatattttgttcacagtttaaattatgaagaggcatgcatgtagctaagctagctagctcaataaaagccataggttaatataaaatggaaccaaacagaattattatcctaaaagttaagaataaagaataactgattctactataaaatcgtaaacattaaaggtgctgctgtaaaatcatgtattcgaggggaatatctcgtctaattatgtatgaatcaagtatatttgtattaatcaattttagtttctacattagttacttgtatgggtgtttttaaatggatagttttaaatatataaaaaaacattttctgtattcctaaaaagtttgatgttctagagttttcacatatattcaaaaataatcattgtttaattattggttaatcatttttaaaaattaaatattttttaacaattttgaactaattgtagtataaaatagttaatcattatgtcttaaaatctaagatttattaatattaattaataaaaataaagtaaaaacctaaaaaatcaatctttatgtaacaaactacaaacacgtaaacatcaatattttatgaaaaaagagagtaaaaatatgagtgtatttaaatgagaactgtgtcttcttagagacatttaaaactcctatttttgggatatttttaactttactattatttttcgtgaaagatatttgtgaaaaattgttgaatgaggatggtcaaatagatatacccagttatccacttacattattttcatgtttctttttatttgtattttcattttttttgtggtttcatttcttaccttccaaaacttccgaaattattcgaaattacgccactactctcggtcaacctcacgacgatgtcgttccttttgtacttggcccaaaccgaatggatccagtccactggcagttccaagccacatgttcaatatgcctacccggctactccgaattctggatctatttctgttgtcggataaccccaaaagcctttccacaaaaatttagtagttttcctaaaatttagacgttaacccagtaatataggattccacacgtggtggcatcgatcgacaactataaagtaatcaccgtttttactccaaacgatgcctgcgaatgctatgttgcttagaacttggaagagtggtcaattgtttcgtagttgggtcatacttcattagtctaccgattctgtctccactcatcgtactatccctcaattaatcaattaaattaacaattacgagctaatccatcatataaacatgctccttttattaatataaagtataaacatgttctttgtttaagataatataagataattttaactctataaagtagataacttcggtccgtggatcgatatcctatccattggtcaatcgaagggcttcattcagctcacatgacaaaacctgattggttacaccacatgttgtgccaactttaagaaggcccgtataagcatcggctatatagaggtcacaagtggatttgtcaaaggcaaggccgaacggacgaacggtcgtttttggaatggatagaagctaacattatcatttcgaacggtgggtttgaacttttaagtccaagaataggactttgtgaccactggtggacacgtgtaaacacgataggttatgatcagatctattatatatggtctctaaagatcatataatttttttttaacattttcgttatagaaatatccctataaatatatatgccattatcttcgatcacgcgacaaagttgactggtatcttgtccccaagttttgctgcccaactataaatacatgtgctgtgctcatcatacacttcactaacaaaatcatcttccctcaataaaccaaataagctaagtgttttgtgtaacgaaaacaaaaaatg

SEQ ID NO: 16890 - DNA, 3000 bp, Unknown; identical to SEQ ID NO: 12860
  misc_feature (1)..( 3000): 2750-1469P.txt file - cDNA_ID_1807045; gDNA_ID_2214576; Annot_ID_135185

SEQ ID NO: 16891 - DNA, 3000 bp, Unknown; identical to SEQ ID NO: 5122
  misc_feature (1)..( 3000): 2750-1469P.txt file - cDNA_ID_1807073; gDNA_ID_1620764; Annot_ID_50077

SEQ ID NO: 16892 - DNA, 2490 bp, Unknown; identical to SEQ ID NO: 11304
  misc_feature (1)..( 2490): 2750-1469P.txt file - cDNA_ID_1807075; gDNA_ID_2214489; Annot_ID_133410

SEQ ID NO: 16893 - DNA, 2490 bp, Unknown; identical to SEQ ID NO: 11304
  misc_feature (1)..( 2490): 2750-1469P.txt file - cDNA_ID_1807075; gDNA_ID_2214489; Annot_ID_183580

SEQ ID NO: 16894 - DNA, 3000 bp, Unknown; identical to SEQ ID NO: 11585
  misc_feature (1)..( 3000): 2750-1469P.txt file - cDNA_ID_1807078; gDNA_ID_2214504; Annot_ID_133726

SEQ ID NO: 16895 - DNA, 3000 bp, Unknown; identical to SEQ ID NO: 11585
  misc_feature (1)..( 3000): 2750-1469P.txt file - cDNA_ID_1807078; gDNA_ID_2214504; Annot_ID_184070

SEQ ID NO: 16896 - DNA, 3000 bp, Unknown; identical to SEQ ID NO: 12314
  misc_feature (1)..( 3000): 2750-1469P.txt file - cDNA_ID_1807082; gDNA_ID_2214543; Annot_ID_134505

SEQ ID NO: 16897 - DNA, 3000 bp, Unknown; identical to SEQ ID NO: 12314
  misc_feature (1)..( 3000): 2750-1469P.txt file - cDNA_ID_1807082; gDNA_ID_2214543; Annot_ID_185289

SEQ ID NO: 16898 - DNA, 3000 bp, Unknown; identical to SEQ ID NO: 11222
  misc_feature (1)..( 3000): 2750-1469P.txt file - cDNA_ID_1807086; gDNA_ID_2214484; Annot_ID_133336

SEQ ID NO: 16899 - DNA, 3000 bp, Unknown; identical to SEQ ID NO: 11222
  misc_feature (1)..( 3000): 2750-1469P.txt file - cDNA_ID_1807086; gDNA_ID_2214484; Annot_ID_183462

SEQ ID NO: 16900 - DNA, 3003 bp, Unknown
  misc_feature (1)..( 3003): 2750-1469P.txt file - cDNA_ID_1807094; gDNA_ID_1620756; Annot_ID_49901
atgttctcaggcgtaacatgtgaactgtgttttgcagagttttggctccaaaaccgctccaaatgtcctgcggctacctctcctgggtccttgattatgtttctgcagctgtgaataggcagagagggtagaagaaccgtggccggatctttgccgctggatttggtcaatgacatccaatacttcatgaaatgactgaaggtgactccatctgctacaacatgtgtagctgagttgcctatacagattccagctccagggaagatggtgacttgcattgccattattggtcgcatctgaattccttccggagagacgtgaggaggaggtaacttgggcaagacgccatgcaacacactgatatctttaggggaatcagacttcagttggtcgaagtcggtttcagtagactctgctacggtgaaaacaagagagtcttcgccagcgttgtagtgtaaatatggagggtcgggacgaggcgggataatcagtttaccggcgtaagggaagaaatgttggagagtgatggagagggaatgtttgaggttgggtacaaagtcttggaggaaagattcagttgagttttggtaagagaagaagaagagagaatcggcgagtgggagagagagccagggggcatcgaagaaggtgagaggaagagtggtggatgcaacggtgccctttgggggagagatgtgacaggtctcgatgatgttataaggttgaagttgagccgccatggtgtgattaagttttgaggaaatgagttcatatttgtctttttataaaaggaaaatgaaaccaccgggcaagtgaagaagttgattctgttacgtactttggtcaaaaaaacgctctcatgtgccccaacctccacaaccaccattttttttggttttcaaaacatttgttggtcctttatgtttgcttatttatcaatggaactcacaaatcacaattagtattttcgaattttataatctttgaaaaccaaaaacattacttttaagtacacaattgaaattcatagctaaatagttaacattactgctgcaactctatattaattgtagagttatggaaaaacaaaagtacaaactaaaataaagttcgttaaactagaattttaccccggaaaatccactatttttatgatatctcctttaccggagttacacaaatacactaaccatatgtctatagtaatctttgtcacatatcaactcaacccactaaaatataattctatcctctctggtttgtgtcgtatcatttatcaaccctagttagatcaataatctcataattccccaatgcgagggcatcattaggattgtttatcagtaccatcacatcatctttttcttgctcttgagtaacgtcacaatcttcttgacgttgttgttgttgttgttgttgttgttgttgttgagtaacttcgcgagattattctccatctagcatcatcgtctcaaggtcatcattagcaaaaccggttaattcagcctcttctggctgctcacgatcttcatgtccctctagcatcgtctcaaggctatcagcaaaaccggttaaatcagcatcttctggctgctcatgatcttcttgtccctctagcatcgtctcaaggctatcagcaaaaccggttaaatcagcctcttctttctgctcacggtcttcttgtccctctagcatcatctcaagctgatcagcaaaaccggttaaagcatcctcttcttacactacttggttccgtaagatgttgttggtgttctccgccacctgagtctgatgagcctgatggttaacgagtccaaactcgttgacgttcgcctctttcttgtatcggatccgacacaagacaaccttttggaggtcatcactctagtgaagagaatactccatcttctgtcaatcggtcttgacaagctttccatgcactctcctgtggtacgtgaaagactgctcgtaacccatcacccttttgcatgtgtccgtccttgatctcttttttcccatcgttgcttctccaagtgccgccttcgcttcctcctcttgcggctaccttccggtgtacgcttaatatcttgccacctcgttcagtaagcggaacaaagtagtaccactcgttgttattgaacaaaggattgtttacgtgaggaagaagccaagggtagtcttggtggatgtccatagttgttatgaaactgctctgatttctctccaccttgtttcgaagataaagcctcaccaaccctagatccgtcggacaaaaccgtgatccaaccggaagaatcttcatatcgatcgtatagattcgaagaagaactagctaaggtacctatataattgctaaggttaaaagtgctctttcgtctcttgtgtaatactgctctgtgaagcagggttttcttgaattcctcgcaggtcaagcggctgaactctctatatgatcatgaatatatagacaacgtgatgggcccaaccggattttcttttgtcagcgattaactattttttggaaagaataagacggttgtaattacatctatttggttatttgaaataataattagataggattcgaatctataatacacttttgttttgtttatcacagattctaacgatagataaagatatattacatgaccatgatttatccacatcaaaatagcatagtgccgtaaaccggctaatcgttttgggcctaatttgggcaattaagcccgttaagaaggataagagcctattgtgtatcaatatcttcggttcgaccaaattaaaccgcaattttaatttcgtgtctggtttggtttcggctaaataattcagaagtggtttagtctgagaagactggaactgtgttttcttttaccttgagctgttaaataaaaagggagagcggtcaaaatcagtggacgacgaagacttcttatcatttaatatctctccatcatcatcttcttcttcagcatcaaatccaaattcggatcaaacatg

SEQ ID NO: 16901 - DNA, 3003 bp, Unknown; identical to SEQ ID NO: 16900
  misc_feature (1)..( 3003): 2750-1469P.txt file - cDNA_ID_1807094; gDNA_ID_1620756; Annot_ID_166984

SEQ ID NO: 16902 - DNA, 3003 bp, Unknown
  misc_feature (1)..( 3003): 2750-1469P.txt file - cDNA_ID_1807104; gDNA_ID_1620790; Annot_ID_50454
cactcggggataaacctgctcccgctgctttagccctctgatatgcacgtaggcctggctcaatcttcttgactgcaccccacataccctgtctcaccccaagctttgcaatctcccacggtattcccatatcttcatggtgaaatagtagtacctcacatgatgtcatctcaccatcgcctctttttgattcaactacaccatggtaatatccatttgagaaactaaacaacacttaaataacagagacaacttgcttagtagtacctgcacggatacaccagcttgaatagtacaagtcgactcgccttggcttgttttgtctaggtacagacgggtattgtactccctgatgcaaatacaaaggagcatacttactataaacacatgaataaaaagagtgaatttaaaagacaatattcacaagaagaacacatgtttaatagctcgcactagaagaataagttggatatttgcttggttactagcagcgaaagaatggaataccttagtaatgcagtaaaagactcggccagcatcccatatacgacggcctataatatactccctgtcgctacaaaagaaggggaactgcaacagtagcggaagatatgagtaaagagaagggagaagaagcaaacagaacgaagaaaaaagagaaacaagtagcgacctttcgcacccattgcacaaccatagtgcccgtgtccttgcaacgctcgagagtagaagaatacaaaagcatatcatcccacttggaacggaactcatcatcccaaaagaagtccctgaccatctcgggagtggcatcctcaaacacagttctgctacggtactggggaggcccattctggcatcatacaaaaaatgattcaacttggaggaacatgttaaactaaacttaaaggaaggagggaggggggtacctcaggatctcgcctccaagcttgatatgagaaggttggggttgatcggtccatcatttgaatccaacaaggaccgccatctttgacctcaaccaacttccatagatgcctaaaatcatcgtccgttacaaacccagttttctctttggaagaaaggctgcgacccaaagagaagcagagttatttatttagcagaagagtaagaaagaaagagagacaagtggggaaacgggttacatcaatgaaatcatctcaaccttacctggggttaacgtggtgagaagaagttttgaggatggaagtgggaagctgaagattgaggaatttaggtgaattggacaagagtttagaatcgagataagcccacttgggcctccaaacccaaccaaccaaaacaccggcagccacagcaatccagagtggcgcaacaaaaactataaggtcagagaagccgaggctgtgaaactcggtaaagaccaaggaactcaatcccatcatctcgccccctccctccgatggttgggtcttgggagatattgaagcgctgggaggagtcgaggagaccaagagattgaagaagaaggagaataaaaacgagagagaagaggataaggattagaatttgggattactgtaggcccaatttcggcgttcgatgcaatcttcgcctctcgtttctatacacacctctctctcaattttatacacgactaccattacccatttctttaataagtggataaaaaaaagaccaaagtgtttattactgcctgtctccactcgtttcgattctgtggtcgccgcatccctccctcccccttctttttttcttttctgttttgctattatatttgctgctaccatttaaaatttttaagattaaagtctttataaaaaaaaaccttttattaattaaaaaagatcttttgcaaaactaagcatatttcataacttaaaaatatagcattagaatagattttgtatataattggtcatataatcgtggttacatagattctttttctaaaaactctttaattgaaagtataaaaagattagcaaataaaataaaaaaactttaactttttacatatgtaaattaaaattaaaagtatctaaattaaaaaataaatataatcttgtatggtgttagaaataaaataaaaattagaaacaatgatagctatatgccatactttccaaaataaatttagaaccaaattcttaccatgatgaattctttgattttcaacccatataacaatataagatatatatatatatatatatacatgaatatagtggaagatgatgagagaattactatatataagatgtaattaaaaatagacagtgcagatttattttaaaacaaaaaaaaaaaccaaaaaaacaatgtaaatttcatagtctaaaattaaaatttagaactaagcttttacaatgatatttttaaactcatactacgacaacaataaaaaaaaaacttaaaactaaacaaaaaaataatatttgagatttgagatatgtggaaggggatgagaaaataaatgaacgagaaaatgagtattttttattttattttagaaatgtttcattttttttgacacaagttaatttttttatagaaaatgtttaaaaaaatatttaagatttgagatatgtggaaggggacgaaagaataaataaactttacatgtgatacaatgttatgagttactgattttaaaaattatactttatttaacaggatgatttcaattggaaaatttaaaagttttttttttaactaaatgttttaaaagttttatgggggaaaaaagaagaaaacagaaatggaatggattaaaatccaaaaaagaaaatatcgacccaggattggtgaattctttaattaggcatttcgagcggaagagacttttcggggccggcccctttttaagttcgtccagtccattccagctttttgtcctttcacatctaaaagcgggagagccaacaaaacaaccttcttcctcgcgaaaacagagagaaagaggaagaagaagaagaagtctctgagaaattttcgaacatg

SEQ ID NO: 16903 - DNA, 3003 bp, Unknown
  misc_feature (1)..( 3003): 2750-1469P.txt file - cDNA_ID_1807107; gDNA_ID_2214527; Annot_ID_134194
tacacttcaagatacgttgaagatgttatgttctacgctaacaccaatcttagttacacaacagatagtcgcgtaaatcaaacaagtaactaacaaaataaacttatttcccaaattattttcaccatttattaaaaagaaaaacggtttttgaaatgtattgttgaaatttacagcggagaaaaatggagttcctgtgggtgaaccggtaagatttttctttccacatgtagcttaaatttattaatttaaattgtgtaatagagacgagtaaatataattgatgtaagaaatgttttcattttcagacgagtgctgattggctctttatatgtccagaagggtttcaagatgttctattatacataaaatcgaagtttcaaaatccagtaatcctcgtcactgagaatggtaggtcaaagtaaaagataagttgggtttataggcgaaatgtataccatcaattgcaaccagttaatgatctctacttgctacattgctaaaaaaaagccaaaataatatatgtaattttagaaataaaaagatattaaaaaaaacatacaattataattttaggaattgataaacttttaatttgtaggtaaatcggatatattggtcaaacaatttgattgcaagtgttttattactttggccctacttattctgatatttacatactttgggggggcattttacctccttaattaggaatgcctagcgagaatgacaaatcattgtccgtgaacatagcactcaatgacgaggcaaagatcaaatatcaccaactccatctcactgctcttctagaagcagtcaggtaattatattaatttcatatacaaagaatttcaaatatccagacttctgtcatagttttacaaaaaaattaataatgttgatgactgatgtgtttttctttcatggaacattgaaacagtcaaggagcagatgtgagaggatattatatatggtcattaatggatgattttgagtgggaatttggttacaaatatagatacggattggtctacgttgattttcaagatggacttaaacgacacctcaagagttctgctctttggtaccatcattttctatccaactcatcctcctatcaaatggactagcaaggaatatctaaaattaatatcttcactttatacaactttcttatgtattcctaagaataaaatgaaacatgcaactttagcagtactgtttatcccagactgggacacgaatatatgtatcaagatttttttgtgtggccatcaaaacatattgggccgtggttctaggcttcaagcactcggttttcagatccgaaccgggttgaatgttgggtcttcagatgacgacccggagaggaatttacttggactcacccacttcatatctatgtactaatgaaaataaaaatatccaacaggccattacggatgatcatcacacaattattgcatgcaccaacccattatcaatatttttgttttttgtttgcaaaacacaattatcaaatcggcaagtagatgttagtcttaatcactggaataatgacgaaactattcgagtgattaactgattatatatatacttttctgtcagtgactatatttagtataaccaaagaaagtatttaaatagtgttgcaatttctttataaccgatctgaagtttgagctgttatgtgattttttatctttttttttgtttttattctttccgctttcgtaaaagctttttataaaccattgatagactgatagtgaaagaaattagtcgacgaaaaaaaaaaaggaaaaaaaatcgacgacaaagttgaccaattagatgccacgtcatcaagactaattgtaatttgtcaagtggtccccgcttcgtagagcccaaagacgaaatcttattcacgtgcttgtaaattaccaatatgcccttcttaagttccggtgaacgattcaaagtcaacgacgacccccatgggtcgatctaaaaaagagttgactggaggataaacaataaaaatatacaacattaggctatatatttgttgaacattaaaaaaagttataaaatttgttgaacaagaaaaggttataaatttagaatctacacacaacaaaacgaggacttgaagacctcgttgtttcctaaagactgaaatctgttgttcctaatgatatgaacatcattaggcgcaaagtatctaatttgaattgtgcgtgcatgttttttctttttaattattgacttattgtgcatgcatgttaatttacgattctaatttctaaagcattagcctctttcgtaacttagtggaactttaagttacaaaaaaaattatgaaaatccattcgattaattaggtgtagttggatttgggtcaccatggaactcatttatattattgacctgtccttttctcacttgatctattgtttatttagagaatatggtaactgttacaagatgtttggtaaattatagcctaaccaagctaacataaacgtaaataatatcgaataactcaattttgaaggtgaaaatggattattgattattatttatatactatggactatggagattggagacagacaatattcacggtaagaataatcgacaatggacaaatttaatatcaaattaaaaataaaaaaatatattaaaatatgctagtgtgctgaaaattttgaagttgaccggtcttcttgatattttttgtaacaaacaaaaaaactagctgcaataggactcaatcaatacgattgaaaaaataataaaaatcccataaaaaaataattgtaatcctagtttgacttctcaattctctgcatctctcaatcacgcatttatatatcatatcattcaagcctttttatcttagtgtctctctataaccagagaaattatttcaagatctacttctcatcatcgttcttttcttatctcttcttgtccaacttcttctgaatcaagacaagagaaaagcaaccaaagatg

SEQ ID NO: 16904 - DNA, 3003 bp, Unknown; identical to SEQ ID NO: 16903
  misc_feature (1)..( 3003): 2750-1469P.txt file - cDNA_ID_1807107; gDNA_ID_2214527; Annot_ID_184804

SEQ ID NO: 16905 - DNA, 3003 bp, Unknown
  misc_feature (1)..( 3003): 2750-1469P.txt file - cDNA_ID_1807111; gDNA_ID_2214501; Annot_ID_133670
tacaagattacaaaactgcaagaaaagaattagaagttcaaacatacacacctccagaagtgggataagagactacaaaaaaattaacgaaggaaacactgctggagatggatacctccagtggaagatagttgggccgatctggcttgccaacatcaaggcatggaaagtacgcagaagaaataggctctgtgtaggtttgcttgaaatagtcatacacagtaatctctctaataggtacctcacgttcaccatctttaatcttcattgaaaacctggaaaacggtgaagaaagtcaagcaaaggctgaaaaagaggacaaaatatatattgatagtacaatcatggggaacctacagttgctgattgcacggtttcgaacttagacctataattttaaattccatgttacggtgtgttgccttaaccctcatatgtttaagcattttcgcagcctgccaagtttcaatgaaaacttcacaagctcaaaacaaaagcagccagtcatgttctcagttattgcatttaaaagccagaactaccttaatccagtcgatttgccgtggtgtctcaacactctgattggctttcaggaattcaataactggaccaggttctaagatcattgttgttgacacatctgcaaaccatcacaaaacgaaaacagttttgcttattaataaaactatccacaattaagacaagtttatgaaagctggagatgagaaaggtatactgaaaaataccaatgttaagcgagagtcctccatgagttggacgaaagctcgaatgtaaacctcgaatacctataacacctcctccaactttcatggggtgcccatcgctatggaaaaatgcctgtctgaccaaaaggcatcccctgcattatcaacagttttctatagtaagcatcgagcatggtcacaaaatgcaaatagttgtacattgattaaatttcaccaacaaagtgaaaatatgataataaaaattggtccattagaacgtagagtatctattttaataaaaatataaactgcacaaaagcaaacagatagaaagatttacctttcagctgcttgctgcctcagtacaatgtcaagcactctaagtgcatcctgagcactcttatctggtgtataagctcctctctgagtgccaagaacagtcttcaacggtatttctgcagcataatgtatctgaaccttgtaacttcttggcaagaaagaacgttttgatcgcttgcaagtaccggaagaactaccaccatcagagacaccacaatcactataaacttaacaagactgcgttagttagaagatcaacaagatctatcttgacaccttgaaacgattaaatatcaatccagataagagggacataccgttttgaaaatgacccttccacgatgactagaaagtcaaattcgttctgtggtagaggaccaacagtatataaagtcttctctccatcatatgccaaccttttaccatcaagatcagaagagtaagtcttgaatagttggtccataagctttctgcttattcctgtcccatcaacagcatcaccgttttctgtggtgatactaacctgcaaaaaaggtaccgatatgtcaaacatctcacacacgcacagacactgatgaaagaatgcagaaaagtgactaatgaatcttacagtgtactggtaaaatactacatccggctgtctcacagaaacattaaagtgattggtgcacaattctattgggttgcctgtggttccaaccccacgtctagttgtgatgtcataatctcgatggctgggctgttctggttctatacttatgggtgacagtggcagagatgaagatgtctccatccttccaggggaaaataatctgcaagagagaaaagtggaggttggttacagtgtgcaaaaaccagtccaaaacacaatgctcaggagactaagaaagaaaagaaaaacaccaaattaagaagacaactccaaaaggtaaaaagctaaaaactttaccaccattgtcgttctaagattttaatttctgggcatatcctgctaaatcgcgagaaatggtataaatttcagatgaggaacaaacttaatctggaaaaaaaatggcacctttaactgttggtcgccttcaaaattgagaaacattacacaaacaaaaactcattcgagtgtgtcatacagtagcataacaagactttcaagagagaaacaacgcagccaaaaccatacaactatcaacagacaaatcctagcttcatgcaaattctccgaaagagagacaaaaacaaaacctagctccgaatcaacaacaattacaacagcgatatctagtgaaaacagcgcacctttgaaagaattaagaagaggatttctagggttccggtgaatcaaagagaggaatttatttagctcatttctcttctccgtcacagtctctttgggtttcccagacaagcaaaagaatggagggaacgtttccagtgatgggaaaattaaaatatatttcacttttcagtcattttttacagtaacaaaatttaagaactgaaataaaaatggtttattccaaaattattaaaccgaatccttcaaaacttattctatttctagggttatgctccggttgaatggattgaaattcccaacttattcatttcaaatagtaagaaataaaatgaatggttgtaagaaattaaattagaccgtcgtggtaattgtaagaaatttcattgaaccggactataaattagaagccggataattaaaccgtaccagcgcttggagaaacgccagacacacgcgcgaaaagaagcgcgtagaccagaacgtgtaggatttgtcacctcagaaaagaaccacggtggatcccaccacacctcagcctcactcctccttcatctccgacgtcatacccaaaccactcttttctcacaattccgattttctcaaaaaccaaaatcacaatcgaagaaatcttttgaaagcaaaatg

SEQ ID NO: 16906 - DNA, 3003 bp, Unknown; identical to SEQ ID NO: 16905
  misc_feature (1)..( 3003): 2750-1469P.txt file - cDNA_ID_1807111; gDNA_ID_2214501; Annot_ID_183994

SEQ ID NO: 16907 - DNA, 3000 bp, Unknown; identical to SEQ ID NO: 3612
  misc_feature (1)..( 3000): 2750-1469P.txt file - cDNA_ID_1807115; gDNA_ID_1620653; Annot_ID_47796

SEQ ID NO: 16908 - DNA, 3000 bp, Unknown; identical to SEQ ID NO: 3625
  misc_feature (1)..( 3000): 2750-1469P.txt file - cDNA_ID_1807115; gDNA_ID_1620653; Annot_ID_163556

SEQ ID NO: 16909 - DNA, 3003 bp, Unknown
  misc_feature (1)..( 3003): 2750-1469P.txt file - cDNA_ID_1807115; gDNA_ID_2926185; Annot_ID_140764
gtagccatcacgatacagacagatgactcgtttcccaattatggtaatgcttcccaagataaactaaacgagtggttaagaattaatccccaatcataccaagtgacagtgtcaaagacttttgtaatacacaaagtcaaatgaaaaaagggaaaagaaattcattctaattgtggtaagtactatgtatccatatatacatatgctttcctaattaacaaaaatcacactataatattctgctctcttatttcccagtacagaaatcttaaccatgagtctaaatgaaaatgattgaaaaattacacgttaaaaacccatattatgttaaacggaattaaatacatgatgtgttatacataaaagtaataaaacatcaatcctatactttaaagtataataatttaggtcatcaaattatgccgtacatgagatctccgagcctactgataattaactttagagagtaaacgagaaaataaaaatctcatttaaatacatatcttaatatatttatccaaccatattctcaaaaacacaaacatggattgaaaaaaataagacaactactaacaaaaagatagaatataccttgagctggagaactcgaagagctttccggtggcagagaagatgatgagagcaacatcagcatcgcaaagaactgaaagttcatcggctttcttgaagattcctcttcttctctttgagaaagtaacttgtctcgctgttatgttatcaatcttctttatccttatcttctctctcgccattttaccagatctctccttcactactgttcttgaatctgcctatacccataacaccatttagattttagaccaagaacaaagaaagaaaccaattggaacggtgttagctaaagagagtttatataatattcttaggaaaccctaatggctagagagagagagaaagagagatcagatccataaaccatgagaagcaaaagaatggacaggactagatgaattcatcaaacactttgcttaagaagaaagaacacagattcacagcttttacctttctgtgagttggaggatcttggattacgttattcaatctcagcacccactttattaaatttgtgagaagataaaaaaggtttttctggtagctgtttactccctaatgtgtgagtgagagagaaagagagagagagatggtgactgtgtttgtgttcaagattggaaaaaagagtctgctttttttagctaaacagtgatctatacttatcaatgggccatatgttttgtatcccttttgattatgtctttttcccaaactataatcattaaaaataacacataaacacactttgtgttttgtctgactgagctgccagacgaagagactgctacagttatgatttaataatttacctaaccttctaattcaattagtctgtcatggaataatgtggaattgtaactttattcagtagcgggtttcctagttttactgttttagtctagttttgaataacttcccatctaaaaacaaaataaaaataaatgacgtgaaatactactccgtataagttaatagatttatatatggctaggtcaaataaaatgatacaaaagttacccactatcaaaaatgtaacatgataaaataaaaaaacataattggaaaatgaaagaaatcacaatacacaaggaactacgtaccaattctaatggaaagaaagtttggttactttttttattcgtaattagaagatgctgttcatcagttcatctacctttttggttttggtttattacaaaagttgtgtctattaaatatttcatgtcttttttatagtctttcacctatatatgctagatgcgacacctgataagatcactcgtctcccaccgtcatcattatcttttatttttgggtttgatcagccatttatacccttttaagttttaaccctaattagaaatgatatatcaccggactccggtaactctagggtgatatcatggccgacaagtatcttgtaaattttttctcccaaagtacaactgaaaattaaactaaactgataaaattcgtgggaaacgtaccatctcataatgatacatgtgaaaagtaatatagatgactttaagacttcaatctgtataagattaagttctttatgactaaaacaaataagcactaagaatgtgagacagatttagtattgtaagcctttggttttgtttatgggaggaaaaaaagcgagtgcaaaatcagaaagtgagagtttttggtgtagatcaatgttattggtctttaggatcttatagtaatatgttgaaaatatatttgggacgagctagaagactcccaaggtcatataaatgtgaaactaaacagtaattgtaatagtgttcaagaagaatcatctaacacgtttaaaaagcttagacttgttgttgacccttgttaccctttcatatatcttgtgtttcttacttgagtttagaaaaagaaaaatcttaagcctttcatttggaatgcttggtcatcttgtcagccctctaggctcatgtatatctcccgattgctcgatcccgaaagtcttcactaaccttcgttgtcagcttaatcctcaaagttttgacttccaaaaataaattatgtgttgtaccctttatatcaactcacattttgcttcctcgtaaacaatgtttttttttttctcctccgagatcgaaccatcatttatagtacttactacttatttccttaaactcataacaagttcgaaatttgggccatattgatgtcttaaaaataggcccatataagaacaagaaatcataattcacaaaaacacagaaccctccgtctcatgaagaagcttcacgataacgacggcaaatggtaaaacgtgaaccacctcaccaccagacacacaaaaagacgagaccgatcggcgatcagtagacttaaccaaactcgcggtgaaacagtcggaatccaccgctataaggaacgatg

SEQ ID NO: 16910 - DNA, 3003 bp, Unknown
  misc_feature (1)..( 3003): 2750-1469P.txt file - cDNA_ID_1807115; gDNA_ID_2926185; Annot_ID_200569
gccatcacgatacagacagatgactcgtttcccaattatggtaatgcttcccaagataaactaaacgagtggttaagaattaatccccaatcataccaagtgacagtgtcaaagacttttgtaatacacaaagtcaaatgaaaaaagggaaaagaaattcattctaattgtggtaagtactatgtatccatatatacatatgctttcctaattaacaaaaatcacactataatattctgctctcttatttcccagtacagaaatcttaaccatgagtctaaatgaaaatgattgaaaaattacacgttaaaaacccatattatgttaaacggaattaaatacatgatgtgttatacataaaagtaataaaacatcaatcctatactttaaagtataataatttaggtcatcaaattatgccgtacatgagatctccgagcctactgataattaactttagagagtaaacgagaaaataaaaatctcatttaaatacatatcttaatatatttatccaaccatattctcaaaaacacaaacatggattgaaaaaaataagacaactactaacaaaaagatagaatataccttgagctggagaactcgaagagctttccggtggcagagaagatgatgagagcaacatcagcatcgcaaagaactgaaagttcatcggctttcttgaagattcctcttcttctctttgagaaagtaacttgtctcgctgttatgttatcaatcttctttatccttatcttctctctcgccattttaccagatctctccttcactactgttcttgaatctgcctatacccataacaccatttagattttagaccaagaacaaagaaagaaaccaattggaacggtgttagctaaagagagtttatataatattcttaggaaaccctaatggctagagagagagagaaagagagatcagatccataaaccatgagaagcaaaagaatggacaggactagatgaattcatcaaacactttgcttaagaagaaagaacacagattcacagcttttacctttctgtgagttggaggatcttggattacgttattcaatctcagcacccactttattaaatttgtgagaagataaaaaaggtttttctggtagctgtttactccctaatgtgtgagtgagagagaaagagagagagagatggtgactgtgtttgtgttcaagattggaaaaaagagtctgctttttttagctaaacagtgatctatacttatcaatgggccatatgttttgtatcccttttgattatgtctttttcccaaactataatcattaaaaataacacataaacacactttgtgttttgtctgactgagctgccagacgaagagactgctacagttatgatttaataatttacctaaccttctaattcaattagtctgtcatggaataatgtggaattgtaactttattcagtagcgggtttcctagttttactgttttagtctagttttgaataacttcccatctaaaaacaaaataaaaataaatgacgtgaaatactactccgtataagttaatagatttatatatggctaggtcaaataaaatgatacaaaagttacccactatcaaaaatgtaacatgataaaataaaaaaacataattggaaaatgaaagaaatcacaatacacaaggaactacgtaccaattctaatggaaagaaagtttggttactttttttattcgtaattagaagatgctgttcatcagttcatctacctttttggttttggtttattacaaaagttgtgtctattaaatatttcatgtcttttttatagtctttcacctatatatgctagatgcgacacctgataagatcactcgtctcccaccgtcatcattatcttttatttttgggtttgatcagccatttatacccttttaagttttaaccctaattagaaatgatatatcaccggactccggtaactctagggtgatatcatggccgacaagtatcttgtaaattttttctcccaaagtacaactgaaaattaaactaaactgataaaattcgtgggaaacgtaccatctcataatgatacatgtgaaaagtaatatagatgactttaagacttcaatctgtataagattaagttctttatgactaaaacaaataagcactaagaatgtgagacagatttagtattgtaagcctttggttttgtttatgggaggaaaaaaagcgagtgcaaaatcagaaagtgagagtttttggtgtagatcaatgttattggtctttaggatcttatagtaatatgttgaaaatatatttgggacgagctagaagactcccaaggtcatataaatgtgaaactaaacagtaattgtaatagtgttcaagaagaatcatctaacacgtttaaaaagcttagacttgttgttgacccttgttaccctttcatatatcttgtgtttcttacttgagtttagaaaaagaaaaatcttaagcctttcatttggaatgcttggtcatcttgtcagccctctaggctcatgtatatctcccgattgctcgatcccgaaagtcttcactaaccttcgttgtcagcttaatcctcaaagttttgacttccaaaaataaattatgtgttgtaccctttatatcaactcacattttgcttcctcgtaaacaatgtttttttttttctcctccgagatcgaaccatcatttatagtacttactacttatttccttaaactcataacaagttcgaaatttgggccatattgatgtcttaaaaataggcccatataagaacaagaaatcataattcacaaaaacacagaaccctccgtctcatgaagaagcttcacgataacgacggcaaatggtaaaacgtgaaccacctcaccaccagacacacaaaaagacgagaccgatcggcgatcagtagacttaaccaaactcgcggtgaaacagtcggaatccaccgctataaggaacgatgatg

SEQ ID NO: 16911 - DNA, 3000 bp, Unknown; identical to SEQ ID NO: 12492
  misc_feature (1)..( 3000): 2750-1469P.txt file - cDNA_ID_1807129; gDNA_ID_2214555; Annot_ID_134748

SEQ ID NO: 16912 - DNA, 3003 bp, Unknown
  misc_feature (1)..( 3003): 2750-1469P.txt file - cDNA_ID_1807133; gDNA_ID_1620774; Annot_ID_50248
agtactcatcgaagcttatcaccgtttcatgcagaatttgactttttgctatgggcaatagatgcatgatctctattagcaatacttctggtacttttgcttcagattgttcagacctaatttctatcattgacaaccaagacgattagccgacattcgcagcggaattggcttcctatcgatctttagtttgtttttttcttcttttcatattagatttcttcttcgtagttttactgttcgagatgattgtttagctaaaaaagctcgggatcgaaaaagtcttttctcccatgaaagcacatcggttcctgaatggctttctctagcggagagtttattaccgattacttaaataaaatagtgtttgtgggggggaaaaaaaattagtctcctacatttattgaaatttctttacttaattagatcgccaaatttatgaacttgtttaggtcaataatttcgatggtaaaaactaaaatcataagacaaaagaaactcaaacctttttatatgatttaacttatagaataacttgttacatatgatatgtttgtatgaaagaaagaaaagagaaccgagaaaaataagagaatgaaaagatgaaagaacagagaacaatttcaaagatatcttatatagtagagaagttaatggataacttggttttattaaaatgtcgaatgcaacatttctaatattctagttaggctgcctatgtgtttaacttcatgcctttcatgacatttcatctcagtacttggagtttactattcaagcttcgtttgcaaacgcacattcaaaacatcataagatttctcgaagatactacacagtagccatacataaaacaattcgttctacaaaccagatcgaataacatgtgtgaaatagattcatctgcagtacctttttaacgcggctagctatcaggaaacagagtgcttcacttgtatataaaaaaaagaggttcaagcagaaatacaaggcatcgtaaaacccgatatggtctaaaagatataactaagcaagtttgcatatgtcctcgtactcaatggacttgatgactcttccatcatagacacctttctcgatctgcactttagcacagaacttctctgtatccacacccaacaaccttgcattcgaaccacgatatgccccattcactatcttcaccatccctccaatttgtggaagcacagtctctagctccttttgatcaactctcaacacatgtttagaatcaagcattttgatctccccaacataattatcaatcactttcttcacaacacctttttgcttataataccctttctctgccaaagccttactcatcaccttcacaatgatcccttcgaacaaccagtaatctttccgattcatcctctccttcttcttctcttcctccttcatcaactcatccaaagctgatctcctctccttctcgctcctcccggagtccccacttctcttcctcttctcccctctctcaaccttgtcattctcttcatccccaaacaaaagtttcgagctttcccctctctctttacccgtagcaacctgtttaacacctccaccaagagcaaatccaaccttgaccccactcttcaacctcaagtcttcatctttcttcctctcatcatcaccatcatccacaacttcatcattaccactggtttcaccttcaccaccaccaccattcaatttctcagcagctctctcaatctgtctctgaatctccctctcttgcttctcctcctcagctaaatcactcttaactctcttattcttcaacctctccttaaacaaagtctcagaatctctatctatataagtaataaaccaacctttaggagtttcttcaaccttacacttaccagttttcccaagatgcttgataaactccgtcaacgtcgcccactccgtcgaattcatgtgaacatgatgtctatcgttaatatactcattgtagacaacagtggcagcgatacgagagaaacggtggctccgcctcatcagatcgagaaacgtctgctcgaattcttcagagtaaccatcgacaacacgagtcggattctgcccaaaaacttgcatctgcctctggtgagattcgctcatacaatgacacttgaatccattctcgtctcggcattgtttctgacacatctgacaataccatcgaagcttttgaagtcctttggctttaattcgattcgcaatcgcctttggggttagaaaatcgttcttacccatcgaatcttcttgggtttgtcgaacaaaattaaggtgttgggaattgaaatctagggtttctcaggtaacaaccactgatcgagaatgatgaagattcaatcggcgaagattagctaatatattgattgatgataaaccgaaactcataccaaatataattgtttatcctgaataccgaatacgacccatcaattaaagcccatacaatactgggcctataagaaaagaaatgtaaattgtggggaaaaaaaaaggtaaatttacaactttataatatatgcctcaaataattttaacagcttgtttggtcttatatcttgtgatctttgactttcagtctttcacaatggaaattattgaatcttgcatttttattgaattaatttcctatttgtaacagaatactattattagagatatattgattgagaatcgtaaaagataatgtagttgtgtgacaagtgagattcaagaaaagtcaactatatacaacgagagtagcaaaaaagaaataaattcaaatgatttggaaaattgaagaggggaccaattcttgggggtaaggagtagactcgtcgccagagctgactttgaaaacttgacttggtctcattcttctcatctactgcaaaaaccacaatcagtatataacaacaacacatgagtgacttaattctcatagaccaatacagagatacaaagcaatagaacaacaagaacaagaaaacagagaaaaaaacaatg

SEQ ID NO: 16913 - DNA, 3003 bp, Unknown; identical to SEQ ID NO: 16912
  misc_feature (1)..( 3003): 2750-1469P.txt file - cDNA_ID_1807133; gDNA_ID_1620774; Annot_ID_167639

SEQ ID NO: 16914 - DNA, 3003 bp, Unknown
  misc_feature (1)..( 3003): 2750-1469P.txt file - cDNA_ID_1807141; gDNA_ID_1621194; Annot_ID_57531
gttttcatacaaacaaatgttgtcgaccttgttttattattatattgtttgcttgatattcatcgtttttatagggcggtgccaagaaagttataatttctgccccttctgctgacgcacctatgtttgttgttggagtaaacgagcacacataccaaccaaacatggatatagtctccaatgcaagttgtaccaccaattgtcttgcccctcttgccaaggttggtaatgttgcacaataattttaccctcatttcattgctatgagattcattaaggtcaactaaactgtatttggcaggtggtgcatgaggaatttggtattcttgaaggcttgatgacaactgtccacgcaactacaggtctatataacttactctcctgctgcagatcactgaatgttgataacctgattacactaacctgtgtgttttggttattttttctttcagctactcagaaaactgttgatgggccatcaatgaaggactggagaggaggtcggggcgctagtcaaaacatcattcctagctcaaccggcgccgcgaaggtacacaaaaactcacatggttatcgcaagcatgtaattatcctaaatcgggaatcatatctgagctgtggttttttgatcaagtaggctgtaggtaaagttcttccagaactgaatgggaaacttacgggaatggccttccgtgtaccaacatcgaatgtttctgtggtggatttaacttgtcgacttgagaagggtgcctcttacgaagatgttaaggcagccattaagtatgcttcctaaaattttattgcccgaccagatatcgtcatcgaaacattatcgtttaatgtagaactcttaataacctctcatggtttaatgtaaacctctaacaggcatgcctcagaaggacctcttaaaggcattctcgggtacacagatgaagatgtcgtctccaatgatttcgtcggtgattcaaggttggtctctctccttttcttcatagtcatctgaatctttttttgtggttgaccaatgtggtgattccaatttggttataacaggtccagtatctttgacgccaatgctggtattggattgagcaagtcctttgtgaaacttgtctcttggtacgacaacgaatggggttacaggtacacttttgtttctcatcttatatttctcatcctagctaacagttctaacacttaaaaatcttctcccattttacttacagcaaccgagttcttgaccttatagagcacatggctttggtagctgccagccactaaatacacacaccagttcttgcagaagcttgagtctttctgctttttgcgtaacctgctctacaaagccggtttggatttgttcggttcaattaggtgccactgtgctaggtgttttgaaatatttggcttgaatctcgagcctttactctatttttgttctgttccagtatcagcaaccatgatttggtccaaaagactgaaaaactgtgcgacttacatctatgaataaggggctaagctagttgtactttaccaaaaatagcttaccagtataagcaacgtttggatacttcttgatagcgcatcgttagctttgcccgtgcttatgacaaaagatcactaaccactgaaacatattttttacaaatgaaaacagaaattgaacttgattagcctgtgtaaccatgtttcagaagaaagcttactcgttttttcatccgacgaaactcgtttggtattggcgattcctggaagggaagcatgaagatttatccattgagatggacaacctcatcatctatctcctctgtcttgtttctgatctctttcaaaacttgtttgtcttttctctatcatcaccacttaagaaaaggtggctgtttttgagttaacggaagtagactcactcaagtgaggctatagctaaggaaggacatgagttatttattggccaccatgcggataaggagaactcttgaagtaaggttactcatatattttcacttgccccgatatttcatggaaactacaacattttccacgaactattgtttattacatatgttttctaagactttatttattacagatatcgcctgaaatttcgtattattacaaaaacacacgtaaattttgtcaattccaaatatctccaaatttttgtttgttacatattgttccctcaagtttttgtttattacagattcccctgaacctctcatggtttgatgtaaacctaaaacctcaaaatcaaacaagtttgtcacagaaagatatatagtctccaatgatttcgtcagtgattcaaggtctctcttctttctctaaatacgtaacaactaacacggaaggcatttcattggctacaattatttcaaaatttatcttacaaaaaaggataatagagtgtgatattgttcatcagagacgtccacgtaagggtaaactaatcagtatatggacaaaaaggtacttgtttatctacaccaggaagaaaaacaataccagttttccggtccacaacttttgcatcaccatgcatccgcagccacgtgtgttcttatgaatattaaaatctacttatttcgttatacgacaaacgaaagatactgctttgttgcgtagacaaacaaacaaaatctcttgataataccagatattcttaattaattagtacgttttaaactcaacatacccataagaaaatccagttagctcatggtttcatgttttccaatagatatatgtgtatataattaaacgctttgcatcgtttgtgatttgcatgttggaaataataatgttttttttttgctaatcaaggtttgattaaggaaaaggagtttggactttggacctttctactacaaatacatgtggccctttttggccaacaccaaaagttccaaaaaagaggccaaaaaataagcaacaacttttgattctctcgtaacttcccccacaaaatcagcagagcgagagcgagagcgatcggttatg

SEQ ID NO: 16915 - DNA, 3000 bp, Unknown; identical to SEQ ID NO: 6292
  misc_feature (1)..( 3000): 2750-1469P.txt file - cDNA_ID_1807145; gDNA_ID_1621088; Annot_ID_55448

SEQ ID NO: 16916 - DNA, 3003 bp, Unknown
  misc_feature (1)..( 3003): 2750-1469P.txt file - cDNA_ID_1807145; gDNA_ID_2926212; Annot_ID_142035
atatttacgactagtttgaaaaaccgtgagctgacacaagctcattgctaatgctacagtaacagctaccttcacttttaactaaatgacagaccaatcattttaacctctgttttcttagctggcgcgtgacagacactctccctctctccatgcccataaaatctcaaagactgtttaaaaaaaaaaatgttttagctttaactgctttttttttgttgttggtgtaatgatatcacagagagaagaaagagaagagaagaagcagagagtgatgggagataagaaattgatttcatcttcttcttcttcctcggtttacgatactcgtatcaatcatcatcttcatcatcctccgtcttcttccgacgaaatctctcagtttctccggcatattttcgaccgttcttctcctttaccttcttactactccccggcgacgactacaacgacggcgtctttgattggtgtgcacgggagcggtgacccacatgcagataactcgagaagtctcgtttctcatcatccaccgtcagattctgtgcttatgtcgaaacgtgtcggagatttctctgaggttttaatcggcggaggatcaggctcagccgccgcgtgttttggtttctccggtggtggtaataataacaacgttcaaggaaatagctctgggactcgagtatcgtcttcttccgttggagctagtggcaacgagacagatgagtatgactgtgaaagcgaggttttttctcaatctctgttttttatcttttgcatgttttaaaagttgattctttgtctctttcccgagaaaatgtttctacagagatttctctttaacggatctgtactttattttcccccttaaaatccgcaatttttttggttgtgattttgagtgaagttttgtcatttgtgagtgtaataatgaatgcacaccgagtgtttgataatttgcttcaatgaaaatacaggaaggaggagaagctgtagttgatgaagctccctcttccaagtcaggtccttcttctcgtagttcatctaaaagatgcagagctgctgaagttcataatctctctgagaaggtttggtttagagtctctcccaaaagtagaaactttcttatttgagatttatgtttatctttcttgtaacagaggaggagaagtagaattaatgaaaaaatgaaagctttacaaagtctcatccctaattcaaataaggtaatgatactatatatagagagacatctacatgaatcattctattttctgtagattctttttgtgtctgattattgcaatgtgtttattggggaagacggataaggcttcaatgcttgatgaagccattgagtatctgaaacagcttcagctccaagttcaggtcactaaagataccttatgtttatcattataaccaaaatcctaaaaccagtctatattctgacataagtctttttttgttctgatatttgcagatgttgactatgagaaatggaataaacttgcatcctttgtgtttacctggaactacattacacccattgcaactctctcagattcgaccccctgaagcaaccaatgatcctctgcttaatcataccaatcagtttgcttcgacttctaatgcaccggaaatgatcaatactgtggcttcttcatacgctttggaaccttctattcgcagtcactttggacctttccctctccttacttcacccgtggtgcgtagttgaattacacatttttcattctataaccataaagctagtttgcttactaatttttttttgttacttaaggagatgagtcgggaaggtgggttaactcatccaaggttgaacattggtcattccaacgcaaacataaccggtaaagtcttgttgttttggaatcctaaggaagttttaggacatttacaatgttaataacgttacgatatttggggatttgcaggggaacaagctctgtttgatggacaacctgacctaaaagatcgaattacttgaacagtgtcccaacttcgggatctctatgtgttcttgtttcttagaacgcaagccataaagctgtctgacaatggagatgcatttaactgtctttattttttctaaggttctatttaaaatcaattgttggtgacacgaattctagagtctaatcttttggatctaatagctatatataaaaaggactgaaattttattacaaagtaattgactaattgttagattgttgtatgtttatggtggatgtaaattttctagatcatcttcgtattgtatttgagagtttgatactcgatggctttggatatgtaaattaccccgataagcttctagagaagttttcgattctacaagatggatttggtatctttaaggttgaccatgttcttttggtatctcttgttctcaaattgatcatttacaatacaattttttaaaatcttttacccttcacatttttgtacttacatttggtatattagtaatttcatttgtaagtgtcttttaaaagtttttcatttataagtgttgttttaagatcttttatgataattaaaaaatgcttaaatatcttattaacccttaattagtatacttatagctttagttctccaattaatctttagtaagtaaaagggacagagctagaactttatttaaaattggattgaaaatacataaatcttatatttttttcaaaaactagtattgaacatacaatttatttattttattttatttgtaaaacaacaataaaagtaaaatcatacaacgatatattttgaaaaaaggaaaagtaattaggattctctttcggtgaaaatatcagagaacaaaatatatttgaatgcgactgtagttgaaacttgaaaaaaatttagatactaaagtttcgtcattctctttttgttaaagactcagtgacgaccctctcctaaaaaacactcataaataaactcgctggagacgccggaaccaaaaacagagttctaatg

SEQ ID NO: 16917 - DNA, 3000 bp, Unknown; identical to SEQ ID NO: 4220
  misc_feature (1)..( 3000): 2750-1469P.txt file - cDNA_ID_1807149; gDNA_ID_1620691; Annot_ID_48611

SEQ ID NO: 16918 - DNA, 3000 bp, Unknown; identical to SEQ ID NO: 4220
  misc_feature (1)..( 3000): 2750-1469P.txt file - cDNA_ID_1807149; gDNA_ID_2926159; Annot_ID_139647

SEQ ID NO: 16919 - DNA, 3000 bp, Unknown; identical to SEQ ID NO: 14172
  misc_feature (1)..( 3000): 2750-1469P.txt file - cDNA_ID_1807153; gDNA_ID_2214704; Annot_ID_136934

SEQ ID NO: 16920 - DNA, 3000 bp, Unknown; identical to SEQ ID NO: 7668
  misc_feature (1)..( 3000): 2750-1469P.txt file - cDNA_ID_1807165; gDNA_ID_1621156; Annot_ID_57019

SEQ ID NO: 16921 - DNA, 3003 bp, Unknown
  misc_feature (1)..( 3003): 2750-1469P.txt file - cDNA_ID_1807205; gDNA_ID_1620748; Annot_ID_49748
gcacccaaccaagacaacgttataagaacttaagaagagcaaaccataagcatacttagttaaggtttttaacgaggacaaggaaacgaggaaattaacagtgcataaagaatatatagataccaaatggaatgaatgttttttttatatataattaaatcgaataaatgttattagtaatagtattactaaaacaaaactggtgaaacgaaacagaaatgtgatttaaatggatataataactagaaaatttgatcaaatgcttcgtatgatttacctataggcaaaacgttcgtgttcgatacaaaactaaaaacaaaaatctttgaaaaatacattgttatatcaagctaattttctaaagatgcgggagctagtggaaattgtgatttcaaactccttggttgatcattgtaaagaataagaaaaaaaaaacacgatcagaaatcataatgaaaccaatgctcactttttgttccaccattttttagatggacccggtaacaattagtggatctagaatcttcagtttggattataacttatcgaaaacagtttagtattttgactcaattctgtacattggaatcaattatgaacaaatttcattatatatagttagctcatcttattcttcttaatttgtgttccgacataaaaaaacatagaaaccgaaatagattcagttagcattcacttcttattgagaaaatatgtaggttaaaattgtaggtttttgccatgcatattaccgacgtagataggtttggtcggaattttttctacttctttaataagtttggttagatcattcatcttatatgaatatgtaaagaatgcttttaattatggtcgtttcgtttctttcaccagaaacaaggaatgtccgagattcacttattaaattaatatatacttgatctgattcacacgaaaagacaatcttggagtatcaaactataatatcacttattatactttgaattactaggaatttttatcctccgatttcataatgatcctactaacattggatcacaacaagttggctcggttatgaatttggtttgcaacatatacagtttttcaaccgctgttaattttagtgttaatcaattatcttggataattgttgatgcaagatcagacattatatccatatatataaatatgttatatagatatgtattaatatctttagccaaagacgataagtctaaaatcatcaacattttttgtccgggtcaatgtaacaactaacaactcctactgtagactagctagttggtcgtctgatcgtctctctgtttgttagcgatctcaacgggtacatgaacagatagttatgcattattgatactcaaattttcttagttgttatgtttttaatatgtaactagattttaatccgcggtacaccgcggagataatttatttttttaagttaatatatataaaaattttgcaaattatatctatttataaattatttttattttatagtttacaattgttattaagtaacgtccttccaaacccgttccgccaaacccgtcctgtaaaaaaagctcgcggtaccccgctaatttaaatttataattaaaataaatattttacgggattgcaattgtgttttagtttgtcaaacaaaattttgttttaaatagttgtcgaaatctagttcaaattttgaagaaataagatttagtgaattgataaaaaatgtatttagttgcgttttgctcattttaagggattgcaattgtcttttgggttgtcaaacattttttgttttaattagttgccgaaatttagtttaaattttggaaaaatctgcgtgatatatgggattggaatatatttagaatgtttttcgtttgttaatcaatttattgctaaaaaactaataattaaaagtcagtggcagcctttgtaaataagttccaactccaggatttatttcacaaaatggctgcaaaaatgtatatatagattcacccatttatttattattcatagtattatagtactatcttcgtgtctttttacttggtgtttaaagtttttgtacaccgattgaatcatttttaattttatttttttaaacatcaatttatctaattaaccaatagaaaaaattatctgtatattataaatcatcaaaaccaataaaaaaaaactaattaatattgcattaaaaattaaaaacatcatctaatttagaacattttttcctactataacattaacatcaactaaatacggagaaaacgttgtactgaggttcttgcattttaaaattttggaaactaagaatgttaaaaaaattatggttacaaatatatatatagtgttataattagtacttatcgtacttaataaaaaagatactaattagttgttgttatattattttctacaaaaataaaatcattcaactaaaatgttctatttgtcagtcgcttcacaaaactatgcatctaccataccagtgatcataattataaaactctgtttttgttttttgtctttacaaccacttaaatacgtcatagctatatatgcattattacaagttctcaaggtggcgcgcgaatgttttaattaaaatattatgtttttcttatgtatttcatctttaatcgaacatagaaaatgtgaaagatttggagcatagacacgaatcagttttttttttttacacgaatcaatattcatagggtaaataatagacaaacgccaacaaaaaaaaaaaagagaaattcacaacggattatcggctcaaattacaaaacaaaaaaaaaatacagagacaacagtatacgtgtaactttccgaatttttttttttttcatatcaaaaataaaagataggccaagataagaccattataaaatgtaaagaccgacccgaaataatactcatgtttaaattatcagcaaagagccaagagaggaaacatcacacattggtgacaaaaattcttaggaaaaccaattaatg

SEQ ID NO: 16922 - DNA, 3003 bp, Unknown; identical to SEQ ID NO: 16921
  misc_feature (1)..( 3003): 2750-1469P.txt file - cDNA_ID_1807205; gDNA_ID_1620748; Annot_ID_166720

SEQ ID NO: 16923 - DNA, 3003 bp, Unknown
  misc_feature (1)..( 3003): 2750-1469P.txt file - cDNA_ID_1807213; gDNA_ID_1620671; Annot_ID_48161
aagttttagaaaatcattattattggaacataaggaatatctttaatcttgaaaattttgaaactggaaaaataaattaaaatcttttttttaaaaaaaaacattgattgaaaatatttgaatttagttatatgaatactattggttcagagttatggaaaacagaaaaatgtttaatgtcactgattcagtgaatggtgttgtcataatgtgtcttaatttatgtgaaacttttacaaaaatcattatttttaagaacaaatgaagtatctttctgtagaaaattttgaaatttgaaagagattttcatctcaattcatttattgtgaaatggttatataatgaagtagacaagaaagtctattccttgtattttattacattaagtcgccgagaaaacttttttgctttgttggagtgatcggaatggcgaatgcatcacagttatctccgacaaacaaacacttcttcaagcctcttctccccggattccagagaaacctcgtacggaatctctctgtctctgtctttctctcaatctgtatgaacttatagtctcacggttctgtttctctgttgcagaatattcctgtgaagttcttctccgagcacatcgagggaaaacacgagggcgagactgtaaagttgagagcagatgcgtcgaagagaacatgggaagtgaagatggatggcaacagactcaccgaaggttggaaagagttcgtggaggcacatgatcttcgtatccgcgacttcgttgtctttagacacgaaggagacatggtgttccatgtcactgctttgggacctagttgctgtgagatccaatacccacagtctatcagccatgaagaaggcgaagagagtggtgaagttggtatgattgaatcatcattcagtgaccacatttacatttatttagactcttttctattcttgaaacgtttcaatttctgattcagaaatatccgagagagaagttgaggagaatttgcaaaaagaatatgatcagtcttcagcagatctgaattgttttagccaatccgtaacgcactcaaacatatcaaatgatcttgtggttagtcagattaacggtttctttggtgttgttatgtttatttatagttcaaatctgtgtgagtgtatataagtcccaatgcaatttgatgactgatgcagactctgcccagggatttcgcaaaacgaaacggtttagacaaaggaatgcatgagatagtattgatgaatgaagaaggaaagtcatgggaatcagaagtaaggagtagaatgtctggtcaggtttttattgttggaggttggaaaagtctctgcagcgaaaataaattaaaaggtggagattcttgcacattcaaactgctgcaaaatgcgaaaacgcccgtgtttcagctctgtagccgcatcggagaaagtcggtttgtgaagttaactcctacactaaacagccttgagattggcaaacaggtgacttttcgaaacctctatctctggtttcttcagtgcagtgtctttttaattctgaatacttttgcagcatctaccggtaagtttcacgaaagggaatggactcatacatccgggggagataattctggtggacaaagacagagttgaatggtcgatgaagcttcaggttgataatagaggagggatgcatatatttggtggtaatgactggaaaagtttctgtgccgcaaatgaagtaggcgcaggggagtcactaactttggagttgattcgaggaggcttaagtcctttattcaagttcttctccaaggtcagtatttcaaatagcttgcagtccacgttttaggttttgctaaatcaaacaacgacttgttttcagatagagcaaccctcattcgaagcagaggataggagacacaagagagctcgagtccataatgggagccaggaaacagataagggagaaccttctcgagcaactaaaatgggaccggagcttgagaaaagggagaagacagctgaaaaaggagaaccgtctcgagcatctaacaaatccagtggtaaacaaggaaacttacagaaaacgcaagcttgctctgtcacagatcacgtggctaaggtgaaagagagcgttgtagatactttaactagtatcagacggttccaagcagagcttgaaacaatggaacagaaattagaagattcattgcaggaaatcaacaagttaagttaggtatgatctgtaatctgtaatattatcattcttataacaatcttttagtttcggttttggttttgttcaaatttctaacaatttgaatttggcacagagagaggagaagataacatcttcaagtaataatcaagtttaaatgtgaaactgaagactcttgtaacctctgtttttattatatgactttgtttaagatgtagttgttttattttcccttttttcattttgttaattaatcgtaaagtttataatgttcttgttctctgttggcggactaatgtcgtatttccataatatttattaattagtatctgataagtgataacaacttaaaatggttttttttttttccttatctgcatcactgcattgaaatggtaaacaaaaaatgactttatctgctgcaacaagccatagccaaaaacaatacaaaaccaatatacagtagttttttttttttttttgtcgtaaccaatatagttttattaaggaaaagaaaagtaatcatagccaaaaaaaggaattattacaaggtaacgacaaaaaacgtagttgaaaaaggaaaacaaaaaagcatataaaggcccaatctttgtaattgcattggaaaggcccaaacccaacaacatagaacactgtcttctctactaagtaacaaaaatcaacgaagcggtaattcttgaacagacaaagaaaaaaaaaaggtgaatacttgaaatatataaaagatacagaagacacgagaagggagaagagatcgatgattttgagaagcgaattagatg

SEQ ID NO: 16924 - DNA, 3003 bp, Unknown; identical to SEQ ID NO: 16923
  misc_feature (1)..( 3003): 2750-1469P.txt file - cDNA_ID_1807213; gDNA_ID_1620671; Annot_ID_164115

SEQ ID NO: 16925 - DNA, 3000 bp, Unknown
  misc_feature (1)..( 3000): 2750-1469P.txt file - cDNA_ID_1807213; gDNA_ID_2926200; Annot_ID_141478
ttttagaaaatcattattattggaacataaggaatatctttaatcttgaaaattttgaaactggaaaaataaattaaaatcttttttttaaaaaaaaacattgattgaaaatatttgaatttagttatatgaatactattggttcagagttatggaaaacagaaaaatgtttaatgtcactgattcagtgaatggtgttgtcataatgtgtcttaatttatgtgaaacttttacaaaaatcattatttttaagaacaaatgaagtatctttctgtagaaaattttgaaatttgaaagagattttcatctcaattcatttattgtgaaatggttatataatgaagtagacaagaaagtctattccttgtattttattacattaagtcgccgagaaaacttttttgctttgttggagtgatcggaatggcgaatgcatcacagttatctccgacaaacaaacacttcttcaagcctcttctccccggattccagagaaacctcgtacggaatctctctgtctctgtctttctctcaatctgtatgaacttatagtctcacggttctgtttctctgttgcagaatattcctgtgaagttcttctccgagcacatcgagggaaaacacgagggcgagactgtaaagttgagagcagatgcgtcgaagagaacatgggaagtgaagatggatggcaacagactcaccgaaggttggaaagagttcgtggaggcacatgatcttcgtatccgcgacttcgttgtctttagacacgaaggagacatggtgttccatgtcactgctttgggacctagttgctgtgagatccaatacccacagtctatcagccatgaagaaggcgaagagagtggtgaagttggtatgattgaatcatcattcagtgaccacatttacatttatttagactcttttctattcttgaaacgtttcaatttctgattcagaaatatccgagagagaagttgaggagaatttgcaaaaagaatatgatcagtcttcagcagatctgaattgttttagccaatccgtaacgcactcaaacatatcaaatgatcttgtggttagtcagattaacggtttctttggtgttgttatgtttatttatagttcaaatctgtgtgagtgtatataagtcccaatgcaatttgatgactgatgcagactctgcccagggatttcgcaaaacgaaacggtttagacaaaggaatgcatgagatagtattgatgaatgaagaaggaaagtcatgggaatcagaagtaaggagtagaatgtctggtcaggtttttattgttggaggttggaaaagtctctgcagcgaaaataaattaaaaggtggagattcttgcacattcaaactgctgcaaaatgcgaaaacgcccgtgtttcagctctgtagccgcatcggagaaagtcggtttgtgaagttaactcctacactaaacagccttgagattggcaaacaggtgacttttcgaaacctctatctctggtttcttcagtgcagtgtctttttaattctgaatacttttgcagcatctaccggtaagtttcacgaaagggaatggactcatacatccgggggagataattctggtggacaaagacagagttgaatggtcgatgaagcttcaggttgataatagaggagggatgcatatatttggtggtaatgactggaaaagtttctgtgccgcaaatgaagtaggcgcaggggagtcactaactttggagttgattcgaggaggcttaagtcctttattcaagttcttctccaaggtcagtatttcaaatagcttgcagtccacgttttaggttttgctaaatcaaacaacgacttgttttcagatagagcaaccctcattcgaagcagaggataggagacacaagagagctcgagtccataatgggagccaggaaacagataagggagaaccttctcgagcaactaaaatgggaccggagcttgagaaaagggagaagacagctgaaaaaggagaaccgtctcgagcatctaacaaatccagtggtaaacaaggaaacttacagaaaacgcaagcttgctctgtcacagatcacgtggctaaggtgaaagagagcgttgtagatactttaactagtatcagacggttccaagcagagcttgaaacaatggaacagaaattagaagattcattgcaggaaatcaacaagttaagttaggtatgatctgtaatctgtaatattatcattcttataacaatcttttagtttcggttttggttttgttcaaatttctaacaatttgaatttggcacagagagaggagaagataacatcttcaagtaataatcaagtttaaatgtgaaactgaagactcttgtaacctctgtttttattatatgactttgtttaagatgtagttgttttattttcccttttttcattttgttaattaatcgtaaagtttataatgttcttgttctctgttggcggactaatgtcgtatttccataatatttattaattagtatctgataagtgataacaacttaaaatggttttttttttttccttatctgcatcactgcattgaaatggtaaacaaaaaatgactttatctgctgcaacaagccatagccaaaaacaatacaaaaccaatatacagtagttttttttttttttttgtcgtaaccaatatagttttattaaggaaaagaaaagtaatcatagccaaaaaaaggaattattacaaggtaacgacaaaaaacgtagttgaaaaaggaaaacaaaaaagcatataaaggcccaatctttgtaattgcattggaaaggcccaaacccaacaacatagaacactgtcttctctactaagtaacaaaaatcaacgaagcggtaattcttgaacagacaaagaaaaaaaaaaggtgaatacttgaaatatataaaagatacagaagacacgagaagggagaagagatcgatgattttgagaagcgaattagatg

SEQ ID NO: 16926 - DNA, 3000 bp, Unknown; identical to SEQ ID NO: 16925
  misc_feature (1)..( 3000): 2750-1469P.txt file - cDNA_ID_1807213; gDNA_ID_2926200; Annot_ID_201792

SEQ ID NO: 16927 - DNA, 3003 bp, Unknown
  misc_feature (1)..( 3003): 2750-1469P.txt file - cDNA_ID_1807217; gDNA_ID_1620836; Annot_ID_50813
atacaccctccggttttattttattttatatggtaacttaacataacctaaccgggaaacatggatacaaattgtatttggaaccaaaccaaaccggtttgtaaccctaagtaaatcgtgttgacttgaaccggatataaataatcattccggtaatcaaagatggttatgtgatgtttctcttcttgattgtgttacagaaacaagccgatgtgaacttcttcttgctgcttatgggcctgttgtgtcatttgctgccattattgttaaaatatgcagcaaccggcgaagtatcgacctctatgattaacaaaatgtcgctcactctgtcgcggacaagcagcatagttatgcttattgcttacattgcttatctcatcttccagctctggactcaccgccaattgtttgaggcacaacaggtacctaagagttacgtcatgttttcatgcgaataaaatgtatctataatcaattttattggtatctaggatgatgatgatgcatatgatgatgaggttagtgttgaagaaactccagtgataggattctggagcggatttgcttggctcgttgggatgacaatagtcatcgcattgctatcagagtatgttgtggacacgatcgaggtactgattatgtcgatatacgtttgaatcccaacatgaaaaagaaagaaagaaactcacaagattaataaggaggtttcatgttggtcaggatgcatcggactcatggggactatcagtgagtttcataagcatcatattgcttcccattgttgggaatgcggctgagcatgctggagccatcattttcgcattcaagaacaagctcgtgagttttcttttttcttgctttacaagtattctttgtttgtgtttggttttatgtttagtgtgaatttcttccaaatgaacccacaatatttagcattgaaaaaaaaaattgttgcaaaaatatcttataaaactccaacatgtaacactgcctgaaatctatttttgtggaatggttaattataactacaggacatatctctaggggttgcgttgggctctgcaactcagatttctttgttcgtggtaagttcttcttcgccttttatattatgttgaaatctgaaagatgacaaatgttgcgtgcaatataagaaatctaaggcaatgttaatgtgtgtgtttcatcaggtcccattgagtgttatcgttgcgtggatcctgggaataaaaatggatctcaactttaacatccttgaaactagctctctagctttggccattatcatcacagccttcactttacaggtaaaacgttttgctttaaacacaagtttgatttggttgacctttctagttaatcattatcgtttgtttttgggccggttaggatggaacttctcattacatgaagggactggttctattgttatgctatgtcatcatcgcggcgtgtttcttcgtcgaccaaattccccaaccaaatgatttggacgtgggacttcaacccatgaacaatttgggagaagttttctcagcttaaagttatcaaatgacttgtaaaaaaagaagaagagaagaaatcagcaaattatgatttgattgattcgtcatccaaaaacggagagactttgtcagagggattcctcaagcatgaatgagggagggagcttgatgaagacagaggttcttggtgtttaagaaatgatcacattaatttctgtttgctttctttttctgtttgttgttggcatttttaagtttttcttgtatattatatgttcttttgctgagtaatgtggactatattttctgatatattcgtttaccttacagacttaactgatgatactgtatatgcaactttttctttttgagttaagttgcaaattagtcactttttaaaacttaattggaaaagtagtcactttattatttataatttgcaaaatagtcatttttcattgtttgattcgtacacttagattgtacaccacttttagtgtacagatatatataaaaaatacacagcgtacactttacatttgtacactaaaagtgatgtacaatccaactgtacgaatcaaactgtgaaaagtgactactttacaaattatgaatagtaaagtgactattttcctaattaagtttgaaaaagtgactagtttgccaacacaccctttttttttaatttaccccaagatacatgtagaggaataaaccaaaaatgaagttttccctatcatatatcatggtgcatgaaaaatgttaaacaacttcttgtagcataaaccagcaacagaaacaatcaacaaattgtggaagcattgccataaaaagttatctaataagataagacttccttgcactgcaacaatctttggttgtggatcccaattacactcacatatacaccatcatccccttcttgtccttgagtccatttgagatacacattgttactaatgttgtcaaaaataaaaatcaccatacaagaaagtggcttctgaggttcatcacaaattcagcaaaaactcttgttctgctttaacataatgttagtcttattcatacacacaagcatataaataaaaatgggtgtgttggcaaaatagtcactttttcaaacttaagtggaaaagtagtcactttactattcataatttgcaaaatagtcatttttcactgtttgattcgtacacttagattgtacaccacttttagtgtacaaatgtaaagtgtacgctgtgtatttttatatacatttgtacactaaaagtagtgtacgatgtaagtgtatgaatcaaacagtgaaaagtaactattttacaaattatgaatagtaaaatgactacttttccaattaagtttacaaagtaacttaactcaattataatttggtttataaggaaacgtgtgggaccaatctcaagtagacgaaaccatttcttaaggtttttgaaaacctttgcgtcttatcttcttcttccctctctacaacatg

SEQ ID NO: 16928 - DNA, 3003 bp, Unknown; identical to SEQ ID NO: 16927
  misc_feature (1)..( 3003): 2750-1469P.txt file - cDNA_ID_1807217; gDNA_ID_1620836; Annot_ID_169904

SEQ ID NO: 16929 - DNA, 3000 bp, Unknown; identical to SEQ ID NO: 12104
  misc_feature (1)..( 3000): 2750-1469P.txt file - cDNA_ID_1807221; gDNA_ID_2214531; Annot_ID_134280

SEQ ID NO: 16930 - DNA, 3000 bp, Unknown; identical to SEQ ID NO: 12104
  misc_feature (1)..( 3000): 2750-1469P.txt file - cDNA_ID_1807221; gDNA_ID_2214531; Annot_ID_184931

SEQ ID NO: 16931 - DNA, 3003 bp, Unknown
  misc_feature (1)..( 3003): 2750-1469P.txt file - cDNA_ID_1807228; gDNA_ID_1620645; Annot_ID_47590
aaaatgttgaatcactgaagtacttttctaacaatgagaatgacgactgatctttatctctatttcaaatagcattgttctggtatatcttttgaatgatttcaaccataaatattctagtaacatgtggaattctaactagctttatatatatatataatgtatattaaatacataatgtatttctgtactgtatgcatatatatgttaaatcatgaaatgcaaacatatgattctctttagttattgttattaacagaaaaaaatttacattttcagataattgtactcttctcatgtctttaaaacatcatattagaggaatatttatgtacggaggttcacgtaatatagtgtataactgtaacttttcccaaagttttataatttcaaaaccaaaaaaaaatggaaacttttggttggtagatttttttaaaaacaaatctgccaaatcgatactttctttgtttaatggaccagtgataaatagatttagagaaagaacatttttaatctcttttacatttttaatagttagttccacattaacatgttctgccaattaatttgggggttaaggactgttcttgattcaaatatattttttgtttaattgtttaataaatttttggtagaagtttacttttgtaccagtgataaacagaatagtaattttatattttacataaaatttggtaggcattaactattgtaatcaaatttccttgataagcacaacaagatcagatgcatgtggaccctcatgatcattttagcttagatctccaaaataccataactgccgctggttattattctatgctatttagcatttgtttctaaatcgtttttatagttgacacttaacacatgttgacactactttagtacatagaccatagtttcaggttatttattgatttttaacaatgtatattagtatgatttatgaaaccatatatatttctctttcaacagaaaacacttattgtacatgtgacatattttgtcacatcttcgatagaaatacatatttttaataaaaacaatatcctaattcctaattaagaaattccggagatccaaggtgactgagaattcgcaatagagtaccatgaatcataaggtctaaaacttgcaatatgcatcggccagaaaagatgacacaattactctagcgtttgtaatgatatcaaaatactaaagaaagatgggataattatgcattttacgcgctagaaatatgtgtagtataattattttttggatttactgttgtaaaattcgtcagaaatgcaagtcactaaacaacagcaacaccacagttgtattgttatatatcagtataaatttatattcatatgatataaatttagcttctagaaaagtagctagtcactaatcaataaaaatgcataaaacttacactatcaaatgatttcaatttgcataactacaactcatggatttcatggtaaagaaacttagaagctactacaatagaccgtggactatttctaaacaaatgcaataatgaaactgtttaaaagctattaccaaattttacccgcaaataacattatatttgtttctggagccaaaattaaaagtccatttcctatcttgatttatgcttgtacccatactatatcttcaatgtttcgataattagtaattactccaatataaatatatatttttttaaagtttttgtttttactattactttttttatgtttaaactttttaactcactaatcttttttcttacaaaacctaatctacttttactctctaaatcggtggactatatatatatatatatatatatattctcttcttctatgacaaatatttgtctcatttatatttactttgactaatagcataattacacataatataatagcacaaaagataacaattcacttgtgaataaaaaaaggaacgaccgcatcgcatgcattagttaataccgttgctggaattgcggttcacagggctctataagtcccgtatccataggatccgacacgaaaatatattattttcctatatataaaatagaaaataaagttgagagataacagaagaattaaagttgagaaaattcgaaataaaatgataaaaaaaacattaaattactacaacaactcgtgggtgaaaaatgactttaaaacatattttaaaacttaacaatatcctattttaaaatttcaacaaaaaaaataatatagatatgaaaatccgagcattacagacaattagcttaggaaagagaaacatagtcctaatcaccaaatgttaaacacagtgtaagagattttgtcttctttcttttgtctaagattttaaaacaaaataaaaataacaagagagagagagagagaaagattagtttaagaattaaactgctaattaaatacgaaacagtaatcttctcttcaaatgcttataaaaaggcccttcacaatctctcattcaattcacacttcacatttggatatctctctaagtctctctatactttcatttctcgtttcataatattaggtaagtctaattaaatatctcatctccttaatttttttattcgctcactaatctctctacacctttcagctaaacacaaaacaaccaaaagctcaggttcttgtgttttggtcctctgtttatttcttgctcaaaaaacaaccaagagctcacttgctcttaatcacaaactgagacttttctcagtcttcctctgctttaactagtttacttgggacagattctgtataacataaacttaaatcaggacatgtaactgaaacatgtcaagtttctaaatttaacttgagttctaaaaccgttaacacaaacacaaagctgtatgctttcctctctgtttctatgctctgttttccattttttgctctctgtcctctcttgcttagtaaggtctgtttttttttttgcaggaaacttgttagtgtttaaggaaacaaaaggaagaagatg

SEQ ID NO: 16932 - DNA, 3003 bp, Unknown; identical to SEQ ID NO: 16931
  misc_feature (1)..( 3003): 2750-1469P.txt file - cDNA_ID_1807228; gDNA_ID_2926175; Annot_ID_140310

SEQ ID NO: 16933 - DNA, 3003 bp, Unknown
  misc_feature (1)..( 3003): 2750-1469P.txt file - cDNA_ID_1807232; gDNA_ID_2214483; Annot_ID_133306
aggttggaaaaatttaatgatacattgtacgttttctaggttttgttctaaatgctcataaacctacttggatttggaaataaatgagagcttacatatatagaacaatactctatttccacaaaaattatttgctactcatatacaaatgtaggtttagaaaaaatccactttagcaaaaagagatgggaaattaatgaaaattcacttgactttctttgttttgtgagcaattttcgatttcaaagtaatggtcggacttagactttttcctgttcttttttgctgacttaataataagctgaaacttaacagttagaagttggaacaagatataaataaaaaagctaagttgtcaaacataaagttgaaaatgatttggtgatgtcaattaaataaaaagttgaaaactaatcatttgtatttgaccggcggttacttggaataagactaagaattattgtactttctatttaatgggtttgctaagttttttatcagatcattttaagcaaaatatcgataacttttcgaagagattagttgaaaatactaagcattatatatatttaaatatgatggatcagtatatatagttttgaaaatcacactgcaggatccgttggaattggtggctgagaacttttatgatcttcttaaaattttaatccgtaaataaattatacgagttggattggttcgcgtcttctaatgcgtattgacatctataataaaagctatcagaaaagttgctgatctttttctgtatcttattaaatatgtagacccgagcagagaaatgtggatcaattaataaatatcatgtacggatgaacaagagagaagaaaaaagtataataatactatagagcgaaaagtattgcatgatggagaaactctcaacaatttcaaacatgaacgacttcttacaaaacaatgtatctttagttgtcacaatctttgaaattctacaaatagagaagacggaaaaagatgaaaatgaaattagtgtttttctttggcaaggtccttggatctcttaaaagtgattagatcaacggtaatgttttagatatcctacatgtgcattgattcgataaaagcatttaaatagtgaatattacaaacaaaaatagatacttacatcatgaaatagaaacaaaatcaaactgggttgctacttaccagtaatcacgtgacggtaactggctaactgcaatagtatatccaaaacaactttaagaaatggatacgaaatgttttagttttgggaaaatgtcaaataaagatttcgtcacaaatccatcaatccagtatagaacacttttatcaaaatgattttgcaaattgattcttagagtacgatacaagttgcaaactggaaaaataattttgcagttgcaacaaataataataaatgattgtgcaaattgattctcaaattaagtaggaaacaagttgtagtagatatagactgtttttacatgatgttaattccaaaaggattcattgccatacaaatggttttctcatagaggacgtaatatcaattaatggaaaatagtagttgaagatttatagaagaaaaaaaaaactttccgcaaacaacactatatatatatatattggatcaaaaataaaaagagttaaatgaaagaaatacacagacctggcctgtatcaaccaactcatatattattatataaaccaacatccatttctcagctcctcatcaaattatcttctttctctttctctctgatcatttccaaattatttctaagctaagaaaatctttaaaaataacaaagcttctaaaataataatccgacctaccggattcaaaccattgatctgaagatcatctataaaccagtccttgatctataaactaaaataaggtcggttgcttaatctttgttacccttttatttttgtggttataattatattatcttcattttgtttccttttatgattaatcgatcatatcaggatagatatttcgttaagtttatagtttaaatccagaattttatgtttagaaaagagaatgggaagagttgaagtgtttaacgtctatgaatattcctcacgtcaagaaaaaagaaaaaaaactatgaatggtcctctctcgatgtccttacattggttagagagcgttgcaactacaatacatacatcactttcatcatatttattgtctttttcagaggttttcatatttcgactgaattcttcaatttgcaatattatgaataatagagaagatgatgaaaaaaggataaagagagtgaagccagggttatgcatgctctcacgtttagggcgtgactctaaactagcgatttagtttacggtattattaaaaataatattagtcacataatatttgtaattttagtcgaaattaatgacagaaaaatactagacgctaggatttgtacttccttgaatccttggaaaatatacgtatgtaattaatattattcattatcaaaccacaaatacggaaaccaagtttgtgtcaaatccaaatggagtagtttggtatcttaggttgttgtttatcataaatgagaaactttggggttgcactcgatcggtatggttaggtggaccggactggtgacaattaatgccattgatctataactgttagattataatctaaaggttccattgcagaacaattcatcaaactttaatatctatgtatttatgtatgttcccaactcacagaatttcacggaattgcaaaactatgataaattctgctaccttaatgaatacactatgaacttgactaaaaaaacaagaataaagtatgataaattccctcattttatatttctcttatctatttcacatttttgcttgaaaatttgtaccattaatctctctattcggcagtgttaaattttattatttaactccgtcggttggattcattttaaatttctcttcagggaagaaaaaaacaagagagagaaatagagaatg

SEQ ID NO: 16934 - DNA, 3000 bp, Unknown; identical to SEQ ID NO: 11091
  misc_feature (1)..( 3000): 2750-1469P.txt file - cDNA_ID_1807236; gDNA_ID_2214478; Annot_ID_133168

SEQ ID NO: 16935 - DNA, 3000 bp, Unknown; identical to SEQ ID NO: 11091
  misc_feature (1)..( 3000): 2750-1469P.txt file - cDNA_ID_1807236; gDNA_ID_2214478; Annot_ID_183201

SEQ ID NO: 16936 - DNA, 3003 bp, Unknown
  misc_feature (1)..( 3003): 2750-1469P.txt file - cDNA_ID_1807240; gDNA_ID_1620716; Annot_ID_49114
atcaactccaccaaaaacaaaacgagtagtagtacgtcgttcattagcactattagaagcctttgaatcatattagcaaaaactgctatacgtcattttgtccaaagaggacgtttaccaaaagaaaatagataacactaaaattaggcatgtgataaacactccaacccccaaaatgtacaccgccctattctcaccaacctcttctgactcttctctcattttctgttgttcacaaataagttaacgtggtaccgaactaccgatttcctccactattttattgaatttctggtcaaaaaacttaagtgttacataacgaatctataaaaagaaccctcactttcaaggtttttgtcagcaaaacatttgtcttcgtgtttgaaagctagataaaagattcactaaatggccaccgcaagcaccgctgctactttcagaccctcctccgtttcagcttcttccgaattaacccatctgagatcaccctccaaactccccaaatttacgcctctgccatcggctcgctcacggtcctcttcttcgttctccgtctcctgcaccatcgctaaggacccagctgttgtcatggcggactcggagaagattaaggccgctggatctgatccgactatgtggcaacgacctgattcattcggtcgtttcgggaagtttggcggcaagtacgtccccgaaactctaatgcacgccctctctgaactcgaaacggctttctattcgctcgccaccgacgaagatttccaggtatgcctgctgattttgtttccatcttgttcatagtttttgaatcgattcgaaatgatttggctttgtgagtttctgattcaagcgttgtcattgccatggctagtgataaagtttaaaaaacggatttttttgttccaattctaaaaaataatctgccaaacaatgttaagccgtatgggacaaatcgatttgtttgcgatgtaggatgtaattctgggaaagtgttgtatttttccagaaatctggaaacgacattcatttcatattcttagtttcttcagcattacatgcttctgtgtgatgtaagttagaagtctttttggttagttcgtttgttgggcaatgtctaactaatgtttgatgaatctgtagagagaattagcagagatcttgaaagactacgttggtcgggaaagtcctctttactttgcagagaggctcacggagcattaccgccgtgaaaacggtgaagggccgctcatatacctcaaaagggaagacttgaaccacaccggtgctcacaagatcaacaacgctgtggctcaggctcttctcgccaagcgtctaggaaagaaacgaattattgctgagacaggggctggtcaacatggtgtagccacagctactgtgtgtgcacgtttcggtttgcagtgcattatctacatgggtgctcaagacatggagagacaagctcttaatgtgttcagaatgcgtcttctcggtgctgaggtgatgtgaattctctgcgtaaaccttgcaaaatcgcaatgctttcaaattgttatctaagtctgatgcttgtaggtaaggggagtccactctggaacagccactttaaaggacgcaacttctgaagctataagggattgggtgaccaatgtggagactacacattacatattgggatccgttgcgggtcctcatccttatcctatgatggtcagagactttcacgcggtgattggtaaagaaacaaggaaacaagcgatggagaaatggggcgggaagcctgatgttctggttgcttgtgtcggtggtggttcaaatgctatgggactcttccatgaatttgtcgatgacacagaggttcgaatgattggtgtggaagccgctggatttggattggacagcggcaaacatgctgccacattgacaaaaggagatgtcggtgtactccacggagctatgagttacttgctgcaagatgatgatggccaaatcattgaaccacactccatcagtgccgggtaagagattcttctctgttcaaagttggttttaagccacatgtatctggtcacctgtatctaaagagtaaaagttgatgttatcagattggactaccctggagtcggacctgagcatagtttccttaaagacgtgggaagggctgaatactttagcgttactgatgaagaagcattagaaggtacttacttgacacttcatttttctccttttagatgtttctttcacaactcatgagaacttgcattgtgtattctaatctatgcgtgtagctttcaagagagtgtctcggttggagggaataatcccggcattggagacatcgcacgcattggcccatctggagaagctttgtccgacgttacctgatggagccagagtggtattaaacttcagtgggagaggcgacaaggatgttcagactgcaatcaagtatctcgaagtttaaagagtgtagattactttcattttcacacagtgctatttcttttatgtagtttgttagttctccttgcttatggtcgggaatccaaaagtttggatcaaagggttaagaagagaataagtgttatgaatgtatcatataaataaaaatgttctatggaacgtttgatgttcttataagcaattcgaactgttttgttcttgacttagctggttttccctttcatatcttaatttcaccaatgcttagaaaaaacaactctgatcgaatgatttataaacaactctgctctttaatggtgatcattgtaaattcaaacttgtgtattgtttgtactaatttgttctgatagaaactattttgggttaaatgggaaacgggtcaaagcatagggggctagtgttgtaatttagtagattggggaggagtttcaaatctgaacgctgaagataaatcacaagggaggtgcttcgtcctcgaagcttttagaacttagccaagcagctgttgtttcttagttgactccctctccgacgaaaatg

SEQ ID NO: 16937 - DNA, 3003 bp, Unknown; identical to SEQ ID NO: 16936
  misc_feature (1)..( 3003): 2750-1469P.txt file - cDNA_ID_1807240; gDNA_ID_2926190; Annot_ID_140993

SEQ ID NO: 16938 - DNA, 3003 bp, Unknown; identical to SEQ ID NO: 16936
  misc_feature (1)..( 3003): 2750-1469P.txt file - cDNA_ID_1807240; gDNA_ID_2926190; Annot_ID_200965

SEQ ID NO: 16939 - DNA, 3000 bp, Unknown; identical to SEQ ID NO: 14064
  misc_feature (1)..( 3000): 2750-1469P.txt file - cDNA_ID_1807244; gDNA_ID_2214695; Annot_ID_136808

SEQ ID NO: 16940 - DNA, 3000 bp, Unknown; identical to SEQ ID NO: 14064
  misc_feature (1)..( 3000): 2750-1469P.txt file - cDNA_ID_1807244; gDNA_ID_2214695; Annot_ID_189518

SEQ ID NO: 16941 - DNA, 3000 bp, Unknown; identical to SEQ ID NO: 12293
  misc_feature (1)..( 3000): 2750-1469P.txt file - cDNA_ID_1807247; gDNA_ID_2214542; Annot_ID_134484

SEQ ID NO: 16942 - DNA, 3000 bp, Unknown; identical to SEQ ID NO: 12293
  misc_feature (1)..( 3000): 2750-1469P.txt file - cDNA_ID_1807247; gDNA_ID_2214542; Annot_ID_185262

SEQ ID NO: 16943 - DNA, 3000 bp, Unknown; identical to SEQ ID NO: 12542
  misc_feature (1)..( 3000): 2750-1469P.txt file - cDNA_ID_1807259; gDNA_ID_2214558; Annot_ID_134831

SEQ ID NO: 16944 - DNA, 3000 bp, Unknown; identical to SEQ ID NO: 12542
  misc_feature (1)..( 3000): 2750-1469P.txt file - cDNA_ID_1807259; gDNA_ID_2214558; Annot_ID_185801

SEQ ID NO: 16945 - DNA, 3003 bp, Unknown
  misc_feature (1)..( 3003): 2750-1469P.txt file - cDNA_ID_1807277; gDNA_ID_1621091; Annot_ID_55516
aacgccatggtcctccaagctcaatgctcgtagctgcagccgctccaacatcaatgagaaccaggacagacgatcaggtgaacattccgacttcaagccagtgctcggtggggcgagaaagtgagaagcagagtaaagaagcattggacgttggtggagagaaagtgatggaatcagctaggactttgttgagcattggattcgaaatcaagcaatgctgattatatgtagtttatgagttttatagagttcatcgactcaattttcgcctccttgttcttgttatataataataataaaaaaccccatgaagattaccaactaaatacgttaacattcgtctgtgtaatgatggtatatgtttattgtgatattaaatcgctaattttagtgaatagcctctggttcgtctagagggtcttctgaaacttgaaagggactaaaagacgagaacaaaaaccctttctctctactctgtgtaaaccctagtgtgttcgtgctctccgatggcgagtcttcgatgctttcgtgagctgagccgccgcgctacgactgttttctccatcaaccagacgcgatcgatctcttcatttcatgggattgagttttccgggaccagcatttctcatgggaccgtaattccgaatcgatctctcactaggaatttgccatggtacagtcattggtatcgctctcaagatcgttgtttctcttcgaacacaaaggatactgatgaagatgaagaaagcagtgaaggagaggatgatgatgaggaggagggggaagactttgaggattcggcggatatggaagtagaaagggaatattcaccggcggagaaagtggaagaggcggaggagatagggtacaaggtgatgggtcctcttaaaccttcggagagacttttcaaaccctatgaaccagtgtttgccattgttcaggtctcgtctctgtgctatctcaattaatcctttagtttcatttctcactctcactgatgctgagtggttatttttatcctgtagattggttcgcatcagtttaaagttagcaatggggactccattttcaccgagaagttgaaattctgtgacatcaatgataaggtatgctagcttcaagctcttcttcgttaatctttgctattcttctctcaaagggctagactttaccgtatctctcgtaagaaggacgaacctttgcatttgtgtttatgatttatgattgttgctaaaacctttctctttatgtccctttgcagttggaactaaccaaggttcttctattgggctcggcaagccagacgattattggtaggcctattttgccagatgcgacagttcatgctgtagttgaagagcatgtaagtgtctcattgacttgcttggtgttttataatactagtgaagctgtgcttaagaataatttacaattgaaaagaggatagatgagagtttgcttgctgaatccggtgactgagagaaactaaatcaaactgtctgctgattagtttgtgaaagtcttgcaagtcattagattagtgttcatctatctctacatcatctgaatgtcttgatttaagatgggcttggaatgtagaaggatctactcatgtaccagcattactcaactagtttttccttgatgcgtgacaggctttggatgaaaaagtgctcattttcaaaaagaaacgaagaaagaattataggagaacgagaggacatcgacaggtatactttataactccttgtttagatagacagtgtgtttatttcatctttgccttcttctagttctttccactgtgttatgattgttgtttttgaccattcaacacttgtgtccaggaattgacgaagttgagaataaccgatatacaaggaattgaaaaaccagaaccgaagatcgtccataagccttcgaaagaagctgttacagaacagacgaaggctgagctagttgcttagagataaaatttgcttctttcttttttgctgatgccgatacatttgaagtaagttaaattatcacttgctgttcactaagaactagattttaaagtcgttgaaatgatgaaaaggccttcttggtagttagtggtaagtaactaggctcctgagatatgaaatgtgatttgcctttcactgtcttgttctccttgctcttcattttgtatttaaactggctcatgcttgtgggagctgtttgttgcttctgtttcagaaataaagatttgcggaaacatctctctccttatcttctctatgctttgtactttgtactgtactactgtggtttggttatggtttaatttacttcttcatgcaagtctcggtcacagatatgaaactggtggtaaattggtaataactgcaagtcacattacactcaaaatctcgattttttccactatgactctttagatcaggtgattattattgtaactatatatggcaaccacttcctcatcaacaaatgattcacagaattgatagtacttggaactgatttataatttcttttatcaacatcggaaaatcgtgtaagaatgccttgaaatatttgaatgtttgtaaatagtatcaaaaccattgtttgtataaatatgtataaagaacttaaacaaaagcaatttggagccaaagagaattataaagctacacgagtacgtaagtccatggttaagatcgggtcgggtggggacgggttggataaaagcaaacaatgagtcaagtaaaagaagaatcatcgtcaacaagagagagagagagataagcacaaacgcggcttttcttctccttataaataagagaagctcagtgcgttactcaaatggccgtcactttggtaacgtccttcgcttcttcgtcttctcgcttccatttccgctcattctcctcttctccgtcgtctctctcctcttgtttcgtccgattccagttcccctctcgccttagactcgcttttgccgtcacgcctctctactcttcttctagagccatg

SEQ ID NO: 16946 - skipped

SEQ ID NO: 16947 - DNA, 3000 bp, Unknown; identical to SEQ ID NO: 6015
  misc_feature (1)..( 3000): 2750-1469P.txt file - cDNA_ID_1807281; gDNA_ID_1620836; Annot_ID_50808

SEQ ID NO: 16948 - DNA, 3000 bp, Unknown; identical to SEQ ID NO: 6015
  misc_feature (1)..( 3000): 2750-1469P.txt file - cDNA_ID_1807281; gDNA_ID_1620836; Annot_ID_169898

SEQ ID NO: 16949 - DNA, 3003 bp, Unknown
  misc_feature (1)..( 3003): 2750-1469P.txt file - cDNA_ID_1807300; gDNA_ID_2214528; Annot_ID_134208
cgtttcctttgctgcagtaaccatgtagatcaacaagatttctttgttttaccttggagattgcatcgatctcggctattagggctgtcttttcttgccttgtgttgcaagtaattctctttacggcaattatctctgtaggagcaagttgccctttataaaaactcccagagtttccctctcccaaaagcttagagttgtcaaaacctcccgtcgcgctggaaatcgtctggtgggagaatttccgtgcgcctccggtgaagttttccgttctacgaaaaaagcaaaccgctaagaagcttaagatcaagattccaaatattgctgatgcagcaatgattatgatcagcatcgtgttactcgaatttttcatgactgaaaccggaggactcggggatggagacaatggaggtagcgggtctggaagagagggaagcttcgtgatatcaaagtctgatgctttcccctcgatgctgaagctccagcctagcacaaaatgtgagctcgtgacagttcccgtggctgcagagaatccaacataattttcttcagagatgatcccagaaagatttagttttctagagagaagaggcaactttggcttcggacgatctagaggagccaatgtgacattgagcatcgtctcagttgcgttgtattcgatccagactcttattggtttcccactcgccagcctcaaacttatgttctttgcctctcggtcatcaaaatattcagcggaggtagactcaatggagatcactccgttgaggtctataccaacatggttatcatcaatatcgttcaactcaacggcctgcacagtgtcgaattcaactgcaagaatgcaattcaaggagtttccattgttggaggtattgaataggcctagataattgcttggtaaggccccgctaaagtccagcgagggtgaaatgacaaaagctaagccgtggcctggtgcgccaggtcctggagtgatggcaaagacgaagcttgtggggaaagataccaaatttgaggagttggggtttaagaatggtatgggaaagccatgaaaagcttgacctatttgcctcatcgaagtgtttgtcaactccaagtggccactcgggtggatcttggacgagccagacttgaggagattagcttccagaaagccatggttaagaaatttggtttgttgttgacttgagacacaagaaaagtatagtaggaagattattgatacagctatcgatttataggtattagccattgatagttttcagattttgatgttagctatgttcaatgctatctttttatagcttcaaagagctcaagacacattcatattcaaattttttgtttatgctgacaagttaaacaaacttagttgaagatttgactttctatataaactgctaaacaaaccctttttttttttgcaaacctttatattagtatccttgaaaaattctttcgaactttcctccacaatttcttcctaataaaattgattgcaaaataaacaagaaaatggttacatattttctgtataatttaaatgtgattacaaagtcataatggatcaaaaattattgaacaaaaaaaacgtcatcttttagctagcctttagggtgaatcacctttttttttgttacacatataattttgactgcctaacgatcgacgtttatccactatgactatgtgatacaaacaaatagaaaggtttctcttgagtcttgtaattgtgcaattatttgtattaggaagaaattgtggaggaaacttgcaataattatcaactatatgtcgcataaaaggcgttgctatgttaggcttttagccactatatatccaatataaaaataaaaaatggatgaacaattgaacattccttgaaattaaagtgttaactttaaatatgaatatttataataaaaaaatatcctaacttttttttattattattataaagacatacgttgtcaaactaagaaattcaatttgtaaacgaagaagaagaatacttgaccattcaaatcttagtcttgttctcactgaaaacttgtacaaaaataaataattacaaaatctagagaagttttcatgcaaaattgtatatgtagatgtagtcagatagagttccatatattctataaacgaagaaatcacaacaatacaatgtacaaattaacatcattagattagagtcaaagaatttttaaaaatatatcaactttctgagaagagtacaaagattgtttacgaacgaagaattctcaaaacataaaataattagtttccattttacaaaaatgatcttaggtaatctgcttatattggttaaagtatttctattttctaaccaaaacttaggcaatttattttgtcaccaacatacaatattatattaacaatctatatattactaatctatatgtttttttctttttggtctaaggtaaactttgtgatttaattgtagtattgtacctcttcaatagatactccgtactcgcatgtattaatagagcatcacatttatcgacttctctatggttagtttatgcatctactaagttttttatggacttttgtttttgttgttcatttatcgaaataaagcaaaaaactgcaacgatccagttaatccgcaaaaattaatgaattagagttttttttttttctcttcttcttgttgcattttctcctttttttttctattttttctaatgatattaactaatatcttccctactaaaatattgaaatgctttattttattttttaaataaagaaattgattatgattttttttttgttacagtttataaatgtgtctaataatttatggatattttataaagtttataagatatatatacagtaatttaaaatttgccgcaatgatgacgtcgtcatcgtcactaaaccaatcagaaccatgcttcgcataaaggtgactctgactcatttgaaaagctgaaacataaactctgctctgcataaatg

SEQ ID NO: 16950 - DNA, 3003 bp, Unknown
  misc_feature (1)..( 3003): 2750-1469P.txt file - cDNA_ID_1807311; gDNA_ID_1620631; Annot_ID_47244
taattggtttatgaaagaatctacatatacaacattagcctcgcttttaacgaggactaacacacgtgaccgatacagaacaagaaaaagacatgctagtagacggaccacgctgcaatctatcagctaagggatttggcttgaatctgaccctaaagacaaatcctggtggttgaggcacatgtagagtaattgaagtatttgtgagcatatgaaagactgtagacatcgttggacgatcagcaggattttcttgaacacataacaatccaatgtgaatgcatctaatgacttcatttctatcataattctcccccatgggtgcgtctaccagttccaacaatggttcattgttccaaagcctccatacctattcaagtcatttatcaagaaactaatttaaatgttgagagctatgatcattttgctaagagaagtagaaaagtttgagatggcattggaaatatactaacatatgtgactaagttacttattgagccgtctgtctcgttgatgctactattctttttcccaccaataatctccagaatcaatactccaaagctatacacatcagatttcgtcgagaactgcccattcgtcacatattcgggtggcatgtaaccgctgaaaaatacaacgcataccagtttcaacttttatcaacaacaataagtacaaacagattatataactaaaatggaaaattacttacattgttccaactactcttgctgtggtagcttcagtttggtccactctaaaattcctagccacaccaaaatccacgattttcgggttcatatcggcatctaagagaatgttacccgctttgaggtcacggtgtatgattgtaagccgtgaatcttgatgaagatacacaatccctcgagtaattccattaataatgttgtatcttcttgtccaatctagttgacccttctttaccgggtctgcaaaaatcccatgtattaagcaattagactatgagatcaagaactaaggtttcagagaatataaccctatcatctgtttcttttcttaccaaagaggaagtggtcgagacttttgttaggcaaaaactcgtagactaatatcttttcgtctcctttgacagcatacccgagaagcttaacaagatttctatgttgaagctttgctacaagaaacacctcgttcttgaactcttcttcaccttgtcctgacgttttagacaacctcttcacagcaacttctgttccattcggaaatgttccctgccaagtcatatgatcttcacataattatcagaacatgttctgttttttctctctaacacaaaaaaagtactagagacaaacattataccttgtaaacttcaccaaaaccaccatgaccaagcttgttaacattatgaaaattacatgtggcagcttcaattgctttaaactcgaactgaagtgaacctgaagttgtaatatcatctgctactgcaaaacgaaatcataattatatagtgtatccagagagtttctaagggacattcaacatttatatctcaaattcttattcaagaccactatcaactttatgttttcaaaacatgagaaaacttacttttagttgtctttgttttatatgcttttctcctcttccaaagaccaactcctagagcaagcaataagatgggaacaacgataatcgccacaatagctcctgtagaaatgcttttgccatctgcacgaaccctaggaaaaatattagtctcaaactacgaacatagctataaaaaaaacttaaaacatggacccatggtcttacctttttgacgaggacgaatattatcaaaaagtcccaagaacggataaagctcccatcgaatgaaacagcttggcctcaaaataatacctccttgtctcccacggcaacatgacctatactcaaccacgttttgttgtagacacttggtgcagttttgaagagataagtctctactgcattgcacaaaaccgtaaatgcgtgagatagacgtctcaagctttcgtatcccggctgcatagtacaaatatgaagcttggtctatcatacgaatcatcaaagcctcccatgtaatttccaaatccgtcaagttagcttgaaaatctctggtatagttatcactcctcagaatctccataccaagggaactataaaacgagcggtttgagtaacgtacaagacaaactgttctatcaattctccagactatagcttctgtctgattagtacaattctgcaacaatctagcatttgaaggatgatacaatcagaacaagagtgtgcatcagtacctgggacacacatccctagaccatatgctctgtttggatgttccccgatccatgtcgtgtaaaagccgtcgatagctgtgacattagaggaagagaagaaagcaggactcggcggtttaagtcgtaagtactattgggtgtgaagaaaccagatctttcaaggcatacctgtgcagagacatgactaaagcttatgaccacaaaccagaagattactaaaaacttgaccattttatttactctttccttttttgttttgatgtctgaaattaaaacctcaaatcttggaagatgtaatatttatacaggcgtttcaatttcaacctcttgtgctgtacaaaatttgactaatcgtcattgaattttctaacgtagacttttgatgatgagtcaatgtctagtttaggtgacttatgtcttatacgagcctgattcacattttttaccactttgtaccatatgaattggtatttttcctccaatgtggtaacaaatcttgttgaagcttcatcaaagcaaaacagcaaatgcatgattcttgaaagggtattaaattgaaacttttaaaatgtttaagcatattatgaaaagttaaaatattagtggggtggatttgtagttttttaaaacttggagaacagatacatcttactgtcattactgaggcaacatcgagtacattcaccggaaaatg

SEQ ID NO: 16951 - DNA, 3003 bp, Unknown; identical to SEQ ID NO: 16950
  misc_feature (1)..( 3003): 2750-1469P.txt file - cDNA_ID_1807311; gDNA_ID_1620651; Annot_ID_47749

SEQ ID NO: 16952 - DNA, 3003 bp, Unknown; identical to SEQ ID NO: 16950
  misc_feature (1)..( 3003): 2750-1469P.txt file - cDNA_ID_1807311; gDNA_ID_2926182; Annot_ID_140600

SEQ ID NO: 16953 - DNA, 3003 bp, Unknown
  misc_feature (1)..( 3003): 2750-1469P.txt file - cDNA_ID_1807318; gDNA_ID_1620766; Annot_ID_50117
cgaaaaaacgtaaagcaaaatagtacaatatggatcctgatcttttgacttgctcacttctttccaatcatgttctttcctttggttgttttctctcgctgcgttgttgttccatctacgttattaactattgtcgttttctctctcgtcactggttttgtcccttttaaattgcttttctgaagctgatgaaggaaaaataaacaagaaattagacaagacacttccaaaaaaaacccagcatcgagtcactagatcataaaacgtttatttatctaagtatatgattatatacccctttcaacgcggtccgacctgcatagataaacaagacatgttagtttcatacaaggtagtacttagttaatcatatataagttatttcagctatcttaattattcatcatgtacaaattagcccgaacgtacgtaccttcttcgcctgcagaattactggatgaagaatccatagatggaaacaactaaacaagagatcagagatatccgtgaatacgaagcttgttttttttattttatttttattttttaatgttcttaatttcaaatatatagagagaaaaattattattcttgttctcttagggacgacgccttgtaattggtctgctcacaaagcaaccgcacttgtgttttttgattcattgaatataatttatgagtgactaactaaatatttagtaaagaaagtgggaaaataatagtcaacaaattgaagcgttaaccttgccataaaatcgtcttttcattcaaaaagtgagggattaaattacataagaaaattacaaaacttttatttcataggccagaagtctagaaggtacgtaggccaatattctagtttgttcatcataggctcatcgcgataaactccatatgattaactgcaacactatttgttatgaatttccaaataatgtattttaattttgagctaggtttcatatgaaatcagaataacaaaatagtagtacgaagtacgaaaaagcaattttaaaaaacagctaaaaacataacaaaatagcagtaagaaaaagtggaaccaaaaagctgaaagtatcaaagccgtgttgctaatcaaacccaaaaacaaataatccacccttaccaaaaagacaaaacttgatagtattaattcacaaccatttatcaccaaaagtggggaaaaaccaacgagcatccttgaaaagttttgtcgaggaagtagttagatgttcaaactcttggaccacataatcgcttccgatttggtaaacgcaaatacggtcagcgttataaccatcgcgtagactaatcccacaacatctatgatactgatcattactaaaatatatgcaatctctcataactccatctttggccggaaccgtaattcctaaatccaaaagcaatgcctcgtcccctatagacttgattagtactgtaaattctgatgattttggatccatcttattgacagtgaagacgcatttagcctctggagaactatccattttaccacctacaatgatcaaaacttctccagacaaagtcacagcaagattgctgaaatacttcatatgaaatctatttacacacacagacgatccgaaacttgcacattccatttctactggagaaacaccaccggagaaatcaaaaacagtgagacattgatgtgcactaatcatgtaaagcttgctttctttaaacaccatatcaacacagccttgatgctttattggttgaagaactttccagctattgttgtcatctcctctcttgtgatgatatgctacataactagaaagattacaaaacacaaagtaatctctgcttttgtcatctacccacagaaccgctttgtctatttctatatggctaccgctaatgggtctcttgaatcgcatataccgttctccatcgattgattcgagagacggaagaagaatcctctctcgagtaaaaagattcaaaagatgaaaatcagctctatggtcgaacataaggaaccaactaccggaactcgctaaacaacgactcgtagacatatcaaaccctaaatctctgattatgtaggttttgttttcatgaggatcaaacaacttacatgaaccgttgttttcgacatttttgtttggaaaaagaatgatccatggagttgttggatttgttactccgatgactgatttcgaagcaacataccatgttgaagaaacgcatctcgctcgatgaaaatcaacgaagctcaagcgctccaagattaatctaactaggtccacgatataggccgcttcgaatcgtccttccatattttttccgtcggaatcgctcatctccttcttttgtgctatttcacgattttcaatcttagggtttgtgctcagagacgtgggggagaagatgagtcaataaagttaatgaggctattgggccattatgtaaaataggcccatatattaatgggtttcgttggattagaaatcttaacttgtaggaaaaaaaaaattcacgccggcaaaagaaaagaaaaaaaaaaccttcgccgtcgtttgcttagtcttcttcgctctatcccaacactcgatcaaataatcccagtgagcttcttccattccaaggtacgaatcgataaagtcatcaaacctataccttttcaggatttaatggtaattagtcaggatctaaatcgtttcttcgaatttgatttcggtgatctagaaccctaatttggtcgggaattttcaaatcaattgatttccctgccctaatttaatttgatgattgttctgtttgcctatgaataagtttgatttcaatggcaaacaaaaaaaagagagacattgatttgaatatttttacttaggtgcattgattctgcagattgtgttaatgtgtgtcactcttaatcttctgtcttatgtttttctcagttgataaggaatttgaagaagcctttgtttaatggaaagcaaaggaagaatccatccatctcatcatcatatg

SEQ ID NO: 16954 - DNA, 3000 bp, Unknown; identical to SEQ ID NO: 12879
  misc_feature (1)..( 3000): 2750-1469P.txt file - cDNA_ID_1807330; gDNA_ID_2214578; Annot_ID_135214

SEQ ID NO: 16955 - DNA, 3000 bp, Unknown; identical to SEQ ID NO: 12879
  misc_feature (1)..( 3000): 2750-1469P.txt file - cDNA_ID_1807330; gDNA_ID_2214578; Annot_ID_186395

SEQ ID NO: 16956 - DNA, 3003 bp, Unknown
  misc_feature (1)..( 3003): 2750-1469P.txt file - cDNA_ID_1807333; gDNA_ID_1621088; Annot_ID_55422
aatctttcccgaaattggtgttcacagttcccatcctagaagagctcatttcagcagcagcaggaacaaccttgtcactggcatttggcttagctgataccatgcccattagctcagcaagaacctgctttgggttctctgcttgttgttttaaatcctcaagctgcagaaaaaaaatgttggacattagtatgggtttagagatattttaatgaactgataggtttagtttacttgccttcttttctagatcttcagcgagaccagctaagtctccgatctcaacttctttgtctgaagcagatttatcaatgtaaggaacattggatgattgttggatgccttcatctatttcagagacggttgaggaagttgctgaaccagatgcacctttgatttcattactgagcctctccatccgagctttgcatattaacaaagctttttgacaatatggtattgcttccttaggctgacatccagtctcaagacaaatgcagatgcggaagtttctgaaacgttcaagttaagatataatccaacaactgaattgacagaaacgaaaatcaggtacaatttaagaaaccacaaggatacaattcagctgtgcgtcgactgtcgggctcaaccagtctctctaagatggataatgcattcttgtagtcagacagggaagactcaatgtcctctgcatagtaaacaacagaactcaaaaccaaccaatagctgacatgagaaaataagacaatgcaaaggtgaaaggaagaaaaaatacctctttccaaggacacttcagcaagcgaacagagtatatccactttttccattgtctcagtagactgtttgtcagtaataaccctagcaatgtccagcattttccaggccatatccaaatcagactcatcttcatcagcatcaccatcagcatcagataggtcatcatcttgacaatcttcaccatcctctccttggtctttaccaccagaacctatacatgagggagaaaagaagtcagcaaacaaagaagcagaagcatctatacccataagcttaacctaagacaattcccaataatccataccttcttgcccacttgaactcccttgtctctctgggtcacctgaaacaacagaaggagccagcgattcaccattgctggactcttgctgaacttcaccttctttcttaggcatgttcccaagtggatcagcttcagcttgagcctttgccaggagagctaatccatatcgatagtatgcgtttatacactcagcatcaagttcaccataatgtgcaaccctaaccataccattaaaacaagcaatgttttcattagatcctttgataaaaggaccagatactaaagaattcagtcgagagaacacacaattgaaactcaactaaaaattcagaaccatgattagatcattcgagcataaactagattcagaaacatctgaaaccctaaacccttgattgagaggttctcgactacaaattctcaaatgaatctcccaaaaagatacctgatttcgagagcacggctgaagcaatcgacggcttcagcgaaatcgttctctttcaaaaacacagagcctttctccgtcaattcctcagcgaactcaagcgtcttctcacgctcctcatcacaaacctcagtagcagcactgtcagcggcgttgttgttattagcgtcgttgttacaagtcgattcagtgcctccctgaacaaccgattcgacggtggcttcgattgaggctaggttaggttctagggtttgcgcaatctccgtcgccggctcggttagggtttgtatcaccgaagcttccgacgcagaagctgattcttcaaccatcgcggattgagattttttctgggtgaatttgaatttcgaagaacaaaaacgtcaaatttgttgagaagagtggaatcgtattaaaaccctctcttcgctttttttggcggacttgaaaatgaaaaccaaaattaaagaattaggggaaaaaatatttttatgttttaattaaaatattcacggtaaacactaaaatatacgaataaaaaatgcgtatgttatcccactaacggttagtctagctaaactgctccgcttttgttcaagctatttgactcatgacgcacataggccataggaaaattgttacgctgtaaaaaaatatatgaccgttgtaacggaaaagggtaattttgtcttaccgaagttgtcttaccgaaaagggaaaattgttagctaaaagtttttctattatataaaatatttttattacaaaaatgtttttaaacttaaatgttaaatttaaatactggaacggttagatttaacatcccgtcttttaggtatgtaactcgtgcgttatcataagttcaacatgttttctcatatttaaatttaattttaagattttttcaaaaataatctgttttgatattttaaagctaaaagtttattaacaaaatgttttcaaacttaaatgttgaaatttaaatacttgaaagcgtttagcatcctgttcttttagtctgtaactcctgcgtattataagttcaacatattttcacatatttaaatttagttttaaggcttttttaagaataatattgtaagtaatccgttgatttttttttttcgtcaagtaatccgttgattaaacgcaaattttaattatatatattctttttattcaaaacttaaatgttaaatttcaaagatgtacaaactaaacttgatattctgtccttagaaaaaattaccacttagctttataaatattaaagtttatcaaggtaaaaaaaaacactttaagtgtatgtggaatataaagagtgactcatttcatattattttgtaacaaagtttaaatctttgtaacaaaaagcgtgtggctctaatagcttggttagacgaagaagctactactccttcgataataacgatctgatgagtagcagttttgtcatctctctcactctctcccgacgatg

SEQ ID NO: 16957 - DNA, 3003 bp, Unknown; identical to SEQ ID NO: 16956
  misc_feature (1)..( 3003): 2750-1469P.txt file - cDNA_ID_1807333; gDNA_ID_1621088; Annot_ID_170554

SEQ ID NO: 16958 - skipped

SEQ ID NO: 16959 - DNA, 3000 bp, Unknown
  misc_feature (1)..( 3000): 2750-1469P.txt file - cDNA_ID_1807333; gDNA_ID_2926213; Annot_ID_202743
ctttcccgaaattggtgttcacagttcccatcctagaagagctcatttcagcagcagcaggaacaaccttgtcactggcatttggcttagctgataccatgcccattagctcagcaagaacctgctttgggttctctgcttgttgttttaaatcctcaagctgcagaaaaaaaatgttggacattagtatgggtttagagatattttaatgaactgataggtttagtttacttgccttcttttctagatcttcagcgagaccagctaagtctccgatctcaacttctttgtctgaagcagatttatcaatgtaaggaacattggatgattgttggatgccttcatctatttcagagacggttgaggaagttgctgaaccagatgcacctttgatttcattactgagcctctccatccgagctttgcatattaacaaagctttttgacaatatggtattgcttccttaggctgacatccagtctcaagacaaatgcagatgcggaagtttctgaaacgttcaagttaagatataatccaacaactgaattgacagaaacgaaaatcaggtacaatttaagaaaccacaaggatacaattcagctgtgcgtcgactgtcgggctcaaccagtctctctaagatggataatgcattcttgtagtcagacagggaagactcaatgtcctctgcatagtaaacaacagaactcaaaaccaaccaatagctgacatgagaaaataagacaatgcaaaggtgaaaggaagaaaaaatacctctttccaaggacacttcagcaagcgaacagagtatatccactttttccattgtctcagtagactgtttgtcagtaataaccctagcaatgtccagcattttccaggccatatccaaatcagactcatcttcatcagcatcaccatcagcatcagataggtcatcatcttgacaatcttcaccatcctctccttggtctttaccaccagaacctatacatgagggagaaaagaagtcagcaaacaaagaagcagaagcatctatacccataagcttaacctaagacaattcccaataatccataccttcttgcccacttgaactcccttgtctctctgggtcacctgaaacaacagaaggagccagcgattcaccattgctggactcttgctgaacttcaccttctttcttaggcatgttcccaagtggatcagcttcagcttgagcctttgccaggagagctaatccatatcgatagtatgcgtttatacactcagcatcaagttcaccataatgtgcaaccctaaccataccattaaaacaagcaatgttttcattagatcctttgataaaaggaccagatactaaagaattcagtcgagagaacacacaattgaaactcaactaaaaattcagaaccatgattagatcattcgagcataaactagattcagaaacatctgaaaccctaaacccttgattgagaggttctcgactacaaattctcaaatgaatctcccaaaaagatacctgatttcgagagcacggctgaagcaatcgacggcttcagcgaaatcgttctctttcaaaaacacagagcctttctccgtcaattcctcagcgaactcaagcgtcttctcacgctcctcatcacaaacctcagtagcagcactgtcagcggcgttgttgttattagcgtcgttgttacaagtcgattcagtgcctccctgaacaaccgattcgacggtggcttcgattgaggctaggttaggttctagggtttgcgcaatctccgtcgccggctcggttagggtttgtatcaccgaagcttccgacgcagaagctgattcttcaaccatcgcggattgagattttttctgggtgaatttgaatttcgaagaacaaaaacgtcaaatttgttgagaagagtggaatcgtattaaaaccctctcttcgctttttttggcggacttgaaaatgaaaaccaaaattaaagaattaggggaaaaaatatttttatgttttaattaaaatattcacggtaaacactaaaatatacgaataaaaaatgcgtatgttatcccactaacggttagtctagctaaactgctccgcttttgttcaagctatttgactcatgacgcacataggccataggaaaattgttacgctgtaaaaaaatatatgaccgttgtaacggaaaagggtaattttgtcttaccgaagttgtcttaccgaaaagggaaaattgttagctaaaagtttttctattatataaaatatttttattacaaaaatgtttttaaacttaaatgttaaatttaaatactggaacggttagatttaacatcccgtcttttaggtatgtaactcgtgcgttatcataagttcaacatgttttctcatatttaaatttaattttaagattttttcaaaaataatctgttttgatattttaaagctaaaagtttattaacaaaatgttttcaaacttaaatgttgaaatttaaatacttgaaagcgtttagcatcctgttcttttagtctgtaactcctgcgtattataagttcaacatattttcacatatttaaatttagttttaaggcttttttaagaataatattgtaagtaatccgttgatttttttttttcgtcaagtaatccgttgattaaacgcaaattttaattatatatattctttttattcaaaacttaaatgttaaatttcaaagatgtacaaactaaacttgatattctgtccttagaaaaaattaccacttagctttataaatattaaagtttatcaaggtaaaaaaaaacactttaagtgtatgtggaatataaagagtgactcatttcatattattttgtaacaaagtttaaatctttgtaacaaaaagcgtgtggctctaatagcttggttagacgaagaagctactactccttcgataataacgatctgatgagtagcagttttgtcatctctctcactctctcccgacgatg

SEQ ID NO: 16960 - DNA, 3000 bp, Unknown; identical to SEQ ID NO: 11918
  misc_feature (1)..( 3000): 2750-1469P.txt file - cDNA_ID_1807341; gDNA_ID_2214522; Annot_ID_134090

SEQ ID NO: 16961 - DNA, 3003 bp, Unknown
  misc_feature (1)..( 3003): 2750-1469P.txt file - cDNA_ID_1807355; gDNA_ID_2214555; Annot_ID_134771
gcagtgattttgagcatgaagtagcatcaaagcaagtattagaagcgctcttcttcaaagcagaagccccacacaggcaacgcatcctcgcagctgaaggatcggactccatgaaccgccgtttcatagagagggcttacaaatacagacccgtaaaagtggtggagtttgagcttcctcgcccgcaatgtgtagtgtacctggacttgaagcgagaggaatgcgcaggactattcccttcaggaagagtctattctcaggctttccacttaggaggtcaaggtttcttcctctcagcacactgcaacatggaccagcaaagctcgttccactgctttgggctattcctcggaatgcaagagaaaggggctgtgagttttggtgtggactacgaatttgcggcaagagataaaagtacaaaggaagaatacgtaagcaaatacaaaggaaactacacattcacaggggggaaagcggttggttacagaaaccttttcgggattccatggacttcgttcatagccgaggacagtcaacatttcatcaatggcattctccatctcagagccgagctcaccattaaacgttcctcagacctgcactgactgttttcttctctctctctctctatgtcgtcacatttaagttgtataatctcgttatgtagcagctctaaccacgagtgtcctttgtacaataattgcctaaggagcaaaagtatggcttaaagagtacctcattctgtaaattctttgattggatttttttacttttctatatgggtctttataaatagtccaagatagaatttgggcctagcttttgaggttagtcttaaaatatgggctcaaggcctactacgatgcgtaatgatgaagctaaattgcctatagtgtgaacattaggcttttatattcaaagttcaaacaatgcggctatagcaatggtacatcgaggaaatagaatgaagtgacaaggataatttaggaaatgaggatagaggaattgagtcctcgtcacatggggcccacataaatgcgtaagtaagactatccgcttaccagacggacacgtcattttgtcgggacacgtttgagccgttggatgattaatctccttttctgacttatcgaccccactttttttttccactacaaaatattgatggccacgtcagatgattcgaagttatataaaacacacgtttttattgcagcttaaccgtcgatttttttctaatcgagaaaccgagatcaacggtctatattcaaagctgatgtggtctgtacctttgcttacgtcaccgaaaacctaagttgaataatactagtactagtattatgctctctgatttctttctacagtacacaaaataaaaataaacaaaaatagagagcccagacaatatttactacatcacccaatggataaccgacacgtagatacatccatgtgagtcgcattttgtaatgtagggaccacttcgtggatagaagctcttttacgccaacgcaaaaaaaaaaagcctcgttggccctttagcctctaaatgccaataactatctactggcgtggcttagtttataccgttggatcatttgtttatcccagccgttggattcgaagcagttgtcgggcttgtgggccttttctttattgttttgttttcataataatgaaagaaaataaactaaaaaagtattttttatttttccttttatggtgattccatgatggcaaaaacgtggccatacacgtgggtcgtctcgtggcacctttggaagatacgaatcggtagtgaataatggacggttcggatctttagttttgtcgacagaagtgctctccgcgtcggagatactactagtcaaaggtcttttcttccttcgtattttaccataatgtcccttctttctaatcaaatttttatcatgtatccaaattattcgaagcaatattctatataataaacaaatatgcccatcggtaagtagcaaaagttaaattgtgtttattttcatgccatacaaaaataatgattctgaaaattcgttggaaagattgtttagttttcttatttttatgttgcacatgacttcactgacgtgtgaatgtgatgacggattttgaagaggattatacactatggtaaatatcgactataaaaataatctaaacatgagggaagcgtagagcgactagaaatcgaacacgtgtacggtagagatgacataagaaatggctggcactaaactcgatgagccaactcatcaaacaccaccgtagtttacgctgttatatattctcatgacacgtgtctgatgacgtggtcatcgtcttggcgctccgttttttttctctctctctcgcgtctcccttccctcaaaaaaaaaaactgaactctttttcgctctggtttttttagagagagagaaagatgaaaatgcgtttaattgctgtttaggtttcgaattcgcgatttaaatttctgggtttctctctgtttaagcttcttcttcttcatcttctgcttacgtttcttcttcaaggagctttcggattcttgtaggtattgcgtaacttaaatggttcaaatagagattgtttggtcgaatagttttgtgatttggtttctctatcattcattgatcttctaagttttgtgaaaattttgccatttttgatcgtttgcttttgcatttacttgaattgaatgaaaaattataagttttgaatttgaacaaaaacagctaaagcgtagagaagaacagagtttctttttttgggtgcatgtgattgtttcaggggtagaattgtccagtagtgtctactttgttgattccttttgtcttcctgaaagttttctgaacataggatgtgagagagaaatactattttacccttctctgtctctatatttctcacacaacaacacccatccccatgattttgcagaaagagtcattgttctcttgagtgggaaaccttgaaaccattcctatg

SEQ ID NO: 16962 - DNA, 3003 bp, Unknown; identical to SEQ ID NO: 16961
  misc_feature (1)..( 3003): 2750-1469P.txt file - cDNA_ID_1807355; gDNA_ID_2214555; Annot_ID_185702

SEQ ID NO: 16963 - DNA, 3003 bp, Unknown
  misc_feature (1)..( 3003): 2750-1469P.txt file - cDNA_ID_1807359; gDNA_ID_2214527; Annot_ID_134190
agtgggatcagcttgaggatgaaaagaaggtgaagaactagcgaatggttgagaaggaattggctggtttggtttgtgcgtcttcatagaagctgaaacagaagggcttggcaatgtatcgtgaaccacttgagcagcattgcgcatacttggctgcattcctccagattgtctccattccctaataaccgaaaaagcatttgttattgataggaaaagagaagaagcttttcacttgctcatcggataaatgctcagatttaagatcttgccttatccttcgtattgtatcatctgagttaacacggcctagaagctctctatgctcctcattcgataaactcaactctttacgtaattcagttatgacactttctttttcctgaacataaaatacatgttattccacctaaccagacactaacacaacaagagaaatcaaagtagatcaaaaaatacccatgaaatagcatctccttgggctttaaaggctcttaaaacagagatatatgcttccttctcaatctggtgaatctgagcttccatatccgcagcaagatcatcatacatctttgggtaagatggcggaagattcaaaggtcttccattaccagccacgcgtcctcctcttcctcctcctcctcctcgtggaactctatgcgacggtggcagatcatcatcagttcctgaatacaccaccggtaaaatcaatcaatgttgcattctcaataatcaaacctttgtgaatcaatcattaccacacattacattcaaaaggtttcagcttaaatcaagaaacagcaagatccaaaatttcaactaaaaacaccaatccaccaaaataacacaatgtataacagtaatcgcacggagaaatcccaaaagttgtgaaaaccctaattttcagtgactgatagagaaggcgagagaaattctacacagttttcgggaactaaccactgctatcagacgatttgcagtccatgacgaagcttaaatcaagagacgaatctcgaagatgaaaattggagaagctagacgaagaatcaagcacaatttgccaaggttgatttcaatttgacttagaagaggactcgatttttggttttgagctcaattttgtactttgtcgagctgctataagaaagaagcgacggatcaatttcttgctccggtaacaaatctgagcttcactataagtgattcagcttaaaagattacagattttgcctaaagctcattatttgccaaaattagaagaactcagacgaaatttaattttataagaacaaaagtaaacaaatttgttgagaaaataaattttcgtagattcattctcattaaaattatcaaaatagttacgagggaaataaaacaccgtcgtttcgtccccagccacgtgttcacgtagagatttaaaaataaaaaataaactgaaaattagatatatcacaaaaccccgaagctgtgtaaagccttacccaagcccattagttttataagtaggcccaactatttgtatgttaaattgataaacaaacgtatgttattgcttcgatgtgttcaagtaagtaaaatacaacaacgtacgttagtacggtaaagaaagagttcaattttgatggatcctctaattctttttttatattatttgttattcttcaaatttgttgaagtgcaatagctcaccaaagatactacgagtctacgataaagaaagagttcaattttgatggatcctctatttttttttttttcttccaatgattctatgtcacattgtaattctacctaagcctgcatgcttatgtaaattgtaatcacgaggaaaatcagttttagaaacgagcaaaacctcactcgtatacttttagtttacgcggtgtctccgaagacgatcgattctaattataatcggcattacattgttgatatatggaaggttcttcaatgaacagtgtgagtttcctaagaaacagctaaacagttatcggtgatcgctaaaacctttcacagtttgataaagttttctcctgctctagtttaatttcatcaattttggaataaattttatttaaattatttttggcttacaaataaatttgtattggactgttcttgtaaaaattaaaacttttgtaatgaatagttgttaaatataaatattttgatagttaaattattactaactattaagaatttagtccatatttaatttaatatgaactaaattctttgtttttgatcaaaaaacttataaaattaaacgtggaaaaagatccgatcctctcaaaccaaaacaatgacttggttcgtcacattgaaaatcaaagagagtgttaattaatttattaaatatatcatgttaggtttgataaataaaattgttattctgaccgacagtccaaatcccaaacgcgttccagactacaccaacctgtgaaaataaacgtttaaaaaagaaagaaagactcaaagaagtaaaacaaaagtaattaattaaaatttgaaatagtagccgttacaagaaacttgtcgatatttgtatcaaaagacgtttttacacaaaatgacgaaaactggacttatcaataaaactaacacgtcttcacgtttccttgagaaattagcacatctaagtaaatgtctacacgacgtgcaatgatgcttttctttctctaattttttctttttaataatgactcagctactttagatttatttttgaaaaaattcactcacgttttatcattcttttcctattttgatataacttgataaggtcatttttgaattttccgtttactaattaagaaaattagaatattttatcatactctctttctctttccctctatcagatcatctttctcaaatagctctatttagatattcacatacatatccagttgtgattctcttccttatataaacctccacttaactcatcttcttaaaaacaaaactaagattgaataatcataaagaagaaaactaagaatg

SEQ ID NO: 16964 - DNA, 3003 bp, Unknown; identical to SEQ ID NO: 16963
  misc_feature (1)..( 3003): 2750-1469P.txt file - cDNA_ID_1807359; gDNA_ID_2214527; Annot_ID_184800

SEQ ID NO: 16965 - DNA, 3003 bp, Unknown
  misc_feature (1)..( 3003): 2750-1469P.txt file - cDNA_ID_1807363; gDNA_ID_1621153; Annot_ID_56928
tgcacaaagaaaacgctcttatacgtaaatatattggtatttctactagatcatactttatactttatgtgttatttctccattccagtattattgtttttcttttgttacgcatcataatagggcggcaatattcgttgacaatgattgctaagctgaatggaaacataattacaattttaatagcaacaaatatatttaaataaagtaaatagtaaacaatacttaaatgctaatcgtacaaattaaaggaagggaaaataatttgataggtctactgattgaaaaagaaagaactaaagcactcttgctggccccatcccctgtctccctcatctatcacttaacttgataatccaaaaaatatcatatacttaatttgcatttacttaattagtttaattttatatacatctacgttttaagtttgtttggttcgaaataattctgaacagcaatcactttactttcaactaaaaacgaacttggttttaaaaaatgatttatatattcgaggttgattaattatagaacactagattttgctgaaaatgaaaataaagtaatagaacactagctttcagtttttttgtagcccttatagatttgatgctacgtgtgtgtatatatattattcccatcaaataatttacgcgagaatataataagatttaattttctaattagtgtataaaattttctaaagttttcccccaccatcattgacatagtttctctatattcccctcttcttctcctttcaagaccaaaagaaaaaaaaaaactttttcttttctgatgaatcgtatctattagctatgagcctgaggtgatgatcatgtcaacataaccatcaacgttctaccatggctagtcatagcaacaaaggcaaaggcatagcagaaggatcgtctcaaccgcaatcgcaaccgcaaccacaaccacaccaaccgcaatcacctcctaacccgccagcgttaagccggtacgagtcacagaaacgacgagactggaacacgttttgtcaatacctgcgtaaccaacagccaccggttcacatctcgcagtgtggatcaaaccacatcctcgatttcctccaatatctcgaccagtttgggaagacaaaggttcatatccatggatgcgttttcttcggacaggttgagccagcgggacagtgtaactgtcctttaaaacaagcgtgggggagtttagatgctttgatcggacggctaagagcggctttcgaggagaacggaggattgccggagagaaacccttttgccggcggcggaattagggtttttctgagggaagtgagagattcacaggcgaaggcaagaggagttccgtacaagaaaagaaaaaagaggaagaagaggaatcctatgaagagtcatgatggtgaagatggtactacgggaactagtagtagctccaacttggcttcttagcggaagcaaacaaaaaatctataataaaacaaagtggaattagttaatggtaagcatttaatactctccataatctctattaattttcagtactttaatcctattttgtgatctatttacaattttacatatagagtgaaaagaaacaattctacattcgtttcttgatagtcagctcttaatgcatagttgaattttatacgtatcatacccaaactataagattaatcttgatcttagatcatatacatatatcatcatggtgtgtaccctaagtttcataatcatttttcttaactatttatgtggatattattactgtactagataatattttatacagcttaaattaatatgttcattaattttacctcgctgtaaaccctagctagagagtatacaatatacatatacacacaaatggtataaaaccctagttttggctcagatgtaagtgtgtgtatacaatcatgcatcgtgatatatgcatctatacatgaatgcataggcgtatacatttaattcattaatgtgaatatgaagggaattacatcgatcagatgttttaggggtttagtttctgcggtggggcttcctgtttaattaagctccggggatattgtgctccttaattaagtgtttacgaatgctacaattttttttgaaatggttataaatttttattaatctatacatgtataaatgtataaaaaagatcaatgctagctaaaaagtttcactgactaacttttgtttcatattttaactgcattattccaattattgtttgcataatagtctactagtttgcaaactaggcctattgcttaacacagcgttgtaagttgtaacgttataaatcgtgtaaaaaaaaaattgcatgtgcactagactatgatatatcacgatgcatgatttacgcttttgttccacaaatgttgattagtgcgactatattaatcttacacataagtgtcataagacacatacacagactatggacagaccaaactaagggtagaaattaaaaaagtttaactcgaaggagagacgacacatcgaagaagtgtggacgtattgccggagaagaggcaaacgattgaagaagtggggctaaagagtttagaaaatttgagaacatgtaatgtagtaaattttacaatattgtggcttacctcttataatgttttttttccccataaagtttcgattgatcttccatgtcaattcgtatctaaaatgttcttcagagaattagaggggggaggggggggggattatgcacagtaaaagttcagggatcagcttgttaaaaacagagattttggggtaaaagttttaaaacgttagaagttttgggtctaacttgtaagaaatcagaggattaggtgaaaaacataataaagtgaaagtttaggcgttaaaatgcagtaaatggtaaattgttaagagaaaagagatctaaaataatataaaaagtgaactctaatgacaaaaacggaaagcttgaagttcttcttcctcatcggaaaacaaacaaagaatgatg

SEQ ID NO: 16966 - DNA, 3000 bp, Unknown; identical to SEQ ID NO: 12576
  misc_feature (1)..( 3000): 2750-1469P.txt file - cDNA_ID_1807367; gDNA_ID_2214559; Annot_ID_134856

SEQ ID NO: 16967 - DNA, 3000 bp, Unknown; identical to SEQ ID NO: 12576
  misc_feature (1)..( 3000): 2750-1469P.txt file - cDNA_ID_1807367; gDNA_ID_2214559; Annot_ID_185839

SEQ ID NO: 16968 - DNA, 3003 bp, Unknown
  misc_feature (1)..( 3003): 2750-1469P.txt file - cDNA_ID_1807371; gDNA_ID_1620677; Annot_ID_48275
ggccagttcatgagcaactacagtggcaacctagcagcagaaatttaactgctttagataattgcacaagagagcacaagacaatttcctctagagaataaatggacatgtttacagtaccctctgtttgttagaagcagctgaatgttgttcatcatagagaagagctgtttcacggtatgtaactaaaccataattctccatagctccggcagcaaaatctggtattgcaatcatatccattttgggaaggggatatggcacagcaaagtacctacaagaatgattggacttatgcaatgagatgatacatccattaaagaagctcagaaatatgcatgcacataaagtttcaaatgtcaacgaaggacctactctttgaacagatccaatgtcttggcaccaacatgcaatgcaaatttcccttggtcggctttgcccacttgacagtatactctgactttaatccctgagaaaaagatgaaacttgatttagagcttctcgacttgactagacgggagataataatggataaaattaatttaccatcggatgtatgatcttccacgtagtcaaacaaaccaacaacaattgctaccaaatatgtagacatgattggtgactcttgataggagacaatcttcagattcccattgactttctcctccattattggcatattggagagagccaccaaatcagttggcacctctaatgtaatcttgaaggtagcctgttgaacaatgtgtcaatattgatagataaagacagaagaagaacaaaatcaccaacttgataaactcatgctgatagaaagaggagggaatgagaaagaacaagtggaaaccttgcaagcaggttcatcccaacatggaaagcatctcctagcatcagctggttcaaactgggtaactgccatattcttcttctcaccgttatgttcataagtactgccaccaagacaaatacaagatcgttctagaattaatctcgagctatctaacagtaaaaaaagatcgaaactcattgctttaccttctgtagaatcccttcattttgtcatttagtactccattgaaaccaagtttcagaactcccactccatggggaagaatctcaccaaactcaagcacgagaatctcatcctcctcaaacaagacaacttttggagctgcaagcgcctgcttaacaaaacataagaagcaacaacaagctaaatctttgctgattccagattcaattccaatccatgacagttttctaaagttgaggattggtttttcagtcgaacagaaaagtctggctgaaacgtgattgtatctctctagttaatttaccattggaatcaaaaatcatagatgatgatatccaaatactcagatcaagaagctaatcatgaaaatgaatatctccaaggcgctaattagctcaaaaccataactccaatcacattgctaaaatcggaatccataacagcaaaaaagaaacgcgatagagagaccttagaggaggaaggaggagtgaaggaaacggaggcatcgttgacggagagatcagctgcgttgagaacgatgaaacgagtatcggcgactatgtcgagatcgatggctacagttccagtgaaggtgcaggcgatgagatcgggattgaggcggagatcgtagcgcttggggacggcgaacttgggtagacgaggctcacctttgaactgatccattttctattacttgcagatatgatttttttttgttttctcttgttggagttttgtcttttataatacgagggttgtaagcaattgttttatgttacgccacgcgagtgattcgtttctagtagaggacgcaacgttaataacatttacaaaacattcaataatatcactatcaaattcaatgacgttggattatccattagcatctccaagctaggccgaatatgacaaaatgtgttttgaccagtgaagaaatgtttaatcagattacacttgttcataagaagattcaatgtcactactactcgtcaactcaaagtcccgcggatctagtttgaacaacacacatttaatcgttctatatcctcaatcatctccttgatcagattcccaacatcccctgagtcccatgttgtactgatgaccagggtgatcttcttggctcggcgtgtccgtttctcgaggagcatccgccatgttccacgtagcttcatcaggttgtagcctctgtcccttggagctcggccattatacttaacagtgagatgaagatgatctttattcccttatttatatcatcataataagactttaaaattttgaattgtatagtttctcttttttaatgttaatttcctctctttctttttttggtcaacgagactaatttagttttctttcttgcctagggttttcgtcttctgaaacgacgtcgttaggatctttccaatcgagttcttcccaagcttcgtcgtcgtcgtcgtctaggtcgggtgtttaaatttacggtttctgagttagacgagagactctcaatctcggagaatctgaggttttacgggatatcccgttttaatcaaattcagggtaaatttcaattctttttccttctgagatctgattttttttcttttttttttgggtattgaaattctattatccttgaaaagcttcatacttcttaaaactttgcattgtctgagtttcatttttgatacaatctctctatttgattctttctgcaactttggttatgttcatttatatttttagagtatcaaaaatgaatcttttagttgtcttttggtcatcttggattatatttctctgtttgtgatgaattctgaagcttgttgttgtgttagattcttattgtctcactgtttacatttttatccttttcttaagagtgatgatataggttttttttttttctgaattatagatagatggattttcagagttgctaaggtgggacagagtattagtggtgattgcaacgacaatg

SEQ ID NO: 16969 - DNA, 3003 bp, Unknown; identical to SEQ ID NO: 16968
  misc_feature (1)..( 3003): 2750-1469P.txt file - cDNA_ID_1807371; gDNA_ID_2926203; Annot_ID_141618

SEQ ID NO: 16970 - DNA, 3000 bp, Unknown; identical to SEQ ID NO: 11202
  misc_feature (1)..( 3000): 2750-1469P.txt file - cDNA_ID_1807374; gDNA_ID_2214483; Annot_ID_133319

SEQ ID NO: 16971 - DNA, 3000 bp, Unknown; identical to SEQ ID NO: 11202
  misc_feature (1)..( 3000): 2750-1469P.txt file - cDNA_ID_1807374; gDNA_ID_2214483; Annot_ID_183436

SEQ ID NO: 16972 - DNA, 3000 bp, Unknown
  misc_feature (1)..( 3000): 2750-1469P.txt file - cDNA_ID_1807381; gDNA_ID_2926150; Annot_ID_198017
ttaaagcccaatccagatataaaggaaagcacttgtaaaaagtcacgtgagaataacattttcaaccacagtggcttgtattggcccaacgtttttttcactaacggcccaaaaagcccaaatcagctattgattagtggaggagtactcatttattaattcctcctactaattggggtttaccaacttaacagaaaaaatgcatcagttgtgtgagttgtcgaacaatcaaagtgatttaccaacaaaatataaataaaagtaatcattaacttgattagatataaaattaaaaaaaaatcggttagtcaaacacaatgtttaaattaatgttgacttaactcgtttttagtaatattgtatgtatctttataataataaaagaatgcttgggtttgggtccacgcgtttttgtgatacaatgcctcgtgcaggccacttggagctaaatattttttttgctaaaaaaactcgtcctcgaaggtttcacgtggctcatgcacccctgactgggtcaggagaatcttgaccgttggatcaaagttgaagcatttataatagctttgaccgtccgatgaatgactacaaagattgtgattcgttataagccgtacgattgactaacacaaagaggaatcaacatcacgaggcgagagataatggtaacaacggcataaaagcatttttctcgacagctgtagcaaactccacgtcatcttatcttactcgccgtgtgaaccgttgattttatgaaaatttgtcaaccttttttactcgcggagatcacgcgctcccctcgtttggcacgtgtgtcacactctgcttcactcgtaaaattctttttccttttcttctttcttattgttcaccatataaattattttgaaccaattttttttttacaatacaaattgtttttaaatttctatacaaattatatattatttttatatttatgattattacataataattagttaaattttttcaaaataaatattcttaaatctgcgtgtttttagttaaaataatttatattgtgaaacggaaagaataatattttttccgaaaataaaatgtttagtaaatttgtgtgtttatttcaaaaattatgttattgtttttcttttttttaaatgagttgtagaatgggaagaactaaataaacacactactcatattattattttttataacattacctacatgtgctttgctgttgctattctcaaaaggtaatgaatggtacaatagtatcccatgtttagagtatgtggcagagtgatcaacactatggtgctaagtgacaatcactatctttctatctacatactttttatattgcatttaagcacattttttggaaaaatataaaatggaatacatatgtgttatccatgaatggttctttttttataaacatcagttgttagattgactattttgtaatgtcgaaagctcacaacaaattaaacttttattcttatcccttaacattataattttttttgtctaaattaatcttgacaacttccaattccataatcgttggtgtaaaaagatttaagaattgtttacttcatcttgtgcgcatcgataaaaagtgggcactagtacgaaagtatggtttcccactatttaaaatcaaatcaaaggatccctaaaagcgcgtgtgagagacgcgtggaaatgtccaaaggagtgtgaggttgacaaaagatgaattaagagattattcaaagcctttgacattttatcaaagtcaaccaaatacaagaaaccggaaaccataagtggttttagtcactaggcgacaaagacaggataagcatcgagataccttcttcaagcacatacttttctctctttctagaattgcccaaaaaagccaaagagactattcctctctctatatatatatagaatataaaatattctaatatacgtattatataatcggcatatacacgtattgtgattccgacagtgctcatctttttccaagtgtgttcatacttatttgcttttaaaacaagatacagagatatgtttaatttagtaatgtctaaacaattgctatcactaaaaggaaaatatgtcaaataaacactaacatttagtaaaattgtaacgataggttggcacaataatggcatcggtttatagaggacgattcctattagtttgctaattacaacatctagtattagttttgtgcaatcgtcacatgtccttcttcatttcctgttttatatacaaaaattattcagtatgtttacaccatccgtacacaaattttatttttagttaaatatattttatagtcacaagttgtgtgactcaacaaaatattttcaggtctttttttgtaattcataaattcatgtctattaatattttcaactaataaactaatttttgcgagataaactttgaatggttacagcgatccaagcggacaaaccatctacaaaccgaaccgctttttatttatcattcacaatctatagttcgtaatgaagcagaaccaaaaaaacaaataaatttgatgcggattgactttaaactaagtttgcagcggtttgttctctgtcctaaaaaatagtatagattggaccgttgacggattagttcgcactaaccacaacatatccgtctcaaaaaatagtatagactgtactgctgacggattattccggattaaccacaatatccattcaaaacaataagttgatatgtggaataattacaatgtaacaaaaagagagaagaaaacaaaattgtatattatactgtatttgaatcataaataataatttaataaaatctttcctccatttttttcaaccctttttttattttcgtccatcttcagtctctttataaacatatctctctacccttcaaaagtcagcgctctcttttgtctcctctgcttttttctcttctctcctcagagattcgaagctttttgtctcccctgagtaaccaaattcaatg

SEQ ID NO: 16973 - DNA, 3003 bp, Unknown
  misc_feature (1)..( 3003): 2750-1469P.txt file - cDNA_ID_1807381; gDNA_ID_1621155; Annot_ID_57002
ccattaaagcccaatccagatataaaggaaagcacttgtaaaaagtcacgtgagaataacattttcaaccacagtggcttgtattggcccaacgtttttttcactaacggcccaaaaagcccaaatcagctattgattagtggaggagtactcatttattaattcctcctactaattggggtttaccaacttaacagaaaaaatgcatcagttgtgtgagttgtcgaacaatcaaagtgatttaccaacaaaatataaataaaagtaatcattaacttgattagatataaaattaaaaaaaaatcggttagtcaaacacaatgtttaaattaatgttgacttaactcgtttttagtaatattgtatgtatctttataataataaaagaatgcttgggtttgggtccacgcgtttttgtgatacaatgcctcgtgcaggccacttggagctaaatattttttttgctaaaaaaactcgtcctcgaaggtttcacgtggctcatgcacccctgactgggtcaggagaatcttgaccgttggatcaaagttgaagcatttataatagctttgaccgtccgatgaatgactacaaagattgtgattcgttataagccgtacgattgactaacacaaagaggaatcaacatcacgaggcgagagataatggtaacaacggcataaaagcatttttctcgacagctgtagcaaactccacgtcatcttatcttactcgccgtgtgaaccgttgattttatgaaaatttgtcaaccttttttactcgcggagatcacgcgctcccctcgtttggcacgtgtgtcacactctgcttcactcgtaaaattctttttccttttcttctttcttattgttcaccatataaattattttgaaccaattttttttttacaatacaaattgtttttaaatttctatacaaattatatattatttttatatttatgattattacataataattagttaaattttttcaaaataaatattcttaaatctgcgtgtttttagttaaaataatttatattgtgaaacggaaagaataatattttttccgaaaataaaatgtttagtaaatttgtgtgtttatttcaaaaattatgttattgtttttcttttttttaaatgagttgtagaatgggaagaactaaataaacacactactcatattattattttttataacattacctacatgtgctttgctgttgctattctcaaaaggtaatgaatggtacaatagtatcccatgtttagagtatgtggcagagtgatcaacactatggtgctaagtgacaatcactatctttctatctacatactttttatattgcatttaagcacattttttggaaaaatataaaatggaatacatatgtgttatccatgaatggttctttttttataaacatcagttgttagattgactattttgtaatgtcgaaagctcacaacaaattaaacttttattcttatcccttaacattataattttttttgtctaaattaatcttgacaacttccaattccataatcgttggtgtaaaaagatttaagaattgtttacttcatcttgtgcgcatcgataaaaagtgggcactagtacgaaagtatggtttcccactatttaaaatcaaatcaaaggatccctaaaagcgcgtgtgagagacgcgtggaaatgtccaaaggagtgtgaggttgacaaaagatgaattaagagattattcaaagcctttgacattttatcaaagtcaaccaaatacaagaaaccggaaaccataagtggttttagtcactaggcgacaaagacaggataagcatcgagataccttcttcaagcacatacttttctctctttctagaattgcccaaaaaagccaaagagactattcctctctctatatatatatagaatataaaatattctaatatacgtattatataatcggcatatacacgtattgtgattccgacagtgctcatctttttccaagtgtgttcatacttatttgcttttaaaacaagatacagagatatgtttaatttagtaatgtctaaacaattgctatcactaaaaggaaaatatgtcaaataaacactaacatttagtaaaattgtaacgataggttggcacaataatggcatcggtttatagaggacgattcctattagtttgctaattacaacatctagtattagttttgtgcaatcgtcacatgtccttcttcatttcctgttttatatacaaaaattattcagtatgtttacaccatccgtacacaaattttatttttagttaaatatattttatagtcacaagttgtgtgactcaacaaaatattttcaggtctttttttgtaattcataaattcatgtctattaatattttcaactaataaactaatttttgcgagataaactttgaatggttacagcgatccaagcggacaaaccatctacaaaccgaaccgctttttatttatcattcacaatctatagttcgtaatgaagcagaaccaaaaaaacaaataaatttgatgcggattgactttaaactaagtttgcagcggtttgttctctgtcctaaaaaatagtatagattggaccgttgacggattagttcgcactaaccacaacatatccgtctcaaaaaatagtatagactgtactgctgacggattattccggattaaccacaatatccattcaaaacaataagttgatatgtggaataattacaatgtaacaaaaagagagaagaaaacaaaattgtatattatactgtatttgaatcataaataataatttaataaaatctttcctccatttttttcaaccctttttttattttcgtccatcttcagtctctttataaacatatctctctacccttcaaaagtcagcgctctcttttgtctcctctgcttttttctcttctctcctcagagattcgaagctttttgtctcccctgagtaaccaaattcaatg

SEQ ID NO: 16974 - DNA, 3003 bp, Unknown; identical to SEQ ID NO: 16973
  misc_feature (1)..( 3003): 2750-1469P.txt file - cDNA_ID_1807381; gDNA_ID_1621155; Annot_ID_173463

SEQ ID NO: 16975 - DNA, 3000 bp, Unknown; identical to SEQ ID NO: 16972
  misc_feature (1)..( 3000): 2750-1469P.txt file - cDNA_ID_1807381; gDNA_ID_2926150; Annot_ID_139277

SEQ ID NO: 16976 - DNA, 3000 bp, Unknown; identical to SEQ ID NO: 12185
  misc_feature (1)..( 3000): 2750-1469P.txt file - cDNA_ID_1807383; gDNA_ID_2214536; Annot_ID_134373

SEQ ID NO: 16977 - DNA, 3000 bp, Unknown; identical to SEQ ID NO: 12185
  misc_feature (1)..( 3000): 2750-1469P.txt file - cDNA_ID_1807383; gDNA_ID_2214536; Annot_ID_185079

SEQ ID NO: 16978 - DNA, 3003 bp, Unknown
  misc_feature (1)..( 3003): 2750-1469P.txt file - cDNA_ID_1807395; gDNA_ID_2926145; Annot_ID_197687
tgttatgttgctttcacagttatattgttacccggctactcttaacaaaactgatcatatttaatttttatttttttttgtaattctttttatccatcaattttccgtaaaagatatttcgttgatgctttgtgtcactgacctattgctcccaattttgttattcaataccgtgatagatacacaatcattgtgaatttgtgattactcttcacaaccacgaaggagaagagaggagaaaaatatgatacataccaaaataataagcatatacaaaaatacttcatatatcaaaaaactcgcaaaacgataagacattaatcaccttagatatgcttgttctctaaatctgttacgtaagagattaaattcaaactaaacgataagacattcccaattttcttttactcttcttctttcttctctaattcttttcccatatctcttcctctccacctctgtctatcacttcatcgatggaagtgaaacaaacaacggcaacgttgactcgttgagtccttgacatagtgatcaaaacagtggcgatgaaaccgaatatggcttgagtgcacgatggatatgacacgttgacggaggattcacttctctctcgaagctatcatggctatggatttccatcacgtatgcaacgcatacaacctaaaacgtaacgatgacttaatattttacgtcagtcatcactaccaccatcatcgccagcataatcacactttcgacgacaaacacaaatctatcacttctattatggaggaaataaccaactttttgcaatgacggtgattttgtttttcatcctccagtcctttagaattgggttaaatagcatatttataagagattgttaccgaaaattacgaaaccgacttccttatatttatagcagtttgtaacatagctaggtattaagattttacatatgaccgcatattctaaccgggctaaatttccttttccaaaaaaagaataattaattttgttacctattctcgccatgatttttcttttaagtttatggtagatatcaatttttgtttttctttttgttaagttattttgagaatttatgctaaatattgatgtggaccaataatatcatgtttttaaaatcctatgtggacacctttaaaaccaaataacctcaacttttatatagtatagattgttgctgggtgagttttttcctaaaatgtgacagtttagtcgcaccaaccgttgaaggtagttccagtggtgcaaataaggaaacaactataaatggttttttacaaatatctgatttcagtagtagaagactattgttagttgttacctcgactattattctccttcaacttttttggtcatttcaatagctttacctttttactttaatattctattttgtgttttctgtgaatatgattttagttttcaaggattcccttatttttcgccggcttttgtatttcaaaactgcattttaagtgggtgattggttcgtctgtagctgtaaaaattttgcggtaggtgtgatgactttagctttaggttttattgttgtagaaattaggctgtaaattttattaatataatattattacttaaataaattgattgtagaaataaaattttggttgtatgtatttttaaacaagaaaatattattggtaaattgtacttatatgttatattatattatttacaaatatcaatttaatatatatattaaaaaacaatgtgagttatatatatgtcctaaagtagatatttacctactatttatattcataaaactaaatttaatatatatatatatatatgaaaactataaaaaaaaattttaaatgaaaaataaagtgaaaagaaatgaaaaagatatcgaccttttaaagaccactttaaaaaaacttgatttaggctgtaagaaaaaataggaaagctacgacataaaatagaaactctataaattaatactcgataaattaataaacacgatatattaataaattttgccggtcccaagtcgggacaatgtaaaaattaaccaaaatcgataagataataagataataaattttttgaaatccctatgtaaagttatagtcccactaatattataaattaataatcataaatcttaagtatatattttaagactaatttttatatgaattttttgttcaagctacaattacaattcgttttaaaatacaactagtatgatatctgttgtagtcacataactatttgcgtatttgatccgttatagttgattttgtaaaatcttttatttgagaaagcattgctaagaattgtgtaaagagaaattggattaagcttcatgtttacgtttacgttcacgttcacgttaatattgtagatatacatacacaatatcttgccaaaaaataaattaaagaagtcaaagaaaaataaaaacctaacataattatatatgcaaacaacaaagcatatagataattaaattaataaacattttcaaaagaatatagtattgtattttacacaaacatttctataaattaatatttattaacttatacgataaattaatatttattaacttatacgataaattaataaatattaatttataagataaattaatatcactataaattaataaaatttcatggtcctaacattattaatttatagagtttctactgtaattgtttcaattctgaagctatagtttttaatggttttacaaattttcaacaatctaaccaatcatgtccaaaagtcgtatcatatccttatattttttcattgtattatttttaaaaatttgtaaattttaagaccaaaaaacaatttttttttgttttatcagaaaagcaaataatcaattgcctgattcattttcgtagctccaccgagaaaactccgagtggccgaaacagagatttcgcagaggaaccatcactgattgtgtcaccgaaccattgatcttcaagttccgatccaatttcagatatg

SEQ ID NO: 16979 - DNA, 3003 bp, Unknown; identical to SEQ ID NO: 16978
  misc_feature (1)..( 3003): 2750-1469P.txt file - cDNA_ID_1807395; gDNA_ID_1621187; Annot_ID_57443

SEQ ID NO: 16980 - DNA, 3003 bp, Unknown; identical to SEQ ID NO: 16978
  misc_feature (1)..( 3003): 2750-1469P.txt file - cDNA_ID_1807395; gDNA_ID_2926145; Annot_ID_139072

SEQ ID NO: 16981 - DNA, 3003 bp, Unknown; identical to SEQ ID NO: 16978
  misc_feature (1)..( 3003): 2750-1469P.txt file - cDNA_ID_1807395; gDNA_ID_1621187; Annot_ID_174480

SEQ ID NO: 16982 - DNA, 3000 bp, Unknown
  misc_feature (1)..( 3000): 2750-1469P.txt file - cDNA_ID_1807407; gDNA_ID_1620742; Annot_ID_49634
tctcctataagatttaacaccaaattttttaaagaaaaattcaaagcattgatttttttatatataatcaaatacaaactttagttacaatctaaatcctgctttgtttcttgaaaatctgtttaaattaacaatagttggtgtcttggaatcctcgtaattaactttaatctcaagatttacaaacattacaaagtaacaaaatccaaaacacgtgaaacaacaacgcgttacaagctctaacaaatactaataaggaaagaaatccaaatcataaatttctgctgacgtggatattagatacgcgctctaatccagctagcaacgacttttccagatttcttaccttacctagtccgcgtaaccgtaaaaaactaaaaaacccaatttagaccagtccagtgtcagatccaccacacatataaaataaccatatctctcacttcttcttcttcttcttcttatcactattcgctcatttccccttctctgttgttacagaagtcgacggcgagtagcttcaaccaaaaagaaacaccagtatctgtctcagcaatggaatttttccagaaagcaaaagctattcgaatgcgtaacagtcacaacaagtatctaacagcagacgacgatgaagaaaccgtaactcaaaaccgtaacggatctaccaaaaacgctcgatggaccgtcgaaccggttcgtgattctttccatgttattcgtcttaaaagctgttacggtaagtacttaaccgcttctaacgagcggttcttgctcggggctacggggaagaaagtgattcagttgaaactgagtcgggttgattcgtctgttgagtgggaaccgcttagagaagggtctaagattaagcttaggactagatctggtaactatttacgaggtaatggtggtcttcctccttggagaaactcggtcacacacgacgttcctcatttgtctgctactcaggattcgatttcttgggatgttgatgttgttgagatcttgactgattccgaattcaagacggagtctgcgaaagcgccgccaccgaagacgacgtctccaccgccgcatcggagaccgacgagttcgccgttgtcggctgagtctccaaggacttcgtcttctctttcagacagatccgattcagatgtgagtacttttcctaaattcctaaaacacctttggttttgtttaaaattacagttgtaccgttttccggttattgaaaattttgattttgattttgaccagtcggttgagtctccgcctaaatctgatggacgaaccatatattaccatgtcgctgacgaggaaggacacgtggaagatgaaacaaccgttggatatgctttcacgtttaaaggaaatagcgtggcggagctgactcagacattgcgagaagaaacgtgcatggaagacgctgtggtgtgtactcgtagtcctttaaacggcaagctgtttcctcttcgtttgcaacttcctcctaacaacggaacattgcatgtcattttactaccctccagcgcgagcctctagaatcgacccgagacaattagaaatgagtgattgtgtgattgtttggtgaagcatatgatatgaaccgtataagaagatagtaagagttggtagttggtacaagactcgttgttacatagattgaaaaaaggcgtcggcacatgaaccttgcttaatctatagactatttgtaagagttttgataataggaaggacttataaattattttttgggggaatataatacaagtttgtttttgtaaataagcgatttctttgtaaacgaacatttggattttgggggtttatttgtgtgagcatggattcataaacaaaaatcattaatttcttataagttattcactagtaaatggagattatgactcgaatgtagccaaatttagtttggatgacgtgaacaaccaaatcagaataatcacctatcttaatatagtgatttagtgaccagtagacgatagttgtgacaagaaatcttataaatactttgttgtcacaattcacgaatgttaaaggggttagaagttgaaactatctccaagttaaagtatccattaagctatcgttaaacataaaatacaaatcatgaagcatacgaagaccttaatatcaagtcatatacagaatgaatatacaaaaagaggaataattcctaatgtatacgtacgatactacgttgacgaaaaaaaaaaaaaaaacgtacgatactacgattggagttttctaattacttacagaatatttaaacaacattatgtatctagaaggatctagaataaaattgaatctaaagtacaccaaaaaagtggaatatttcccaatatcctaacaactttgataatatcttaatttcaaactgtttttattatgtaacaataccgtatttcatttcttaacttaaaactcattatttacatgatatttcaaaaattacctatgtacttgtcattatatacatggtatttcaaaaattacctatttacatattacccttttaaatggtatatttactaataaaattaagtattgcatttaggaaaagagagtgcctcttgatacaattttaaaataatacaaataccctatgtcattccaagtaactaataataaattgacaaataatttttttatacaagaaacgtaatccacaaaaataatttgaaaaaatctacacaaaatagttgaaaatagaacactcctatttatttatttttttccttttgttttgagacggataatttcacttgcattactggaatttttcatcaattattatatatttagctcaaaactatcactacccaaaaaccagacgcttcaacttatccccatttctctgaaaaccctaacaaatcctcctcttgttccgccactgccgccgccgctactcaacggtggtgaattttctatacggtcagttcgatcctctttttatcgacaatcctacacaaatccataatcatg

SEQ ID NO: 16983 - DNA, 3000 bp, Unknown; identical to SEQ ID NO: 12141
  misc_feature (1)..( 3000): 2750-1469P.txt file - cDNA_ID_1807419; gDNA_ID_2214533; Annot_ID_134325

SEQ ID NO: 16984 - DNA, 3000 bp, Unknown; identical to SEQ ID NO: 12141
  misc_feature (1)..( 3000): 2750-1469P.txt file - cDNA_ID_1807419; gDNA_ID_2214533; Annot_ID_184999

SEQ ID NO: 16985 - DNA, 3003 bp, Unknown
  misc_feature (1)..( 3003): 2750-1469P.txt file - cDNA_ID_1807429; gDNA_ID_1620618; Annot_ID_46941
ctaccttcctctctgctgctttaactgcagatgtacttatcatttattttcttactttaccatttaaataatatatcaaaacactgtagtttgcttagcattgttaaacaagactactcacttggtacttggtcgtggaatattatacggtatgcaatgaatttgcataataatctagattcggagcagtatcattaattaattttgttaggttaaaacgttttgttattaaaaatcgcttagaactgaacaaaaaccaacacatatttagaatattcattgcaacatctttgtagacaaactaaaggagcaaattcacatgtaaatctaaagaacaaaagaataaagcatagattaatcatacacacataataagaccgggaccaaattttcctcttttgccaagttcccaaattctctataaatacttcttgtctccatttcacaacagcaacgtggactctttctttgttttggctgactcttctttcaccgtttccttagagaacttattcatctcataaacaccacacacaacacacacttctctttctccttctctctatatattttaatatcaactttctagggtttccaagttcatatatagtgatgggtttctcaatgttcttctcccccgaaaacgacgtcagccatcattcctctccatatgcttctgttgactgcactctctcacttggaactccctccactcgcctctgcaacgaggatgatgaacgtagattctcgtctcatacctccgacaccataggctgggacttcttgaacggttccaagaaaggcggtggaggcggcggacataacctcctcgctcgccgttgcgccaactgcgacaccacttctactcctctttggagaaacggtccaagaggtcccaaggtatttaatatgtaacctttacatcaaatattttatcatttcttgatgtgggactaatatttctctctgtacaacaaaacaaatattgataataactttatatgatttttaatttggtcagtcgttgtgtaatgcgtgtggaatccgattcaagaaagaagagagacgtgcatcgaccgccagaaactcgacctccggcggaggatcaactgcagctggagttccaactttggatcatcaagcaagtgcaaattattattataacaataataaccaatatgcttcatcgtcgccttggcaccatcagcataatacgcagagagttccatattactcgccggccaataacgaatactcatacgttgatgatgtcagagttgttgatcatgacgtcacaaccgacccgttcttgtcttggaggcttaacgtcgccgaccggaccggccttgtccacgattttacgatgtgatgagtgatcatttcatagatattccccttataagtcttagccttggataccttttaacaaaaaagaaaagtcttagccttcgttaaattctttattttactttcctttaaatataaatatttaatgtctttttttggtctctgtgtaagtgtttttcttaaatttataattcgtatgatggatgctacttgtgttttccttgcatgacttttaaaatgttctctcgggtaatgaactaataattcgtgactttataacctttacatgatgtgtgtcctactttgaccacgattcagtgatatactatacatatacagaatacatattcattcctttaatttctttttaaagcatctttgggtttttgtacggagaatgtgaatattttgggatgcagatactatcttcacaaatacttatatcttaaacgtttaatttgtgagtttcttttccaaattgaaataatcaaatacttggaccgaatttgaaaattaagccaacaaatatctgcagggtggccaagctgaatgtttgtcgtgttttgcccaaattgtcttggaaatttgaccatcaattaggtcttcgtgtgctgctctgcttaaaactgttgctgccaactgcatgtgaagaatatttatctttttcataacgtgtttagttattgtattaaaaaaacgttagtttttatttgattgtttccggaaacacaatccaagataataaagtgttttgaaactctataacaacagaaagcgagagtaacaatttttttttgagtcatttatgagagtcaagacgaaaaaagagtcactaaactactaaatttgtcttccaattagaataataatgaaatgtttttctattttttcacgaataaaattaaatgtcttcagaatttctactttccactttcaaccgctcctgaccgggaatgagcatataagttgcgattttatttgggcctaagcccattcgatataaattccattcaaagtcaaatgaaattccaaattgaaacgattttttaaaaattggaatatagaccaccgccagattctatacctataaaactctattttaccaagacctacatatacatcatacaaatatacattacttatccgctacgcaagaagaaactgtaacatacggatttaagtaggatgtttaggtcatccaccgggtatctccccaactgtaattagatccaacaaacgctatcttgtcatcattcattgaaaagctaattaagtcattttctcaaaatcatgcataatgacaaacaaacaaaaaaaattaccaaagcaactatcaaatggtggtaatctagtgatttcggtctatttaatatcataaatggaattttgaagggatttgactgtactatgacacttttagtttctagaattgttgtgttcttgtactggttaagaggctaattaaaaaaaaaacagaaaagcatagattaacaacccaacacctaacattttaacaaattccaaatccaagtgccaattctccaagttacatttgaaaagatcgaatggaaaaaatgtttatataatgttgcatcccatttgggcttctcttcaaacatctctcaacaacaacaacaaaacaaaacttgcacaatg

SEQ ID NO: 16986 - DNA, 3003 bp, Unknown; identical to SEQ ID NO: 16985
  misc_feature (1)..( 3003): 2750-1469P.txt file - cDNA_ID_1807429; gDNA_ID_1620618; Annot_ID_162123

SEQ ID NO: 16987 - DNA, 3000 bp, Unknown
  misc_feature (1)..( 3000): 2750-1469P.txt file - cDNA_ID_1807429; gDNA_ID_2926211; Annot_ID_142002
ccttcctctctgctgctttaactgcagatgtacttatcatttattttcttactttaccatttaaataatatatcaaaacactgtagtttgcttagcattgttaaacaagactactcacttggtacttggtcgtggaatattatacggtatgcaatgaatttgcataataatctagattcggagcagtatcattaattaattttgttaggttaaaacgttttgttattaaaaatcgcttagaactgaacaaaaaccaacacatatttagaatattcattgcaacatctttgtagacaaactaaaggagcaaattcacatgtaaatctaaagaacaaaagaataaagcatagattaatcatacacacataataagaccgggaccaaattttcctcttttgccaagttcccaaattctctataaatacttcttgtctccatttcacaacagcaacgtggactctttctttgttttggctgactcttctttcaccgtttccttagagaacttattcatctcataaacaccacacacaacacacacttctctttctccttctctctatatattttaatatcaactttctagggtttccaagttcatatatagtgatgggtttctcaatgttcttctcccccgaaaacgacgtcagccatcattcctctccatatgcttctgttgactgcactctctcacttggaactccctccactcgcctctgcaacgaggatgatgaacgtagattctcgtctcatacctccgacaccataggctgggacttcttgaacggttccaagaaaggcggtggaggcggcggacataacctcctcgctcgccgttgcgccaactgcgacaccacttctactcctctttggagaaacggtccaagaggtcccaaggtatttaatatgtaacctttacatcaaatattttatcatttcttgatgtgggactaatatttctctctgtacaacaaaacaaatattgataataactttatatgatttttaatttggtcagtcgttgtgtaatgcgtgtggaatccgattcaagaaagaagagagacgtgcatcgaccgccagaaactcgacctccggcggaggatcaactgcagctggagttccaactttggatcatcaagcaagtgcaaattattattataacaataataaccaatatgcttcatcgtcgccttggcaccatcagcataatacgcagagagttccatattactcgccggccaataacgaatactcatacgttgatgatgtcagagttgttgatcatgacgtcacaaccgacccgttcttgtcttggaggcttaacgtcgccgaccggaccggccttgtccacgattttacgatgtgatgagtgatcatttcatagatattccccttataagtcttagccttggataccttttaacaaaaaagaaaagtcttagccttcgttaaattctttattttactttcctttaaatataaatatttaatgtctttttttggtctctgtgtaagtgtttttcttaaatttataattcgtatgatggatgctacttgtgttttccttgcatgacttttaaaatgttctctcgggtaatgaactaataattcgtgactttataacctttacatgatgtgtgtcctactttgaccacgattcagtgatatactatacatatacagaatacatattcattcctttaatttctttttaaagcatctttgggtttttgtacggagaatgtgaatattttgggatgcagatactatcttcacaaatacttatatcttaaacgtttaatttgtgagtttcttttccaaattgaaataatcaaatacttggaccgaatttgaaaattaagccaacaaatatctgcagggtggccaagctgaatgtttgtcgtgttttgcccaaattgtcttggaaatttgaccatcaattaggtcttcgtgtgctgctctgcttaaaactgttgctgccaactgcatgtgaagaatatttatctttttcataacgtgtttagttattgtattaaaaaaacgttagtttttatttgattgtttccggaaacacaatccaagataataaagtgttttgaaactctataacaacagaaagcgagagtaacaatttttttttgagtcatttatgagagtcaagacgaaaaaagagtcactaaactactaaatttgtcttccaattagaataataatgaaatgtttttctattttttcacgaataaaattaaatgtcttcagaatttctactttccactttcaaccgctcctgaccgggaatgagcatataagttgcgattttatttgggcctaagcccattcgatataaattccattcaaagtcaaatgaaattccaaattgaaacgattttttaaaaattggaatatagaccaccgccagattctatacctataaaactctattttaccaagacctacatatacatcatacaaatatacattacttatccgctacgcaagaagaaactgtaacatacggatttaagtaggatgtttaggtcatccaccgggtatctccccaactgtaattagatccaacaaacgctatcttgtcatcattcattgaaaagctaattaagtcattttctcaaaatcatgcataatgacaaacaaacaaaaaaaattaccaaagcaactatcaaatggtggtaatctagtgatttcggtctatttaatatcataaatggaattttgaagggatttgactgtactatgacacttttagtttctagaattgttgtgttcttgtactggttaagaggctaattaaaaaaaaaacagaaaagcatagattaacaacccaacacctaacattttaacaaattccaaatccaagtgccaattctccaagttacatttgaaaagatcgaatggaaaaaatgtttatataatgttgcatcccatttgggcttctcttcaaacatctctcaacaacaacaacaaaacaaaacttgcacaatg

SEQ ID NO: 16988 - DNA, 3000 bp, Unknown; identical to SEQ ID NO: 16987
  misc_feature (1)..( 3000): 2750-1469P.txt file - cDNA_ID_1807429; gDNA_ID_2926211; Annot_ID_202647

SEQ ID NO: 16989 - DNA, 3000 bp, Unknown; identical to SEQ ID NO: 11310
  misc_feature (1)..( 3000): 2750-1469P.txt file - cDNA_ID_1807433; gDNA_ID_2214489; Annot_ID_133432

SEQ ID NO: 16990 - DNA, 3003 bp, Unknown
  misc_feature (1)..( 3003): 2750-1469P.txt file - cDNA_ID_1807441; gDNA_ID_1620617; Annot_ID_46899
ataagagataatgccattttgttaaatcattattaaaattgaagaaaaatttaaacagtgcatctaattctcttctttgactacatccaaacaaagaacaaaattcccaaatcatttttattcttcttttttacaagtgggcatttgtgaggttgtgaggcccaaccaaaagagcctctcactacattccacaagaaccacacaaattcaaaagtctcactcctaacacaaagaagcatccaaacgcaatcctctcacctccacctcacattcccctgtgccaccatcacttaccctttctcgcctctcctgaaatcaaaatcccattatgcaaatccattttcatcatcatcaatatcatcaccaacttcattctcatcatccatggcccatttctcatctatgtagattctcatctctctacctcctcctcattttctcctcttgattcactaattcttcttcttcttcttcttttcagacatgactcttccttatcgtttctcttccgttagaaaccactcacttctacttaagacttctcatctctgcacacccagatcagctcttggttgttgtttctctcccaaggaatcccctttcttcaggaagaacactgcccaattcctttctcctcagaaacacacttctcttcctctgaaacttgtctgccctttagctagtttctcttcttatgcggattctgagggagaagagcaacaccatgctgatcaaccgatacagaaccctcacgaatcttctaccgtttcaaacgaatcagatgggaaaggtaatgcagaagctactggagacttttctggaatggctcaagcctttcacatttcttccacaacagcaagggcaatctctatagtcatcgccttctctgctctcacccttccaatcttcatgaagtccctgggacaaggactggctctcaagaccaagcttctctcttacgcaacactactctttggtttctacatggcctggaacatcggagctaatgatgtcgcaaatgccatggggacttctgttggatctggagccttgacaatccggcaagctgtgatgacagctgcagttctcgaattctcaggtgctcttttgatgggaactcacgtgactagcacgatgcagaaaggaattctcatggctaatgtgttccaagggaaagatatgttgctctttgctggtctcctctcttccttagctgcagctggaacttggttacaggttccatcttatcttttgcttcttcatcactaggttcaagacaggatttagtaaagttaataccttttaaagatggcattcacaaatgatacaagtagagaacgtaattgtgaacttgtgaatataacaggtagcttcttactatggatggccagtatcaacaactcactgtatcgtcggatcaatggttgggtttgggcttgtatatggaggagctggtgccgttttctggagttccctagctaaagtagcttcatcttgggtcatctctcctatactgggagctcttgtctccttcctagtctacaaatgcatcaggagagtaagtaaaacaaaccaagaaactaactttctaattctgaaagatcactaaagtcatactcaagcttctgctacattttcacactcttctttcgttctgtgcagtttgtttacagtgcaccaaacccaggacaagcagcggctgctgccgctcccgtcgctgtatttgtaggtgtggccagtatctcctcagccgcattgcctctaagtaagatctttccaatagctctatcacaagccttagcctgtggagtagcaggagccatagtattcgacagaatcatccgcaaacagctcggtcacctcctagctaaaacaaaatcaccagaaacatctcaaaaccaacccaaaaccattggtttcctctccgatatcgcaggaccaacaggtacacaactcgaaatagtctacggaatctttggctatatgcaagtcctctccgcttgcttcatgtcattcgctcacggaggcaacgacgtctccaacgcaatcggaccattagccgccgcattaagcattctccaaaacggagcagctgcaggaggagccgagatcgttatcccaatggatgttctcgcttggggaggattcggaatcgttgctggtctcacaatgtggggatacagagtcatcgcaacgatagggaagaagatcactgagctaacaccaacaagaggattcgctgcggaattcgccgccgcgtcggttgttttgtttgcttcgaaattagggcttccgatttctgcgactcatacacttgttggtgctgtgatgggtgttggtttcgctagagggcttaatagtgtgagagctgagactgtgagagagatcgttgcttcgtggcttgtcaccattcccgttggtgctacactcgccgttatctacacttggattttcaccaagatcttatcttttgtattgtgagtttctgtttcttttggttttgttatacgaagaacatgaaattgatcttcttcttctatgttcgtttgaatgattcgagtttgaaaaaaccctaaagttatcatctttcgattttttcacccatcggtgaagtatgatcaaagcttgtacctttcttgttcagtgtttcgtctcgtcgtccagtaaaatcgaattagagtgggtgacgtttggttacttctaaaacgtcttgttgtttgtttcctaatcgtaaaaacgtcataactttttaaacgacatcgtttttttttcgagtaaacgtgagacgcgcgtatctcttgcttttcgtacacgcgtctcgaacaaagactgacatgattatcttggctaaagacggaaatagccttacacgtttccccatttcagcgataaaattgagggtatttgagtcaaataaagaaatagaaatatctctcttcttctatcttttgattctctggttctacttgttcctctgttttggattgtggtggctctctaatg

SEQ ID NO: 16991 - DNA, 3003 bp, Unknown; identical to SEQ ID NO: 16990
  misc_feature (1)..( 3003): 2750-1469P.txt file - cDNA_ID_1807441; gDNA_ID_1620617; Annot_ID_162058

SEQ ID NO: 16992 - DNA, 3003 bp, Unknown; identical to SEQ ID NO: 16990
  misc_feature (1)..( 3003): 2750-1469P.txt file - cDNA_ID_1807441; gDNA_ID_1620593; Annot_ID_161472

SEQ ID NO: 16993 - DNA, 3003 bp, Unknown
  misc_feature (1)..( 3003): 2750-1469P.txt file - cDNA_ID_1807445; gDNA_ID_1621108; Annot_ID_56023
tttcatgtccctatatcaatcacataaagcgttttccaataacataaaaagtcggataaatgaaaatatttgagaatctaaaacaatgtcatatatactttaatggaaggtccttttcttcgaaatatttgctcaccgaaatcggtgaaagtgatctaagactaaaactaacttgtgagtaattcatgtgatgggccttctgcatcgaaaaagagcatggcgatcacgtggcagcctctcttgcgccgtctcagtattagcctatcacgatagagtaagccaatgtatacagcatggcgatcagacacatgatgatgatcgatctgaataacaagattccgaaggatgtaataaattcatgtgaacagtgcttcgtagctaaactaagaccagagctattgaaatgaggtaaagtgttttctttgtaaccccattttaattaggtgaaatatctagcgcacacaccaatctgattcatataatcataactagcttgtaaactacaaaattatttttcattgtgttacaactagaccattcccacgtgaccattcacgtgctcctataatgaaagaaacctaaagaagagacgctccaattcgcatagacatcccaagcttatcctttcttagtgaatcaagatccaatttacactataatacatgcatatattacgtaataaatgttttataagttttctgtgtcactcactatttttagttattttctcaattttcaatcatcgcaaatatcaattatcacaaaacatataaagtttccagatttgtatatgggcctaccttattagatgcgatgaatatggactaagtacagagctgatggtttttgttataaatatcgtttcctcttctaccctcacctttactctgtttctttctccactctctctctctctcgttgcaagcaacttgttttctgaatccaaagaagacgataacgatgaatggagctataggaggtgaccttttgctcaattttcctgacatgtcggtcctagagcgccaaagggctcacctcaagtacctcaatcccacctttgattctcctctcgccggcttctttgccgattcttcaatgattaccggcggcgagatggacagctatctttcgactgccggtttgaatcttccgatgatgtacggtgagacgacggtggaaggtgattcaagactctcaatttcgccggaaacgacgcttgggactggaaatttcaagaaacggaagtttgatacagagactaaggttcgtgtgtaaagaaaacttaagtttaagttctataaatgaaaaagaaaacagatcttactttgagatttggcttatctgtttcttctgtgtgtgcttttaggattgtaatgagaagaagaagaagatgacgatgaacagagatgacctagtagaagaaggagaagaagagaagtcgaaaataacagagcaaaacaatgggagcacaaaaagcatcaagaagatgaaacacaaagccaagaaagaagagaacaatttctctaatgattcatctaaagtgacgaaggaattggagaaaacggattatattcatgttcgtgcacgacgaggccaagccactgatagtcacagcatagcagaacgagtaagagagcctcattaactaaaattcattaactttgttttttgtgtaatcattgagactaattattaaagtattaaatttgtgaaggttagaagagaaaagatcagtgagagaatgaagtttctacaagatttggttcctggatgcgacaagatcacaggcaaagcagggatgcttgatgaaatcattaactatgttcagtctcttcagagacaaatcgaggtctgaaaattatttccatttatagaaaatatgttttaaagactaattttgcattaccttcctaatttgttatcaaaatattgtttaaaacagttcttatcgatgaaactagcaattgtgaatccaaggccggattttgatatggatgacatttttgccaaagaggttagtcattgatttgtttatgcttatatgaaaaacaaaactttaaaggctatttatagatgagctaaaatacgccatgtggattcaaaaccaggttgcctcaactccaatgactgtggtgccatctcctgaaatggttctttccggttattctcatgagatggttcactctggttattctagtgagatggttaactccggttaccttcatgtcaatccaatgcagcaagtgaataccagttctgatccattgtcatgcttcaacgtaagtcatatttttaatactctttcattatgatctatcctttagtttaactttggatatgataattttttactaaatatgttttgattgttacagaatggcgaagctccttcgatgtgggactctcatgtgcagaatctctatggcaatttaggagtttgattaagaaaccaatccacaacataacaatgttccctaattcaaattattcatcggaagagagagcaaaccagtagctgttatttactaattccactagattattgacttgagatcccccgcccattagttgatgtatcaaagagtgtagacattattgtgtataatttgcaaaccagtccagtaatatatttcttatcggtggacttgtgtctttaattcaaggtgtgttctcatcttcttgtggtgaatgatcatccattagtatttttttttttagtatacaatgccacaagtcatgcgaccatgaaatcaagaaacaagacaccagtcgtttaacgttatgttttacatcttatcactaacaatcttctaatctatgttttggttactttgaaaaagcgggactaatcccaaatttaaagcaattgaataaacaacacctgttaagcgtggcggacaaaacgacgacaatgtaagagaactgagtcagagattaaaacctatgaccaacccattggaactaaactatcctaattctctatacggagagtatatataaatg

SEQ ID NO: 16994 - DNA, 3003 bp, Unknown; identical to SEQ ID NO: 16993
  misc_feature (1)..( 3003): 2750-1469P.txt file - cDNA_ID_1807445; gDNA_ID_1621108; Annot_ID_171668

SEQ ID NO: 16995 - DNA, 3003 bp, Unknown; identical to SEQ ID NO: 16993
  misc_feature (1)..( 3003): 2750-1469P.txt file - cDNA_ID_1807445; gDNA_ID_2926207; Annot_ID_141803

SEQ ID NO: 16996 - DNA, 3003 bp, Unknown; identical to SEQ ID NO: 16993
  misc_feature (1)..( 3003): 2750-1469P.txt file - cDNA_ID_1807445; gDNA_ID_2926207; Annot_ID_202324

SEQ ID NO: 16997 - DNA, 3000 bp, Unknown; identical to SEQ ID NO: 6974
  misc_feature (1)..( 3000): 2750-1469P.txt file - cDNA_ID_1807460; gDNA_ID_1621119; Annot_ID_56263

SEQ ID NO: 16998 - DNA, 3000 bp, Unknown; identical to SEQ ID NO: 4035
  misc_feature (1)..( 3000): 2750-1469P.txt file - cDNA_ID_1807468; gDNA_ID_1620680; Annot_ID_48336

SEQ ID NO: 16999 - DNA, 3000 bp, Unknown; identical to SEQ ID NO: 7398
  misc_feature (1)..( 3000): 2750-1469P.txt file - cDNA_ID_1807472; gDNA_ID_1621143; Annot_ID_56689

SEQ ID NO: 17000 - DNA, 3003 bp, Unknown
  misc_feature (1)..( 3003): 2750-1469P.txt file - cDNA_ID_1807490; gDNA_ID_2214478; Annot_ID_133191
acaaacaacacatctctctgcttagttttgtacactcaaaaccatccttgacaattttttgagcgaaaaccttttgtcttgagaacagactaattgctgtcagctcattactgatttcattcaataagcaatgacacttacctttagatcagtgttttgaagtttctttaagacctaactttgatccaacctctacttatccaatgttagatacattgatgcggaagatagagtgaaggtgagttcagagaaattgcagaagttgggttggacttaccggccgttggaggaaacacttgtggattctgttgagagctaccggaaagctaagcttgtggactgaaaacttggaaagaagagcaaaatagtgttttagcttcatatgttatagttatagtgttccattctgcacacacacacacactctctcatcgtttactcaataataagagttgtgcattcaccatggatttctgagtttttgttattttctttttagatatcattacttttattaccaatctacaattttctttccataatattttacaatatctctctattgtatatgttgttccaatttctaccgaaatcttactttcaaaggataaaacacacaaacttttatctcaattggtacgtcttgtttctgtataaatttgttaatcattgtagaaaataacataacaaatgtggatttaagctgaacataaatattaatgctttttccgatgaataaaattagtcgaacaaaagttgagatatggagctgaagcagagatggtcaaagtcaaacaaatagctaccatttgcacaaggaagaatcttcttctcatttgggtgatcaaaaatggcggttgtgcagaaaggaaaggtttgtgtaaccggtgccggaggttttttgggttcttgggtcgtcaatcatctcctctctagggattacttcgtccacggcactgtcagagaccctggtactactctcctcaccttttatctctccctctgtaaattgtcaacctttattctctcgcatttctagttcatcgaatttttgtagctcagcctggtcaaaattgattctttcgtctactttctaaggttttctattcccaattctttttgtagctccgatgtttctgtctacagacagaagattaagccttttgagtttgtctattgttctgatgaagagtttcgcatggttcttgttataggtaatgaaaagtatgctcatttgaagaagcttgataaagctggtgacaaactcaagctcttcaaggctgatttgctcaactacggctctcttcaatctgctattgctggctgcagcggcgtcttccatgtcgcttgccctgttccatctgcttcagtccctaatcctgaggtgaggatttcatttttacaatctcattggtggctatatgcattgtctcactatggtttcactggttttgcaggtagatttgatcgcacctgcagtggatggtacgctgaatgtgcttaaggcatgcgttgaagcaaaagttaagcgtgttgtgtatgtttcctctgtatctgcagttgctatgaaccctatgtggtcaaagagtcaagtgttagatgagaccgcttggtctgaccaagattattgcaaaaaaactgaggttaataatgcatcttgaatccctcatctcacttttttttcttcttttaaatctgactttcgtccctctggcagaattggtattctttgtcaaagacacgagcagaaagtgaagctttcgaatttgcaaaacgaaccggacttgatctcgtcagtgtttgccctacccttgtcttgggacctgtattgcagcagcacacagtaaatgctagtagccttgttcttctcaagcttcttaaaggtattataaacaagcctctcatttcatctgggattgttagaagcagcaacttggtatatgagttggtattgattttatacttaagtgtggtgcagagggttatgaatcgcgtaataaccaagaacggcatttggtagatgtgcgtgatgtggctcaagctttacttttggtttatgagaaagcagaagctgaaggaaggtacatctgcataggccacacggttagggaacaagaagtcgctgagaagctgaaaagtctttatctaaattacaactacccaaagaggtaagcaaacaacagctgcacatctctctacccaatttgagtgaaaacctttaaaccttaataagctgtttttgttactttcatcagtaaacagtgtcacttacctttacatcaatgtctctgaagtttcttttagaccttacctttgatctaaattctacttatccaatatcagatacatcgaagcggatggaaaagtgaaggtgagttcagagaagttgcagaagttgggttggacttaccggccgttggaggaaacacttgtggattctgttgagagctaccgcaaagctaagcttgtggactgaaaactgggaacgaatagcatatgagtgttttgggtccatgtgttaagtgttcctatctgcacacgctctttcatcttttactcaagaataagagttgtgcaacatattttccatcatgaacttctgagtttttgttactttcttagacaccattacttttatgaccaatctacaattactccttccataactatgttccaatatctctttgatacgttccaatttctacctacttacaaaggataacttcaccattaatacatgaaatcagtaacgcacaacttcaccattcgaattaacctctaagcctagcgtagcagatgcactacatcttggctgaccatgggactaaaaaaacattcgcaatatttaacaactaaagccaggttaatggacctgtattagggcccaaaccaggcccgtttagatatccgactttttttttaactttgcccatctcgatagctagattctcttttccctcttccttctccggcgaagttgcgttagttaaacagagagtcatg

SEQ ID NO: 17001 - DNA, 3000 bp, Unknown; identical to SEQ ID NO: 4772
  misc_feature (1)..( 3000): 2750-1469P.txt file - cDNA_ID_1807494; gDNA_ID_1620730; Annot_ID_49379

SEQ ID NO: 17002 - DNA, 3000 bp, Unknown; identical to SEQ ID NO: 4772
  misc_feature (1)..( 3000): 2750-1469P.txt file - cDNA_ID_1807494; gDNA_ID_1620730; Annot_ID_166087

SEQ ID NO: 17003 - DNA, 3000 bp, Unknown; identical to SEQ ID NO: 4772
  misc_feature (1)..( 3000): 2750-1469P.txt file - cDNA_ID_1807494; gDNA_ID_2926157; Annot_ID_139581

SEQ ID NO: 17004 - DNA, 3000 bp, Unknown; identical to SEQ ID NO: 4772
  misc_feature (1)..( 3000): 2750-1469P.txt file - cDNA_ID_1807494; gDNA_ID_2926157; Annot_ID_198522

SEQ ID NO: 17005 - DNA, 3000 bp, Unknown; identical to SEQ ID NO: 4382
  misc_feature (1)..( 3000): 2750-1469P.txt file - cDNA_ID_1807497; gDNA_ID_1620703; Annot_ID_48804

SEQ ID NO: 17006 - DNA, 3000 bp, Unknown; identical to SEQ ID NO: 4382
  misc_feature (1)..( 3000): 2750-1469P.txt file - cDNA_ID_1807497; gDNA_ID_1620703; Annot_ID_165150

SEQ ID NO: 17007 - DNA, 3000 bp, Unknown; identical to SEQ ID NO: 4382
  misc_feature (1)..( 3000): 2750-1469P.txt file - cDNA_ID_1807497; gDNA_ID_2926174; Annot_ID_140253

SEQ ID NO: 17008 - DNA, 3000 bp, Unknown; identical to SEQ ID NO: 4382
  misc_feature (1)..( 3000): 2750-1469P.txt file - cDNA_ID_1807497; gDNA_ID_2926174; Annot_ID_199728

SEQ ID NO: 17009 - DNA, 3003 bp, Unknown
  misc_feature (1)..( 3003): 2750-1469P.txt file - cDNA_ID_1807508; gDNA_ID_1621200; Annot_ID_57642
ttcatcttactctactagtagtggtccttcagatgtcctagcaatctttcccatgacccatctagcgtaggccttactaggttctgcttatgtttttaaattttgattttgcagtcaatctggcatatggtaattggttaaagggaaatttttatccagctttgagtttcctggtatgtattatctttgtggtgacatattttctcgattatagatttagaaaatcggtcatgctatccagaactatggggtttgctgacatctctgttatccgataatcagatttttgccactgtaatcttcagatgcgatacgatgttactgcttgggcctattggtcttgaacttttattggtgagctggtgacgaatattaaatagtttgggttctcaacttctgtatatgtataattggccgtatactttaccgttccatctgatgcgggtgctttatgtttgtcaatgacagaccaaatcgatctccttctggaaagcacttaagtattgtgttggaaccgctctgttggccgtaggttggttaaaattcctcttctttctgtgatctattttgctttttcccttcagacactaattcccgagtctattttctgtggtcatggaataatccttagcacaggtcttaccattttcgttgactctatcatgtggaagaagtttgtctggccagaatttgaagttttctggtttaactccattctaaaccggagttctgattggggtgtatccttcaaaaaaattgtttcctcaattgatttatttttcatatgatgcataatgttctagcatttttctactgcctgattaaaggattgcgttctgtacaatgataaccgtttggaatttccaattcaaagtttaatattgtggcacttgcatttgtatgaaatgatgtgttgtccttgaaaattagttgctaaactagacacattccatacattggtacttcacctcagcactcccacggtctttacttgtagcttatccactttcattggtaaataccagacttcctaacatctgtgatagtgtttgtcttgttcctttctagttaggatcgctaattgtatctctacaaattttcttatttggtttctttttatgcagcttggtactttagttgacagaagggttccattctttatagttccagttttatcgttcgttatactatactctaaacttccacacaaggtattcagatggattacttatctcagtagccatcaacgtttcttaaccattttctgacatcggcttacctatctttcttgatttatgaaggaactccgatttatcattagttcagtgccaatgttcaacttgtctgctgcagttgctgctagcagaatgtatgagttctatcagatgtttgctagctaagctttcaatcatagctaggacgttctttgattctgtatcttaagagctctttggagtttggatacacataatttctgtatgccactttaaattactaccaatgcgggccgacctcttaatataatccgattttgttgtacagctacaataataggaagaaaacgatttggaaactggtgaatatggttatgctagcgttttttgcaatcaggtagaaatagtaaacaattatctttgctatgtaagagaaggaaagagatttgctagtctactaaacctggttctatagtgcagggtgcacggttgtaacattcatggcatcttactacaattatcctagcggctatgctttaaagcgcttgcatcagattggtgagtgacttattctgttattggggtttgttattaatgcagcagcattgacttggctatcaaacaagaaacatctgctggtcagcgtttgttttgtggtgtctatctacctctggttgataatttgcctacaatatgattaattgacttggtgccttccatggttctcaggccatcctgcaaatgtagctggggaagagtgggttcacatagacacttttggtgcgatgaatggaatatctcgcttttgtgaagatgattttccgtggaggtatgttagctgtactacctcgttttagggttggtaaaagtaaaggaaatatcaatgtacatggaaaaaagttgccactcggaagcacccatttgtgcgagatgaggcatctgtttgtttttcatgttcattttcttggatacgaatatcactttgttggaaaagggatcattctacattgcctttgaatacatagaagaggtatctgtttatctatttaggaggatataaaattttgttgtgcaatgcagatattccaaagaagaagagatagtagtggaggagttgcgaaaccgaaatttcacgtacctggtgaagtgagtatttcatcatatagtagaaagcaattcatagtaaataaaaaaagataccactggtggtcaacatgtaacactgttgtcatgcttggtgcagcgagcattcctctgtagatggatacaagtgcttattttatgaagaaggctttgagagacttgagctgcggcgaggtttccctcccattgtcttggtaaatcggtgggcgtggggctagtatttcatcaaaataggtgcatggaatgtaatgtaatgtaatgttgaattgcaggtaaaaaaagccaaagtatacttgcaccgggagatgaagaaggaagatccttttcataagaaatggcctggatgttaggtaatcctacaaatagagacaatgttttgggtcgatgtaatgtagcattcctcagagaggacatgatgtaatgtaacaacggagatgcttgttactgacttactgtaatggattcaacaaattcatccagaagcatcatcggcctttgggctttgagttacgcgtcacaattgaatcaattggtccttttaattagttttaccaatatacccctccgtcttttcccccttctcgtttaggaaaaaaaatcattagcttcgacttatccgaaacctaacgagtaacgacgagagatg

SEQ ID NO: 17010 - DNA, 3000 bp, Unknown; identical to SEQ ID NO: 3757
  misc_feature (1)..( 3000): 2750-1469P.txt file - cDNA_ID_1807522; gDNA_ID_1620662; Annot_ID_47992

SEQ ID NO: 17011 - DNA, 3000 bp, Unknown; identical to SEQ ID NO: 3757
  misc_feature (1)..( 3000): 2750-1469P.txt file - cDNA_ID_1807522; gDNA_ID_2926151; Annot_ID_139326

SEQ ID NO: 17012 - DNA, 3003 bp, Unknown
  misc_feature (1)..( 3003): 2750-1469P.txt file - cDNA_ID_1807526; gDNA_ID_2214552; Annot_ID_134693
tctttgttgatttactctaatctgtgaaattaactaactataaaaaccagcatcatgttttaatctactaataaagaccattcaacatattaataaaatataatccgatggtgacgactgatgatcataatactagtagtaatggatcaatcaagaatcctctttaggttagaaaaatagactaataaccaattatagagttatatttaagctcaacaaaacccacaatagtacattctcgttggtttcttcttaatattatattgttgcttgttttgtaccaacaaaaaaagtacgaaccacacactttcgatcgtgattaggcttctttcaacaaattttgattagtaatataattaaactatcatcgtctacataacatatgttatccgtttcactcaacctatctatgttatctctttgcgaatctggcgcgggtacttcaactagtgtagaaagatactattcaaaaaaaaaaaaaaaatctaagatcacgagattaaacatgatatatatatgatgtttaacaataacaaagcggtttgttcaaaaaaataaagcggtgccggtatgctagagaggaaagccttgataattacgaccacaagttgtatgagaaaaattattggaaccttttgtatttcatgaccctgagaaaaattgaaaatttgacttaacgtggagtttgctagagaaaatgactcaacaaaattatatccctagctttgttttacgtcaaattgttactctcttttcagttggttcgctagtttgatttccggtattaagttactaaaagcacataatgatatttcagttggttcttggtaataagtttacacgagacttttgtggtattaaagtacataatgatcttttaattagatattattaaagcaaaggtgaaaaaagtggttcgtttactgtttttacaatgtgacgactgacaagaaacatggacgtgttaggttggatagatagctagatactatcacggggcattgtttgattctttctggcgaataatatacacttattttgttctttttatatataccaattgaatcctataatcaatataatattagtccactaaccacgagcactttttgcagattgactttccaacgatttataatagtaatatcttcataaagaaattcattagcattctacaattttcttcataaactggaagtgacaacaatcggacataaaaatgattcaacttttccatgacaatttttgtttctttggtgaagaaattaatcttttctaaataaactttttttattgaccaaaaacaatgtatcttttaaaagattgcacggattctatggttgaatatattctagatttagtttgtaatagcatatcgtcaactagacataagtctatattcctcactagctcgtgttcctttcttctttcgtcacggttagttcagatccggacaagaatcctggattgacaaaattttggaaatggcttaattaaactattgttttatctttcttacaattctttgaaacggtgatatttcatataaaattctcaaaatttttaaattagtgtcgttaaattctgtattagcagctcaaccagttaaatataaagccacgttttgagagaatcggattatatctgaaattcgataccagttacgaagattatattacatttgattttgaagttgtaagataaaaaaaattagtgtcattattgtatgaacttcgtgaagtttatttatgtgcttcacttttagttaataatgtaatatgtataacaaaaacaaacttgtatgcctatatttagtacaggtggattgaatcgtatcaatgtcacgtaaaagttttatttggtttaatgtctcacgtaaaagttgcttttacttttcaggtgcctagccgtgttcagaaatcagagaccaaaatcttatgggggcaatatgatcaaatgtaatataccaacagttagttaatgcggattgttgacaaagaagaacatttcatgatcggatattgttgacaaaaaactactgtaagccaaaaatgaacaaaagaaattaatgataattaagtataagacttgacaaaaccaagccgacatgagctgagtcaagttcatgtcgtcaatgttatagtgatgattgacgaatatccaacggctgagaatgattggaccgcagtggaatggacttttaactataaaatgggacgaattattcatgattgcttaattgaaaattcacattgttattttgttatttatttatcattaaaactctacttcttttctcttttagtcagttttgataaaattcaaaatttcgtttgttacaatttgaatagtattttaaaatcaataacatcttttttttgtcattctaaataattaaaactcaaaataataatttttaaaaaatattgtttatatatgtgatataatgtggtaaaatacgaatcaatatattttcgtataataaatttatattccttataaattatcgtcaaacttcatattaccaatgtttatttttgggttaaaatctcacactattttttttttatacttcaaaactcatatattttttgaacaatcatgcctccaatatagaaaaaacaaaattgacggatacaaagaaaaaaaaacaaatttgacattgaatataaatgcaaatatttttttgaaaaagtagaaaaaataaaaagaagatggggtttaaaggcgggaccggtccgtcatcaatgccacctccctaactcctttctctttctctctttcagctacttgcaacaaaattgcaaaattgtcgacagaaacttctctcaaatttagttcctttctcatttatccactgctcttaatccaacttcaatatctctctatcctcacaatatttgttctgtttctccttcaactttcaactgataaagtttaaacctttatgctctttactctctgatctcaaaagggttttgtttagttctcctcaaaaccatg

SEQ ID NO: 17013 - DNA, 3003 bp, Unknown; identical to SEQ ID NO: 17012
  misc_feature (1)..( 3003): 2750-1469P.txt file - cDNA_ID_1807526; gDNA_ID_2214552; Annot_ID_185592

SEQ ID NO: 17014 - DNA, 3000 bp, Unknown; identical to SEQ ID NO: 6291
  misc_feature (1)..( 3000): 2750-1469P.txt file - cDNA_ID_1807542; gDNA_ID_1621088; Annot_ID_55450

SEQ ID NO: 17015 - DNA, 3000 bp, Unknown; identical to SEQ ID NO: 6291
  misc_feature (1)..( 3000): 2750-1469P.txt file - cDNA_ID_1807542; gDNA_ID_1621088; Annot_ID_170586

SEQ ID NO: 17016 - DNA, 3003 bp, Unknown
  misc_feature (1)..( 3003): 2750-1469P.txt file - cDNA_ID_1807542; gDNA_ID_2926212; Annot_ID_142033
gtttgttattgcatcatcccactcaaaatatgtacaacgtgtcatgtaaaaagcttttgaggagcttagatttttagatttcattgaaagtttcactgatttttcttattttattttcacattcatatcgtcctactctattttcctctaattatttttttgtttcctacatcaactaatttgatgtttaattacatttgaaacatatcttatgttcattgaaaattatttaagattttgaccgacatatgggattagtaaaatatatcagcagctttagttatgatatgataaatccactacatggaaatatttgatgagtttggaatacactgaaaaaagacacagaattcttcaattcctcattcattcctttagaataaatcattgcaataaactccaaaaaaaactcgatggtaaaatcacaaagtggatagtgacgtggcaacctcaaaaattttggtttcaatttttttgttagcccatctttcttcttggacccaacaaatacacgaaaataaaattattcatgtttccctttccgacacaagtccatctccttcatctttcattcgattatttttgtggagatttttcagttagtaatagttttaatatctataaagattaaaaaaatattatggtgatgtaaaggatgacgaatttgctcacaaacaaataaaatacgaatctaacaatccaaatcttataattatataaaacaccaaaatgtaataacagttggctccagcattctagtcagaaaccaaacgtcatctcgagtcgtatctcgtgttcctcacgcgcgtttataagaaagggtgataaacacgcgggttttagagcgcctgaagatgaaaatacgaggtatagagagaaacgaaaggttattggtggatggaagagggaaaaagtggaccccatagtttgtccgtactaaaggattgatcttttctggtaacattttcctttttctctcataattcctttttccttttttcgatacctcttcctctctctaataacaaatcaacgtttttttgttttttgagtatttacgtttatatcctcgtagtcctctcatattttcagattaacctcaagggttttatatgggccactcattcttatgtaatctctccctttcttaatcgattttttaaatcttttactgggcattaccgatcaagcccgattataataaacccaaatagaataattagtaatctggtttggtgtatatttcaaattagaacaaacaaaaacaaaaagcaaaaagtttcattaaaccgaaccaaatggttgtaaatcataagaattgaatgcctaacctaaagcaaagcaatgcctcattttgcaccaaattagatggaaactagcttatgatatctcaaaattagtttgttcctagcaagttgatgaagcaacttgtgagctatttccactacgatttcgttctcttgagtgttttggttgtaattaattttgattaggtctaaaatcttcgtgtcacatgttctgcatgtacaactgtatttttcttgagaaaaaaagccattgcacaaacttcagttcaaaacattttgtgtttcttctatcaattattactatatagaaaaagtttctctcttgatatttgagtttaaaatctggtaatcatcaatgaatattgtcaacagttgttaaaatcagcaactttactaaatatgaacagagaatgcaaatggtggaagtttcacattatattggcaagtgtagaaaaatgtctgaaagtatatgggcgactgggagttatcattcattaagaaaacaaagaaatctagatcgttaaattctacggttaagaaagactttttattatggtaaagaaaaatagtcaaataaccaaagtaagcaattaatatagtttgatcaatgagttcaaaagcctttggttggaataactcattaagaaaacagatagtttaaaatcaattgaattatgatttcagacatagtataagtttgggcaaagtattttaatggaaatagaatacaaacttgataacaagttattgccatttagaaaatgttataactccttatatagtgagaaccctattgcttgcttgtgttcaaggaattgctgtttatggaactccactttaaataaacatataaataatctatttagtatcaaaaacttaatatcccatctactttgaatttgcccgatcatgaaaacacctatttattgtacataaatatacatctttaacaaatatagatctatgcgtgatctatttgtatttgtatcttattaccttttattcatatagaaaaaggaaaaaacaaacaaaaagctttgttccaagagtttaaagtatatcaaaattggcaaaattgtggggttttgaagtaatctactagattattcattttcttgcaaaaaacacctttttatagaattgcttaccgaaccaagccgtggacttcactttcttaaaacatgaaattacatattaaaggaatcttttgattaatcaaagaagatgtttgtatacatagataataaatgaaagtggaaatatttttttaaaataaaaataaaaaaaataaagaaactccaatacgaggaattgtttcgaatataatcttttttccaaagaaagcaagtggttagagagagaataatattattttattaaatttttacaaaaaaaacagtgacaagagaagagagagagagaaagggcagtggaagtaaatataaaggaaaggataaaaatgaaagctttcgtagaagcaatctatcaaatttttattttattttcttctctctctctctttagctcttttttttttgttttcattaaagtttttattttattttctaccaaccaaaagcttttctctttggtttctcttatttagcttctaaccttgaggagaatcataccagaggattgaagtttgaaccttcaaagatcaaaatcaagaaaccaaaaaaaaacaaaaaaaatg

SEQ ID NO: 17017 - DNA, 3003 bp, Unknown; identical to SEQ ID NO: 17016
  misc_feature (1)..( 3003): 2750-1469P.txt file - cDNA_ID_1807542; gDNA_ID_2926212; Annot_ID_202696

SEQ ID NO: 17018 - DNA, 3000 bp, Unknown; identical to SEQ ID NO: 12375
  misc_feature (1)..( 3000): 2750-1469P.txt file - cDNA_ID_1807546; gDNA_ID_2214546; Annot_ID_134579

SEQ ID NO: 17019 - DNA, 3003 bp, Unknown
  misc_feature (1)..( 3003): 2750-1469P.txt file - cDNA_ID_1807550; gDNA_ID_1620648; Annot_ID_47654
agatggagagattatcaggagagaaagagcagagcgtagaggcgtttggatgggccgcgagagactcctcaggccatctctctccctttgtcttttctagaaggtaacggtgactgagtgatgatgaggatggtgttacatgatggatcgatgattattatagccattatgatgatcacgatatgtgcaatgtgcaggaaaacaggagaagaggaagtgagagtgaaggtgttatattgtggaatatgtcatagtgatctccattgtctcaagaacgaatggcattcctctatttaccctttggttcctgggtacgcaaattctttttctttcaataacattaactttcataaattttcagttatgttcaaaataattatatgatcattgtgtcgcttacattatagtactcccagtaatttttgtttctatttgatgtttaagattatatctacaagtttgaccactctagaattcacatggcaattataaacaatgtagattttgatcccgaaaaactcgagtcaagaaaatcgaacttttgcttatggttatttaaatacccaaggattaggtatatattggtgaaatgaagttaacatatgtttcatgaaatattaaaaacaaggagttgtttggtaaaatgcttaattattagagatcaaaatataactgagtggaagtaaatgtggcaaattcttgtttgtccactgtttatagtggagcacttacttagttcttttctttcggctaaattaaatatacagttgaataaaaacacatttaggcagatttattactctcaaataagttctgcaaaaaaatgagagcactcaccgttcattattaccatcattacttaaagttgactattgttagtttccactctctttttttttttttttttttttttttttttttttctgttttgacaaatgatttctcatatagtgacttgtcttttttggttaaaataatataactttattatattataggtaaatccacgaacacacagatcaatataagtgcaacacaaactaaatacatggggcactctttttatattgtttcaagttcaaatgtataaaagttttaaaatattttttaatataaataagataagataaacattaattattacttttattttgttattaatgctagttacattgccagattaatgttagaaatactatattaacgtatggttacgttgtttagtacagtcacgagattattggagaagtgagtgaaatagggaacaaagtaagtaaattcaatcttggagacaaagtcggtgtgggatgcatcgtagattcctgcagaacttgcgagagttgccgagaagatcaagaaaactactgcacaaaagcaatcgcaacctataacggagttcaccacgatggaacgattaactacggtggatactccgaccatatcgtcgtcgatgaacgttacgctgtcaaaattccacacacattgcctctagtttcggccgcacctttgctttgtgcaggtaattcaaatcaaatatggctatatatttaaaaccaaaaaaaaagtgtggtagttgttaagattatcgatatttacaaattacaaacatgaaaaaaaaaaaaaaaaaagaagaaattatctacgtttctatcaatttttacttttcatctgatgatcatgaatatgatttcaattaatataccgtttgtaacgtaacatataggcatctcgatgtacagtcctatgaagtacttcggattgaccggaccggataaacatgtcggaatcgtggggctaggtggtcttggacacattggtgtgagatttgctaaagcatttgggacaaaagtcacggtggttagttcgaccactgggaaatctaaggatgctcttgacactcttggagctgatggattcttggttagtactgatgaagaccaaatgaaggtacgtaatcttaaaccattcattaattatgcgaataaaacgtaaaaaacgttatcaggtttcaactttatttaggctgcaatgggaactatggatggcataattgatacagtttctgcatcgcattcgatttcacctttgattggactactcaaatccaacggtaaacttgttctactcggtgcaacggagaagccatttgatatatctgcattttccttaatattgggtatgcatatataaccctacgtaatagaacgttatattagtctttcacatctagactatgtatcgagtatgatgaaaccatgatgcgacaggacgaaaatcgatagcgggaagtggtattggaggaatgcaagagacacaagagatgattgactttgcggcagagcatggcataaaagcagaaattgagatcatatccatggattatgtgaacaccgccatggatagacttgccaaaggggatgttagatatcgatttgtcattgacatttctaatacattggctgctactcgatcttaattaaagtcgatgttctatatgtattcaaaataatctggatttcaatcccacaaaacttaaggatatatatatatatatatatatagtctattttatataaatggagtatagtcaaataaatatgcattatcaacgatatatagtcttctattacatagatacgtgggagttcacccaacgtagatacgttcggttgaaacaagtcaatttcatcaatgcctcttccaaaaaaaaaacaaattgcattattgatgaacacatgcatcattatcaaataggttggttaaaatgaccaagatgactaaagccaatcacactactaccagatcgagtaaccattagggaccattaattcacgtggacgtagtgaatatggtccttgtgaattaatgagtacgtaattgtcctcattcatatatggatcggttccacaaacatttcctgtataaaattctacatctttcctctcattattatctctacacttctcatctctcaatcccattcgcttattatttatccatatg

SEQ ID NO: 17020 - DNA, 3003 bp, Unknown; identical to SEQ ID NO: 17019
  misc_feature (1)..( 3003): 2750-1469P.txt file - cDNA_ID_1807550; gDNA_ID_1620648; Annot_ID_163330

SEQ ID NO: 17021 - DNA, 3003 bp, Unknown; identical to SEQ ID NO: 17019
  misc_feature (1)..( 3003): 2750-1469P.txt file - cDNA_ID_1807550; gDNA_ID_2926214; Annot_ID_142138

SEQ ID NO: 17022 - DNA, 3003 bp, Unknown; identical to SEQ ID NO: 17019
  misc_feature (1)..( 3003): 2750-1469P.txt file - cDNA_ID_1807550; gDNA_ID_2926214; Annot_ID_202855

SEQ ID NO: 17023 - DNA, 3003 bp, Unknown
  misc_feature (1)..( 3003): 2750-1469P.txt file - cDNA_ID_1807560; gDNA_ID_1620618; Annot_ID_46929
actataaagtcggagatgatggcgatgactatgatcacttgttttatccggtgccggaaaatagttacatcgatgaagcggaatggatgagtctatacatataaattactagcttaatgtaatattatatcaagttagtatcgtgaattagggaagcatatttctaagtaaatttactagattatataactgttgcatttctaatgtacaaatatattgacgatgagtttctcgctaatgtaatttggctatctttatgaaagcaacaatataaaattgcttaagtagttaaaaaaaattagctactttgttgaattaaatttctaagaaaaatatatatgaattcgttaggatttaattataataagtaaactgtaatttggtttcactaacgaaaaaaaaagtgcggccataaaagcagtatcggctgcaagattcgaaaaacctttacttttaaaattgtagaagacaaaggactagatgacatgcacatgaagataagatgagcaaatttgttaaaactttttatctccatggataagagtttgcccgatttatacaaaagagaagttcggataaaatataactaattctggtaaaacattttgagtcaacttttatagatcggttgacaactaatgtgtaagcttatattatggtttatacataatatattcatcacgtaatcattattacttattagtgatctgatcgcataatataaaatgagagtattagtcatcaaaagttaccacgtatcatgcgtttctcaaaatgttagaaaaaacacatcgttttctaatcaacggaaaaatcaaagtgtctttggacaagatcagatgttcttttgattaaaacctcttccagtaattgtaaactgtacaagtgcattttctgaaaatcaaagttttcttggacatgactagagattctttgattagagtcttctggattttgattgacgttaagatatttttgatttagacatatactaaatcctaattaattaaaattatagatcgaaaacattatggtctcgtaaagtttagaaactatggacccacgaagaagtgtttggcgaataagcgaaggatttaatttagttttgggtatatagaaaacgaagtgtaaagaaaacgtaacgttatggctctttctaaattgggtttgttttaagtactcgtaaccactttcaacacattcactgtatatagtgtgttgtattatattgtttgagtcgtcatatgatgagattgtatatatataaagaaaagtcttggaccttttgatatggtgatccatcacatcaactacgtaatggtaatactaatgctctacgatagatgctatatttacctaagaaaaccgattttttaagaatgcactgaattttgctatcaatcagttaactattgataagtcatatttagatttttattttgtttcatttgtaaacagaaaatcacaagacgttggagacatcttggcttgctcctggcacctataaaaaaatgtatgtttgcaataatattagggacttattaaagtaggcccaatgggcttaagattccaccaaattagcttgacaaacactaagggcctgtctcggatattagttgtttttaattagcaattgaataaactgatgcacgttgactctctttttttcgtcgtcatgtttgatttttttttttttttgtcgtcatgtttgattagttcttaaatcttaacgataagttaaattatcgatttaatatcaacaactgtagcaaattttaatattctacgttaaaaaacttactactattttttttttttttttcagtaaaatgacacaaacatgcaaacctagaaaatagctttgacttggttagtttcttgttaaagaaaaagattacaaacaattaacataatatattatgcactacaacgggaaacaaaattaagaaaaaagactctttatctacaaaaaaaaatcatataaatgtaaaaagggttttatcattgacaatttgacagttatcaatttacatcaaaatatattttaaatgtttttaatattcatgtacttaattagatcgctaataatgataataaattgaatatcctttttgattgtaataaatgagtagatgagtcacaccaactgtagctaccgtgtcaaaaccttatccagtaacacgtgtacagctggacctctcattgtcgcacgtgtcagatcatcaaaccctaaaattaaaatcccaaagaaaaaaaaaactttcctctttcttcgcattcttctcctcctatcggactttgccacaccagatcggaaaatcccaatcctcttttcctttgttttttttgctatcttcaatcaaaaactctccgacagattcaatgaagcagcaaaagagataaaaccctaacaaaagtaaacaatcggagttttaatcttcttcttcttcggagccggagttttgtctgatctgtcggagaggacgtgtcggcatctattaaaatcctagctggacttccacatcactttactcaattagaagctggtctgttttctctgtttttattctaactttttctctcgtttaatttctcatatgcaaacaaacacctttgcatgtaactgattctgttgtacttgaattgaattctttaatcaattatgcaaacagagcttgttttggagatgatgattcacaagtatgagattgtctttctgcttaagaattcgttgagtgttggtttctgaagtttgaattgtgtgtgtgtgtgtgatttaaaatactgatgcatggttcgaagcttagagattttagattgctataaatgaaagcaaaagaacagtgcccttactcttgttctgttttaaagtcattgattgttataattgaaagcaaaagattttagttttgatgttttatgattactatttatcgttaagatttttgatttttgtttatagttttgagtaacacaagtaagtagtaagcttataaaacaatg

SEQ ID NO: 17024 - DNA, 3003 bp, Unknown; identical to SEQ ID NO: 17023
  misc_feature (1)..( 3003): 2750-1469P.txt file - cDNA_ID_1807560; gDNA_ID_1620618; Annot_ID_162108

SEQ ID NO: 17025 - DNA, 3000 bp, Unknown
  misc_feature (1)..( 3000): 2750-1469P.txt file - cDNA_ID_1807560; gDNA_ID_2926211; Annot_ID_142014
ataaagtcggagatgatggcgatgactatgatcacttgttttatccggtgccggaaaatagttacatcgatgaagcggaatggatgagtctatacatataaattactagcttaatgtaatattatatcaagttagtatcgtgaattagggaagcatatttctaagtaaatttactagattatataactgttgcatttctaatgtacaaatatattgacgatgagtttctcgctaatgtaatttggctatctttatgaaagcaacaatataaaattgcttaagtagttaaaaaaaattagctactttgttgaattaaatttctaagaaaaatatatatgaattcgttaggatttaattataataagtaaactgtaatttggtttcactaacgaaaaaaaaagtgcggccataaaagcagtatcggctgcaagattcgaaaaacctttacttttaaaattgtagaagacaaaggactagatgacatgcacatgaagataagatgagcaaatttgttaaaactttttatctccatggataagagtttgcccgatttatacaaaagagaagttcggataaaatataactaattctggtaaaacattttgagtcaacttttatagatcggttgacaactaatgtgtaagcttatattatggtttatacataatatattcatcacgtaatcattattacttattagtgatctgatcgcataatataaaatgagagtattagtcatcaaaagttaccacgtatcatgcgtttctcaaaatgttagaaaaaacacatcgttttctaatcaacggaaaaatcaaagtgtctttggacaagatcagatgttcttttgattaaaacctcttccagtaattgtaaactgtacaagtgcattttctgaaaatcaaagttttcttggacatgactagagattctttgattagagtcttctggattttgattgacgttaagatatttttgatttagacatatactaaatcctaattaattaaaattatagatcgaaaacattatggtctcgtaaagtttagaaactatggacccacgaagaagtgtttggcgaataagcgaaggatttaatttagttttgggtatatagaaaacgaagtgtaaagaaaacgtaacgttatggctctttctaaattgggtttgttttaagtactcgtaaccactttcaacacattcactgtatatagtgtgttgtattatattgtttgagtcgtcatatgatgagattgtatatatataaagaaaagtcttggaccttttgatatggtgatccatcacatcaactacgtaatggtaatactaatgctctacgatagatgctatatttacctaagaaaaccgattttttaagaatgcactgaattttgctatcaatcagttaactattgataagtcatatttagatttttattttgtttcatttgtaaacagaaaatcacaagacgttggagacatcttggcttgctcctggcacctataaaaaaatgtatgtttgcaataatattagggacttattaaagtaggcccaatgggcttaagattccaccaaattagcttgacaaacactaagggcctgtctcggatattagttgtttttaattagcaattgaataaactgatgcacgttgactctctttttttcgtcgtcatgtttgatttttttttttttttgtcgtcatgtttgattagttcttaaatcttaacgataagttaaattatcgatttaatatcaacaactgtagcaaattttaatattctacgttaaaaaacttactactattttttttttttttttcagtaaaatgacacaaacatgcaaacctagaaaatagctttgacttggttagtttcttgttaaagaaaaagattacaaacaattaacataatatattatgcactacaacgggaaacaaaattaagaaaaaagactctttatctacaaaaaaaaatcatataaatgtaaaaagggttttatcattgacaatttgacagttatcaatttacatcaaaatatattttaaatgtttttaatattcatgtacttaattagatcgctaataatgataataaattgaatatcctttttgattgtaataaatgagtagatgagtcacaccaactgtagctaccgtgtcaaaaccttatccagtaacacgtgtacagctggacctctcattgtcgcacgtgtcagatcatcaaaccctaaaattaaaatcccaaagaaaaaaaaaactttcctctttcttcgcattcttctcctcctatcggactttgccacaccagatcggaaaatcccaatcctcttttcctttgttttttttgctatcttcaatcaaaaactctccgacagattcaatgaagcagcaaaagagataaaaccctaacaaaagtaaacaatcggagttttaatcttcttcttcttcggagccggagttttgtctgatctgtcggagaggacgtgtcggcatctattaaaatcctagctggacttccacatcactttactcaattagaagctggtctgttttctctgtttttattctaactttttctctcgtttaatttctcatatgcaaacaaacacctttgcatgtaactgattctgttgtacttgaattgaattctttaatcaattatgcaaacagagcttgttttggagatgatgattcacaagtatgagattgtctttctgcttaagaattcgttgagtgttggtttctgaagtttgaattgtgtgtgtgtgtgtgatttaaaatactgatgcatggttcgaagcttagagattttagattgctataaatgaaagcaaaagaacagtgcccttactcttgttctgttttaaagtcattgattgttataattgaaagcaaaagattttagttttgatgttttatgattactatttatcgttaagatttttgatttttgtttatagttttgagtaacacaagtaagtagtaagcttataaaacaatg

SEQ ID NO: 17026 - DNA, 3000 bp, Unknown; identical to SEQ ID NO: 17025
  misc_feature (1)..( 3000): 2750-1469P.txt file - cDNA_ID_1807560; gDNA_ID_2926211; Annot_ID_202660

SEQ ID NO: 17027 - DNA, 3000 bp, Unknown; identical to SEQ ID NO: 4152
  misc_feature (1)..( 3000): 2750-1469P.txt file - cDNA_ID_1807575; gDNA_ID_1620687; Annot_ID_48472

SEQ ID NO: 17028 - DNA, 3000 bp, Unknown; identical to SEQ ID NO: 4161
  misc_feature (1)..( 3000): 2750-1469P.txt file - cDNA_ID_1807575; gDNA_ID_1620687; Annot_ID_164645

SEQ ID NO: 17029 - DNA, 3000 bp, Unknown; identical to SEQ ID NO: 4152
  misc_feature (1)..( 3000): 2750-1469P.txt file - cDNA_ID_1807575; gDNA_ID_2926209; Annot_ID_141903

SEQ ID NO: 17030 - DNA, 3000 bp, Unknown; identical to SEQ ID NO: 4161
  misc_feature (1)..( 3000): 2750-1469P.txt file - cDNA_ID_1807575; gDNA_ID_2926209; Annot_ID_202486

SEQ ID NO: 17031 - DNA, 3000 bp, Unknown; identical to SEQ ID NO: 11487
  misc_feature (1)..( 3000): 2750-1469P.txt file - cDNA_ID_1807579; gDNA_ID_2214498; Annot_ID_133619

SEQ ID NO: 17032 - DNA, 3000 bp, Unknown; identical to SEQ ID NO: 11487
  misc_feature (1)..( 3000): 2750-1469P.txt file - cDNA_ID_1807579; gDNA_ID_2214498; Annot_ID_183905

SEQ ID NO: 17033 - DNA, 3003 bp, Unknown
  misc_feature (1)..( 3003): 2750-1469P.txt file - cDNA_ID_1807583; gDNA_ID_1620618; Annot_ID_46924
acaacacctcctcctataccaccgattgtaccaatgaggttcaacattccgaaaccagctcctctcgcaccatccttataactatctgcaataaacgattgaagcgcgggtataacaattgccaatccaaaaccattcactgctctccataaagcaacctatatcacaagaccattcaaaaacttataacttcaaaatcaaagtccttaaagaaacagatcaaaaagtacctgaatgaagtagctgctggctccaactgcagcagttgataaagcccaacagaaagtacctattgcaagaacaatgggacgatcataggtaatgacaagaactcctgctaatggtgatgcaagtccttgaacaaagtttctaacgaatgttaagtagcctaaatctgatggtcctgcgttaaatgcttcactcacttctttataaaccgaaggcaatagattctcgtctgcacgttccatgatcgcagctaagtttataagaatcaatgatatcgaaacccccaaaaacgttcctgttctgttcaaaaacagaataaacaaaagaaagttttgagttttgtaagattcagaaccagagacaatgaaacggttaaccatttttttatgattactactaaattcaaagataaagtaatcgattaaacagatccacgagccaatcttagaaccctaaaaagtttgaacagattctgattcgaatcaaataaaacccaaaaggagaaaagtcaaaaaggagctaactttatcttcatgctgttagtacggtgatggcgagggaacagagacctgaagaatttaaaagcgacggagatgataccggtacgagttcgagcatgacccatcaaaatccaaaacttgaactcccgagtaaccggagccggagtttggttgctttctataaatatcggatctaaagttccgacacgaatagttttctcgtacgatttaacaaccgccgaatttaatattaattacagtaacatgttggatattctttttgttactgacgtcatatttctttggatgattctttctggataagtcatgaagtggccattaagccatttaattatgtagattaacgtatttattggatttaaaaagatcattaagcacgtaacgtagcttgtttggtggatcgttacatggtaagtgtcgggaacgtgattacatttatctttattcatttttgggatgtgaatggattggtaacgtataatttaagttatatgttaatcttggtaattttcaatttagagctgaaaattattgttagaaataacattattagaaaagtcttcttctttagctcctccatgttaccaggaggaaaatatcagaaatattgctgagtctgaaattaagggcccatgggcctcggacacatatactagacaaatcatgtttcattcaatttaataacgaagtgcccaaattcgttaatattaatgccgagatcttcggctgtctgacaattttcataatgtctacatgcagaatgagctagtgatacaataatattgtgattataagaaatatgtaatgtaatgtagcaaacaaatcgaaacgtttacaaaagcacatataatttttctttttaaaacgcaatactaaccaatattgaccgatgcattgaacaatagtgagaatagttggattatgacttaaatggacgccgcacgattaattagaataatcaacaaattaaattaaaagtaagtactaagtaagattaaatgtacgtgaccacgccgtacaaattgaaaatttatgttaaagattcccccacgtgaatgatctgatccaaagtcactctgacagattggattttttttggcgtcaccgattttatttttcattttaaactttagtagtttttggatttgtgactataaatgagaagacgtggtttaataaaataaaataataaacacaattattaggaacttttttttgtttcatttgattgtctgcaataataacaaatgacattttatgaaattacttttattaatttaaggttgtgaaaatttaacaaatatgtaaataggatttgttaaagtactatattaattagttggctaaaaaaataataatggcatgagtccagctgggtgattctgcttcctggctttgctcacgcctaactggaaccgcacgtgctccgaccacaatagccaaattgctgtttgttatcttatttccatcctttttaatattactaaaaaatgttttagctagcttccctaattatgtggatacatttttttaattcacatcaatgaatttgggaaaatcaaataaacatgtaatttttggaataatttgttcgtcattttctaaaatccaatatgaccgttttaaaactctttagatgctatactaggttaaaaattatgttaggaaaatgagatcagtttcgaattacgttttgacaactccaagaaataacatcaaatttggtgtaaagcttttgtgagttgtattaatgcgttacaatatgaaaatgtgcaatatgtcgtcataaaaaacaatgcaaaatcgttagtatatccagtttttatactgattcttaattcttacaacgctttttgtttttgtttttaagatacaaatttaaattaaagaaaatacgaaaaaaaagaagaaggaaagatccgaattcattgaacagtggacgggagggaaacaacggggaagggaccacagctcgtgcgttacataaataggacacgtggaagctgacttccagaaataaatcgatcacacgtgtagaaacagaccacacgtgtggagacaaatgaatatttgaatttatttatacttaatgaatgaaagttacagccaatccgcttcagactcacacacacacccaaaacaaaaaaaaaaacaaaaaaactaaaaagaaagcttcgtctctctctctctatccctcgtgcgccagtctgacaaagacttagagatagattcagagattcagagctcttcaatg

SEQ ID NO: 17034 - DNA, 3000 bp, Unknown
  misc_feature (1)..( 3000): 2750-1469P.txt file - cDNA_ID_1807583; gDNA_ID_2926212; Annot_ID_142019
acacctcctcctataccaccgattgtaccaatgaggttcaacattccgaaaccagctcctctcgcaccatccttataactatctgcaataaacgattgaagcgcgggtataacaattgccaatccaaaaccattcactgctctccataaagcaacctatatcacaagaccattcaaaaacttataacttcaaaatcaaagtccttaaagaaacagatcaaaaagtacctgaatgaagtagctgctggctccaactgcagcagttgataaagcccaacagaaagtacctattgcaagaacaatgggacgatcataggtaatgacaagaactcctgctaatggtgatgcaagtccttgaacaaagtttctaacgaatgttaagtagcctaaatctgatggtcctgcgttaaatgcttcactcacttctttataaaccgaaggcaatagattctcgtctgcacgttccatgatcgcagctaagtttataagaatcaatgatatcgaaacccccaaaaacgttcctgttctgttcaaaaacagaataaacaaaagaaagttttgagttttgtaagattcagaaccagagacaatgaaacggttaaccatttttttatgattactactaaattcaaagataaagtaatcgattaaacagatccacgagccaatcttagaaccctaaaaagtttgaacagattctgattcgaatcaaataaaacccaaaaggagaaaagtcaaaaaggagctaactttatcttcatgctgttagtacggtgatggcgagggaacagagacctgaagaatttaaaagcgacggagatgataccggtacgagttcgagcatgacccatcaaaatccaaaacttgaactcccgagtaaccggagccggagtttggttgctttctataaatatcggatctaaagttccgacacgaatagttttctcgtacgatttaacaaccgccgaatttaatattaattacagtaacatgttggatattctttttgttactgacgtcatatttctttggatgattctttctggataagtcatgaagtggccattaagccatttaattatgtagattaacgtatttattggatttaaaaagatcattaagcacgtaacgtagcttgtttggtggatcgttacatggtaagtgtcgggaacgtgattacatttatctttattcatttttgggatgtgaatggattggtaacgtataatttaagttatatgttaatcttggtaattttcaatttagagctgaaaattattgttagaaataacattattagaaaagtcttcttctttagctcctccatgttaccaggaggaaaatatcagaaatattgctgagtctgaaattaagggcccatgggcctcggacacatatactagacaaatcatgtttcattcaatttaataacgaagtgcccaaattcgttaatattaatgccgagatcttcggctgtctgacaattttcataatgtctacatgcagaatgagctagtgatacaataatattgtgattataagaaatatgtaatgtaatgtagcaaacaaatcgaaacgtttacaaaagcacatataatttttctttttaaaacgcaatactaaccaatattgaccgatgcattgaacaatagtgagaatagttggattatgacttaaatggacgccgcacgattaattagaataatcaacaaattaaattaaaagtaagtactaagtaagattaaatgtacgtgaccacgccgtacaaattgaaaatttatgttaaagattcccccacgtgaatgatctgatccaaagtcactctgacagattggattttttttggcgtcaccgattttatttttcattttaaactttagtagtttttggatttgtgactataaatgagaagacgtggtttaataaaataaaataataaacacaattattaggaacttttttttgtttcatttgattgtctgcaataataacaaatgacattttatgaaattacttttattaatttaaggttgtgaaaatttaacaaatatgtaaataggatttgttaaagtactatattaattagttggctaaaaaaataataatggcatgagtccagctgggtgattctgcttcctggctttgctcacgcctaactggaaccgcacgtgctccgaccacaatagccaaattgctgtttgttatcttatttccatcctttttaatattactaaaaaatgttttagctagcttccctaattatgtggatacatttttttaattcacatcaatgaatttgggaaaatcaaataaacatgtaatttttggaataatttgttcgtcattttctaaaatccaatatgaccgttttaaaactctttagatgctatactaggttaaaaattatgttaggaaaatgagatcagtttcgaattacgttttgacaactccaagaaataacatcaaatttggtgtaaagcttttgtgagttgtattaatgcgttacaatatgaaaatgtgcaatatgtcgtcataaaaaacaatgcaaaatcgttagtatatccagtttttatactgattcttaattcttacaacgctttttgtttttgtttttaagatacaaatttaaattaaagaaaatacgaaaaaaaagaagaaggaaagatccgaattcattgaacagtggacgggagggaaacaacggggaagggaccacagctcgtgcgttacataaataggacacgtggaagctgacttccagaaataaatcgatcacacgtgtagaaacagaccacacgtgtggagacaaatgaatatttgaatttatttatacttaatgaatgaaagttacagccaatccgcttcagactcacacacacacccaaaacaaaaaaaaaaacaaaaaaactaaaaagaaagcttcgtctctctctctctatccctcgtgcgccagtctgacaaagacttagagatagattcagagattcagagctcttcaatg

SEQ ID NO: 17035 - DNA, 3003 bp, Unknown
  misc_feature (1)..( 3003): 2750-1469P.txt file - cDNA_ID_1807585; gDNA_ID_2214522; Annot_ID_134084
gcggtgataagagaaataatgagaggaaatggtatctagatgcatgtagtgacgaagaaaaagagagctatgggagttaccaaaatgtcttggccaacccaagaatacgatgtgtgacgttttataaaccagaaaacagcaaacgccaaacaaacaatattcaccaaaagcgacaacactgacattgttccaagcaaagggagcttcacagatttccgagcaagatgtctgcattttctgcaggcggaacaaacatatatctgttaagagatgttgaccagaaaaagagagaagtgaaataatcaggaatatttcagaatacctcaatataacagccataatgatgttgtgcataccctgaaaacaacagccactgcgttaaattgacggaaaaagcacatatacatttaatctaaattctagacaggttcaaaaccgccggatgttaatgaaattacctgcatgccgccaatgcagaaaaatatggtgagcacccatacaaaccatgatgacatgaagtagaaaaggagcagcagaaatatggaggctgttacaataaaaaatacagcaccagtgacacttatatcaaggatttccttctctgggtcatcttttctggtcccagcactagaaacatcctggaaaaaattcagtaaattatttttttttctttaaaaagacattgttaattcagctacataaactgaagttttgatcaccaagtctacagaataacaagaggctgctacgcaaagtatctgggaaatgtaaactacgtgtataggatatcaaaggcagttaattgtagaaaccatagcatgcaaaagtgcttaaccacaattctctggtacacctttgctagtatgctgtaagattcattagcttggtcaggatctgtaagctctgaccacagtgatgcaacgacaacagttcccacagccatgagcaataacaatccagctgtgaggtccacggcaggacgctttggagcatacaacaaaagctcaactgcatcataaagaaactggacttagcctaaaagagatttatacgaataccagatggttcaaattgtagagctacaggaccaacaagagaaaaactgaagtgcgaaatcacaaaggctcaccattcttattgtcaaccatagacttgttgagagcatctccgcttgacttagagatcattaagacaggtatgctcacatttagagatgtgtccttttccatacatcccatctcatcaagatctgataacagatcatgagtaaatcatatgatccaaagctacgaaacacgaaaaacatcaatccgaaaccgtattgaaaagaaaaaaacaccttctttgtcattaatgactaagagagcagaagcaccagctgcctcagcatgtttggccttctcagtgaaagcacaattgccacggatcgacaaggcaatatgtccatctaactggaacaaacaatgtcaatacaagatatcaatgaacattgccaaaaaaaaaagtcagcttgcacttccaaattacatggtggaagccattgacttcattctaaaagcaagaagaaaagagaaactgaccctggaagagagatgggaacaagagtccaaaggatctacaaaagcagcaggaaatctaagagcttgatcaggaacagaaggcaaggcagctccaaattgagcagttaagccagtaaggaagtctccttcaacaccatcaacccaatttaagacctttacctatatgaagatcatttccaccaaatatagaatctcattaacaaagagagagagagaaggaaaactagatcaatcaactccactgaaccagagagtgattagatacgaagtaaagataagaaattgaatgcaccatttgaaacttattggtacagccaggagactcgaggctggaatcttcggtccacgatacatcgtcggccgccgctaccgaaaaaccaagcaggagaagaataagtactaaggctgaatatcggtgattcggcggatcaaacgacgacatgacgcaatcgactgagcaaatcggagagaagaagaagaagaagaagaagaagagacaaagagttgctgttaaaatctttctgggatatatcggacggtcgatattatagtcttttttatcctctaaattcaataattcttttactgtttctattgtgccaatttttgagtgattcattaaaactatatgatatacgacagctctttttgctcaactaatcaaaaatcataaattaatatatgtcgcattatgtaaaatataatggtttcaaaagtattttgagcagaattcagatccccacgatgtattttgacttgtctagtatgtcaaacaaacaaatagaacagttaagtagaggagtttgattgtaaattctaaatgtcatcgtaccggccggtttaaatgttcttcatttgataactatcaagaaaaactaaattatttagataactaatttatatgaactcgatttatctgtttatttaacaatagaaatatcaagaaaaacgaataattcaggagagaaacaccttcttggttatataaaattacaagaaatttacagtttgtacttaaaatcttttccctttgaatttcgttttgagctaattacaaaacaatttgtttttttttttctgtttggttccctttgtaattagtaccttaatttactctgacaagatgaatatttttccaaaaagaaagtaaaaagagaaaaagagtccatgacggatattcaaaaaataattaaaacaaaaaggaagggaaagaagaaagaaaaaggcctttgtttttttaaagagaagagaagatctctgagaagaaactcctctgacgttttttctccacccaaatctctctcaactctcaagctcctctctttttcttccttctgcaacaacaacaactgttactgatctctctctctctctcccaagtttttattttattttgatcggagatcgagatcagctagacatg

SEQ ID NO: 17036 - DNA, 3003 bp, Unknown; identical to SEQ ID NO: 17035
  misc_feature (1)..( 3003): 2750-1469P.txt file - cDNA_ID_1807585; gDNA_ID_2214522; Annot_ID_184648

SEQ ID NO: 17037 - DNA, 3000 bp, Unknown; identical to SEQ ID NO: 13985
  misc_feature (1)..( 3000): 2750-1469P.txt file - cDNA_ID_1807597; gDNA_ID_2214687; Annot_ID_136717

SEQ ID NO: 17038 - DNA, 3000 bp, Unknown; identical to SEQ ID NO: 13985
  misc_feature (1)..( 3000): 2750-1469P.txt file - cDNA_ID_1807597; gDNA_ID_2214687; Annot_ID_189354

SEQ ID NO: 17039 - DNA, 3003 bp, Unknown
  misc_feature (1)..( 3003): 2750-1469P.txt file - cDNA_ID_1807601; gDNA_ID_2214555; Annot_ID_134761
atcatatgtactaaaccgactcgttgtagattagttagtacgcgttggctaactggtcgatttaacaatttcattcatacaattttgctagtttaaccataacccattgtttgctttagttgtaattttgtatgatctagatacaagaaatacatcgttttcctacgatcttcgtgattagtttacatactcattaatcgtgaccattatcagtttttcaaacctcgggtccttagttagtacgaaccccgagccaagagtgtttagtaaattgtagtgggaagccttgaattactcaaatgtaaccaaaacgaatatcaacgaaacatgacaacgaataagtgtaaaatattttcaaagaggacccatcaaacgaatattgttaaacagtcaacgttacatggctcgaacacattttatacaataaacaaaaaaaattacaaagtaaaacaagaaaatatattattccttggggttgggccacttaattaataaaaacctaacttactaataaatgcaaatttcagtttccaaacaatattaaatgcatcagctgcaattcccacccacctctttttctcttcccctaactaaattaattaaaattaaattttcaaaaaaataaaaaaataaaaatctctatcactctcttctctctctctcccacatggacccagtcttcttcttctttaccatcaaatgtcaacactcgcctcctccgcctccgtcttcctagtccaccctccccttccaccgtcgccaccacaagcaggcaaccactcttacctcacaactctaggctttggctactccatagccatagctctcggttttctcgtccttctctcgaccgtccttttatcctcatacatctgttgccgtgactctcgccgccgcacaaccgccgtggaatccacaggcgatcgtggcggaagtgtaatcctcccccgcataatctttgtcgccgaggaagacaatgaagatctcgaagcaggtgatgtcgtggtgggacttgatcaagccgtcatcaactcataccctaagttccacttttccaaagatacctccgccgcgtcctcagatggctttggtggcggaggagacacaacgtgctcgatctgtttatgtgagtataaagaagcggagatgctgaggatgatgccggagtgtaaacactacttccatttgtgttgccttgatgcgtggcttaaactcaacggatcttgtcccgtttgtcggaactcgccgcttccaacgccgacttcaacgcctctgtcaacgcctttgtcagaagttgtgcctctctcccagtacgcggccgatcggaggagagcaagaagatgatattattattacatagatccattcgcctaaattagggtaattcctatttattatttttgctccgtttcattacaactttactgatttgtaattaaaaaaaatccgtcaaaagtggagtttgccattaatttcatcgaaatgaaatctagtttgaatcgtttactaaccttacaaaatttatccttttctattggcgtttttgaacgtttttttccgtttcccctatcaatatgagcggttcaaaataaaatacgcgtccgtgttgtgtaacttaaataaaagagtttgagtttgaacaaggcaacttacttttagttttttgttgttttttggtcaagggtcggaaactaagtttagttaaaatattagatttgttgaatgtcggaaatagatgtttctaaagttgggaacaaaaagagttacgacttaagatagtatagttttttttattgcatagcgagtacagaagatgaattcaacgtcgtaaactcgtaggtccaaatgttggtcgagttaaagtgtactctaggacaacttttctaaatgaaattaacatttttatagataaaatgtttttgtttatatatatcacatgtgatttttgtttcaaactaaccgatcacaacatacctatgtttgaagaagcgttgccttcaagcaattctgcatttcttctacgtgacctggatgtttctggttcgatgatagccgaaaactgttatatttttcgtaaggcgcacgttagtcacacgaatcctaaggaaggttggttggtgtgaacactttatattaatacatttgaaaattatggttagtcaatatatagtcataatgaaatgcgaatgtgttatttgacttacactagtccacaaattcgctttttcctacacggcactatcctgtggagcgtagtggtaatatgtttttgtaattaagtaattaacctcgctttgattttgatttattctctttctagcaacttgtatataggatacataattagatgtatatcacctacggaatgtaatagagtttagcattattacattacatctgaataataaaaaaagcagtagtagattaatacatgttaaaacttaaaataactcgacctatcaaagccgcttacttaaagagagagttacgtcgtgagcttgtatttttatttttttgacggcccagtaatatattaaaagcccaaaggcaaacattatagaaggccctcttaaggggatacaagcgaaattacgtcgtgagctttaatgcttcatcataattaagtttgagccgtaaatttcgctatacgatatgggacacgtgtcgtgaatctactcgtggtatcggttacttaatgaaaaggcaccattcaacgttttcttccttatcgttgcctacacgtttcaaggctctgcttctccgtcaattaacgtccgttttcgtcatcaaaatactaacgccgttgatgaccttatttaaaaattaactccgaaccacgacgttcgggttttggaacctcaggctcgtggttataaaagtcttgtgtgaaacctattatatttgccattgcttaatcctctcctctccttcacgttgagatatttttgagttttctgtgttgaattttggggaatcgaagaaattgaatttcaaaaatcaatg

SEQ ID NO: 17040 - DNA, 3003 bp, Unknown; identical to SEQ ID NO: 17039
  misc_feature (1)..( 3003): 2750-1469P.txt file - cDNA_ID_1807601; gDNA_ID_2214555; Annot_ID_185689

SEQ ID NO: 17041 - DNA, 3003 bp, Unknown
  misc_feature (1)..( 3003): 2750-1469P.txt file - cDNA_ID_1807609; gDNA_ID_1621201; Annot_ID_57675
agtctcctctttcaagcaaagcacctaacttctaccatcctctcctctctcacactaccaattcattgattctccaatataccaaattaaaccaaacataaccgaccggtcggaagatttgggttagtgattgaactaaaaaggtaaaactcaggtaacacgacccgtacctttcattatgattatatggagagcttcaatgtccatcggttgccaacggtgaatacttaaattaaatgacactctctcatttctctaaattattggtggccatacatctgtgtgtataataatgtacaagtatattaaagcatgtgtctacttcactttgatggttatggaaaatttaagtcttgtggcttcctctttggtacaccaaaaatcattatatcaatcggttggctaacgtaagagacatgaaaattgcatcttcttctttttaaaaaacaaaattgactccattttttttttctttttgcaaaaaaatgaaaactatctttaaaaaaaaattgctaaaattactgccatataatttgttacacattgatctaccacctattaaaaaattatagcttttttaggcattgcttttgagaggaaataatgtgcaagtgcaacatatctataacataaaaatctgaaatatatgtgtgtatatatagacaaacatgtttgaaataaaccatgtggtttgattaacagctaataatgacacaccatacacgttatacttgaccatcacccccattctcaatttataagaccataaaatagttttccgtatgcaatgaataaaaaaaaatcaatgatagatctgaagcttattaacataaaatagaagtggataacattgatccaatcaattcattgcagtctctctgtttgttattcaaaacagcaccgaccttttgattgctcacatgccatgagcacagccatcgatggaatattacgtgaaggaaacaaaaacttgaatatatatttttcctcacgattgagttcagaaacctggttgagaaaaagaattagagtccacctaaacatatacaaaattcagtattatatagtatatttaataaaaatagatatgtgcgtttcagttacaacatatatatgtgttccctaggagtgaaaagatgtcttttgaattgattttcataataattctacgacatagggaattgaaaatttgtagtggcatcaaccgataaactgacttttatataatctaacgtaaattggttaaacacagagagcatctttacactttttttttttttttaaaccaaataaattaacaatgaccagtattgtcggaaaaaataaaactatccattaaaattaagatgcagaaacccccaaaactaaacctagggacagaacatattatatatatgtcaaagggggattattaaaactcaagaacaaatcgatggccaaagtcatgcatgtggcatcattatggacagaagttacacaaaactctcaaacatacatcaatggattgtaaaacgttaatgatgacacgtggaagaagctcgtgaggtgagacccactatagtcattatattttgggatactgattttgcagtgagccttgtgatgcaaaacagaaagcatcacatgatcgttagtatgtacagtcgcagaatgtctaatgaattaaaatgcatttatttattttttaagtgatcatttgaaatttaaacgtgtttgacgtaaaacatcctagttgtgactaaagacaaaaacacaaaacaaaaataaagtgatagttttgcataaataatcgatttcttttgttggaataacacgatagacatacaaaagtggagtcaatgggtcgaaaaatggacgtgaagccataaacgatggccatcaaaacataaaatagttgcgttaaactaaatctaaacgaatgtgatgaagcattattgatgggttacactatacatgaaagatcataaaactaacggtgttggttcgtaaagtgcacgtgaaaatgaatgtatacccttatttatatttcaacgattgaattttcaattactatttaccaaccaatttaactcaccacctattatgaccatgtggcgaggaccagctctataagctaaaagtcagagtcaaccaattaaagtgcctctaatttcaatatctcaaaatccctacgcatagcaatagacataccgtatgtgacatacctattaacgtatatatatatatagctaggctatttacatatcacaagctggaagataaattaatttcatctgatatgttgttttatatcaacaagttttatctaatctattatagagacctagatttttttttttttttaatctattatagagaccaaaaaccgtgatgccatgcttcattttgtttgtaatggtgatatagtaagtaaaaaaaaactccaaatataaagcgaattttgttttgtttttagtgacataatgcgttttgtttttatcatagttatgtttaatttactagcattattaatcggtaacggtcacaaataaagagatggtggtaactaggtaaattatatttggtgaaatactatatgacaaaaaaaaaaggttaatacatagtagtatttgataagagggacattttggtaaatatctcaaaatattggtcagtttattaaataggaactagagagacggttaagaagtcgttctgatttcgtctttcttctctgtaaagtcgtttctctctccaatttttttgttttcctgcgaaaatcaaagagactaacacagagagcttattcaattttctttcgatctgtgaaatctcagattttgatttggaaagttgtggagatttcagctgttcttctttgttgttgggtctatttctgggtttcttcgagctgatttatagagtttggttctccgatgatagagctaatctgcttgagatagctactgtattgagagttcttctgaggatctttatttttctttacatcttgtgaggaaaatg

SEQ ID NO: 17042 - DNA, 3003 bp, Unknown
  misc_feature (1)..( 3003): 2750-1469P.txt file - cDNA_ID_1807613; gDNA_ID_2214575; Annot_ID_135164
agaagtctgatcgtgcagctaaaagccccgctgggctcttcttccagcatgctggtcacaggttcttaaagacttatcttgatttttcttgattgctttctcattttacttgcttctaagttcccttgtttataaaccatattagggacaaagttgttgatttccactggaatgcttcagacccttggactattgtcagtgtttctgatgactgtgagactactggtggaggtggaacattgcaggtaaccttgaaatctttcttggtaccttgataagcaattttattgacataccgttaaatgttgtttatactttcttctatggcagatatggcggatgagtgacttgatttacagaccagaagaagaagtcgtggcagaattggagaagttcaagtcgcatgttatgacttgtgcctccaagccttaagagtaaagaaaacccattgtctatctatctatcgcctatggtaaactaatgcgggttttagcgaggagtcttggtttttgtaaggctggtttgtcttttgagatattggtggtagcttttaggacctttccatatcagttaggggtacatggttctggttcatgatcctgtttcatcagactcttaggtgctgttttgttcaactgagatgttaatcaaatcggaccaactttatgtgttttggtttaaggtttcaatacttggcctgaacctaatgattccttctctgtaactagtcgagaccaacccggctacaaaaaaaatagttgcattgatgttcaaatgcaaagcagaaggggtcattataaaacaatatagtaataagcatcgcaaaatttggaaactgggttcttgatgattcgtcgcatcttaaataatgtttgcattgtcgttttcattagaaaaaaactgttaatcacgcttagcagtaggattaggtgattttcaattcacagatttattcgtaggattttgaagaaattttaagtattaacagtcactaaacaatcagaccattgcaaatcatacatagatcacctggtcatttcataaaactaaactatatgataatgttttactttattgggcttaacgttaatggtcctcccgcttaataggctttatgaagtctcttgatgagctagagactttaaaaatccaatcacaaagcctacatgagaccgtcaagatcagtcagagaagatcaaacgaagaagtttttgttccaaaagatactaaagagagaaacatgaatcaatgtattgcttgaggaataaggtagggaagctaatcaatcacaagtagacgaatcggagtatttcataaaattagggtttttagacctacattttcttttctttttccgacgatacttaaattgctcgagaaactctattagtgagaaatcccccatcggaatctcgatggaatcatctccttctggatccgaacctccgcagaaagtcgtttctaaactgcagaaagtaggctggcgagctacgatgatcttcaatctcggttttgcaggttagagaaatcttcattactttcttagtaaggtttttagttttacgtccgtaatgtgttcgatgtaatgcctagctgagaaagttctttcctttttctttattaatttttgagaatagaaaatacgaattcttctagcggtcgtctgatatatatgatactacaatttatcccttgaactgttgttgttgtccttgctttgattctcgaagaaagctgattgcattactctgagagtgtttgattctccactctattatcagatattagaacatgcttattgaaaggacattttttggatctgtatctctcagtcactgttgatgttttcagcgacattgaattaagcaaatgtagtatctagaaactatctatatctctgtgtgcgtgtgtgtatatatcttggctaagcatttttgcgttgaatagaggattcacacaggttcttgtaaattttctggttcatggacatgattgcacatcttattatcttgtactcaatacttttcaaatgtttcagcatctcgatttttagctggcagaactacaagcttggtctaaatcagaattgagaaaagcatgcttgcttgatttcttatgatatagcattcatgatagacaacttcaatgtttgctgatttgatcatttggttctgcagcttatatatttgcgataaaacgagaaaaggacattgatgcggacgagaagaagaaagttaaaaagggcagcgaggctagacataaaggtgtgaaaaagggtgctgttaacaccgaaatcgagaagaaaggtgcagaagaaactgataaggctaaggaagcagaaactgcaataccggagaaggaagaaaccaaactgatccctgaactggatccactgtttgaatttacagatgcaactgatcaatccatgtttcaaactgtggcaactgaacatgtaaaggtagcaaggaaaccaattccagaagatgagcaaaaggagcttttcaagtggatattggaagagaaaaggaagatagaaccaaaagacagaaaagaaaagaaacaaatcgatgaagagaaagctattctgaaacagttcattcgtgctgagaggattccaaaacttctacctgatgattccgttgattcttcacttcgtgattgggacaaattcttctccaagtagaacgaatacagaaactagtgtgtacttgttttttgttagtacaccaaatgaccattgttggctttttagttttactactctgattgttactctaatcaacgaatagtttaaatgtgatttcttgggggttgagagtggcacttttataaaactttggggtaatgtttctatttcttataatataaaggacttaaaatataaattcaataaaaataagggtgtttctgagaaagagggtataaatagcttaaaccctagagaaactgaagaatcctaaattgatcatcgtcgtcctttgagtaatttagaaaatcaaaatg

SEQ ID NO: 17043 - DNA, 3003 bp, Unknown; identical to SEQ ID NO: 17042
  misc_feature (1)..( 3003): 2750-1469P.txt file - cDNA_ID_1807613; gDNA_ID_2214575; Annot_ID_186322

SEQ ID NO: 17044 - DNA, 3000 bp, Unknown
  misc_feature (1)..( 3000): 2750-1469P.txt file - cDNA_ID_1807621; gDNA_ID_2214578; Annot_ID_135213
gcagcctgtgaaaatatgattagtggaaccggaatgagacctggagatgtcatcactgcctcaaacggaaagaccattgaggtatctgatgattttttccccctcagagttgagcttttactgtttttcctatgaaatgctaattgttggcgatggtgtgtgtaggtcaacaacacagatgctgaaggtcgtctaacactcgcagatgctctagtgtatgcttgtaaccaaggcgtcgacaaggtattgcattactttattgatatgagaagctaaaggagcttgtttctgttaaatttatcctttcagttaaacattgtcaaatatcttgcagattgttgacctcgctactttgaccggggcctgtgttattgctcttggaacttcaatggcaggtacacagctcaaaaaccctgcagaaaaactcaatctttgtgtcgtttttgagtccaaaattggctcatgatgatcattctgtgttcattacttgataggaatctatacacctagcgacgagcttgcaaaggaagtgattgctgcatcagaaaggagtggagagaagctgtggaggatgccactggaagagagctattgggagatgatgaagtctggagtggctgatatggtcaacacaggcgggcgggcaggaggatccatcaccgcggctctcttcttgaaacaggtgaaaacaaagtccctttagaggctatacatacatgtttttgacaaaaaattcgtcggtgaaagtaactaaaccatcctctattttctgtggtatggcagtttgtgagtgagaaggtgcaatggatgcatatcgacatggctggaccggtgtggaacgagaagaagaagtctgggaccgggtttggtgttgctacgcttgttgaatgggtacagaagaattcatcttcgtgaatgaaacctagagagcgtgagggagagactgtagagtttttcgggtgttgaaatgattgctggtttttaataaggtctcaaaagttactatgttttcagatgttcttaacttgttatgaaaagtaaaatcgtcaaaagttgaataaagtggtactttgttttagtcgtgcaaaaatactgtctgaaatttctacttttgaagtcttcaacattgggttctccttttcattacttttttcggtaaccacttcaaattttatgaaccataatgtcaaatgcaataattgaacatcttttgaaaaaaaaacagcatatgagtggttacaaaacatgacttttatctatcataaaataaaatatttttttgataatattttgaagtaactattctacttaatactccttttgttccttagtactgattttctaaccggtttgcccaggtccacgccttgaagcactgggaagtacacgaaccttcacattgttgaagatcttttgatcccaaaccctgtttcctatttctttcaaaacagaaaaaaaagaagcaacaattaacaaatcatttctgttatgccagtttattgcttacgtatctagaggaaccaatccaaattgaaaaagaactgtatgtccataccggaataattattacaaaagccaaaaatgaagagatattattacaatgattcagttttagttttcatatataatgagcaaatcgtaaattcaaactgcgatgataaagtaaaattgacgactattttctatggatattctttgattttaaagatatatttgcaaacatggaattataaccaaaactatataacattcgattttcattcaatatctctgttttctaaaacggaaaatttgaagtgtatatttaatactctacaatcaaattaaacaaaaatcgaatagtatacaaaattgcttggaatataaaaattacttggatttgaagactcatgatgtactcgggccaatgctgtgtttgatagtccagagagcaagagaaaactcaaagttaataagcaaacgacgaatttatacattttgggttgatttagatctatgaattcaaaatgtaattcaagcatatatatatagagagataaatgaagcccacgttttacagtattcttttttataaatgaaaccaggtcaaaaaaatggtttggtgtgtcccgcgtgcaatgaaaaattgaaaattcatatgtgaacctaatatattattatatctctcagcgtgtttcattttcaatatacaatgaaaatgcgtatgtgactcttgaaaatgtaagattttctatgaattagtccaactcttgaaaatgtaaagttttcaggagaagaaggtggacggttttattaagatcgtgtcaaaaaaaaaaaaaacaatgatttgtaaaataaactaaactttcgactaaacgattgtaaccatttataaaaaaattacgttcaacaatagaaggtatttattcggattacagttttctgaaaaaaaacaaaatcatacaatataatttttgttttcagaatcatatatttaacaaaaaattgcgataaaataacacaactgaaaaatatttgttcaaattactactattatataaattaatctattaaaaactataaaatatttgtttaaaactttttcaccattcaaacattcatactggataacatattattttctcattattcacacattattttgagctgtttgtagcgtttttcttctgcataatgagttttcctccaacaagtcgcatcacataatttaatctgtttgttctgcacattctgattaccatatatatcgcctcagctttacatatatatagattttgttatatatcttatgtctaagctattttcttttaactattctttataggccgcttatgttaacgaaaacactaaaatcataaccaaaactatttaatggtgagattattgggccactcactctttaccttttccaagaacatcaatttctgagctacgtggcttcattggcttccacatttcgtttgaaacattcttgtctgaactaaaacctagaaaaaaatg

SEQ ID NO: 17045 - DNA, 3000 bp, Unknown; identical to SEQ ID NO: 17044
  misc_feature (1)..( 3000): 2750-1469P.txt file - cDNA_ID_1807621; gDNA_ID_2214578; Annot_ID_186394

SEQ ID NO: 17046 - DNA, 3003 bp, Unknown
  misc_feature (1)..( 3003): 2750-1469P.txt file - cDNA_ID_1807632; gDNA_ID_1620687; Annot_ID_48482
tttttcttcttttcagaatgaataatgtttaacaatgtatcaaaatctttctccatcaattggaaaaacaagtttgttaacaaacaaagagctttgttatttgtttgaagtgattatgattgatgatgaaaaccgccttaaagaagctgcaggtgatctcatgttctctttttaatgtctcctttccctgcaactccctgaaactgaagatcctgttttaacaaaaaagcaaaattcaattcagatcccaaactatactcagatatataaatacacagttcactgtaggaattaagaaagtaagttaccatttggtattgtctctctataagcaacagctacattttgaaagaactctctggtagcatctgcatattcaatcaactagcatattggcacactacgaaagcctgagcaatggagaacaaaatcagaatactattttcacaatcaagactcaccatgctccattgtcatagatggatcttgctcatcaacaaacccgatgagttttgctggatttccagccaccatgcttcagaaacgcccgagagaaaatgtcaatttgagcaatgttcaaacaaaaaagctcaacgagattgatatttagatgcatgtcagtggtttcatacctatgcgaaggaacatcctttaacacaagcgaaccagcagctaccattgctccagcgcctatcttaatgttaccaagtatagtcacacatgctccaagaagagcaccgtcgcctatatttggatggcggtcaccggtttctttcccagttcctcctaatgtcacaccctgtaacatgaaaatataagctagcatttataacatcaacagttctttatagttttggagaaatgaagttagagaacggatttgtacatgcaaaattgagacacggtcgcctatcacagcagtctcacctatgaccacaccagttccatgatccaacaatattcctttcccaattcttgcagctgagcaaaaaaaacagaaaccaaagttattcagatgctagatgtaaaagcatagacaagctattagctatgaatctaaaatctttaccgggatgaatatcgattccaaaaacctgagagaaaccattgacatggatcagaggttaacgttgtacaccaagactataacagtaaccaaagaagttgtagaagttactcttacctcgcttactcggctttgcagtgccaatgctaatagttttcttccttgcttccacaacttatgtgctactctatacgcctgcagtgcaagatagccctgtggaacaaactattctggtaaaatacacatgaaaactcacttagcaatcattttatatcggtgtaagagatgttattgtctttaaatcagcaactatgatggttaagagactaccttcagatgtaaaatagccgaactatacgatagacaagcaggatctctgtctttgaatgccttcaatggaccaaaaaaaaaaaacattacactgcagtcacattctcagacaataatatcagtgtcaaaaggaagattcaccgatacgagatagcgtttttacctgaacatcaagacgaatcgagctttgaatacctctgtcatgtaccataacgttgcaaaatatatccataagctgagttgccaacaaggtagggttttggagacggttagctagaacaaaactcaatgcttgctctaaacagtcatgcgacaagatactagcatacaagaagctactcaaaaccggctcctcttctgcctgtaaaacacacaacaatattcaccattaaaggaacataaacacacacaaactctgttccttaacttgtccttcgtgtagttaatgaaaaattgacgctgaaaaagtagacgggtgagagaaatacgtaacagcaagaaaaatttaaaagctttaatcaagtagttaaagagacagagaaagcatttagtgagaattcgaccccacggttttgtcggattgatataaaaggtacacaagaatgtcattatcataacctttcaatgtagaaaatcgaagttgattaacaatatcaaagtttctgtctttgttgaattgaagtcacatatatgaaaaacgtataaatcaataataagaatatgattatggagcataaggagaaaacctcaagcttagcttcttctcttatagaatcccaaattgggtcataactagaattggtaaaatccagcaaaaccgggtcggccacgggattaagggttcctctagcgtaaaccgggaaaatcctctcgaaaggaaactcgtcaccggtctctccatcgtctctggcagaaaagttccgggagacaatcattggaagagaagacaaagatgacgaggaagaaaaatcacgattctcgccgtttatacaagccatgaccaaaaagagtgaagctattggtgaagagtgtagagaagatgataaaaaaaaggttaatgataaggaaactgagaaacccttttaaacacagtgattgattgtgttggaatcgaagtagcgacagtcaaaaagataaaagaaaaaaaaaagtaaaactgaagtcttgtgtttctgtcctcactgttttggaatgtttcatgcgaaatcagatgtggtctctctctctctgctcttgtttgtaatgcgtgtgaccgtgattcagtccaagttcttaataccaccaccattgcaagagaatccaaaactatttggaagtatcctttatctatattactttaaacgtaccacacacgaagtggacgtgaactttaggctacaataaaacatttctttatattatcataaaacaattttcatttttttacaaaatattattttagaaattacaaaaaaatgattgaacaaaataattttttttggaataaagctgattggccaaagaaataaaataaaactgacaaaggcataaacgctgcatgtaaatcgccgaaaacgaaatcgaccttcgttgctctgaaaccctaaaagaagctaaatctagcaatg

SEQ ID NO: 17047 - DNA, 3003 bp, Unknown; identical to SEQ ID NO: 17046
  misc_feature (1)..( 3003): 2750-1469P.txt file - cDNA_ID_1807632; gDNA_ID_1620687; Annot_ID_164656

SEQ ID NO: 17048 - DNA, 3003 bp, Unknown; identical to SEQ ID NO: 17046
  misc_feature (1)..( 3003): 2750-1469P.txt file - cDNA_ID_1807632; gDNA_ID_2926209; Annot_ID_141913

SEQ ID NO: 17049 - DNA, 3003 bp, Unknown; identical to SEQ ID NO: 17046
  misc_feature (1)..( 3003): 2750-1469P.txt file - cDNA_ID_1807632; gDNA_ID_2926209; Annot_ID_202496

SEQ ID NO: 17050 - DNA, 3000 bp, Unknown; identical to SEQ ID NO: 3787
  misc_feature (1)..( 3000): 2750-1469P.txt file - cDNA_ID_1807640; gDNA_ID_1620665; Annot_ID_48034

SEQ ID NO: 17051 - DNA, 3000 bp, Unknown; identical to SEQ ID NO: 3787
  misc_feature (1)..( 3000): 2750-1469P.txt file - cDNA_ID_1807640; gDNA_ID_1620665; Annot_ID_163895

SEQ ID NO: 17052 - DNA, 3000 bp, Unknown; identical to SEQ ID NO: 3787
  misc_feature (1)..( 3000): 2750-1469P.txt file - cDNA_ID_1807640; gDNA_ID_2926196; Annot_ID_141295

SEQ ID NO: 17053 - DNA, 3000 bp, Unknown; identical to SEQ ID NO: 3787
  misc_feature (1)..( 3000): 2750-1469P.txt file - cDNA_ID_1807640; gDNA_ID_2926196; Annot_ID_201480

SEQ ID NO: 17054 - DNA, 3000 bp, Unknown; identical to SEQ ID NO: 4379
  misc_feature (1)..( 3000): 2750-1469P.txt file - cDNA_ID_1807647; gDNA_ID_1620703; Annot_ID_48801

SEQ ID NO: 17055 - DNA, 3000 bp, Unknown; identical to SEQ ID NO: 4379
  misc_feature (1)..( 3000): 2750-1469P.txt file - cDNA_ID_1807647; gDNA_ID_1620703; Annot_ID_165144

SEQ ID NO: 17056 - DNA, 3000 bp, Unknown; identical to SEQ ID NO: 4379
  misc_feature (1)..( 3000): 2750-1469P.txt file - cDNA_ID_1807647; gDNA_ID_2926174; Annot_ID_140250

SEQ ID NO: 17057 - DNA, 3000 bp, Unknown; identical to SEQ ID NO: 4379
  misc_feature (1)..( 3000): 2750-1469P.txt file - cDNA_ID_1807647; gDNA_ID_2926174; Annot_ID_199725

SEQ ID NO: 17058 - DNA, 3000 bp, Unknown; identical to SEQ ID NO: 11557
  misc_feature (1)..( 3000): 2750-1469P.txt file - cDNA_ID_1807662; gDNA_ID_2214502; Annot_ID_133691

SEQ ID NO: 17059 - DNA, 3000 bp, Unknown; identical to SEQ ID NO: 11557
  misc_feature (1)..( 3000): 2750-1469P.txt file - cDNA_ID_1807662; gDNA_ID_2214502; Annot_ID_184025

SEQ ID NO: 17060 - DNA, 3003 bp, Unknown
  misc_feature (1)..( 3003): 2750-1469P.txt file - cDNA_ID_1807666; gDNA_ID_2214600; Annot_ID_135550
aatattattttctccgaatataatttagttaacattattttcctgaaaaaaaaaaaaccaaaattaagcccaactatacaatcgtaagaccaaacgaccaaatacataactatatcgtctaacaacaagtatataagatttgctatgagcagcttattctattttgcaattggacttctttaaaatgacattcatttcagattgtaaagagttggtattggattggatctaacaaaggagactaattggaccttcacggccttcctaagaagtaagaacggtgatacaaaatttcaccatgcttgaagacatgacaacaaaaagtccaaaagacaagttatccaaatcagaaaaacaaaacccaaaagacatgacaaccctttaattattttaaatcacaaatgtttgtggaataaaatcaatcatatgtaaaatcatacaaaattagctaattactgttttgggtttggatgcacaagtataagattttctattggctgcttactattttgaaactggacttcttcaaattggcattcatttcatattgtaaagagttgttattggatctaacaaaggaaactaatttgaccttcctttgttaatagtaaaaaaaattaattaatctaaacgccaaatagaacacaaaaacaatatataaatacaaaagtaaattagaattaattgttgattctatatagaataagaataaataaatatatatatacataataaaaagtttggaactcttggttctagaaccggccaaatagttggttttcaacattgaccggaaaagaacgaattcataaaattttgggattttaaactctacccaaactaataaaatagcatgtttaccagttcaattagtcggacaaaaaccggtaatgaaacaccaatagagtagggatgtgtcgtgtgtgaaatatttcaggttgtagtttttgttagtttgtcaagttgatttatggatatattaattcacgtggtcaattatttacgtcgaagatgtgatagatatttagtaagccggactataggaacaggagtgtggaagccacacgtggaatagcggtggagaataatttggatggatggcggtttaggccgaaccggggaaggttttgtttcttagacatcgtgagaagtcatacgttatgtccttaagattttaaaagctacaagagccactagctatttttcaattccaatatgataaattaattctttgtaagctaaattttattttaatttctaaataaatgttaaattttggataattaaccctaaagccataaacaattcagaaaaaaataacaaaattataacaagcctattcattgaaattcatatatgtacaaaaaagctataaatgttcatagtataaatgttttatgtactataatatgtatggatatgcaaattcatataaacataaaaaatagcagtgattaatatgagatatttagttcataatttgaatgtttatagtataaattttgttaattttttatataattaaaaatgacaatatatgaattttaataaccaaacataatgttgtcacctcgatgtatactaaattgcaggaagatgatacatataagttgaaaacgattgtgcgaataatctatagaaaagaaatataaattagaaaaaaaaagacaatgctaacgttttggtgtggacaagaaagaagacgttgcgacttgcgatgatgtttgaacctgcaggtagtttgattcatgtctctagaataacgctaaagaacacctatggctctgataacatattattaatatttacatttattttatttaaagtagtccattcataattgcacacgactaaatgctacacaacttgtcttagttgtttaatcaagatatttttaccttatgatattttgtgaaaaatgatacctataaaatccctaatgagcacatcaaccttttttaccttattatattttgtgaaaaatgatatctataaaatccctaatgaccacatcaaccttgaatcttctctaataaaccttttttccaaacacgcactaaaccaaaaattaacatctcaagaggaaaccatttaaaaaaaaaacagagttagattaagatcaacaaatatagttgaaaagaacatatgttaagcaacattaccataaattcataattagtagtgattaaaacttaagaatactaaagtatgaatatgaaaattgttgtatttttttgtagtatgtaatatgcggaaacttggatgttatcctattcattgaaattcatatatgtatgtagttatcattttttaaatatattaaaaaattaaaaagtaataatactataaacattcaaattatgaaataaatatctcatactaatcactgctaattttttttccaatgtttctctttagtatttctctttagtatgggagtgacaaacttaatatgaaatctatctccctacatgcaaaaatcgaatctcttttattattaatgaagtgtatggtcggtgtcaataactaatatgtcatattttttacagactgttcagatatgataaaaatagtttttttccaaccaaatggttggtcttctgagtgtatttgaaaacgacattgaagaattaatatatttttttttaattttagttttttatagtacaaatattaaaacaaacaatcctaccatatcataacatttgtaaataacattttaagttttgttttgagttttaattaattttctatgacaaaaaaatgaagtcaatagactaagtgaatcatatagtataaataaacacaatttaaatagtttcaaataaatttagaaagaataaaacaaatagaaatcagaaggtgtctgtttcctcctcgcaacatacgatcaaagagaaacaacttgaccctttacattgctcaagagctcatctcttccctctacaaaaatggccgcacgtctccaaccttctcccaactccttcttccgccatcatcatg

SEQ ID NO: 17061 - DNA, 3003 bp, Unknown; identical to SEQ ID NO: 17060
  misc_feature (1)..( 3003): 2750-1469P.txt file - cDNA_ID_1807666; gDNA_ID_2214600; Annot_ID_187033

SEQ ID NO: 17062 - DNA, 3003 bp, Unknown
  misc_feature (1)..( 3003): 2750-1469P.txt file - cDNA_ID_1807670; gDNA_ID_2214519; Annot_ID_134030
gaaaagaaaagaaaaaacaatggcggatcagctcacagacgatcagatctcagaattcaaggaagccttcagcttattcgacaaggatggtgatggtatgcttcatcctccctttccctctatcatcgtaggtcttggccgtataattctgatttagtttctgcttgatttggttcccttttgatatgtatcgattaccgtggtgacggatccattgttcgtatcctcgcattgactcttttcgttttcgatgttccaaatcattattgaattcaaggatttgtttgtgcctttgttcaaattaaagatctatgtagttcggatgaaatatttgtgaatcagccctgtggtgttagtgatgattcatgttttcaattcgtattttgaccagtttttattgatttgttctgattctggatttgcatcgtagtaacaccaatctttgattactttgtgtaggttgcattaccacaaaggagcttggtaccgtgatgcgttccctcggtcaaaacccaaccgaagctgagcttcaggacatgatcaacgaagttgatgcggatggtaacggaaccattgatttcccggagttcttgaacctaatggctaggaaaatgaaggacactgactctgaggaagaactcaaggaagctttcagagttttcgacaaagaccagaacggtttcatctcagctgctgaattgagacatgtgatgactaacctcggcgagaagcttactgatgaagaagttgatgagatgattaaggaagctgatgttgatggtgatggtcagatcaactacgaagagtttgtgaaggttatgatggctaagtgaggattgaaacaacttcttcggctttctccttttttttttttgactaccttcttatgtaatttcataaagaatgttccttcgctttgttctaaaatttcattcatggctggtttttgctggttaaaaagacaggaatgttatgtgtttttaccttttgtctaaatgactcattgttcatgttattgacaggttcagaacctgattcttgaaatataacagtaatgagatcttcttctattatcttcgtattgatcattctctttagaatctgtcgtcgtatgtagaagcaagaagatgcttatcggttgcggtaagggtagggagcttaacccgagttggctcagacgatgaatgtaaaggagagaagagtatagaagttgtctcagacattccattgttgaagtcaagcacagtctctaagctgtaaatactctctccagctgcataaccacctaagagttgatacgatctgtctgattgatccatcgtcaaacacatatcttctgaacctatcatcaatcaattcagatttcttgagtgtcacaattaggttcaatttgctaaatggtttcctcaatcaaaaattcaaaattcaaaacttacaggcagcaagttcaagctgagtttgataaacgaattcaagaactgcggagacatctcgctcgaattcatgaaacggtccgtcttcgaaattcatcttccttagcttacatactccttctcctaactccatcatcgctcctttatggttcttcaaatcccaaaacactcactaaaattacctcaaacgtgaacgaaaacgagcaatagatggagttaaaaggagagtagatttacgttgttgaatagatggtgaaatccaacagcacattgaagaattccatggattaaggtacgagttggttcctctgcttgaatccaaagagcttcaagcgcgtcatgacttttgtaataatccctcttgttgaagagagtcactgcttcctcaaagctccaatattcttccttatcctcgtcactatcctcttcgtcttctccggcgtggtcgttgtatctgacgattgatcttcgactgaaacggacgcgtatggagctaaattttgtggaggctcgaatcgttgaagcagtaacagagattggagaagaagggattaaggagctgaagaaagaagatggaggaagcgtgaaagatgaaggaacctggaaatgtttcgaagaaactgccattatcaaagtcaaaggtcgagctctgtctctactgcatggttctggcttgcgccagttttgtggtcaccgttttaccaaaactttgtaattgggccactatttgggtccttattttttatataatttaggcccatattttatggcgaagccttcctcatatcatatggttgtctcattcgtaaattatttttctgcagtagctttctcttatgattatcaaatttgttgattatttagggcttttatgttgtcaaaaaaaaaaaattagggcttttgaatactcaagtttttccagacattaagttaaaacaaatactgtatattatttaatttttgttaaataacaaatttatgttatcgcattgcactgtgtgagatttatccggacaaaacacaatgatagaagcagcataaatcatatcaggatatgccttttattgtttatctttaataccttagaaatggtatcttatcataataacttaaaggatcattattatggtagtggtaaaacatcattattattcataagtaaagatttaaagaatgttcaattttttgagatttgtttttgaatttttgaattttggaaatgcagtaatatactatatagtcccaaaagtccgtatgtatcttcagttcaattgatggatcatatagaactatttagaatgatgatggtggcaagacaatgacctaattaaggacccttcctaaaaatttcaaactctatagcaactttttccccaccaatatatatataaatacaaaaatcaagtatttaacatctaaaataaaaaaaataaaaaaaataatctacactctctaccctctcatttcacgtatatataatccatcttttaggacagaacccaccgaaagctccacaaaccccattaattaacaaaaaaccaaaagaaggcggcgcaaacaaaagataatg

SEQ ID NO: 17063 - DNA, 3003 bp, Unknown; identical to SEQ ID NO: 17062
  misc_feature (1)..( 3003): 2750-1469P.txt file - cDNA_ID_1807670; gDNA_ID_2214519; Annot_ID_184555

SEQ ID NO: 17064 - DNA, 3003 bp, Unknown
  misc_feature (1)..( 3003): 2750-1469P.txt file - cDNA_ID_1807678; gDNA_ID_1621200; Annot_ID_57644
tctctcgccacgagctcaaaggctgcatcaacgacgccaagtgcatgcgtcaccttctcatcaacaaattcaaattctccccagattcaattctcatgcttaccggtacagagtatttctatcttttcaaatgcctatgtttgctactatactactattccttggattttgaatacaattttccttggcctcttcaatctgataaacacacattccaagttaccatttcgaaccactttgataaaaatgtgttgcattccatagctgactaactaattgttcatcatggatggttttcattctcagaggaagaaactgatccatatcgtatcccgaccaagcaaaacatgaggatggcattgtattggctcgtacagggatgcacagcaggcgactcacttgtcttccactactctggtcatggttcgcgtcaaagaaactacaacggtgatgaagttgatggctatgatgaaacactctgtcctctggattttgaaactcaggggatgattgtagacgatgagatcaacgcaaccattgtacgccctcttccacatggtgtcaagctccattcaattatcgatgcttgccatagtggtaccgttctggatttacccttcctatgcagaatgaacaggttattagtccctcaaccgcttctaaaagggatgttgcttacctctctcgttatatttaacatacatccatttttttttttaattgaaacagagctgggcagtatgtgtgggaggatcatcggcctaggtcaggtttgtggaaaggaactgctggtggagaagccatttcaattagtggatgtgatgatgatcagacttcggccgacacatcagtaagtagaacgactctaatcatacgtcttgctgttgtagttggttcctcctctcatgattaaaacacatacacaggcgctgtcgaagatcacgtctacgggtgctatgactttctgttttattcaagcaattgaacgcagcgcacaaggcacaacctatggaagccttctgaattctatgcgcaccacaataaggaatacagggaatgatggtggtggtagtggtggagttgtgacgactgtgctgagcatgcttctgacagggggaagtgcgattgggggattaagacaggtaaaattctttcttgctctcttgtgttgatacagatcgataaatgttttcttaaatctgttttttgacaggagcctcaactgactgcttgccaaacattcgatgtctatgcaaagcctttcactctctagtaaaggacaagtcactttttatgtatagcgagtgtgatttgagaatccgtccatataaccaccttttgtttcttatttttatttttctttcaaaagaataaaggaaaacattgatttggtgattcgataacaaaatgtgccatctattctttagtctttacaaacaagcagcaaatggtttgcctttcagaatcaaaatttaaggtgtttctcgaatagacagaaggaagagaagagaagtcccagaaagctgttcagaaggcgcatacaaatcatgtgtgcgttgctgctgcaaggaaaagcacttccgctgtagcagcctgttctttgtttgataccccggccgttatcttccagtacaaaggaggagtttttcacaccatcgctaaagagaagacaccaaaagaaggtacctttatgcaacctagccattcccactccaacctcggtatgcgacctgtttctgagcaccgacaacgcactgctatctctaaagagaatgtctgagaaagcgacttctggtgctgcatacttagagctgcagccgaggatatggccagttatggtaccaaaagtggggagttctacaccacagtttggggcaaacacctgagtgaagtcgtcttcagggtgttcacagctgagagtgttgttgacattgcaattcccctcgcagagctcaacatactggagggccatgcagccaagaccgggactctcatttagtttgcctagtttccgagctgttctgttctggttcaagatgctcaccatttcatgagctgagtttcctgcaaccattctaactaacacttagtccgcctaaaacgaatcaacataatataaactgtcgaatctggttctgactaaagaaagcgaactcgagattaaatcagagggagtggctgtaaattcaaaataaagcctggccaaatgctgaacgagaaatccaagtctatattcgcatatgttatgaggggataaagcaaggagttaccgtgcaatttggagctagctagcactgatgagagtgacagaaacagtaaaatcaactccaaaatgctgatttcgttcttcatatcgtgttttatcctctgaattcccagcgtaatagctcgagctggcggattttcgaaaaatcgagaaaaacaaaaaacagaaaaggagaaagtttttgaaaggagatgagcttgatggagatgttgactggtccctgaataaatgaaaaatgtgttgcattatttctattattgagaagaaaaaaaccaggcattttggttattgggctttgatttgatgttgggctctcaaccattgaaattgaatgaagaaagaaggaaagtacgtgacttgaatttcatttacttcattaaatgggcggcgttggggccggtggaggtgggccaatgacattgatgtgtaaacagaggtaaagccgaattttggctaaggcgaatcaatgcccattggctcctctccttacatatttgaagtttgaggtttccttccttttcttaaattaaatgttgctgtaacatttctactattgtaaaccggggctccaccaccatgtgcttcttcaacactgtatcatcagagcccacatggtcatgcctctatataatactttgtattattattattcttatgtcacattataaacaagtacctccaaattgcacttccttcaaacttattcgacagtagactagctcaagtacctttggatg

SEQ ID NO: 17065 - DNA, 3000 bp, Unknown; identical to SEQ ID NO: 12312
  misc_feature (1)..( 3000): 2750-1469P.txt file - cDNA_ID_1807682; gDNA_ID_2214543; Annot_ID_134500

SEQ ID NO: 17066 - DNA, 3000 bp, Unknown; identical to SEQ ID NO: 12312
  misc_feature (1)..( 3000): 2750-1469P.txt file - cDNA_ID_1807682; gDNA_ID_2214543; Annot_ID_185284

SEQ ID NO: 17067 - DNA, 3000 bp, Unknown; identical to SEQ ID NO: 4912
  misc_feature (1)..( 3000): 2750-1469P.txt file - cDNA_ID_1807690; gDNA_ID_1620745; Annot_ID_49697

SEQ ID NO: 17068 - DNA, 3000 bp, Unknown; identical to SEQ ID NO: 4917
  misc_feature (1)..( 3000): 2750-1469P.txt file - cDNA_ID_1807690; gDNA_ID_1620745; Annot_ID_166620

SEQ ID NO: 17069 - DNA, 3000 bp, Unknown; identical to SEQ ID NO: 3325
  misc_feature (1)..( 3000): 2750-1469P.txt file - cDNA_ID_1807702; gDNA_ID_1620732; Annot_ID_49419

SEQ ID NO: 17070 - DNA, 3000 bp, Unknown; identical to SEQ ID NO: 3325
  misc_feature (1)..( 3000): 2750-1469P.txt file - cDNA_ID_1807702; gDNA_ID_1620640; Annot_ID_47459

SEQ ID NO: 17071 - DNA, 3000 bp, Unknown; identical to SEQ ID NO: 3325
  misc_feature (1)..( 3000): 2750-1469P.txt file - cDNA_ID_1807702; gDNA_ID_2926178; Annot_ID_140415

SEQ ID NO: 17072 - DNA, 3000 bp, Unknown; identical to SEQ ID NO: 11953
  misc_feature (1)..( 3000): 2750-1469P.txt file - cDNA_ID_1807705; gDNA_ID_2214524; Annot_ID_134122

SEQ ID NO: 17073 - DNA, 3000 bp, Unknown; identical to SEQ ID NO: 11953
  misc_feature (1)..( 3000): 2750-1469P.txt file - cDNA_ID_1807705; gDNA_ID_2214524; Annot_ID_184694

SEQ ID NO: 17074 - DNA, 3003 bp, Unknown
  misc_feature (1)..( 3003): 2750-1469P.txt file - cDNA_ID_1807713; gDNA_ID_2926145; Annot_ID_197690
cgtgagaaacttactattcgaatttaaatacttcacaaataaaactattttcgacaaaatcttaatccgatctcattgtctctcttaagattgatcaattcataaaaatgttttatttttatttttatttttaaaaagttttttttgcttttttctcttgaattttaaaaagcaaataatatagaaacaaaatattaataaaatgtaacttttaaaaattaaataaaattagcgcttcatcacctaaaaattaatagttaattgagctagtaaggataaaattggaattttatttttattttgagatcgtgagtatgaaaataaaaatatttaattgtttgtgtattaaattttacagtttcttttgtatgtgtattgtttttccaaccgaaaagttttggatattaaacgttcaaatataaaatagttggagttttgtttgggaattttcactagtaataaagcagaagttttctaatttattatatccatatataactttactgtcattatggtactcttctatgttagattgtatatattataatgaatcaattacggatttgccattctcttaattgtatttatgaatttttcctttttgaatagtttgtaaattttgccctttttgaggttacaaaaatgtgatttaagatgcgttttactcgttatatttaggtttagtctttggtataagtatgtattttaaaaaaacgtaacgaggtacatttttaagtgttaaaaataataaatccgtaagattttaggaaaaatatcattttcacaagatttttataaaaaaggcaaaatcaataataatctctattattttttgtacatacatataataaaataataagctctttctagctatattatgaatactcctacgagcaataaaataataaaaggcacgttatttacactcgaaaacaagctaatttagaggtggtcgagagcagatatcatgattgttttttttaatgtatgtaatccgttcatttgtgtcatcattattcatttttatattatttatccgctttgttaaatatattttgtctgatgtgaattaattgttgagcggtaaaccaatcatgaagttatctttaaattaatgtgttattgataaaaaaaaaagtaaattagttgtaaattttttttttcgtcaatttgttgtatacttaatctgatgaatatttatgattttcagaaatgtatgtttgtatcttctaatttttacccacaaaattcaatgtcctacgcatatgatggaatttaaccaaatacaagtagctagttagtgattctgatttgttatttttttttatgtaggtctaagttataaatcaattttcttcgaacctaaaatatatttttaaccagctctcagtatcatgtttaaagctattaaaaaatttaagtagacgattcgacaactacgctcaccctaaaaaaataatcagatgaaaaaaatctaaatctaaactatcaaacatattaaaaacaattatgaagactattcgacaactacgctcactataaaaattaatcagaagagaaaaatgtagatctaaactatcaaacatatatgtgatggaattaaaattgggtaaagccgtaaaagaggtttcataattttggattagtgatttggtaacttaaattgacttgtcaagggagtcttaactctatcatgaatcaagataaacactctccacaccaaaaacaatatatatatatatatatatatagataacataaaaagtcctaaaatatgttaaaaggcaaggagggccaaccatatccatctctcgcccacttttgctaatatgtcactctctctcatatcctaaccttccaataacatttcagaaccatcctcggtacatcatttatatgatttctctattatccttaataatcaactttaaaaaaataaaagaataaaattaagatatcatttgttttaccagataaaccgatccgattcaaactaaaccatattgatatttataatccaaaaacctcaaatccaaaactataccaaatcatttattatatcattttattttatctgaatataccatttttcataacacagaaattttaaaaacctaaacgaaaatcgaaacgaatcagaaccgaaatccgaattgaaccatttgataattaaccaataatcgtcccactaaaatccaagtgtataaaaaatcagtttaatatttatatgtagaatatgttctagagaattatagtataagattctacattttttttttttttttgaacaaagaaaaaaggagaaattttagggaaaggagtagaaatcttgtgagtcacagttgatttggttcaactggattgggataatatttcaagtggaaagaaataaataaaagttgtggtggaaaattattccaataaatctcgtcgtgtgaattgaatcattattcctagtgtcaatcttcttcacctctctctatcaacctccaatttcttcttcttctttttttttagataacttatttttattttatttttctttgatttttcactttaagacaaaaataataattttatatttctaccaaaaataaataataattataatttaataagagataaatattttttcaaactgtaacctaaacaataaataaattaaaagagaaattaatgcaaatattgctatatttttgggttattacttagagactactttgtccaaaattaggaaaaatctttttgggtgaataattcccaaaagtatagttgcattttgccagagaggcactcagagagagagagagatattcgtaaagataagctttttttttttttttgccttctcatcaaaaatctttttttttttgttgtctttcttctcgagagagataagtgaccaaagggtttcgatttctggaaatagtttgaataaaaaagtaatttttatgtgattattggcaaagaaaagttttagttttttttagtttgtgagagatg

SEQ ID NO: 17075 - DNA, 3003 bp, Unknown; identical to SEQ ID NO: 17074
  misc_feature (1)..( 3003): 2750-1469P.txt file - cDNA_ID_1807713; gDNA_ID_1621187; Annot_ID_57445

SEQ ID NO: 17076 - DNA, 3003 bp, Unknown; identical to SEQ ID NO: 17074
  misc_feature (1)..( 3003): 2750-1469P.txt file - cDNA_ID_1807713; gDNA_ID_1621187; Annot_ID_174489

SEQ ID NO: 17077 - DNA, 3000 bp, Unknown; identical to SEQ ID NO: 7013
  misc_feature (1)..( 3000): 2750-1469P.txt file - cDNA_ID_1807717; gDNA_ID_1621122; Annot_ID_56310

SEQ ID NO: 17078 - DNA, 3000 bp, Unknown; identical to SEQ ID NO: 13138
  misc_feature (1)..( 3000): 2750-1469P.txt file - cDNA_ID_1807721; gDNA_ID_2214600; Annot_ID_135557

SEQ ID NO: 17079 - DNA, 3000 bp, Unknown; identical to SEQ ID NO: 7391
  misc_feature (1)..( 3000): 2750-1469P.txt file - cDNA_ID_1807729; gDNA_ID_1621143; Annot_ID_56682

SEQ ID NO: 17080 - DNA, 3000 bp, Unknown; identical to SEQ ID NO: 7391
  misc_feature (1)..( 3000): 2750-1469P.txt file - cDNA_ID_1807729; gDNA_ID_1621143; Annot_ID_172917

SEQ ID NO: 17081 - DNA, 326 bp, Unknown; identical to SEQ ID NO: 12762
  misc_feature (1)..( 326): 2750-1469P.txt file - cDNA_ID_1807736; gDNA_ID_2214570; Annot_ID_135061

SEQ ID NO: 17082 - DNA, 326 bp, Unknown; identical to SEQ ID NO: 12762
  misc_feature (1)..( 326): 2750-1469P.txt file - cDNA_ID_1807736; gDNA_ID_2214570; Annot_ID_186157

SEQ ID NO: 17083 - DNA, 3000 bp, Unknown; identical to SEQ ID NO: 4179
  misc_feature (1)..( 3000): 2750-1469P.txt file - cDNA_ID_1807740; gDNA_ID_1620689; Annot_ID_48531

SEQ ID NO: 17084 - DNA, 3000 bp, Unknown; identical to SEQ ID NO: 4179
  misc_feature (1)..( 3000): 2750-1469P.txt file - cDNA_ID_1807740; gDNA_ID_1620689; Annot_ID_164695

SEQ ID NO: 17085 - DNA, 3000 bp, Unknown; identical to SEQ ID NO: 4179
  misc_feature (1)..( 3000): 2750-1469P.txt file - cDNA_ID_1807740; gDNA_ID_2926182; Annot_ID_140631

SEQ ID NO: 17086 - DNA, 3000 bp, Unknown; identical to SEQ ID NO: 4179
  misc_feature (1)..( 3000): 2750-1469P.txt file - cDNA_ID_1807740; gDNA_ID_2926182; Annot_ID_200358

SEQ ID NO: 17087 - DNA, 3000 bp, Unknown; identical to SEQ ID NO: 3050
  misc_feature (1)..( 3000): 2750-1469P.txt file - cDNA_ID_1807744; gDNA_ID_1620622; Annot_ID_47063

SEQ ID NO: 17088 - DNA, 3000 bp, Unknown; identical to SEQ ID NO: 3050
  misc_feature (1)..( 3000): 2750-1469P.txt file - cDNA_ID_1807744; gDNA_ID_1620622; Annot_ID_162354

SEQ ID NO: 17089 - DNA, 3003 bp, Unknown
  misc_feature (1)..( 3003): 2750-1469P.txt file - cDNA_ID_1807744; gDNA_ID_2926201; Annot_ID_141514
tttaatcgtgtataaaactatccttcttccaccttctcattatattcatttccatctttctaatttatctttccatttccgagccgttgagaattttttctgagagataatttaacaaatttcttcttcttcttctgtttctgaaccaccaaatctgcctttctcaattagctatgggcgtcgctgttctaaatccccaggattgcttgaaagatccattctctcacatgaaacaacatcgtaatcctagcgcatgtcccaacaggcagaagaagacggtctccaacaaccgtacacgccggagtcctcctcgtagtcaatcctccagatcttcttctcctcctgtagcgccgccgcttcctcctcctcgtgcggctgtctctgctttcgttccaaagggaacccttaagaagagtcttagcaataccgttgccgttagccaggtgagaatccttaagcgcggcgaagaaatccccaaggagacttcagatctggttgtggaaatgtcagatctgggatctactcgtcggattggaccagatccgggtttgattccgggtcagatccgtttatctggccgcaaatcgaaatcagcaccgttttacgccggtcctgtgaccatgacctcgccgcctcctagcgatgtcccgcttccagctttcttcacgaagaaggcaacaaatgatctcatcaggatccttcgcctagacatcgcctgacggtgtctgtcaccgatcatttttgattttttaaaaatctccgatgatccaaatggttaccaaagtgttacatttccgtattaccgatcgtccgattccgcctgaaaaccggagatctgcaacaaaatataatctccagacgatgatgaatctagaagatgaagaaacacacatcttcgttatgaaccgtttcgaatcttcccttattttttcaaggggcaagatcgaaatatcttcttaacaggtcttagtttctcttcttagggtttagtgtttgtgtaggagtatttgtgtatagactttttactagttttcgtatctttctctgtatcttcgggtttttaatttctgcttaatcgtcaggttctctgggtaaatcataggttggcttttgtcatttcgtctgtgtcttaagtggattagttggtcgtaagacaagttatagagatgtgtttacgggtaaagatgaagcttaggttttgatgtaatcttcttcggtttttcaattctctgtatttctctatctttttagtttatcaagtttaagttttatttggggtttcttcttcgtttgggtatctttctgtttttccttaaggttcttcgtttgtttccgtgtcgtctaggttaagtcaaagtaaagagatgtaattactggttagatgaatcttaaggtttccatgtaaccgtttgtactacaattctctgtacttctctatctttaatattatcgaatttaagttttatctttggcgtttaaagttcagtatttggacatttgatacacatcacatgagattaaataagatggttgacccaataaaaccataaacaaatgaacatacgatgggtttacgcaaatgatctcaatgaattgtaccttggaaaattatggaatttgtgactagtatatgttgagttgtattattgattagcaattctgtaatctcaaacaactcggagaatatggcgcacaaaaaaataacttgcacagatgtttcccgatgtaagagcgacagttttgatatgtgtgtgtgtgtgacaggcaaagacattgacaaattgatataatctctagtccagcgtataaacaaatcactaatgccaatttgatatcagaagttgaaagtgactttctctaagttgataagttgatattgtgctatctcaattatcatcattacaatgggtttaatagcaatggatgttattattgtttaggtgggtaattgatatttcttgctaagggtgtcattatctcaatatcatataccgtatgccacttgtttggtccaagttgtataagatataatgttctctcacaattagacagcccaccttagcccgatttaaggcccatgtatatatctcttcaaggctggacagctggggcttgaattctaaaaaatttcttagtcataaatctgctgcatttagagattcttctataaaagaaacataaggtaagatatataatcattaatgacagaaactcttttttactcatccacaatgtagcaacttgcctttacctattaacggcggtacacagtcgtcaattgttcattggtcaagcttagcaaaaccattgagccacgtcagtttttttttgttggttcctttgcaatactctacgaacatcataattgatgagagcataggaagattttctacctaacaagggaaaaaaaagcaaaacgaaaaagacgaaccctaaagtaattttgcctatttttaaaaatttattcttttaatttcagcattatgccaaatttataattttgcgagagaattttaatttggggaatctttacatatttttcacataccctttccccacacaactcagtttttgggtcccacctttcctttcttattttttttgtcatcacaaacaaaccattgagataaaaaaattaaatccaaatctgcaatccatccagccacagacccgatcttgcattttcgcatcgacattaaaatggcaataaaataaatcattttttttttcttttcgaaaagaacaaagaaaaatgagaaaaggaagaaaaaagagatagaggaataatttagagggagcctcgtatataacaccattcccatctctctctctctctttctcctctatttcgatatttcttcttcttctccttctctctcccttcgtcattatctctcttctgtaacttctctttctttccctctctctctttcgctgcttctcttctgtatctgattcccttttttacgggagctgtagatttgagtagtgtaagcgtcgatg

SEQ ID NO: 17090 - DNA, 3003 bp, Unknown; identical to SEQ ID NO: 17089
  misc_feature (1)..( 3003): 2750-1469P.txt file - cDNA_ID_1807744; gDNA_ID_2926201; Annot_ID_201856

SEQ ID NO: 17091 - DNA, 3003 bp, Unknown
  misc_feature (1)..( 3003): 2750-1469P.txt file - cDNA_ID_1807746; gDNA_ID_1621130; Annot_ID_56469
acaaacactttgtttcttttaactaactcagattcggtgagacatatcacagaagctcgcaaaaggctgtctgctagctttattcagtctttacgtttaacaatctatttttaattattcactataagatggcttcttttaaaaactttcttttttcctttatggaagctttagccctttgaacactcccttttttttcttagttatataggtaacccacttatgatcacagttaattccatgtagatcgtattaaagtagtctattgactaaatcactaaaatatcaattaatgaattaatgttgtatgatttgttatcgtttatacgaaagtaaagaaaaacaagaaaacatgacttggattaagtaactctatgttctgtcttaatacaggagagcagggaattcaagacgaccaccaggaagagcataagtacggttaaagcttgggtaagaagcagaaagagagagagaagtataattgttggcaaattaatataggtcttgtattgctgctagattctcttttcctttcatttgggatcgaatcttttaaatatgcgcaaaatatttgtgaccctacaattctgttttttttttttttaaatgtttgttttgttcctatagtgaagaaatattgagctagttaggggaggttttaaaaaaatgaagacactgattattaaaaggatttcaagaaagaaaagaagtatacgtacatgcaatgcaatcctgttttctcacgcattgcacgacttatattgggattatttctaatttgatccatcatcaaataacgtttagatgctttatttccttactcacattgtttattgggtacttgcactaaatgatcattaacatttattaagttaggtaaataattgtgtactccttttatgtgcaaaaacacaaaatgggtactattttattactaacatgctttcttatcaaatagcagtaccctatgttgttctaaataacatgctaattcaattcagatttggcagacaaaataacatggtattttagagagagcgcgcacaagtgtgtttttttaaaacaaatgaaaacatcataattacgtacctgattgacccttgtgtatatattcacgattagaaattgtagattaccaaaacactcgcacaaaatggttctatatatagacaatatatgattcttatcacatgttttgaatgaaaaaaaaagaattaagatggattttttttttgtaaagaacaattgtactttgaaagagtcttatccaatcattaaaaaaaatgtcgaatccattatttattgatgtattctgaaagcatatattcttccaaaggggcaaataaaagagatgtcgacaaagattggatacataagatattaataatttataaatgcaatggcatatatatatgatataatttgagctctaaatgccgaaatttgaaaaggagaatgtgtgtaatggttcttacaaataaaggagaccacaatgcttctttgtgttatgcttttttcccatcttttattcttttgttcttttgtggggttaactctaccactactcattttctcgctcttttttcacttattttccatatatttctaatttctaaattaattttactaatcttgaaatacaaaaaactattagacttagcttactaatttactacaccaccaacatacacactacgcaacatatgctaatatgtattaaaatgaaaagaacaaaaaatgagaaccggtattacaatttatcgtagtgtatgactagttatgagatgagaaggttcttgaaaaaagaattactaaccaaataatgtagattaattatttgcaaataaagaaaagcaagaatatatagcaaaatcatgagtttacggttcggctctataaaatcttctacaaccatccacgataaacttgatacatgaaatgtcttcttccattaaaacatgagttccacatataaaatggtttacaagtaactctcgaacatatgtgcatggtaaagcaaatatataataccattattttttctgtcttaattaagcaaaattaaacatatatataatatatgatccctacatgttcacttttaaagttcacaatttcaagagtttgaatatctttaatttgaattattaccaaacgcattagacagactaaacagagacataataatcaatcaacttctttttgtcttttttttttttttttttttgggcttccagtcttcataatcaaaagtaactgaagaccagtcttaaagctggaacatttgaactaaacatatacgactgctcctatcgctctagaaattttaattaacaattattcatagttacttaattacaaagacaacaataaaggtgaacgaataaattaaaggaaaattatgaaaatagtttaatttgtatgaaacttttcatccgcataccaaatgtcatatactcttatcttacatttttctcttgggacatatttttggagcgaacactttcgcatgtacgataaggttcagtggtctgagcttcgactacgttaaaatgatgattagggtttactaatttggaattaggagttacatttaaggttaaaagtttatgagtttcaagtttcaacgaagctttaaagtttaaacgatggttaaagttttatgattatggtgggctatgttatagttctttcaatttcgttgggccaaatgggctaaacgattaacgaccctatgaatgggcctgaaaaaatgaaagccacgtgtcagacccccacaatggactttgactcggtgcggctgccggagagaataattaattatcaactccgatgaaaagaaaacaaatacaaagttccaacaaaaatcgaaattcacaatttctcttcttctaaatccatggagtgatgatgatgatagatagattgaatccaaacacaaaccggatccgagattaaaaacaatccggattgtttatatttactttagatcggagaaagatg

SEQ ID NO: 17092 - DNA, 3000 bp, Unknown; identical to SEQ ID NO: 11273
  misc_feature (1)..( 3000): 2750-1469P.txt file - cDNA_ID_1807750; gDNA_ID_2214487; Annot_ID_133376

SEQ ID NO: 17093 - DNA, 3003 bp, Unknown
  misc_feature (1)..( 3003): 2750-1469P.txt file - cDNA_ID_1807757; gDNA_ID_2214535; Annot_ID_134361
agactgtggctttagtcgcctcaagctccttcaacacctctagcgtttcgcgttctttaacaattagttctctttgtagctcgaaagcttgtgctttgagtcccatgatatcaggttcttggatattttcctgccaccaatatcagaaagacaaactttaccttacatatcctaatttgaacaactatgatactttaatatatgacacacaacacaaaatcttcactgatgtgatgaatcaggttgcaaaatgtaggtaatgaacaattccttaaaatgaggtttaagttttcttcatcattgatgctaaacatgaaagggaaatcaagtatcgtcatcatcattatcttcatcataatgtcgtttaaggcataaaccaaacatcattaaacatcaatttcaaagtttgatgatatctttttgttgtttcagacaacaacagccaaacacgcttaatctaacaacagtaaaaccctaaatcatatttttcagagagaatttaaagaaaagactgcaagtgagggagatagagaaagggaaagaaacctgagaagcatctgggagtttattgagagaaggtctccagaaaccaaaaccgccgaaacgagtggctgcttctctcactgactcgaacggagccgaagtgtctatctcaggcttctcagctcgaccattcgatagatccgagtcagggtttacagtgcccggttctggaaattcggccattgaagcagaagaagacgagtcttcgatggggaagaagagagtgaagtgaaaaagagagagagagagagattagggaggaaccaaagtcttgtgtttgtgaattgaaactggtttgataaagacgtgtcggaacacgcgccacggtcgtctcgtgaacagtgttagaaagtcatgttttttttttgtctcaatttaaatttgaaattagcaaaaatttcgcgtcttttcccctcttggatcatataattgctaatctcaattcttaaattgggattaaggaataacctttaaacggctaaaactatctgaatgttttgatattttatcagattgttaaaaagtgatcaaaaaaaaacaaagcaatatatttatcttcacatgcctattcaatttaagtgacgtgttgttatttatcacaattaactgacagaattttgtaaaacgttaccatgtgactgtttttttttttttcttatcacaaacagaaaattatttccgttccaatctttcttgccatggaagaagctatgttagaaaatgagctctagcttaccggtaatagggaaaccagtcttgacaaccatcgagaagagggtgacaacgatacatgagcgatggatagcacataagaataaaatgatgaagggttcaagcaaaaaaaaacttggtaagagtttgaacccaaaacatcagatttgtcatcttttaggtgagacaaaaaagtcttgataacaatgtgtgccggacacagtttttttatctagaagattaaactttgatttttctcacctaaaaggtgacaataaagtgagctatgtagagtgtcgtcaattatttgtccatcttcttgtttgtttttttaatttcttctttttgtccaaccattagactaatattttcattttgtttctttctcttttgtcttcgctttcatcttgttttcaggaatgactaatgcattcgaatgttttttcttttccttttatgtgcattcctactttatgaaacaattagttttcaattcaatttcggtgatagttttagccatttctgtccactttggttgtcttagttagtttattgatgagaagaaaagacaaggagcaaaagtattagattaggttaaccaaaaagtctagcatatggactcgtatgaaattgatatttgtatgtattaggtaactttgttttctcagagattattgagcaaaatgtttataatttatcgattagtgaaggtggcttcggaggctacatttgcgttatttacgggaaatggaaggacaaaacacaagtgctttctagtttgaaaataaaatcaaagaaatattggttaaaatagaacacactttataatcactgatcacataatattacattattatgacttatacgatttacaaaaacaattcaggtcaaaggcactcgtcgatataacataaagttggacattgaaactgagaatacgttggcgttcgcggatttaacatatatttttttgtccatatttttataccgtatcgtctcaacaattctatcatcaacaagaacatgtcactgataaaaacatgtttatcgcagcatgatgatattatacatagacatatcttacgtttaacatgaatcaacaaccatatctttagcgaccctacacgaattcaaatttgatatcaatttcgtacaatttctatcttactactttgaaatttgtgtcgtttataattatttatcaaactcaatgatgcgtattctattctcagaaggagtcatgtatgtcttgaaataaatctagaaagaagtataggcgaaattgagaaccatctcttcatagaactatacgtcgattcatagtaagtaaaaagtctacatctgcaataaaaatgtatggagttagctagttttgaaaaatactatatacaattgaagtgaacatgaaaatcttaattgtttaattaaagcgcgcgaaaaaacacaataataagttaaattatgtgcacataatagatagcattgtcaaaaggatcggttaatttatgatttcactaatttttattatccttcaaccactctagtaaaatacatattgccttaaaacaaaacctactagtcttaaaacgaaaaaagaaaaaaaaaaaaaaaaaaactcaatacctaataatcaaaaatagtactcaagcttccctatataatgttccttcttggctttagctaattcaccatatacccacactcacaagtcacaactcaaataatctttgtcttcctcctacaaatatg

SEQ ID NO: 17094 - DNA, 3003 bp, Unknown; identical to SEQ ID NO: 17093
  misc_feature (1)..( 3003): 2750-1469P.txt file - cDNA_ID_1807757; gDNA_ID_2214535; Annot_ID_185061

SEQ ID NO: 17095 - DNA, 3000 bp, Unknown; identical to SEQ ID NO: 6454
  misc_feature (1)..( 3000): 2750-1469P.txt file - cDNA_ID_1807767; gDNA_ID_1621094; Annot_ID_55602

SEQ ID NO: 17096 - DNA, 3000 bp, Unknown; identical to SEQ ID NO: 6454
  misc_feature (1)..( 3000): 2750-1469P.txt file - cDNA_ID_1807767; gDNA_ID_1621094; Annot_ID_170863

SEQ ID NO: 17097 - DNA, 3000 bp, Unknown; identical to SEQ ID NO: 6454
  misc_feature (1)..( 3000): 2750-1469P.txt file - cDNA_ID_1807767; gDNA_ID_2926162; Annot_ID_139750

SEQ ID NO: 17098 - DNA, 3000 bp, Unknown; identical to SEQ ID NO: 6454
  misc_feature (1)..( 3000): 2750-1469P.txt file - cDNA_ID_1807767; gDNA_ID_2926162; Annot_ID_198820

SEQ ID NO: 17099 - DNA, 3003 bp, Unknown
  misc_feature (1)..( 3003): 2750-1469P.txt file - cDNA_ID_1807774; gDNA_ID_1620712; Annot_ID_49032
gtgggataggaatggtgagtaagttgaccccaaaataaaaaagtacaacgtgaaaaagagtttatttggttattgtaatgttatttcacggatcctaataaaaaattgaaatgataattaaaaaacatttatattaaaatcacaaaataaattgatgtactaaaaaacatttatattaaaagtatcaaaccaaaactttctataaaaaggagatggtaaatttttcttgaattttatttgaaggtgaacgcagcagcagcaacacaacaaatgatagatgtgttcagtgtgaaagggattgtgcattttgggattgctggaaatataaacaactcgatgtccataggagatgtgagcatccctaagcaaatcacgaatgctggcttgtgggattggctggtatatacaaaatttacatgcacaagttttgttattgataaataattgcttctccttcatattgtctgatgattttagttctgatcgtcaaacagaatccaggcaaagcaaaaggaaatgaggatgtagcgtacttagatgtcgggaactataatgttccacaaggaaacaataagttaggaactattggatacagttacgaggaattatattcagtcagtggtcacatcaattcaccaaagaaagtgttttggattaatacaactcaagagtggcttcatcttgcagctgatcttgaggttgttaagaatgacatatgattagattagaatatattttttctaacaaaagactttattccatggttgatggttgttgtatgaatgtagaagatggagctattgcagtgtgtgaatgcaagtctgtgtcttccaaataaacccaaagtagtagttggattaaaagcagccactgctgacatatttgtggataatgcagcctatagaaatttcttatacgatacttttggagtttcctcctcagacatggagagttctgctgtggccatggtaattattcacgtttctaacattgtgattcattcctttcactccattttttttttcattgaactttcacttaattttgtttgcatgtgttttggattcgaccagacttgcgtgtcaaatgggtatcccctaattgtgataagaggattatcagatttagcaggagtaggagataacactgttcgaaagtttggatctttggctgccactaacactgccaaagctgttttagagttcattaaaaagctcccaccgtcataattcctacgtgtaacctatcattatggatgtttgaatctgtattttccctagtttttctacgtacgttaaaaataaaattaataaaatctgtttttcttttctttaatcagcttcttgcatggaacactttaatttcagccttcaaaactagaattacaggtctctttgttcatatcaacgatcccgtgacagcaacaattcaaatatgggcaaaaatattttgtgtttataaaatagtatttttttggaaatttgtagagcgtgtattatcgtccacaaaatttattttagtggtattgtaggatatttgtcaaaaaaaaaaaaagtgcgcagccagcagcccctcatgtttaatgcatacacaaaggttatatcagctagtctagagacgagaagcacgtggaaagaagaaactatcaagttggacttggatgatatatatatatatgcagctgtggatttgaatcgtaaaccaaccaaccaatcagatggaccacactctttctcttcttccatttctcttcatcataatcatttcttccttccatgttttgcctgtttcacccacaccttcacacaaactaaaatccgccactaccatcagaaaactcaaccgcggaggaccttacatcggtctcgtgacggtcattgcgaccgaagaaaatgcttttctccgcagtgtcgatttcagacctgaccctactcatcccttcttggatctctctggtatccacttgaatcaaataactttttcaagttttctaacgtaaatagagtcttttgttttgcttaaatggaagttagtacttttgagatgaaaatattagtagtttctgatttaataaccttatgtatacagggagacgttttcgaatagggaagattcatggaaagaaggttgtgtatgttagatgtgggagaggaatggtgagtaaccacaacattaaattatccaaaacagaacaaaaaaaactacaacaaaataaagaagtttatatggctcttatttcttatctaaaagtagtatacaaaaagggaatgggcacacaccaaaatatcctgatccgtatacaataattgaaatgatgaattgatgataaaacttatattaagttttaatatagttagtaagtagtatagtatattaaagatgcatattagtaaatgtaatccatatgaaaagtagcaaacgaacacttatattaagacaaaagaattgcaggtgaatggagcagcagcaacacaacagatgatagatgtgttcaatgtgaaagggatagtgcattttgggattgctggaaatatgaacaactcaatgtccataggagatgtgagcatccctaagcaaattacgaatgctggcttgtgggattggctggtaagtataatagttacacaagtttgattgcttcttcttcttcatattgtctgatccatgcttttggttctgagtaaaacagaatccagacaaagtaaagggagttgaggatatagcgtacttagatgtcggaaactataatgttccaaaaggagatggcgacaatgagttagggagtattggatataattacgagcaactatattcagtcactggtcacatcaatgcacctcagaatgtgttttggatcaacacaactcaagagtggcttcatcttgcagctgatctagaggttgttaagagctatacaacatactgattagattatagattataaacaataacggttccattgttaacaacggtttttcgtgtggtatacggtggcagaagatg

SEQ ID NO: 17100 - DNA, 3003 bp, Unknown; identical to SEQ ID NO: 17099
  misc_feature (1)..( 3003): 2750-1469P.txt file - cDNA_ID_1807774; gDNA_ID_2926185; Annot_ID_140746

SEQ ID NO: 17101 - DNA, 3003 bp, Unknown
  misc_feature (1)..( 3003): 2750-1469P.txt file - cDNA_ID_1807786; gDNA_ID_1620642; Annot_ID_47516
tctaagacatgcgagtattctgttaatataattattactttttatataatagagaactccaattgttgaaacagattaaaacaaagatttggtgtagaagatgatcaaatattacatgaaagaaaattctgtagttcattcttgtatatttttataagatatttagttatattatttatttgaatgaagaaagaaacaaacaaaaatgtaatattttgagatgtctaaggagtattaagatgtccagactaactttaaatttttctccgaagatttattttgagattttttttcgttttaatatttttgatcagtttatgacgataataaaaataaacgaaacttttcttaaatctatagttgggaaagtgattgattttcgtaaaaaccattttccaactaatataacatatgataggaaagtagtcagaaaaatcttacaaaaatgtgcatggaaatggtggaatttacaggtagcattacacataatcatttcatcattaaatgctaagtttatccaccatattggcttggttacagagtctaaatagaaattgcaagagttacatcctagttttgtcaaactttggactacactattacagtttcgcctcttgtaaagaaaaatcgttgaagagaatttcgatgaccagttgtgaatgtcctggactaagttaaagatctcacttctagttgtagtcccggtaataaatacgaaatataggattgtattgtattgtatgttttctgactcgtatattacaagtatatgtaaggatttcttggaaattgaaatcactgggaaacagaatattagggatctccaaaccctaggacattgattccttcgagattactggtcttcttcgttgtaggcaaaaaaaaatggtatttattgttaatttgtatttttctgatcatgcttggacaaaaaaaatgactcgttcaggttagaatttaaaattaagtgtatgcgtcatatgacacaatgctctcgtcatcttgtgtctaacagagtgaaataaagaacgaacaattgtttgtatacacacaaatacaatcgcacctacatgtgcacatattttattacgcttatctatagaaaactgtttgatacattttttcattctaaagtaaatacacaatccaaaaaatactatgtcatgttaagaatgtttagtatatctatttattttaggacaaggaacatttaacatatagtaaacagttttaacaaaatttctctgatttgaaatatattttttatattatcagtaaaaagaaaactgtaaaggtaattatagtcgttgattaagattatacttagttttttaaaataacatgttttaaaaattttgcaaaataagtttttttttttacatgtctcataatttttgtcctcagtttatgttaaaaatattttgttattttgatactaacatcttccatacgctgaaaacatctttgagaatatttttcaaaacacaatatacaaaaatccacagtgactttattccacgatgaaatgatatcaagacatatatgttcttacctttacctttcaacgaaaatgagagaaaaaatatatatatatagtatcacttttagaaaatgtttttttttgctaattaattattatataaaaatgttgagagcaacttgatcatatatgtaataaagtcgcagtgaaaaaaaaaatgtaataaagtcgcataccgacgttgtgactcgtttttatgtaattgattagttaagtacagagttcgttagatgtatttgcattgttacaattacagaaaaccctacgcaacacaattcagtactttttacgtcagcaaaaatagaatctttcgttgaaaataataccagaatcgttcttgtctttaattttcttacctttttgtaattggatatgatttttgactatggaattattattattttattctataaaattatagtttttattattggaatcatttataaatgctattactcagtgttctttaaagtccatactaacgaattcaagtacttatttaacaaaacaaaacaaacaaatactaataaactaaaagtacaaacattactatgttattaaaaaaagcatatagctgcgtgattttaaaggtatatgtgacatataatacaacgacgccgtcgtattttattgaatttttttgtcacttttaattagtatacagtgaggaaataagcaaaaagaaagaaaaaaatattgttggctcggctagtacctataaataaaaacactagtatttggcccaggatataatcattgcaagtttagaactagttagctaatctaaaccgttagatcaaagaagcaatcttactaatcagaaaaacaaaattcaacaagttacaagaatgaaaaaaatagggataaaaaaaaggataattcatttacattcgatcaaaaggcgaatgcatagatcatagatgcaagacacttgtgagttgtgatataaccaaaaatttatttaattatatgtaatatatattcgaaaaatttatacaccgtatataaaatattcgaataatccttttctttgatttaaaaatattttctgcttgttttctcaactcatgtattaatttaaataataaaagtagctaccacctttctctgccccactttaagataaagctaaagcatggaaaaaagcatgggaaaaaagtaaatatatgatatacaatcaaataaatctaaaaaaatagaaaagaaaaattaaaggaacgaaaaaaagagggaggaaaaagacaaaattaaaaaacaaaaataaaaattccaaaaaaattaacatcacatgttatcaaatgagatcaaaatttaagttagttttgagttttctctctctttctcttctctaaaactacttaagctaaagaatcaaacacttctcaacgtttctccaaagcctctgattagtaaacacataaagagatctatagagagagagagagtagagataaaaggtgatg

SEQ ID NO: 17102 - DNA, 3003 bp, Unknown; identical to SEQ ID NO: 17101
  misc_feature (1)..( 3003): 2750-1469P.txt file - cDNA_ID_1807786; gDNA_ID_1971821; Annot_ID_176191

SEQ ID NO: 17103 - DNA, 3003 bp, Unknown; identical to SEQ ID NO: 17101
  misc_feature (1)..( 3003): 2750-1469P.txt file - cDNA_ID_1807786; gDNA_ID_2926195; Annot_ID_141226

SEQ ID NO: 17104 - DNA, 3003 bp, Unknown
  misc_feature (1)..( 3003): 2750-1469P.txt file - cDNA_ID_1807798; gDNA_ID_1621169; Annot_ID_57227
tacctgttttcggaatgataagcactcctatgttgaatcgaccatattttccccaaatacgggttccaaaccacgagcctagtgttgctgacctccttactcatcattaacaataagccatcgcaatgaaagacttgagatatctcaacatgattaaacttagctatttgctttatagatggctcaactacttcgacgttgttattttggattccatgaagatcaaatctcattgaacaaaccttagatccctttatcatgaaaccagcaaactgttgtctagcttctgctttacatatgacccgagctttagataaatcgttccatctcaatgctcctagagatattattgaaaccctagacagtatctcttctaccatatcctccggaagatcggatatcatcatcgtcgtcttcaaatgaaaatcagggttttttgacctatcatgtatttcctacagtttttcgatttgattatatatatgcgcataactttgggcccataactctaattttcttcttgcttcccgtttgtgtataacacaccttatatgccctcatatttcataaggaacattttgtagaagattattacaagattcacgaagagaaagaataaagacacaagacaaaacaaaaagatgcacctctctaaaacatctataaaacgctctatataatgtttatgtgtttgcgactgtgataaccacatctggcacatgcacatctcctagaagatctctactctaaaactcgacatacctctcccggtcatggtctcgtgcactgtctcggccacaatccatatggaattgcattgagaaagaaacccaagacataagtccaagtaaattgtttgaagctttgatcccaaattattttcacaattattacaaaaatttaacaattacaatcattctatagtactagaaatcttatttttagtccacgggagcaagttgcagtttgtcgcttctccttatgaacttattgcgaattttcttttctttttttaccctggaactttgctctaattcattgttcgataatagtaataattctcaacatcacaactacaaggggaaagcccggtacaagaaactcagtaagatttgttgatccataataattggtagtcttcaatcatatgatataaatgtatttataaaaaaccataaatgaccaatctttttcaaatgaaaacagaagaaatgaacgagaagaagatgatgaaagaaacaaataacgtactgtaaacaagactggctaataatctcgatcttttcttttcctcgataaccgagagttcttggccttgggtgattttcactaaactaggagcataagagactggtaggttagatggtatgaaagttactccgaaatccaatattctcaagtatccattatctccaatgacgtaagctatgttgcacctcatttgtttagataagcttctaccaaacactacggctaatttcttctcttggtcaatgaagaaactcgtaactaaaaacttaattctaaaatgagtaaatgttaagaagttgctccatgacacagcattgggttcaatcttagttgtcacccatatctccatctcagattcttcccaattattaaataacaccacaagatgttcctctctaacagaagatagagctacattatcatcaaacttagcaatttgaaatgggagaggaagacacgacacaaatctctctcttgtaaaatcaaaagaaagtaagcaaccagctagtccttcccctattttctcacctcgatagaaaaaataagtatttccctttattgacatgtcacgtacataaatatttgtatgcaagtcgggaatgatatcaagaaccttccatgaatcagatttaaaatcgtagatttcacaatttttcctattatacatcaagattttgtggttacggttgttgtcgtatccgagagcatacctatatttgaaatgctcagtatctctgcattggatcaacctggtttgtcccaaatacggattccaaaccacgatcttggaatctacctcatcagttaccaataacaacaagccatcgctgtaataaacttgaaataactcaagttcaataaatttatttatcttatttatagagagctcaactagttcaacgtcttcattttggatttcattaagatcaagtctcattgaacaaaccgtagattcgttcacatatctcgtgaaccctgtaaactgttgatttgcatctcctttacatacaatacgatctttggataaaccgttccatcgtttgcaagtagatctcactgctcctagagatgttatcggaaccctagacaaaatctcttctaccaaatcattcggaagatcagacatcatcatcgtcattttttcaaatgaaaaattagggttgaactatcacgtcttttccacacttttaagatttattctgagattgttcacagcataatatggattaatcttctaggaagccttatattgtgtaacagattaattgtacagatgcctttcatttgcagacttattaaagatgaaatgattaataagagcagatttgttctttttaatcatcagtcatcatcaatgtcaatattaataagccatcaaatcaatgaaagacttggaaaaatatctcaaacttacttacaccttcccacacacatttacggtcgattatatatgcaatagatgggccctaattttgggcccataacacttatcacaaaaggcccatcactttaaatcttcttcataattcactgctctcttcctcactacacagttttctattcttctagaatttgcttatgcagacattttcaatttcactcctccgtcactcttctccgttcctccgtcacaccgcgatttttcacggcggagttggagttagattcaaattccttcgcagcttttctcctctctcagcaagacgagataatcccgatgtctccagaaaaccccaaccgagcaaaaatatg

SEQ ID NO: 17105 - DNA, 3003 bp, Unknown
  misc_feature (1)..( 3003): 2750-1469P.txt file - cDNA_ID_1807798; gDNA_ID_1621169; Annot_ID_173923
aagataagtaattccctttattgaatgatatgcaacctttacgaaaattgttacccgagtggggaatgatattaagaaccctccacgaatgagatttaaaatcgtagatttcgtaatttataaaatacctcaagattttgtggtttacggttgttatcatatccgagagtatacctgttttcggaatgataagcactcctatgttgaatcgaccatattttccccaaatacgggttccaaaccacgagcctagtgttgctgacctccttactcatcattaacaataagccatcgcaatgaaagacttgagatatctcaacatgattaaacttagctatttgctttatagatggctcaactacttcgacgttgttattttggattccatgaagatcaaatctcattgaacaaaccttagatccctttatcatgaaaccagcaaactgttgtctagcttctgctttacatatgacccgagctttagataaatcgttccatctcaatgctcctagagatattattgaaaccctagacagtatctcttctaccatatcctccggaagatcggatatcatcatcgtcgtcttcaaatgaaaatcagggttttttgacctatcatgtatttcctacagtttttcgatttgattatatatatgcgcataactttgggcccataactctaattttcttcttgcttcccgtttgtgtataacacaccttatatgccctcatatttcataaggaacattttgtagaagattattacaagattcacgaagagaaagaataaagacacaagacaaaacaaaaagatgcacctctctaaaacatctataaaacgctctatataatgtttatgtgtttgcgactgtgataaccacatctggcacatgcacatctcctagaagatctctactctaaaactcgacatacctctcccggtcatggtctcgtgcactgtctcggccacaatccatatggaattgcattgagaaagaaacccaagacataagtccaagtaaattgtttgaagctttgatcccaaattattttcacaattattacaaaaatttaacaattacaatcattctatagtactagaaatcttatttttagtccacgggagcaagttgcagtttgtcgcttctccttatgaacttattgcgaattttcttttctttttttaccctggaactttgctctaattcattgttcgataatagtaataattctcaacatcacaactacaaggggaaagcccggtacaagaaactcagtaagatttgttgatccataataattggtagtcttcaatcatatgatataaatgtatttataaaaaaccataaatgaccaatctttttcaaatgaaaacagaagaaatgaacgagaagaagatgatgaaagaaacaaataacgtactgtaaacaagactggctaataatctcgatcttttcttttcctcgataaccgagagttcttggccttgggtgattttcactaaactaggagcataagagactggtaggttagatggtatgaaagttactccgaaatccaatattctcaagtatccattatctccaatgacgtaagctatgttgcacctcatttgtttagataagcttctaccaaacactacggctaatttcttctcttggtcaatgaagaaactcgtaactaaaaacttaattctaaaatgagtaaatgttaagaagttgctccatgacacagcattgggttcaatcttagttgtcacccatatctccatctcagattcttcccaattattaaataacaccacaagatgttcctctctaacagaagatagagctacattatcatcaaacttagcaatttgaaatgggagaggaagacacgacacaaatctctctcttgtaaaatcaaaagaaagtaagcaaccagctagtccttcccctattttctcacctcgatagaaaaaataagtatttccctttattgacatgtcacgtacataaatatttgtatgcaagtcgggaatgatatcaagaaccttccatgaatcagatttaaaatcgtagatttcacaatttttcctattatacatcaagattttgtggttacggttgttgtcgtatccgagagcatacctatatttgaaatgctcagtatctctgcattggatcaacctggtttgtcccaaatacggattccaaaccacgatcttggaatctacctcatcagttaccaataacaacaagccatcgctgtaataaacttgaaataactcaagttcaataaatttatttatcttatttatagagagctcaactagttcaacgtcttcattttggatttcattaagatcaagtctcattgaacaaaccgtagattcgttcacatatctcgtgaaccctgtaaactgttgatttgcatctcctttacatacaatacgatctttggataaaccgttccatcgtttgcaagtagatctcactgctcctagagatgttatcggaaccctagacaaaatctcttctaccaaatcattcggaagatcagacatcatcatcgtcattttttcaaatgaaaaattagggttgaactatcacgtcttttccacacttttaagatttattctgagattgttcacagcataatatggattaatcttctaggaagccttatattgtgtaacagattaattgtacagatgcctttcatttgcagacttattaaagatgaaatgattaataagagcagatttgttctttttaatcatcagtcatcatcaatgtcaatattaataagccatcaaatcaatgaaagacttggaaaaatatctcaaacttacttacaccttcccacacacatttacggtcgattatatatgcaatagatgggccctaattttgggcccataacacttatcacaaaaggcccatcactttaaatcttcttcataattcactgctctcttcctcactacacagttttctattcttctagaatttgcttatg

SEQ ID NO: 17106 - DNA, 3000 bp, Unknown; identical to SEQ ID NO: 3660
  misc_feature (1)..( 3000): 2750-1469P.txt file - cDNA_ID_1807806; gDNA_ID_1620655; Annot_ID_47836

SEQ ID NO: 17107 - DNA, 3000 bp, Unknown; identical to SEQ ID NO: 3660
  misc_feature (1)..( 3000): 2750-1469P.txt file - cDNA_ID_1807806; gDNA_ID_1620655; Annot_ID_163623

SEQ ID NO: 17108 - DNA, 3003 bp, Unknown
  misc_feature (1)..( 3003): 2750-1469P.txt file - cDNA_ID_1807806; gDNA_ID_2926209; Annot_ID_141884
cagttgcttcgagtaacattgcaatggctactctgggtgttggatccagtgaacggatcaactggaaacgaaagtaagtttttttcctttgttcattttttttttggaaaattcaagttctttaaatagcttgtgttgaattaggggtgtagtaacatgtgcactgacgattctgacgagttctcaagcgatacttatcgtgtggtcgaaacgagctgggaagtatgagtatagtgttacaaccgccaactttttggtgagtttcatagatgcattaaattgagtgtactgtatgtgttgcaagcgaggccagttttgtgtggtttttaatctctgaatcatgatgatatagtgattttgtttactctttggtggacatcaggttgaactctgaaatgtgcgttatctcttcttgctttgacaaggatatggaaaaatgaaggtgttactgacgacaacaggtagcgaattattttgttactcaatctgttgttatcagttttagagaaatttccatgagttttatatctaattcctctttgaacatgaccgtagatagctcactgaatttttcgttactgatacccaaatcctgtctctataacaggttaagcacaacatttgatgaagttaaagtctttccaattcccgcagcattgtatctttttaagaatttgttacaggtggggtgtcctgagtttgttatttttttctgtggctttggtcgatttttcttaacttatgtttttcatgttaatatgtctctaactacttgttgtgtcaccttttacgtggcagtattatatttttgcatatgtagacgccccaggctatcagatattgaagaacttgaacatcataagtaccggtgtcttgtacagaattatactgaagagaaagtaggtttttttaatcatccaaatggatttaacagcttccaatgaatagttgttctggaaatccatcagtgagctgtttcagtttccttcaattcttgcaagtgtgaactgctttgcttactatcttctctaacagattgagcgagattcagtgggcgggtttcattctattgtgttgcggatgcaccactgctcagttgaattcaaagtaaaactttacccttgattttcatatgaattctattaaattgagctttaacgattcttgcatatgatgcgtaacacacaaaagctcatatccggttcctgctctgtgaactttcaggtctctgctgatttttccaatatatgtctcatatttgaaattgcttttgcagttctgatcgtgttcttcagacatctcttcctggctggactatggcaattgtaagctgttagccccctttgcaagctaatatcaactaagagttgtgaagcagctttcatgtccacatcaattaatataatcactcgttgtttctaggtcatggctcttttaagtggtttcgccggagtgtacacagaggtgggatattaggactgtatactgtaaatactcaaagctgatttggtttcttttctctgtgtgtgtgtcaacactaatacagtataattggttccttccattgataaattaacttatgatatataaagcttataaaggttttgctttccattttggcaggccattattaaaaagcgaccttcaaggaatataaatgtacagaacttctggctatatgtctttgggatggctttcaatgctgttgctatagtgatccaagattttgatgccgttgcaaataagtaaatccaaaaaccatcctctttcatacttgctataaaatgccagaacatactagtactacacctctatatcctcggtgtcctatagttccattatattatactaactgcgtattatgctgttatgactcttctgttctggtattgaatgggatggttttccattttcaggggattcttccatggttactccttcatcacattactcatgattcttaaccatgctctcaggtaaaagctgcttaagaggccagacttttttcttaactctgatgtaagttagtgaagctaacaccaaaacactcttttattgtttgttttgaagtggcattgctgtgtcgatggtgatgaaatatgcagacaatatcgtgaaggtagtgtatttgcaaaaaaatgcacattcattcccctgtcactttttgacacagggtttaactttatcaatcggtatgtaggtttattcgacatcagtggcgatgcttctcaccgcagttgtctctgtattcctcttcaattttcatctttccttagccttcttcttgggttcaacgtaagttaaccacatttgcttttgctaatacaatcatctcaacttttgatatcaaaagtagccaccaacatttatgcacataagagccactgactgcgtaaaaggtgtctcataaaatgcattactgtgtttgcactttgcagggtcgtctctgtttcagtatatttacattccgcagggaagctacgatagtaaagatcttcacacttacatctaccaagaaaacaccattattctagtacagagataaagcttttgaacgattacgattttgtttttcgtgtaggtatattcacatttgtgcttctgtattgatttttttttccgtctcatgaaaccttctattctcatttgtacgataccaaaacttatcaagaatagttacaatttcagaaattttaagcctctacgtaattttttttataaaacacccctccggatattttaataatcattaactgtctgaacgtgaagctgtatgttgaaaattgcacgcttagaacaaaaggcttaaccaaaaatgatccaaccgtgaagactcggagaccggcgtacttagtttttaaattaatcattgtctttgcttcaaagccaatcctatgagactttgtcttgtctccaacttgtatataagctctattcctctactctgtttcacaccatctcttcttcttcttcctcttctctcagtgaacaaatttggctatg

SEQ ID NO: 17109 - DNA, 3003 bp, Unknown; identical to SEQ ID NO: 17108
  misc_feature (1)..( 3003): 2750-1469P.txt file - cDNA_ID_1807806; gDNA_ID_2926209; Annot_ID_202467

SEQ ID NO: 17110 - DNA, 3003 bp, Unknown
  misc_feature (1)..( 3003): 2750-1469P.txt file - cDNA_ID_1807822; gDNA_ID_1620742; Annot_ID_49627
aagcaggtacattcatcttttatgttctattaagcaggcatcattacccagagaatcaccaacaattggtaactcagtactgattctaattctgtttctggtggcaggatgtcacaaatgttttcatgctaaacttgtataactattttggaggcaagagcacaaagctgcctgaaatggtaattcagatatgggatatgtaaaatcgaattgatctccctatttctctccatagttatgactatgtctatttttggtgttaaaacctaaaagtgttctaatccctttttctttaatatctataacttttgcagtgcaaatatattgtatagttgtttatcttacaaagcaattaacttaatcttacaggaacagcttcagcttcctgtaaaccagagggctcgtaatttgcttgcagatgttgaaactaaggtgtcttttctgttttatttatttaagaagtcacgtttgcttgtatttaacgtgattgttcgcactattctaacaaaataaatggaaacttcttctcttgctgataacaatatttcgtccaatctgtttcagggtctgaaaaacttggctgaagagctgtttaaaagcaatggcacacaggtgacaaccacagtgaaacaaatcagtttgagtaaagtgaatgtgaagtcgaggccattgttatcaaggtttggtcactttgcttcactgtctctgtcttgtgagtttcatatgttgatataatagaggtgtgataaaggaaatgtgaatgcagggctgcttcagctaagtgttgatatggaagttttcctgatggcggtttggcttgcgggatgtatataacaaaactcttacttatacaaatggtctcgtgagccgtagaatgctctcttacatctattcgttggtttggcttttttcccccaaaacttgggtcttatgatattttggtttgcactttggaggtttttcctcgaattggagtttgtttattgacatgtgtagtgtccacttttgaactttgacgcaatttaaaataaagtacatgtggggaataattatattatacctaatcatgtgatgcatgtttgcaataaaagtggttaataggttaaaagtttatggtgtttccatagatgtatgtacagagttaaataatcaactatttctggatcaatacatttaaaagagggtgataaataactgggatgccgcgacatgacgggcaagtggagcataactgaaaccacttgtcaatgcaaaaagcgtggaactgatgtccacaatgtggcaacactctcacaatgtcactaaccatgtaatcctcaagacatatcacacatctactattacataacctcacaccacattcctgcgagaatgttaatttcgggagagacttcaaaatctccttcttcaagggttttgttttctgcctaaacctgcagttgcagtagtggaatagagacggtgtaaacgatcattccgattaagagatagagtggtaatgaatctggtgacttcaagaaaccaacgatggtcaggtcagggtcattaggcaaatctgctgctacggcggctgcaggggaaatagcgaagggagaaggaggggatgtcatgagtgtaagagtcctcgaagagatttgctgaaagaagcttccgacgaagagaagattacgatgttatcagggcgtacgtatgtatgtgtgtttgaccttttcttgttacagtctaaaataccttagattattgagaattatgtatagtttatatttcttaatggcgaatgcatacattctttgtttatggatttttttttataggagtttacttccaataccaatttgaagaaggaattgtgtatattcctattcattgagggaaaaacaatgtattatttttatacatattaggatcatgcataaaattgtgtatttgaattacgttaactctctattgaccattgttgagtagagtgacaccaatagagaattttctttttcatttaaaacctctcttcttaatgttatcttcttttgagtccttgttctcattaactttgtttttcttaagcaaattataaattattttttcttttattataaaacgacgtctattatattctataaggaagccaaaccaacacaagtctaagaatgttttgtttgtacgcagaaaaatgttagactacagttttattattcataattcatagtactaaagtaattttttgaagaatgattttctttaataaggtatcatcaacatatactaccaaaaatatttaatttatcccactaattttgaaggcatcacgattaataatacgtgcttaaaatcttaattccgtaataatgctacacttttgagaaatttgttaagtttatgatagtttgtatgatagccatcttttgactgatctagtcggacataaccaaacacccatttactgttattatcatctggaaacccaatgagaagataagagttttatgaagcacacaagtgagaaacaaaaataaggaacatatttggttggatctatcattaaaccaaagatagataagagggaaacgaaactggagtaataatcaaaatacaatctaccatgtagatagggaaaatactcggtggttttagttgaaaaatgtaaatagttgaaagttatcaaaattttctaatatttaaacaccaaagttgaccaagatggcaaaaaggcaagaaacaagaaaatgaaagacaactatcgttatgatacaaatttgaccaaaatgaagatatgataatgtttccaaaattctcgatgcaagtagttcgctcaattatttgataagaatgatttccccactagctcaataaaaaacaattaatccttgtacgcaagttatcatagtgaagcattgacactgtgacccttggcattataaattacgaatttaagataaagaagagaagaatcaagcaaaagttgtgtttctcataaagatctcaaagatattcctactacacatg

SEQ ID NO: 17111 - DNA, 3003 bp, Unknown; identical to SEQ ID NO: 17110
  misc_feature (1)..( 3003): 2750-1469P.txt file - cDNA_ID_1807822; gDNA_ID_1620742; Annot_ID_166488

SEQ ID NO: 17112 - DNA, 3003 bp, Unknown
  misc_feature (1)..( 3003): 2750-1469P.txt file - cDNA_ID_1807834; gDNA_ID_2214548; Annot_ID_134626
tattattaatttttaaaaataataaccaatcaaaatcaatatataagatttgatatctaaattttaattaatttaatttaatgaaaaaataaatacattattaattttcaaaaaagtaacttattaaaatcaacaaattagatttgatatctaaattatcatattaattttttattaattattataattcacttctcatctttatatgattctatttttgcgaaaaaataatatcatcattataaaaaaaaaattagagtttttttgcatatgccataatttgaatttttaaaaacgaatataaactgttcaatacatgaaaaaatattataacgggtgaaaaatagatttaagaaaactttctactgagtaacaggtcataatttgaaatatttatattcaatttcatacatattatattgaaaatttataatcttatatactataataattaataacatattagatttttttatgtgtatgatgtgattcaatttttaatacaagctggaaaatcctagaattgacgggtttagatcgatattaatacaagatggtatactacaggtgaaactcttaaattaacaatcaaactacaagtgtataatcttaaacactaaacaatatagataatatcaacaaaacatatacaactcacagtttactatacatttaaaatcaaataaaataatatcatatatttttaaatcatctttacaataaaagtttttagtttaactaaaatataagcgtacctgcggtatactgcaggttaatatctagattatagggcttattggatctaaagacgggtcatcaaagatttcctaaactgaagcaaaatatactaaatactcaaatatctatctgttaccaaattataaacaaataagttcgtaaaacaatttaatattttatatacaaaatcaattaaatcttaatcacataaaaattagcacaaaaaaaaatattcaacaattaaaaaattatcaaatctctgtgttatataagttttgatactatattcgaataaagtgtaatataccttttcaatttgtattctttaattaatttaagctaactaatatatttgctaatcttatacctatcaaaaccgactatcgtttcttatctctatagtatttttgcaagacttttttgatggatttgggtaaaagtgcatttgagtcatatggtacattcccttattaaaaaaatatggtgtactcctatttattagctaaaatgtttagattataattcagagtcatatcattaataaaattaatattaataaaataaatggctttttggcaagacatatttggagtgacgggtttttgaatcaacattaacaaaaaagtaaaatataattaatccaccgtttcaatacgggttaaatctttaatttattattttttaagacccctaatattaaacatatcaaatcatcctaatttagaaaagattatataaaaccgaaaatattatgtggtatgtataatgttagtatataaaattaaactataaaatataaatgtattagagaatgatacaatttgcaaaacttttatatataaaataattcttaaattttaaaaattactctttaaaaaaaaataacgggacgggtaaagaaattatagaacaggttttattttggaattggattatatggtggatctatttgaatcaatatttataaaattttaaaatattattaatatgctgttttaataggggttacaacttcagttttttaaaaattgtctcatggattcgtggtataacgttatttaataataattataaactgtaaaatataaatattttatacaaaataaaatttgcaaattttaatatatattacttttaaaaaataaatcgtcctgcgatataccgcggattaaaatctagtataagatatttaagatgattaatcaagagcagattagcagaatgatctggattttgatttataaagatattttcatatttaataatcgaatttatatgttttcatacaaaatttcgagtttgcttatattaaactggatccaataaaaaaatctgtgtttttatttgggcccattgaaatggcccacttctagttccgtacatgttcgaatcaaaactagtcattataaatttaaatgaactatataacactttttttgttgaaaatttatttttgtcttaatcttttgtatatttttatagctagaagcctacaatactttccatataataatatttcttaagttttattatcttatataagttttaggatttgaagacatacatatagacctatttatgtttcgtttaggtgcttcctttttcaatgtctaatatgaatatcttgtttcaacaaaaaaaaatattttttttgttgtattagtttattatatggagacacttatgaaaaacttgttgatatatcttttttaaagcaaaaaaataaaaaataaaaacgtggataacaaaagaattttttaaatatctgatgtgaaaaaagagaaaattgtttcttttcaaactgcgtttgaagaattgaacagtttctcgacattctatcaaaaccgccttaattttcgatgaacttttaatacgaggctttgttttgtttattgcagcagtactgttggggccggtttattaatgggccgtctcaatactacaaattgtcttgtagggactaatttttgaaataataaattacagggtgaataccatgaatagataatgaaatgaaggttcattatgtaaattaatattttacttctgatttcgtttcaacgcatcaacaagatttttgtgaaacaaaaacccatttttatcaaaaaccaaaccaaacccatagggttgtgttgttgctgttctgttcctatcgaccacggcggcgacgaggcggagaagaccgacaaagcggagaagccagcttcgaaaccctctagcatttattttttaaaagcgaaattcattttaagggttttggtcatg

SEQ ID NO: 17113 - DNA, 3003 bp, Unknown
  misc_feature (1)..( 3003): 2750-1469P.txt file - cDNA_ID_1807842; gDNA_ID_1621146; Annot_ID_56759
ttgtgttaggtcatttagttgaagtgatcgaaagcctaatatatcggtcagtggaaaagtaaaagagaataaaaatcacttccctaagtgagattgaaactcttttagagatgattttgatcatgaggaattgaatccagttgttcaggaaatggaaagaagagtaattttagagggatcctttcatctatcaatttttctgagtgtgagaaatggtgtattatgggagtcaagttttgtataatgttcttgtgtatttgtgagtatcctctagattgggctattctaagcatgagggctatgctttgctgccttacatattgtggcccacatgttgtggcgatgacactcacctacagtggttaattgacctagtttgctaggatgggaggtacgtctttgttggtggagaggtgtgtataatcaattttattgagacataatatttcgtcactatgtcaataaatctgtaataataaaaattttgtgacgattttgtgactaactgttaacggttgcaatacattcgtcacaaaattgttttctcggattgtttcatccgtggcaaagcgcgttgcgctcttaatctcttacctgcttgcggaaattcacccccaaaatatcattaaattcaatacaatgtgttaaacacgtatagtatatcgttagtattatttataggcttgcttataagtaaatttcgttacctatttatatacagataagccatacaaaatcttcactaatttacctaataattaattatttaccgcactatcatctactaagctttaaatgtgttaatttcttcatggaatcgagaagactttaagtatatgcagtttgcttataaacgcggccttgtaattttatgcatatgacatcttatcgtgcatgatctcagaaacagattaattggacatatagtaatgtgaatataaaacctaataaagaaaaaaaaatcaaatggtcacatttattgaaaataagatggtgacatgataatacaaagaagtttatctatttgtctatttagcgacctgtttatttaattcgtttgggcttcgttcaattccgcaggctatctttcacccgaagcaactaaactatagtattaaaagtatatatggaatagcttgtaattaggttttataattgctgctaattattactattatcgttattgaatattcaactgaatcgggccatgattagcgatgaggtacatgacaatgaaacatgcatgttcctcaaattccaattgatatgatggaagaaaacaatacaatgcccgacaaatttgaaaatataaattttaaaacaatgttaacaaaggaaataatataagaagaaaatgccaaaatagtggtttttgacgaaaatgtatgagttctaagaaccaatgaaaaataaaataagaagttatctttatagtaacgggaaattcaactaaaacatgttttgatgagatttaagagtttcgattcgagtttaattttattcctatttaaaacttagaaaattctacactattttctctaagttttctactttacactaactctttctatcaatcttcagcaatttattgattgtctcttttatccccctatactgaatatatgagcgatagttgactggtactaagatgtatttagacataaaactgactttgaatatgagaactggcccacctcctttgattatagatccacccctgtatatatgtttttttaataaagcaaccacgtctccgttccatgcatgtaaaacactcatctacaaatgttttaaatacaagacctttttcttacaataataaaacacatatcttatgattggtaacccttagaaaaaggaaaattaatggtgccaaaaaaaggtatgccaaaaacgttttagtgatatgaaaaagaaaaaaaaatgcaaattctatcaaatttggttaaaaaataattggaatttctaatgcaataaaaatcatgtcattgttattacttcaaatatcccaaattcagaaattattcatccttatatttatttatttcgtaaaaaataatctatagtaataagttcatcatagaaatagtctgatatccaagacagaagatcaatacaatcatagtaaaacttagagtgtatacttaaaatttagagagtcaaaattcatcactgtttaataataataatattaaccatgtaatcatctagttggtattcattgacgaaaaaacaaaagtaattgaaatcaaaatcaagaccgatacagaacatggagacacggaagaaaaaatgatgaatccattgttggtgtctattttcctttgttccctcaaaatattctaatgttggtggggttttttccgccatgcaaaaaacgtattgcattttattaaaaaaaaaatccctttttttttctctttactaacccgaaaatttatgtttggatagcaaaaacattccttttttacagttagaaataaataaataaaatcgtcaaatttgttaggaatttttcttctaaaaaaacaagcatacaattccgggtaatgagaaaatgtcacagatcttcggctataaatagaggagtagctagagagcatcttcttatatcaactaaactttgtattcatttccaagtatcactctaaatcatctttttcgaattcgcctcccaaggtccgtctagaaaactaaatcatcttttcgtttttgtatagatcatatcattatgatgatctcgatctctttttctgtccactcgtctacatgtgaccgctattatagttttcgatatccggttttttatgttaactccttcatatagctagattcaacgcatgtttttttatttgtaaagccggaattaattcgaccagtttcttgtatttgtttcttagagtctcttaggaatcggacatctaataatactcaactcaatcagataatcattttcttatctaaattctttgtgttattgtgttattggaacaaaaagatatg

SEQ ID NO: 17114 - DNA, 3003 bp, Unknown; identical to SEQ ID NO: 17113
  misc_feature (1)..( 3003): 2750-1469P.txt file - cDNA_ID_1807842; gDNA_ID_1621146; Annot_ID_173047

SEQ ID NO: 17115 - DNA, 3003 bp, Unknown
  misc_feature (1)..( 3003): 2750-1469P.txt file - cDNA_ID_1807848; gDNA_ID_2214520; Annot_ID_134046
ctagtgaccccaacaataatgtacttgtgagagtttgtcttcgagtttcatgaataagaagagaaggcaagagaagactctcaaggaatcagaaggtttgattcaaagttagaaaacttcaggcccatacgcaagaagcccatctcgtacaagtcgttgaagaggaagcacgcctgcagcattgtttccttttaaaggtttgtgtcgttctgtcctttgtagaagtgttcgaacaaaacaggaaaaacaggggacaaagaatcaaagatgcagagagtagatgagatggaatggcgtgtttggttgaatgtagttaatgagttgtgtatgtacaagctccagtaagagccaactgtatataaggactgattctagtggattccgggacaacaagtttcccggcgtgagtagggtttcacactgagacctgaacacgtaaaaactctctcttgcactttactttctctgcaatttctctgtttctactctgcttcaagtctttctttctaagtttctttcacacgagtgtaatggagagaaagagaggggtttatggtgataaaggtcgctactttaacacccaaaatctccacagtacttttgtcactatctgaattaaacttggttcttataacatgctaaatttcacaggcttctgactacaaccaattgagtattactctaggtccctttacactgcgatgaaactcgagaagagatcgaaaactcaataacttactaagtaaatagcgtaaaatatacaaaacgactatcaaccattagtgtaagagagttttgggcttccataatctctccatagcatctttaaagtacgattacttcaatggatatattttgcttgtaatgttattaaattatcgtctcgcaggatcagataaaactcttatgaccccaagaacatcttacaaggttcatgactacatacccgtataaattttcatcactcaaaaaatacaacttattattgcacaccataaacaatgtgaaaactatatccatcacttaaacaagaaatggatatcttcattatgttggcttttgattctttttccttttccttacatatacgattaactctctggatgtactagaagtatcttccacttcaactatttctttaccatgtgacacattttgagtcttctccattttcttcaaaagaaccaacatcaatctcaatcaataccaacattatcatcttcaaaaaaaaaaaactatctttatacaaaccttcttatttaagcgctgtctagacattaactcatagaatttccgcatcatcatctcttcttccacctataaacacaaatgtatgtaagattgatttcttgctcatattattcatatcaaaagtacacaaagtttcatcaaacaaacctcaagtgtttggagttcttgagtcatcgttttacgagtttctaaaagcaattcagtttgcttctccaaatggctgttgatgtgctaacaacggtaaatcattatacgcaatgcacacacgaaaaataagcgtaaaactgaaaacaaagacgcactttaataaatcgtcggtatattcaggatccatgctccacaaattgatcaacttcaactttatactgatcttgtgctgatcacaagtggatcaaaatgtcatgagaatataatagataaaaattacgtacaaagcacagtttgattaagaaaaaggagagtcttttatcattgattcattcacacacatatcactagagaagatatgattctaataatctaaagggtatgatcacaaattcgaacagttaacagcaaaaacataattaaagaaccaaacaaaaaaaaaaaagcagatttagagaaagaatatcttagttagacaattcgtcgagcaactggtgtgcatagtctcgtgcctatcaaatttttcacaatgccacgatacttaaatcagaaacaatcaattacgtctaatatatagataaatcatcaaaaaggaagttcttttacgtaccctttcgtcaaatttaacgattcttataactttcaccaccataaacacttgacgattctcttcttctctctctcaatctcacccaaaatcaagtcctctcttctacaatggagttgactgggctaatgggccggtgtgactaggctaatgggccggtctattgtgacccaaagagaacaacaaagataaataaagtttcgatttttatgtttatcagctctatgtgcttctcattagatgagagactttcgctaatattttatgtgtttgttttgttttttgaatgcagaagtccataaactttatatactagcgtaagaatatcctaacttaacattctaataaacataacacttatataggttgaactacacttggtatttgatatttgtagttgtaattttcttttagggttctttgaaccactccacgattttgatccttgattaaattttaaagtatgttgaaaagtagaaaatatgtgtatcgagaaacgatctctgacttctctgatgttatgctttcactaaccatctttatagaaaacatacaaaaagatttgattcgttttgtcctttgaataaatgttaccaagaaattctgattaccgcaggaaagatgcaacttttggattcgggtttatattttaacataacaaatttacaacacaatgggcaaccaaaaagaggagttcatgtgccaagcacttagaaaaaaagaaaaaaaaaaaaaaaacaagcgtggtgtttgggttttcgagccttgagaggttggtgggtgtgttgttgtgaatctctaagttttctctgtaaattatatatttgtttacatgtatataaaacaatgtttctttttaaagtgacccttttaagctttcttgaaaacaagattgtgcatagatctcttctaagatccttagctttgttttctcttttgtgtctaaagatcttgaaagtcttgtgtgcaataacttattaaagagatagaaaaaaatg

SEQ ID NO: 17116 - DNA, 3003 bp, Unknown; identical to SEQ ID NO: 17115
  misc_feature (1)..( 3003): 2750-1469P.txt file - cDNA_ID_1807848; gDNA_ID_2214520; Annot_ID_184584

SEQ ID NO: 17117 - DNA, 3000 bp, Unknown; identical to SEQ ID NO: 12504
  misc_feature (1)..( 3000): 2750-1469P.txt file - cDNA_ID_1807856; gDNA_ID_2214555; Annot_ID_134756

SEQ ID NO: 17118 - DNA, 3000 bp, Unknown; identical to SEQ ID NO: 12504
  misc_feature (1)..( 3000): 2750-1469P.txt file - cDNA_ID_1807856; gDNA_ID_2214555; Annot_ID_185683

SEQ ID NO: 17119 - DNA, 3000 bp, Unknown; identical to SEQ ID NO: 13736
  misc_feature (1)..( 3000): 2750-1469P.txt file - cDNA_ID_1807870; gDNA_ID_2214647; Annot_ID_136381

SEQ ID NO: 17120 - DNA, 3000 bp, Unknown; identical to SEQ ID NO: 3950
  misc_feature (1)..( 3000): 2750-1469P.txt file - cDNA_ID_1807874; gDNA_ID_1620675; Annot_ID_48222

SEQ ID NO: 17121 - DNA, 3003 bp, Unknown
  misc_feature (1)..( 3003): 2750-1469P.txt file - cDNA_ID_1807874; gDNA_ID_2926203; Annot_ID_141581
gtccaattagcttctcccagtttggtgatgattttttccaggaaacttcagatcaaacgatggaatcaaaatcaagagtcaaaaaatcttgccgcagaagtagacgtcaaataacaacttttctaaaaatataaactaattttgtcgaacttgtttacttggctctttgaactcgatcgttgaatttcacaaagcatgattttctatatatagctcaatctatttttgctctgagttaagaatatttataacgagtgttgatgatgaaaatgaatacttgtaatgagaataaagattaaaacacaataaatttcttcaagtaacacgaacaaaagattattatcaactattttaattaatcatgaaatttgctacttgctttttagtttcttacgttcttgtctttctcgttcttagcgtctgtaaaggtaatatataccagatattttctttcgattctgtttcgttacttgcgtaatatagaactatgacccttacaaattattggcaaacaaaattacagtgttgacattagaaaaaactaacaaaaatgttgttctagaacaatgttttttgttttgtttttttttttttgcattatcaataattgttttatctaaagagcttcaaccaaaaacaaactaacagttcttgttgtagaagtggaagccaaagaactgtgtaatagaatagaagacatcgatggaaattgtgactttgaaggagagaaggggtgcttgaaattcatgacgaataaatataagaaagaaagacatgttagctgcacatgtactaacctttacatgttacacaagaccaaacgtttttgcgactgtaaacatcgctgctcaggataaactcccctaaccaacattgcttttacctattttttagtttttactaatagaattgttatgagtgtttgtagtgttgtcattttcatgacccataaataagttatgttattctaatgtatctctctttttccacacaaatttttaataaagttatgagttacttctttctaagtagttagtatgagttttccaatcaatctattttccacgttcagttttccaaattgtattgatcctgttatagtgtaattacgcattttgtaattggccatggtactacaatactaatactatcatgttatctgcagacttcaatcttttatttttaaaaattaattattagcatttgtaatattgatgtaattttaatacaaactgtttattaatttgtttgaaaacttatgtggacaaataaaattagtatacagaacaaaaaaatatgtttcaataccaaaaaaagttcactccctaagcttttctgtctcttaaggataacatcctggatgaggtctctcgatgattccccccacatacaacataaccatataaaaaaaaaatcatcagccaagtgaagcctcgggaacagtagtgtgaacctttggatccttggcctatcgtcaaatgatcgacgacggtcgagttgattgatcctacacagtacacaacctgaatgttttcccatagcatctctgcttcatctattccttgctagtaggattgatcccagaaaaccataaatttgttttataaagattgaacgtttgtctatagattaattttcaatggattaaacattgtaaattaatggtcttatggattttgtgagtttagattatcaaggttagaactgtgtattttgaaaagaataggtgatgcgtcatcacaatacacgcaaaaaaaaaaagtgaaaaatatataatactagtaagtagatttacaaagaagaatttttccaaaaaagaaagagttgatccgtcgaactcgttaattaagaaggctcgttgaattttacaaagcaaattctaaaaaaagatgcatctatttttacgatatctcgaatatatttattatgagtgttgttgataagaaagataaaaaattcgagaggcaaacaatagttttctgcaactatagagataattaataattcttatcagcttttcaatcatgagatctgttatttggtttatagtttcttatactctcatgttactcgttctgagaggtggtaaaggtaatatgttgagttttttttgtatggacgtaactcgtatataataagatataaaacaaggatgttctttctaattgcaaaaacggtgttgtgattaaaggaaataaaaagcattgttacaacgttaacatatggtttaatagtgaacttatttggattgtcatttgtttattaatcgaactaaaattaacgtttttttttttttttttggtttgtgtggttgagaaaacaatagaagtggaagctgagaaactgtgtacaacgataggagacttggacggtaaatgtagccaagacggagaaaagttgtgcatgagatacatgactgatcaatctaaaaaaaagtttcttagctgcacatgtaataacgttgttatgttacacaagtacaaacattattgcgaatgtcaatctcattgtactccaaaacaaacgtaagctgtaactctataatcaatatatctctttacaactaaataagaattgttgatagagtttgtagtgttttcacgactcaaaaatacaaatgttgtgctgattgaagtatgaatttttggttcaagtcttgatcttgatcattgaaaaaaatcgtgaaaatattgatcaattgccaacgaaaagacgtaatggggtgaatcagatagtgtaggattatttggggtaattttgttacattctaaagtatagtgggtggggttaaattgatagtattaaaaaagtcaagggttaatacgaaatacaaatataatcaatagcgaaaaaccaaaaaataaataaataaatgacaatttgactcgaaaactttaagagaaaatggaaactgtgtctcaataaaccctagtaccctttttctctcttattcttctatcttcctcctcctctatctttcgctcgagccattgagcaattatg

SEQ ID NO: 17122 - DNA, 3003 bp, Unknown
  misc_feature (1)..( 3003): 2750-1469P.txt file - cDNA_ID_1807878; gDNA_ID_1621115; Annot_ID_56183
tttatagtgtgagcttgtagatttgggttttaccgcttcttaggtactggatttagcactttggtgtaaagtttccaaggaaattttaagagatatatgtatatgagcttatagatttgtattactgtttcttattggattttactatttgcatttctatggggatttttggtttcttatggatgttcatcttttatgtttttgtaggtttgatgatatcactttcgtaagaaccaaggaatctgctagcaagcagaattctactctggcagctgcaggcttggtggaagcgatactgtttgaggtgaagcagcgagatagagttggtggatcttttttcaaatctgaggacatgtgctgtacgccaaaacttgcggatgctggttcctgcaatcttggagaggttatgattagtgcagatcctaatgatcctgaatggcctaagcggattcccacttttttcaaaaggggtgaggaagaagtgaagatgtctccggaagctgtcattatcaagaaaactggattgtacactgtttacttcatgacatgtgatccggaattggatggcgcaacaatcagaggaagaacagtttggaagaacagaggtggctatttacagggagagaaagctcctttgaagaagttctacgcctccatgcttttggcttacgtggttcttggcctagtttggtttccacaagttgctcagtattggaaagatggaatccagttgcatagtcatatcaactttgtaattgcatttaccatgggtgaattggccttcctctaccttgacttcgtttatctcgactcagctggtacaagtcctatggaggttacagtatgggcaataaccctttcttccatgaggaaggcactctcccggcttctactgttggtcatatcttcagggtttgggatagtgagacctaccctaggtggcataacattgaagatgcttcttattggtgtcttatgctttgttataagtgaatccctcgggttggctatgcaatttgggaacatctctgaaaatggaatgaattacttaatgctctcttgggctatactggaaacttgctttatccagtggattttcagatccttgtcgaaaacgcttaagaagctcaaggtaagagaaacatacaatcctccttttcttttgattattgatataacaggttaggcacactgattgctacatgtttctaacatatcacttgtaaatatatctttcttgttaattgttgaaagttgcagaaaagccatttataaagatccatttcttcttagattattcatccctgctaatcccatatttttcttatgtagctgaataagaggaacattactaagctgcagctctacaagatgtttgcaactgtgcttgtaatcatggttgtgctcagttttgcctggatttatgtggaggtaacatctcaacagtctagtgataactctggggaatcacttgaaaaaagtcatatgattgtgtgactgaaattgttttctgaatcaggtatatctctacagctccttgagtcagttttggaaagtgaagtggattgttccaacactttggtacatcctttcttatgcaatgttggtactgatttgcctcttttggcctccatcggaaaaaccaatgaggtatggtatcaatctttctgtacttgccctttatcaatcgggtgcttatgtggcctgttttaagttccacactaagatcttgtctgttttgtactaacatgtttgaactttgtatatctgatcttctctgctgctagttacacatttttctgatgtatatatactggtttgaaattgcaggtacctatacgtagctgacatggaggaagagactgaagaagaagatgatctctccactgcagaaaccggtatgaacgcaacaaaggctgaatacgagaggagtgaaaggaagaccctgctggaagcattcatcctattgcttgggaatataccaggggagaagtgaaactccccatcttacaaagttaccgtccttttagcttaagctgcctacttctcatcctttttcagcttaagctactcctaatcatccttttaaacctacggctttaagtttttttttaactcatataatcttctgcagtagacttgacttaatcggattttctgtttcatgaacttgttggtagtgtggaacaaatgggaaaatgaatatttttggaacaaattgattttctgtttcatattaagttaaatcattctgtttccactgaaataaattgttttccaaaaatcactccgtttattatgtctttgtttttaagaaataaaagtgagaaaacagaataacgcgaaaatgtcgacatatttggctaagtatagacaagattgggaagctctgtttagttatgcgtcagtctctcatcagtgttcaactgccacggagcgaaccgattcctaattgcaacgtcccgagtccatagaatgtcgacactctttcactctttctccaagttgcctcctttgagtcctttctcatattttatagactcactttctgtttcttgatcccgaggaagaagaagaataaactcttgttcccatgatcttcgtcgatgttagtaccttgagattcgattcgtctctccgattctttataatcggaatttattggtttgtggaatctgattttgggttctcttctattgctcttataggttctttggaaattgtttcctctatactcgtttggatcaggaagagactctctctcaggtatttcatcgaacacttaccctacaatttagtgaaatttctgtgtgatgtagaattctctagattcttctaatcgagttttagctgagaaaattagtgaaatgaaatgagattttccattgattgctagattccaaaactttagcttgttgttctgaattgcacttatttgttgtgttgtatggaccatggaaacatccaaaagagtccattttgcagatcattcccgagacaatg

SEQ ID NO: 17123 - DNA, 3003 bp, Unknown
  misc_feature (1)..( 3003): 2750-1469P.txt file - cDNA_ID_1807882; gDNA_ID_2214571; Annot_ID_135065
aaaacggaaaatccatgattgaatcatttctctttcaaaagtcactacctttatgaaacttgtatgtttccgaagcatctatatgaatttgagtttagaccatctccatcaattgtttctcatttagaaaccacctaatataaaaataaaatgtaatcaaaaagtaagaaaaagagtgaagagagtctcttaactgagaaactatgagaaacccacaaagacacttgtttatcatgcattgatcaaattttattttaataattaaaatctaattatataactaatatttattaaaatactaatactgtttttttaagaaacccagagagtatctcactaattgagatgctcttagtttgtatctaatattatcgcttatgaaatttaaatgtgttctcatagttttaatcaaaaagtaagaaagagagtgaagagagtctcttaactgagaaactatgagaaacctacaaagacatttgtttatcatccattgatcaaattttattttaataattaaaatctaattatataactaatatttattaaaatactaatatatatttttttaagaaacccagagagtatctcactaatggaaatgctttagtttgtatctaatattatcgcttatgaaatttaaatgtgttcttatagttttttaaaagactcattcaggttttcttatctattttgtcaatctttgtaaaccggaatttcaatcttacaaattcgattttacaatacaatttaaatatctattttactttaatcaatataatttaattctatacattacattttattgttagttttccattttagttaagaaaattataagttaattttttagatatagacatataaattaaatatctagaaatatgtttatttatttagtttctttattttctttaggaaaaaagtaaaaaaaaaaaaaaaatctaacacatgtcaaaatctaaaatcttaaagattgacatgtgtcatgatattgtgagttactaacttttaaaaccgtactttatataataagattttatatatttatagacttaaaaattaatatatgtaaatttatttacttttttatgttttctatttttttaagaaaaaaaaagttcaatctttattgacatatgtaaacatcttgtcgttagatttactacgtgtcatgatctcgtgaattagtaacttttgaaaccgtactttatataataaattacatttgaattcgatttatacaaaatcttaaccgtaaatcacgagatcatgacacatgtcaggtatatcattgagatgttgacatatgtcaaaaaagtttcttaaccgtactttatataataagatgtgcaatttcgatattgaacctcatcaaacaatttacgtagctcgaatcaacccatacgattctaggcgcaaaagttatttcgctgtcatgctttgaacccaaaatttatcatctttagaggatagatttaataattgtgataaaacggaacttttgttaagttatgaatatattgtgtataatacatttatgtattaaaaaattaagattttcttgtcaagaggtatggtcattctcttacattaatttaaactcaagaattttttatatcatttataccaaatatgataaattttataaaaacaatgtaatttcgatatcgagcctcattaaacgatgaatagctccaatcaacccataggattctaggaggaaggctgaaaaacctcgtcgtaaaccctttatcacatgtagatcaatagttccatcatgaagttggaacagttaaaattacaggaacaacaattatttctgctgcctaaatttgaacccgaaatttatcatctttagaggaaaaatttaatcattgtgccacagtggaacacttgctaaggtatgaatatatcgtgcatatatacagttatgtattaaacttcttatgactcattattggttttaaaaagaatttaccaaaaaaatatgatcattctcatagattaatttaaactcaagaatctttgaatatcatatttaccaaataatacatatcctcaatcaatccacatagttttaagcgcaaggtcgataacccacggcttaaacccttcatccataattcatatagatctatagtattatcttcaagttgtaaccgttaaattacaccgcttgttctactaactcaggatcaagatccatcaaatctgcatctaattttggtatcgatctattaatagtactatatgtatattttctcgacataattaacttatgataccaatacttgtttaaattattaaagttccggccaaatacttatttatttaccatcttggaagaagcattaatgtgaaagaaataacacttcaacatgaacagaacaaacatctgtttaatccctaattgcaaatacaaattgcatgactttcctacactgcaagatctttctccttaaaatcaagaaaatagccaaacatctccaagaatttgcaagaacagtggacgatgttaaaatttgtaaaatacgtgcgggtagggtcgtgtaaactttcttcttttttattcacacttcacgtgttgtgtgtggaactatgttcacattagtttaacagctcgacacaaccatattcatacaaagtcttgataatattgattgcgttcgagccagaaccttcaaaactccattaaaaaaaacaaaaaaaatatatttgaaggaacaagaaaatttattgctcagcacagaaggttagggagatcattaagagtccattacaaaatttggaggctgaaacattaatattcttgactcgtacggattctctcatgttcatacacataaactagttatgtttttgtctttgtcaacaacctcaattaatatttagcagttgatggttggagaggaactttttatttactctttttatcttctgccttttaaagactacttgtttctcttcttcttctttattgcttatagcttctgagcatcaatg

SEQ ID NO: 17124 - DNA, 3003 bp, Unknown; identical to SEQ ID NO: 17123
  misc_feature (1)..( 3003): 2750-1469P.txt file - cDNA_ID_1807882; gDNA_ID_2214571; Annot_ID_186178

SEQ ID NO: 17125 - DNA, 3000 bp, Unknown; identical to SEQ ID NO: 4818
  misc_feature (1)..( 3000): 2750-1469P.txt file - cDNA_ID_1807890; gDNA_ID_1620734; Annot_ID_49449

SEQ ID NO: 17126 - DNA, 3000 bp, Unknown; identical to SEQ ID NO: 4818
  misc_feature (1)..( 3000): 2750-1469P.txt file - cDNA_ID_1807890; gDNA_ID_1620734; Annot_ID_166203

SEQ ID NO: 17127 - DNA, 3000 bp, Unknown; identical to SEQ ID NO: 4818
  misc_feature (1)..( 3000): 2750-1469P.txt file - cDNA_ID_1807890; gDNA_ID_2926217; Annot_ID_142251

SEQ ID NO: 17128 - DNA, 3000 bp, Unknown; identical to SEQ ID NO: 4818
  misc_feature (1)..( 3000): 2750-1469P.txt file - cDNA_ID_1807890; gDNA_ID_2926217; Annot_ID_203032

SEQ ID NO: 17129 - DNA, 3003 bp, Unknown
  misc_feature (1)..( 3003): 2750-1469P.txt file - cDNA_ID_1807894; gDNA_ID_1621129; Annot_ID_56432
ttactaaaaaggtgagttcaaattccagtaatccagagtggaatcaagtatttgtcttttccaaagaaagaattcaatcatccgtagttgagcttttcgttaaagaaggtaataaagatgagtatacgggtagagtcttgtttgatttaagcgagatcccaacccgcgttcctccggatagtccgttagctccgcaatggtacaagatagagaatagaaacggcggtagaggtaatggagagcttatggtttcggtgtggttcgggactcaagctgatgaggcttttgcggaggcgtggcattcaaaggctggaaatgttcacatcgaggaactctcatcgatcaaatcaaaggtttacttgtctcctaagctatggtatcttaggatatcagtgattgaggctcaagatgttgcaattatggacaagggatcaagtctcatgaggtttccagagctttcggcgaagcttcaagtagggagtcagatactgagaactgcaatcgcatctgcaatccccacaaagagcttttcaaatccttattggaatgaggatttgatgtttgtagttgcagagccgtttgaggattgcgttacagttgttgtagaggatcgtcttaatggtggtgcaataggaggacaaaacgatgtggctgttgggagggttcagattccgatttccgctgttgaaagacgaacaggagatacactggttggttcaagatggtttagcctagataacggcaacaataacaaccggtttggttctaggattcatcttagattgtcattagacggtggctaccatgttttggatgaggcaacaatgtataacagtgatgttagaccgactgcgaaagagctttggaaaccgcaagtagggcttttagagattgggattcttagtgcaactggtttgatgcctatgaaggttagggacgggaaatgcggtggaatcgcggactcgtactgcgtggctaagtatgggcctaaatgggtcagaacaagaactgttgtggacagtctttgtcctaagtggaacgagcagtacacttgggaagtgtatgacccgtgcacagttgttaccgtcggtgtattcgataatgcacgtgttaatgaaaataacaactcgcgggatgtgcggattggaaaggttaggattaggttgtctacgctagagacaggacgggtttacacgcattcgtatccattgattgtgttgcatccctctggagtaaagaaaacaggtgagcttcatttagcggttagattatcttgcggtaacgctgttaacatgcttcatatgtatgcgttaccattgcttccaaagatgcattatactcagccgttaggcgtccatatgcttgaacgtttgcggtatcaaacgctaaacgcggttgcggccaggctgagtagagctgagccaccattgggtcgtgaggttgtggaatatatgctagatcatgatttccatgtttggagtatgagaaggagcaaagctaattttttccgactggttaacgtgatttccggtttggtcgcggttgctaagttggttgaagttatgagaagttggagtaaaccggtttactcgacggtttttgttttggctttcttgtttatggttctgtttccggagcttctattgccgtgtttgcttctttacacggctgcggttggcgtttggcgtttcaggcggcggtctagatatccaccgcacatggacgcgcgtatctctcacgcagaaactgtgtttcccgatgaacttgatgaagagtttgacacatttccgacaagcagaggatttgatgttgtgagaatgagatacgatcgagttaggagcatcgccgggagggttcagacagtggttggtgacatggcaagtcagggagagagggtacaagctttgctaagctggcgtgatccacgtgctacgtttctcttcttgatgttctgtttattggcggcagttggattttacactgtgccggttaagttgacagtagctatttccggtttgtattatctgagacctcctcggtttaggaggaaacttccgtcgcgagggcttagcttctttagacggttgccgtctagagccgatagcttgctctagaacatgtcaagagtgtatttaactatttatcgtcttcttagattactagggactttagtttttggtacgatttattggttgtatgtatttattatgttttcggttaggttaacaaccggtgtttgaacacatgaatgaaagaccgaaccggttaaggcattgtaccgaacctgttgtgttaatgattaggatgctttgctgttcattacaaaagtttgctaactgcttgtagttttttcgtttttggtccccgcgtgatgaacttgttaagtgtgtaaaacaaattacacataagacataactcaattaatatacccctactgattcattaaatttaagaatttgccaacattgtatgaattgcgattcaatcctccttcgtgtccatgataagatatattacgaattattatagcaactaatttttcagataaatctcaaatattatttggatcaatcgaggaattatcaaaaattcaaaattatatattaggattacaaatagggttacagtgttctataagtttttatcagggtaaaaatatgaaataaagaaaatataagggtatgtttaaaattatgaagattgtgtttagataatcaagaacagggcatttccaattagagagaaaaaaaggagatccttttaatgtatcgcagaccatcctcagctatggcctcctgtttttccttttaggtatcttcgtagctcttcaccgtaaataatcccgacccatctagaggacggagccgccggcgaggaaattcaggcagattagatcggcgatttggccttgttttcaacgaagatcgtcttgttagggtttcgtccgcatctatggattctctgtcaaatggggtattgatatgaatttcggctttcgtgatg

SEQ ID NO: 17130 - DNA, 3000 bp, Unknown; identical to SEQ ID NO: 12280
  misc_feature (1)..( 3000): 2750-1469P.txt file - cDNA_ID_1807898; gDNA_ID_2214540; Annot_ID_134463

SEQ ID NO: 17131 - DNA, 3000 bp, Unknown; identical to SEQ ID NO: 12276
  misc_feature (1)..( 3000): 2750-1469P.txt file - cDNA_ID_1807898; gDNA_ID_2214540; Annot_ID_185220

SEQ ID NO: 17132 - DNA, 3003 bp, Unknown
  misc_feature (1)..( 3003): 2750-1469P.txt file - cDNA_ID_1807910; gDNA_ID_1620653; Annot_ID_47777
tcttcacttaaatcccccattggaggcacatcgctctccactgttcgtcgctttgtaagttgattctctattttggttttatggccttatctcgttttctccattcgatttttttgattggaagcgaaagtaaaattttgacactctttgttgttgaatagggagtaggtgttgttaggatgcaagctgttgatgaagatattgatttgaagcaaatgagagacatagctgctgctaaaaagcgttgggatggtttggtaaccatcacttacatcttaaaattggaacattggagtgattatggttcatgtttttattttcattgttattcaactgttctcactattaacaaatttattgtttgcatagttaagggaaggaaaagtgaagcttcttacaccaagagaagcaggctatgctatttctctttcaaacaaacctctccttgatgttcgtccctctagcgagcgcaacaaggtacattcttgttttttaagttattaggctgcttgtttacttatccatagatgatgattgtcttgtctaaattcacccttgaacgttattgcatagaatttggttcatgtatctcacctttgcatgacatgttagtaagttagttcaaactcttggcgactgtaatgttattatgaaatcaaaactatagtgtgttactgatgtagtcttctccttcgatttttttcttttcttttctataaaggcatggattaaaggctccacttgggttcctatcttcgacaatgatgacaaccttgacgctggaactctttccaaaaaagtcactagttttgctatgggtacttctccaccattataagttataacctgttgactatagtgacattggatcaattcattattattccctactattatctatatttctattgtatatcattgactaatcccatctaggatagagactagaacacttgaatacacgcatttattaaattctttttggttcttgtaaaaaattttggttttgatttcaccatgtttccacttgtacagggggatggtggagtggagcacctacactatcttttaataggtatgtctgcgagagtaagctgaccttcttctttgccttttggcatacttacttgcttcttggttttctacttcgtttgcaggctcttcttgtcaaaggttgaggagaaattcccaaaagactcagagctgattgttgcttgccaaaaaggattgaggtacttgaaatatagatagataatgagtgactaaccatgcttgaaatatgtggttactttatattataatgagtaagtggctggttaggttctctgcctatatattatatattcatagaattgcatggtgatttatccaggttttgggttgaagaagtatcattatcaaatggtctcggttcttgtggaatgaaaattagtcttatattgaaagttagtatgttgatagtataactgtgaatcacagggttcatattgttggatgatcctcaaatttatgcttgactcgtaaatattgtcagatccttagctgcttgcgagctactatataatgcagggtatgagaatctgttctgggtacaaggtggtttagaatctgctcaagacgaggttatacgattgttttaaactttcggttttgtgctttatactttttcagtttcgtttctgaattgcaagattctacaacatcgataactaattcattcattatgtgatagcaggatctagtgacagaaggtgtccaacccttgaagcttgctggtattggaggtttttcagagttcctcgggtaattctctcttttgctactcagactttctcatagcttgaaaagtaaaagtctcaaaagacaatgaggagaataatggataggcctgtatttatttataatgactgtaagtcaatagcctagctctatcttgtacatcattagcagcatttggtattatgctcatacatctttttacttgcagttggacagaccagcaaagagctcaagctgcgaaagaaggttgggggtaccgtttggtatatactgctcgtctggtgagtttttttaatcaaaatctcttgtagcttctttcttttgtgaatcatgttcctcatgactgcttctctcatgtcatgtttgtagtttggagttgttctggctgctgatgctttgttcgttggggctcagcaactaggccattatattcaggagttaagaggccattaggatctctctttaaccacgctccaagtggctatatttctcttcaacaaaaaaaaattgaaaagttttggaaggtagagtagttgaaatagatcaaaaatacatctttgaatcctgaaattccaatggcaaacttaccctttgctttataccaagatccgtattatccaaagaataatttgcttatataaaaaagaaaattcgttgacgaaaaaaaaaagaaaaaaaaaagaaaaaaagaaaagaaaattcggcttaaacttctagtagacaaagttaaataatctaggacaaaaattgcgactattcgagtttggtccgaaatcgtaagtaagagagtttggtcgggacgaaaaaaagaagaagagagtttggtccgaaaaaaaagttaattagagagtggaatattcgacccgcggaaaaaaaaatctttatccaatttaaatgcgtgtcgttttactagaaatatgaagcacttcttgttgtttcatcgtctggaaagtggaagcatattctctctcccatcaattattgagccaacccaactatggttaaatccagcacagttccaactaacccaggttataccggttgattacacgtggacggtggagatttttctgactgcttctctatcgcaatttgctattcctctgcttaaaaactagggttaggctacgattctgtttacaccaaaaaagcttttcgtcatcgccgtttggctttctgaaacaaatcacaccgtttaagattttctctgattctgagattatg

SEQ ID NO: 17133 - DNA, 3003 bp, Unknown; identical to SEQ ID NO: 17132
  misc_feature (1)..( 3003): 2750-1469P.txt file - cDNA_ID_1807910; gDNA_ID_1620653; Annot_ID_163532

SEQ ID NO: 17134 - DNA, 3000 bp, Unknown
  misc_feature (1)..( 3000): 2750-1469P.txt file - cDNA_ID_1807910; gDNA_ID_2926186; Annot_ID_140783
tcacttaaatcccccattggaggcacatcgctctccactgttcgtcgctttgtaagttgattctctattttggttttatggccttatctcgttttctccattcgatttttttgattggaagcgaaagtaaaattttgacactctttgttgttgaatagggagtaggtgttgttaggatgcaagctgttgatgaagatattgatttgaagcaaatgagagacatagctgctgctaaaaagcgttgggatggtttggtaaccatcacttacatcttaaaattggaacattggagtgattatggttcatgtttttattttcattgttattcaactgttctcactattaacaaatttattgtttgcatagttaagggaaggaaaagtgaagcttcttacaccaagagaagcaggctatgctatttctctttcaaacaaacctctccttgatgttcgtccctctagcgagcgcaacaaggtacattcttgttttttaagttattaggctgcttgtttacttatccatagatgatgattgtcttgtctaaattcacccttgaacgttattgcatagaatttggttcatgtatctcacctttgcatgacatgttagtaagttagttcaaactcttggcgactgtaatgttattatgaaatcaaaactatagtgtgttactgatgtagtcttctccttcgatttttttcttttcttttctataaaggcatggattaaaggctccacttgggttcctatcttcgacaatgatgacaaccttgacgctggaactctttccaaaaaagtcactagttttgctatgggtacttctccaccattataagttataacctgttgactatagtgacattggatcaattcattattattccctactattatctatatttctattgtatatcattgactaatcccatctaggatagagactagaacacttgaatacacgcatttattaaattctttttggttcttgtaaaaaattttggttttgatttcaccatgtttccacttgtacagggggatggtggagtggagcacctacactatcttttaataggtatgtctgcgagagtaagctgaccttcttctttgccttttggcatacttacttgcttcttggttttctacttcgtttgcaggctcttcttgtcaaaggttgaggagaaattcccaaaagactcagagctgattgttgcttgccaaaaaggattgaggtacttgaaatatagatagataatgagtgactaaccatgcttgaaatatgtggttactttatattataatgagtaagtggctggttaggttctctgcctatatattatatattcatagaattgcatggtgatttatccaggttttgggttgaagaagtatcattatcaaatggtctcggttcttgtggaatgaaaattagtcttatattgaaagttagtatgttgatagtataactgtgaatcacagggttcatattgttggatgatcctcaaatttatgcttgactcgtaaatattgtcagatccttagctgcttgcgagctactatataatgcagggtatgagaatctgttctgggtacaaggtggtttagaatctgctcaagacgaggttatacgattgttttaaactttcggttttgtgctttatactttttcagtttcgtttctgaattgcaagattctacaacatcgataactaattcattcattatgtgatagcaggatctagtgacagaaggtgtccaacccttgaagcttgctggtattggaggtttttcagagttcctcgggtaattctctcttttgctactcagactttctcatagcttgaaaagtaaaagtctcaaaagacaatgaggagaataatggataggcctgtatttatttataatgactgtaagtcaatagcctagctctatcttgtacatcattagcagcatttggtattatgctcatacatctttttacttgcagttggacagaccagcaaagagctcaagctgcgaaagaaggttgggggtaccgtttggtatatactgctcgtctggtgagtttttttaatcaaaatctcttgtagcttctttcttttgtgaatcatgttcctcatgactgcttctctcatgtcatgtttgtagtttggagttgttctggctgctgatgctttgttcgttggggctcagcaactaggccattatattcaggagttaagaggccattaggatctctctttaaccacgctccaagtggctatatttctcttcaacaaaaaaaaattgaaaagttttggaaggtagagtagttgaaatagatcaaaaatacatctttgaatcctgaaattccaatggcaaacttaccctttgctttataccaagatccgtattatccaaagaataatttgcttatataaaaaagaaaattcgttgacgaaaaaaaaaagaaaaaaaaaagaaaaaaagaaaagaaaattcggcttaaacttctagtagacaaagttaaataatctaggacaaaaattgcgactattcgagtttggtccgaaatcgtaagtaagagagtttggtcgggacgaaaaaaagaagaagagagtttggtccgaaaaaaaagttaattagagagtggaatattcgacccgcggaaaaaaaaatctttatccaatttaaatgcgtgtcgttttactagaaatatgaagcacttcttgttgtttcatcgtctggaaagtggaagcatattctctctcccatcaattattgagccaacccaactatggttaaatccagcacagttccaactaacccaggttataccggttgattacacgtggacggtggagatttttctgactgcttctctatcgcaatttgctattcctctgcttaaaaactagggttaggctacgattctgtttacaccaaaaaagcttttcgtcatcgccgtttggctttctgaaacaaatcacaccgtttaagattttctctgattctgagattatg

SEQ ID NO: 17135 - DNA, 3000 bp, Unknown; identical to SEQ ID NO: 17134
  misc_feature (1)..( 3000): 2750-1469P.txt file - cDNA_ID_1807910; gDNA_ID_2926186; Annot_ID_200619

SEQ ID NO: 17136 - DNA, 3003 bp, Unknown
  misc_feature (1)..( 3003): 2750-1469P.txt file - cDNA_ID_1807922; gDNA_ID_1620686; Annot_ID_48458
tatatcctggaatgctatgatatctggatttgcacaaaatggattctctcatgaagctctcaagatgttcttatccgcagcagcagaaacaatgccgaatgaatacactttcggaagtgtcttgaatgcaatagcttttgcagaggatatatctgtaaagcaaggtcagcgttgccatgctcatttactgaaattgggtttgaatagttgtcctgttgtttcaagcgcgcttcttgatatgtacgccaagcgtgggaacattgatgaatctgagaaagtctttaacgagatgtctcaaaagaaccaatttgtttggacatcgataatatcagcctattcaagccacggtgattttgaaaccgtgatgaacttgttccacaagatgattaaagaaaacgtagcaccagacctagtcacttttctctctgtgttaacagcttgtaatagaaaaggaatggtagacaagggctatgagattttcaacatgatgatcgaagtctacaatcttgagccgtctcatgagcattactcatgtatggttgatatgcttggccgagctgggagattgaaagaagcagaagagcttatgagtgaggttcctggaggaccaggagagtcgatgcttcagagcatgctcgggtcttgtaggctgcacgggaatgtgaaaatgggagcaaaagtggctgagcttgcaatggaaatgaaaccggaactgtcaggttcttacgttcagatgtataacatctatgcagagaaagaagagtgggataaagctgcagagatcaggaaagcaatgaggaagaaaaacgtaagtaaagaagctggattcagttggatcgatgttggtgacactgaagggtctttaacgatgcaaggtttctcttcaggggataagtctcatccaaaatctgatgagatttatagaatggtggaaattattggattggagatgaatttggaggggaaagttgcagtttaggactcttactcaaagttctaaagagttgtagttatagatcaaaaattagaaatgttagctatagatttacatgaactcactgagtgtatgattacttttatttttgcacctacatacgtgcacattgattttgtaaggaccatggtaaaccggtaaagcatggttctctgattttgaccttattgaccggttcgattgattaatccaacgctacgatcaaaatagacgactctaacttttctaggtcaaccgtaaaatatatatactttaatttctacaaatagtatcttgaaactattaaactatttattaggttcgaatttggttggtattattcccaatccaaaggctaaaatcaaaaaaaaaaaaaaaagtcaaaataacaatggattttaactacaaaaagtttcaagtttatgggccatttcaagtttgaaacttttgttgttttttctatctaacgaactcaaaaagagaatatgatggctttaaggtatgagtttggtgttgtactcttactcacgtctctttacatttatcattgtataacaaaataagattttaatagtaactttgaaatgattcttaagcaacttaaaaagcgagagaagagaatgtttacgtcgtcgataacctcataatgcggattattcttcctaacacgttaccctctacgtaccccacttgataagccagtttacactttcccttccaatttactttttctaataaaatacttttgtcttccgtcgtcaaacaaacaaatgtatgacttaataagttctatcaaaatgaacgttcatatactcagctgattataattgacgcaacttaaaaaaaacagaatgaagactcatatattgtaacatggcttgtatcaactataaataatatttgtctagaataaagactccgatggtggttgaaacttcaaactaaaccacccaggacacagcttaacgtatcattataaattaaagataggatagtaccatactagttagtaatttgactatttattaactacacaaatttttaacagatttagaacttgagtgttatacatattgaaagtacctgtaacttgattttatcaaatcagattttaagtacttattaaaggctgaagcatatgaaaatataaatcaatttatatatgacttgttgaagcttttaaattaaggagcgtatcaaaaaacttaaaacacacaattaacgcgcgtgtccacgctctaagcaaagcgagtgaaacatattaatttacacaatcgaaccgtcattaatgttatgggttgtctcctatttctggtttaaaagagatattaacttaaatcccacgtcaccaaatattaaaaataaaataaaaataaacaaattatataaatttcttaacgcacaatttgttgttttccataattccatttacccgaaaccctaatccccaatttctctttcaagttttcgatcacgatctctggaaaattaagagagaaattcaaaaacttcgggagttcaaagtctcattcagacattccagaaggtgatctcttgtttcagtttttctccctttttgttgattgtttcaatattggtgttttatccttcgatctctatgaaagttgtttcaattggatcgagattcttcgctgtttattgattttacgatacccttttcaatcgtttggaagtttttttggtttgtcctaattcgaattattcttgctgtctgaagaatctgtttggaagtaaatttggattaatcttgcttagcttgtatctcctgtgattgatcgcgattacgttggttcttctttctgtttacgcataattttactgattcatctaaattttgttgcggctttcttatgatctgtgttccagagtttgtggattattacatcaaactatatgtttttagagttgtttgttttattaagaatgtatgatcttctgctttggatgtttgctcacatatggatatttctcttttgcaggtattctagtcgactgagtaaacaatcatg

SEQ ID NO: 17137 - DNA, 3003 bp, Unknown; identical to SEQ ID NO: 17136
  misc_feature (1)..( 3003): 2750-1469P.txt file - cDNA_ID_1807922; gDNA_ID_2926202; Annot_ID_141553

SEQ ID NO: 17138 - DNA, 3000 bp, Unknown; identical to SEQ ID NO: 6995
  misc_feature (1)..( 3000): 2750-1469P.txt file - cDNA_ID_1807926; gDNA_ID_1621121; Annot_ID_56297

SEQ ID NO: 17139 - DNA, 3000 bp, Unknown; identical to SEQ ID NO: 6995
  misc_feature (1)..( 3000): 2750-1469P.txt file - cDNA_ID_1807926; gDNA_ID_1621121; Annot_ID_172093

SEQ ID NO: 17140 - DNA, 3003 bp, Unknown
  misc_feature (1)..( 3003): 2750-1469P.txt file - cDNA_ID_1807934; gDNA_ID_2214482; Annot_ID_133285
cggcagcgcaaacgtcgtcgtttgattgattggtccatgccaccctaaatccctgccttttttgcaaaagctacacagaagaaactgcaattcccaataagcccgcaatcaacggcccaaatcgagtaatcagtcaaccatcccatacaaccgttctcacatgaaccttgtctttaacaccggtcaatctaaacaaccaaccaatcataattcaccacgtcatcacgtcgttataatctgtctctgtgtctctctcttcttctcactctccgagtggggtgatagtgtgactctgtaacgagaaagcacaatcatatcgattccttcttcaaaagctcttttgcttttttcatctccttttccctttctcttttcttttgtaattttattaattatgataagtgaaaagggctcctctttaaaacccttcgaattcgtccatctcttggttctttgtggtggcgatggcattggcagaggagcagcatcagaattatcatgtggctgaggcgattccgggtacgcctgggatccatgatgtcaggattcaacccggttctgagaattccgggttctgtgttgatccggttggtgtttctaatgtacctggaattaggagagttgggttgagagctgaaatcgatacttctcctccattcggatcggttcaggaggcggtgactcgattcggtggtcgtggttattgggttcctttcaagcttgatgacactttcgtaagttttgttctttctcagttttttcttcaatgtcagatcagtgtaatatacaaacacattaatatgcattgcatactaacatttgatgctttgatggtgaccattttccattgttctttacagtcgaatctcatgacttctgtggaagtatgtaaaattgagttcatgacctttgtgcaattcagtagcattacaatattgagattgaatataactcgagtctagaatttcataatcgaggttttagcaacatatatgtaagttgttgaaagcatcaagatcgtttaagctgttgttctgtctctgagatcatcatcaccattaagtgttgatcgtcgagtgtaaaatgcacacactgattttgtaacaatgaatctcggagtatctgtgtcactgtgtgaggttggattaggagttgagatatgattttcattttcttttggtttttgtcaacgttcagaatggtgaatttgacattaagagaatggaggagcatgcagcggagcttgagaaggatctgattgtgaaagagcttgaaactttggatgttttagaagctcttggatcaaccaaaaggatcgttgaagatttgaagcggcagcttcagcaagaagcactgagatgctctgaccaactcagttcagatatcaaagagatgaacgatgagcattgccatcacaatcccatgtcatctcctgatttgatcttgatggaattgaagcaagctaagatgaatcttggtaaaaccatggacaaccttgtagtgatccagtcctctgttgaatctctgaataagaaaatgaaagaagagaaagacttccttgagaagacacgggctaagctaacgtatgggtttggtggaccggtatctctagctgaggagttgagtcggattaaggtaaaaccacaggttcaagatgaaccgttaagggagcaggttaagatggttgctgaagccgatgaaacgggtttaaacctgcagaacaagaacagtctgagaactgcagagatgagattggttgctgctaggaaaatggaagaagctgcgaaagcagcggaagcacttgcgattgctgaaattacaatgttatcatccaatggtgaaagccaggacgatgattcggaattttgctttccagagcctccaagatctcctgtgacaccaagaggactcaggattgataatgacttctccacggataagagttcaagacgagggattttgaagaagcttgaggaagctactgaaggagttaaacaaagtaagcaggctttagaagctgcgttaaaccgagtagagatcgctaatgtgaagcaacttgcagctgaaaatgctttccgcgggtggacaaaagactcattgaaaggcgataactttacacctttgaatcatacccgacgctcctttttcagccatttgaacaagcatcacgagccacttgacattctcccaaagccagtgttaaagtctaatatctcaatgcgtgatgttctaaggcgtaagcaagttccaaaggaagatgttgttgctccccaaagacagagccttgaagggcaaataccgaggcgaaatgtgaatttgagccaaatgttgaaggaactaaagcaggatgtgaagttttcggcacggggagagaaagaggaggtacatgaagagaaacagtacgtcacgcagaggagaaagtttgggttcatacacattacacttccactgcagaagcagagcaagaaaaaatccagcctttaaaaacaaacacctcccactatttctatttttagtccttattaatgtgtttgtaattggttttcattttggtttgatatggtgttgattgcttttccggtcttttatatttgttgattttccaaaaaataaatatacaatcttagtctttaaataaaacataatgctttgaatctaatgagtaaacaacaaatttgatagtgattgtaaaacaacaatgaaaactgcagaaatgtgattactggataaaagctgtatcttagcaatgaaaccgaaccaaattgaaccaagatgattagaataaaccaaacaatgacgtggcagagatagtagctgactaggcaacgttgaatccacgtcagcagatctcttatcatcaaagttttttctatcttcttcgttcgaagacgttaaccccatctcgttgaaagagagaagatgctaagatctcaaaacagagtataacaacaccttgacctcgttgaagaagcctttgagattgtctcggggatctgaaaaatg

SEQ ID NO: 17141 - DNA, 3000 bp, Unknown; identical to SEQ ID NO: 6659
  misc_feature (1)..( 3000): 2750-1469P.txt file - cDNA_ID_1807951; gDNA_ID_1621100; Annot_ID_55833

SEQ ID NO: 17142 - DNA, 3000 bp, Unknown; identical to SEQ ID NO: 6659
  misc_feature (1)..( 3000): 2750-1469P.txt file - cDNA_ID_1807951; gDNA_ID_1621100; Annot_ID_171331

SEQ ID NO: 17143 - skipped

SEQ ID NO: 17144 - DNA, 3000 bp, Unknown; identical to SEQ ID NO: 6659
  misc_feature (1)..( 3000): 2750-1469P.txt file - cDNA_ID_1807951; gDNA_ID_2926168; Annot_ID_199253

SEQ ID NO: 17145 - DNA, 3003 bp, Unknown
  misc_feature (1)..( 3003): 2750-1469P.txt file - cDNA_ID_1807959; gDNA_ID_1620782; Annot_ID_50369
gattttttctgaagtcaacacataattgatgattttaatcacaaggtataaagtttatgttttaaagcaccgcaaattgcgaagtcgtgatttaaatgacatttttcccattataaaaaggaccaaaatgattttgattacgaatgagcaggaatcttgatttatcagtcatccaaaattaaaatggttatccggtttactcggattctttattttgaagaattgaaactttaaaatgtttccaaaattataaatattttaacattatgataaagttaaaatctttataattttaaaaactttttctaaagtttatctttaaaaaagatttaaatttttttataattttaaaacttatgaagttttaaaaattatagattgaattttacaagaaatttaaacattataaatatatatatataatatattaatacgggacgatatattacaggagaaatcttaaatataacaatcaaaattcaatgatgaattttgggtcgatattatatttttttgaagtttttcaaattttataatattaaaatttataagaaaatgataaaattatgtttaattttacggaactaggttatatggttggacggatttgggtggataataatatggaatggtatattacgattgtacaatgtccgacgttgcttaaaaaattggacaatggttcaaagccatagtataaaaaggaccaaaatgatttcgattacgaatgagcatgaaatttgatttatgaggtgtccaaaattataatggtttgttaactagggttctttattttaaagaatgaaactttaaaaagtttcaaaaaattataaattgaattttacaagaaatttaaatattataaacaatataaaagatattaatacgggacgatatactacgagagaaatcctagatacatacagcgagagaaatcttagatataacaatcaaaatttaatgatgaagtttgggtcaatattaatcttttttgaagtttctaattttataattgaaatttataataaaatgacaaatttgtatttaatttcacgggatggggttatatggtgggacgggtttgtgtggataataacacatttgattcttttataagaaaattaaatattataaatgtttatattttaaattttatactacaagtgaaattctagaattgactggtttgggttgataataatttgcgatagaactaggagtgaaatcctagaatgacaatcaaaatataattatataattaaatattaccacgggtaaaattctagaattgacggggttgagtcgatattaatatgggatggtgtactacggatgaaatctgaaaaacaacaatcaaaatacaattatacaatattaaatatttaaaaaaataaacaaatacaacttaaaactttaaaatttgagttataaaattttgtctcgcggtgtatcatacatttaaatcaaacaatagcataaatttaaagatcatcctaaaaaaaattcaattattttttatttaatgaaaatataggcctgcggtataccgcggattaatatctagttgtataaaaacaaactgaactatgtttccctaataaataaataaataaaaaaaaactgaaaaaaacaattcctgaacaattttacatccaattcatagtataacgacatatccaataacacaatttgaattctaatagtaatctctaatacacacttttttatttatcggaatatttttaaactaaattttaatagctacacgagataattgatctattgaagtattaactactaacatagattttaaggtctagttatttcacataaaaactaagttgtccaactactaacgcaattgacaaccacaaccaacaccaatattaagtatgattaccgaccaaatttgaattttataaacatatagaattttttttgccaactcataatcatatttttatatgtattttaatataaggtgaatgattatcttttgtttcatgtcatattgggcataacaaaactagtacaacaaagttgtgtgaaccactccttttatatagttttgttgttgtcttttcttccaaggaagattactagacttagacaagtggattatatatatatatatatatatatatatatatatatatatatatatattaactaatctttcaacacttgtggattgataattattcatacttttaataaaaattccatagttcaatgaatctgtaacaaaaccaagaagtgacgtgatatacttttggaactataatcatattgtgagctcaatggataagaattgattgtagtaaatgatgtcggcagttacaagtgtagttagatatatgcaataactcaaatcggacatgaactcattttaacttatctaaagagaccaccgacgaatcattttgggttcacaaaattgtacttcgatttctaagcctgaatgtgaacgcacgtttttgaatatttcaacacgtgtttcatatttcattacatgcattataacataaatattacatctttgagtctttaactagttgaccaacaaaaaaaaaaactttaactaagtctagctagttttgttactacatatataaaaacaaaaccgaaataaatatttaaaatttataatatatttgtgtggctaaatcaatcaacgtgtcatgaaggtctaattcaagttggtaaggaaatcttttgtttatgtccatttcccacgtgtcactatttgtatgacggctagagaaagacatgttgaattaactagtgactccggattatataagcaagcatctactaaaaagataggaacaacacaatttgattacactgagcaacacaaaactggcgaaccaacgtgactctaacgaagaaaccggcaatggccagtatcactacaatgccgaagaaataacaagaatcataaacgagccagaatattatcccccgggttacaacttgtctaccaccgcaatttcaaacatg

SEQ ID NO: 17146 - DNA, 3003 bp, Unknown; identical to SEQ ID NO: 17145
  misc_feature (1)..( 3003): 2750-1469P.txt file - cDNA_ID_1807959; gDNA_ID_1620782; Annot_ID_167988

SEQ ID NO: 17147 - DNA, 3003 bp, Unknown
  misc_feature (1)..( 3003): 2750-1469P.txt file - cDNA_ID_1807963; gDNA_ID_2214509; Annot_ID_133811
cgtttatagattttgttgccaatggtccgtttaaaagatttgaaatatatatattttttttctactttttcttttcttggtttataacctttgaatatctatatttgaaacacacattgaagatcactaactcgaaattcaaaaataaaaagagagacaaatatagcaatccataatcaatgcatagagacttcaagtgacctactaggatcccactaaaaaataatatgctgttttttgcctattccttttgcatcattcttgttatagtaaaatggtaaaagaaattatggaaaataagaaaatggggtcattgaatgtcaagagggtaacattttcagacgataaggcgcaatgaccccacacctcacatgaagctgcagtgccatttccaaaagagtgtgtggatatgaatttgaacaaagaaacattggtgatgaaattaaaaaagaaaaggaaagattactacaaagtgaaaagtatgaaattatgaagactacccgatcttctttgcctccctttccgtatttggcatgcccctaaccactaccacaacctcttcccttcggaactttgtaaataaacattcactgtttttttttttgctttttaaatagctgttaattgtacaaattcatttacatggcttactgtttttcaaaaggagatactaaatagtatatagtactataattttgtccaccatgttctatgaaactcgtccaaacataaaaaggtttttatatcatcaaacgtacgactttcctttgttattttcttggattggacacaacgagattggtttggtcactgtccgatctagttattgatatatatatatatatatatatatatatatatatatatatatatttttttaatataatgtagatgtagcccactaacttttgataagctttcatttttctatactttcatttttctataatgtaaaaagatagatgaaaatgaaactactagattacaactttttaacaaaaaataaaaaactactagattacagctcttgattggttgataacttgatatcatatatcgtgtttgtagttgaagatgtaaagatttatcatcttgtatttgaattttgcacaatatataatgtgatgattctatgtttgtttgtaaacttatgtgcaaatgggcgataactaaacgttcgtaaaatagttacatgtactaattaatcgaagcacataaatattatatatatatatatgtatatatatgaaacgattcattgattttaagtatttaatttattttttaagattttagttgtcttaacctcgtacgaagaagaaggatatatactatttaactcgtggagatgatgaggttcggatatttttccttaagaccacaagacactgacacgccgactgatcgataaaaaaagttaaggcctacaatacaaaagagtagcagattcccttacacgtgtttcatttatgatctgttaattaactccattgagcttcaatatctcattagccgaaaattaacttgacgttttccattgaactgtcgaaaaaatttgtagaaaaagtgaaatgtcccctatttaacttccaagtttaaaacctaaaattaattagttaccgttttgatgaataacgttgaaagaatcgtcaacatatcaaatgatgcagatacaacaagggacaaaaacatcaaaaaattgattaaaaataatcattcagatattagcaattaaactgtaagtaaatgattgcatatatatatatgaatgaatacatatatatgtatcaaactgtaagtaaataatacatacatatatatatatatatataggaaaatatctcatttttcaatcattttcagaggtaaacatttttaaagacaattttacctaacccaacatcttactatatttaaccagctctgcgagagcttcaaaacaatgatgaattttctgccccttttcattgaccaaataaaagttcacaaatttgtaaaaccaatcagcattaatttcgcacgtagtttacttcgtccgattttagatcaagtagacattttaaccaaacatattgaatcacggttcaatcaagatacatggttgcgagtataatatatcaatccttcaccgcattagaaaaccaaattttctatttaatttagcgtgttcttttaatgaacgcagcgtcagcgacaacaaagaagaaaaacagatctgcggcgagaaaaaatacattgattagagaagaactgccgcaaaagatgtacgatgatgaagattgacgtgacgctgcttaatttcagcgattcatttgatgcaattgcaattcatcggctatcatcggcgactcatccgaaattgttattttcaagctttaatgtcgttttacttacctactacttctcatgacacgtcgtttcagtccgctattgccgctggcgcagcatcaaataaaagaacacgctaggatagcttgaaaagggtacaataactagttatagaagaacatgagccataacatttggaaacaaaatgagttagtttgaatttgaaacatcgcgctctatgtaaaaaaagcaaaaaagaaaagaaaagagtcctaataattaaaaagagaaaataaaaggaattttcaatggtccgactgttacaagtagatttccatttttaggaatctagctataacgatgaagacagagttatcattttgttccatcaaatatatgacgatatttatatttaatttcttcaacaacaaatatctcatttgttggtgccactttcacatacttaggacgactaataattaattaaaaaggatttatgtaataacgcaccatattaacctgtaacaagaagaattgaaagtaatacaagtttatatatatagcaacacatttatcgtgtacgatactttattccttttatctattcttgaaaaaaagttaccaattcttgagaagaagaagaaatcagaatcaagagaaggagagagaaagatg

SEQ ID NO: 17148 - DNA, 3003 bp, Unknown; identical to SEQ ID NO: 17147
  misc_feature (1)..( 3003): 2750-1469P.txt file - cDNA_ID_1807963; gDNA_ID_2214509; Annot_ID_184204

SEQ ID NO: 17149 - DNA, 3003 bp, Unknown
  misc_feature (1)..( 3003): 2750-1469P.txt file - cDNA_ID_1807967; gDNA_ID_1620837; Annot_ID_50818
ctcttcgtcaaccacaaacgcgtttcactcttcgttcacgtcggggaatttaaaaaaatctccttcgtaacaaaaaagagaaagatcaagaagattgtcgtgatggctgccggatccatggacggaatattccgcaacatctttgaaggttgcatctctagctgtgactcttccatccaacgacgtccataccacaagaactgcggttgtgcccttcacgagagatctcgcggtggaggttcagcgactccttgtcgtcatggaaggtctgaggtcgttatgttccctatccaacgatcttggagtgaaggaaacagtttggctctgcatcttgcctcatcttcttcttcctctaacctccagtcactttcgtcgtcttcgtctatttctacccttgcatcgttatcttcgaccgtgtctgatattgattctcccatttaaggcatgaactattattagttcccattcattaattttttgtcttttatttgtttgtttcgaagagagtcaaattatgtttggtgtgtgattggaaaggtttcatgagtttccttggatatcaaaggaaactaattcaaatgttgtaatataatggtcaattgtagggaggcttttctataaaatttgtacagaatcatgtatttgagcgtaattatagttttttttgtatgatgtaaatttatacataaaccgtttgtaacatcgagagatgaaatttggattggaatgcgagaaaaataattttattttaatttttgtaatatgatcttcaagctatttcttcttattttatgttcttcggttaccactgtcttcatattgttttgattatactacgctatcatttgcccaaatctcttgacattctaatgtagagttgttgagcgacttgctaagattgttttccaagaaaaaaaaaattgtgtattccatacgtctaagagaaaatatttgtttactatgtgacttaaaaaatatataaatttaattattttatagttatatttggtaatgactaatgacattcaatccgaatatctgatcattgacattcaatttgaattttggctcaaatagaggttagcagagataatccgtctactggattagctatactggaggagaatgtttttttttggttattgttctttcattgatcggtatttggagaaaaaatataatttttcaggatattgttcgaaagattaatataacgaaacatcaaatatgagtttgtcttcaacggagcctacttccctgcatacaaatatagaagcattaatttgggcgaagtaatgtctaacggccaagcagaagaatatagtttctttcgtcacgaacttttatgaactcataaaaatggtgacatggtgtacatgtcttcaccaaaagagtggcccatattttcgtcatatctcgaggaaatcgtaaagtgtaagtaaaaattttctcttgtttttctgtttcatttgtttcttatcgagttaatgctagaataggcacatgtacactagcataaaatgtccgcactaatccacaatttgatcatgcacgtaaatattgttttctcaggttgcctacctacttttgtttgttatatccttgataacattatcatgttctaacattttcaaccttgctactattgtaatatggtacaaaagaaattgaaatattttatgcatgagatgagacaaccaaaagaaaataaaaatggttaataaaatatgaaaagaattgttaacaaaaaaaaagtaaaccgcaataccttttttcgtctagtaaaatagtaaaactggagaattctctttctttttctctagtaaaccgtaatagtaaaatccgtcccaccatctaatccagtttggtaaaattaaacattttttttttgttctaataatatttttattaaaagaattataattcaaatcaatttaaaaagttttcttttgaaatggttatttaattttatagatttcatatattatatatattctaaacgtttttcgttaaatattctaaacattttagaaactttaaataactataatatttatctttaataaaatcctaagattttttctttttaaaagtaattaaaattgatggagatatattaaataaggaaatgctaataattaggaatattatttaaatgataataattaatgttaatgacattccttgtaaataagttccaacttgaggatttatttacaaaaatggttgcaaaaatatatatgtagataacatgtagataacatgtatttttatttcagttgtctttgatgtcagattgaataaccagtttgagtttttgtctcaagaacagtggttttgtaagatatttctttcataataaagaaacagtaaaaaagaaaaaccgcaatacttttcaaaaaacaaatatgaaaagaattaaataaagatagtaaactgaaagccttgtccctattgcattttgccatctccgtccgattggtgaggtgtgatggtgtttgtacttgtgtctctggttttagcatcctcttgattttctctctgtcggtttgctactggtttgacttcgatgtaaggtctatccaattttattggtgcttccgacgttcacattaggaaagtttggtgagagtttctgatccttttgctcatttttagtgcttaaatcttgtttttctcatagtttttgaccttcattagaattttgtctcttggtttgatttctttgatttaaattagttttcccatatctgttgggttttttcttccctcttttggattgagtttctggagacaatccattgatccaccgatttatatattttaacttgtatcctactttggtttttaataaaatttagaggacaacaaaaaaatagtaaactgcaagcccgacccagtaacctattaaggtccaaaacgacatcgtagaacatagcaagtaaaagaagaaaagatatagagatagagacaatgatatcatcatcatcatcatccaacatg

SEQ ID NO: 17150 - DNA, 3000 bp, Unknown; identical to SEQ ID NO: 11501
  misc_feature (1)..( 3000): 2750-1469P.txt file - cDNA_ID_1807971; gDNA_ID_2214499; Annot_ID_133627

SEQ ID NO: 17151 - DNA, 3000 bp, Unknown; identical to SEQ ID NO: 11501
  misc_feature (1)..( 3000): 2750-1469P.txt file - cDNA_ID_1807971; gDNA_ID_2214499; Annot_ID_183921

SEQ ID NO: 17152 - DNA, 3000 bp, Unknown; identical to SEQ ID NO: 13578
  misc_feature (1)..( 3000): 2750-1469P.txt file - cDNA_ID_1807975; gDNA_ID_2214638; Annot_ID_136163

SEQ ID NO: 17153 - DNA, 3000 bp, Unknown; identical to SEQ ID NO: 13578
  misc_feature (1)..( 3000): 2750-1469P.txt file - cDNA_ID_1807975; gDNA_ID_2214638; Annot_ID_188181

SEQ ID NO: 17154 - DNA, 3003 bp, Unknown
  misc_feature (1)..( 3003): 2750-1469P.txt file - cDNA_ID_1807979; gDNA_ID_2214704; Annot_ID_136935
ctaattgatatttggctaactacattcaaattatcaactattattttagtaaatgttacagtgatattcaaggttaaaagactacaaaaaacatgcaggataacaatgattatagtaatatgacgaacatgaaaatctttcttatcataaagctgctatgtgtaagcaatctcatcgtacaaggacatagaagccgggacaaagtgtgagtgtgtgacagaccagaagtacagaacggatctaaattcttgatttcataacatgcatatggtgatgattagaaaattttataaagtataatgattagtgagaaccaatcatcattcatatatttggttgttggcaacaatttgtagagtggctcattcaaaaagaaaaaaacaatcttactttttggtttggttaatgagaatatgatagcaaaattaaagtttcacatgctaaaagcctaaaaattctgaattaaaggaagacaatgctatgaatatagaaaaaaaagcaacgcatgtgaataattgacagataagaaacgaaattaaaagtggatgtacgattagagagaagtaggaccatggaagttagggaagtaggaacatgtcatagataaggcccaccccaaatatgtggtcgtgcttcatcttagaacctcgtggtgtttggcttagctacgtcgtcaaatcatccatcagaatccagtttcagttttgtcttccaatcatgtttatacacgtgttcctatcgtctttaaagatatctcacgtctcttacattgcctagttgccctaataattttctgccggtgcgactagttttataagactatttgtagtttgaatgtgaagattcacaaaatgggtcttcataaaaagttaaaaacccttaccagttttcgtgatttttctattttgatgtaagtttctgtgaatcgatgtgataatatgtcatgtgagtcttttttctccggctgacatagtaacatgtgatttgataagaaaattattttagtatcgtgataaattttgtgaggtgtttaactttttgtttaaatcttaatgcaaaaacttccaaaccctagatttcttttttgtaattggttttgcatcaaaacacaatatccgaatgtaaaatattgaattagctaaacagtagatgtccactagatcatgagtaggcgatatacatataaatttcattaattcagagagaataataattaaattttgtaaaaaggtgctaaggcaaggtcttaatacaagtctaaattattcagatgaaaaattcatgttaggaaataggttggaccataagaggatggtgctatcaatctattaacaaaagtacaaataccctgagctgtattgccgtctagtttcaatcaacaatttcgatcataatggttaattacatccagaggattgacatataggattgtggtttattttggtttgattcggtaagtagaaccaaaatgctattttctgattaaggatatgcaatttctacacacctgaattcaaaaaaggcattggagctaattctagtcagatcatatccatgatatacatttagtaaaatgcaaaaaaaactcaaaattttttacctaatatatataagtaattttttttactaaaaactcatattgcaaataaatgtatatagttgctcataggtttttttttattttgcgagtttatattattatgtaattatgcggtgttacaataattaacaacggtcccgacctcacagcggctaaaccgaggggacaaaggctaagaaaagatgcaactagaaaacaaaatgaaccacaaattaatacgaacagtttgggccaaagttggttattatttgtcaatagcccaaaaagtccacgtcaagtttccctaatcacgcttcttccaattcacacaataatgtcgtcttcttaggaaacgccagacgagtttagcacatttcgctgtcatttgtgcaaatctcttatctgttatatatggttggggaggttgcatggattcggatagaggcaacggtacgaaaccgtgactagaagaaatatagcttgatggaattgaccaagaaaagaaacaatcaacacacgagctgagatattgcttagcttgatcgagaaacttaacttgttattgcaaagcccatttgtttcataattaagaagcccaaccaatacattgcacataaacatatgtgtcgactctcaagtctagccgcatgtgactttatatggttatcacactatactccatgtgaagcttgcaaaatttatttataaattccaaaagtgggagagttgtttcaactaaaagagcaataagaggattaagataagatgaagtttcaaataagaggattaagttttaacaatagattttgaccccaattttagtactagattctttttgttgttgttgtagattgttactagattcattgtggataaaatcatgttttttgtatttgacagctaaaccattaatttgtatgccagacaacatgaccaaaccgtctggtctacaaaccgaaccaaaccgccaagtctacaaaatatcaaaaccaaacctatcaatcaaacaggaatattcttccaccaccataggccatagcccacatcccctactaactagtgagaatgtagatcataacaaaacccaaatctatcaagcaaaccggaatattccaccaccacatagcccacatcccctactagaatgtagatctttatgaggtcatgtttgaatggtataatgaaatctcatagtaggagaaacccggtttaacacatttgtagaaaaccaaggattcaatcaataaccggaatcttgagatagcacctgtctagcgttgacgacaccaaaattgaaaatttggcatcatttgcgaaacagagagagatccattcaattccaaaaggattctcttttgggaaaaccctaaatcgacccaccaaatttggagactgtgattgagcatgagcgtcagaagttgatg

SEQ ID NO: 17155 - DNA, 3003 bp, Unknown
  misc_feature (1)..( 3003): 2750-1469P.txt file - cDNA_ID_1807979; gDNA_ID_2214704; Annot_ID_189785
gtaaatgttacagtgatattcaaggttaaaagactacaaaaaacatgcaggataacaatgattatagtaatatgacgaacatgaaaatctttcttatcataaagctgctatgtgtaagcaatctcatcgtacaaggacatagaagccgggacaaagtgtgagtgtgtgacagaccagaagtacagaacggatctaaattcttgatttcataacatgcatatggtgatgattagaaaattttataaagtataatgattagtgagaaccaatcatcattcatatatttggttgttggcaacaatttgtagagtggctcattcaaaaagaaaaaaacaatcttactttttggtttggttaatgagaatatgatagcaaaattaaagtttcacatgctaaaagcctaaaaattctgaattaaaggaagacaatgctatgaatatagaaaaaaaagcaacgcatgtgaataattgacagataagaaacgaaattaaaagtggatgtacgattagagagaagtaggaccatggaagttagggaagtaggaacatgtcatagataaggcccaccccaaatatgtggtcgtgcttcatcttagaacctcgtggtgtttggcttagctacgtcgtcaaatcatccatcagaatccagtttcagttttgtcttccaatcatgtttatacacgtgttcctatcgtctttaaagatatctcacgtctcttacattgcctagttgccctaataattttctgccggtgcgactagttttataagactatttgtagtttgaatgtgaagattcacaaaatgggtcttcataaaaagttaaaaacccttaccagttttcgtgatttttctattttgatgtaagtttctgtgaatcgatgtgataatatgtcatgtgagtcttttttctccggctgacatagtaacatgtgatttgataagaaaattattttagtatcgtgataaattttgtgaggtgtttaactttttgtttaaatcttaatgcaaaaacttccaaaccctagatttcttttttgtaattggttttgcatcaaaacacaatatccgaatgtaaaatattgaattagctaaacagtagatgtccactagatcatgagtaggcgatatacatataaatttcattaattcagagagaataataattaaattttgtaaaaaggtgctaaggcaaggtcttaatacaagtctaaattattcagatgaaaaattcatgttaggaaataggttggaccataagaggatggtgctatcaatctattaacaaaagtacaaataccctgagctgtattgccgtctagtttcaatcaacaatttcgatcataatggttaattacatccagaggattgacatataggattgtggtttattttggtttgattcggtaagtagaaccaaaatgctattttctgattaaggatatgcaatttctacacacctgaattcaaaaaaggcattggagctaattctagtcagatcatatccatgatatacatttagtaaaatgcaaaaaaaactcaaaattttttacctaatatatataagtaattttttttactaaaaactcatattgcaaataaatgtatatagttgctcataggtttttttttattttgcgagtttatattattatgtaattatgcggtgttacaataattaacaacggtcccgacctcacagcggctaaaccgaggggacaaaggctaagaaaagatgcaactagaaaacaaaatgaaccacaaattaatacgaacagtttgggccaaagttggttattatttgtcaatagcccaaaaagtccacgtcaagtttccctaatcacgcttcttccaattcacacaataatgtcgtcttcttaggaaacgccagacgagtttagcacatttcgctgtcatttgtgcaaatctcttatctgttatatatggttggggaggttgcatggattcggatagaggcaacggtacgaaaccgtgactagaagaaatatagcttgatggaattgaccaagaaaagaaacaatcaacacacgagctgagatattgcttagcttgatcgagaaacttaacttgttattgcaaagcccatttgtttcataattaagaagcccaaccaatacattgcacataaacatatgtgtcgactctcaagtctagccgcatgtgactttatatggttatcacactatactccatgtgaagcttgcaaaatttatttataaattccaaaagtgggagagttgtttcaactaaaagagcaataagaggattaagataagatgaagtttcaaataagaggattaagttttaacaatagattttgaccccaattttagtactagattctttttgttgttgttgtagattgttactagattcattgtggataaaatcatgttttttgtatttgacagctaaaccattaatttgtatgccagacaacatgaccaaaccgtctggtctacaaaccgaaccaaaccgccaagtctacaaaatatcaaaaccaaacctatcaatcaaacaggaatattcttccaccaccataggccatagcccacatcccctactaactagtgagaatgtagatcataacaaaacccaaatctatcaagcaaaccggaatattccaccaccacatagcccacatcccctactagaatgtagatctttatgaggtcatgtttgaatggtataatgaaatctcatagtaggagaaacccggtttaacacatttgtagaaaaccaaggattcaatcaataaccggaatcttgagatagcacctgtctagcgttgacgacaccaaaattgaaaatttggcatcatttgcgaaacagagagagatccattcaattccaaaaggattctcttttgggaaaaccctaaatcgacccaccaaatttggagactgtgattgagcatgagcgtcagaagttgatgaacaaagtcgacgaaatcgaggatttcagattcgaggatctcgaaatg

SEQ ID NO: 17156 - DNA, 3003 bp, Unknown
  misc_feature (1)..( 3003): 2750-1469P.txt file - cDNA_ID_1807986; gDNA_ID_1620689; Annot_ID_48523
tacaacgtcgtcaatgttagattttgccgttagtttttattttattttgttttcagttgtcataaacttatttcagttatcagttattataactaattgttttttgttcctcttttcctgctaagtgtaaacctattgcacaaatttcttgcatgcgtgttcaccgtatatatgtttttaattcctctttcgttattgggtttttaatgatgaaataaaacggaactcaactagggacagtacagttcatgatcatattggatacatgtattagttcatttaatttaattcaattatatacacaatagtttatttaatttctctctaaatgattgatgatgattgacgttattttcacggttttggtaccgtataagtttagtaaagtgtcaaaacgacattgtttgtgaaacatatggagtattttttcaagagttaatttgccactctatcatatcgtttctaaaaattgaaatcatttctagttttaatcctggtttagctgtagtgatactattatgctcctcattctcacaatttatttctactttgtttctttaccttcacaatttctgccaaatgagatcaatatagacgtcttcaacatcaaagtttttgtttataaatacaaaatttaaaataataattttggtcagagtcgatggttataaggtgatgggcgtgatggcaaagcatgtgacaaagttttatgtccactattctcttttcgcctaacgcaaattcgtgtacgttacaactccctaataataatgcgttaattactctgccaagctcattttcatttattactttacatgttttttttgtttaaagcattgtcatatttattgtcattatgaaacccaaaatgaaaggagttaattagagatcattgttttcatctagagcagagctctgaaactggaaccaattatttggagtcttgatgcaaattcatgtagccttggagctctgaaattgttcttctatatgtttgctgatcaaattgttaaaataatggtgagactgagactcatggtttaaatactagcaaaaatggtaaatttaaaatcccccttagccacggaccttgagcaaagagtctagtgtatgtgtctatatatggttcaccttttggataagaaatcaatttcaagctcatctttctacatagagagaaacttggatcttgtactttttaagatggaaacatccataaaaaggtaaagataaagctgatatggcaaaacgccaacaaaatcctacaagtaaataaatcttgggccaactttaatgttcctaaaagaaatgaacttagctacaaagttactagtcacgtctctgctgccaaaattcttgacacattctttacacttcttcgaacaaagagaatggtttgatccacaaaggatgcaatgcgcaccgcttccacaacatttgatctgtggcataaatcaatcttgcaccataagggcttgaaactttcagcttttgccactaacactctaacgcaaacttgtgttagactgcaaccaaatgaaatatttgagaagcaccagatccattaacagcaactatgagcccattacaatgatttgcctccatcagtgtcttggatcgctaacactatccaataaccagcctagctggtacttagacagaatttttttttcttctggatctgtgaaaataaatgtaacatgagccattgactaagatctagctctaattaactcagtcaaaacgacgatcaaaagattgaactattggaaatggaaggggccgcgcgaacgcaggcccccaaggcaacaaataatgacgcaggatctcccacttggggtgacctttggcttagcgcacctcaagtgcaggaagccaccagcctaggccacggatcttcatgatcacccgtaaaccccgtccaggtaagtaatttgcaatcctcgaccatcttctttatttatactatgctacacacgagtgcccatcctcaaacttccgatgagggagcatcaacattatctcgtatctactataggcaggctttcgttgtttgattagcccaagttttatttcttgataggccgcaatgtctatattccggtccaaatcaaacccaacagattttttttttgtcggctatttgtcacagatttctttttatatacgaggaacaaggttaattatattgaactaaacattaaaaaaaaaaaagaattttacagatgcaggttgatatttaacgttattgtgggtcaactcaactcataagcaaagttgatatgatactatttaaattgacttcaccacatccacttgacactaataaattgacttctccatccctatccacacatatttgaatcttccaataaggttccacgaaactgctaggaaaacaatattttctaaggcaatagtcccactttggttaatcataaaattgtcaaatccactatgtaatttgtgatccataataaattaaaccagttattcatcatctaagtcagacactattttaactctagaaaacttgacaaagtacatgaaatgtttttgaagtgaagtaacaaaattccaacatgtacaaaatatatatttttttttttaaacgaaaatatatacactagagacctcacctatttttcttaataatatcaaatctcacatatttgatgtacacacaaaattaaatttatagaaaatgaaatatattattttagaaaaataaggagaaactttgtggaaaaaatagaaaaatatttaaattattgtttttataaattttattttgggttcgaactcttcaactccctgaacacaagtcgcataaaacgaaggaacaatctagaagaagaacgataacatccaatctctctttatattccttccttccattgtggcaataagtaacaaaccttgccctctacttcattccctccttgttttgatttcatcgtctttgttagctctcctctgtttttttttcttagtcaatcgatg

SEQ ID NO: 17157 - DNA, 3003 bp, Unknown; identical to SEQ ID NO: 17156
  misc_feature (1)..( 3003): 2750-1469P.txt file - cDNA_ID_1807986; gDNA_ID_1620689; Annot_ID_164685

SEQ ID NO: 17158 - DNA, 3003 bp, Unknown; identical to SEQ ID NO: 17156
  misc_feature (1)..( 3003): 2750-1469P.txt file - cDNA_ID_1807986; gDNA_ID_2926182; Annot_ID_140623

SEQ ID NO: 17159 - DNA, 3003 bp, Unknown; identical to SEQ ID NO: 17156
  misc_feature (1)..( 3003): 2750-1469P.txt file - cDNA_ID_1807986; gDNA_ID_2926182; Annot_ID_200349

SEQ ID NO: 17160 - DNA, 3000 bp, Unknown; identical to SEQ ID NO: 8598
  misc_feature (1)..( 3000): 2750-1469P.txt file - cDNA_ID_1807990; gDNA_ID_1971820; Annot_ID_58311

SEQ ID NO: 17161 - DNA, 3000 bp, Unknown; identical to SEQ ID NO: 8598
  misc_feature (1)..( 3000): 2750-1469P.txt file - cDNA_ID_1807990; gDNA_ID_1971820; Annot_ID_176129

SEQ ID NO: 17162 - DNA, 3000 bp, Unknown; identical to SEQ ID NO: 8598
  misc_feature (1)..( 3000): 2750-1469P.txt file - cDNA_ID_1807990; gDNA_ID_2926158; Annot_ID_139601

SEQ ID NO: 17163 - DNA, 3000 bp, Unknown; identical to SEQ ID NO: 8598
  misc_feature (1)..( 3000): 2750-1469P.txt file - cDNA_ID_1807990; gDNA_ID_2926158; Annot_ID_198557

SEQ ID NO: 17164 - DNA, 3000 bp, Unknown; identical to SEQ ID NO: 13234
  misc_feature (1)..( 3000): 2750-1469P.txt file - cDNA_ID_1807998; gDNA_ID_2214606; Annot_ID_135675

SEQ ID NO: 17165 - DNA, 3000 bp, Unknown; identical to SEQ ID NO: 13234
  misc_feature (1)..( 3000): 2750-1469P.txt file - cDNA_ID_1807998; gDNA_ID_2214606; Annot_ID_187244

SEQ ID NO: 17166 - DNA, 3000 bp, Unknown; identical to SEQ ID NO: 5138
  misc_feature (1)..( 3000): 2750-1469P.txt file - cDNA_ID_1808002; gDNA_ID_1620766; Annot_ID_50110

SEQ ID NO: 17167 - DNA, 3000 bp, Unknown; identical to SEQ ID NO: 5138
  misc_feature (1)..( 3000): 2750-1469P.txt file - cDNA_ID_1808002; gDNA_ID_1620766; Annot_ID_167336

SEQ ID NO: 17168 - DNA, 3000 bp, Unknown; identical to SEQ ID NO: 4817
  misc_feature (1)..( 3000): 2750-1469P.txt file - cDNA_ID_1808006; gDNA_ID_1620734; Annot_ID_49448

SEQ ID NO: 17169 - DNA, 3000 bp, Unknown; identical to SEQ ID NO: 4817
  misc_feature (1)..( 3000): 2750-1469P.txt file - cDNA_ID_1808006; gDNA_ID_1620734; Annot_ID_166202

SEQ ID NO: 17170 - DNA, 3000 bp, Unknown; identical to SEQ ID NO: 4817
  misc_feature (1)..( 3000): 2750-1469P.txt file - cDNA_ID_1808006; gDNA_ID_2926217; Annot_ID_142250

SEQ ID NO: 17171 - DNA, 3000 bp, Unknown; identical to SEQ ID NO: 4817
  misc_feature (1)..( 3000): 2750-1469P.txt file - cDNA_ID_1808006; gDNA_ID_2926217; Annot_ID_203031

SEQ ID NO: 17172 - DNA, 3000 bp, Unknown; identical to SEQ ID NO: 12081
  misc_feature (1)..( 3000): 2750-1469P.txt file - cDNA_ID_1808010; gDNA_ID_2214530; Annot_ID_134258

SEQ ID NO: 17173 - DNA, 3000 bp, Unknown; identical to SEQ ID NO: 12081
  misc_feature (1)..( 3000): 2750-1469P.txt file - cDNA_ID_1808010; gDNA_ID_2214530; Annot_ID_184900

SEQ ID NO: 17174 - DNA, 3000 bp, Unknown; identical to SEQ ID NO: 13806
  misc_feature (1)..( 3000): 2750-1469P.txt file - cDNA_ID_1808014; gDNA_ID_2214653; Annot_ID_188699

SEQ ID NO: 17175 - DNA, 3000 bp, Unknown; identical to SEQ ID NO: 13806
  misc_feature (1)..( 3000): 2750-1469P.txt file - cDNA_ID_1808014; gDNA_ID_2214653; Annot_ID_136460

SEQ ID NO: 17176 - DNA, 3000 bp, Unknown; identical to SEQ ID NO: 4313
  misc_feature (1)..( 3000): 2750-1469P.txt file - cDNA_ID_1808018; gDNA_ID_1620698; Annot_ID_48722

SEQ ID NO: 17177 - DNA, 3000 bp, Unknown; identical to SEQ ID NO: 4313
  misc_feature (1)..( 3000): 2750-1469P.txt file - cDNA_ID_1808018; gDNA_ID_2926180; Annot_ID_140542

SEQ ID NO: 17178 - DNA, 3000 bp, Unknown; identical to SEQ ID NO: 5001
  misc_feature (1)..( 3000): 2750-1469P.txt file - cDNA_ID_1808026; gDNA_ID_1620753; Annot_ID_49847

SEQ ID NO: 17179 - DNA, 3000 bp, Unknown; identical to SEQ ID NO: 5001
  misc_feature (1)..( 3000): 2750-1469P.txt file - cDNA_ID_1808026; gDNA_ID_1620753; Annot_ID_166836

SEQ ID NO: 17180 - DNA, 3000 bp, Unknown; identical to SEQ ID NO: 7174
  misc_feature (1)..( 3000): 2750-1469P.txt file - cDNA_ID_1808030; gDNA_ID_1621130; Annot_ID_56446

SEQ ID NO: 17181 - DNA, 3000 bp, Unknown; identical to SEQ ID NO: 7173
  misc_feature (1)..( 3000): 2750-1469P.txt file - cDNA_ID_1808030; gDNA_ID_1621130; Annot_ID_172452

SEQ ID NO: 17182 - DNA, 3003 bp, Unknown
  misc_feature (1)..( 3003): 2750-1469P.txt file - cDNA_ID_1808041; gDNA_ID_1621146; Annot_ID_56734
tttttttttttaatttcaaatctcatgggacatcattttgatcatgaacaagttgaccacaaaggttttgtgtagaggttttggagtaaagcaaagaagtgaaaaagcacatgacttgtgctttaagcatagatgtatagaaaaacaaggccttatcttcatgtacttttaagccaagccaataaaccccacaaaccccattaattactctgcatataaattcaacccgaaaccaatcatctctaccaaagaaataaggaatctcattagtaggcactggatttaataatcaacaggaatcttctcttggcgttttgattgaagcatatgatggataagctcttcattctttctcttctaggtctgttattggtaactgcttatggagctgcagggaagatggtgtacacagatcttgacattcttgacgagcttgagaactttgatgtactggtagatgatgatgatgatacaaagctcttggattggccatcattcacaagccggcattctggtaaaaatctggtgaatgttgatacattcggtgcagctggagatggagtttctgatgatactcaggtttgcttattccataaaaatgacaggttatctagatacctaaaacgctatcagttctatgtctggaatgaaacaaatccccaaacttgaaatcatggggaaaatttctaaacaaattgtttgcattgtagacttggcctatagatatttacggaggtctagttagatatttttctgcatctgatctgtgcaatgctcttcccaaatcaggcattcgtaagcgcatggagcaaagcctgcagtacatcaaaatctgtgtttctggttccagaaggacgtcgatatttagtaaacgcaacaaagttcaatggtccatgtgaacaaaagttgatcattcaggtcaagttatcttcagtaggaaaacagaaactagaccataactatatatacaagtatgtcttatacaattcagaaacttgtctttgtttacagattgacggaacaatagtggcaccagatgagcccagcaattgggactcaaagttccagagaatttggctcgagttttcaaagctcaaaggggtcgtgtttcaagggaaaggagttatagatggttcaggcagcaaatggtgggctgcttcttgcaagaaaaacaagtctaatgtaaaatcttctatacccaaatctatctttctttatcacaaaagataagtgcctcgagttttcgaatagaatcttacacatctttcttgctcttttacagccttgcaaaagcgcaccaactgtaagaaaccattaccttcatcatttaccagttattattccttacaaatggctgcttatttggtttcgttcaacaatctgtttttgttttcccctgcaggcactaactatagaatctagttcaggtgtgaaagtaagtggcttgacaatccagaacagccagcagatgaatttcatcatagcaaggtcagattcagttcgagtctccaaggttatggtctcttctccaggagatagtcccaacactgatggaatccatatcactggatctaccaatgttatccttcaagactgtaaaatcggcacaggttttttttcttttgaccaaacctttatgcaaatgaaacattttacacttcgactacggttgtaataatcccttaagactggattaaacaggggatgattgtgtctcgattgtgaatgccagctcgaatataaagatgaagaacatctattgtggacctggacatggaatcaggtacatcatcaaatttctagattacatctgttccaaatcaaattataattagttggaatttcttgcagtattggaagtcttgggaaggataatacgacaggcattgtaacacaagttgtgttggacactgccttattgagagaaacaactaatggactcagaataaaaacatatcaggtacacaaaaaaaaaaaagcttcactatttagtaaaaacttcgatttggctagatccacaacaattttatttcattgtttctcattcgaacagggaggttctggttacgttcagggtattcgattcacaaacgtagagatgcaagacgtcgcaaacccgatactcattgatcagttctactgtgattctccaactacatgtcaaaaccaggtttccttataatacaacctcgtgattgagattattcaatcaaaatgaaactcaaagatgaaaactcagatatgtttttgttcttttttttggtataaatgcagacctcggcggttaaaatcagccagataatgtaccggaacataaccgggacaaccaaaagtgcgaaagccatcaaatttgcgtgcagcgacacagtcccttgcagccacatagtcctcaacaatgtgaatcttgaaggcaacgacggtcaagtcgaagcttactgtaattcagccgaaggttttgggtatggagtgattcatccatcagcggactgtctctactcgcacgacgacaagggcttggaccagactcacaagtcggaggaagccgagactggccacgacgagctttgatggtgatgttcaaactgttgttgtagtgagagatgatatgtaatatagttttctgaagcatatgatacagtaaaaaatgatattgtttttgtgtttataatcaaccatagttaaggttgttgttaacagcatttgtccaccttttacatcaaatgattttttttttcttttcatagaaagtcatatgcttcatctattgagcaatggccatcactttgaaaacttacgcttataccataaaccgggttctatacgtaaccaaatttcaatttctgatgggttaataataaaccgggtttataaattgggttatgattacacagtataccagaagctaacaaaaagctcaacgattcgtctcaaagtttcacactttcgtgaaattcttgttctcgaatctcgtttcatttgatacatttgaagaaatcggcaatg

SEQ ID NO: 17183 - DNA, 3003 bp, Unknown
  misc_feature (1)..( 3003): 2750-1469P.txt file - cDNA_ID_1808049; gDNA_ID_2214508; Annot_ID_133790
aattcatggtacaaacatcgaatatatatttttctgcttacacacaccaattaacgtggatagaccaattgaaatattttgttacgacaaagcaaaacaaaacaaacgtcatgtttcgctgtttgtttgtcgtcccgttaatggtaatctttcagacacatacagtacccaaacaagtaatttgactaaaattttctctctgtctaaatttcagaagaaaaaaaaactttaggatatattgccaaaagatcttaaaaatgggtcatatcattttgatcatatagaatccaacgacctttatcttttcgccgaactatacttttttgtgtccatttgtttgactttctttcacacacacatccacaaagaaaaaaggaccattcttctccttcttctagtcacccctcgtgcctctctttaacaccaaacccaaaactcccttctctttcttccttcctctccgatctccgttcacatctctctctcatctttatcttcttctttttttgccttgtgggttgaaagtttctatattttctctttctcttctgtttacataatccattttcagctcaagcagctgaagaataacgatcaagaaccaaaaaagaagaaaacgaatctgttcttagctttgatgggttcttgcttcagttctcgagtcaaagcagacatcttccacaatggtaccatctctctccaactatcaattttcttgcaatctggaattatgcatctctctgtttttaattcatggagatttccgattttgattattgtaaatggtcaacatgtgtgtctgtgtaggtaagagcagcgatctttatggtctaagtctctcaagtcggaaatcgtcttcgactgtagcggcggctcagaagacggaaggggagatattgagttcgacccctgtcaaaagcttcacctttaacgaactcaaactcgccacaagaaacttcagaccagatagtgtgatcggagaaggtggctttggttgtgtctttaaaggctggttagatgagtccactctcactccgactaaacctggaaccggtttggtcatcgccgttaaaaagcttaaccaagaaggttttcaaggtcaccgtgaatggctggtactgtgttttcatttccccaaacttaagagtcatgtgttatatatgtgtgaatgcgtgtctgatctgttgtgttgtgttgtgctattcagacagagatcaattacttggggcaactgagtcacccaaatctagttaaactgatcggttattgcttagaagatgaacaccgtcttctagtctacgagtttatgcaaaaaggaagtcttgagaatcatctattcagaagtgagtcccatggatcatctttatctttgattaaatctgttttcttttgtttttggttctgatggaaaatggttttaatataggaggtgcatattttaagccactcccatggtttctacgggtcaatgttgcgcttgatgcagcaaaggggcttgcttttcttcacagcgatcccgtcaaagtgatataccgagacattaaagcctcgaacatcttacttgatgcggtatgtagagaaatatacacattcaaagaattagatgtcttcatagtactttcctgatgactttgattcccttaaacaggactacaacgcaaaactttctgactttggactagctagagacggtccaatgggtgatttgagttatgttagtacaagggtcatgggtacttatgggtacgccgcgcctgagtacatgtcatcaggtaaaaatctatcaccttaaatatgaattatgactaggttgatcaaatgttttagagcataaggataattgtttttaaatcctcgtatcatttcaggtcacttgaatgcaagaagcgatgtgtacagtttcggagttttgcttctagagattttatctggtaagcgagcgttggatcataacagaccggctaaagaagaaaaccttgtggattgggctcgaccgtacctcacaagcaaacgtaaggttctcctaatcgtggacaatcggctagacacacagtacctacctgaagaagccgtgagaatggcaagcgtggcggtgcagtgtctctcatttgaacccaagtcgcgcccgaccatggaccaagtggtccgtgccttacaacaacttcaggacaacttgggaaaaccgagtcagaccaatccggttaaggataccaagaaacttggttttaaaactggtactactaagtcatccgaaaaacggtttacacaaaaaccttttggcaggcaccttgtgtaggtcaagttgataactgaattccaggatggacatttttccggcggtttacttgaaactgccgatatccgttttcgacggattgaatgcggttctggacaaaccgtgcaggtcaagactaataaaggatacattaaattttccggttacatgtcccatacccaaccttagagaacatgtgtagcctttagcttaggcttccttgtgtgctgttatattgagtatatatgaggtaatttttgcctcttgtgttgtaacacttgtatttttgttcctttaacatttgatgtagagatttttcctatatcttcagttttgaaacccaaatttattgcaagtcaaaatatgaaaattctaatcaatgtgcaatgaataacacaaatccgaattgtgctttgttggctgcagacctgcagttaacacaaatcttataaatttgaaatgtcgttcaaactccaaaccacaaaaaggggaagcaaaacgcaaccgtttcacgatttttgtctagtttggtccaatttctcaattacggttttgtgaaatgcgtgtcggtctttggttctgcattcgaactgtgtggcgttttgtgtaacttatccacttagtgagcaaaactactcgactcgtagtagttgcagagaggttttagccgcagaagaaaagggtttactctgtcttcttcagacttctcagtgatcgaagctatgatg

SEQ ID NO: 17184 - DNA, 3003 bp, Unknown
  misc_feature (1)..( 3003): 2750-1469P.txt file - cDNA_ID_1808049; gDNA_ID_2214508; Annot_ID_184175
atatatatttttctgcttacacacaccaattaacgtggatagaccaattgaaatattttgttacgacaaagcaaaacaaaacaaacgtcatgtttcgctgtttgtttgtcgtcccgttaatggtaatctttcagacacatacagtacccaaacaagtaatttgactaaaattttctctctgtctaaatttcagaagaaaaaaaaactttaggatatattgccaaaagatcttaaaaatgggtcatatcattttgatcatatagaatccaacgacctttatcttttcgccgaactatacttttttgtgtccatttgtttgactttctttcacacacacatccacaaagaaaaaaggaccattcttctccttcttctagtcacccctcgtgcctctctttaacaccaaacccaaaactcccttctctttcttccttcctctccgatctccgttcacatctctctctcatctttatcttcttctttttttgccttgtgggttgaaagtttctatattttctctttctcttctgtttacataatccattttcagctcaagcagctgaagaataacgatcaagaaccaaaaaagaagaaaacgaatctgttcttagctttgatgggttcttgcttcagttctcgagtcaaagcagacatcttccacaatggtaccatctctctccaactatcaattttcttgcaatctggaattatgcatctctctgtttttaattcatggagatttccgattttgattattgtaaatggtcaacatgtgtgtctgtgtaggtaagagcagcgatctttatggtctaagtctctcaagtcggaaatcgtcttcgactgtagcggcggctcagaagacggaaggggagatattgagttcgacccctgtcaaaagcttcacctttaacgaactcaaactcgccacaagaaacttcagaccagatagtgtgatcggagaaggtggctttggttgtgtctttaaaggctggttagatgagtccactctcactccgactaaacctggaaccggtttggtcatcgccgttaaaaagcttaaccaagaaggttttcaaggtcaccgtgaatggctggtactgtgttttcatttccccaaacttaagagtcatgtgttatatatgtgtgaatgcgtgtctgatctgttgtgttgtgttgtgctattcagacagagatcaattacttggggcaactgagtcacccaaatctagttaaactgatcggttattgcttagaagatgaacaccgtcttctagtctacgagtttatgcaaaaaggaagtcttgagaatcatctattcagaagtgagtcccatggatcatctttatctttgattaaatctgttttcttttgtttttggttctgatggaaaatggttttaatataggaggtgcatattttaagccactcccatggtttctacgggtcaatgttgcgcttgatgcagcaaaggggcttgcttttcttcacagcgatcccgtcaaagtgatataccgagacattaaagcctcgaacatcttacttgatgcggtatgtagagaaatatacacattcaaagaattagatgtcttcatagtactttcctgatgactttgattcccttaaacaggactacaacgcaaaactttctgactttggactagctagagacggtccaatgggtgatttgagttatgttagtacaagggtcatgggtacttatgggtacgccgcgcctgagtacatgtcatcaggtaaaaatctatcaccttaaatatgaattatgactaggttgatcaaatgttttagagcataaggataattgtttttaaatcctcgtatcatttcaggtcacttgaatgcaagaagcgatgtgtacagtttcggagttttgcttctagagattttatctggtaagcgagcgttggatcataacagaccggctaaagaagaaaaccttgtggattgggctcgaccgtacctcacaagcaaacgtaaggttctcctaatcgtggacaatcggctagacacacagtacctacctgaagaagccgtgagaatggcaagcgtggcggtgcagtgtctctcatttgaacccaagtcgcgcccgaccatggaccaagtggtccgtgccttacaacaacttcaggacaacttgggaaaaccgagtcagaccaatccggttaaggataccaagaaacttggttttaaaactggtactactaagtcatccgaaaaacggtttacacaaaaaccttttggcaggcaccttgtgtaggtcaagttgataactgaattccaggatggacatttttccggcggtttacttgaaactgccgatatccgttttcgacggattgaatgcggttctggacaaaccgtgcaggtcaagactaataaaggatacattaaattttccggttacatgtcccatacccaaccttagagaacatgtgtagcctttagcttaggcttccttgtgtgctgttatattgagtatatatgaggtaatttttgcctcttgtgttgtaacacttgtatttttgttcctttaacatttgatgtagagatttttcctatatcttcagttttgaaacccaaatttattgcaagtcaaaatatgaaaattctaatcaatgtgcaatgaataacacaaatccgaattgtgctttgttggctgcagacctgcagttaacacaaatcttataaatttgaaatgtcgttcaaactccaaaccacaaaaaggggaagcaaaacgcaaccgtttcacgatttttgtctagtttggtccaatttctcaattacggttttgtgaaatgcgtgtcggtctttggttctgcattcgaactgtgtggcgttttgtgtaacttatccacttagtgagcaaaactactcgactcgtagtagttgcagagaggttttagccgcagaagaaaagggtttactctgtcttcttcagacttctcagtgatcgaagctatgatgacgacaacaaccaatactatg

SEQ ID NO: 17185 - DNA, 3000 bp, Unknown; identical to SEQ ID NO: 11110
  misc_feature (1)..( 3000): 2750-1469P.txt file - cDNA_ID_1808053; gDNA_ID_2214478; Annot_ID_133183

SEQ ID NO: 17186 - DNA, 3003 bp, Unknown
  misc_feature (1)..( 3003): 2750-1469P.txt file - cDNA_ID_1808061; gDNA_ID_1620740; Annot_ID_49581
tatatatgtctccaatcaaggccttagggtcgaatggtgacagcgtatttggcagtgcgggaaaagcggatttatactgcggtacggtccaactgcggtacatgcgggagaaatatatttgcggtacaagtgtggtttttatagcataagcggtacggaataatgtttgattggtaagaaaataatttgcggaatttgtttgattggtaaatagatatttaagataaataattgataacaaaatatattagtaatataaatttaattataactatataatttcatttattgttaatgaaataatattttcatctactatttttttagaaatttgttatagctaaacctataattttcttttaaactattgagtaaaaattgactaaaatgattattttacaacttgttaattgttaatttagttctaataaactgttgtatcaaaccactcaagtattaattagtggttgttattaagcatttttctattttcataaatttaataaaaaaaaaattactttttttctttgtcaagtgcggatttttatttgaaccgctgcttattacttgctggataaataagtgcgttttcattgattaatgttcttactttaaaaaacgcaacattactttttttgttttctgaaaaataacgcaattgacaaaataactgtgattggtgacatattgaggttttccaaaaaagctattgaaatacgcacttatatatgtctccaatcaaggccttagattggtacgttcgtaggcgttcttatggaattttagaattttgttttaaatatataccctataatttgataagtatttttgaattaacttagatatttgttggaacaaaatgattttaagtgttgattagactcttgtgagtggtggttcaagttgaaatgaggatatttattttctttatttaaattttaatgaaaatatcatagaagagcaacattctcgaaagtttaaatatcttgcaataggtgtcaagttcgaaagagcactcctatgccttttgatctcttttactttaaaatcatcactttttacatggtcatttcaaaaacttctctttaaatcgttgaacaatttttttcttttcaaataataaatatctggacagtcagtgaatatggaactttctttatcaagtatgatatatgaatatgagaatgatgcattgatgctttgtatggttggttattgataggaataccccaaatacgaagtggtattttgatagataagactaaagagatcctaaagaaagaaagagatcgaaaaagaaaaaggaaaaagaaaaagaaaataggtattattagttgagtttaggaccaaaagtgcaacacaccaatacgaacccgtatacactactacgcgtacggctcttccttcactccttgtatgggtccctcgctgagcttctatagtggaagctccccaaacccaaccatgaaattggctcctcatcacattcacacctttaaaattccaatgtaatatattttctttctctggagacaaaacttattttcaatctagtctattagtttgagttattatttggagtttaaaaaatatgtccttttcttttatttggtatttctatccgagaacactttggctgattctctggcaaaggctagtcttaaatcttgtatcatctcctctagtgatagagagtttgagtaatcttaacgtccctaaatgcataaatatatgcattttgattaggatatttttttcttgttttttttttgtttgcattttgattaagatttatacacgatggttacaattttacttaattaattattatggcttttgaccccgaaatcgtatattattatattcaattcagaattttgtatctaaacaccgttagtgaaaagttttttttttcagtattattacaaagacaacgtttctcctaacaaaggagaaacaaattacaacaagatcatcacaatcatccttacatataaataatcttcgtttaaaataaccttcttatcataaaacaatgcccaacttagagtaacaagaaagaaccagcaatggatgtacaccaacgacgaccgcagagacgccaagagctgccgcaccgcttttggcagaatcagcagagcctgtaggcgcattgtcgtacgaggagtcacttcctagaggaccagccactgcaacgtcaccgtcaccaggagtaggagctgcatcgtcatcggtggttccgatttggtcatcggtgactggagcctcgacatgatcggttttggaggcagctggagctttggagggagacgctgaaggagatggagaggaggcagctgcggcaaggccaatgatggccatgaagacgagggcaaccacgacgacaatgttttggcgacccattcttctctctctccttcttacgtagaactcgtttaatttattttagggtttgaggtttattgattgtgatgatttccgaagatgagtttgatatgtatatatagttgtgttttgtgatcaagaccaaaaataaaatagaaaacgtttgaactaagatgtaggattaccttacaatccaatgtaaatctactggagtacctaaaaatggacttgttcagatatagattttgattggtgaacatgcgaatgaatatgaaaccattcgttcaacttcaaatcgtcgtattaacgagtgtcttattaaagaaccaaattatgatagtattgccatgaacattctattcatcttatatcagatgggctttaaacccataagcccaaacgtcttgttaggcccatgaatcaattccgatttacgattctgccatcaacagcgagttagggttttacactcgaccactttaagctctcaaatcttccagacattcttcttctcgcttttttccccatttcaacttttttttttcctctccagtgcactaggaaacaaaaaaaacccaagatctatagttcgatcggatcgagagaagctcgaaaatg

SEQ ID NO: 17187 - DNA, 3003 bp, Unknown; identical to SEQ ID NO: 17186
  misc_feature (1)..( 3003): 2750-1469P.txt file - cDNA_ID_1808061; gDNA_ID_1620740; Annot_ID_166409

SEQ ID NO: 17188 - DNA, 3003 bp, Unknown
  misc_feature (1)..( 3003): 2750-1469P.txt file - cDNA_ID_1808065; gDNA_ID_1621200; Annot_ID_57652
atcgctgagtgatgacgatgatgataattaatttcgaaagcgataacgttttgggagatttggaggagcttaccgttgtgtgaggagcgtttgaggtttttggaagaagctctctcgatgtgttccgcagagaaaagctaaagaatgtgaccttatcggtaatttgtttaatagttcaaattattttcacttttactcctctatttctttagtgtttctttttagtgccttcaaattttgaaaactaacaaactcaaccccaaaccaaatccagttaccaagttgcagcattacacttcatattttcatggaagactacattaggtggaacattgaattagcatagcgtcacgggagctcaagcgattctctgaacctttcttcgcttgtaagtcaaggaaaacaaatggtcactattggcttctcgagcatgattgtcttcgctcaggacccccagcggttttctcagagccttggcttccctctgaaagttattactagacgaaatcctcttgctctctgttgtttcagagcctctgtcaacagtcctaggcttaaaaccaggagacttcaggtggtaccggacatattcttcttgctttagaggtatattctgttctgtgatggagtaatttgaaacacggagagcactgggaacagtgtgtgttggatcatgaaacaccggttctgtaccttggattgatctttgtgtagtttccaaataggttaagaaagggtctgggatagaacagccaagagttccgtagggtggtttctcaaatgtcgtacctaagtatggagacgctgcaaatctagtactctttgaaccggtttcatggatttgcaggagattgtttcctggagctacatagggtttcctgaggatggcagaagaagatttagggactaatttgagaacaccctttggcaaagtctgatgatgatggccagcagaaactaagctggaaccttgataccggaatactccttccttggttatctttatcttgagactgttcttggagctgccactgcgagggaaggttaaacttttcgatctatttctttccacgggtttcactacattgggagttttgaatctacatgtagcactatccatttccttagatggaactctattgaggtccagtagcttgagattaccggtttgagttcgtcctgaccaaatgaggagccttgagtaattgcccaatttatttccatactgaacccacaccctttgcatttcggtaaatgtcctgatcagcttttcatgatagaactttaaagagtagtaatactttctcctcttgacaaacataacaccttctttgaaacaagctacctttggagtaaacaatccacctagcaaattcttgtaaaacttatcctctggattcccaaaatataaattggcaccatcaagaagttcctgcatcgtcaaactgaaagtctgtggatccatatctggcagaaaacatgagaggaagaatctttcttcttcagtcagaagtgagttccaagtctcaacagacaatattcccgttaaatctggtagatcgtagagctcgtatggtatgttacagagctgaccttcaaccaaagctagctcacagtttacttgcgcaatgtcgtaatcatcagagtcatcatcttcagagtctagcccaactgtttgattcttattcatctgtagttaaccacttactacccttaaaacacaagtacttcaaatctccaaccacaaactcagtagaaaggaacacaagcaggagatacctagatagaaaatgttaaagactcatcatcagcaattcacattacaagaattctactacaatacaatggacagcgagaagctgagtatgttactaatcagaaatcaaacgaacataaatagcattttactcactgatttcagcaacaacaacactaaaggctatataaaacacgaaatatacattgtgagatcaatgaagcactcaaaaagaagaagatacacaacaccagaaaatctcccagatcggatcagctacaaagcttaaacgtaatcgatcgcgaactcaatcaataaccaaaatcaaaagctccaacaaggcaaataactagagagcgaaaacccttggatttgacaacaaaaatgtgcagacaatttgaataaaaaacaagtatcatacaaatctcagcacaaatcagctccaatgagtttcaaaaacctaccggaactaataaaaaaaaagaatctcgagatattcagagaaatcgatcggaaagcgtaaaagacgaggagcttaccggctctaaagacaggtgaaattagcagattagggtcgaagaaaccatatccctttggctacagatacgaacttcatcgccttcaaagattctctgcttcctttctagagatttctatggcttttcgatcgatgcgacagtagagtagagactagagagactaattactgttacacttgtattttgatttctttaattaaagccgcctaaagtaactaatgccttgattactttaattaataatcatttttaaattgtgatttataatcaagttagacattacttcacaaatagtttgggcctggaaacgtataggcccatgtaaactttaataaaagaatcaccttgcaggtaagtataatatcctgatattattatttacttgatagaatgggcctataataaaagaaatcaccattaaagaattataggcccatgatatcaagtaaatatcaagaaatgatgattaatgatcaagttagacatcattacttgatattttggtaagtaggatcaatcaacggtcaggatccttttagtaaaatcatgtgtcattttcagtttgtctaaaagataagcctttcactttctctctctgtcttattagaaaagaaaatttgtaccgtttccaaagtctgagccaatcattgtgttgattctggaattctttgtgggaacgagaaatttgtacaagggagattcatcatg

SEQ ID NO: 17189 - DNA, 3003 bp, Unknown; identical to SEQ ID NO: 17188
  misc_feature (1)..( 3003): 2750-1469P.txt file - cDNA_ID_1808065; gDNA_ID_1621200; Annot_ID_174886

SEQ ID NO: 17190 - DNA, 3003 bp, Unknown
  misc_feature (1)..( 3003): 2750-1469P.txt file - cDNA_ID_1808072; gDNA_ID_1620642; Annot_ID_47522
tcaagactttgtaactttttctattcaataatgacgttaagagaaaaagaatttattttcagttcctcttctcttactagtttctttttatagaaaccaaaataaagttactgatctaatttttaaaaagggacaattgcatgggaatgtcaatatgattacgcaaacaacttctgcagataaaaatggtttgcagaaaatggaaagcacctatccatcatagctatcttggaagtctcgttatttcaaaaatatttctctcctttttattttcagctacttattaattccataatatttttatattaatatatttcaaaaaaatccagattttatttctatttttagaactataaatcaagaaattatctatgtaatgttaaattcctatttttttttagttattatagaaactgaaaatggtctaattcatacgaagtcgatttttctcacggcatattatgtaaaccatgaatgtattttattagtgattcgtaaaccctaagtttcatatacaataaaaacaaaaatggaacctaaattacgaataacctttatcactatacgataaagtataaaacactaataaatggaccctattacgaccaatcgtaccaatatttggtcgtatctttcatttttatttatttacagatttgtaaattttaaaatagacacttttgtgttggtcaataaaaaaatagactaaaataaaaaatgtatttacaagtgaaaccaaactaaaaccattatgagaaagaatctcacaaaattgaccagagtaaagagagagacaaaaatgggtcgagcaacgaggtggttcaagggtttgttcggaatcaaaccttcctcttgttccggcaccgactccggcactatttctaaccgccttgaccgctctttatgcgacagctacgagactataccacctaacatctccgagaaagaagctgcgtggctaaggtccttctacgcagcgggagaggaggaaaaagagcgtagaacgcatgcaattgcggttgctgccgcgacagctgctgcagctgacgcagcggttgcggcggctaaagcggctgctgcggttgttaggctccaaggtcaaggcaagagtggtccgttaggaggtggcaaaagccgtgagcatcgtgctgctatgcagatccaatgtgcctttagaggctacttggtactaacacaatttttcaatttttctaatcatttcaatatttttaatctttatgtatttgagccgttacatttttgtaacgtaaaaggcgagaaaagcgttgagagcgttgagaggagtggtgaagattcaagctttagtgagaggttttttggtacggaatcaagcggcggcgactctccggagtatggaagcacttgttagagctcagaaaactgttaagattcaaagagctctccgtcgtaacggaaatgctgctccggcgagaaaatccacggtaacacttacttttccggtttggccgtaccgagtttatttatttatttttatattaagcatacttagcaatcaaatctgtttagagttccataatttgatatatcaaacatagagatcattttaaataattttctcgggtcaaaagaaaataatcttaaaatgtaaaaagattgaaactgtttaacctttatgtaaaaagttgaaatcttcttaaactagtttgtaagcagataaacacttttttaactaggctgtaaaagtgttgatgtaactttttacaggaaagattctccggatctttggagaatcgaaacaacggcgaagagacagctaagatagtggaggtagatacagggacccgacccgggacttacagaatccgagcacccgttttatccgggtcggatttcttagacaacccgtttcgacgtacgctttcttcaccgctctcgggtcgagtcccaccgcgtctatcaatgcctaaacctgaatgggaagagtgcagtagcaagttcccgacggcgcagagcacacctcgtttttctggtgggtctccggcgaggagcgtgtgctgctctggtggcggagtagaggcggaggtggatacagaggctgatgctaaccggttctgtttcttgtcgggggaatttaactcgggttacatggcggatacaacgtcgtttagggcgaaactgaggtcgcatagtgcaccgagacagagaccagagagtaatgcttcagctggcggatggaggaggagtatcggcggcggtggtgttaggatgcagagacagtcgtgttcgggtgtcagagaagctgtggtcgggaatatcgagaggcgtaggatgcgttggtgattcttatttccataattattatccgtttagttttggttaattaggggagtaatgttattaatttaatatagtttgatattattatagttttctaagtttcactgacaaaatttaaaattgttgtttcttgtatgctacatattctatttctatgtaagttttttgctacggataatttacatttttattagcttaactaaaattatccgagtttttttatattcggtgttgagaaaacggtactgatcggttagtaaacaattattggttcggttaaatataccaaaccaatattatcggctacaacgcatgcaagagactattttgtaaacaaccacttaaacataaacacgtgttaacgcgattcacatcaacgcgtgtggaaaaaggaaagttgcttccttcgttcttaatcccttctctgtgaacacaaaaacgcgaaataacaaacaaaaaccaatacaagtgatttccattatttctcgtctacgtatacaattgatcttcccccatctccaattcagatttggacagaggtattttttgatccgattcttacgaatcctgaatcttcctcgtagattaatcgatcgatcggttcttaattcgcggaaaattgtttcagtaacctgtgatcgtgtcggttggggtagaagagatcgaagtgggagcaaaatcatg

SEQ ID NO: 17191 - DNA, 3003 bp, Unknown; identical to SEQ ID NO: 17190
  misc_feature (1)..( 3003): 2750-1469P.txt file - cDNA_ID_1808072; gDNA_ID_1620642; Annot_ID_163080

SEQ ID NO: 17192 - DNA, 3003 bp, Unknown; identical to SEQ ID NO: 17190
  misc_feature (1)..( 3003): 2750-1469P.txt file - cDNA_ID_1808072; gDNA_ID_2926195; Annot_ID_141232

SEQ ID NO: 17193 - DNA, 3003 bp, Unknown; identical to SEQ ID NO: 17190
  misc_feature (1)..( 3003): 2750-1469P.txt file - cDNA_ID_1808072; gDNA_ID_2926195; Annot_ID_201376

SEQ ID NO: 17194 - DNA, 1587 bp, Unknown; identical to SEQ ID NO: 4185
  misc_feature (1)..( 1587): 2750-1469P.txt file - cDNA_ID_1808099; gDNA_ID_1620689; Annot_ID_48548

SEQ ID NO: 17195 - DNA, 3000 bp, Unknown; identical to SEQ ID NO: 4726
  misc_feature (1)..( 3000): 2750-1469P.txt file - cDNA_ID_1808099; gDNA_ID_1620724; Annot_ID_165886

SEQ ID NO: 17196 - DNA, 1587 bp, Unknown; identical to SEQ ID NO: 4185
  misc_feature (1)..( 1587): 2750-1469P.txt file - cDNA_ID_1808099; gDNA_ID_1620689; Annot_ID_164724

SEQ ID NO: 17197 - DNA, 3000 bp, Unknown
  misc_feature (1)..( 3000): 2750-1469P.txt file - cDNA_ID_1808099; gDNA_ID_2926184; Annot_ID_140693
taaactttgagcccttcttcttccttatcaagaattgttataataaagcacgttagtgagaaaagggcgtacctaaaaaactcctgggaacagcaacagaactctccggcctctggttgttcctccttgctacctttccaaaactctgtggagtagatgaccgaggaagaagttgattctggtcgagagaagaagagtcagcatgctcatgcctcaccttgatgtgagggtaccttttgcagagaccagcaatatcatctttggttaaaagccaacaaccttggaggtcgagtgttcttagcctgttaggtggtctaaacttctcaagaccattgctggtcaaaactccatctcggactccgagactgactaggtttggaagagaggagagatggtggagtgtggaatctgtgagggatgtgcttgttagggacaaatgtgttaatccagtaaggctacttagaccggaaagagctttgtcacccaggtacggatgttctagactcagggtttcaagggaagttagagattgtagtgctgctagtgacttctctttttcttcttgtggagatattagatagtagaatcctgaaaaaaatagagtcgtagggttatgatagggttaataatcactcgttagatcttagaaggctcatacatacctagggtgctgttcatgcccaagtcaagggctttaatgcaaggcatcgtggtgctgataagcaagatggaaagatcgtcgacaaatgtctgggacatagataatgtctcaagttgtggcacatgtccagcaagattcccgaccccagaaggagtgatttgtgtatccgagacattaagattctttagattctcaccaacacatgctacaaacccaacagaatcatccccgaaagctgtggagctcagatcaagatgttctaggttaaacatagtttctaagaagctgaagtttttgagggaagtcttggaaacgtctaagtaggttatacagcttttgttggtaaaggacaaggactctgtctcggcactgaaattagctcccgataaaactagctttttcaaggaagctaatgagctatgagtttttggttcggagacaatggtgcacgtgttcatgtgtaagcattcaaggtgcggaatgtttggagtctgtgtgatgcttgtccacgagaggtttaggaagctcaagttagaaaatttgagaatactgacagctccttggttggttacgttgcttccccagatgtcaaggtactctagctttgtcagtgcctgagcagcaataaagaaaatggcggtcagaaaaactaaaaaaagattgatcgtctacatattaaatgttattacaaataggcatgtttttcagtgacaaaaataaaataaaaataggcatgtttttaataagtgaattcgggcatacaaacatcttcacgcaagaaactatattgaacatacacttgaacttcatttgtagggattaatgggtttaataaccaggaaatgatatttgaattttagaatcctgaagactaaatagtttctgtgcacattatactctatactcaacatagtagtagtacctagaactttacaattttagcagagctctctaacaaatttaactagatagatagatgataactattgaactacacagttcaataacatacatcatgcaattaaaacaacccctaatgactacaataaagaaagagcacaggtaatacctggagagaaatcaagttctgatcagttacaggtaagccgcccaaatccaaaagagacaattttttaagtgaagcaagaagagaaattccaacttcagtgacacctgtctgtgaaatccacaactttttcagatttacaacagattggaggtgcttcataccagcatccgtaaccttgaaacatcttgaaaggtccaactctgtcaaacttgttaatcctgaaaatccaatatcacatattaaacacttaaatttctcttaaacttccattccaaaactcggagtatatcactcaacatacctgtgataggccagagggtggaactgttgattctctggcaatctgaaagatttagagtaattagattaacgaagcctccaatgtaagccatccattctgcgttaactgagcttttgcctcggagatctatattctctacagaatatttgaatcctctgcacagaaaagagtcttgtttagttgtgtgatacagatacaatagttcagtgtccatgcaatcattgcattttccgcaacgatgtaccaagaccaacacaattctacagctaaacacttcaggaataattatttcaacatgaatacagaaaaaaaaaaaattctaatcaaatttaaaaactaagatcccaagcgatcactcaatatctcaaatcgaagcatatatatatatatatagctcagcatttcgagatcagaaatcagattcatattagaaacgatcagaactatgtaaggaagtgaagagtttactcgagtaacgaagggaaaagaagccgctttttgaggaggcgacggaggagagcatcagcaaggtgaggaggcagactctcaagactacgccgctgaagtcgccatcgttccaccgcatctccgctcttacaagcttcctttaagcatagacgcaccaaaggactctccatctccaatctccaaatcgctgaaatctctgatcttagctccaaatttcacaaaccgatccaacctttatataataagaataaaaaccctaaataaaatagaaaatcaaagaattaaaaaaatccgccaaaaacaaaaaacaaaaagttgttcatccttattgggccactaaagcccaaacgtttctagcttatatggcccgttgattcacgtgtatcagcacgtgccttcttctattgaacgttgtcgagtgtcgactatatcatactaatcttagctccaattctgcagattttactctcatcctaaataaacctctcttcatcgaaaatg

SEQ ID NO: 17198 - DNA, 3000 bp, Unknown; identical to SEQ ID NO: 17197
  misc_feature (1)..( 3000): 2750-1469P.txt file - cDNA_ID_1808099; gDNA_ID_2926184; Annot_ID_200474

SEQ ID NO: 17199 - DNA, 3003 bp, Unknown
  misc_feature (1)..( 3003): 2750-1469P.txt file - cDNA_ID_1808107; gDNA_ID_1620636; Annot_ID_47373
accaaaagaaagcttactgagatgaatcgagatgggtcaggaagccaaggctcaactaaagctgcggcgtggaaaacgatatcgcaaccggagcaagcatccgttagagaacggtaatccgttacgtctccataggcgagctcaacttctggaggtaagtcagagagatcgctggtgcggcggaccaatgcacgtacggagtggccacgacggaggagaacgtggcagagtcgtgcgcctaagtaaccagtagagccggtgactaatattttcatattttctgtttctgtgttgggcatctttgggcccatcgttgcttttctaagccaagaaacctctaattggttgagagggtttaattaattaatatttaatacaaacatcattgtctgaaagctggatcaaccaatagcaagattcttttgtgttttgttttgtcacatactacagataacaaagaactagtaagtttctcatttgagtgaaacaaaatttcaaattacagacagatccacgaaaatacaagatgacataatgagtaaagaaatctcaattcggtgatagctagttcgaaacaagattagagcacgaaccttgaaacaagattacacctctcctctgtatccatcagagccaaaatggtctttcctagaactagatatagctacactcttctgatgttcaaattttggacactgtagaatccgatgcccgagaccaccacaataagcacaacccttgacaccgcttgcattagcaatggtttctgtttcttccattggaccattaagctcagcaaggacaggtggaatcctctgtttagcttcttgcaacaagtgtttcaaatcgagcagcgtgatttcgctttggttcttgtttataaacgtagttgctatcccagttttcccacagcgacctgttcttcctatcctatgcacgtagttctcaatctccccaggcatgtcgtagttgattacatgttgtatatcagggaaatctaaaccctttgaagcaacatcggtcgcgaccaaaacgtcttttttcccagctttgaacaaagatattgcgtaatctctgtcttcttgatcttttcctccatggatagccactgcttccactcctttcagtaacaagtactcgtgaatatcatcaacatcagctttgttctcacagaatattaaaaccggtggagtggttttctgcagacactccagaaggtaaacaatctttgcttcttgcttgacgtattcaacctcctgtatgacatcgagattcgcagctccagctcttcctacattaacagttacaggtttcaccagagcacttgtggcaaagatttggatttttgcaggcattgtggcagaaaacaaaagtgtttgacgctgagacttaaagtggtcaaagacatgtcttatgtcatcttcgaaacccaaatcaaccaacctatctgcttcatccagtgtcaacaacctgcaagcatctaagctcatctttttcttggcgaggatatccttcaaccttccaggagtagcaacaacgatgtgaacacctttcttaacaacgtccaactgtgatctcatatccactcctccaatgcatagcaacgacctcaaccgcgggtatccatcctcgactaaagatgccacaaactgttcaaccacatcgtaagtctgcttagcaagctctctagacggacaaataacaagcgcaatgggaccttctccagcagctataggcatcattatctcctcctgcagagctaatatgatcataggaagcacgaaaaccaacgtctttccggaaccagtgaacgcaatcccaatcatatctctgccagacaaaacaacaggaagaccctgaacttggataggagtagggtgcattattcctttatccttgagcatacggagaagtggactcggaaatttcatatccatgaagtttttgattggaggaggaatatcttcaccgttaactgtaatatgccattgcttcctaatcaaatccatctgtttggttgacatcttcctaacgtgcagagggggtttccaccatgttgagagaggctctgtataagtgatacctctggctaattcaccaacagacataagcttcttcttgtcagataaatgctccatcatccccttctcttgtaaaataatggcctcggtagcactgacttaaggtacatgtcgcttgagctgagttgcttgaacaagtaagctaggtttagcttcttcagtgagctttaccttgccaggttcttccaccacctttcgcttcatctgcgctagacgctcctctactggaacatactccacgtaaccatcatctacttccatgattcaaaatccactcgccaactttttcaaagatcgaatccaaaccctaatcagcagatctctcgactttcaaggaagatcacgcagatagatatgaccgacacggagttttggttaaaccggggttggggaatgatcgggtgtgttgtgttttctgattataagcaaagaaaagaaaagctacaagaagagagtctcaattagaattcgtatgttgacaaggagctaggtaaaaggtagtttttcaaaaatttaatttccatttttttcatatattggattgaaaaatggcaatgacatgaatcataggattatcaccacatttaaagatgtagtatttacataacaattgcaagaaataatactacaaaacttcctatctagtatagacgctgccaaagaaatacatacgacgtttttatccacacgcattgatgagattggtatatatctctgtctctgtcgagtgaaaaataaattaatagagtaataattaaaagctctctctctctatctcccacgatttcctttttccgccggaagaagaagcaaaaaaaaaagaaatcgaatctctctttcaagtgttcgatttaaagcaaaagtgtaattataatcggaagcgagatcttgagaaatggtgggatgacggcggagggagatg

SEQ ID NO: 17200 - DNA, 3003 bp, Unknown; identical to SEQ ID NO: 17199
  misc_feature (1)..( 3003): 2750-1469P.txt file - cDNA_ID_1808107; gDNA_ID_2926204; Annot_ID_141646

SEQ ID NO: 17201 - DNA, 3003 bp, Unknown
  misc_feature (1)..( 3003): 2750-1469P.txt file - cDNA_ID_1808111; gDNA_ID_2214519; Annot_ID_134026
attctcctccgacaagttcatatgcaatcatctgatgagcatgtactccaagcttggagattttccttccgctgttgcagtatatggacgtatgcgtaagaagaattatatgtcatctaacatactcatcaatgggtatgttcgtgcaggcgatttggtaaatgcccggaaggtgtttgatgaaatgcctgatagaaagctcacaacttggaatgctatgattgctggtttgatccagtttgagtttaacgaagagggtttgagtttgtttagggaaatgcacggattggggttttcgcctgatgaatatactcttggtagtgtttttagcggatctgctgggttgaggtcagtgtctatagggcagcagattcatggctacacgatcaaatatgggcttgagttggatttagttgttaatagttcgttggctcatatgtatatgagaaatgggaaattgcaagatggcgagattgttataagatcaatgccggttcgtaatttggttgcatggaatacactcatcatggggaacgcgcaaaacggatgtcctgaaaccgtgctttatctgtataagatgatgaaaatctcaggttgtaggccgaacaagatcacatttgtaactgtgctcagttcttgttctgacttagcgataagaggtcaaggtcagcagattcatgcggaagctattaaaattggggctagctctgtcgtagctgtagttagttcattgatcagtatgtattcaaaatgtgggtgtcttggagatgcagctaaagctttctcggaacgtgaagatgaagatgaagtgatgtggagctcaatgatttctgcttatgggtttcatggacaaggcgatgaggcaatcgagctgtttaatactatggcagagcagacgaacatggagataaacgaggtcgcgtttctgaatttactttatgcgtgtagtcattctggcttaaaagacaaagggcttgagttgtttgacatgatggtggaaaaatacgggttcaagccaggtttaaagcactacacttgtgtggtggatttgctcggtcgagcaggctgtttggatcaagccgaggcaataataaggtctatgccaataaaaacagacattgttatatggaaaacattgttatctgcgtgtaacatacacaaaaacgcagaaatggcacagagagtctttaaagagattcttcagattgaccctaatgactctgcttgttacgtcctgcttgcaaatgttcacgcctcagctaagagatggcgcgatgtatcagaggtgagaaaatcgatgagagataagaatgtgaagaaagaagcgggaatcagctggtttgaacacaaaggtgaagttcatcagtttaagatgggagatcgctctcagtctaaatctaaagagatctattcatacctgaaagaactgactctggagatgaagctgaagggatacaagcctgatacagcgtcagtattgcatgatatggatgaggaggagaaagaatcagacttggtgcagcacagcgagaaactagcggttgcatttgcgctcatgatattacctgaaggtgcaccgattagaataatcaagaacttgcgggtttgcagtgattgccatgttgctttcaaatatatatcggtgatcaagaaccgagagatcacgttaagagatggtagtagattccatcatttcattaacggaaagtgttcttgcggcgattattggtagctgggcagttaaagtatgctatgactctctgcttcagagtctttctggagtcttaagcactcagattggatcgggaagccatctgggacgaaagcattcagcagcaagggtaaaattacactgcgggtagtagctttgtagtctaccttgagattgctcctgcctgtgttattcttgagtcaggaacatgaagtggtttgctgtcaactttacttactcaagccatctccgcaaggtagaaactatggttcgcgttatttcgtatgtaccatgtttttggtcgtttgtgtagtttctaaccttccacacccttggcttgcgattctttccaaagcagagatgttagatcagaggatggagtgggttctcaagtagaatgcacttgcgaatccctcagatcagatttttcataggtaaagttcgttaacttcaacaacaccactttagtaaacatgtgataatcaatcgtcataagcatcttcgattcatttttatcttatgcaagtgtttgctttattatgatttgttaagttttgcataaatacggacgttgaagcacttcccagaactcatgagtgtttttataaactatttattaaaagttagtataagaaaactataacataaaagtaaaatataatttagacaaatgtagcgattggtccagttactcatccaaaattccaaatgaatcttccaccgttgataattctattccattgttttcttctgtagaagaccatatattattaagtctctagtccattgtcaataaatggaaatacaaaaaaaaaaaaaaaaaaaaaaagaagaagaagaaaaagacagcatttaatgaacgaaaataatattaatgaatttggaagaaggaacgaaccaacgagaaaaatcaacgaaataatttagacaaatgtagcgattggtccactacccatccaaaagtccaaatgaatacttcaccgttgataattctattcaattgttttcttctgtagaagaccatatattattaagtctctagtccattgtaaataaatgtttctttcaaataaatggaaatacaaaaaagaaaagaaaaaaaagacagcatttaatgatgataacgatttggaagaaggaaccaaccaattagagtaacaaaccaaggaggcgactcacatgaaagcaaaagctgacatggcagtgaattcagttttataaaaaaggcttcaaggccgagagttcgtagtacaaactcttctctcagtcatcacagaaaataaaaaacaatg

SEQ ID NO: 17202 - DNA, 3003 bp, Unknown; identical to SEQ ID NO: 17201
  misc_feature (1)..( 3003): 2750-1469P.txt file - cDNA_ID_1808111; gDNA_ID_2214519; Annot_ID_184551

SEQ ID NO: 17203 - DNA, 3003 bp, Unknown
  misc_feature (1)..( 3003): 2750-1469P.txt file - cDNA_ID_1808122; gDNA_ID_2214543; Annot_ID_134521
tttctaatattattaaatattatagatggtatatatttttaataccaagtgtctggtagctcaattggtaaagatcatagatgaagtttagaggtcgccggttcgagtgacgcttggaacgaaactaagggggtgttattagttaatgaattttaatagaattaaaatccaacactaatcaactgttattcaactaatgattctaaatccagttttaaaatctagtgttattggaactcatctttgtaatcatgcttaatagattttaaaatttagtgttattcaattaagattttaaatatttcattaaaatccagtattattcaaaacaaaaaaacttgtaaaatccttgtatattagttcatttgaaatgaaatctctttggagtttcatgagtaaatcattagaatcaatattcaagacatattgcatagattatattgcatagattttgaaatttatacaaacatatttttaaaagcaacatcagaaaacaaatctaaagcttaaagaattgactttaactccataattgaataacaccacctaatattacatgctgtagttttggatctggaaaaattacggatttcggcctagaaccttcttatattaaaaaaaaaaaaaggtatatatttttattgtcacgaagaatgtgtgtatacacgaacgctcataatccattgaagtcaatttcttgcgataaacgtagtttatttcttgcacacaatcaaatctagttacgtacattagcaaacactgttttagattggtccgagtgattgtttgactttgatcgaaaataaacacacaattttaattaattacctttgaaaatatgtaattacaatgctcatattagtgcaaagaaaaaacaacaaatataatttgaaccaatagtttgttcactagcaatatattatatgtatagttgactctagtacattagtatcaatctaaaaatctaatctaactcgatattaggccatatgttttaacaccaaattagatttgaaaaacatggcaatggaaacacaataatatttttaagtcacatcagagaagaagatgcatagaatatacctagaaaatattcaattcgccaaggagatcaatgattaggtcataggagtaataaactatagaataaaattatgtggaaaaaataataaataaaattaagaaaagaaattgggttgtcaaaaacacacatgtatctaagctgtcaccactcgtgatactctgttcgaaaaggacatctttagattcggcatcacattctggcatctttgccgccaaaattactttattgtataaacaatattttcctcttgagtaagaataatccttcacgagaaagtaaaaattaactttgatcttgcgagcaaaagtagtttacatgtttaatgtgatatatgcaaaataagtgatatattattaaactgtaattggtaattgatgcggatcaccacactaaacatatttgatcattgttcatgtgaaacttaaaatatttttaaaaagtcgagtatgagtaggtgtcttttggagatgccatgttctgatggtttgatttagcttcaagagtgtgattcgacatttgaaaaattaaataatgcatcaaaaaatggttagaaaaactctctcttcaagaatatatatgtcttaatatgcaggttaagaagcacatgaactatttagtctatttcacgtgcaattaagatgtagtcatattccaagagacatgttactgttgcaatcttaggtcgaaagcatcatcttttgtcgaaacaaaagttccaagagtccaagacattaagttacaatatgcatatgatgcgagcaaatcatcacccatttgcacaacttctttcaaaaccgcataaaacagtttttttttttatctcgcttaagagaagcaatttttagaattagaaaaataccttcaaatgacaatgatccatatcttgaaagttatttttgttgcttcagctctattcaagcctcacatcttattcgaaatatccgtaaaactcattgaattcaacaaccacaaaccgtacttcatctttcgagatcctaaaccgtataaatcacaatccttgtctcaaatgtagaatacgatctccatacacaaataattgaaaaaaaaaaacttgcacatgaataatccgtttgtttgaaaaacaaatatctaattttttacaagaatctttccaaaacataaccaatccaacacttaaaccaataagcctaccagttgacacatggtcactagctagagtttataatcttttcaatgaaccaaaaaatgtttcttaacgcggttttaggtttcgaaatataatcagaatattgacaaacatatgttcttctaatagcaataaattttagtatatgctctatacaaaataaatgaaagattataagatttaaatgcttatagatatatacaacacacacgtaaacatagttttttttttttgacataatacaatgatatatatttcttttaacagaatatttatttccttaactattgggaataatttcttttgaaattgatgacaaccaaaaaaaaaatcttatttgaaatttcaaatagaaggtgctgattcttaaagatttatgaatttattaaaaataaaaaatagtaaagttgagttttttgaattaaaaaaggaagaggaaagaaaagggatgtgtccatgattgattgaatggtgtgatttagtttttgaaaaatattattataagtttagttttttagttttctctctggattttcgctggtccgtcaatggtgatctgagacaatttcacgaatctaattggtttcgatgtgtgacagagagagacaacgagacgaatttcaaatctagggtttctcattttttgctcctctgttctctcttcttcttctcaatcctttattgtcgcgaggaagaggacgacgttgaatacaaggagaggacacaaggaaaagaaaagagacgaaagatg

SEQ ID NO: 17204 - DNA, 3000 bp, Unknown; identical to SEQ ID NO: 5045
  misc_feature (1)..( 3000): 2750-1469P.txt file - cDNA_ID_1808130; gDNA_ID_1620758; Annot_ID_49939

SEQ ID NO: 17205 - DNA, 3003 bp, Unknown
  misc_feature (1)..( 3003): 2750-1469P.txt file - cDNA_ID_1808137; gDNA_ID_1620775; Annot_ID_50271
ataaattccaatggattaattataatcgggattttataaacaccttgacgtgatccaacatatgtctattctctctcttgctgcattaagattattgaaacacatgcggaccaaattaaaagtattatagaataaatactatgaatacaaggcatatatactaatcaaacatgcagaaccatgatagtgtagcagaaataagactttaatgcagtatttacttatcgaaattatatggaccataaaaagtgtcaatgtgtgaataaaatccagttaagactctaaaatctaaattatgattttaaataacgaattttcaaggttttgaatatgatgcattaattgttgcaaaaagaggacaagaaagataggatgcattggatggagggaaagcctgaaagcactccgcaattaaatttattttcatttctttaaagttttagttatgtttttttttttttttttttatctttataaacattactgtatccttctttcgtaaaaaaaatctatttaaaaaagaacattcgcatgttatgctttttagccattaccaaaatagagccgaccagaaaagtattataagtttataacacaatatacagagtatttataaatcattttcgttggtataaaatgtattttcaacaattttgctttacaaattgatattctgcttgtttgttttatatcaatcatattgatcattttaaaaacactagtcagtactcagtagtcatgtatatttttgtatgtattaaacccatgcactagatcagtagtagatttttttatttttttttcacaccaatcatagttagttttagggtgaatctgctgtataaccaaaatccaatctaaaattaataatataacatcatattcaaaaatattaaaaaattaacaaattagagtagtgaaaagacaaaattattcaacggtgaaagatacgcgctaaagaggacgtgatgagatatgtggaagaagagagagaataatctaatgttataaaaattaatattaccccaaatgattttaattgttgaattagtgatataaaaataactgattaaattttgcaataggtttataaaaacatagatttttttttgagtataacatgattaaaaattttaaaatctaatataaattatttaaaatagtggataatgtttgtataaaacagacaaataaaatagtatagaataaaactaaatagtatagaacaaaacgtagacaatccaaataaccgaattaaaccgctttgatcaaaaaacactataccctaagatacaacattgacaacccaaataaccaaggtaaaccgtagcggtgacgttgacgatggtaagattctgacaattttttttacccattcgttaatcaatagtttaaatagacaaacaaatcgaaatcgaatgaattggtttgtttgtttgtaggataagttaatagaattacataaacattttctgggcaaatcaaagaaattggaatctttaatagactaaacattgatgtcaaggatatgagtgattgtccgttggagattctattgccttggtgatgcaaacggatttaggagagagagagaaagagagagagaggaattgtgacagttcgattgtgaacagtgaggggaagaagaaaagtggagaaaaaatatcgagaaagagagggggagagagaaaatgagaggagaggcaaaggggcaaaattgaaaatagtatatcaaatatagaatatatcatccatcttttttgttgatgtgattttcttaattataatatttttgtgcgttagttctgcaaattctccttagttttaggcaagtttgcaacacttaaactctaataccatctccattggagttttttataagagtttctcacaataaaaaaaaaaaataatgaaaatgacggaaataaagtgtagaaagttaattctgagatactctttacaacccatcatgacatttctcttctcactattggttcaaatttttaacaatttttttttttaaatcaaataattaaattataatataatattattattttttgtctaaaaaactttgtgggtttctcatagatggagatgccgtaaaacatatgagaaaacaaaagataacctctgacaaaaaaaaaattgaaaacagaagataatgttatcaagatgcattattatattggacctaaaacgagattatcaaacaaaatagattggtgcataaagcttgtgcatgttaataataggctacaatcttaaattcttataaggaatataactttttaaaatatgatttttggtaaaaactttaatttaatatttttctttggaaaataacattgggctattaaatttaatagtggtgaaagattcaatgcaagaatggcaccggatatgaggagattttcatatttacgtgcctaattaataatgtgaaactgattagccaattaagaaataaaatttgtattggggattttttttttgtttaaataattaagaataaacaaaaagagagaaagcaaagagacacacatgcaagcacgtgatgagtgcatgtctcgcagagtctcacgccatgcacatttcatcatatcaacttcgttgactccttctcagtatgtctttacctttttcctcttatcaattcaaattattcaatacatgttgatgttttaatttaaatgggctataatgaagtttatcagcccaataaggcccacttatagattggtttattttttaaaatttacaattgttatattggcccgttttaagcccattaagaatcacatcatcaagaaatccaaaatctgaaaagtatgtggctatgtggaagcagaggctggcgcgtgccttatctgcttctctctctccagtggtctcaaatctctctgtgtgatcccacttgtcatcctcctccacaacataaagcttgagaccataaccctttagcgttttcggctaaagctttcgctgactactacaacaatg

SEQ ID NO: 17206 - DNA, 3003 bp, Unknown; identical to SEQ ID NO: 17205
  misc_feature (1)..( 3003): 2750-1469P.txt file - cDNA_ID_1808137; gDNA_ID_1620775; Annot_ID_167685

SEQ ID NO: 17207 - DNA, 3003 bp, Unknown; identical to SEQ ID NO: 17205
  misc_feature (1)..( 3003): 2750-1469P.txt file - cDNA_ID_1808137; gDNA_ID_2926205; Annot_ID_141697

SEQ ID NO: 17208 - DNA, 3003 bp, Unknown; identical to SEQ ID NO: 17205
  misc_feature (1)..( 3003): 2750-1469P.txt file - cDNA_ID_1808137; gDNA_ID_2926205; Annot_ID_202143

SEQ ID NO: 17209 - DNA, 3003 bp, Unknown
  misc_feature (1)..( 3003): 2750-1469P.txt file - cDNA_ID_1808145; gDNA_ID_1620653; Annot_ID_47776
ctctctctatctctaaaagaaagagaagcaaaaaagtaaggaatgtttcctcgcaatcatcatcatcatcaccatcttcgtcttcttctttgaaacctccagcgacttcctcgtagttctctcacttatacacttactaatacagagtaacagagagagacagagtggactcttcttagagtaagatgggaggtgtgacttcttcaatggcggcgaagttggcgttttttcctccgaatccgccgtcgtacaagctggtcagagatgaaacaacggagctttttctaatgagcccttttccccatcgagaaaatgtcgacattttgcggctgcccacgcgccgaggcaccgaaatcgtggccatgtacatcagatacccaatggccgtcaccacccttctctactctcatggaaatgctgccgacatcggtcagatgtatgagctcttcatcgagctcagtattcacctccgcgtcaatttgatggggttagtaaatctcccagatcagatttttctttctatatttagctcaggatcttgctcagaaagtcctcgccttttttggttttgctctgttttctggatttgtgcaagtagatttgaagcttctagatgcagaattttggtcttagtgttagagagaagtggactttattaagctgtggatttgtgattcacaaagcttttgaaagtttaagttgcagactcataaaatcttggatttttgctggaagagtttgtctttagggtttgtctgaatcaggatctctactgatcctttatcaaagagacaaaaagtagttttgaggttgagatgtttgagtttgattgttgacacttgacaacaagtggtcttgggcaaacattaccatttctagaaattcaagatctgttattgtttctgtttctaaaggcaagtactgaatacccaaaatgtagttctttgatgtaacaactttttggctcattcaggtataacttgggattctgggatagattggtttctcaaattagtacgctatttttttctgtcgtatcttcaagtgaacctgaaattagtagaatttacttctgtaaggttatgatttccatcttatgacattggaaaatcctctaaatatgttgtggtgtttataggtatgactattcagggtatggccaatcatcagggaaggtgagtaaccacagatcctaaagctctcttagttctgagattcaaatgttggtccatttacactgtgaacaactgaacataaatctccattttgttgcagcccacagaacaaaacacttatgctgatatcgaggctgcttacaaatgtctggaagagaattatggggctaagcaggagaacattattctctatggtcaatctgttggtagtggtccaaccgtggacctagctgctcgtttgcctcgactaagagcttccattcttcatagtccaattctttctgggcttagagttatgtatcccgttaagcgaacttattggtttgacatatacaaggtgaacataatacccttttgatttctctacatgatgttgctgataaacattcctccttcttgacaccgttttgtttgatcttcttcagaacattgacaaaattacgctggtgaggtgtcctgtcctcgtgattcatgtaagtttccgtgatcaaagattattgattggaagaattgaagttaataaagttgaacagatttgcaagatccgttcattcttgtatgaatccttgtctaataatcctcagtgttagcttaaaggtgaaagcttttcgatttgcagggaacagcggatgatgtggttgacttctctcatgggaagcagctttgggaactctgccaagagaaatatgaaccgctatggctcaaaggtggaaaccattgtgatcttgaactctttcccgaatacataggccatctcaagaagtttgtgagcgctgtggagaaatctgcatcgaaaagaaacagttctttctcaagaagaagcatggaagggtgtgaacaacctcctcgtcatagtgtagatgctccaaggaagagtaaggacggacgagaaaaaccgaggaaaagcatagacagactaaggttccagggatacaagttgagccacatagagaaaccggagaagctgaaggttccatttgaagaaatggagaggtcaaggagaagcgtggacatatacagagataagtctcagccgatggagagagcacgtaagagtgtggattggttggacagaagtcgagctaccgaatgaaaatggagggtttgatgtcaaaagattgtatttgagtgtcgttcaatttattggggtatgtgtttgtattgtagtttgtatgccaagttaaaatacaacaggaagatagatttaaacaaagtatgataacttgtctgactgtttcccacacgacacttttgactggtttttagtttatttgacaagattcgtgtgctgtcgtcttgctgttgttgttgttcatgtgcaaacttgaagtgtaatagcctgcaaacagaatctccgatctaggaaccaactaacaataatcaacaaaaactctcgatccaacctagcacagaagcttgcactcgatttgctatagtgggtggaagttgtattgtacttgtatttgtaagaactaagaaggatccatagttttttgatcaaaaagaaaaaggaaaaagaaggatcaataggcttgatgattactgattatgtagatgggtatttttattggctttcttaggcccaaacaagggatctttatgggcttttattacattggtactgtcagagtcggataagactccgaccgaattttctaaccaaagtgagtctggttcgaaaagactgcttcaatgaagccaaaactatccaataactcgaaattgactactcttttcttttgtctctgttgttgattcgcaaaggcgaagattatccatcttctcagttactcctactggaaccaaaagctcagaaccttaaaacatg

SEQ ID NO: 17210 - DNA, 3000 bp, Unknown
  misc_feature (1)..( 3000): 2750-1469P.txt file - cDNA_ID_1808145; gDNA_ID_2926186; Annot_ID_140784
tctctatctctaaaagaaagagaagcaaaaaagtaaggaatgtttcctcgcaatcatcatcatcatcaccatcttcgtcttcttctttgaaacctccagcgacttcctcgtagttctctcacttatacacttactaatacagagtaacagagagagacagagtggactcttcttagagtaagatgggaggtgtgacttcttcaatggcggcgaagttggcgttttttcctccgaatccgccgtcgtacaagctggtcagagatgaaacaacggagctttttctaatgagcccttttccccatcgagaaaatgtcgacattttgcggctgcccacgcgccgaggcaccgaaatcgtggccatgtacatcagatacccaatggccgtcaccacccttctctactctcatggaaatgctgccgacatcggtcagatgtatgagctcttcatcgagctcagtattcacctccgcgtcaatttgatggggttagtaaatctcccagatcagatttttctttctatatttagctcaggatcttgctcagaaagtcctcgccttttttggttttgctctgttttctggatttgtgcaagtagatttgaagcttctagatgcagaattttggtcttagtgttagagagaagtggactttattaagctgtggatttgtgattcacaaagcttttgaaagtttaagttgcagactcataaaatcttggatttttgctggaagagtttgtctttagggtttgtctgaatcaggatctctactgatcctttatcaaagagacaaaaagtagttttgaggttgagatgtttgagtttgattgttgacacttgacaacaagtggtcttgggcaaacattaccatttctagaaattcaagatctgttattgtttctgtttctaaaggcaagtactgaatacccaaaatgtagttctttgatgtaacaactttttggctcattcaggtataacttgggattctgggatagattggtttctcaaattagtacgctatttttttctgtcgtatcttcaagtgaacctgaaattagtagaatttacttctgtaaggttatgatttccatcttatgacattggaaaatcctctaaatatgttgtggtgtttataggtatgactattcagggtatggccaatcatcagggaaggtgagtaaccacagatcctaaagctctcttagttctgagattcaaatgttggtccatttacactgtgaacaactgaacataaatctccattttgttgcagcccacagaacaaaacacttatgctgatatcgaggctgcttacaaatgtctggaagagaattatggggctaagcaggagaacattattctctatggtcaatctgttggtagtggtccaaccgtggacctagctgctcgtttgcctcgactaagagcttccattcttcatagtccaattctttctgggcttagagttatgtatcccgttaagcgaacttattggtttgacatatacaaggtgaacataatacccttttgatttctctacatgatgttgctgataaacattcctccttcttgacaccgttttgtttgatcttcttcagaacattgacaaaattacgctggtgaggtgtcctgtcctcgtgattcatgtaagtttccgtgatcaaagattattgattggaagaattgaagttaataaagttgaacagatttgcaagatccgttcattcttgtatgaatccttgtctaataatcctcagtgttagcttaaaggtgaaagcttttcgatttgcagggaacagcggatgatgtggttgacttctctcatgggaagcagctttgggaactctgccaagagaaatatgaaccgctatggctcaaaggtggaaaccattgtgatcttgaactctttcccgaatacataggccatctcaagaagtttgtgagcgctgtggagaaatctgcatcgaaaagaaacagttctttctcaagaagaagcatggaagggtgtgaacaacctcctcgtcatagtgtagatgctccaaggaagagtaaggacggacgagaaaaaccgaggaaaagcatagacagactaaggttccagggatacaagttgagccacatagagaaaccggagaagctgaaggttccatttgaagaaatggagaggtcaaggagaagcgtggacatatacagagataagtctcagccgatggagagagcacgtaagagtgtggattggttggacagaagtcgagctaccgaatgaaaatggagggtttgatgtcaaaagattgtatttgagtgtcgttcaatttattggggtatgtgtttgtattgtagtttgtatgccaagttaaaatacaacaggaagatagatttaaacaaagtatgataacttgtctgactgtttcccacacgacacttttgactggtttttagtttatttgacaagattcgtgtgctgtcgtcttgctgttgttgttgttcatgtgcaaacttgaagtgtaatagcctgcaaacagaatctccgatctaggaaccaactaacaataatcaacaaaaactctcgatccaacctagcacagaagcttgcactcgatttgctatagtgggtggaagttgtattgtacttgtatttgtaagaactaagaaggatccatagttttttgatcaaaaagaaaaaggaaaaagaaggatcaataggcttgatgattactgattatgtagatgggtatttttattggctttcttaggcccaaacaagggatctttatgggcttttattacattggtactgtcagagtcggataagactccgaccgaattttctaaccaaagtgagtctggttcgaaaagactgcttcaatgaagccaaaactatccaataactcgaaattgactactcttttcttttgtctctgttgttgattcgcaaaggcgaagattatccatcttctcagttactcctactggaaccaaaagctcagaaccttaaaacatg

SEQ ID NO: 17211 - DNA, 1432 bp, Unknown; identical to SEQ ID NO: 6386
  misc_feature (1)..( 1432): 2750-1469P.txt file - cDNA_ID_1808149; gDNA_ID_1621091; Annot_ID_55528

SEQ ID NO: 17212 - DNA, 3003 bp, Unknown
  misc_feature (1)..( 3003): 2750-1469P.txt file - cDNA_ID_1808149; gDNA_ID_1971789; Annot_ID_175526
ttctttcgccttcgttgcacccagaagaatttatcctcttttttgctttttttgtttctatttaaaaaggaaaaaaaaaattaagctaaccctagaagacgcaaaagcagacgtgatacgacaaaggaacgcgattgcgtgaagagacgagtgtcaaagtcgaagaatttatccgaagccgcaacaacaaaggatcaaacttctcttcacgaaaacctctttcaccactatacttaaacaattaatatcctcaattttcttcttcttcttcttcctcttccacttcgcttcttccttttttctaataaatttttgacattttcaataatggaaagttgcgcagaagcttctaatgtaagtttactctctcacgcaaacaccagagtcgaagaaccctttcgctcttcttcatctgttgtccaagacaagacaagataaagcctgttttgttataaaaagtaattattttaatttaatatttttatgggggaacggtaattctgtaagtatttcagtttcaccccaatagttttgtaaatggtttaatttacccctaacagatttaaaatttacacaaccggttacatttggttcggtttatttactttggtttttcacaaaaaaaaacacataacgcaaccataaattgtactgtatatggttttgagtaacggtatcaacatgaatttcgaacatgtaaaatcacattggatatacacaaaaataacaacacaaaagaataacaaaattatctttttggttcctaaaaaaatctgaatcttggcgatacggacaaacaaaaaaaagttcaatacaataaaattgtggagccaataaattactttcatttcttttgataccaaaacttataaccaaccttcaaaaccagcataactctactcgttaatcttgttatattcctagatttgaaccatcgtggccatataactgaaagctgaattcattgtgtaagtaacgtatgatatgataatactatatgtgtataaataggtggacacatatatgtatataaactaaatttggcatttcctatcatatgatatgataagcttgattggcatgtgatgtggattggaccacacaaacacacacacacagaagatgtccataggccataggcggtccattattattggtaagaaatgattaaattaagtatgcaaacaacttgacattgaaaatgatcttctgaaagtgatatttcaatgttttcacacaatcttgcccgtaaatggttgcatttaattgttactagatagaaaacggaaaaaaagaacaatttttttttttgtgtttttgtttttaatctctttctaattatgtttttgtgaataactgtgtgtttgattaatatattgttttcgagattcatcatataatatttgttacactctatagatgtgatagagttatctactacaccaataagatataagaaggccacattttgattgtaattgtatatatgaatatctgtggacaaaaaggtaacacttcacataattccaaaggctacgtaacatcagattggttgagcttccacatgggaattcggcaaatctgtaatcttctgtatatgccaaatatgtaattcttagacttaggaaaaaatggtcatctcttcaataataatacttctaattaaatggtcctcactaaaacaatgtttacttaataaaacgtataaacaaatagattttgttacatataaaagtataacctaaaatgcatgcagcaaatttctggattgttagcatatagctcagaacaatcggaaacaagatgtgctgccacctgaaacaaacatactaatatatgattattaagttgacatgacctaaggggaatctcgtgagattcgttttttgacaacttagctttggatccagaatcaaacatagcccacacaaatgaaaataggataacatggattccacaaactcttcacactttttatattatatatagtacttgtgattttataatataaaataaactatatcaatgatattagctagatatttaattcgcgttgaatgtggatactacaagagtttgatagattaaattgattcaagcaaatattttagtgggaatttgtaaaacactacatcttcgttatcgacttgggtatgagactaagagacaatatatatatattctattaaaaaaactcactgttacatgcgataaatggatgaataattcttgcttaattaagtttgagtatattactttgtttgtgacaaccgaaatagtgtcaagaacttcatatcactcggtggattactttatttgattgaatcttagttgataacgaaatcctttctttttctatgtatttcgattattaatgtaatcagaaaattttaagtattttttcacgttatccaactttgagagtactgtccttgtgttggccaataagtggttgaatatatggtaaaagtataaaagctcccatcatgttggacctactagctttgctatatataaaatgtcctgtcattgcataacgtaccactttctgaatctgttttacgtgcctatcaatgatttgtctttaacacttaccgtaatattctacaattaagttcaagtgcctagattttctaaatgtgtataaagacattatatatggcaaatgatcctttagataaccatttcatttaaatcaagcattcgattcgcattcatagataaaatactattcaccggtccagttctaactagccatccagtctggttagaaagcaaaattgtttattttattttaggttcagttttcagatcggttttctaacactgttttggtttggttctcgtatcggttcaaccggattggatagtcataaagaatttgaagtccttaattaagcccaaaacaagtagagcccatatatatactaacaaagccgtgattagggtttttggttttcgtcagaagatttcaaggtttagggtttctgcaattcaaccatg

SEQ ID NO: 17213 - DNA, 1432 bp, Unknown; identical to SEQ ID NO: 6386
  misc_feature (1)..( 1432): 2750-1469P.txt file - cDNA_ID_1808149; gDNA_ID_1621091; Annot_ID_170739

SEQ ID NO: 17214 - DNA, 3003 bp, Unknown; identical to SEQ ID NO: 17212
  misc_feature (1)..( 3003): 2750-1469P.txt file - cDNA_ID_1808149; gDNA_ID_2926198; Annot_ID_141393

SEQ ID NO: 17215 - DNA, 3003 bp, Unknown; identical to SEQ ID NO: 17212
  misc_feature (1)..( 3003): 2750-1469P.txt file - cDNA_ID_1808149; gDNA_ID_2926198; Annot_ID_201634

SEQ ID NO: 17216 - DNA, 3000 bp, Unknown
  misc_feature (1)..( 3000): 2750-1469P.txt file - cDNA_ID_1808164; gDNA_ID_1620769; Annot_ID_50168
gagcgtactcttcttggacaggggatggttccaaagcttccaggtcatagtcatccttgtgaactgggttttgttcaagagaatacatcttcctaatagtccaaccttgttgcctctcgaactcttccctctctgaatggagcaccctcatagcataagctaccccgctagtaagaggcctctcaaaggaagttctatcagtgtactctgagaatgttctctacacaaagcttcttaatgttagttactgttcactaatactcaagaagataggaatcaagctaccaagtgttagctaaatacaaagactgtaagcaacaatcagcaaaattgtaaatcctaactgaaattcgagagcaagttgaatgaaaaaagctaccatcatccaaggaccgttcatatactacaccgtaggaacaacttatgtactacaagcaagactagatctcaggcatcaatccaaacagattagaagacaagaagatgcggaatcgagaatacctgatcgatagcagaaggaatcttgccatggtggaaggttgagatcaagatagacatggcttgaacatgattcatgctaacgttgaactgatcctgcagcatacgagctctctcatcacacatactagctagcgtctctttcctcttctccatagcttgcgagctaaagtaccaaaacgtccaaatagagaccaagacccagaagacaacccaaaccaccacaagcttcctccaccacgccttgttgaatttaacagagccaagaaactgataagagaaactcgggatcttgagtccgctgctagagatcttattccagaaccacatcttgttcttcttcttcaacgtagtcatcttagtcttctcaagatcaccgacagagccaactaaaagaccagacttgtcctcgatcccattatcaacgaaccaagaaacaaaccagcagcatagcatccagaagagatgcccaatcttgacaccaaaccctagcacatggaacagactcatccaccacttgaatacacgatcaacccccaagaaacagagtgattgcaaccagctcaattcaactcagcaagaagctctaacaaccaaacagaaaccatgtacaaaaagggacgaatcagagaatcaaaaaggaagaattttttggggttgggtatttaataattaatccttgtaggcttcccacaaacgagaagagaaaaggaaagctaagacagaggaacgtgtcagattagacaacccaaaggctgaaattgagagatcaaagtggttacttaatcaaagatgacgaaagataagagagaagaaaacaaaaacaaaataaacaaaggtagaaactttgaacaggagcttaaagtttccaaagcgagattcctcgaaatctaaaacaggaaactaaaattctacaaggggagtacgaaaattcgctagagcttgctccaatacaacagaaatctttgagtgtgatgatgatgagtgaaagagagcgaataaagcaacgagaagaagaagaggagctggagacttgagtgaattatcaaatggagaaacttaagaaagaggagcagaagtagtagtagaagaagaagaagaagaagaatctatcatcggaaaagatgagaagaatatggtggaagacaaatgtctgcttccttctctctctctctctctctattatctgattatctttcttttcttttttcattcatacttccattaatatatattttaatcttaagctgcttatgtactcctaaaaaaaatacagataaaattcaaacacaaaaaattatatcctgctgatgatgatgttaaaactcgattctagaagaaaaatgttcatagttgagattctttgagtttgtttagtaagatctgatttttataaacaagtttagaacctcattaatactactattaataacaccaaatgattggtaaaataacttacctctatttatatataaaagaaaaaacactaaacggcgcaggcaaaagaaaaaaaaaggctaaagggacccacaagaagggaacaaaggcatatatggtctcagttctcaccctccaataataaaaataaaaggcgtgttacaatttattattatgaaaatggtttttttgcagtagttggtaaagtgaccaaaattgtttggccattttatcaaaactaaactacacaaaagaattatacaagttagtttaaccaaagcttccttctttagtcaaataactctatatatataactcggtttgttttttcaatttcaacatacactttcctttaaagaaaaaacaaatggctaaaacaaaatacagaatcatttattttcttggtacgtcatctgttttacacgtgtcgatatcttaaagcataatcatttcattttgtttgcaattgcttacataaatttatttttttaaaatgggattgcttgaaagttgaaacacaccaatcaacggttgttctctcacccatgaatcatgatcctttttcttccacctcgatcttccagattcaacacatagacataggatttaactcattttgttttagatcttttagaatttaaaggattactttacaagttatattataagagactttctttttatttcacaaagataaatgttttaaattttctatccaaaattaatatttcatttcataattttccatgttagttaaatgctttaaaatattatcttagttatatcagaatttgattaaaaatctttaaatggtgtaggaatcaaatgaagttagtcaatttaccaattgagctatactgttgattgtcccatatattaacgggcccaacttgaaaaatataaggcccatttaaagtatcgtcaaacactcatttcagtatctctagtcttggtccattcgtataatttttcagtaaattatctaaccctctcgatcctctctcgcctgttgaaaaagcacgacgcaagagctaaggatcaaaaaggaagacgaagaaagagatg

SEQ ID NO: 17217 - DNA, 3000 bp, Unknown; identical to SEQ ID NO: 17216
  misc_feature (1)..( 3000): 2750-1469P.txt file - cDNA_ID_1808164; gDNA_ID_1620769; Annot_ID_167422

SEQ ID NO: 17218 - DNA, 3000 bp, Unknown; identical to SEQ ID NO: 3317
  misc_feature (1)..( 3000): 2750-1469P.txt file - cDNA_ID_1808168; gDNA_ID_1620639; Annot_ID_47442

SEQ ID NO: 17219 - DNA, 2589 bp, Unknown; identical to SEQ ID NO: 447
  misc_feature (1)..( 2589): 2750-1469P.txt file - cDNA_ID_1808168; gDNA_ID_1591053; Annot_ID_150453
  misc_feature (26)..(26): n is a, c, g, or t
  misc_feature (1616)..(1616): n is a, c, g, or t

SEQ ID NO: 17220 - DNA, 3000 bp, Unknown; identical to SEQ ID NO: 3317
  misc_feature (1)..( 3000): 2750-1469P.txt file - cDNA_ID_1808168; gDNA_ID_1620639; Annot_ID_162981

SEQ ID NO: 17221 - DNA, 3000 bp, Unknown; identical to SEQ ID NO: 10397
  misc_feature (1)..( 3000): 2750-1469P.txt file - cDNA_ID_1808176; gDNA_ID_2213647; Annot_ID_132396

SEQ ID NO: 17222 - DNA, 3000 bp, Unknown; identical to SEQ ID NO: 10397
  misc_feature (1)..( 3000): 2750-1469P.txt file - cDNA_ID_1808176; gDNA_ID_2213647; Annot_ID_181463

SEQ ID NO: 17223 - DNA, 3000 bp, Unknown; identical to SEQ ID NO: 11443
  misc_feature (1)..( 3000): 2750-1469P.txt file - cDNA_ID_1808188; gDNA_ID_2214496; Annot_ID_133580

SEQ ID NO: 17224 - DNA, 3000 bp, Unknown; identical to SEQ ID NO: 11443
  misc_feature (1)..( 3000): 2750-1469P.txt file - cDNA_ID_1808188; gDNA_ID_2214496; Annot_ID_183845

SEQ ID NO: 17225 - DNA, 3003 bp, Unknown
  misc_feature (1)..( 3003): 2750-1469P.txt file - cDNA_ID_1808192; gDNA_ID_1620686; Annot_ID_48462
tgcttgtcttttatcaaaaaaaaaaaacatatacatgttaaaaatagtaagattataactaatctttccattaacatttctttctttttgactcttcggatgctcttctagccaggctctagccctctctaataatataactgatgactgtcacaatataattgatcatacatttgaattagagaaatataccgattagcagcatgatatttaaccaaatctgttggagtaagttgaatatgactcagcagttagcctaaaagtttttaagatatatacaacaataattaaaggcgaaaagggtgatataaaatatagctgaacagagtttaacatatcttatactgggaaaatcatgtgtataattatatatacaaacgtatggaaacttgtcgaatgagtccgtcttctaaaaaaaacaaatctcctgcaattaaagatgggttttcactattgtaactgtcgtagagaaagaaaaataattgatggtattgttgtctacaacaagttttttttttttttttgttgttgttgttgtctacaacaacaaactctatttaattcagttttaaacttttttttcaaataatttttgttttcttctgtccgttaattgataaactttaatttatgtaaataaattagttgaaactttaattttttttgtagtatatattttccattgccatcaaaattctgtagtgtatattagcgcgaaagatgagcattatatatcagattggttagttaacgtgtccaatatgcactccactaaggcactaatttagtttgtaattgatgtatcaagaacattttttaaaaaaaagatcaagaacattataatagcatatccttgccacaaacatatatgggtacatggacagctttgaacagcactgacctaatttaattacacacaaatttatttgactctcatactaattaccaaacgtcgatttctgaaataaatcatttaaatttcaaatcttaattttatttcgtttttgttaaccaaatagtataacaagtacagtatcaaaagtttcaagtttccttagaatgacctaatcactattcgatgtaccaacgtatctactaaacataatatgcatgcaatggcattattgcattttttgcacattttacaatttctttctgttagtgactaacaaaatggtgtaactgtttagtatttacctcatctcaatgatgatctggtccacatgctgccaccatgtgacccttactccagaatattcccagtctccaaaatccttcgtggagaaaatgcggaatattctactaaaccgaatcctttcattttattttattttttcctactcttttctgattatatttaagatccgatcaacttttcatatgggcgatcgagaaaacatctatttaatttgtagaactgtaaaagtgatataaaacccatgcatgtgtccatggtttgatagacatctgaatatatatcgaaaatgtgatataattctataaccacatttgccaatccttcttaccaaactaaaactaaaagtatgtataccatttcattttgttgtaatttttggtatctgaaaactgattatatttttttaacaaaccgataaactgataccgttaatatttatattagagcaattttttttcaaaatataatcagatcgaatcaattgaaataaggaagatcatattttccggcatattttcttaaaataagttctaactttcagctaatttcctccgatccaatagttgttttggtggcaggacaaggagtccccgagtacgcacgagccgggataaggcgtttaggacaaaagagacacgtgtatggctatcttccacgtagatgtctttgtccgcgtctaattattggcacgtgggtcctagtatccaagatcaggacgattctagcgagtcgcaagtgcttttcatgattaatcatattattatataccttttttcatgatcaatacgcatcttctttaacgaaaattaaataaaaacaagcaacagaaaaagtttcttaatcctgtggacgatcgattcaaccatacaaaataaattctatgtcaaggaacataaacatttttttttttgcatgaaaccggttaaatcatcaagaaaaatatgagaacttgtttcttaaatggtatataccgtccttgagtttcatttaaattttttgtgatggatattgtaaaaagtagtttgtaagcttgctaataatgcatccaaaaaggatatgtgacatgattaacaaaatttgatacaattgatttgtgataatgaaaacaaaaatacaactaaaagctccataaaccttgccttaagataatgacaacgaaaataaaagctagtttactgtctcggttgattggttgatcccaagttctcctttatcttagagcaaccataccactagacaaacgagaattaatttttttactaaaaatggttcaaaaaaggtttatttagtggctctaattgtttcgttaatctaaactatacacgctttatctagttttcagataatcttatttcaaattaagaattaagaaaatagtatagagataaatctaattgttaaaaatggattatagtacatactaattatttgttaaaaaaaaagcatcgagtatatccgaatctgtggtccgaagttgggacaagctgacataagatctagctgtctttagccatcagatccgacttagttcccaatcatatactgacacgtcatcttcttccaaactcaaaacagagcatcgaagcactctttcgcggcgccttgtatctgttttttctcccacctctcaggcgggtccctaaccccttatccgggtcttacttaagccttcaatttttctgactatatatatcccttccacttatttctattttcttcatcgaaacaaaaaataattaagagagaaaaaaacaaaaaacattttccatctctctctctctctctctcgcctgcttcaagaaatg

SEQ ID NO: 17226 - DNA, 3003 bp, Unknown; identical to SEQ ID NO: 17225
  misc_feature (1)..( 3003): 2750-1469P.txt file - cDNA_ID_1808192; gDNA_ID_1620686; Annot_ID_164622

SEQ ID NO: 17227 - DNA, 3003 bp, Unknown; identical to SEQ ID NO: 17225
  misc_feature (1)..( 3003): 2750-1469P.txt file - cDNA_ID_1808192; gDNA_ID_2926202; Annot_ID_141557

SEQ ID NO: 17228 - DNA, 3003 bp, Unknown; identical to SEQ ID NO: 17225
  misc_feature (1)..( 3003): 2750-1469P.txt file - cDNA_ID_1808192; gDNA_ID_2926202; Annot_ID_201925

SEQ ID NO: 17229 - DNA, 3000 bp, Unknown; identical to SEQ ID NO: 12704
  misc_feature (1)..( 3000): 2750-1469P.txt file - cDNA_ID_1808196; gDNA_ID_2214567; Annot_ID_134975

SEQ ID NO: 17230 - DNA, 3003 bp, Unknown
  misc_feature (1)..( 3003): 2750-1469P.txt file - cDNA_ID_1808204; gDNA_ID_1621104; Annot_ID_55942
agtatatatcaacatcatcatgattctaaagatgtactttgggttgaatgttgaaagtgacgatggaaagcatactcaataaccaattttcaggaaataaaatgcagagacgagtgtattacttaagtaaataaggcagagatgatttcatgtgatatattttatttacataataaatgttaattttaatacacactaaatattgttaatcgaccttcacaaatacaaataaaaagtattagtccaaggaagccgtatgtatgtaggaaatgaaaatgggtccccattttcgttggctagccaatacaagtgctcttaaaagctgattttccattatctctatatttccaatttttccctttgtcttaaaccgaaagtgatttttactttttagtttaagtggttaagaaagtaacgttttcaatcttttttggacagatttttgcctttggcatatactctttaacattgccatgttgatgaggcgacaatatcgatatttttttttttcacaagtgtgattggtaattatatgagccacacaacttttctcatttggaattcatagtcaatcgacagtgtcagttgcataacaaaattcatagtttgatccaatattaggtcattgaactgaagcaagtttcttatatagaaaagtctctgacaaaactagagtactcgaagatactagatcaaaaagagtactttctacacattatctccaagaaaaaaaaaggtgggtaagaaaacactgattgagagtaagagttcaatattcactcgaactcacttttggataagcgtaatcgagctaccaacgtgacaatgagctggaatcttgtactcaagacacaacaaggacaatacgaaaaaggcaaggagggagagaagctttgcatccccaatcatctattgtcgtttgtatgaaagggaacacacatgaagctctcagatgtgccaaacaagagagataaagaaagcttcacataagcatcatggtttttgaatgtgttcaaagtttgtaaagaatgagattttttgtgtgaatttggggatataaacgacatgtgaatatgtgataaactgaatatattaatttcgttctccttctacaatttaacagaattttatttttattatttttatcaatttcatacttgtaaaactctctgtccttctcttattgatatttgatttgatttttttgtatagtaaatatgttcatccgtgagagatgcatgtgagctttatatgttcaacaaaatttcaagcatatataatcattggctgaatccttacaaaaacttataacaatatgacttaaaaacggtattggatgttacggagactgaattattgaaaaataattgatcattagcaaataataaccaaactaattagtaaacaaattaaatatatttttttgtctatgaccgtgttccaagggagaggagaagcgatccagcacgcggtgagtaaacctcacgtgcgtaaaccttctcacaagattcttctttaacgtttctacgagactaattacttccttattcatccacataccacattgcctctcctgccgttttcacgtttactgctctaactactcgttgtctccatgtacttactttatattgtctacggtagtcccaagaccgcgcttattccgagattgatataggaaatacaagtatttaaaaaaaattaggattagtaaatgaggaaagaataatgagataatgagtgacactaagtatacaactaatacgtcacgattgtataattgtcccctacaagtagtcaaaccttagcccttttgaccgttaatatcttgcatttgacgataatcttttccgtgttttgatctgtttccactgtacaaaactaaacgttaataagctcagtattgggtacgttagtaaaaaatcaatcataaaatataaaataatctcactttaagctccaaccagagactgacagctgttagttagtttgaatactcaatagtaatcaattaggtttgaccaaaatagcttcataaattattcatcaatccaataagtcatttaagtgataattaccaaaaggcacatgatagctctctaaatatagatataccaaaatcaatccataccaaaagttgatgatttctttccctctacaccatcgatatgttgaatagtttagattttttccaatatttgtttaattattatttatattgcctttatatatcaaaagtgaaaaaatccaaacaaaatcttgtcaaagaaattaacactggataaatatttagttatttttggataacttgttttgaaattgagtttaccattccaaaatcagcttaactttgtccaaaaataaggaaaaaatcagtctatatttaacacatgtattctttgtaaagattaaatctaaaattctttaagacaaacttgtgtttttttttctgtatacattgtttccctagtattttatgtttcatcgtaatgcagcatcttttgctaacctctctagtaggttttaaacaagaatgaatattgttgacaataatatcataataaaaatattatactgtatacaacaactagacctaccactacgaaatgatttaaaacaagaagagagtacaagaagaatatgataaatttaattttaaaaaaattcaccgatcgtattgataaaaaagttgtatctacttttctctctttttacctcatcaattaaaaagttgactataaataacacattactatttcttctctctcgccaggcggcgttgcctacaaaaacctgacaatcgaaacacagtttttctgataataatatagacatttaccattatgcccttctaactgaaaacggcaattacgttccttgttatttgttttcttccttctccttctgtttcttttttgtggctttaatttttttcatattaattcggaaagagaaagactcttcactcccataacagtcgccggtaacagaatcactccgatg

SEQ ID NO: 17231 - DNA, 3000 bp, Unknown; identical to SEQ ID NO: 6212
  misc_feature (1)..( 3000): 2750-1469P.txt file - cDNA_ID_1808204; gDNA_ID_1620864; Annot_ID_51310

SEQ ID NO: 17232 - DNA, 3003 bp, Unknown; identical to SEQ ID NO: 17230
  misc_feature (1)..( 3003): 2750-1469P.txt file - cDNA_ID_1808204; gDNA_ID_1621104; Annot_ID_171517

SEQ ID NO: 17233 - DNA, 3000 bp, Unknown; identical to SEQ ID NO: 6212
  misc_feature (1)..( 3000): 2750-1469P.txt file - cDNA_ID_1808204; gDNA_ID_1620864; Annot_ID_170422

SEQ ID NO: 17234 - DNA, 3003 bp, Unknown; identical to SEQ ID NO: 17230
  misc_feature (1)..( 3003): 2750-1469P.txt file - cDNA_ID_1808204; gDNA_ID_2926184; Annot_ID_140716

SEQ ID NO: 17235 - DNA, 3003 bp, Unknown; identical to SEQ ID NO: 17230
  misc_feature (1)..( 3003): 2750-1469P.txt file - cDNA_ID_1808204; gDNA_ID_2926184; Annot_ID_200501

SEQ ID NO: 17236 - DNA, 3003 bp, Unknown
  misc_feature (1)..( 3003): 2750-1469P.txt file - cDNA_ID_1808208; gDNA_ID_1620636; Annot_ID_47376
caaaaattcttaagacttcaatattatatgcacttatgctatgagcaaaacatgaaaatttcaagaatgtcactttctcagcaagaatatacactgcaactagagttctgcttacccaagaaaactgagcattgcggaacttgttgtcagatccagctaaatgtgcatcaagaggcctcaacttaagcaaccttggtgcggcaatcttatttcccatgcgaccctcgaagccggtctttgttttgccacttttgtcagtgaaaagggtacagataacaatcaaatatgtgtcagttgtaccaacaatccatttcccatcgaatgtagcatccacatgagtaacaggtgcaccaagtccagggaaagccgtctttgcctgcctcatagtgttgctcgagtagagtctaattttgccatcaagagagccaacaacaattgagccatcaccagtagttgcaaagcactgaaagttagtccctctagaaaactgatgcccctgtgcccaattcaagactggagtattcgcagtagcaagatcctgaaccatcccatatcggtcacgcatatcccacctgcaaagcctattgttatccagaccaagaaacgttgacgcagatggatccaattgagcacctttaccatcattagtaatgtcactcatagagatatccactccatctttctcaaacttccactctgaaataattttcccggtttcaatgtcaagctgatggatacctcgtgaatgaggcgtttggctcataggactcatgagcagcatattagtctcagctctcatgagaagagccttcttcggtgctgaagaatgagttcgaccataaccaggctcaaagttaacacaaacacctttcccttgaatcccctgtctcatgttcttgaaaacctgaataccagaatctccaactagaaagctattatctaaagcacctagagctaagctatgtatgccctcacttgtagcttcttcaaaggcctcagtcaaatcctgtgtatctctagccggagttgcagatcctcctcctgggctttgaagcaaaatatcatcagcatcttcccacatggaatcatcagcagcttcaggattagcccacccaatgaaatctttcccatagatttttgccttgttagcctcattaaactcaacaccatgattgttctcaaacaagcaattgttatagctgcttacaaaaaccgaaaaatcttcactgctggcgaatttcatagcccaaacagctttagcaacgaaatcaacacggcgttgatctttataagctttcaattgcatttcatctgataccttttcacggatcttgcttccgactttcaaaatccaccattcgttttccacatctccgttctcatcgtcgtcttcatcatcttcatctcctttgttagtcttgacgaaacaataagcagtcagtttctcagctgtgacccatttggctttgggagtgttgccattgatgtagcggaaaagccgagctgagttctgagtagacggggctgattgcgtcaatgggtatttcagcttcagggcttggagttttgcctcaacgtcgtcgagtgatgatgaaggagatttaggccggagacgacgaccaccggaggaagatatacctaacgtatcatcccgcgagtcctgaaacgtctcttcctcttcctctccctctcttccttcttcatattcttcatattcatcttcatcggaggaacagatctctagatcttcatgactgtgagatgctcccatatcgaagaatcctggaaatgggaagagctagagagaataacggcaatgagattattcaaacgaaggtgggaagttgaagaagaagagagaagagcgtaaagttcgaattttgaaaattagggtttttcaaaagcatgtgttcctgttcccctttggacagattgaagttaaccggctatagcccgtaaatgcggatctgtaagtactttcatataccggctatagcccgtaaattcggatctgtaagtactttcatgtaccggctacagccagttgaaatttttatgatttgtggttcattcaaattcaaattagaagtggtccgatttttaagaagtacggttatgttgtgatttggtgatgctgtaacttcgtcttaaatatgttgtcgttttgactcgcattacaatatgttatcgtttaatttacgatacactgtaattaattaatagtttcaatattatagaaacgtttggtcctttagtcggagagactgatatgcgacagaggatccaacgtcgcgactgaaacctagatcccaattctccgtttccaccactgtctctcctccgtcgttagggtttctcaggtgacacactccgcttctcttcttttccgtcttgatctaatttttccgtcaattggtttctgcaatctctacgtttcttctctttcaccttagatattgcttgattcccacattaattgttgctgagaagtataattaatttcttgatcgaatttaccagttctcaaagttttgtgtccgttgagtacaacaaattcctcgaaattgagtcattgattgaaataccaacttaatttttgatttctgggtttgttattaaaatgtagacacacacttggataactgagtttccttaacttcaatctggttataaacaattttaaatttaccctttttcttaaagaactcaactttagcttgaggtctgaatttttgtgccaaacatgtacttagtagcttagtaaccatgtcttgtgaactattatctttcttgatgtcccttgttctgtaaagttcgtaaaaacttaatctttttggttttaaggtggcttacatgaggtttgttggtgtgattttttattttacaggttcacatctgttggaaacttattgcaactcctaaaggcatttcacatatttgcttttatgcgtacgaggcttgggggatatttatataatccgaaataactcttttcttatcatg

SEQ ID NO: 17237 - DNA, 3003 bp, Unknown; identical to SEQ ID NO: 17236
  misc_feature (1)..( 3003): 2750-1469P.txt file - cDNA_ID_1808208; gDNA_ID_2926204; Annot_ID_141649

SEQ ID NO: 17238 - DNA, 3000 bp, Unknown; identical to SEQ ID NO: 11505
  misc_feature (1)..( 3000): 2750-1469P.txt file - cDNA_ID_1808219; gDNA_ID_2214499; Annot_ID_133632

SEQ ID NO: 17239 - DNA, 3000 bp, Unknown; identical to SEQ ID NO: 11505
  misc_feature (1)..( 3000): 2750-1469P.txt file - cDNA_ID_1808219; gDNA_ID_2214499; Annot_ID_183928

SEQ ID NO: 17240 - DNA, 3000 bp, Unknown; identical to SEQ ID NO: 6598
  misc_feature (1)..( 3000): 2750-1469P.txt file - cDNA_ID_1808227; gDNA_ID_1621098; Annot_ID_55791

SEQ ID NO: 17241 - DNA, 3000 bp, Unknown; identical to SEQ ID NO: 6598
  misc_feature (1)..( 3000): 2750-1469P.txt file - cDNA_ID_1808227; gDNA_ID_2926166; Annot_ID_139930

SEQ ID NO: 17242 - DNA, 3000 bp, Unknown; identical to SEQ ID NO: 12532
  misc_feature (1)..( 3000): 2750-1469P.txt file - cDNA_ID_1808235; gDNA_ID_2214557; Annot_ID_134794

SEQ ID NO: 17243 - DNA, 3000 bp, Unknown; identical to SEQ ID NO: 6829
  misc_feature (1)..( 3000): 2750-1469P.txt file - cDNA_ID_1808243; gDNA_ID_1621108; Annot_ID_56019

SEQ ID NO: 17244 - DNA, 3000 bp, Unknown; identical to SEQ ID NO: 6829
  misc_feature (1)..( 3000): 2750-1469P.txt file - cDNA_ID_1808243; gDNA_ID_1621108; Annot_ID_171663

SEQ ID NO: 17245 - DNA, 3000 bp, Unknown; identical to SEQ ID NO: 6829
  misc_feature (1)..( 3000): 2750-1469P.txt file - cDNA_ID_1808243; gDNA_ID_2926207; Annot_ID_141799

SEQ ID NO: 17246 - DNA, 3000 bp, Unknown; identical to SEQ ID NO: 6829
  misc_feature (1)..( 3000): 2750-1469P.txt file - cDNA_ID_1808243; gDNA_ID_2926207; Annot_ID_202320

SEQ ID NO: 17247 - DNA, 3003 bp, Unknown
  misc_feature (1)..( 3003): 2750-1469P.txt file - cDNA_ID_1808251; gDNA_ID_2214526; Annot_ID_134150
aattattctatattcaatgtttgtcgtttatggatttgcaaacatttacaagatcatgcacacaacacaacacgtaactataagcaataaataaaacaagattcagatttaagataattaatcgtttttagaggaacggaggaaagaacatgtgaaaacaactatgagaagaaaactcagtactatcgatgatactaccatcaccaagcttgaacatcttaacagcttcatcattcattccatcattacaatattctccatcattatcatcgaagtagatataattcttcaaaagtccatggtactcggaactctcatcatcatgcttgataaattgatcagcttctgcgccactctgatacgttcatgagaagttggcacgtgtgagaactgaagtgagagattggagtcacgtgtgaagaagattataaatagtaagagagagtagagagaaaagcatcctgcgtgatcattgatgtgtaaagaggattagagctttatgtgctctgttcttgggagataagattggagaactgtaactccaagcttatcgatttagggtttgtttcattgtaattgggattttaaggataagaaagagaaattcatagtttcattcttatcacactctttcgcacattatcaacgaagtagatagaattgttcaaacatccatggtactcggaggctacaacagtaaaacaactgtccctagccacaatgagtgccttgtctcccaaggacctaacctcaacccattttgccacatactcgtccatcttataaaccttaaaaccaactgtcctttgactccttcggatataagctttctttaagcgaagttgatgaataatgcatagatctccacaatactcaacgagtctcttgttgcaactatcatatccgtcgtagtccattggaattgaaggtgtgaattgaaggaggctgagcggtgataaactaatccaccaaattgcgccggttaggtctaaggcatagacttgtcctttatgaagtataatgtccaagaaatcttcaacttggtttttgatttttgtccatattctactactctcttctccactcttgcagcaccagattttgtcatcctgtccgactgcgaaaatcagattgtctaggaaaacaactctagacaatatatgtgatggtccttctttacctatcacgccttgtattaaatacttatcaaatatatgaatctcgtaagattggcgaatctctgaaacctcaaatttcaaaaggtctagggtttgttgtgaaggggttaggagctggcgaaagaaaggagacaagagattaatcttactggattcagagacttgtttggttctgatcagccatcctttgtaagaacatgaagaagggccagttacacggaagaaagtggtgggagagagaacagtctctatcatcttgttggaggaaggaaggttgcattgaaagctcttcggtgtcgcagccgccgaacgccagggtttacagatgctacgtacacggaggacgtcactaatggaggagaaacggtttgcggttaaattgatgaggtctccaggtaattcagaccactcaggtttttccatctttgaatcaatcgacgatgtgagagcgtgatcaacatcggctcgccctctctgttataactccatatatatacacaacaaaacttaaaccctagatacttgaggacttacgtgggctggactagaatccatccaattcctagttggattttcgattagctattatcacgtgagtaatatctgcattacatgtattgacttagtattattgttggagcaatgttttttttttgttaaaaattattattggagcaatgttttgtttttgttaaaaattatttgagcaaaccaaaaaatcgcagaatgaattataaaacagttcgtatttcgatgaaatttcgtctctccctctcaatagctttggtgcaaattaatacccttactacatacatgtcaacttaactctaattctaacaaatagaacagaaaatctggagagagaaaaaaaacgtaactagatgaaagaaaagaaaaaaaaaaagacttcaaaatttgtataaaaatatagaaatgttgaacaaaaattattaactctaaaccaaaaattaagacaatgatctaatattctaatatcatgaatcatgatagaaaaggaacacctaactccataaatgatggtcatgcaatgatcaaatttctcctttatcaattattggtttatattccaatgtccaaactcgaaagtcgaaacaatctcctccatatatagccatttctttccctaacccattaaaatacaaaactaaagaaccatcaataattttttcaactgaaaaaggaagaacaatttgtgatccaaaataaaagagagaaaaaaaaaagtggagaaaggagaccaaaagtagaagcgtggtttactccaattgacggtaaacccctttgacaagtagaggcacttgatagtagtgtaacaaaagtacaacgatgggtgaagattggtcaaacatcaaaaggaccccatactcaaaagatagtattctgtttatttataatcatatatttacaaaaaactaacattcagaatataaaaatattagaatatgtaaattttgcaaacatagaggagtattaaatatagttaaatagtttcgaattaaacactaaataattaaatgttgacaagaaaaaaaaacataaaaattaatacggattccgtgcgttacaataacttagcaatattactctctagtagagatgagaacttgagtacttgactaataatttcaacgcatgttgtcttcttgcgaaatagtcccacgctattctaaaggtgggctagtggaaagagtgtagaacccacttttcaaaagcacatcaactactatataaattaatgaaccacctaacaaacaaacccacacattaaactaaagaagagagaactttagaggttagagagatg

SEQ ID NO: 17248 - DNA, 3000 bp, Unknown; identical to SEQ ID NO: 12190
  misc_feature (1)..( 3000): 2750-1469P.txt file - cDNA_ID_1808260; gDNA_ID_2214536; Annot_ID_134383

SEQ ID NO: 17249 - DNA, 3000 bp, Unknown; identical to SEQ ID NO: 12190
  misc_feature (1)..( 3000): 2750-1469P.txt file - cDNA_ID_1808260; gDNA_ID_2214536; Annot_ID_185092

SEQ ID NO: 17250 - DNA, 3003 bp, Unknown
  misc_feature (1)..( 3003): 2750-1469P.txt file - cDNA_ID_1808283; gDNA_ID_2214559; Annot_ID_134868
tcagaatccaaatcatctcatgcatattcgttactacgatcactgactacttagaattctcattaaccgaatctattacacaacccaagaatgtatatactgaaaaacctaacccacatattgaatactgatcgatataatatacatatttttatcatcaaaaggagattcacaagattgaatactggcaacgctgatcactacttaacaagctaaacattgtttagtaattgattaaaaaaaagaacatggtttagtaatcatttgaatttgttcatgaccaatttcttattcacttgtacgtctttcagcagctattaattatctatagcttgttgtcaatctccatcaacaatttttcaagtttcttacgtttgtatatatagatggatctcgattatctaccatgtcttattcaaacaatctgcatcaaaagccccgtatcttttaacttttcatatgctacatataatttgattcaaaagtattcaatgcttttgcgttaaattagctgttctaattcatataacgcatactatatattaacaaaaactctcctactatctttcaattgctttcacaaaacattttttctacttttccacaaattataaattcacgaatactatggtctatggctgctcgcgctctatgtaacttttggagctagagcttaaatggtatggtgtaaaaatgcaatggtctaaaggccatgttttatataaaaaaataatttaatgtttggcgtcaaagggatgaaaccattatatatatacgctactaattagtaaattcattatgcacgaaagaaagtcaaacatgattgataagtagcttcttgttttggtaacgtattttttttggatttaccaaatatagaccaccatattcatgattccaagtcatcaaaaaatgactacaaaatcatgattccaagtcttttatttgggaatatctaatcatatacgtaatcgtaatgtactaatgtggattggaaatgttagtgcaaaaaagtcttgtgacacctgatgtaacaagtaccaaccgacgtcgtttaatttatccatcagaaacatcacaggtaagaagcaacccaaaaacatcgtcgtatttgccatcaaatgagtaaaggcaattatgtgggtctttaagattcaaccaactacacagcaatggaacggacgggttcgcacccaaagcccacccaaagcccaaagggtctcgagagagcttcaaggaaacactttgcaacgattacctaatttccaaagattacctgatacctttggtatgatcttttagtctctactgatgacctaattatcgagtagacatattatataattggttttgcaagagaatggcctagtttcgcagacttttacattctcggtaacaatcttatcaaccgatacatatatgtttgcattatgtttttaaacattatcgagtagacatattatatatcgcttatttcacaactatttgttactctacaactatcaatcatttcctgaaagagtagaacactgtgaagatataaacactgagagcagaagagaccaataccacaagcaccagcacggtatgaatcgccaaagcattgccgcaagagagaagccccagacggagttgtataacatcaacaattgacaacagaagaaatacacaacccaagatagatccaccagctgcaccaaccacaccgaaacgaagcacatctctgttgatattcgctttaaacacttcgtccgtttctttgctgttcaaaaggttgatggctagcttcatcccttgagccacaagggaggagaagagaaagaaggcaaatgagatgacttcaaacacaaccaggtcacgttccacgtctcgtcctgcactgcactctgttctgtccgtgagggtgaggtcacttggctggtcgaaggagattccgacaaagactgcaaccgtgaagagagaattagcacttacaatcccatcgagagccgtaacatgaacactcgtggttgaagtagttgaatggctggtgttgctattgctattttggttgctgctcgtctctatgtcggaatctgccattaccaatgaatggatctctctttctttcttttttgggatagctaaaagcttctttctaatggtggatcataatcttctgttgtgttcttatgattcccttttgaatatgatttggtaatgttgtttaagagtgggtggtgtttggtttagaacgattagccttttggaaaacgatagctctatgttaattgataatttaatctttttcaagtcttggaaggtacacacacctttctccttttgttatgaaagaaaatggtttcttctagtaaccaaaattttgaactttattcacatgtaaaacaacacaatcttgtagcaaatttacacgttaaatttaaaacggtgttgcgtatttgaagagacaatatcctaaacgttatcatattaatattatttttgttatttttccgtcaaacaccatttttattaagttatcgaaaagatactatccgttagagaaaactattaaggaaccgacgtgcttacatgagagaaaataacattttcagttttaacttttttggctaaaaggtctactcgagtgttaaatttttgagaaaaaaatctaatacgaaaaaaagaaaaataaacaataaaacaccgaaaaagaggcgaattccgctgcaaaagttggctaatctttttggttatccagaagagatatcaaatcggagcatagtactattattaactttgttttaacctaagcgatgtgggataaaaatcctcttaacaaagacaaacaatcaatgacgtcatcaatccaaaaattggcatgtcctcaagattaaaaagacagtcttagctgacgtggcctgttctcaagttttaattggctggagaattcaagaggatgaaacatagaaatcctctttgactaaaatattttaaaccacacaagagaaggaggaggcaatg

SEQ ID NO: 17251 - DNA, 3003 bp, Unknown; identical to SEQ ID NO: 17250
  misc_feature (1)..( 3003): 2750-1469P.txt file - cDNA_ID_1808283; gDNA_ID_2214559; Annot_ID_185855

SEQ ID NO: 17252 - DNA, 3000 bp, Unknown; identical to SEQ ID NO: 12544
  misc_feature (1)..( 3000): 2750-1469P.txt file - cDNA_ID_1808299; gDNA_ID_2214558; Annot_ID_134833

SEQ ID NO: 17253 - DNA, 3000 bp, Unknown; identical to SEQ ID NO: 12544
  misc_feature (1)..( 3000): 2750-1469P.txt file - cDNA_ID_1808299; gDNA_ID_2214558; Annot_ID_185803

SEQ ID NO: 17254 - DNA, 3000 bp, Unknown; identical to SEQ ID NO: 12747
  misc_feature (1)..( 3000): 2750-1469P.txt file - cDNA_ID_1808306; gDNA_ID_2214569; Annot_ID_135025

SEQ ID NO: 17255 - DNA, 3000 bp, Unknown; identical to SEQ ID NO: 12747
  misc_feature (1)..( 3000): 2750-1469P.txt file - cDNA_ID_1808306; gDNA_ID_2214569; Annot_ID_186116

SEQ ID NO: 17256 - DNA, 3000 bp, Unknown; identical to SEQ ID NO: 4384
  misc_feature (1)..( 3000): 2750-1469P.txt file - cDNA_ID_1808321; gDNA_ID_1620703; Annot_ID_48820

SEQ ID NO: 17257 - DNA, 3000 bp, Unknown; identical to SEQ ID NO: 4384
  misc_feature (1)..( 3000): 2750-1469P.txt file - cDNA_ID_1808321; gDNA_ID_2926174; Annot_ID_140267

SEQ ID NO: 17258 - DNA, 3000 bp, Unknown; identical to SEQ ID NO: 11235
  misc_feature (1)..( 3000): 2750-1469P.txt file - cDNA_ID_1808325; gDNA_ID_2214485; Annot_ID_133351

SEQ ID NO: 17259 - DNA, 3003 bp, Unknown
  misc_feature (1)..( 3003): 2750-1469P.txt file - cDNA_ID_1808340; gDNA_ID_2926128; Annot_ID_196760
catttcatgcaagaaaaagccttggtttcatattcataaatcataatacaatataattaattaattggaccttttatttttatactttattcaaagttagtctaatacttttacgccacatatattctaaatcttgagtaattaaaatgaatgaatatagcaatgatctacatgtgatttagctatctctatattaaattgaatataatgtgaattttttttttgtctattggtagcctaatctggaatataagatttccaaataaaatctcagaaaataaagctctataaatttacaagtcaattagctatctctattttaataattgaatatcatatgcttttgcttcaaaggcatgtttttcaacaatgtgaacatctcttttcaccttttctttatttcattgtccttgtccgtcaccaaccaatcatacacttttttcccattgacatgttcttctatgattggtttctttccatcacagtcagtatctttatctctttgacgtacgtttcaatcttcttctctaaatcccgccctcgcgttccacgctaacacctaattctaatatatacaaatcatataaatagccatttttatatcctctcgtaacttttccttctttctttctccaaatttgatcgtaaaaaagattcctatcttcttcaccattcttttcttgaaaaagaatcatgggcttatcttatagcggcgccggagttattatcgccggagttatcttgaatgattttatcaaatcagttcgttcttttcttgatattcgtcgtttgtttggttcggcatcttcagggagcactatcatcgacaagattccgatggacgatatgcttccggcaacaaagttcgaggatatatcatcaagggttaatccgccggagagctgccggatatgccaagatgagttcgacggcggtgacgaagtccggtgtttgaggaattgcgtacatgtttatcacaagacgtgtattgaccgttggatccaagacgataagatgacgtgtcctttgtgtaggaccccgatcgttcctgatttctatttttttcgtttgtaaattagaaaagctaaatgtttcattaatcagattttttttcagcaaatagatatcaatcgttcactaataaaaactaattttttgtctagtttatttatttagttacttcccataattcatttccgtttaaaaattatggttatcatagtcctggacgttcggttatccattcgatttcggttatattcattcagttatcggtttgttgttctaaaggtattcattcagtttggtttcgattctttcggttttcagatatttttttgattattttcaagtatttttattattttatatatattctcaagtatttttaattatttactttagaaataactaatacttttaaaattttgattgatgtttcggatattttcggtttgtatcaattcggtttcggttatttcagttatagaatttagtatgcattcgattagtttccaattttcggttcggtacggttcattatttttgcttcgatttcagtttgatatattcggttcagaatatttgttcagacttagttgataattgagaactctttctcgaaacgtttaaatattaaaagatcacaaaatgggataaacaactacaagaaaattttgccttaatcgacgtcacatgtaaacaaaagaactaaatcggattcaatgttgggcctttcttgaagcccacatgctatttgggtcaaaagcgccaagacccaagacatatctcttaaaatctttgaactttttgagttttgatcacataagaatttacgataagatttactcaccacgagaacacacacgtggcagtttcactgattaaataacacatttggtgtattcactaatatcaaataaatgacgtcatttcacgcttctaatttatttcctaatgtacatttagtgataaaaccctacatacgtgttagagatacggccccgtgcacctactcaaaatagtaaagtcaaagaacgaccgtcagattctatgtctccctcctcagcttataatcaaatcgtggccgttgattctcttttgactcagaacgagcattaacggtgacctttttatccgacttcaccaccatcgttgccgccgcattcgatcgatcactaatcacaattctccagctcaagtgggacattcgtgttcgccactctctcgcctgtcacgcgtgtctctcacgctccacattttttttaatccccttaatcacacgatcttaaggtgtctgatttcactaaaaacatcggaggcaaaaaatgaaaaatcccatgtgcatgctcagtcaaactcacccctcacgtgacacattgcctctatcacgtgatagacgagtaccatttctagatacaactaagattcatatagatcctttaggatttatttttttacagtgttgtatgtttaaattgaacacatttatgccgttgacaaaatttaaaagtaaatatgaggttgacttttgatttataacagattcgtagtatagaatatttacaattgattgaccaacaaaaatgagcaaagatgttaccgtgggtcgattctttacctgggaacttaaatttggtaaaaattagcggcagcttttcttttttaattatgcctactactacatcagaggggtattatagggaactagagtaaaacctaaggacatttccgaccaatgaaaaaaacatggaaaatataagaagggctgagaaaagcaaacaaaaaaaaagttttaataaaccagagaaaaaaaagaaccctcctatcgagttctgtgagatctgcttcaaaagaaaaaaaaactggtggagaagaagaggtgaatcgagttataagcttacgtggtgatgtaaaatatttatatattgagcattttatacatcttcttcttacttgtgtttggtttcttttgggccaaagtattgttttgggtaaaaaatg

SEQ ID NO: 17260 - DNA, 3003 bp, Unknown; identical to SEQ ID NO: 17259
  misc_feature (1)..( 3003): 2750-1469P.txt file - cDNA_ID_1808340; gDNA_ID_2926128; Annot_ID_138680

SEQ ID NO: 17261 - DNA, 3000 bp, Unknown; identical to SEQ ID NO: 7697
  misc_feature (1)..( 3000): 2750-1469P.txt file - cDNA_ID_1808340; gDNA_ID_1621157; Annot_ID_57056

SEQ ID NO: 17262 - DNA, 3003 bp, Unknown; identical to SEQ ID NO: 17259
  misc_feature (1)..( 3003): 2750-1469P.txt file - cDNA_ID_1808340; gDNA_ID_1972020; Annot_ID_178027

SEQ ID NO: 17263 - DNA, 3000 bp, Unknown; identical to SEQ ID NO: 7697
  misc_feature (1)..( 3000): 2750-1469P.txt file - cDNA_ID_1808340; gDNA_ID_1621157; Annot_ID_173577

SEQ ID NO: 17264 - DNA, 3003 bp, Unknown
  misc_feature (1)..( 3003): 2750-1469P.txt file - cDNA_ID_1808354; gDNA_ID_1620630; Annot_ID_47235
ttactactaagtctactatagtagatatatcagtacatttttatttatatatatacattttcattttaatgcaaacaaaacaattactatatgtttcccactgacgagtaaaaaacttaattagattcacagagagcaaataaatataacttgtccttctaatgtatggccgagtgggcaatggcgaatgatgatccatttttgtgttgtcaaattatcgttggttatgaatatcggtttccccatgcaatttattgtttcgtatactaaattctttaatatgttaccaagaacgtgaaatcgaaatcgagataatgtgtaacacataggcaagccatgtaaattatgcagtcataaaagagacgatacgctaaccaagaatcaatatatggtttcgagccttcgattattagaaagataacgaccacactactattggttctacatgttttatgtacataaaatcaaatcgggaccaaataaaagaaaaactgaaatggaccagccaatataatgtatatattctttaatatcagttgataaaaaaaataacaggaaagagcaataaaaacatagagccatgacattatgtcttcatcattatcagccttaaacgataacaaaattataaagctctagaattcaccaaatatacccaattgaatttctactagtacctaaaatcatagttacgagggctaatggacttctcataagacttatcttacgcatcatttggatcctctaatatttcgcacactattaagtccctagacgaatcgaaccaaggaaatgcgtaattacctttttaagaagaattaatgcacctaacggatattgccgctcaacatagagtggttaatgttcttttttgccaacctgtatttccatttactgaagaaataaatttgacacaactaaatctttgaaaattacaatattttataaagatttacagtttttgggttttataaaataaataagatttgacaaagatagttatgaaaagaaggatgaaatacggatgtcttttcatgaagatttataaagagtactaataacttcatatcttatgattagaaatctaactttgaggcccttgtgtaccttcgaatatagctagtttatagtgacgggacccttagcataaccaaaatcactgacaagccatagcattccacgtggttaagtccatctatactctcattatcatcttccctccggttcgggttcacgatactggtttagcaactaaattatcaaactatcaccagtttcgtagaatttattcacactaaaaccaattatacgttaaatcattcgttagtcttgtaacttttgttattacttattaaacgccatggcgatgttgggtccactaaacagcgcagccaatcacataaataggggaacacgccagttagattgtatttttaataactgttgtccaaacgtgtaatctccaatattttatctgttccataatgctaatgacaaacagaatagaaaatgagagagctatagaagtcatatatacagatagatataattggactcagattctatgtatatagttgaagatataataaaagataaatctaaaataccatactttgaagaatcagagaagaaagaaaacagcatggccatttgttggcactaaataattagtttatggacacaagtaagacaataaactgtactgttatagtgttttgtagtcaaaagtgttccacacttcatgtgactacaccattacactcattacaataatcaatagaataccaaccaactctataatataacgtgttaaaaacatgaaggtgttaatatttaaataatagggcacgatgtttatatgcgttcttaagtttttctttcagtagttgtgtcttgtatatcgatatatatgtagtggtcttacaaagtaggtgtatgtatgaataaaacaatgttaacaatctaatcaaattattgtttactttggagtaaaacaagaaaaaaactcaggttgattatgattgaaaataggatcaaatgataatggataacgcatatatatgtgtatgagaatgagatatttgagaaattttattttcggtagaaatttgcacagaaacgtttagggaaaatgttatatgaaaaaatagttagaaaaaaaaatttagtgaaaattatttactttgtttgtgattatcttcattagatgtcatatataaatatggacatatccatgtttttctaaagtgttggcgctacatcaaccaataacacgttttattgtttgatctgtagtaattagtgagtagtaaacaacgaagcataaagcttcatctatttcatagtcgttggttgatcaattttttttaacaacacatttcaatgactagcgacttaaattgttaatcgctaaaagtaaggtttcaaattttgaattaacgattaattactaaaataagttgttgtcgtcaacaattacaaaatgaacacgattgctacaatatgttattgttatagatctttggcaactgcaaaacgaatataatttaatcacgtacgatacgactatgaaaaatcaaacttcatctaagatatatgttttggttttcattttaagattaattaaaacgagagtggttatgtattaaattgtttttaaatttataaagaaaaacaaaacattttttacatgtttcaagaaacacttaaatatttatccacaaaaaataaaataaaacaatgaatctttatttttcattcacaaaggaaatctgaaataagagtaacctaaaaaccacgtcaccacattatccttaagaatagatatgtaatgtacacgtggcagatctcaagtggagggaaacgattcgtttaacccaaaacatctcaaacaattcctcttttcttagccttacgaacatattactaccaacaaaacaatcaagaaccactctttcgtgtcgcaataacaataagaaagaaagaaaaagaaaaccagagatg

SEQ ID NO: 17265 - DNA, 3003 bp, Unknown; identical to SEQ ID NO: 17264
  misc_feature (1)..( 3003): 2750-1469P.txt file - cDNA_ID_1808354; gDNA_ID_1620630; Annot_ID_162653

SEQ ID NO: 17266 - DNA, 3000 bp, Unknown
  misc_feature (1)..( 3000): 2750-1469P.txt file - cDNA_ID_1808354; gDNA_ID_2926193; Annot_ID_141151
ctactaagtctactatagtagatatatcagtacatttttatttatatatatacattttcattttaatgcaaacaaaacaattactatatgtttcccactgacgagtaaaaaacttaattagattcacagagagcaaataaatataacttgtccttctaatgtatggccgagtgggcaatggcgaatgatgatccatttttgtgttgtcaaattatcgttggttatgaatatcggtttccccatgcaatttattgtttcgtatactaaattctttaatatgttaccaagaacgtgaaatcgaaatcgagataatgtgtaacacataggcaagccatgtaaattatgcagtcataaaagagacgatacgctaaccaagaatcaatatatggtttcgagccttcgattattagaaagataacgaccacactactattggttctacatgttttatgtacataaaatcaaatcgggaccaaataaaagaaaaactgaaatggaccagccaatataatgtatatattctttaatatcagttgataaaaaaaataacaggaaagagcaataaaaacatagagccatgacattatgtcttcatcattatcagccttaaacgataacaaaattataaagctctagaattcaccaaatatacccaattgaatttctactagtacctaaaatcatagttacgagggctaatggacttctcataagacttatcttacgcatcatttggatcctctaatatttcgcacactattaagtccctagacgaatcgaaccaaggaaatgcgtaattacctttttaagaagaattaatgcacctaacggatattgccgctcaacatagagtggttaatgttcttttttgccaacctgtatttccatttactgaagaaataaatttgacacaactaaatctttgaaaattacaatattttataaagatttacagtttttgggttttataaaataaataagatttgacaaagatagttatgaaaagaaggatgaaatacggatgtcttttcatgaagatttataaagagtactaataacttcatatcttatgattagaaatctaactttgaggcccttgtgtaccttcgaatatagctagtttatagtgacgggacccttagcataaccaaaatcactgacaagccatagcattccacgtggttaagtccatctatactctcattatcatcttccctccggttcgggttcacgatactggtttagcaactaaattatcaaactatcaccagtttcgtagaatttattcacactaaaaccaattatacgttaaatcattcgttagtcttgtaacttttgttattacttattaaacgccatggcgatgttgggtccactaaacagcgcagccaatcacataaataggggaacacgccagttagattgtatttttaataactgttgtccaaacgtgtaatctccaatattttatctgttccataatgctaatgacaaacagaatagaaaatgagagagctatagaagtcatatatacagatagatataattggactcagattctatgtatatagttgaagatataataaaagataaatctaaaataccatactttgaagaatcagagaagaaagaaaacagcatggccatttgttggcactaaataattagtttatggacacaagtaagacaataaactgtactgttatagtgttttgtagtcaaaagtgttccacacttcatgtgactacaccattacactcattacaataatcaatagaataccaaccaactctataatataacgtgttaaaaacatgaaggtgttaatatttaaataatagggcacgatgtttatatgcgttcttaagtttttctttcagtagttgtgtcttgtatatcgatatatatgtagtggtcttacaaagtaggtgtatgtatgaataaaacaatgttaacaatctaatcaaattattgtttactttggagtaaaacaagaaaaaaactcaggttgattatgattgaaaataggatcaaatgataatggataacgcatatatatgtgtatgagaatgagatatttgagaaattttattttcggtagaaatttgcacagaaacgtttagggaaaatgttatatgaaaaaatagttagaaaaaaaaatttagtgaaaattatttactttgtttgtgattatcttcattagatgtcatatataaatatggacatatccatgtttttctaaagtgttggcgctacatcaaccaataacacgttttattgtttgatctgtagtaattagtgagtagtaaacaacgaagcataaagcttcatctatttcatagtcgttggttgatcaattttttttaacaacacatttcaatgactagcgacttaaattgttaatcgctaaaagtaaggtttcaaattttgaattaacgattaattactaaaataagttgttgtcgtcaacaattacaaaatgaacacgattgctacaatatgttattgttatagatctttggcaactgcaaaacgaatataatttaatcacgtacgatacgactatgaaaaatcaaacttcatctaagatatatgttttggttttcattttaagattaattaaaacgagagtggttatgtattaaattgtttttaaatttataaagaaaaacaaaacattttttacatgtttcaagaaacacttaaatatttatccacaaaaaataaaataaaacaatgaatctttatttttcattcacaaaggaaatctgaaataagagtaacctaaaaaccacgtcaccacattatccttaagaatagatatgtaatgtacacgtggcagatctcaagtggagggaaacgattcgtttaacccaaaacatctcaaacaattcctcttttcttagccttacgaacatattactaccaacaaaacaatcaagaaccactctttcgtgtcgcaataacaataagaaagaaagaaaaagaaaaccagagatg

SEQ ID NO: 17267 - DNA, 3000 bp, Unknown; identical to SEQ ID NO: 17266
  misc_feature (1)..( 3000): 2750-1469P.txt file - cDNA_ID_1808354; gDNA_ID_2926193; Annot_ID_201236

SEQ ID NO: 17268 - DNA, 3000 bp, Unknown; identical to SEQ ID NO: 11886
  misc_feature (1)..( 3000): 2750-1469P.txt file - cDNA_ID_1808366; gDNA_ID_2214521; Annot_ID_134072

SEQ ID NO: 17269 - DNA, 3000 bp, Unknown; identical to SEQ ID NO: 11886
  misc_feature (1)..( 3000): 2750-1469P.txt file - cDNA_ID_1808366; gDNA_ID_2214521; Annot_ID_184625

SEQ ID NO: 17270 - DNA, 3003 bp, Unknown
  misc_feature (1)..( 3003): 2750-1469P.txt file - cDNA_ID_1808370; gDNA_ID_2214478; Annot_ID_133190
ccattgattgatgcccaactatacgaactggtctaaggttcttctggatctcttctctgacaattgcttgactttgatgatgattcgatttggaactgaaattgcaagaaaagtaaaagcaggcgatttgattttgattcgcatttgcttggtgaacactgccaaaggctaaaccggtcgccgagacggttaatctgatgtttgggattgacacatcatgcggctgttgtttctccacgtaacatttggagacccgctcaaatatattgtgggccggagaacattgttttaccatatagggcccatagactttgaatatgtgtaggtaaataaaatacaatctgtggaacaaaaatggcaaaaatatttgaagtcagcaggattggttaacaatttgagcacagaaatacatttggtaacatctgagcatatcattcatatcatatcgctgtcgaatttgaaggaaaaaaaaaagactaaggaagtggatatattggtgaatgctgatgatgagaaaacttattattatatacgaaaaatttactaaagacagcaatattccaaaataatgatagggaagattctgagatggtgtgtggtcagtgtggaggcactacagatggtcaaacagtagcatacccacctggctatttggacaaggacaaggaagaagaaaaatcgagaaccatcttctcagccgattttagtaaccatcttcttgtttgctccgaacaatcaagagatcgaaaatggctgatgttcacaaaggaaaggtttgtgtaaccggtgccggagggtttttgggttcgtgggtcgtcgatcttcttctctctaaggattacttcgtccatggcactgtcagagaccctggtactgaatcttctctccttttactctcttcctctgtaaattttccgcctttattcactctgatgtctcgttgacttgtgtgtgcgtgcgaagtagaaagtctgttcccaaagtttgatttttttcttaatctactttctaggtgtttagattcgctagtttctgttctctcgacggataaaagccttagcttttgatttttgtttgttgttcccaaatcattttagtttgcttctcttcttttagtgtagttgttgttgttctgatgaagagtttcgcatggttcttgttatagataatgaaaagtatgctcatttgaagaagctcgagaaagctggtgacaaactcaagctcttcaaggctgatttgttggactacggctctcttcaatctgctattgcaggttgcagcggagtcttccatgtcgcttgcccggttccaccagcttcagtccctaatcctgaggtgaggatttcacttcactcctgtaatctcactggggatatataacatagtctcactctgcttccactggttttgcaggtagaattgatcgcacctgctgtggatggcacgctgaatgtgcttaaggcatgcattgaagcgaatgttaagcgtgttgtgtatgtttcctctgtagctgcggctttcatgaaccctatgtggtcaaagaatcaagtattagatgaggcatgttggtctgaccaggaatactgcaagaaaactgaggttaatgcatcctcaatccctcatctcatctcacttgttatatatcacatcttttttttgctgacttttaaattcctctggcagaattggtattgtctggcaaagacacgagcagagagtgaagcttttgaatttgcaaaacgaaccggacttcatctcgtcagtgtttgccctacccttgttttgggacctatactgcagcagaacacagtaaatgctagtagcctggttcttcttaagcttcttaaaggtatacaacaagccttatcattcacatctgggattgttagaagcagcgtggtatacatgggttggtgaatctcgggttttgattttacttttgtgtggtgcagagggttttgaaacacgtgataaccaagaacgtcatttggtagatgtgcgtgatgtagctcaagctttactcttggtttatgagaaagcagaagctgaaggaagatacatatgtacatcccacacggttaaagaagagattgtggttgagaagctgaagagtttttatccacattacaactacccaaagaagtaagtaaacaaacaacacatctctctgcttagttttgtacactcaaaaccatccttgacaattttttgagcgaaaaccttttgtcttgagaacagactaattgctgtcagctcattactgatttcattcaataagcaatgacacttacctttagatcagtgttttgaagtttctttaagacctaactttgatccaacctctacttatccaatgttagatacattgatgcggaagatagagtgaaggtgagttcagagaaattgcagaagttgggttggacttaccggccgttggaggaaacacttgtggattctgttgagagctaccggaaagctaagcttgtggactgaaaacttggaaagaagagcaaaatagtgttttagcttcatatgttatagttatagtgttccattctgcacacacacacacactctctcatcgtttactcaataataagagttgtgcattcaccatggatttctgagtttttgttattttctttttagatatcattacttttattaccaatctacaattttctttccataatattttacaatatctctctattgtatatgttgttccaatttctaccgaaatcttactttcaaaggataaaacacacaaacttttatctcaattggtacgtcttgtttctgtataaatttgttaatcattgtagaaaataacataacaaatgtggatttaagctgaacataaatattaatgctttttccgatgaataaaattagtcgaacaaaagttgagatatggagctgaagcagagatggtcaaagtcaaacaaatagctaccatttgcacaaggaagaatcttcttctcatttgggtgatcaaaaatg

SEQ ID NO: 17271 - DNA, 3003 bp, Unknown; identical to SEQ ID NO: 17270
  misc_feature (1)..( 3003): 2750-1469P.txt file - cDNA_ID_1808370; gDNA_ID_2214478; Annot_ID_183225

SEQ ID NO: 17272 - DNA, 3000 bp, Unknown; identical to SEQ ID NO: 12895
  misc_feature (1)..( 3000): 2750-1469P.txt file - cDNA_ID_1808374; gDNA_ID_2214579; Annot_ID_135232

SEQ ID NO: 17273 - DNA, 3000 bp, Unknown; identical to SEQ ID NO: 12895
  misc_feature (1)..( 3000): 2750-1469P.txt file - cDNA_ID_1808374; gDNA_ID_2214579; Annot_ID_186426

SEQ ID NO: 17274 - DNA, 3003 bp, Unknown
  misc_feature (1)..( 3003): 2750-1469P.txt file - cDNA_ID_1808383; gDNA_ID_2214565; Annot_ID_134933
gtatcgaggacagtgttacagcgacaaaaccatttgtaataaatttagatctctttaagatgtctttctttcttccaaaaaacaacattgtgattttagtctttgttcttgacctagttcatgatataaaaatcatcatcccttttatctgaccttcactcatgtttaatcaacttgaatcttatgagacctactacaatcacacaactctcctcttcttagagcttgctgcaacaatgacttcatcgaagctgatatagagtacctaccgtacctaaagtgtttcattaagttgatcaaacttgtgaggcaatgagattttgagaggatagcttgaacctctttggatatagctacaccaagattgctaagatgttctaccaatttcagaataaatcatcaatgttcacatcaattatacaactttgatttttccatctcaaacgtatatatagaatttgagttgcatatagatacgatctttacctatacaatcttgttaaagtagaccacatcgaggttgcaattaatgttctcccgcaatatgtaatcacaaacaataaagattatcaagttttaagtcttcctatatcacaaactaacctttaaggagtcttaagtcaatttatgtgtttcaccagattctacctttgtttagacatggattgtgtctttagcatccattcattcatccatagttacaaatcacctttccatcaaaatgatccactcccatccatagtagtatccaccaccattaaaattgtaacatggggctatgaatatgatagcattcttcgattcttgcatcaatctggaacctaaatcgaagcataaactacaccaaatacaatcgtaaacaaccagaacaaagatctaacaactcatgctcaagaacatatatagattaatgatggagaagatagataagagaagtagatgaacacaagaagttattagttaagatcaatcggtgtgatattgatcctacatctcggcgagagcgggattgaacaattcataaacttaacttcacaagatcatggagagctccataaatccggaggttcacgaatcatggccaaaaaatctatcgtacaagataacaacatgaacacggctcataaaaaaccttatctctattaatcagtaaaaccctaattttcagccaattccggttcagttagtcttcggtttaacattttttcttcggtttaatatttaaacaaaaaaaatacaaattcggtttaatgtcacacaaccattactaaaccgcgtgattcgaagcacaacttaacaattagaaattagaatattcatttttttcaaaaacaaatttggattattgcattattgtttggataaaaccacgatgatgttcacatgacaaaatgatgtttagtgaacgagacgccaaccgctttatatgaactgttttagttcggagattttgcgagttccgactatgggttagaactaaaattttcccatattgtcaaatgatgttgttataaataatatattctctacataattactgtggaattaaggaacataaatttgattctttaacagagaagtgaagatattggccatgcttggttgggttgtattatgccctacttttcttcccccccaacacaaagaatccaaccatgtttaaccaaaccaaataaatatataaaaagcaactataaattattcacttgaagaaatgttaattaacaaatcgataatttttatttaaagcgaattcgccattccatgaccatatggacaaaaagaagctttattgggccaaagtacccacatgcatatcccacagctaatcttttttatttttgacatatcccagctaatcatattccatgtttcttctatcctttttttttaaaaaattgattatattcccatgataatcatttcaattgttttacctaatcctatatttgttcggagtttctactagaatttctatctacatcaacatcaaattgtaatagctttatgtctttgctaaagcacattacctatgtagcaaacaatcgtattaaatataaacgaaaatatagctttatgtcttttcactaaaatcaacaatactaatccaaatcggagatttgctttcggtaaacatttttgttcgactttttatctagaatattataaagtaagaaattttgtgaataagttactaaaatgaattcattacaaaagtagataaagtataaactatcatgataatttagaagtaaaaggattatttttttgtgaatagtaattttagataaataaattatatatctactaaagagtaaataaaaatatcaatacaattatttaatttttaagggcaatacaattatttatcattttgattcataattaaaaaaaattgtcgacaaacaaaaaagcttcataattttaaatttagcatatattaagagatatttcataagagacactaatgtctttctaattttcatgttaacttggatgttttaaatatcaatcaaaaaggttataattgagcctcaccaaaaaaaaaaaggggttataattgatctgattcgatcaattatccagtgtaattatatattgcaatctagttaatgatataacgttataggtctcatttcctacattcaactaaaaggtaagctaaaaaatctaaaagatacaaatatccaacaggagaaatatctttttctctcattgtctatatttgttgttcttctatctctttctctctctttttcttccacaccctcacaactttacttacgactttattatatatataccaccaacccattttgtcataaaagatcattactcgttaagactttccactacccattctcattctctcttcaactaatattcttccccggccctcataaagaagcttctcctgttctttattcacattttccaaaattgtatcttcttaaagtatctccaacaaaactaaatcctactaagttaagagatttgaaaatg

SEQ ID NO: 17275 - DNA, 3003 bp, Unknown; identical to SEQ ID NO: 17274
  misc_feature (1)..( 3003): 2750-1469P.txt file - cDNA_ID_1808383; gDNA_ID_2214565; Annot_ID_185977

SEQ ID NO: 17276 - DNA, 3003 bp, Unknown
  misc_feature (1)..( 3003): 2750-1469P.txt file - cDNA_ID_1808391; gDNA_ID_1620702; Annot_ID_48797
aagattttgaattatttaaagttcacgatatattggcatatacctcgaagaatggtgatcttgtactcaagtgctggaggagacctttaatttttaggagtgaaattctcttcaatttgcaattttctatttgatcacgttgaagatttcaaaaacattttttaatccaattttgtatgtttgaaattagtcaggaattcggcatatgattaactgcttatacacaagtattctgaaataaactaagatgttttggaaaaaaaaaaaaaaaaaaaaaaagtattttaaactcatattacattttttttcttcgcaaactagtattaccttcttactagaacaagtaaacaactatgggatcaatgaggtcatcgaatgccaaatatgaattctattattggccgtctacaaattaattaatggatataatgcaacccttggatactcataaacatcattatgcccaaaaagaacattagaggtagactttttcctctacacaagagaagctcagctgtctacagatcctatcttctccttctcataattttatagaaaactatagtatatagataaaaactatattgttttaggcgtcatatataagaaatatgcccacgcaagagaggataaaaaaaacaccacacaacagaatattttcccttataggtaaaggtaaaatgtcaatggaacataatattaaaatgattaaatttgatgcaaaaatattattttgtatattttcatgtagggcatatgattctatctttgtgatataaaaagatagcatcgagtacccagttttaaaattatgtcaacgtaggcatatcacaagtgaaaaacaaaacgtagacaaatcaaaatattaaaaatgtaaaggtcttatcataagtagaatgtgaatttgttaatagaaaatatgaaaaagtcgttaataacataaatgtgtataatatgtatcgtgggttcgtatattagatagaagacaagtcacctacgaacaagaaaatgtactatgtagtaatcttggaatattaatgtaatttctctctaacgctcaattaatatataacgttgtcacttgactcactttatctcttaaccattcattttctggtgttttgtgtaccgaataacatactgattaattattatgtatccgtccacttgttcgtgattttgtaaggtaaagtccaaacattttgtaaatagtctgaaaagaccaaaaaaattctaaaacataacgctaagtaattcacctaacttaaattatatgagacactaataatttcggaaactttgatgacgattttagctcaaacattatgtaactattttctaatgtttgtcccagtgattatgatgatatgaatatatgataatttttagatatttaaattatttcaatacttttgtagatagtgattgaatacattataccttacctaattagaaattaactcattcattcacctatagtttttacaaacacattactggtttacaaactcatattattatacgctgatgacatttatataaatcattaaactacaatgtatgttctaaaaatcttccaattttaaagtaaatagtataaaattaaatatatgcataaagtttaaacttagtttgtttccaaagcaaggaataatgtgcagggattcagaactttggaaattcttgtgagtttttttaaaattataagaactttggaaattaaactttagaagaaaatcttcatacaatcataaattcagctacaattgaaaagttgtagaagaacaaaaatagacaatgaaattagtgtttcttcaaataaaatggaacattttcttttgatgatattaattagcctttagaaaagttgtgatactcataaattgaattactcattttttctagagactccataaattgaatttaatctcataagaaatgtaaaatctatttttcaattgtttttatcacaaataaattattggttagaaagtgaattattgagatgaatatatatatatttgtgggaaaaaataaaatttaaaaataaaaaggagctatcatcttccatcatctgtctttagggcctccctctaagtctaacaaccctaaaataaaagattctaacaccaaaagagagaagcaaatctcaaattcttcccctattattatatgtgactgttgttgtttttctctcttttaccatctttggcctgaagaaaaaaaaaaggaatccttcttaatggatttggtaaatcaattaagaaagcattacacaaaataaaaaaggaaagttttttaataagcttcattgagagagagatatagagagagaaaagagagagaggccatattttgataagagaagaagaacccttatagagaaagagaaagagagagacagagagagtggatggatgtcttatagaatgaacaaaacatcctctgtttctcttgtccttgtccctttttccagatcttaaggttttccacattttatcatctgggtcctctccttaatggtgaattctccatctttacaagtttgatgtttttgttcatcaaatctggcgtttttttttctcttctaatatatattgtctctgctcattttccgtttctcttcccattgattgttctgtttcatttctgttttttttttttcaatagttttgattggatgctttgatgatccattgtcagatttgaagacactcaattcctatttgatcggggactagaatttggattctgtttcagacaaaagtagatttccctgtctctttcccgtttgattttcaataagatgaatccggaggtaaaacattgaacaattcttcataaatctcagaactttgagcttttttgaatcttaaaacacgatcgaagtaaaaaatcgaattgttagatgaaatgggcaatcgtcattttcgcaaatctgatccgtatttgtgagatcggattcattggatcgactttggggttttgcaggagcaaaagatg

SEQ ID NO: 17277 - DNA, 3003 bp, Unknown; identical to SEQ ID NO: 17276
  misc_feature (1)..( 3003): 2750-1469P.txt file - cDNA_ID_1808391; gDNA_ID_2926189; Annot_ID_140950

SEQ ID NO: 17278 - DNA, 3003 bp, Unknown
  misc_feature (1)..( 3003): 2750-1469P.txt file - cDNA_ID_1808399; gDNA_ID_2214477; Annot_ID_133137
tcagaaaatgagaacccttcccacgtacacactctttgcctttccttttatagctttcctgtgacgtgtttcttcgtttctgggttttgggtttactagcgaaaacgtcaaagatcaacttttgttctgagagattacgattagggtttatcggggattttgaaacgatttttggtaagaagatgacaagagtcaagagtaaactagacgaggaactgtcgtctccttggttttatactgtttgtaccatgggaggaatgcttagtgccggaacaacccatttggctataactcctcttgatgtcctcaaagtcaatatgcaggtttgtgtttcctttctctgcttcttgacttcttcaaatctctaatcttgtttgtttcttctagttattgtctttttagggatgtataatgatcgatataactgctaaatttaggatcttttgcttttctctgagcttaaatttggaaccatcatgattgttcagtcaatgaggatcgatcattctctcttgtaggtgaatccagtgaagtacaatagcattccttccggtttctctactctcttaagagagcatggtcattcttatctttggagaggttggtcagggaagctattaggctatggtgttcaaggtggatgcagatttggactctatgagtacttcaagacactctacagcgatgtgttacctaatcataacagaacttccatatattttctcagcagtgcttctgctcaaatattcgccgatatggctttatgtccttttgaagccataaaagttagagttcagacgcagcctatgtttgcaaaagggttgcttgatggatttccaagagtgtatagaagtgaaggtcttgctgggtaagcccttttttcagaatcattctacttggctggctcactttgcgttcgtttttgagtcttttatctcttcaaatgcagcttccacaggggactttttccgctctggtgtcgcaatcttccatgtaattttactgcttcgtgcaatgcctgttttcacttaatctatttgatcatcaacgtctctcgttatcagtttgatcttaatcttattacaactctcaaactgtcagttatgtaatcaaatcattcagttttagtcattagcatatgagacagatacttgagctatagatgcacattagcatgtctgtagacttggttgtgttttctaccaaaaccatatcttgttgattatatcttctatgtggtttcagtttctatggtgatgttctcaacgtttgagcagtcagttgagtttatatatcaaaagattatccagaaaaggaagcaagattgctctaaagctcaacaactcggtgtcacatgtcttgctggctatactgctggagccgtaggtacaatcatctctaaccccgcagatgtggttctttcgtctctctacaacaacaaagccaagaatgtgttgcaggtcgactcttaaccatcattatttatcttttaaaatccatttcgaaatttcacaatcatgaagcaaagtattcttattgatgttggttatttgcttgagctttaggctgtgaggaatattgggtttgttggtctattcaccagaagccttcctgttcggatcactattgttggacctgtcattactttgcaatggttcttttatgatgccatcaaagtcttaagcggattgtaagtagaaatctctcaaaatttccatatcagaaactcgaatctctctgctccaaatcctcatctaaccagcttgattgtacaattgtgaaaattatagccctacaagtggcggagtgaagaaaccagtggatgcagctaaattatcagtgtgaagcttagaagagtagatctatctctatcaacaataaaaccaggaactcaaaacatacggtcatataagattctcttgcaagtagatacgaggcgttgtgtagcgattagaaggagctttttgatattttcgtttcatgcgcaaatgcatttgtcttgaacccctgcctgaaattggattgtaagtaaagtgctaatgatggatattgctgtaaacagaaacaatgatctttaactgattgatgtcaaaggaatgagtctggttttatctttggtatgctctgaacaatttttgtatgagaagagaagactgagatttgctgtttttagattgttcaatagcttccaagtactttggttttaggcttttagctaattagtttgtgccgtcttcatattttccccttcttctttgcaattttgctattttatggaagctgattatgaccaagcatcaatgaaggaatctctccactataacttatcaggttcacataactttcttaaaagtaaaacagtgaagaaccattcaccttccatatctccagagcaggttcattgcatcttagttagggtttaaccttcaaacttgtctttacactatcctaggattctattgttttcttgtcttctttgtattgctgcatttgattgacttaccactactctcttgagattggccaatttttgctgattaacagttcatttttgctctaagtttcatcagttttttttcttggcatggatgttttgctgaattatcattcgcctaatgagttacacaaacaaaattgtagattttcagagaaaacaaaacaaaacatatgaataaaaaagttatgcatatgatacgcgttaagaaaaacaaatgattaacgtacgtcggctgtgaagtgttgtttgatacaattgggggaagtgacggcacaatgggctggtttcacggcccctttctaagtcatacacgtctcctttttttattttcgtttttttcaaaataataaaaataatatagagagtggcatatccgacggtttaggatctctgccttttctcaacttatagtatataccaaacactttctaaggtaacatgagatatttcacatccttttctctcttattcgtttctgagattcccttcttgttgttgtagccatg

SEQ ID NO: 17279 - DNA, 3003 bp, Unknown; identical to SEQ ID NO: 17278
  misc_feature (1)..( 3003): 2750-1469P.txt file - cDNA_ID_1808399; gDNA_ID_2214477; Annot_ID_183160

SEQ ID NO: 17280 - DNA, 3000 bp, Unknown; identical to SEQ ID NO: 3749
  misc_feature (1)..( 3000): 2750-1469P.txt file - cDNA_ID_1808411; gDNA_ID_1620660; Annot_ID_47955

SEQ ID NO: 17281 - DNA, 3000 bp, Unknown; identical to SEQ ID NO: 3749
  misc_feature (1)..( 3000): 2750-1469P.txt file - cDNA_ID_1808411; gDNA_ID_2926174; Annot_ID_140247

SEQ ID NO: 17282 - DNA, 3003 bp, Unknown
  misc_feature (1)..( 3003): 2750-1469P.txt file - cDNA_ID_1808414; gDNA_ID_1621085; Annot_ID_55375
cgtttttgttttatttttttctcccttgcacaaaaagatcattttcaatttttcattatgagttgattacttgatttccttcatgtgttattgaatttggaggactagtgattcttgtagtgattatcacattttcccactaggtagtttagtgtcagtttatttcttaactatagtgattttaaccatttacggtttacacaaaatacttctacagatttggtaaaacgattggaaaagagaattcaactagaaaaaagagagggttactgtttgttacaaacaagacaagctgtttttcattctaaattgttggcatatgactaaaacaaaatattcttaagaattaaaagaacaatcatgatcaaacagagtacaaggagtatagttgcacatttcaccattgctccttctctttgtgttctctccgcctatttaaaaattgaaatgtctttgtgagttccatacggtgaaaaatctgtagtactcacaaaatcttatgagttttgggtaaagaatcaaaccttttgtagttgtttatagccttcctcgaccgatgtagaaacgttttggacattgtagtctatccgatcaacaatcgtgccctaattgatacaagaatataagaaaactaattgttgagaagccagcaaaaactttgtatctagccagttatgtaattcataagccttttaatgactaagctaggcacctggtcaatcacaagggctgataagtctttcattatctgtgcaaggtcattcacggaacccagaacctagacagaactctgaagttaatcgccatcgaaaatgtgaagcacgcagcttcttaaatatggtcgagtaacaacttccattacctgttgtatctctcgttccctttccgctgagacatgttgcccttccttcaacttgattgtctggtgttcatcgaaaccctacaatttattgaagaccagcgattctcattatggtattggcagagtaaggacgacaaggttctgaagattgattaaaaaaaatctgactcgtcctagcatgataaccataagaagtgtttcttaaaaatgtaaggaagacaaggataactgattaaaaatctgaattgctctagctagataaccatattaagtccttattaatttgtcaatgatatatagttttacaatacaagtaagcacttaccatcccaccaagttcatcctcttcatccagtctcgacatctttccattcacattaaactctaaatctacttcatcctgaccctatgattagagaagccaaatacaaataagaacatcatattacggtacatgcatgtctcaagaatcaacactttttttgtttatttcttgaaaataaaggaaacatacctctttctgctgctgcagacgttttaagtaagtagactgttttctgcggagctccatggaaaggttctgaagatctgttgcaagagaacgctgtcaaaagcagtatgccaaaaagtaggtcaagtccattggagagccccactatacatgtacacagaactttatcctcatgctacaaactcaaaacatagaataacccaaagtacattatatagagggaaaaaaaaacacttcatacattttgctgactgataatgtcaactagataggtagtcaaaacatatgagagtgatttaacccaaaattcctaactttcttctctaaaagcacaaaagaaaaggtaatgaccatgcattctttattgttaacaagctcgattctgaaaaagtgtccaacaacctacctgcacatttttcctgagatttgattcttcagaaggccctctagtagataacatctgcaatctcttttctgacttcctcaacaaatctgtgatctcatgagtgagcatctcgacttcacgatgaatccctttgttatctccaaatgtaggcataagagcctttgaatgtgcctttgctagttcattcattttgtctcgcaccttttgtatattaaaagttatctcctcagaatcatcaacccaagctggtggcataccaattgtgaaggcatcactactgcaaacattcacaacaacacttaaatcatttgctcattctgttacctaattcgtttagggttctaattctgtatctcaaatcaatcccatgattacaattcgtttctatatataagttcatagaatttcccaggttttgcagaatcaaacaacacattatattattaccttgatggaccaggatcataggaattcaaaggagcataagaggagtgattggaccgggaaaatgaaccgctaaccatttcgatcaccggaccaccgaacgaatcagacgccgataaagataatggagcacgcgcgctcttacacgcatccctgtgtttccggtacaccgtcgttcgattcctcgtcgccatcaataccaaatcaattgattctcaacagaatctcgaaagtaaaatttcccggagaaaataaacaaaatcggagcttttgtcgtcggcaaaagcaaacgaatctgaatcgcaaaatcgtttctcattagcgcgtgttacagacttagcaacgaaggagaagtatttgggcctttttaggcccatttatatattgggcttatagtccacttgcgcgatagggtcaatataagtgtgtggagcacacgttttaagacggtggcgcaaagacgaaaatgcccgtagattcgtggcggctaaaagtcaacagagggacgttggtggttcagggtaaaagaggctatagtgaccggttaggggtagtttggtcattggatttagctcaatagattcgtgtccatggattccctcatgtcgccagagaaaaagaccacatttaaaggtcttgcctttttggtgtgtttcctcgcactttcaggctgaacaaagtactgacagatgctaataaatacacggaggaagaatatgctcctttaattattatctgagatttttcaattcaagttcgtgtggattcagaatcaaaatg

SEQ ID NO: 17283 - DNA, 3003 bp, Unknown; identical to SEQ ID NO: 17282
  misc_feature (1)..( 3003): 2750-1469P.txt file - cDNA_ID_1808414; gDNA_ID_2926183; Annot_ID_140637

SEQ ID NO: 17284 - DNA, 3000 bp, Unknown
  misc_feature (1)..( 3000): 2750-1469P.txt file - cDNA_ID_1808422; gDNA_ID_2214588; Annot_ID_135383
agatggaaaacgctctttgtaaatacatagccaccagtcatagaacccaaggacccattttctctgctgttaccttaatgaaaaaggtgagattcatatatatggaaaaatctcttctgtaaaatggtacttagtgtcctgaaactgaatatgcataaagcaaccggttgggttgggtcttcactgacatgattgttgtaggttccatcagagttagaaactcacaaagataatgtcacagcctccattcaaactagttcgtgaaggagtgttgagttgtagccaaacagaagaaaaaattgatattgggacaaatgatcgatcattagtgacattagatacaaaacttgacagcccttctttttggaagttgtagccacaattacttaaccctaatgcttttttttttttttgtcaaacacttaaccctaatgctaagcggctatataaatagaagatctttattctgatattatctctacaacttttttatcttgaaaaaaaaaatgaaaggaataacaaaaaaacttttggtctcccgctctctcaaacgtctgacggccaagaaaaaccggaggaagattcatcgagagacgaacaagcgtctcaaaccggaggaagatccatcgatggtgaagaggcgtcaagactctgattcagattcgctggagaaggaggtttcagttgttgtaaccaagacgagtgatgatgagatggtgtcaacagataccaaaaagaattattttcaaagaatatggagtgatgatgatgagattgttttgctgcaaggcatggttgattttgagaatgataaagggaagagtccttatgatgatatgactggttttattgatacggtgaagaacttcattagctttcaagcgaatcaacatcaattcacaaccaaaatccgtcgcttgaaggacaagttcctcaagaaatggaacaatggtgtagatgagaactctcttgtaaatgctcacgaccggaaatgttttcaactttccaaagtaatttgggaacctacaactaaggtggaggaggtaggagattggtttgtaaattcttatcttgtaggatcaattgcgaggttaggggtgagtgaagacgtaatgaaacagagttggagcatggttccgatagagacgaagaaggaggtcgaagagaagttcaagctgttgaaagatgaagaatctgaaaacctacggctaaagacaagttttttgcaaaaggtcaactctatgatcattgaagcaacaaattagacaagtatcgaattagaggtttaatgcatctttttcatttccatcccatatgagtctgttttttctatttggtttgttattggtttttgatacttggattgtgttgttaaaaacactatggaagaacggcagattaaattttaatgcatccaattgtggtcaaggtttatggtctaaattttggtcagaatactcttgttagatacctctcactttgcttagggtcaacaagcatcaatgtttctgagatcacagattttgtaatcaaacagaagcaacagattttgtctatcttgcaagcaaacagaagatcacatgcatattttgtcttcaacatgaacaatttcccggaaacgtgtagaagcaacaagactcttctgctccttcctcaatgacgatgtttctctctggaaatcactggttttctcaagaccagacaatagaacatcgtatgtcccaagcgaaggcattatctctcgctctctcatctctcctaatatcttcattgctttctctggactccctgctgagatataaacatccatcagcgcagtgtaagcagatagacccttttgatcatccggaagtaagtctaaagcctctgcagctaagctaggtcttctcccaaacccgagcatgtggatcagcattgctccatggtacacaccaagcgagtgttgggatttcaccatctccttgaccacatcaatcactttagagagctcgtttgatctcagaaagttaccagctaacgcaagatacgctgacttctcaagatgaattcccatttccaagctccaatcaagagccaacgaagccaagtaaataaccaagatactgtgccaactattagtagtcattaagagacaaaatcagtactagatactgtgccaactattgtcaaacccaaaagtgtttggacggtttcctattatatctctatgcttttactaagacaacctagcaaatattctgaaagtgtaactgcacgactgatagttgcatcaatagtgtgacaagaagccataaatgtttgatcagaggtgtaccatacgggtacctgcatagttggagtaaacaattgaaagatgaatttagccaagcaggaataacaaacagtttaaaattttgtaatcgatccagggagtgtatttactcaaagaacagatcaaggactcttctaatagctcctgagctagctagttcttttcctattgcttcacttcgagttttcagtaagacatgaatgaactccacaatctaagacaagccatcagcaacacaaacgaaatcagaaatatattacacaacagaaaacacacacaagacacaagagtatatgttttgagttagaactccgtacttgttacatgtttgagtgttatgttttatgttgaatttaactaaaatgcagacgttagtatggaatgggcttcacaaataaaagcccaatagtatgtttttttggtagggagcccaatagtatgttggttcacccaaatatcatttctttctctgagagctgtttattatattcacacaaagaagaccaacaagaaacagagttgaatcagttctacaatgatctctgtctctcgattcttgtcgcctcaattctacgcaattccaaggttttatccgacaaaacccaatcttttaagtctctcctttgttcatttctgtaatcgtggcgaccaaactcaatctcaattgtttcaggagcttcgtaaaaatg

SEQ ID NO: 17285 - DNA, 3000 bp, Unknown; identical to SEQ ID NO: 7500
  misc_feature (1)..( 3000): 2750-1469P.txt file - cDNA_ID_1808437; gDNA_ID_1621148; Annot_ID_56809

SEQ ID NO: 17286 - DNA, 3003 bp, Unknown
  misc_feature (1)..( 3003): 2750-1469P.txt file - cDNA_ID_1808441; gDNA_ID_1620658; Annot_ID_47900
ttattatttttatacattctttgtgagaagtaaacacttctacgtgtgtatatgtgattggatagacatttttagatttcatgtctaattttttgtataagtatattttcattaaggtgtatgtagaaattgcataacgaaatttgtaatacacattaacacatggcttcaatcgtatatatctagaagtagaagactgcgtcttgaattagatagcgagttctggcatcaacaacaatccagtttgcaaaatgtgcaatgtgattaacattttaattacatgtcctaacgtttgagttattagagaaacattatctctgttcttcagtcttttggagaatatggaccctcaagctactctcctttgcctgttaaaagaaaattatctcaccattttagcctatggagcttccacatccaaattgaaccaataaaaaacaaaccattcaagttatagataaaactaccggaccggtcacatatatataatgaaattaggagataatgaattaccgtgaagagaggaatggataaaaggctctcgtccatttcttcaaaatataacaattcttgattgaacatgccgatcaattctgtcagctcatagaggattatttcaacctgctgatatttaatcacccaagacattcttaaattaatttcttttacatgtatctatacaaaaaaagttaggaaaatgatctgtatagataaagtggacttactcgtgggagaaacttgatgatgacgtcttcgatctcgtccatgacttctatagctatgaccatttcttcatgtatcgacaccatatctatctgtaacttccaaattattagtttctgctttcttgacaaatacacaaaatgtttataaacaaattggtttcccaaagagagaaattctaaccgtggcaccatgtacgaggggtaatcggacagacaaagcatggagttttcgagttagcttgctcaacgcttcggagttttttgcgtctatttttgaccactcattaagtaaaggcatttggaggctgagaacttcacgtactttgatatcttgacggagcctttgaatttcaatcaaattttctacaacgtagttcctcattttgtatatcctaagccaaacccaaaacaactgatcctgaaaccattcacagaaacaaattaatagatatttataagatacaaatttaaatatttttcatatagtttttgtacctcaacgttgatcttaaggtttgccatagtggcttcagttcttgcgttaacaaacctccattgaagtaatctgttttgaaaaatcctaaaccggtgataatcctcctcttgtaccggagatactttcttctgcgccatgaagtacttcaaaactcctgccaccgctccaccgccaccgcttcttatcttggccttgcttacgggtgactcaggcggcgtcatgcacattgaagtcgtcggagctgagctggacagaggcgtcttcatagtcgaaagtcttccaggagacaacgcccacgccgatggtgagctggctcccggctttacccctctcgatgaagcgttactacgaggactaccacgcgtacgttgctccaagtaccgagcaaacgactctctgcttctaccgttgtttatctcttgagatcttgatgcgctgtttctcgccgggattatgttctcgccggatttagagtcggatgatccgatgggtctggaggatcttgttgtggactgtgatctggttatcatcactcgtttgcttgaattggaaggcgaagaggaagaagatgaagaagtagaagacgataacgaggcgtttaaggacactgggagagagattgaagagcttatagtccggctccggttattattgggcgatggaggacggagtctccgaccggtggttgccattttcttctttaatatatgacgacggttaactatatgactatatcatacaagacttatattcggtttcgtttctcgactcacttgcccctgtccttaagactcttatagtaaagctggaattatatggttcaaggaatcgtctagtctatatacactggtttgaacaattgtgatatataatatagttaggggtatattatatttaatctgttagataacggttggggtacttgaagatctgtaggagttgacagcacgtagaggcagaggtaagaacacttctgcatgtagtgtgtctacataataaaatatagagtgtattttttacacacaccaaaaagagagattataattaatgtattatgtcaaagcatatatgaaggtcagcttagctagagacacgtcttttgtttatctctcgactaaacaacatggcgttttaataaaatcaaaacttaaaaggtccaattcagaacggccccatagtatatagtctacgttgaataaataaacctcaagatagcgtcaaactctttagtctttacccaaaaatatttttttttaaataacgtcaaaactctaagtcttgacctcaacaccaatatatatttgccttctccaatatctgatttttttaattgtttatccgagtcttcttggtcttttcgaatgtttgcccgaaccagaccttcccacgttcggtggttggtggccgcctcggcctttggttgatttctgtccacattttggtccttttcattcatgtaccatgttctagggtcatttgacttgttgaccataaatctactaaaacaggcctaataccgatgggccgtagcccgttaataaacaagacaatttatatttgtttcacttagcttgggagccacggatctctagaaacatccagagaaatatcaatctccccacttctccagaacattcactcactgacaatatcccaccttcaacacttaactcctgtatatagtcctcccctgtctccagtttcgtcgcacacagttctcagataaatactaaactcactgttaaaactttctcaacaaagcttcctgtttctctacaaatg

SEQ ID NO: 17287 - DNA, 3003 bp, Unknown; identical to SEQ ID NO: 17286
  misc_feature (1)..( 3003): 2750-1469P.txt file - cDNA_ID_1808441; gDNA_ID_1620658; Annot_ID_163705

SEQ ID NO: 17288 - DNA, 3003 bp, Unknown; identical to SEQ ID NO: 17286
  misc_feature (1)..( 3003): 2750-1469P.txt file - cDNA_ID_1808441; gDNA_ID_2926186; Annot_ID_140826

SEQ ID NO: 17289 - DNA, 3003 bp, Unknown; identical to SEQ ID NO: 17286
  misc_feature (1)..( 3003): 2750-1469P.txt file - cDNA_ID_1808441; gDNA_ID_2926186; Annot_ID_200668

SEQ ID NO: 17290 - DNA, 3000 bp, Unknown; identical to SEQ ID NO: 13848
  misc_feature (1)..( 3000): 2750-1469P.txt file - cDNA_ID_1808445; gDNA_ID_2214658; Annot_ID_136508

SEQ ID NO: 17291 - DNA, 3000 bp, Unknown; identical to SEQ ID NO: 6680
  misc_feature (1)..( 3000): 2750-1469P.txt file - cDNA_ID_1808465; gDNA_ID_1621100; Annot_ID_55863

SEQ ID NO: 17292 - DNA, 3000 bp, Unknown; identical to SEQ ID NO: 6680
  misc_feature (1)..( 3000): 2750-1469P.txt file - cDNA_ID_1808465; gDNA_ID_2926168; Annot_ID_140002

SEQ ID NO: 17293 - DNA, 3000 bp, Unknown; identical to SEQ ID NO: 12030
  misc_feature (1)..( 3000): 2750-1469P.txt file - cDNA_ID_1808479; gDNA_ID_2214528; Annot_ID_134220

SEQ ID NO: 17294 - DNA, 3003 bp, Unknown
  misc_feature (1)..( 3003): 2750-1469P.txt file - cDNA_ID_1808486; gDNA_ID_1621201; Annot_ID_57674
tattaaggtagttgatgcatttttctttttggttacaacggatatagttaaatggtaattagggtaactacgtatgacatgaggcaaaataataattgaaaatgtgaatgtgaggagtgacgacctaattgctccaaggccgccttcgtcaaagaataagtctcctcaacggttgtcaaatcaatttcacacaaaaaaaaaagaaaagaaaaagatattttcagacataaatagtaaagtaattgtactattgatttcatatgataaaaggtgcatgaaacacatggtcgactattttttgtctttagagtgttcattaaggaatgttattaaaaaaaacttataagagctgcatttgttattacatagttccttattgaaattttcatttgttaattgttaacacaaaataaaatatgccactgaatccacaaatatcttgtcggtatcgaactttttatttatttagaacaagaatatcttgaccaaatgaaatgtgaaccaggaaaataaatatacagttcatcttttttttctttgaatcttctcaatttgttgtttggatttttctgagggtaagggcccatttcatttttaaatttgtctgttaagagtagtttaaaatccatgcctttaaaagattcgacttgaaaacatacttaatcgggaaagatgcacaattttgatccaaacgcatctactaataatctattgacttcattaatctaatccaaactccacgttcattgggtaaattttgtgaacagttattataataatgggcctagaaacagtgagataataggccatgatcaatatagataaatgggttacacaaataatgaattgtcccacagaaggatggttaaaagtaatgggccgaaaatagtgagctaatgggccgtgaaagtaatgatttgaaagaggggattacagaagctgacgatggataagtcttttctggataaaacgctcttcttcttctcttcatcctccttctggagcagagcttagagctccatcatcaaatcttatcaatggcttcctcactcgtctcatcttttcaacccaggtacttttcatatactacaaaccatagagcttcttcattccgctagggtttcgttttctttacttggcattttctactcaaaaatctctataaactgtgttcatgagcctcccaagtataaggaatctctttgaatgggttatttttatctttttaaatcgatggcaatgttgaattggttatggactcttgaaattgtggatttttattttgggaatttgaatgtgttatgcggaactcactgtgtaaaaagcaggattctagaggggtttttagccatggaaactgaaagttctacaagaatgtttctcttccttaatctaacgttatctttgttccaataacagtttctgtgtattggtttagatatatatctggtagagttttactttcttgacatgttttatctgaagatagatagataacttcccctttgttttaggtcagcatttttgggagatagaaatgtgttcaaggtctcaagcacaccttttgctcaagtgggttactccagtaagaccattgagtgcaaagaatcaaggataggaaagcaaccgatcgctgtaccttccaatgtaaccattgcattggaaggtcaagacttgaaagtgaagggtccattaggagagctggctttaacttacccacgcgaagttgagcttacaaaggaagaatccggtttcttaagggtcaaaaaaaccgtcgaaactagaagagccaaccaaatgcacggccttttcaggttacaaacttctcatcttttcttgtcatccaatgaagtccttaacttttttgaggttaaaagatcgtttgttctctaatctttttttttaacttctgtgtgacttttaggacgcttaccgataacatggttgtgggagtatcaaagggatttgagaaaaagcttatacttgtgggtgttggttatcgtgcaacagtagacggaaaggagctggtgctaaatctcgggttttcacacccggtgaagatgcagataccggatagtctgaaagtgaaagtggaagagaacacaagaatcactgtgagtggatacgacaagagcgaaatcgggcagtttgctgcaacggttaggaagtggaggccaccagagccatacaaggggaaaggagtcaagtattccgatgagatagttcggaggaaggaaggaaaagctggaaagaagaaatgatcttcatttttcattattatctacttacttatctcttcctttcaatgtttatgtgtatttgctcaaatttgtttagaaatgaagatgtttgtgttgggattcttgagtaagtttttaaaggaacccattaattgtttttgatgctctgacaaaaatttctttagtgctttgattgaacaagaacttgggcacaaagtgcctcatcggtgtgattctattgttatgtttccttattgaaccaaaccaatccaaatcggacaaaaatcatggtagataaactttttaaaacaattttttaatctattcttcttttttttaattacaaattttcttattttcttatatctaaaaaatcgtaacagtaagatattaatatctgtattcttaatttggtagataactttttaaaaaacgaaaatttcctataagaataataatagtcggaaataaaacaaaaaacaatatcatggtgattattcttatttgcttatatcttcttctttttcacaatttttttttaaaaaaaatatttacaaaattttcttatttgcttatatatataaaaaatcagtaagatattaatatcgattttttaatttggtagataacttttttcaaacgataaatttcctaaaaacaataaaatattcggaaataaacaaaaaccctgattgaagaaaagtctttttgtttatcagttcaccggaggcaaaaatcgtctctcgcttgagctgcgaagatg

SEQ ID NO: 17295 - DNA, 3003 bp, Unknown
  misc_feature (1)..( 3003): 2750-1469P.txt file - cDNA_ID_1808490; gDNA_ID_2926150; Annot_ID_198001
aaaaatatcaataatattttcagatattattataataaccaaaaatacccaaatattattataatacaattaaaaagtaaataaaaataggaaaatatcactttatatgctcagaagactgaaaaattaggtgtaggaattgtggactatttcaacagtaaaagaactaatgaagttactttattattcttctgtatttttcttttttttaattaaagtctcatatattgttttgttactaaatattttcattgttatcatcaggttaacctcgttaacaattattagtaaatattatgtataaattatccgttacagtaaacattattcatgtatcgaatatcttaacgttttcatataaatattattctgttatataatatattagcatgttatcattctatatatcatgtagttataattattatcatgttaattatataaaaaagtctaatttccttttattgtgctgaatatacataaataaaaaattctgatttacaattttaaatcgataaatatgttttaacaaataatttataaacttatcgcgatatcatagtttttaaaacattaaacaaataattatatacttatcatccgaatattacaattatttttattcaatagcatttttgtaattaatttttttaaaaaaaattttttggtttatatattatttatctttcatacttacctaaataactaatatttatatataaattctttattttttcatcatcctcccagcatatcgattaatatagtccataaaaatacgtcaagtttaatgcttccatgttagaagacgtgctctcaaaacttcttcttttgtttgttttctaattcacaacttgaatctaaaagaaacctggatcctaaacgttgaaaaatattaacctcgtaaacgaagacttgaaagatatatggggagtgttatatgatcacatagtgtaggtcgccttctgactatttttgtggtttatacaaaaagctacgtacagctgtaaagtcttctactctgtgtctctgtctatcatttaaagatggatttatagatagtccactttccaacaccaatcagatttgacaaaaatattaacattgcatttttgggataactatcgttgacttttttactacctattttatcggttagttattagactaaggaaacacagagtttaattgacagaacttctgagctgtttaggcccgtaattctttccctaattgataaaagggccctatttgtttaggtgcataacaggcttcattatatgggcttagaacggcccgatttgtttacatgaagacttttacattttaataatttgaacttgatcatgtaagtgagtatgagtaatgagctggtgaactttttttatgtgtgatctacataattatcacatagaataatagccataaggctttcggtatttgattcttatcaactgtggtccgacatctacttttatacacacccacttgtttttttgttaaaggcttttttctttgttttgaaagtaatgatagtgtatataactaaacataaaaactcgatattgatttgttgttttgagtatggaccctccaaaacatgaaaagacaagaaacaagattgatggcatagttgcaattttcttatacattatatgatgggtctgattggtaaccaaaaggtatacaagatttttagctgttagatttatcggaatagtgcaaagctgttagaaggaactatacaaagaaattattaaaaaaaggtgagtataaaacttttaataacacttttgataaagtttttgtgattggtaactttcaaagttatacaaagctatactattattattgtggttatcattcaaacccgatatcatcttggaaaaagttaaaatctctctccgctatacttaacaaaaataatttttttgggaaaattattttatctttttgtcgttccttccatattaagcccaacaatatttagataaaaatatagatagaactaatttacagtctgtgaagtatgtagtgtgaaagtatttcaactttttttatgatcccaaaattgatgtggttacgaaaacttactagtattacaaagactggaagaagtaaccaaacaaatggatcatactgaccaaacgggatcaagcactaacacagttgtaccattatcacgtggcgtacatatatggagagagtatatcttacgcacttagtaacgcgcgttagataacacctgatggtaccacatcataagaaaactttgcaaacaaatccttaaactaacaattgtttctgcatacaccccttgacttaaaattcttaacttttttttctacactaacttctttaacaattgaataacgagagtgtcgaaattcgagtgtacaacattttaaaactgtttttttttgtttttaaatccttaacctcttaaatataatatcaagtgtataattgtttaaatctttaaccttttaagaacttaaaagataggtgacgttgaacataattaaatatcactaaaaagaaaaaatcacaaatgcggctactaatcgccacacactcaacttcaccgctgacgtgcagatttttaatcaaatgaagaataatttcgcacatttcgaagtaaaagggctattttacaaaacatgattaagtcaaggggttggtttgcaaatatttcacaacagaaatgtgccattaaaacggcgtcgttatgattcaggcttaatcagtaggttgtgtcttttggcttttatcatcgccgccgggacacaacacaaagaggggcttagatttgtgctttcgagaagtgctttgatctctcttctccattttcacttctaatcggagatttctcttagggttttgttattcgttgagagatcgaattaaaaacttgtgaagaaatctctagggatcgtaatcgttgttggtgtggggtattacactgattccggtttgaacctgaatcgtatctatcaatcgatg

SEQ ID NO: 17296 - DNA, 3000 bp, Unknown; identical to SEQ ID NO: 7649
  misc_feature (1)..( 3000): 2750-1469P.txt file - cDNA_ID_1808490; gDNA_ID_1621155; Annot_ID_57012

SEQ ID NO: 17297 - DNA, 3000 bp, Unknown; identical to SEQ ID NO: 7649
  misc_feature (1)..( 3000): 2750-1469P.txt file - cDNA_ID_1808490; gDNA_ID_1621155; Annot_ID_173480

SEQ ID NO: 17298 - DNA, 3003 bp, Unknown; identical to SEQ ID NO: 17295
  misc_feature (1)..( 3003): 2750-1469P.txt file - cDNA_ID_1808490; gDNA_ID_2926150; Annot_ID_139262

SEQ ID NO: 17299 - DNA, 3000 bp, Unknown; identical to SEQ ID NO: 14105
  misc_feature (1)..( 3000): 2750-1469P.txt file - cDNA_ID_1808500; gDNA_ID_2214700; Annot_ID_136848

SEQ ID NO: 17300 - DNA, 3000 bp, Unknown; identical to SEQ ID NO: 14105
  misc_feature (1)..( 3000): 2750-1469P.txt file - cDNA_ID_1808500; gDNA_ID_2214700; Annot_ID_189634

SEQ ID NO: 17301 - DNA, 3000 bp, Unknown; identical to SEQ ID NO: 10454
  misc_feature (1)..( 3000): 2750-1469P.txt file - cDNA_ID_1808507; gDNA_ID_2213650; Annot_ID_132458

SEQ ID NO: 17302 - DNA, 3000 bp, Unknown; identical to SEQ ID NO: 10454
  misc_feature (1)..( 3000): 2750-1469P.txt file - cDNA_ID_1808507; gDNA_ID_2213650; Annot_ID_181589

SEQ ID NO: 17303 - DNA, 3003 bp, Unknown
  misc_feature (1)..( 3003): 2750-1469P.txt file - cDNA_ID_1808511; gDNA_ID_1621088; Annot_ID_55427
tggttaatgcagaagacccatatatgttctacacttggactgttacttatggtacaagatctcctttaggtgttcctcaacaggtatgaatacatacactctttgctctttttaagtatgttaattgtcgttatgaaatttttgatattatatactttggtacgaacgatgtaggtcattcttatcaatggacagttccctggtccagcgattgaagcggtcacaaacaacaacattgttgttaatctcattaacaagctggacgagccattcctcatcacctggtatgtaactatataactgattgtatttgtgcgcttagacaaatatgaaaaaaaacctttaacacggttttgtaatatatgtgtaggaatggagtgaagcagaggaggacatcgtggcaagatggagtattgggaacaaactgtccgatccaaccaaactcgaactggacttaccagtttcaacttaaagatcaaatcggtacttacacttacttcgcttccacgtcactgcaccgagccagtggtgcttttggtgctctcaacattaaccagagatctgttattacgactccttatccaacacccgatggagatttcaccctcctcgtctctgactggttctcaaatatgacccacaaggtacataccagtacaaagcctagatatacactcaagatcgtttcaaaagtcctatgtgaatgaataaaaagcaaatttgatgtttttaaaaaagtaaggatttggtttatatgttttcaaatgtttttctttaactattcttgtgatctctaggacttgcgaaaatcgctcgacgcaggctctgctcttcctcttcctgatgctcttctcatcaatggagtctctaaaggtttaatctttaccggtcaacaaggtaatgtcatcataacaaatctttaatattacatcgtgcatggtcttgttctagtctttgatatgtctttaatttcattgtctatcttcaggtaaaacatacaagttccgggtatccaatgtcggtatagctacatcgataaattttaggattcaaaatcacacaatgagcctcattgaagtagaaggcgctcacactcttcaggagagttatgagtcgcttgacgtccacgttggtcagtccatgaccgtcctggtcactttaaaagcttctgtgagggactatttcatcgtggcctcaacccggtttacaaaaccggtactaaccacaaccgcgagtctccgttaccaaggctccaaaaacgctgcatatgggcctctccccattggtcctacttaccatatccattggtccatgaaacaagcaagaaccattaggtattaataccaaaccgaacataaccgaactaaatcgaaccgtacaagtctagattggttctgcttaatttgactttaactttttctgattcttaggatgaatttgacggcaaatgctgcaaggccaaacccacaaggatcatttcattacgggaccataccaataaaccgaactctagtcctagccaatgcagccacattgatctacgggaagcttcggtacacagtaaaccgaatatcatacatcaacccaacaacaccattgaaactcgctgattggtacaacatctcgggcgtgttcgatttcaagacaatcattagcactccaacaaccggaccggctcatattggtacatcggttatcgacgttgaacttcatgagttcgtcgaaatcgttttccaaaacgacgaaagatcaattcaatcttggcacatggacggtactagcgcctatgctgtcgggtaagcaaacacattgccctctgttatctaaaccggttccggttattcataacttaaaccgtacgtaattgattaccttttacagatacgggtcagggacatggaacgtgaccatgaggaaacgttacaacttggttgatgctgttccaagacacacttttcaggtaataatcttatttagaaacaatatgattgaatctaaatatctaataagtaatcaacgatgattgtgtgtatgaaggtgtatccgttatcgtggacaaccatattggtgtcgttggataacaaaggaatgtggaatctaaggtcacaaatatggtcgaggaggtatttaggacaagagctctatgttcgtgtttggaacgatgagaagtctctctacactgaagctgagcctcctcttaacgttctttattgcggcaaagccaaacgtcccctttagatttatcattgttatcttttctactgaattaggtcacaattacgtggagtggaacaaaaaatacaaacgtagtccaaacggaaagctaattgatttttcaataaagagacaaaataaaaatgaaggaaaaaactttcttttgtcttatgatttgattctgtttttttttttttgctctcttaaattcagattgtgttcatgtatctaaagcagaattggaaaccaaaatttggatactagaattgtcagtttgacataaaattttatgtaaatgaattgaaaccaatcctaagcagtcatcacttatcaatatgctttttcaaataattttgcaaaatgtcatagatttttatgtgtgtaattcaaaccatagaaatttatttgaaaatataatattaaaatctttatctttatctcaagttattttcccaatctcatcaatcaaatcacccacttcagtggacaataatctttaatatttcattaatcattgatatctttctcattttcacatttgagaaaaacgttttgtcggtaaaagaaaatgtatcattgaaaattctaaaaatagatataatggagagagagatccacctcaagattatcgccacaaaacagagtagttgactgatatcgattgtgagatttcaaagcgataacgtggagaccccctcaccattataataaatcatcatatcgtcactttagccacatcacataccaaaaaaaggcaaaacactcacgaaagaagaaacggagaggatg

SEQ ID NO: 17304 - DNA, 3003 bp, Unknown; identical to SEQ ID NO: 17303
  misc_feature (1)..( 3003): 2750-1469P.txt file - cDNA_ID_1808511; gDNA_ID_1621088; Annot_ID_170559

SEQ ID NO: 17305 - DNA, 3000 bp, Unknown
  misc_feature (1)..( 3000): 2750-1469P.txt file - cDNA_ID_1808511; gDNA_ID_2926212; Annot_ID_142056
ttaatgcagaagacccatatatgttctacacttggactgttacttatggtacaagatctcctttaggtgttcctcaacaggtatgaatacatacactctttgctctttttaagtatgttaattgtcgttatgaaatttttgatattatatactttggtacgaacgatgtaggtcattcttatcaatggacagttccctggtccagcgattgaagcggtcacaaacaacaacattgttgttaatctcattaacaagctggacgagccattcctcatcacctggtatgtaactatataactgattgtatttgtgcgcttagacaaatatgaaaaaaaacctttaacacggttttgtaatatatgtgtaggaatggagtgaagcagaggaggacatcgtggcaagatggagtattgggaacaaactgtccgatccaaccaaactcgaactggacttaccagtttcaacttaaagatcaaatcggtacttacacttacttcgcttccacgtcactgcaccgagccagtggtgcttttggtgctctcaacattaaccagagatctgttattacgactccttatccaacacccgatggagatttcaccctcctcgtctctgactggttctcaaatatgacccacaaggtacataccagtacaaagcctagatatacactcaagatcgtttcaaaagtcctatgtgaatgaataaaaagcaaatttgatgtttttaaaaaagtaaggatttggtttatatgttttcaaatgtttttctttaactattcttgtgatctctaggacttgcgaaaatcgctcgacgcaggctctgctcttcctcttcctgatgctcttctcatcaatggagtctctaaaggtttaatctttaccggtcaacaaggtaatgtcatcataacaaatctttaatattacatcgtgcatggtcttgttctagtctttgatatgtctttaatttcattgtctatcttcaggtaaaacatacaagttccgggtatccaatgtcggtatagctacatcgataaattttaggattcaaaatcacacaatgagcctcattgaagtagaaggcgctcacactcttcaggagagttatgagtcgcttgacgtccacgttggtcagtccatgaccgtcctggtcactttaaaagcttctgtgagggactatttcatcgtggcctcaacccggtttacaaaaccggtactaaccacaaccgcgagtctccgttaccaaggctccaaaaacgctgcatatgggcctctccccattggtcctacttaccatatccattggtccatgaaacaagcaagaaccattaggtattaataccaaaccgaacataaccgaactaaatcgaaccgtacaagtctagattggttctgcttaatttgactttaactttttctgattcttaggatgaatttgacggcaaatgctgcaaggccaaacccacaaggatcatttcattacgggaccataccaataaaccgaactctagtcctagccaatgcagccacattgatctacgggaagcttcggtacacagtaaaccgaatatcatacatcaacccaacaacaccattgaaactcgctgattggtacaacatctcgggcgtgttcgatttcaagacaatcattagcactccaacaaccggaccggctcatattggtacatcggttatcgacgttgaacttcatgagttcgtcgaaatcgttttccaaaacgacgaaagatcaattcaatcttggcacatggacggtactagcgcctatgctgtcgggtaagcaaacacattgccctctgttatctaaaccggttccggttattcataacttaaaccgtacgtaattgattaccttttacagatacgggtcagggacatggaacgtgaccatgaggaaacgttacaacttggttgatgctgttccaagacacacttttcaggtaataatcttatttagaaacaatatgattgaatctaaatatctaataagtaatcaacgatgattgtgtgtatgaaggtgtatccgttatcgtggacaaccatattggtgtcgttggataacaaaggaatgtggaatctaaggtcacaaatatggtcgaggaggtatttaggacaagagctctatgttcgtgtttggaacgatgagaagtctctctacactgaagctgagcctcctcttaacgttctttattgcggcaaagccaaacgtcccctttagatttatcattgttatcttttctactgaattaggtcacaattacgtggagtggaacaaaaaatacaaacgtagtccaaacggaaagctaattgatttttcaataaagagacaaaataaaaatgaaggaaaaaactttcttttgtcttatgatttgattctgtttttttttttttgctctcttaaattcagattgtgttcatgtatctaaagcagaattggaaaccaaaatttggatactagaattgtcagtttgacataaaattttatgtaaatgaattgaaaccaatcctaagcagtcatcacttatcaatatgctttttcaaataattttgcaaaatgtcatagatttttatgtgtgtaattcaaaccatagaaatttatttgaaaatataatattaaaatctttatctttatctcaagttattttcccaatctcatcaatcaaatcacccacttcagtggacaataatctttaatatttcattaatcattgatatctttctcattttcacatttgagaaaaacgttttgtcggtaaaagaaaatgtatcattgaaaattctaaaaatagatataatggagagagagatccacctcaagattatcgccacaaaacagagtagttgactgatatcgattgtgagatttcaaagcgataacgtggagaccccctcaccattataataaatcatcatatcgtcactttagccacatcacataccaaaaaaaggcaaaacactcacgaaagaagaaacggagaggatg

SEQ ID NO: 17306 - DNA, 3000 bp, Unknown; identical to SEQ ID NO: 17305
  misc_feature (1)..( 3000): 2750-1469P.txt file - cDNA_ID_1808511; gDNA_ID_2926212; Annot_ID_202719

SEQ ID NO: 17307 - DNA, 3000 bp, Unknown; identical to SEQ ID NO: 12034
  misc_feature (1)..( 3000): 2750-1469P.txt file - cDNA_ID_1808515; gDNA_ID_2214528; Annot_ID_134226

SEQ ID NO: 17308 - DNA, 3000 bp, Unknown; identical to SEQ ID NO: 12034
  misc_feature (1)..( 3000): 2750-1469P.txt file - cDNA_ID_1808515; gDNA_ID_2214528; Annot_ID_184842

SEQ ID NO: 17309 - DNA, 3003 bp, Unknown
  misc_feature (1)..( 3003): 2750-1469P.txt file - cDNA_ID_1808519; gDNA_ID_1621088; Annot_ID_55445
taagaaagactctgcaacagaaacggctaagaaacgagaacaggagcgacaaaggctggagaaactagcggaaacaagccggttaagtcggaataggcagcgcagccgtagtaggagtattagtcgatcaccaccaccgaggttgttaataaagttatcatttttgcttcgtgattaaaatggggggatttgtgaagatgagaaggaagttttcggttctagagctctgattggatccgctctcttgatattcactaacacagttgtcatctctccttctcccgtttgattttctttactaaaatgttttgtctacagaagacacaggcgaagcagaagcagaagcggaagcaggagcaggagatcacgcaggcacagttcaaggtcacggtctaggtccccatctaggtcgttatcacgctctccgaaacgtcacgcagacgctctccatcttattcgaggtctcccaggtaagaacagatggaaagcattacatgtacgtcgaaaatggtgtctttgactctttgctttacctttgcctatataacatattgagttgttgtgtttgcaggcgaagaagcagcaggtcaaggcactgaagagaggaaactctaattgttgcggcagctttttttgttgcctctgttcattttttttttttttctgtgtgttttcgtatccttacgattcagtggtaaaatatggttttgtgggtttacatgggataataacaacgttttcatatgatgttttagaaatttataagatgttataaaaaaataattattttagtagttgaatgtgaagttttatggttagctttgtttgttggattagttaacaaatgtgtgtgtttgtcgtctctgtgtgagacgcagcgtaaccatctccatgcgttgcatcgttcgtgaaagtaaaacctttcataaagtttctaactttgaataatcatccgcaatctttataagatattttcagctaattggaattgcaaatacacaatttcaaaagtcttggttctttccaagaaataatttgttatagagagattgtcatactttacaactacatttagaaaaaatagttaaggctggtcccataaaaacaacttgcttaaccatgttatttgcaaaaacaaacttttataatctccatagtatagatttcactcaatttaagtaagaagaagaccatgaatatcaagcttggggcttgaattctcgcgaaaaggaagcatttaaatggttataacaacaatggaaacaaaaaacgtgacattagttgaaaaatctatttctctgatgtctatatgtatattcttcattttcttcttgtgatgaatatatagataaggacgatttggatgaaggagaataaaaaaaatcaaacgttgaatgtggtaggagcggagtcactataattcatgcgtcaatattgaatattggatacatgacatggtttccattaattggacccattctctgattttttggtctgtttattgaagcagaattatttattattattgttataattgatgcctttgttttgttcgaaaaatcaatgctacattaaataataagagagactagtgtgtgttgtcgtgtgtgtgcttgaccatccccatgcgttagttagataacgtgattataactccgtattactttaaactatactaacaatttgaaattttgtaacttcatctataatccacattctgatgagattttccagctctttggaattgttaagtactaaaagccaaaagtcatgctaaaacaaatcatttcaatgaaattctaaaacaaattgtattttctctcgttaatcaaatttattaaatgagattaaaacggacacctagggtttacaataccatcgatcaataagaatcgacagttaacacttaatccaataaagttggaatacgtagttctttaattaaatagatgtccatttatagatgatacaatattcctttatttgaaataactcccaattgattgtctattaaattttatatcttacccaatggaaatactatgaaagagagtgttaatagcctatagagtgctagctctcaataccatttgttcatctctcaaccatactagtatttttctgcatttaattaagaggtaaataaagtaattttcctcaatttcactgtatattctaggaaattgtttgactaataaaattgaataatttcattgaataatctcataattgtctagctaccaatgagaagtactagtaaagagcggaaactacatagcagaaagagtcttagggtctacgatcctagctttttaggcctgcagaagctaacagttacaaatatctgtaaaaataacctcaaagtgaaaaggaaagaggaaaaaaagcagaagctagttaagagaaacgacaaaagagtctgaatttatcgaaagaacaaaaagagcagaaaaatgtcacatggcaatagtcgtggcttctgtaataacggtacagagtaatcggatgaagaaaattaccaaaaacaaacaaagagaaagctctaacgtcagttaaatctgtttcttttcaccaattttttttttttttctctctcacaatttcatgaagaaaaaaataagattaacacattgaagagcgtgtaaaagaagaaactggtaaattgcattatcccaattcccaaatagagatttgtttggcttttcctctatttttcattattcggacaagccacgacacttgtcttaatgccaccaaaaaaaaaaaaaaaatcactcacatcatctctcttccctcaaagttctcaccttttgagattattacaaagaacacaaaagtacagtttctttattcccttttttgaacactttaaacatcatcactcttgaaacacttcaaatctccggtcaacaaaaaccatgacttcaatttcttaaacaaaaagtttcaatctttttccaaacaaaacccatttcagattttgttctttgagaaaccaacatg

SEQ ID NO: 17310 - DNA, 3003 bp, Unknown; identical to SEQ ID NO: 17309
  misc_feature (1)..( 3003): 2750-1469P.txt file - cDNA_ID_1808519; gDNA_ID_1621088; Annot_ID_170579

SEQ ID NO: 17311 - DNA, 3000 bp, Unknown
  misc_feature (1)..( 3000): 2750-1469P.txt file - cDNA_ID_1808519; gDNA_ID_2926212; Annot_ID_142038
gaaagactctgcaacagaaacggctaagaaacgagaacaggagcgacaaaggctggagaaactagcggaaacaagccggttaagtcggaataggcagcgcagccgtagtaggagtattagtcgatcaccaccaccgaggttgttaataaagttatcatttttgcttcgtgattaaaatggggggatttgtgaagatgagaaggaagttttcggttctagagctctgattggatccgctctcttgatattcactaacacagttgtcatctctccttctcccgtttgattttctttactaaaatgttttgtctacagaagacacaggcgaagcagaagcagaagcggaagcaggagcaggagatcacgcaggcacagttcaaggtcacggtctaggtccccatctaggtcgttatcacgctctccgaaacgtcacgcagacgctctccatcttattcgaggtctcccaggtaagaacagatggaaagcattacatgtacgtcgaaaatggtgtctttgactctttgctttacctttgcctatataacatattgagttgttgtgtttgcaggcgaagaagcagcaggtcaaggcactgaagagaggaaactctaattgttgcggcagctttttttgttgcctctgttcattttttttttttttctgtgtgttttcgtatccttacgattcagtggtaaaatatggttttgtgggtttacatgggataataacaacgttttcatatgatgttttagaaatttataagatgttataaaaaaataattattttagtagttgaatgtgaagttttatggttagctttgtttgttggattagttaacaaatgtgtgtgtttgtcgtctctgtgtgagacgcagcgtaaccatctccatgcgttgcatcgttcgtgaaagtaaaacctttcataaagtttctaactttgaataatcatccgcaatctttataagatattttcagctaattggaattgcaaatacacaatttcaaaagtcttggttctttccaagaaataatttgttatagagagattgtcatactttacaactacatttagaaaaaatagttaaggctggtcccataaaaacaacttgcttaaccatgttatttgcaaaaacaaacttttataatctccatagtatagatttcactcaatttaagtaagaagaagaccatgaatatcaagcttggggcttgaattctcgcgaaaaggaagcatttaaatggttataacaacaatggaaacaaaaaacgtgacattagttgaaaaatctatttctctgatgtctatatgtatattcttcattttcttcttgtgatgaatatatagataaggacgatttggatgaaggagaataaaaaaaatcaaacgttgaatgtggtaggagcggagtcactataattcatgcgtcaatattgaatattggatacatgacatggtttccattaattggacccattctctgattttttggtctgtttattgaagcagaattatttattattattgttataattgatgcctttgttttgttcgaaaaatcaatgctacattaaataataagagagactagtgtgtgttgtcgtgtgtgtgcttgaccatccccatgcgttagttagataacgtgattataactccgtattactttaaactatactaacaatttgaaattttgtaacttcatctataatccacattctgatgagattttccagctctttggaattgttaagtactaaaagccaaaagtcatgctaaaacaaatcatttcaatgaaattctaaaacaaattgtattttctctcgttaatcaaatttattaaatgagattaaaacggacacctagggtttacaataccatcgatcaataagaatcgacagttaacacttaatccaataaagttggaatacgtagttctttaattaaatagatgtccatttatagatgatacaatattcctttatttgaaataactcccaattgattgtctattaaattttatatcttacccaatggaaatactatgaaagagagtgttaatagcctatagagtgctagctctcaataccatttgttcatctctcaaccatactagtatttttctgcatttaattaagaggtaaataaagtaattttcctcaatttcactgtatattctaggaaattgtttgactaataaaattgaataatttcattgaataatctcataattgtctagctaccaatgagaagtactagtaaagagcggaaactacatagcagaaagagtcttagggtctacgatcctagctttttaggcctgcagaagctaacagttacaaatatctgtaaaaataacctcaaagtgaaaaggaaagaggaaaaaaagcagaagctagttaagagaaacgacaaaagagtctgaatttatcgaaagaacaaaaagagcagaaaaatgtcacatggcaatagtcgtggcttctgtaataacggtacagagtaatcggatgaagaaaattaccaaaaacaaacaaagagaaagctctaacgtcagttaaatctgtttcttttcaccaattttttttttttttctctctcacaatttcatgaagaaaaaaataagattaacacattgaagagcgtgtaaaagaagaaactggtaaattgcattatcccaattcccaaatagagatttgtttggcttttcctctatttttcattattcggacaagccacgacacttgtcttaatgccaccaaaaaaaaaaaaaaaatcactcacatcatctctcttccctcaaagttctcaccttttgagattattacaaagaacacaaaagtacagtttctttattcccttttttgaacactttaaacatcatcactcttgaaacacttcaaatctccggtcaacaaaaaccatgacttcaatttcttaaacaaaaagtttcaatctttttccaaacaaaacccatttcagattttgttctttgagaaaccaacatg

SEQ ID NO: 17312 - DNA, 3000 bp, Unknown; identical to SEQ ID NO: 17311
  misc_feature (1)..( 3000): 2750-1469P.txt file - cDNA_ID_1808519; gDNA_ID_2926212; Annot_ID_202701

SEQ ID NO: 17313 - DNA, 1145 bp, Unknown; identical to SEQ ID NO: 14198
  misc_feature (1)..( 1145): 2750-1469P.txt file - cDNA_ID_1808527; gDNA_ID_2214706; Annot_ID_136961

SEQ ID NO: 17314 - DNA, 3003 bp, Unknown
  misc_feature (1)..( 3003): 2750-1469P.txt file - cDNA_ID_1808527; gDNA_ID_1620626; Annot_ID_47136
tgtcttatcatcaagatcaagaattgcagcatgctacaattgaagcaagagatgtgatcagtcaggtagtttgatactaatcaacaaggaaaatataagattatgttttgactaaccgcgtcttccatggtagcgcgccaaccttgcatagacgataaaccaaatctgagcttatcattctcaccatcttctgataacttttcagttttcggagaacttaggtatgtacccatcgctttcagccaaaacaacaacatcattcttagctccacaattcacaattcattttctagctcatagacttgtacatgattcagagttgacataatcaacttagaactactcagcaatcaataatcaacaaagaaactaacttgaaaccatcaaaccaatcagaatcttacacaatctaatatcttcctcataaacgtgtgcatgattcacagtggacctaatcaagaaagaagctaacttgtacgaatcataatcttacacaatccttttctcttaaactgatagacttaatcaactcagaactacttagcacatcaatcaacaaaaagggttttgaatcgatttgacctagatgcgaatatttgactatttggatcggaaaaagattcagatattaaagttatgacagaagaagctagcaacttacatatctgggtagagaaatgaacaaaaaggaagagcctttagagatcttcaagaccaaattctggagtttaggagaagaaacttgatcggggacgagaaaaggaacagaaccaaccacttgaaatcacttgagatcagatgtatgtacaatcaaatcctaaggacaaaagataaaaaaagtgtgttctttttatttattgttttgtccgagaaaagaaaactattaaaggtctttacttttttcaaaactttttcttgttaataacttacttaactaaaacttgagatgtgtaatctttacagctgtttaaagctttctctgattcgtcatcacagctttaagaatgtgtgtaatcgtcattgtaaacagcaaaattacagaagaatttaactagttgtgtatttgctatatgtagaccattagtattttgtcatcttaactttcatataaactggttttgtcgttggctaaaagtatattaaaaattttaaacagaaaaagagtattatggtaggataaattgcaaaaacaaattaacatatgctagtttttacctggcatttaacaaaatttatgatttctgtttttatatcgaacatacatagtttcatgatacaatcaatttttgcacttaggtatgtgaagtaatagaaatggaagaaaaaaatacaagaaaaaggaacttcagaagattttttgtctccaagtgaaagccggtccttagttttgagaggcttgaagcacaaaaataattatgtggtctatcaaatatttacgacttaaatattgtattacaacattattaacatttaaatatcttaaatagctaaaaatataatatttttgactttcaatgaggcaaggaactctcgagagaggtcttcctagacccatgttggtgaagatagcttcgacgtcttctaaaagcacctccatcgattatattaacgagtgtttatactatttttttttaatataaatttgaaatatttgtgaaaggagaaaagagaagaaacatatgttaaagacactttttacttacatgtcactttttgattgggtttaatatttttacaatttattgattaaaattttaatctaacttaagacacttcactttgatcaccggtgcagatactttaagagcctcgcttcacgaagaaaaaccgaatcggaataacgagtgggagtgaattcggtgagcatgtaagtatcaccctcatcgcataaaacctccttagcttcaatttcgaaaagggaattgttatatactgattgaacaaaataaagatattctatagtaaacacatgttatatagaacaacatttgagattgatattgtaataatggagagaggtagcttctaatgagtatactactaaagtactaataagaaaactaaatttggctgtcacatcttatctatttgtttatgtggcccaacatttccaatatatattacaaaataataataatggataggcattgccaccggttagattataactcttcgtttgagtgcgacatatttgtaaccagagacaataattaggataaggattgaaccaaggaactaaacaaaaatttgaggatgaaacatagtccaaaacaaaatccatttaatttttgggacaagaacatagatatcataacacttaaatatgtgcctcaaattggtccaaaatgctctcgtgaatgaacgtggattttgcaccactcaacttaattacttactttgtcccatttaaaaaaaaaaaattataaaagcaaaaatattaaggaaaatttttcattataaaaatatcatctaatattttaatttaaaaccctaccataaatcatagaaaatactgcagcatataaataatcataaaattaaatagaattttacagtgatttcatataaaatactacagaagataaataatcataaaataaatataattttgcagtaatttcatagaataaaatgctccagaatttaagtaatcataagaaatctaataagcattttgtaaataaaaaaatccaactttgtctccaattgaattctgcaaaaaatccaactatactgcaaaacaaattccaattatgtctccaaaacgaatttgaaaacaaattgtgaagaaaaatatcattatattttttgtaaagtaaataaaattaaaaacacatttatggtccaaaaatttagttttttttgtttttttagttaatgtgtattttggcatgatataaagtgcgtcgtgtctcgactatatcatctctcggtttcactattgaacgtgtaacactggtcgaaagaagacgaacataaactcgtctccggtaaccaaaaatg

SEQ ID NO: 17315 - DNA, 1145 bp, Unknown; identical to SEQ ID NO: 14198
  misc_feature (1)..( 1145): 2750-1469P.txt file - cDNA_ID_1808527; gDNA_ID_2214706; Annot_ID_189838

SEQ ID NO: 17316 - DNA, 3003 bp, Unknown; identical to SEQ ID NO: 17314
  misc_feature (1)..( 3003): 2750-1469P.txt file - cDNA_ID_1808527; gDNA_ID_1620626; Annot_ID_162472

SEQ ID NO: 17317 - DNA, 3000 bp, Unknown; identical to SEQ ID NO: 11077
  misc_feature (1)..( 3000): 2750-1469P.txt file - cDNA_ID_1808535; gDNA_ID_2214478; Annot_ID_133193

SEQ ID NO: 17318 - DNA, 3000 bp, Unknown; identical to SEQ ID NO: 11077
  misc_feature (1)..( 3000): 2750-1469P.txt file - cDNA_ID_1808535; gDNA_ID_2214478; Annot_ID_183228

SEQ ID NO: 17319 - DNA, 3003 bp, Unknown
  misc_feature (1)..( 3003): 2750-1469P.txt file - cDNA_ID_1808541; gDNA_ID_1621128; Annot_ID_56420
agaagagttactatttcttgggttaatatgccaaaaaaaataaaaatatgtataggtaagcattaatgttttggtgataagagatttcaaaatggggtatgtacacgtactctttatccataaaatcataaatgctagaagacctttccacaacaacaaaaaatgagccctttgtaattattttatccaaacataattttggaacaattttgtgtaatcatatatatgttaaaaatgcagcaaggcagctcggatttgaggatccaaatgaatacccacaactatgcaaattagcaaatggatatttgttgaaaacaaaagggtatgatgagaatgtggatgagtatttggagaatgaagctgagcgtgattctctctatgttcatctccttgaagaatttgatagatgcattctcacttatttttctttcaattggacccaatcttccaacctcatctctcaggtactttgatttcaatcaaattcagtatatttttatttggtagtctgataggtgaagtaggctatttactacaaccattagcgatctccaataatgtgtatgaataataaatattatcctataacacaaaatgacaggctttaagcgatgagtcggatcagaaagttccaaaactcaaggatttcgtgatggcagcaacaaggtgattgattgttccatatccatgactttatatatgcatacctatagttacatacatataaattgcgttacccgtaatcgtcgttgcgtaatgattccaactaactgtaccaagcgtaacatataatgtagaactgactattaatctataactattaacaaacattgtagaactaattaatggctttgttaataatgtaggaaacagaggtttgagagagtaacaaaagatctcaaggtgaaaagggtaatttcgacattagtagaagagatgagagtcattgggagcggaagcagtgagccacactgtacggaagtaatgtctccggtggctcataacaaacgaagtcccgtccttctccttatgggcggaggaatgggcgcaggaaagagcaccgtcctcaaagatatcttcctagagtataactcttttttcttgtatttctttaacatatggtggttataagcctacttaatctttctttaaataaccagaaataatattttgtaggtcgttttggtcggaggcacaggccgacgcggtggttatagaggcagacgcgtttaaggagacggatgtaatttatagagctcttagctctagaggtcaccacgatgatatgcttcaaactgctgaattggtacgttgttcttagttctagctagccatcctcgattgtgtatatatatttggctttaacatgctacatttctggttatttccttatatatattttaggttcatcaatcatcaacggatgctgcatcgtccttactagtaacagcattgaacgacggacgtgatgtgataatggatggaacattgtcatgggagccattcgtcgaacaaatgatcgaaatggcaagaaacgtccacaaacaaaaatatcgaatgggcgaaggctacaaggtgtccgaagaggggacgataaccgaaaaatattgggaagaagaagaagaagaaacgaaagaaaatggcaaacaacaaaatctgaaaccttacagaatcgagctggtcggtgtggtttgtgacgcttatcttgccgtagcaagaggcatacggtaaagattcatcaagttttcacattttcgaaaatattttgtagtctttgttactcgttgttagctgctattatcatgctaatcgtaaccaaattttgtttttttataggagagctctaatggtgaagagagcagtgagagtgaaaccacaattgaattcacacaagagatttgctaatgcattcccaaagtattgtgagcttgttgataacgctaggctttattgcaccaatgctgttggtggtcctccaagggtaaattagtcaaaagtcaatatcaaatctattacgatgtcgtttttgggagagatactgatgtgtgtgttttaattggttggtggagcagcttatagcgtggaaagacggaaatagtaagcttctggtggatccagaggatattgattgtctaaaacgggtcagcagtctcaacccggatgcagaatccatttacgagctttatccggatccaagccaattaagcaaacccggttctgtttggaatgatgttgtgttagttccatcgaggcccaaggtccagaaggaacttagcgatgcaatcaggagaatcgaaaaggcccaaccaaaaaattgatgatatttgtgaactagacctttgaaattatcttcttcctgaatttgtcatttgtttccgtcagctttttggttaaataagttaataaaatggtttttgttgtgagttgacatagctagtggaattgagacccatagtcattggtcacgcacatcaaccaagaacaaattgcagtcgataaactaatattttgataacagttacgacttgatcctatcgtatataacttcgatttaacaaacacaagtcgtaatttctaaaaaacaattaactcaatttgtttgaaaataaaagtttcctttttcttcgtaacaagtgaagtcaaatgtttttcactcgtatctcttacaacgttttgatgagatgataagagaagagtgggcccacatatttgcttaacaatacacgttttagggttacgtgtcactaatgttattgggttcatttaatctgggcttaaaagaggcgtgtatcatgttgtaatattcccatttgggctttcatataatgaagttgggccgacaaaaaaaaaaaggactagggttcccaagtatcccactatatataattttagtcgaagaaaattcttttatttttctcttgcaaagacctctcagcagccaacgacagttatcaaagcttaagccgttttagggttttatccttttgctgagatccaatcatg

SEQ ID NO: 17320 - DNA, 3003 bp, Unknown; identical to SEQ ID NO: 17319
  misc_feature (1)..( 3003): 2750-1469P.txt file - cDNA_ID_1808541; gDNA_ID_1621128; Annot_ID_172406

SEQ ID NO: 17321 - DNA, 3003 bp, Unknown
  misc_feature (1)..( 3003): 2750-1469P.txt file - cDNA_ID_1808549; gDNA_ID_1621085; Annot_ID_55362
ttaataagattctgcttacatatatcttttgattggatgatgtctattggatatgcatataactgcaagaatagttatataaaaaaaacttcaaatcactatggtcttatatctaaaactcaattaccctaaaaaataataatacattaggttagctttcatatcacaaaaactttttaacttgtcatttcttgcccttctcttagtattgcatttttgtatttggattaattacgtcaaaccataggattgactagttcagcaacaaactaaatacacacatcataataaatgccatcaaatttcaatatcttcttggaattgtcgatttatacattctggccttagaaagttcattttgtcaactagtatcttaactaatcatatcaataatacgaaagaaaaaaacacttaataaaatactaagatacaatctcacaaagaggcaagaaccaaactcaacagtggatgaaaaaaaactccaaccacaaaaataagcgataatattctgattttcaagccttaaatatgtgataaactgaaatttaaactcgatttagctaacaacataaaaaaaagtttaggtaacctgatagtgactatttatcattatttttttgtggacacagaaaatttatcatgtaactcatattatataacaaaatgattgtgcaatatgtgaaactggaacgaatttgaatatgaagcctaataaggctcacgaattctatgattgctttatcaacggtcgcctgatcagctggtgagtacaccagaaatttaaactcgtgggtcctatttttatttttaaaaataatcagtataccaaaccaaaaaacccattacaaaatcttatgattattagtgttcctgaaatttcatgtttattcttgaaaaaaagtgagaccataaatgcaaatgaaaattgacccatactgaatatacgttttattatcattattttagcaaaacacatatttttcaaagaatcaaggtcaagtttccatattagattatacttctccatactctgatgttttctatttaaaacgaagacaacaaggtatatcatctgatcatcaacatgacaacatatcacgacaatagacaattatcttcatttgttataatattagttatgtaattattgtattgcataattattagcttcttttgtttccatacacttagacgctgacatttgtgcttatctcatttttttggcgaccttatctttctacgttctatttttgttggggttcaagtttcaacgactaaaaggaatcaattaaaacaaatattttgatatttaactcactctatttcaaaattcgccgactaatcattttcaggtagattcttgtaaatatcattatacacataattgatttgttcaattttaaacgaatataatataaattgtgccggcataaaatataaatattgcggttaaaaaaaaaaaaactttgccatgaaaatatgaagaggtattcgcgtaattgtgtaaatagatttgattaaattcgtcacaaaaaaaaaccgtggcagaaaagtataataagatagggcgattgacacaaatagcactaaaaaactttattattccaaaaatggcatctttttttgaaacttccaaaaatagtatataaaaattttaatcctctataaattaattcaataataaagtttttttattaccatttgtatcaatctcccaaataaaaatgagagcaaacactaatctaatattaaattgaattaaaaacttttaaatagtggaaatatataccctaaattggaaataaaaaacccaaatataatattacaaactaattttaaaataaaaaatctcttttaaatggtgaaaatatataccctaaattggaaataggaaacccaaatataataccataaacttatattaaaatgaatcaatatttcttttaaatagttgaaatatataccctatattggaaatagaaaactcaaatataatatttaaatttatttctaatttattttggttgaatagattttatataaacttgtggtattattattgtccataaaacttgttttagtgttacttttaagaatttttcaaataatcatttgagtgctaattatgtgtaaacaactttttaatgctatttttgtccaaaaaacttaaaaatgtgctatttgtgggaatttttcaataagatataaatttaaaactgagttgattaattaaaagtgtcacacaaaaaaaagtttaatgtgaacaacaacattaattcttttttaaaaaattttgttttatactattattctattaacatgttaattaatataactagaaaaaaaaatcaatctactaaaactaggttttttagcattttataaatatttgtatgagaactttctctaattcagttcatccagttaaccattgttcgcttattctgcaattcatttatttatctgatataccagttaaccttaaatgttgtgtaatcagtcgtaaaattgttttgtgtaatgttacataaattaatagaatcaaatttaaaatgtgttctaattatgctatgacgttataaacaaacgataaattccgattcatgattatgaagtatttcaattgaaaacacaaaaatcgacaaaattttaaaaatattttagatcttacattacatacctgtattgtcgcaaaggaaaatttatttcttgtcctaaaaggccatttggaacttgagctaatgtaaatatataaatgggcttattgggtcctctaatgggcttgcctttgacgtagaagacagaagcatcgttgtgactcccgtttgtgatttaggaatccgcactgcttgccgttttccgtttctactttacttttcaattcagaaacgcctctctcgtcgtcttcaaagctaaattagaaacctgacgatctctctctctctctctctctcgatcggataatatttgagctttgtggttggaggatctgagttagtcatg

SEQ ID NO: 17322 - DNA, 3003 bp, Unknown; identical to SEQ ID NO: 17321
  misc_feature (1)..( 3003): 2750-1469P.txt file - cDNA_ID_1808549; gDNA_ID_1621086; Annot_ID_55381

SEQ ID NO: 17323 - DNA, 3003 bp, Unknown; identical to SEQ ID NO: 17321
  misc_feature (1)..( 3003): 2750-1469P.txt file - cDNA_ID_1808549; gDNA_ID_1621085; Annot_ID_170496

SEQ ID NO: 17324 - DNA, 3003 bp, Unknown; identical to SEQ ID NO: 17321
  misc_feature (1)..( 3003): 2750-1469P.txt file - cDNA_ID_1808549; gDNA_ID_1621086; Annot_ID_170530

SEQ ID NO: 17325 - DNA, 3003 bp, Unknown; identical to SEQ ID NO: 17321
  misc_feature (1)..( 3003): 2750-1469P.txt file - cDNA_ID_1808549; gDNA_ID_2926172; Annot_ID_140176

SEQ ID NO: 17326 - DNA, 3003 bp, Unknown; identical to SEQ ID NO: 17321
  misc_feature (1)..( 3003): 2750-1469P.txt file - cDNA_ID_1808549; gDNA_ID_2926172; Annot_ID_199595

SEQ ID NO: 17327 - DNA, 3003 bp, Unknown
  misc_feature (1)..( 3003): 2750-1469P.txt file - cDNA_ID_1808560; gDNA_ID_2213649; Annot_ID_132439
acgttccacgcgttcagcaaaatctttttgtctgctgcatgctcagatggaaaaaaagatcagctaattaacaaaatatctaatcagaataatcagaatagtctaaactaatgcagctttacttcatcttaaatcttattcattttcatatatgtaaagttggttacgttaatattaaatctttaagagagcggggaatccgagaacaaacagtgtctctccttcgctaaattatttatttatacagtatagtattaccaaattgcaattaattctttttttatatataagtggtgacaattagtggacttcgctttttatgagaaaaaaatatcattcatattgagacaacaacaactagaaaaaatattctacttactgtattatttaaaacacagatatgtcaataattgaaaaatatgtatgagtggatcaacagtaaaacaaattatatgtaacatatcattctacaacctctccttaaatcaattttttaaattcaagccaaaagctaaacattaaataaacagtagtgccacatgaaattataggtcggaccatagtgaaaatatccactatatatactttttttttttcaactatccactatatatactataaaaacaaaacataaagtccacagatgctgagaatttaattaaaaggagtacacagctgtaaagcctacaacttttctttctcatttatggtgcgaaccttttattgtcctgcccaatgcaatttttttaatatgagtaattaaatatatttttcgtttttataaattcaattttcaaggagaaaataattcgatgtatatgcatattttgtgtgtatatattagcaaattttcacgtgtggacaatctacgtcaatggagtatataaacgtgtgttacgtaggacaaatcagtcgttggattagtagttgccaacagttgccttgattaataaattggtatcatactctcttctttgtgtttgttagggtcaagataatatataaatttgtgatactaatcatagacattttacgacaaaaatacggacctgttcattactcgaaaactatatgaagccgaaatagataatgtcctatttttcctcatcattatcatgaaatctatttaaaaaaatcaatagtggtgtaaaacaattgattcgtcatgatttataggtatgattgctattcttgatttcaacatcgtcagatactaaaaatttcccaatgagtaagttaagattcggaccactgttatttgggatttcttaaaataaataatcaacaacagatttcgtgctatgcccggtaatgttaaatgtagaacatggggtgttttgttttacttaattgtcaatcataaatcaaatattcggattaggaattacgtcaagtgccaattagattgttatcactaaaatcatatcatattgctttctaaaccaattaacgtcagtccatttatttaaagaaaaaataaagtatttcactaaactgtccagtccatttcaccaagtacttagatattcataaacacaaaattaatcactcaacttttaaaaatatttcttctagaccaaatcctgtaccaactcgtattgaatgtttcagtgtaaagtgtaaagtgttttcttaaaaaaattagttaaaaaataactgaattatcacaaaatattttcagaacctagtcacaaatctaataaattacatataaaagcttcttcatagttaaaaaaaaccagtgatttcagtaccaaacaataagaaaagctagcatatgatatatttcttttgctaagaagcatatgatatattcaatattcgtccacgatccactgaatattttttctttattccactgagatttcttttcgtcgctactttgaatctgaacattatttttggtctctgaatctatatgtttgcttgtctttcaacatcatgactcgcatatcgatactacaacttcaactcttcaagcaagacacatggaaatataggagttaacacatgcaaactagcacccccaaattttgtcctcctggctcctacaatagctggaccgaacctacatgaagccggctttatctggttctcttctccagttatgatgtcaaatttaaatcattcatccctcaacaagaattgtcattttaggaaccatcatcataccgagagagagcaacattttatctataaatatagtaatagttctactcttatttcttccgtggtttcttgtaaaaaaaacttatgcatgttcgttcactaaatagtagttaaatttgcgataaacgagcgagatatgtcatgcataaaggagttaaaaattacgtgaagttatttcaatgatcatgcaagaaggattgaatgacttgtaattacgatcaagtaatataaaaatggtctatttgttgttccttcgttaccacagtatggttcttacatgtgaaaatgattgtgctttacataaatgtagtagtacatgagcccataaaaagttactgctcagtcgagttttcactaaccggtgaaaagaaatggataaataaaaatatacacgactacaaatagactctttaaatttgacacgtaaactctatttttcaggagtctttgaggcccactctgataataatatgtcaactaaactttctttttacaaacaaaattaccgttgcataagacacatgtcgtcaattataatccaatatgaagaaagaaagaatataaaacgaaaactttacttttcttatttttttcctatttttcaagatgctaggaagtagccaaatccaaagcattgactcttctttatccaatgtctcaccctttgtcttcaactgttcctcatccttcaccaaaatctctctctctctctcttcttataagaaaagagctaaaaagcttcccttcgttttactatatccatgattctgaattccacacacactgagagagatagagggacacattaaaagctaattcaacttttctgcaatg

SEQ ID NO: 17328 - DNA, 3003 bp, Unknown; identical to SEQ ID NO: 17327
  misc_feature (1)..( 3003): 2750-1469P.txt file - cDNA_ID_1808560; gDNA_ID_2213649; Annot_ID_181555

SEQ ID NO: 17329 - DNA, 3003 bp, Unknown
  misc_feature (1)..( 3003): 2750-1469P.txt file - cDNA_ID_1808564; gDNA_ID_2214662; Annot_ID_188909
aaaccaaaccgaatatagattgacccaaactcaaaccaaaccatactaagagtgcctctaatgtagggttgtaatgcaatttttcagaggttctcttgatattttggatcaaaaataaatcaaaatagaattaaaatgatagaggcgttggagataggcgacacgtatctaaattgtattggttgtgcatggataattttttttgtctcttaaaaggttttgaaaatatatgattattagtgacataatatttagtctgtgatcgactatattgacataaaaacgacataattgtcatccttttcactatgttttgtatttataattattgaatgctttaaatatttggagcagtcacctagcaaagttattgaatgggttcgttcagtggtacataaatgataaaaattctcaaaggagaatcatctttatttgcatcatatcaagaagtaatttgtaaagatgtcgagcgtgcatttggagtattgcaagtttggtttcacattattagaaacctaactcttatttgggataaagaaaaaaataggaaatattatgtgagcatgtatcatgctgcacaatgtaattgttgaagacaaacgagatagatacactctgtttgatgttgagaaattcaagttgaagcaaaccaaacttcaaaagtcgatttatcgtattctacatgtatgcctacaaatctcagagattttatgagcattcaaaatcaagtttgtgattgagagatacatctacaattgaaaggtgatttggtgaaatctatatgaaaagaaatgcataacaatcaacagaataactgatcgtttttgtttttttttgttttacatctattttaaaacatttcaaaataatatatttttaatattttatgctttaataattattaagttttataaaataaaataattttatattaaatttttttcttcagagaactactctaagagatcctaccatttaagtatgaaaaataaaaaacaaaaaaaaaacacaaagctctttggttaatttttctgaaatttaattatagaaaaatggagagaacccttagagaggctctcttctttggaggtgctctaatttcggttgagtttagttaaagttttacaaacccaaataaacagaaccgaaccgaaataaaagaaatgccaacccctattctgtaatgaaattacattctacaatttattgacctctcaactacatttactaatcttatcatttaatgcatgctataaataaatagctttatcttgtggtacgtctttctttttatgcatctccttcaaaggttcattttctttcattctgagtttgttccatcggtacttccttatactttctcgtttcattttcgagatttttttgtttttagtgtccttacaagtaacatcatactttgattactaatagtttcatgattcatcattgttgttcatcatctaatgctctcatttcctcacgcagctccaactttcaaacacaagtgcttttgtcttaagaccttttctcttcgggttcgtgagttaaggtaacaacattactgatgattttggtacaattaataaatttccctaagatttttttaggatattataagcttaatttttaatttgtatagctgatgaacaataaatcacatttattgtagccccatgaagcatgtctcaattgacttttcttgctgcgtttataccattagataatagatagcgataagaaaattaaatggccaagaagcattgaataactaccacgttttaaaatggtatgtacattaggtaggcacgcaaactaatgttactacacaatagtccatttttatttgtttagatatgtaaaaatcgtgtcccaaatttcttctattattttgtcgtatagaagaaagaaacctttcacgggatatgattggttggactttaaaatttttttaaagtcattaaaaaaactataacctcaaaattgaaacaattatgatatagcttttctattttttctcacagcctaaataatatttttttaattattttggctgtaagtacaagttattctaaagcacaagtttatggttctttttttcttttcattttatttttatttttgtaaaaacattactataattttcatatatatatatatatatattaaatttagttttatggatataaatagtagataaatatctactttatgacatatatatatataactcacattgtttttaatatatatatatatatatatatatatattaattaaattgatatttgtgaataatattatataacacataaatacattttacaaataatattttttttgtttaaaaatacatacaaccaaaatcttatttctacaaccaatttctttaagtaataatattatattaataaaatctacaatctaatttctaaatcaataaaacctacagctacaaccatcacacctacaacaaaaaatatacaaaaataaatttacagttacagacgaaccaatcacccacatagcttccatttttaaggtatatagtcgtctagattactatcacaacaatttaaaaaatctagctttttttgtttttgatgtaaagaaatctttattatatattatagactaaaaacgcttttttaacacatgtacgaatccaatttcttatttttggaaactagtgttaactatttatctcttcaaaacagctagaatttttggttttatgttttagtgatgcagaattacaacgcaatgttaggtatatattaattactaaaacaatgtcttgatgcataaaacgttggaaatgttatttttaggcacatataggtttgttaaaattagttagctgttttttgttgtactattaattttttttagtatgtgtaaagctttataattgacctcaattttcatctttctttcaatttgcagggttcttcttcttcttcttcttttttctctaaactggaaaataaagaagaaaagaacatg

SEQ ID NO: 17330 - DNA, 3003 bp, Unknown; identical to SEQ ID NO: 17329
  misc_feature (1)..( 3003): 2750-1469P.txt file - cDNA_ID_1808564; gDNA_ID_2214662; Annot_ID_136534

SEQ ID NO: 17331 - DNA, 3000 bp, Unknown
  misc_feature (1)..( 3000): 2750-1469P.txt file - cDNA_ID_1808572; gDNA_ID_2214530; Annot_ID_134260
ggttagagttcttgaatccttctcttgactctctatcccaatccttcacaataataaacatttttgatcatttagattatttaaaaattgcaatatataaaaattatacatattttgagaaatcctaacctgaatgtagagacgtgtgttccaatcttcttgagctgagacattacatctgagaagatctcttctagttggagccacattagggtttcctctccaataagcatacgccacgcggtctttccattgagtcatcttattcccttcttctatcgccactagcgatttatcccaaggctttatattaacctcagccctagcccaataataatataattagctaggtccaataacaagcccattaaatagagaacagaatagaattaacatgtgtgttaagcccttaccagccccagaaggaccaatcagggaagacaatatccaagctggcgtcatcagagcaataacggaacaaaggaggcggggccgggtgttgttgaccttgaaagtctttagatcggacggttggtctatcatctgggtcaaacatgagctcaagatccggtaacctacctgggtaccaccgtagtaactgtacgatgccccacagagtaaaaacgtctcttgtttggattgactttctatatttcttaacgtacactctcccgtcgaggattactactctgaaatgcgccgtcctcctggctttctcaagcatccctctcgttacacctgtctctttccatggccgtagatcttcgtggatccaacggaagtaagaaggacacgtggatattcttgaatggctgcttctgggtttgtcgttgtttctcgaggagccattttggggaaataattgagtttggttctgaacgacgccgcattggttagggaatctttggcttgtgattggtgattttctgatactagttgttacctgcttcagacctgtaaaagttgtctgaagtacagagagatatgaatttattaactcttcaagttcaagattcacttgattgaataaaaagtttctaaaaaagaagttacttcagattcgaactcacgaaatcgaaacaacccaataagtctaagagaccagcagatatgaagagagaggtgacgaggaacagagtagctttagcgatgctttttgctggatgcgacgccgttttaagatagacatacttattcttgttcgttagaagattgttgttgttcctcttcatgcttttccgttgaagcatgaatctatatctatctcagctttatatatatctatgttcacaaacattcaacaggaagagaagaaaaacgagaatcaggtgagattaaacgttaccgaagctaggaggaagctcaaaggtttgattctggtgatcgattggtgctcttccacgaggatttgaatcttgtttcacgttatcttcaacactaaccagagttcacatcttttgtgttaatgacgttcatatttttgtgtgaatcttgtttactttttagtttttcgaagagttaaaatgtttttaaatattaaatagataatattttattaattagtaggagacatttggtcatccatatttggtattcctatgctcaaatcacatatggacattgatatgtgatacacaaatgtttcccaaataatcgtctcttattaacgttgtatttattggtaaataactaaatacaagacctttgatgttcttagaaaaataatctgcttactacaaaaataaaactgcaagagttcaattaattaaagtcctctttgggaaagtttgttataagtgctttaaactgaataaaagaatccgaacttcgaagaaagaagaaagaagataaaccttaacccattaaataaaggtcagtgacatcatagtccatattcgaccactcatcatcatacaagacagataattaatcgtaaataattccatgttgtagagtactttttattattatacaaatacattaatacatctttcacaggctgttcgaaactgtgagtctgtgattagtgattagccttaattaatttactttattgctttgttagaaaaaaaattacacctttctttaaattaaaacaagttgggcaggaaatttaaaaacccgttgggccattaggattcacaaaagcccaacacctacaaaaagagatgtctccatctcatagtccatataccacatgcttaaaccagtttaaattgcatataccacgcgccacataaccggaaagttttgtacacgcgcgagacacagacattatcctttttgtatctgtcttccagcgtgtcgagtcagtgaggctccacgtcaccctttgatccacttaaattttaaaactaaaataattgtttaaatgaattcgagtgattgatattttattatagatttaatacacacccgacactctgtcaattctataggcatacgagctcactccaaatttagattcagttttttaatacgaactttttagttaagccaagattagcaataatatagatcatttattttcttgattgtagtttgattgttgtttttctcataataaaaaaatcccagctaaaatctgattttcaattttaaaccaatttatatggtaaacaaaattttagttcggtataattggaagaattaagttttgttgaatatcaggaaaaaagaaggggaggacaaattttctacagaggtgacgtggcatcattgaaccactttacttgtcggcagtgaggtgtgtttaatcacgtgtaacgcatccaatgcgtatgagagctttacagccgcacgatcacatgggtacaaaaatcaacggcgaagcaaaacaagagtctcacacttattaaacgcgcgtagtacgctccaccggtataagctaacggaggatataaaaactctttaactcattattgtcctaaaatctcaattttatccattttcacggaaaaaacataaaatctgttcttcttcttcggctgagagacaatg

SEQ ID NO: 17332 - DNA, 3000 bp, Unknown; identical to SEQ ID NO: 17331
  misc_feature (1)..( 3000): 2750-1469P.txt file - cDNA_ID_1808572; gDNA_ID_2214530; Annot_ID_184902

SEQ ID NO: 17333 - DNA, 3003 bp, Unknown
  misc_feature (1)..( 3003): 2750-1469P.txt file - cDNA_ID_1808574; gDNA_ID_2214535; Annot_ID_134363
tagtagaaaaccatctcaaacaaatatcttctacgtaccacttgagtttggattataaaaggacttggtagaatgaaaaagcatgactcataattaaataaaacgtacaatgtatctaatccttcatttgtcaaaatggtaggtggtcacacatttggaaaagcacaatgccaattcgtgacacctcgtctttacaacttcaacggtaccaacagaccagacccaagtttgaacccaacttacctcgttgaactccgtcgattgtgtcctcaaaacggaaacggcaccgttctggttaacttcgattccgtgactccaactactttcgatagacaatattacaccaatcttcttaatgggaaaggtttgattcagagtgaccaagtgcttttctcaactccaggagctgatacgattccactagtaaaccaatacagcagcaacacgttcgtgttctttggagcattcgttgatgcaatgattaggatgggaaatcttaaacctttgactggaactcaaggagagataagacagaattgtagggttgtgaatccaagaattagggttgtggagaacgacgatggtgttgtgagttctatctgattatgcatgttggggatatatggatatgtaagaacgtataaaatgtgtgggattgtgggaacatttcgactaaataaagttctcacaagttgtgtgatttatgaaatttggtcttaattaacacttttgattcgattttctgagtactaaaaaagtggatgaatttcataatgaaatgatacgtggtgtttgtataacacttaactttcaattgacatagtttcatgttattggagaagttaaattgtgtgtaaaaatataattcgaacatgcatccatttctataaataaatatcgaggttatcggattaaacaaagcttgtaggacctaaatatagtcatgaaactacaaccctaatagaagtttcaaacataatcaaactttagtcttgagcaaagaaatagaaaatatataaaagttatactcttgtaagcaaagaaaagcccaaacgaagcaaaacaagacaaaaagcccagtttaaagtagatgtaagcagatttacttgctacatcatcaactccccattttacatcgtcccaatgagatatatccactcttttcatagaatttgatgttttcacacgaatacgaaatcccaaatatataatctatcccttataattcataattatatacaaaaaatatgcaatcacacaactagccattaaatactatatagaaatatcaccacttgtcatttcaaaacaatacactaattaatgtctataattcaatccttgtcagatggagataagagagacacaatccataattttgttgctcattcatatagttcaagtgcgttggctcacggcaaacattttaaatttagacccacgccggagaaaatctaattagacgcatagtttattatagtggatttcattgggacaaacaatattagccgcattttatgtaatatctttcacttggaacacgtgccccatacacatatggtccctccatgctttgtacttatgtagttttttgtatgctacgatttggtattattgtatcgcaacgcgtaaaaaaggagagccaagtgtgtctccaatctttgggattgatttaagaataaaagataggaaagacaattatatgtccaatctttaagattgatgatttaaaattttgtagttatcatgaaaaacaaatttttatagtgttgtagggacgtaggtgatcattctcatgactcatgacacccattccatttaccaaatgcattacttatttacttgttttggtacaataccaaacacactaacaatgatttaacatttacttaattataatataaatttgcttacgaaacaacttgcattaaacaatttgcttctactatacttatattgatctatcgtgggcggtgagtaaaatgagttgggacatggatttgtcatttaggtcatttttagtaaatgtgaaacttgtaaccaaaatatgcataaaaactttagcctttctaaaagctaaaaatggtttgaggaacaccaagacgtaagctcttttaagctatttgatgtttgatgtgataaaataactaaaaactatttgttatgttttttcctccccttaaagatataagagaagagaaggtaaagaagttgtgtaagttagtcacaatcaattgttggaaataaatttgaaaactctgttaaaagtcacccaaatgagtttcaaacaagagttaaaagattaaaaaaaaaaagtaactgatataaagaatggtagtttactttttttttaaagaatggtagttttttaaaaactatttaggttgatggtatttttgtaaagaaatccaaaaattgtagttgatacaagaaaattttgatttgtgttgatttatttctcttttggcatgtgaatgtaagtaatctttttccacatgatttctaattctggacttgcatgtcttgttacgccagtcaacattcgttggataagttacaatgtcatttacaacttgcagattaattcggaaatcaagaaggaaaaaatctgaattagaaatagtaggttggatttttcacaaaaaaaaaaaaagtacaatattttgagatatgaccattagattcttaaattttacgattctaacttgtaagatttcaaattaaaccatgtataattcaatttaggggtaatttaatactttagggtagtaacgataaaatagataattaaattgaagtttaaggaccatcctgtaaattcaagttcggtaccggaaacacgtcagcattgatctaatagatacgagtcctcctttctctataaataacgtaatctctctcccgtcttcattaccatcgaaacagtgtcgtcgtagtctctctctctctccgcaaaatatcatcggagaaaagaaacagagacacgaaacagagaaaaccatg

SEQ ID NO: 17334 - DNA, 3003 bp, Unknown; identical to SEQ ID NO: 17333
  misc_feature (1)..( 3003): 2750-1469P.txt file - cDNA_ID_1808574; gDNA_ID_2214535; Annot_ID_185063

SEQ ID NO: 17335 - DNA, 3003 bp, Unknown
  misc_feature (1)..( 3003): 2750-1469P.txt file - cDNA_ID_1808595; gDNA_ID_1621088; Annot_ID_55409
agaacattgtatctgaaacgttacgtctgtaccctgcagcccctatgctgcttcctcacgtagcctcgaaagattgtaaagttgggggatacgatatgccgcgtgggacgatgctattgactaatgcatgggctatacacagggatcccctgctatgggatgatccaacgagcttcaagccagagaggttcgagaaagaaggagaggctaagaagctaatgccgttcgggctaggaagaagggcatgtcctggatccggtttggctcagcggctagtgaccttgagtctcgggtctttgattcaatgttttgaatgggagaggattggagaagaagaggtcgatatgactgaaggtccaggactcacaatgccgaaagctagaccgttggaagctatgtgcagagcacgtgactttgttggtaaaatcttacccgactcctcttgagtttttgtatgtaaaatgctaatacgttgcttagcaacggtaacgaattaaatgaaacgtattagcataataaaaatcagagacaaaaatcatattctaatttccaataacccattgttaattatgttacagtcttacaaatatgaatgttcagtgttatcaatcaaacaaaattctaggtgtgaaaaaaaaataaaaaaatctaggtgtggcattgctatgctaaatgtcatataattagctaaaataaataaataataatgattaggtatctaaacgactaatgggcacatgtgatttggccgaaataagattctgttttcgaagtcaacgtctatggagtagttcaagcagattttgcaccacatcatcctctgttacaacccctgaagatccttgaggaagaagaagtcaaatatggaaggtcaaaccctaattttcacattccttttcatatctctttctctcacgtttatcatcggaagaatcaagcgaagacctaaccttcctccgagtccgtcgtgggcgttaccggtgatcggtcacctccgccttctcaagccgccactccaccgagtttttctatccgtctctgagtccctaggcgatgctccgataatctccctccgtctcggcaaccgactcgttttcgttgtctcttcacactcactcgccgaggaatgcttcacaaagaacgacgtcgtactcgcgaaccgcttcaactcccttgcttcaaaacacatctcatatggctgcacaacggttgttacagcttcgtacggcgaccattggagaaatctccgccgtattggcgctgttgagatattctcggctcaccgtctcaatagcttttcatctatccgccgagacgagatccaccggcttatagcttgtctctcacggaactcttcactcgtaagtttgttctttgttctttgttccaattttatgctaattagcaaaatttattataatcagaatccttagtccctagtcaatctctgcttataggtgaatttcagtgaattgtagcaaatatttaacatatgatatacaataaattttgcaggaatttacaaaggttgagatgaaatcaatgttttctaacttaacattcaacaacattataagaatgttggctggaaaatgttactacggagatggtgcagaggatgacccggaggctaaacgcgtgcgggagcttatagcagagggaatgggttgttttggtgctggaaacactgctgattatttaccgatcctgacttggatcacaggttccgagaaacggataaagaagatcgctagtaggcttgatgagttcttgcagggattggtcgatgaaagacgagaagggaaggagaaaaggcagaacacaatggttgatcacttgctttgtctgcaagaaacccaacccgagtactacacggacaacattatcaaaggaatcatgctcgtgagtaacattttaagttcattagtctattgtcacatttggtatgggattaattagttatgtttgtttttttgtgtatgcgtccattgtgttgaagtctcttatactagcggggactgatacatccgcagtaacattggaatggacattgtcagctttgttgaaccatccacagatactaagcaaggcgagagatgaaatcgataataaggttggcctcaacaggcttgtagaggaatcagacctctcacatcttccttatcttcaaaacattgtgtccgagtcgttgcgcttataccctgcgagtcccttgttggttcctcacgtagcatcagaagactgtaaagtagggggttaccatatgccacgtggaacgatgctattgactaatgcatgggcaatacatagggatcctaagatatgggatgatccaacgagcttcaaaccagagaggttcgagaaagaaggggaggctcagaagctattggggtttgggctaggaagaagggcgtgtcctgggtccggtctggctcaacggctagcgagcttgactatcgggtctttgattcaatgttttgagtgggagaggataggagaagaagaggtggatatgactgaaggtggaggaggagtcataatgcccaaagctataccgttggtagccatgtgcaaagcacgccccgttgttggtaagatcctcaacgagtccgcttgagcttagacttttgtactaaatgctaatttgtgttttttgagtaacggttacttttgtactacttttgttattatgtaaaaagaggaaataatttcgaggtgatacatccaaataatatattaatacacttatattttacttttaagaaagaaaatcttgagaagaaatctagaattataatttcgtctgcttttttaaaaggtttttcttaattagagtccaacgttcgaatttgaacttgtgacaatagtacattatcttttatagagcataatttttaaaaataatatatttccttgaccacatgtatatatctccaaaacaatagtaaaaaaaagagagacgaaaagaaagaaagagagagagccccacaaacaaacaaaatg

SEQ ID NO: 17336 - DNA, 3000 bp, Unknown; identical to SEQ ID NO: 4006
  misc_feature (1)..( 3000): 2750-1469P.txt file - cDNA_ID_1808595; gDNA_ID_1620678; Annot_ID_164304

SEQ ID NO: 17337 - DNA, 3000 bp, Unknown
  misc_feature (1)..( 3000): 2750-1469P.txt file - cDNA_ID_1808595; gDNA_ID_2926213; Annot_ID_142074
cattgtatctgaaacgttacgtctgtaccctgcagcccctatgctgcttcctcacgtagcctcgaaagattgtaaagttgggggatacgatatgccgcgtgggacgatgctattgactaatgcatgggctatacacagggatcccctgctatgggatgatccaacgagcttcaagccagagaggttcgagaaagaaggagaggctaagaagctaatgccgttcgggctaggaagaagggcatgtcctggatccggtttggctcagcggctagtgaccttgagtctcgggtctttgattcaatgttttgaatgggagaggattggagaagaagaggtcgatatgactgaaggtccaggactcacaatgccgaaagctagaccgttggaagctatgtgcagagcacgtgactttgttggtaaaatcttacccgactcctcttgagtttttgtatgtaaaatgctaatacgttgcttagcaacggtaacgaattaaatgaaacgtattagcataataaaaatcagagacaaaaatcatattctaatttccaataacccattgttaattatgttacagtcttacaaatatgaatgttcagtgttatcaatcaaacaaaattctaggtgtgaaaaaaaaataaaaaaatctaggtgtggcattgctatgctaaatgtcatataattagctaaaataaataaataataatgattaggtatctaaacgactaatgggcacatgtgatttggccgaaataagattctgttttcgaagtcaacgtctatggagtagttcaagcagattttgcaccacatcatcctctgttacaacccctgaagatccttgaggaagaagaagtcaaataatggaaggtcaaaccctaattttcacattccttttcatatctctttctctcacgtttatcatcggaagaatcaagcgaagacctaaccttcctccgagtccgtcgtgggcgttaccggtgatcggtcacctccgccttctcaagccgccactccaccgagtttttctatccgtctctgagtccctaggcgatgctccgataatctccctccgtctcggcaaccgactcgttttcgttgtctcttcacactcactcgccgaggaatgcttcacaaagaacgacgtcgtactcgcgaaccgcttcaactcccttgcttcaaaacacatctcatatggctgcacaacggttgttacagcttcgtacggcgaccattggagaaatctccgccgtattggcgctgttgagatattctcggctcaccgtctcaatagcttttcatctatccgccgagacgagatccaccggcttatagcttgtctctcacggaactcttcactcgtaagtttgttctttgttctttgttccaattttatgctaattagcaaaatttattataatcagaatccttagtccctagtcaatctctgcttataggtgaatttcagtgaattgtagcaaatatttaacatatgatatacaataaattttgcaggaatttacaaaggttgagatgaaatcaatgttttctaacttaacattcaacaacattataagaatgttggctggaaaatgttactacggagatggtgcagaggatgacccggaggctaaacgcgtgcgggagcttatagcagagggaatgggttgttttggtgctggaaacactgctgattatttaccgatcctgacttggatcacaggttccgagaaacggataaagaagatcgctagtaggcttgatgagttcttgcagggattggtcgatgaaagacgagaagggaaggagaaaaggcagaacacaatggttgatcacttgctttgtctgcaagaaacccaacccgagtactacacggacaacattatcaaaggaatcatgctcgtgagtaacattttaagttcattagtctattgtcacatttggtatgggattaattagttatgtttgtttttttgtgtatgcgtccattgtgttgaagtctcttatactagcggggactgatacatccgcagtaacattggaatggacattgtcagctttgttgaaccatccacagatactaagcaaggcgagagatgaaatcgataataaggttggcctcaacaggcttgtagaggaatcagacctctcacatcttccttatcttcaaaacattgtgtccgagtcgttgcgcttataccctgcgagtcccttgttggttcctcacgtagcatcagaagactgtaaagtagggggttaccatatgccacgtggaacgatgctattgactaatgcatgggcaatacatagggatcctaagatatgggatgatccaacgagcttcaaaccagagaggttcgagaaagaaggggaggctcagaagctattggggtttgggctaggaagaagggcgtgtcctgggtccggtctggctcaacggctagcgagcttgactatcgggtctttgattcaatgttttgagtgggagaggataggagaagaagaggtggatatgactgaaggtggaggaggagtcataatgcccaaagctataccgttggtagccatgtgcaaagcacgccccgttgttggtaagatcctcaacgagtccgcttgagcttagacttttgtactaaatgctaatttgtgttttttgagtaacggttacttttgtactacttttgttattatgtaaaaagaggaaataatttcgaggtgatacatccaaataatatattaatacacttatattttacttttaagaaagaaaatcttgagaagaaatctagaattataatttcgtctgcttttttaaaaggtttttcttaattagagtccaacgttcgaatttgaacttgtgacaatagtacattatcttttatagagcataatttttaaaaataatatatttccttgaccacatgtatatatctccaaaacaatagtaaaaaaaagagagacgaaaagaaagaaagagagagagccccacaaacaaacaaaatg

SEQ ID NO: 17338 - DNA, 3000 bp, Unknown; identical to SEQ ID NO: 17337
  misc_feature (1)..( 3000): 2750-1469P.txt file - cDNA_ID_1808595; gDNA_ID_2926213; Annot_ID_202756

SEQ ID NO: 17339 - DNA, 3003 bp, Unknown
  misc_feature (1)..( 3003): 2750-1469P.txt file - cDNA_ID_1808608; gDNA_ID_1620653; Annot_ID_47774
cacacattgggagatgtatgcgattggtggaagtgctaatcctacaatcaatagtcaagggaacagatttttggcacccaatatcagatttagcaaagaagtgactaagcatgaggacgcgcctgagagcgagtggaagagatggaattggagatcttccggagatttgttgctaaacggtgcgttttttactccgtctggtggtgcagcctcgtctagctatgcaaaggcttcgagccttggggctaaaccgtcttctctagttggaccattgacgtctacttctggtgcactgaattgccgtaaaggttcccgttgctgattgtggcttagtggtcacacttaagtttttaccccattattatataggaaaaggcaattaaagccaccaattaagggggattaagtagtgtagtaagactttcttaatcccttgatttactcttttttttgtttgtttattcgggtaaaattgaaggagaatacaacctctggctagctgctctctaggacccttcttaaggattctctgttttaaggaatctttaaattaggttaaagtgtgggaacaagtgcagatgtgttgatcttgatattaatataaatatgattttgtgtctttatcttttactagtattattttcttatgagcattgcaatgcaaagacatagattagtcacaaaaattagtttgaagtataaatttgcgtacacacatgatggagaggttagttaaaagtgtgcccatttggcaagtcaataatggctctttgattttccaaataaaatgactttttattcggaagtttgtaatgttatgtaaaatggtaacttttgggtcaaagatgttggagccagtcaatgtttgaccaactgccgcgacttttttttcctctggccaatgcatcgattccggtaaattaaaagaaaaattacccttaaaaataggaaaagaaaatcctaggcatgacaatgagagaagagaaaagtgaagttgatagattttgaatagaaaaaagaaatactaaaattttcaaaagaaagataattggagcagtcaataccacagtagctctacttttgatgggtttgtctcatattcgtgttttgactactgtccactgattatgggatttatttaaaatttgaaagtaactaattaaacaactaaccaactttctttgtggccatgtgcacattttcttttgttaaagatggccatgtgcaacatgataatacatctaggaacgaaaggaagaagaaaactttgaaagtaacaagtggtcgcaactaatgatgtgatgtagttggtgtgattagtatgtggctggtttgatttggtcagtcagtgagtattaaatgttagtttgccaagaaagattttttttttttttggtcatactgtatatagcataaaactaggtagagaatttccttgttatgaaaaaaaaaatctttacatttgagttattggggaacgaaagaaattcctatggagcaagaaggtttaagtggccatgttatgagttgtgtgcggtcacgtgtactggtcagttaatttagttgtaacaatcgattatatttgttctattattctttatatttcagtgatgccgtaacagtaagaaattatagttaactgaaaccaacaaaaagattcagaattactggtgttattcaattatggagttaaagttaattctttaaactttagatttgttttctgatattgcttttaagaatatgtttgtatgaatttcaaaatctctgcaatatatcttggattttgattctaatgatttactcatgaaactccaaagaggtttcatttcaaatcaattaatatacaaagattttacaagacttttagttttgaacaacattggattttaatgaaatatttaaaatcttaattgaataacaccaaactttaaaatctattaagcatgatttacaaatatgagttccaataacactagattttaaagctggatttagaatcattagttgaataacattggattagtgttggatttcaattctattaaaattcattaacgaataacacccccttaaagttaactctttcaaaaccgatcataacgcacacaagcctccaccgaaatgtttgacaccataatattttactaccgagttcgcaaggctaatatgtatttccttttgtaatttttctctttattcgtattcgagaataagtggattgttcttccgaaagttagatagatcattatgaggttgttcttagagagctagaaaactcaaaacaagtttatcaagtcgatcaactctttgataaactcaacaaatagttatcattgctcattataagattgaaaatgagactttgtattgtggaaaataaaatgcttacctcaagtgaaattttaaagtttatgctatgatgtttgtgatttcgcaattatatgatttaatgatattaaataatcaaataaataataattcattaaaattcacatatggtttaaataggtctaaatgagtttatatgggtcaaaataattttgatggttctaaatgggcttcaaatttaagtgggtttatatttacatgagtgtgtgtgtttacatgtagaggggcttacccaaattaacatccaaattaacatagagtaatttccaaaatgaagtaagattaacattcaaattgtgactagaactttgatttgagttatatagactttgtgtattatttttttataatataaacttcgttttgataagtttatataaaccttgttttcgtaagagattgtgaaattttctttgcagagggacatggttattttttgtctttggttcttgtaatgagattttaactatggtaaatctaagagcccatttgaagatgatgtctcggccctccttatccttatctcgcccaccgttctaaaacccttcccttcctcttcttttctcttctccttccacttccacttcttctatctctcacaattcagcaatg

SEQ ID NO: 17340 - DNA, 3000 bp, Unknown; identical to SEQ ID NO: 4063
  misc_feature (1)..( 3000): 2750-1469P.txt file - cDNA_ID_1808608; gDNA_ID_1620681; Annot_ID_164436

SEQ ID NO: 17341 - DNA, 3003 bp, Unknown; identical to SEQ ID NO: 17339
  misc_feature (1)..( 3003): 2750-1469P.txt file - cDNA_ID_1808608; gDNA_ID_1620653; Annot_ID_163528

SEQ ID NO: 17342 - DNA, 3000 bp, Unknown; identical to SEQ ID NO: 4063
  misc_feature (1)..( 3000): 2750-1469P.txt file - cDNA_ID_1808608; gDNA_ID_2926186; Annot_ID_140786

SEQ ID NO: 17343 - DNA, 3000 bp, Unknown; identical to SEQ ID NO: 4063
  misc_feature (1)..( 3000): 2750-1469P.txt file - cDNA_ID_1808608; gDNA_ID_2926186; Annot_ID_200622

SEQ ID NO: 17344 - DNA, 3003 bp, Unknown
  misc_feature (1)..( 3003): 2750-1469P.txt file - cDNA_ID_1808620; gDNA_ID_2214558; Annot_ID_134846
gaactgacattgaagcgggagaactcaagcttgaggtgtctgacgaagtgatcatgacatttctcaaaagctctttcctcatcttcaacaaagaaacttttgcttgctttcctaaacaattttctatgttccttttgcgatttccccagtgtgcttatcaatgcattctcatcaactcccattcccatccctataaacaacaaacatacattttttagattttcaatctcaaatccaaatcattctttgtatcttccaagaaccataataaaatcaagaattaaatattacaattaccagctgagatggcttcagtgaggctttcgagctcgagaggaagagccattttcttgcagttgatcttttattactgtttttgatttccggctcttggtttggtttctgtggaaatctatggaagagggacaagacgttttatatgatgattaagggtaatgttgtggtttatgggagaagagaagggtgttttaggtattcaatacaagatttaagacaaatgctaggggcattgttgtaacaaggagtaacgcccacgcaattaattgcatatgttaacaactgttttacgcaaacggaatttacatacttcagtaagttcaagacaaattaacacttactgtttttctttgtcttaagtggaatttattaagtttgaccactataaaagttgtacttaagtgtcatcattcatatctataatccaaaacggaggttcttgaacacagataagaagaagagtttattttcttttacagttttcgaaaagtaggaaaattacaacaagaagtagagtctgacaaatgaaagtttctttagtataaaataaaatagtaaagaattatgtaaaagaaacagtaaagaatattatactttctaaagaaaattaagaaagtgaaaaagttatttggagaaattacgttttcagaatataggttctcaaaattagatgcaaagaacataaaccaaagtgattcaagtgatggtttaggatatgatcatatatcaaaattaagatccatgtgtcgaatagctcaaatctgaatttgtcaatattaaaggcaactaatctcactgaatcttaaaacatatataaagataatatctacgaaatagatagtctttggtgccaagaacaaggttttttttttgttactgcgaaacacacatggacctattacagaaaaataatggtttgaatatcatgggcaaaggagacagcttatctcttcttctctgttttttttcttctcattatgtccagactgtcccatttcataaattatgcacacaattgtagtagatggcaagcctcaatcacatttgtttcgcattattgtgacttgtgagactaataattaagcttctataatatatatatatatatatatatatatatattcaacaagtactatcacatgtttttttatagattatatattgctgaatatctatctgaatctgacaatgagatttgagaagattgtacaaccactacatgtgtcgcttaaccaaaatataatttggtcaaccaattaagacccgatttatatagtatatgagaattagtataagcgatttatacatcaaaacgtgttttgcacaacttccgctgaagctgtttaattagcatgttcctcatatatagttcaattttccacagctcaaatgccgccagcatataacccttacgtcaaatttcctcatattttattgtgtgtcataagacttgcgtatatccaattatccatacatgacacgatcgatactgaagaatataatttgaatattaatcacgagataactcactcattaaaattttaaaaagtttacaagattacgagatactcacttattggcattaagaaagtgtgaatcattaatcaacttacgtgtagattccagtactttcgcgccagggtcgattcacatttgtttacattagagtgatcagtttttaatctactacacacgaattttccatcgaaggatcaaaaaattctagagtatgattattttaaaaaagaaaagatcacgttttacacgacgagaggactagcaataatttggatcgaggacagctgtgttgagccgtatcatttgcaaatcgcaatctatttatttatttgatttgatttggttatacttagacttcactcataagatcatcccatcatgttcctaatcttaaatggtatttctatttcgcacatgtcacaacttagacagttgactaaatcataactttatatttaggttttaagtattaaaaatatatcaaattatattataagttttgtaatctctttttgttagtttagcctaccaaaaaaaaaagaaatctctttttgttagttcttcttgtcttttcgtaatcaactactatataacctatatatttatttatataaagacattgttaacttcgtcatcaaaaccatttatttatttgtccatttatttgctaccttagtttatttttagtactatatgaaatatcatacattttattttatcttaaattaaatacggtacaagttaaattcctcattaaaaccattgtacgttgtttttagtcctgttgtaatatcatttatttcattgcaagtttgcaaccttacaaaaagtaaaaatatgaaaaggttattttgtgttaattggaaattattacatagtatgtaggatatgaaaataggttaggagaaaagatgctccatagaactcatcaatacacacaactaatatatgaccctaattttaaatgtcctcaaaacgaaaaatctcgacagaaataggctaattgcgtcatattacagtttcgtcttcgggggcatttatgtcaaacaccatccccagctacataattacacctcctaagtaaataactccgccttgaggaaaaaaaactaaaacggctctaaattgaaaacaaaagaagagagagagagagagagacgaagaaacagagagattctctcgaaaatg

SEQ ID NO: 17345 - DNA, 3003 bp, Unknown; identical to SEQ ID NO: 17344
  misc_feature (1)..( 3003): 2750-1469P.txt file - cDNA_ID_1808620; gDNA_ID_2214558; Annot_ID_185818

SEQ ID NO: 17346 - DNA, 3003 bp, Unknown
  misc_feature (1)..( 3003): 2750-1469P.txt file - cDNA_ID_1808627; gDNA_ID_2214493; Annot_ID_133507
aagggtgaccggcgcggcataaaattgccctggagtcaccaacattcgcaacgaaaagcttattctctactaggagagaggctatagcagtacaaccaggatgccagtctttctgactcaccctttttgactgacgatgggaatccagttcttgtctgaaagctaaatctgtcctaacaaatgcttgtgacaatgcctcgccagcgctgaaaatgaaacatgccaatgggtttttcgaacaaaccatgctgagaatatgaaaagattgaactgagcattaaccttgtggaacataagctttgaactagtcctggcaaaacttgagcagaaaattcagcagctgcagcgcctgcatgtcattcaagatgctattttatatcctatttgatggatagctaaagaatttggagtaaaaagagagagggcacaagtaagaatttggagtttaatgcgtcctggataaaattggcagttggtatacctctatgaccatcgaagatggcaaataagtggatgctttcctcattacacatgtgcggtatgatgaagtgtgtatcttccatggattctcttcttccacatgttgcaaaagacccacaagaaattactgggacatatcttgaaggttcatctgttgaactagaccataatttcacatcaaagacagtggaaacagacgatttcttggataaacactccccttgactaaaccaattaacggtgtccctgtaatctcctgaatttttaatgatgtccgccccatccgtatcactctgggaattagaagttttctcaaggagatgaccttgctgttttcctctcacttgttcccaaattgattctagttccaaaaccacattgtccgaagaaggtcgtttagacggatcagattcccagcagttttgtatcagagatagcaaactctttggaaggtgcaatccaatttcagcaagagctggtcgcagaccagaagacacaatggcaactgtaagttgctgttctgtgtaattcatctctaaaacagtgtgagcctgccatcaagatatgcaaagggaaacactatgtgtcatgaatgaaaagaacaagaatgcattcatataaactgctatatgtccataaaatcatatatatttatcacagaaatcgtaagaattgggcttgccaagatatagcaatatcattgaacggcaaatgaatgcaattcaggagcctgaatatatgaaaatacagtatatcgtatataaaggcttctcccagagataataatgtcaaaatgcgaaatgaggaaagaaaattttaacctgagcttctgcacgacgatcagtatatggaacaactccagttaaaagctcactgcaatgtaagatggaaaaaaaattcataaccacagggatcttttaggaagaaagctaaatatactccaaacgaaatataagatctaaagaaaagttgaatgtaagaaaatacgaagaaaaaactttacaatttctactcaaagataattcttacttgatcaaaatcccaaagctataaatatctgctttctcagtatacatgtctttcctcagtatttcaggggccatgtaaataagtgttccgaccatattctttttgtggaatccaccagttggcttcccagacgatctccaattctgcagattaacttcgcgcaaattcttcttgtattcagctaaaccaaagtcagccagatatgggaaaaacttctcgtcaagctgcaacaacaaaagctcacttaagcatcacacacaaatttcataaagaaacagaagaagtacctatcctatatgaaataagcacataacaagatagagaatctagagaatggaagaagagaattacaagaacatttgctggtttcacatccctatgaacaatcccgttgttgtgaagatattgcaatgcctttgctgaaaaaaacgaaacagatagaatcagatattcaaattagtaaccattgaaaagtttatgacaagaagaagaaatcgtcagagtcacacacgaatggcaaaaaagaaggttcctttgagacaagtagagtcacatacccaagtgaagcgtgatcagtaacacttgatcaatactcggagaccactcctcgacgtgtaacttctcagctaaagtcccagactcgtagaagtcaaagaaaaacatgtaatttggaggcttcgcatgtgctgctagtaacttagccacaccaggatgattgagattgcttcaccaatccacagcaaagtaagaaaaaaacaacattttgaaaatggtacgaaatttaaaatggaaatggaaaatgaaagagagaccatgagagctgcaaattcctgtggaacttgtcaaggtcatcggaagtagacaagataggcttcttcgctgctactcttcggccatcgagaatcgcttcataaacaacactctctgatcctgaaaatttctccagacaaatcgaattcaaacgaatgaagattgcgggagtgagagggagagggggaactggggaagagaagaaacagtacctttagcgattggggagagaagagtgaaggaagaagaagggagatgaagagggatcgattcactggtgcaacatcctctaatgcatgtgtttggtttcacaatttccatcaccatttttctccaccggaaaaacaaacgacgaacagagaaccgatcgagcgtgatgacgacgacgaattccccaatttcgcagtttcaacagtaacctcgtagaatgcataccgttttcatgtgtttggaacgctctcaaattaatataaaccacacacagcgtgccgctttttgtttttcttatctctttgacctttcagagagaacgaaacgcacagcctctcaggtgaagacacgtgtcatttgttccttgacttgtcactttcataccttaatcgccaagtaacgtaaaagataccgacatggccaaaacctacgaatctgaaatttgaagaagcataagtttgtctattaaagatg

SEQ ID NO: 17347 - DNA, 3003 bp, Unknown; identical to SEQ ID NO: 17346
  misc_feature (1)..( 3003): 2750-1469P.txt file - cDNA_ID_1808627; gDNA_ID_2214493; Annot_ID_183733

SEQ ID NO: 17348 - DNA, 3000 bp, Unknown; identical to SEQ ID NO: 11622
  misc_feature (1)..( 3000): 2750-1469P.txt file - cDNA_ID_1808635; gDNA_ID_2214506; Annot_ID_133760

SEQ ID NO: 17349 - DNA, 3003 bp, Unknown
  misc_feature (1)..( 3003): 2750-1469P.txt file - cDNA_ID_1808655; gDNA_ID_2926238; Annot_ID_142794
catataagagaaactgctaaaacacactaaaaacttcatctggaagaactccattagtaagcaaacaacagaaacatttgcaaaaccatgactttagcagttaactaagaaaccaacacttctgcttaactcagtaaacttcattaggggactcactgaaatatacggaaagaaaaatcaaagtccttgcaacattatctcaaaatcttgtcggaaatagagaaaagagagaatgtagctacagataactaaagcgaattacaagattgcatctttatacattccgattcatcacaaacaaaaaacagttaagcactaaagaggctccaatcataaagaaagaaaccctaaggttagagaatcccgatcctttagattcacagctattgcaattgaatcaacacattaaaacaaaaaccatttccacataaaaaaaaacgatccagtaaatgaaatagattcaagaccgatcgtcgagcggtagagaaagtaaacaaaacaaagacagagaattgaagaaactgtgtacctgcaaaaataccaatcagatgggtctccgccaaagtaatctgcttagaagttttgtaagaaaaaacaattaaaggcgtttcatttattgaattttccggttgtttgattctcaggatgagattgcctatttccttcaaaaaagaactctttaatttacacagaaaagctctgaaaatttccacagaaaatgaagaaagaaaagagcgtaaaaggggaaagagatgaaatgggttattaaaaaaagaagcagtggatgagggaagagaggattaagaggcgtagagattacatgtgatgaatgatactatcttttcttacaaacacattttcgtgtaattaaaatttaatttggttccaaagattttaatcaaaagaagtttggtaaattgaaacaggcagacataatttattgtaaagagtttttatttatttattcatgacgttgcttgatggtgctttaccaattttcttctcctacgttagatttttttcacttttttttttggtgtttgtaataaatgtgaaaaatggaccgtttaaaaacttaaagacgtttgattactatataaagtaattgtttataatagaaagttaattgagacgtgaaatggtataatattattgtgtaacagttgtgtacacgtagctctcatgcagttttagtggacccatatggcttgacttgtattctgtttttgggctattaaagtccaaaacagagacccctctcaagcccttcctattaatccatctagctaatagaaactataaacgtgtcctctctctcaattaaataagctagaaacatactcaaccattcgcattacgcacttcatagcggtaggtttagatttgtctaaaatacttaaaaaaatttttgtctaagttgttgtccgttacaaagtttttttctttgtgacaacttgacaacattgacaaatagaaaaataaatttcgatgaaacctatgaaatgggctatggcccaactaaaaagagtgggaaattaaagatgggatggttcaagtgtatacttcgaacttccgacattagggtcaaaggatttttaaaaggcaaccatttgttccactttctcgaacaaaaacgagccatttattaatatatagtacggctgaattggttttgttcgtcattgtgtaaacacaaagtcattcgaattatgttagggtccgttgataatatagacggcccatcccacgcacatattaagtgttcaactccatagaatatcatatgggacactgtttttaatttataatcaccatttaaaatgtttaaatgtttatgcaaattggatggcttcttcacacaacatttatttattggcctttcattccatcaaagtaaaatagcttttcaaatacattatactctatactcctatacatgtaaataaccatatgcatatatatttttttcaaatataggtcaacgccatttaatataattttaaaaaaatttgttcggaaaatatcacatttctttcactagacaagccttgttaccacacaatgtatcaatatgatctaaagggcaaacgaaagatcctgacatgaaacgtttaattctcattttctccaaattttattttttatgtgaagtagataaattagtatatatatatatataccaaactagtgtgttatgttatggcaaatgttatatcaattcgaaggttccgctattgcaatattcattaattttttcataccaatactatttttctttctcttttattttgttttttaataaataaaagaaattaaggatgattagtaaggaagtcgcctaccaagagattcacctaccacggtacacttcaacaccgaagcagagttgttgaatccactttttattcccttctctaatctctactcaccaagtctccacttttttttctctttattatatacatttaaattatttaatatacgccaactacatacatatccagtgtaatttctcgttacgtcacacccctttcgtaatcgtctaatttcagaaaaatatccagaggtttaaatacatattcccatcattaaatctagacataaacacatcatactcacaaaatttggcagcaaacagttactacagacccataaatgaaaaaacgtattcacttgttttcaattttcacataaccacttccctgagtttggtctcaatttgattgccccgccgaggcattactacgccaagtgcgattaaggtcccatacagtgtaacgggacccactataagacagcgaccgaccaattgcgtgttaggagagtttcaccaaccccggaccggtttttaccggatataacagaaccggtacgaaccggtctcattatcttccatcttctttatatagacctcatgccatgtgtgtgactcaccaagaaaaacacaatcgtttaatctcacccaagaagacaaaaacacagagagagaaagagagagaaatg

SEQ ID NO: 17350 - DNA, 3003 bp, Unknown; identical to SEQ ID NO: 17349
  misc_feature (1)..( 3003): 2750-1469P.txt file - cDNA_ID_1808655; gDNA_ID_2926206; Annot_ID_141754

SEQ ID NO: 17351 - DNA, 3003 bp, Unknown; identical to SEQ ID NO: 17349
  misc_feature (1)..( 3003): 2750-1469P.txt file - cDNA_ID_1808655; gDNA_ID_2926206; Annot_ID_202229

SEQ ID NO: 17352 - DNA, 3003 bp, Unknown; identical to SEQ ID NO: 17349
  misc_feature (1)..( 3003): 2750-1469P.txt file - cDNA_ID_1808655; gDNA_ID_2926238; Annot_ID_203939

SEQ ID NO: 17353 - DNA, 3000 bp, Unknown; identical to SEQ ID NO: 11728
  misc_feature (1)..( 3000): 2750-1469P.txt file - cDNA_ID_1808663; gDNA_ID_2214513; Annot_ID_133887

SEQ ID NO: 17354 - DNA, 3000 bp, Unknown; identical to SEQ ID NO: 11728
  misc_feature (1)..( 3000): 2750-1469P.txt file - cDNA_ID_1808663; gDNA_ID_2214513; Annot_ID_184338

SEQ ID NO: 17355 - DNA, 3000 bp, Unknown; identical to SEQ ID NO: 11797
  misc_feature (1)..( 3000): 2750-1469P.txt file - cDNA_ID_1808666; gDNA_ID_2214517; Annot_ID_133977

SEQ ID NO: 17356 - DNA, 3000 bp, Unknown; identical to SEQ ID NO: 11797
  misc_feature (1)..( 3000): 2750-1469P.txt file - cDNA_ID_1808666; gDNA_ID_2214517; Annot_ID_184481

SEQ ID NO: 17357 - DNA, 2810 bp, Unknown; identical to SEQ ID NO: 11771
  misc_feature (1)..( 2810): 2750-1469P.txt file - cDNA_ID_1808676; gDNA_ID_2214516; Annot_ID_133950

SEQ ID NO: 17358 - DNA, 2810 bp, Unknown; identical to SEQ ID NO: 11771
  misc_feature (1)..( 2810): 2750-1469P.txt file - cDNA_ID_1808676; gDNA_ID_2214516; Annot_ID_184442

SEQ ID NO: 17359 - DNA, 3000 bp, Unknown; identical to SEQ ID NO: 13794
  misc_feature (1)..( 3000): 2750-1469P.txt file - cDNA_ID_1808682; gDNA_ID_2214652; Annot_ID_188669

SEQ ID NO: 17360 - DNA, 3000 bp, Unknown; identical to SEQ ID NO: 13794
  misc_feature (1)..( 3000): 2750-1469P.txt file - cDNA_ID_1808682; gDNA_ID_2214652; Annot_ID_136443

SEQ ID NO: 17361 - DNA, 3003 bp, Unknown
  misc_feature (1)..( 3003): 2750-1469P.txt file - cDNA_ID_1808696; gDNA_ID_1620751; Annot_ID_49825
gggcccttacttaatcgtgaggcccaacatttaacctagtctgaatgtttcatttgctaaaaactttgtttgttgctactgggcccaaaggtttgaaaggccagttcaattgaaatatcgcataatcaaattgaatttaatctgcaagaccaattcgttaatcaataagagcatactaggatttcaaaccaaatgattcagttcaacgatgttttaaattatcatctagaaattataaaatgtgtaataaagcattttttttttttttaaacttgacaaaatctctaaatgtaaagtctaatataaaccttaaaatctaaaaactaattatgcttgtttttgagaaatttttaaaaaattgtgaaaaagaaaagtaatgaaaaaaatattgagagtgagtgattggaggaaaataacacaacgcaacaatctaacaaagagagaccttatcatcatcagcatcaccttaacccatataacattcctcttcgaaaatgccaacaacaaatttcatagagaagcagaaatggcgaaatcactcctttgttcatcaaccttaaaccctttcttctccaccactctctcctcttcgaagaagaaccaaattgcatactcgggaaacagcaagaaccagacatcgtcgtctctgttatggaaaagaagggaactgtcgcttggatttatgagcagcttagttgcgattggtctcgtgagtaatgacagaagaagacacgacgcgaatgcagcgattcttgaagctgatgacgatgaagagcttctcgagaaagtgaagcaagatcggaaaaagaggattgagagacaagctgttcttaattctgctgtcaaggaaaagggtacttcttcaattttcctctaatctttcatttatgttcctcccctgctacatgaagtaaattgaacaaattgatggaaaagtttactcttttatggaaaaatgtgtgttctttgtgttatggttcctaggctagttacattgaaccctagtctggttttgtttcatttatcttggctacatgaagtaatcagaacaaactgatggagaagttttactcttttgaggacaaatgtgtgtcctctttgtgttatggtcccatggctagttacattgaaccctagtctggttttgtttcatttatcttcattcaaggccgtatgaagtaatcagaacacactgatggaaaagttttttactcttttgaggacaaatgtgtttcctctttgtgttatggtcttcacagaatcatagttaaatggtttgttccagtgccatttacattgaaccctagtttgattttgtttcatttttcttccttcaaggccacatgaagtaattggcacatattgatggaaattttgtgaactcttttggggacaaatgtgtttcctctttacgttatggtcgacatagtaaaatggtttgttccagtgccatttacattaaaccctagtctgattttgtttcctctatcttcatccaatgctacataagtaatcagaacaaattgatgggctcttttggagacaaatatacttaggtcttcttggttctctaactaaaagtatatagtgtacagggtatttgcaggatcttgtttacaagttgagcaaggtaggacaagccattgagaacaatgatctaccagctgcaggtttggttttggggaaaggcattgataccgaatgggtcaaaaccgttaatctggctttcacaaaggtctttcttgctcattttaactttcactaaggtcaaatctattggtccaatgtagaaacaactggttaaaacatcaatattgtctctccctctctttacataaggtagacttttttttaatgtttatgttactgtttgttgaaaagtccttgtttgtgttcttggaacagttgagtacaagcccagaagagaatacagaggtggaagcattcaattcatcattggcttctcttatcacatcaggtcttgtacttgtacttgtacttaactttttcattcacaagaatcaaaattgtcattaaaacattgcagtgatctctttgaaatgtggttttgattccttttttcgcagtgaacaagaacgatatagagtcatcgaagctcgctttcgtttcatcagctggtgcatttgagaaatggactactttgacaggtcttttggaacagcttaagggactgtgataggctggctacaaattctttactctttttttgtattttccaacagatttgtcaaagagggtcttttttttctccaaataatcctttgaataatcatcattcactttcttaacttctttggttattatttacctttatacattttgttcatacttactatgcatcaatatcaacaaggttgatttttccatcgaattccaccacaccaaaaggaaccaagaaaccataccaaaacttctttggttatttatctgaaactaattcaaaaagatctgatcagtaaacctttgttctattgaatctcacattaagagaaacccttttaacttgagaaggcatacagatatagagcatcacaaaatccccgaaacaaaaccgaaccagtcataaccaagaagggggaaagctactagatgaagctagtaggtggaagtttgagtcatttggcctattactacgcactagttatgatcttttctctgatacattgaatactttattaaaaaccattacataaccaatgtaaaagcaaatatttaaacgttaaacagtccaattcagctttgaaaaatcctcccagaagaagaagactagtcaatattggttgcgatggccttgtagaggcattattatctgttagataatattaaacattaatgagaaagtagaaatgcttctgtataaataccttcattacttgtgtcttatttcatcaccttcaccttcaacatcaaacatcacatttcttcctcttttctctcttttttctcagtcttcaaagagtttcttagtaacccaaatcaatg

SEQ ID NO: 17362 - DNA, 3003 bp, Unknown; identical to SEQ ID NO: 17361
  misc_feature (1)..( 3003): 2750-1469P.txt file - cDNA_ID_1808696; gDNA_ID_1620751; Annot_ID_166807

SEQ ID NO: 17363 - DNA, 3000 bp, Unknown
  misc_feature (1)..( 3000): 2750-1469P.txt file - cDNA_ID_1808696; gDNA_ID_2926183; Annot_ID_140668
cccttacttaatcgtgaggcccaacatttaacctagtctgaatgtttcatttgctaaaaactttgtttgttgctactgggcccaaaggtttgaaaggccagttcaattgaaatatcgcataatcaaattgaatttaatctgcaagaccaattcgttaatcaataagagcatactaggatttcaaaccaaatgattcagttcaacgatgttttaaattatcatctagaaattataaaatgtgtaataaagcattttttttttttttaaacttgacaaaatctctaaatgtaaagtctaatataaaccttaaaatctaaaaactaattatgcttgtttttgagaaatttttaaaaaattgtgaaaaagaaaagtaatgaaaaaaatattgagagtgagtgattggaggaaaataacacaacgcaacaatctaacaaagagagaccttatcatcatcagcatcaccttaacccatataacattcctcttcgaaaatgccaacaacaaatttcatagagaagcagaaatggcgaaatcactcctttgttcatcaaccttaaaccctttcttctccaccactctctcctcttcgaagaagaaccaaattgcatactcgggaaacagcaagaaccagacatcgtcgtctctgttatggaaaagaagggaactgtcgcttggatttatgagcagcttagttgcgattggtctcgtgagtaatgacagaagaagacacgacgcgaatgcagcgattcttgaagctgatgacgatgaagagcttctcgagaaagtgaagcaagatcggaaaaagaggattgagagacaagctgttcttaattctgctgtcaaggaaaagggtacttcttcaattttcctctaatctttcatttatgttcctcccctgctacatgaagtaaattgaacaaattgatggaaaagtttactcttttatggaaaaatgtgtgttctttgtgttatggttcctaggctagttacattgaaccctagtctggttttgtttcatttatcttggctacatgaagtaatcagaacaaactgatggagaagttttactcttttgaggacaaatgtgtgtcctctttgtgttatggtcccatggctagttacattgaaccctagtctggttttgtttcatttatcttcattcaaggccgtatgaagtaatcagaacacactgatggaaaagttttttactcttttgaggacaaatgtgtttcctctttgtgttatggtcttcacagaatcatagttaaatggtttgttccagtgccatttacattgaaccctagtttgattttgtttcatttttcttccttcaaggccacatgaagtaattggcacatattgatggaaattttgtgaactcttttggggacaaatgtgtttcctctttacgttatggtcgacatagtaaaatggtttgttccagtgccatttacattaaaccctagtctgattttgtttcctctatcttcatccaatgctacataagtaatcagaacaaattgatgggctcttttggagacaaatatacttaggtcttcttggttctctaactaaaagtatatagtgtacagggtatttgcaggatcttgtttacaagttgagcaaggtaggacaagccattgagaacaatgatctaccagctgcaggtttggttttggggaaaggcattgataccgaatgggtcaaaaccgttaatctggctttcacaaaggtctttcttgctcattttaactttcactaaggtcaaatctattggtccaatgtagaaacaactggttaaaacatcaatattgtctctccctctctttacataaggtagacttttttttaatgtttatgttactgtttgttgaaaagtccttgtttgtgttcttggaacagttgagtacaagcccagaagagaatacagaggtggaagcattcaattcatcattggcttctcttatcacatcaggtcttgtacttgtacttgtacttaactttttcattcacaagaatcaaaattgtcattaaaacattgcagtgatctctttgaaatgtggttttgattccttttttcgcagtgaacaagaacgatatagagtcatcgaagctcgctttcgtttcatcagctggtgcatttgagaaatggactactttgacaggtcttttggaacagcttaagggactgtgataggctggctacaaattctttactctttttttgtattttccaacagatttgtcaaagagggtcttttttttctccaaataatcctttgaataatcatcattcactttcttaacttctttggttattatttacctttatacattttgttcatacttactatgcatcaatatcaacaaggttgatttttccatcgaattccaccacaccaaaaggaaccaagaaaccataccaaaacttctttggttatttatctgaaactaattcaaaaagatctgatcagtaaacctttgttctattgaatctcacattaagagaaacccttttaacttgagaaggcatacagatatagagcatcacaaaatccccgaaacaaaaccgaaccagtcataaccaagaagggggaaagctactagatgaagctagtaggtggaagtttgagtcatttggcctattactacgcactagttatgatcttttctctgatacattgaatactttattaaaaaccattacataaccaatgtaaaagcaaatatttaaacgttaaacagtccaattcagctttgaaaaatcctcccagaagaagaagactagtcaatattggttgcgatggccttgtagaggcattattatctgttagataatattaaacattaatgagaaagtagaaatgcttctgtataaataccttcattacttgtgtcttatttcatcaccttcaccttcaacatcaaacatcacatttcttcctcttttctctcttttttctcagtcttcaaagagtttcttagtaacccaaatcaatg

SEQ ID NO: 17364 - DNA, 3000 bp, Unknown; identical to SEQ ID NO: 17363
  misc_feature (1)..( 3000): 2750-1469P.txt file - cDNA_ID_1808696; gDNA_ID_2926183; Annot_ID_200429

SEQ ID NO: 17365 - DNA, 3000 bp, Unknown; identical to SEQ ID NO: 3594
  misc_feature (1)..( 3000): 2750-1469P.txt file - cDNA_ID_1808704; gDNA_ID_1620652; Annot_ID_47767

SEQ ID NO: 17366 - DNA, 3000 bp, Unknown; identical to SEQ ID NO: 3594
  misc_feature (1)..( 3000): 2750-1469P.txt file - cDNA_ID_1808704; gDNA_ID_2926215; Annot_ID_142180

SEQ ID NO: 17367 - DNA, 3000 bp, Unknown; identical to SEQ ID NO: 4073
  misc_feature (1)..( 3000): 2750-1469P.txt file - cDNA_ID_1808716; gDNA_ID_1620682; Annot_ID_48362

SEQ ID NO: 17368 - DNA, 3000 bp, Unknown; identical to SEQ ID NO: 4073
  misc_feature (1)..( 3000): 2750-1469P.txt file - cDNA_ID_1808716; gDNA_ID_1620682; Annot_ID_164487

SEQ ID NO: 17369 - DNA, 3000 bp, Unknown; identical to SEQ ID NO: 4073
  misc_feature (1)..( 3000): 2750-1469P.txt file - cDNA_ID_1808716; gDNA_ID_2926181; Annot_ID_140560

SEQ ID NO: 17370 - DNA, 3000 bp, Unknown; identical to SEQ ID NO: 4073
  misc_feature (1)..( 3000): 2750-1469P.txt file - cDNA_ID_1808716; gDNA_ID_2926181; Annot_ID_200264

SEQ ID NO: 17371 - DNA, 1542 bp, Unknown; identical to SEQ ID NO: 11194
  misc_feature (1)..( 1542): 2750-1469P.txt file - cDNA_ID_1808720; gDNA_ID_2214483; Annot_ID_133299

SEQ ID NO: 17372 - DNA, 1542 bp, Unknown; identical to SEQ ID NO: 11194
  misc_feature (1)..( 1542): 2750-1469P.txt file - cDNA_ID_1808720; gDNA_ID_2214483; Annot_ID_183415

SEQ ID NO: 17373 - DNA, 3003 bp, Unknown
  misc_feature (1)..( 3003): 2750-1469P.txt file - cDNA_ID_1808734; gDNA_ID_1620621; Annot_ID_47030
attaatgagataatttaaactcaccgacgcggtttcgtcttttcttcaagtgaaaaagtgaaaaccgatgttaaggatcatgcattcaaaagagatgtatagaaatataccggatatgttgtatccatagttcacgtagattcataactactatataagttgttaaggatcaatcatgatatctgactagatcaatcacatatcaatcactccacgatatcttcttctatttatgtaaagtagattatgtaattagatctatcacatatattcctccttttgtactcaataaagattctctctttgaatataaacatttataaaaatctttttttttacaatatgtaacagtttattttattaaagtttttggttatttattatcattaaatttaataattcacatagattcatatctatataagtctcatcttaaaataatactaaaatttattttgtttacttacaattacgataggaatcaaacgaaaagatcatttttacatgaaaaaaaaactgtaaataacgtgaagaagagaagaaatataaaatcaacgtaataatgatcgagtgtttttaacaataccctttgttggaaggtgtttaaacttttgttttctttcttttgaattcttttcaagattctattaaatcatgtggatgtatatatgtgcttcagttcagagacagactttgtactaaatcaaggtaaaatatgtaattatgcggcataatatgccttacttgcttgtaagttataacatatggattccttttgtgcttaaatgcatatgtttgcttgtcatatgaggcatattactacacttccttgctaatcttttttgagtttccttaattctctttcatgttcattgtgcttttgtcctgtcatgtattagctagctatgtgttcttgttattcattcttgctaaaattacgaacacaatttagtaagaagcgttgttgctctttcttccaattcccggcagcttacttccaaactctccctttttggctaatggaatctctacgatcaaattgcaaaactctcatcaatgtgagcgacccggagaaccaaattgatttctttccaagtagatcaaacatattagaccatagtaacaaatgattgacataatgttcaatctttcagagcataaactgtttcggatgctgcaacagagaaaggcgtttagttgtggaagtcgatgagccatcaaagggactcaaaatccaaggaaagatagtgaagaaagatagtgcttcatcagatgacttctggagcacaagtacgtgtgatatggaccacaatataacgattcagtcccaatcttcaaacccgccttttgatccccaatgcagcacaagcaactctaccgaatttgtaaaccatggtaacttttgaatgttctaacttctaaggcctaggttgttttggatgccaaaaacttatgttatgaagcaagcagtatttattactcattcagttattctatacactaaaagatacactactacttattcatttccttccataaaaggacttattttgtggaaccacacgagacaacaatggcgtgaatgcttaaccagacaacaatgtctagttccagaacctgcaataaggtgacaaccacaaacagttacgaatattgaacgaactatttttatgtttatataggattggtctactgaattcgtcaatgttaaaatgaaactttgaattcatatgatttcagctggaactcgacgtatgatagcttattgagcacaaacaagctttttcctcaaccaatacctcttaaggtgatttgatttggttaattagttgttttctgctaatcataactcttaattttaattaacttacagcagaagattctttatcccccttagaacattttcatatcaggatttgaatctagtatatatcattgttgctaggaaagttttttttaaattgatgatgatattggtacaggagatggtgcatttccttgttgatgtttgggaggaagaaggcttgtacatatgattcattaaaaaaatatttttatactatataaagaaagcagaaaaacacagtttaattgcttttttcaagttccatatcatttttagtgtatatttattgcccttttataaatgaaattaggaaatttggatcaccttatggtcaatttctttatttttttagttataccacatttatactactgatgatgaaaatcgattttttgtatcgtgaacacttattaactggttttatcttgaataataaaacttccatagttattccgttattgttaggtcattgtaaaaaatcatcagcaattagtcattaaatatactatcaaagcttgtcagtcatttctcatcaattctagcaaaattattcgatatatccaaatccaaatgtcttggtttggtcatgactcatgaccgtggaaataagttcaagaatgcaaaaagtaacttatttgtgggacagaatcaaattctttgatccagttacttacgtctttccgtagccaatcaaattgaaatattttctttaggggtattcgattatggtggtcctgaagcctataacaattgttttccgataagatttgatatatataaataagggaacaatccccaaaaatgatatctagttaagatagtcgtagaatttacagaaaaggctacttatgtttttggcctgataatgcaaatactttcaaaatgttttatttgctaactagcttttagtttcgttctcgtatctaaagttagagattaacttactattcttgtattacgataacgttttgaatgaacatgtaatgatgcaagggtgtaaccaaaaatgataaaactttggggtcaatttgataatattgactaatagtgtggggcttgacaagaaccggaaactccatgatatttttgcagtctaaatatcttttcatctctcttctcttcctccactgaaatattccccacaagaactaacaatg

SEQ ID NO: 17374 - DNA, 3000 bp, Unknown; identical to SEQ ID NO: 4132
  misc_feature (1)..( 3000): 2750-1469P.txt file - cDNA_ID_1808734; gDNA_ID_1620686; Annot_ID_48448

SEQ ID NO: 17375 - DNA, 3000 bp, Unknown; identical to SEQ ID NO: 4132
  misc_feature (1)..( 3000): 2750-1469P.txt file - cDNA_ID_1808734; gDNA_ID_1620686; Annot_ID_164605

SEQ ID NO: 17376 - DNA, 3003 bp, Unknown; identical to SEQ ID NO: 17373
  misc_feature (1)..( 3003): 2750-1469P.txt file - cDNA_ID_1808734; gDNA_ID_1620621; Annot_ID_162302

SEQ ID NO: 17377 - DNA, 3000 bp, Unknown; identical to SEQ ID NO: 4132
  misc_feature (1)..( 3000): 2750-1469P.txt file - cDNA_ID_1808734; gDNA_ID_2926202; Annot_ID_141543

SEQ ID NO: 17378 - DNA, 3000 bp, Unknown; identical to SEQ ID NO: 4132
  misc_feature (1)..( 3000): 2750-1469P.txt file - cDNA_ID_1808734; gDNA_ID_2926202; Annot_ID_201910

SEQ ID NO: 17379 - DNA, 3003 bp, Unknown
  misc_feature (1)..( 3003): 2750-1469P.txt file - cDNA_ID_1808738; gDNA_ID_2214573; Annot_ID_135105
tatgtgtatctctatcatgacgaatcaatccagatctctccgtccaccggaaaaattgaagagcatgctcaagtttcttagcaccgtgcaatacattatagactaaagaatgatcccattcaggtacaagatctcggattgagttctgtaaacgagtcgtccaagcacgattatccatcattctacatattgtatcctctagcttttcatggttttgacgcttacctcgttggaacctctctctgagtggtctcgtctctgtagaagtcagattcttcttcgtctcggattttgcatctggagattgggtttctgggtttgcgtttgctggagtttgggtttcttcgatggtgctgaatagacgagggagtgagaagagagatgagtttgatgatctgggaagcgagagataaaccctagcttttgattggtagcgtttagatctggaaatgaaagccattacaggaaatggaacctttgtctctgagtttttctgaaaattttcaattcgacatggaaggacaaaggaagcaagagtttttagtgatgagtagggttttagtttagggaagaaatggagtcctggatccaaatcttgttccgggtcgggtattttctgaacttgaacccggcctgttaagtgttactatccagcccggtttcgtgcataacagatgggcctagaatcgtatctagtgttgaccaacatgtaatttccacactgttatctataatttatttgtttttattaatgtttaaagttcttatgaggaataacaaacatgtataaagtaatttgaaatgtaaccttaaacaaatgttggatggtgataggagatgcctaagctgacatattttgtgggacttcaagatagtaatctatagtcttacctttgatcaactatgttatcatatcaatagagacaaaattgtttcgataactggattatgtgaatttgatgtacatctttatttggaaataaaaatatatatcttctagcaagggccacacttatccttcgctgatctcgactcataagtcataatgatcatcaaaaatcaagaaacaatgatcattactttcggtctacgacttgtctttttttctttccctacctatatatcaaatgtggtcgttgtgattgtggtaatggtgttttatggatttagttgagtatccgggcatagcagtgtcgttactgttttttaaatatctatttttcgattgcgattctttcaactcttcaagcacaacacgctttaaggatctcttcaacaggcgggtcatcaccggcttctttgtcctgaaatccgcaaacaaattgttgaaaacaacaatgtgtttgaaaagatatatcggtatactaggttcccaaatatgaggctagtttcacaatcaagattagacgaaagagattaccttgcgtatataagagatgttatctttcccagggccagcaactaagattccgccttgttgcctgcacaaggtccgtgacaatagttgttaagaaaaacggaaagtaatctcatcgatctctaaccagaaggaatgaatgattcatatactcttaaacttaccagccgcctctttcaactgtatctttcataaacgagagtttccagtcttggcggtatccttccatgtaagactctagtatcttcatagcagcctataataatgccacagaagctactgagagtctgagaccacaaaagcagaacattttggttacctaattataatatgctaagtagaagtcactctactttgggtgtaaatgtaacagaaacccctgaaacgaactcaagcgcctcgtatgatgcgtggtttggatccgcatagacctctgtattgagagaaagttgattacagataattagatcatctcataaaaggaactactcaccaggcttttttagtaatcaagagaaaacatacctcctttaaacttagtctgttccacaaaagtattagcctgcatacatagatggtcataacgtgagaagcagcagcttaaaactgcttacgcttacaaaaattgcgtattcaaaatgttgtttacctgatcgatgcttcccggtccgatcagaacaagagcaacaccagatgcatccatcacatcctaaacaaaaatctcaaaggtatcactcaatgacttcaattgtgtataaatggccaatctttttaaaccaaagatcattctgttaccttcttttctgcaagataagctgctcgtttccgacagagcacacatctgaaaacataacaagcaatcttagatagttacacatagtcataaaccagaatcatcaaatataatgagaaaattacccaaaatgacgagcaaatgcaacaacggccttcctatctttccataaatcagaaatcggaatctcatttcctctcaaatccaagactttcactgtatctagcgaatcagctgtacctttccctattccagctcctgtggagaatcaatataatctagtaagtaatctagaatctccgtattcaatataatatagaaagagaagacacttaagctcaccggaagaagctccggtaatggccgacacgaccacggcgctacgccggagagagacactacgaaagtgagatttgaccgaataaccaggaagtactgtccctaatccatgaatcgtcttcagcttcggctgcagagtaatggacgtgatcgtcgacgacgacgagagagcaatcgccattgttgcttccagagaaagctgaaaataataataatcccaatttaaaatcgaaatcgattttctcataccgttggttaatctcgtggagttgggttattacacgtgtcagatgatgtaaccatgatctcagagaaaaagtcacatgccacgtcagttaactttagggcaaaatgggaaaagaatctaaagagcatatgttcgtgcacgttcttgtttagggtaagctcaaagctcaagccgcttctatctctctacatttctctttctgcaatg

SEQ ID NO: 17380 - DNA, 3003 bp, Unknown; identical to SEQ ID NO: 17379
  misc_feature (1)..( 3003): 2750-1469P.txt file - cDNA_ID_1808738; gDNA_ID_2214573; Annot_ID_186241

SEQ ID NO: 17381 - DNA, 3000 bp, Unknown; identical to SEQ ID NO: 11146
  misc_feature (1)..( 3000): 2750-1469P.txt file - cDNA_ID_1808741; gDNA_ID_2214480; Annot_ID_133239

SEQ ID NO: 17382 - DNA, 3000 bp, Unknown; identical to SEQ ID NO: 11146
  misc_feature (1)..( 3000): 2750-1469P.txt file - cDNA_ID_1808741; gDNA_ID_2214480; Annot_ID_183308

SEQ ID NO: 17383 - DNA, 3003 bp, Unknown
  misc_feature (1)..( 3003): 2750-1469P.txt file - cDNA_ID_1808749; gDNA_ID_1621175; Annot_ID_57320
gactttgtttgtaaatgtccgaatattttttcaagatatttatgtatttggtacttcaaatctagtacccaagccttagatcattaaaatttagaactcagtatataactaatgccattttttatttttggattcgatatttttttttttagtgtaatattaaattatatttaaaaaaacaaatatacgtttttataatttgtgcttcgtatgtttgaaaaagtaagctctaaagatttctgatgatttttcgaaaatgtttaaagaaaatgtttaaacaagctaagagtcgaggttaactagtcatgggagtgaatccagttttaaataggcatcgtcatactgcttgtcgcctaataatcgtattgctgaaatcagatttcgaatttgtttatcaacccatatggtgataccctttatattatgatcccacgcacctcaaaaatttcggcgttggattcatgtcactcctagctagcaacctcagggctcgcagtatcccattcgtcttaattagttaagattttttttaaaaatttattttgttcagttattattcatttcattcgaacgattaaacaaagattattatggtctcgtgatttatatgttgacccttctaatattctaaatttaaaaataagaaaaaagaggaaaattgaggcaaaacacatgttgccgagtcattatcaactaggggtgcataatgatggaacaaagcacaaatcttttaacgcaaactaactacaaccttcttttggggtccccatccccgaccctaatgttttggaattaataaaactacaatcacttaccaaaaaataaaagttcaaggccactataatttctcatatgaacctacatttataaataaaatctggtttcatattaatttcacacaccaagttactttctattattaactgttataatggaccatgaaatcatttgcatatgaactgcaatgatacataatccactttgttttgtgggagacatttaccagatttcggtaaattggtattcccccttttatgtgattggtcattgatcattgttagtggccagacatttgaactcccgtttttttgtctataagaattcggaaacatatagtatcctttgaaaacggagaaacaaataacaatgtggacaaactagatataatttcaacacaagactatgggaatgattttacccactaattataatccgatcacaaggtttcaacgaactagttttccagatatcaaccaaatttactttggaattaaactaacttaaaactaattggttgttcgtaaatggtgctttttttttttgcggatgttagtaaagggttttatgtattttatattattagttatctgttttcagtgttatgttgtctcatccataaagtttatatgttttttctttgctctataacttatatatatatatgagtttacagttatatttatacatttcagatacttgatcggcattttttttggtaaaaaatatatgcatgaaaaactcaagtgtttcttttttaaggaatttttaaatggtgattatatgaatataatcatatgtatatccgtatatatatgtagccagatagttaattatttgggggatatttgaattattaatgttataatattctttcttttgactcgtctggttaaattaaagaacaaaaaaaacacatacttttactgttttaaaaggttaaattaacataatttattgattacaagtgtcaagtccatgacattgcatgtaggttcgagacttcagagataacggaagagatcgataattgtgatcgtaacatccagatatgtatgtttaattttcatttagatgtggatcagagaagataagtcaaactgtcttcataatttaagacaacctcttttaatattttcccaaaacatgttttatgtaactactttgcttatgtgattgcctgaggatactattattctctgtctttattctcttcacaccacatttaaatagtttaagagcatagaaattaattattttcaaaaaggtgattatatgcatgcaaaatagcacaccatttatgtttatattttcaaattatttaatacatttcaatatttcataagtgtgattttttttttttttgtcaatttcataagtgtgatttgtcatttgtattaaacaattgtatcgcgcagtacaaataaacagtgggagaggtgaaaatgcagttataaaactgtccaataatttactaacacatttaaatatctaaaaagagtgtttcaaaaaaaattcttttgaaataagaaaagtgatagatatttttacgctttcgtctgaaaataaaacaataatagtttattagaaaaatgttatcaccgaaaattattctagtgccactcgctcggatcgaaattcgaaagttatattctttctctttacctaatataaaaatcacaagaaaaatcaatccgaatatatctatcaacatagtatatgcccttacatattgtttctgacttttctctatccgaatttctcgcttcatggtttttttttaacatattctcatttaattttcattactattatataactaaaagatggaaataaaataaagtgtctttgagaatcgaacgtccatatcagtaagatagtttgtgtgaaggtaaaatctaaaagatttaagttccaaaaacagaaaataatatattacgctaaaaaagaagaaaataattaaatacaaaacagaaaaaaataatatacgacagacacgtgtcacgaagataccctacgctatagacacagctctgttttctcttttctatgcctcaaggctctcttaacttcactgtctcctcttcggataatcctatccttctcttcctataaatacctctccactcttcctcttcctccaccactacaaccaccgcaacaaccaccaaaaaccctctcaaagaaatttcttttttttcttactttcttggtttgtcaaatatg

SEQ ID NO: 17384 - DNA, 3000 bp, Unknown; identical to SEQ ID NO: 4556
  misc_feature (1)..( 3000): 2750-1469P.txt file - cDNA_ID_1808757; gDNA_ID_1620714; Annot_ID_49080

SEQ ID NO: 17385 - DNA, 3000 bp, Unknown; identical to SEQ ID NO: 4556
  misc_feature (1)..( 3000): 2750-1469P.txt file - cDNA_ID_1808757; gDNA_ID_2926217; Annot_ID_142296

SEQ ID NO: 17386 - DNA, 3000 bp, Unknown; identical to SEQ ID NO: 10404
  misc_feature (1)..( 3000): 2750-1469P.txt file - cDNA_ID_1808761; gDNA_ID_2213647; Annot_ID_132414

SEQ ID NO: 17387 - DNA, 3000 bp, Unknown; identical to SEQ ID NO: 10404
  misc_feature (1)..( 3000): 2750-1469P.txt file - cDNA_ID_1808761; gDNA_ID_2213647; Annot_ID_181488

SEQ ID NO: 17388 - DNA, 3003 bp, Unknown
  misc_feature (1)..( 3003): 2750-1469P.txt file - cDNA_ID_1808768; gDNA_ID_1620818; Annot_ID_50656
ttactcaccaccaccaccggttcactcaccgccgcctccggtttattcatcaccaccaccaccacatgtctactctccacctccaccagttgcttctcctccaccgccatcaccaccaccaccagttcactctcctccaccaccaccggttttctctccaccaccaccagttttctctccaccaccaccatcaccagtatactcaccaccgcctccaagccactcaccaccaccaccagtatattctccgcctccaccaactttctcaccaccaccaacacataatacaaaccaaccaccaatgggagctccaacaccgactcaagcaccaacaccatcctctgaaacaacccaagtgccaactccatcatcagaatcagatcaatcacaaattttgtcaccagttcaagctccaacaccggttcaatcctcaaccccatcctctgaaccaacccaagtgccaactccatcatcatcagaatcatatcaagcaccaaatttgtcaccagttcaagctccaacaccggttcaagccccaaccacatcctctgaaacatctcaagtaccaactccatcatcagaatcaaaccagtcaccaagtcaagctccaacaccaattcttgaaccggttcatgccccaacaccaaactctaaaccggtccaatcaccaacaccatcaagcgaaccggtctcatcaccagaacaatcagaagaagttgaagcaccagaaccaacacccgtcaatccatcatcagtaccatcatcttctccttccactgacacatctattccaccaccggaaaacaacgacgatgatgatgatggggatttcgtcctaccaccacacattggattccaatatgcatcgccaccaccaccaatgttccaaggatattaaaaccaatgtagtagtgacagtgttacccatttttaacatttctgtccattttttccatgtgaattatttgtatcaaacgaaaaagatattacaaagatgaaaaattaaaatgccaataattatatagtagattatctttcagcagatttttttttgttgaaattgaagtattgaactataacacgatgcgatttgttttttcggggtaaagaagttatcatttgttttggccattttatgacttctattctattatttgagaagcaaaacataaatatctatatttgtaaaatttaatatcttactagctacatatagtttaatattatacacatttaatctttcataactatgtcatgaattatttgacatttttcataagtcatgataaataaaattatgtatgaaataattgaattagggtttcatgttccaccagatgattgaacttgttctttattcggatagaattatgaaatttttatcttctattaaaaaatatattaacaaaattagatttaacatatattgatatctcattaatgtacttaacatgtgttaacaattttaaatttttttactttatataataaaattagaattttattaaaattatataatatctaaaatttgtactaaataataattcttgctgaattataatctagtttttttttttgatagcataaagattataatccgttaactttaaaaaaaaagcaagaaagggaaataaataaattattatatcctttaaagaggacaaaaatattaattatattgcgaaaaaaggagataaaaattaggtggaaaaggggaagatggtggggacgataagtttttaattagctaaccaaaaaacaaaaacacgaaacgagtcaactcaccggttccattacgagtcaaggagaaacacacattgacacgctcaagcttttttttttcaaggtcaagttggtttttttttttctttcttaaaaatatttatgttgggtcaggcttaaaccagagagagagtgtgtgtggtcgagccatttgaccaaaagcaaaaacttaaaactggtttcagatctgaagtaaaagggttttgcttcggattctccggcgtcgtttaaatgatctctgacccatcttccttggcttaataattctggtccctccttttatctctttttactgttgatttatctgaatatgccacgctctttcttccacatgtttattctctcttcctttcttcaacacaagcgtctggtaattgatctcttctctctcaaattgtgtttcgttctttttggttctgtatttggtttctgacaaaattgaggaaactggtgttgggtttgagtctagaactgccaaagatgtgattttgttttttgggtactgaaaattgagtgagatgaagtgataaagtgtcttttttttttggtaaattattcgaatggaacttgggatcggaactctgtttctttgttagggttggttgaaatctgaatctagtcttgatttttgtggtgaaatgagaggtgagtcagtgaaattttgaaatgtctttgattcaatttgacatcagaatactgctcaggttgtgtcttttgtcagatttattgagaattatcagcttccgactgtagatttgactttggtctcagtttaaagactatgagtggactttatagatctagaagcatgcgttgttttgattataagaaataaaaagagagtttttgctttaagctgtttgactaataacttgacttgggattatgatttaaccagcaaaactctcttttctccagccactgtgttttatgaatgtttgttgattccaaataatagtatgtgttgatcaaagtgaagtcatttggtcattacttggttctgagctttcagttgtttttgcacttacaatacctgatggtcatgtttgcatgtaggactaaggaaagccaacaacaaaatctggtttcaagacggttggcaggagtttgtcaaccgtttctccattcggattggtttcagatacaaagttacagtctacattttcaatttatcctccacactctgagatcaaccaccattctagtagtgaagctcttatg

SEQ ID NO: 17389 - DNA, 3003 bp, Unknown; identical to SEQ ID NO: 17388
  misc_feature (1)..( 3003): 2750-1469P.txt file - cDNA_ID_1808768; gDNA_ID_1620818; Annot_ID_169339

SEQ ID NO: 17390 - DNA, 3000 bp, Unknown; identical to SEQ ID NO: 4249
  misc_feature (1)..( 3000): 2750-1469P.txt file - cDNA_ID_1808775; gDNA_ID_1620692; Annot_ID_48620

SEQ ID NO: 17391 - DNA, 3000 bp, Unknown; identical to SEQ ID NO: 4249
  misc_feature (1)..( 3000): 2750-1469P.txt file - cDNA_ID_1808775; gDNA_ID_1620692; Annot_ID_164833

SEQ ID NO: 17392 - DNA, 3000 bp, Unknown; identical to SEQ ID NO: 4249
  misc_feature (1)..( 3000): 2750-1469P.txt file - cDNA_ID_1808775; gDNA_ID_2926202; Annot_ID_141562

SEQ ID NO: 17393 - DNA, 3000 bp, Unknown; identical to SEQ ID NO: 4249
  misc_feature (1)..( 3000): 2750-1469P.txt file - cDNA_ID_1808775; gDNA_ID_2926202; Annot_ID_201931

SEQ ID NO: 17394 - DNA, 3000 bp, Unknown; identical to SEQ ID NO: 7397
  misc_feature (1)..( 3000): 2750-1469P.txt file - cDNA_ID_1808779; gDNA_ID_1621143; Annot_ID_56688

SEQ ID NO: 17395 - DNA, 3000 bp, Unknown; identical to SEQ ID NO: 7397
  misc_feature (1)..( 3000): 2750-1469P.txt file - cDNA_ID_1808779; gDNA_ID_1621143; Annot_ID_172923

SEQ ID NO: 17396 - DNA, 3003 bp, Unknown
  misc_feature (1)..( 3003): 2750-1469P.txt file - cDNA_ID_1808783; gDNA_ID_2214700; Annot_ID_136839
gttccaattgttgttttgtttttcaatctggtttcgataagaatgtgtttgcttagatgtgtcgaaaaaagttttgttttttttaaatgtacggagattgtttccccaatttcaatttctttaatgctttttttgattaaaatatgaaaatggtatcaccaggaagaagaagtagaatctgactacttcaaaatgttgactttgatgattttaacgatgacccttttgaaaaaatgttttctttaatgatcctggaaccataagattgggaaattttcttgctttgccaaaactctgctttctataaactgagatcatgttttgggaagcttatactatgttttgtggaatgtgcagattcatggtttcaggtggcgttcgttttgaccaccggtataaacagcgcgtatgtgttgggatattcaggaacaattatggttcctttaggttggattggtggtgtggttggtcttcttattgctactgcaatctctctttatgcaaacactctaatagctaagcttcatgagtttggtggcagaagacacattcgctatagagaccttgctggattcatttacggtaaataaaagaccaaaccagctctcttaatctcttctctgttgttaccttcattggaatgatctctctttttatcaggtaggaaggcttatcatcttacatggggattgcaatatgttaatcttttcatgattaattgtggattcattatcctagctggttccgccttaaaggtagtaaaacattttcttctcttgattcttgatttcgttagacgagttagttaattttggttgtgtgttctgtttctgcaggctgtttatgtgcttttcagggatgatcataccatgaaactacctcattttatagccattgctggtttgatttgtgcgattttcgctattgggattcctcatttatcggctcttggggtctggcttggagtttcgaccttcctcagtctcatctatattgttgtggcaatcgtgctatcggttagagatggtataactaatcaaatgatcatcaagattcaacattactaatgagtttaactactgcaaaaatctaattcttgctttgttttgtttgtttctaggagtaaaaacaccttcaagagattacgagatacaaggatcatcattgagcaaactttttaccatcacaggagcagccgcaaatctggttttcgcattcaacaccgggatgcttccagaaattcaggtgacttttccctagacttcaaagttcaattgtttgtttgtgtttgcttttatgtattagtgtaccttttgttcaagtaaaacctgcatcttaaacaaagtttgtttgttaatcatattgacactataatttccacaatgttaggcaacagtgaggcaaccagttgttaaaaacatgatgaaggctctatactttcaattcacagcgggtgttttaccgatgtacgcagttacattcatcggatattgggcttatggatcctcaacctcgacctatctactaaacagtgttaatggcccactctgggtcaaagcccttgctaacgtctctgctatccttcaatctgttatctctttgcacgtaagtttcttagcgccaagtctacgcttttttaacaaagactgtcgtctctaactatatgtctgactcaattctttgttgtagatatttgcgagtccaacatatgagtacatggacacaaagtatgggatcaaaggaaacccatttgcgataaagaacctgctgtttaggatcatggcgagaggcgggtacatagcggtaagcacgcttatctcagcgctgttgccgttcctcggtgacttcatgagcctaactggtgcagtgagcacattccctctcacattcattctagccaaccacatgtactataaggcaaagaacaataagctgaatgctatgcaaaagctatggcattggcttaacgttgtcttctttagtttgatgtctgttgctgcagccattgcagctgtcagactcatcgccgttgattccaaaaatttccatgtttttgcagatttgtaattcattatattatatagtcaattgtgtatcctttattcttaggcaggtttatttctcctgtaagcttgtattctctctctatttgtcttaccattagagcctaaataaataaatcaagttctaaaatctaaaaagcatataaaagaccactttcatcataatcattctgaaaatttaccaacaaagaatactaagttgcatgattaaagtctctattagaaatgtaaatcatagtattagagaagaacataaaaacacctaacttaaaaaaaccttaatttagtgagatagagaagagaagaaacagaattgttgttggtttaacaaaaacctaatctttcaatgattagctgtttaatttgaaattataacaataatttagacaggccaaagtggaaccccactgtctccaccaaagctctagataaaaaaaaaaaaacgaaagcgttagatattttttatcaatcgtgctccgtaatcattacctttcttcttcatcttcatcttcacgcagcgacttctttgattctctctttttattctcagctccaatttcaacctgcatttctctcttctcaattttgggtttctttttttgatatctcatttgatcagatcgacgaagaggtaaccattttgccgtttgttagttcttaacgattttattctgttaaaaatcagatttttttttgcaatgcttgtagaaaaagattcgatttttgtgtactgattgaatcaaaatatgtggttatggatccatggattgatttgtttgaactgatgcaaatggctaatgtgaaaagtcaagaatgtgttaatgtagttttttttgttaaacctctttgtgttgttgggttttgaaatgttgttgttacagaggaagaaggtttgagctgagagatctttggaggtagaaagaagatctcaaaaacgatg

SEQ ID NO: 17397 - DNA, 3003 bp, Unknown; identical to SEQ ID NO: 17396
  misc_feature (1)..( 3003): 2750-1469P.txt file - cDNA_ID_1808783; gDNA_ID_2214700; Annot_ID_189625

SEQ ID NO: 17398 - DNA, 3000 bp, Unknown; identical to SEQ ID NO: 12401
  misc_feature (1)..( 3000): 2750-1469P.txt file - cDNA_ID_1808795; gDNA_ID_2214547; Annot_ID_134607

SEQ ID NO: 17399 - DNA, 3000 bp, Unknown; identical to SEQ ID NO: 12401
  misc_feature (1)..( 3000): 2750-1469P.txt file - cDNA_ID_1808795; gDNA_ID_2214547; Annot_ID_185465

SEQ ID NO: 17400 - DNA, 3000 bp, Unknown; identical to SEQ ID NO: 5248
  misc_feature (1)..( 3000): 2750-1469P.txt file - cDNA_ID_1808799; gDNA_ID_1620775; Annot_ID_50262

SEQ ID NO: 17401 - DNA, 3000 bp, Unknown; identical to SEQ ID NO: 5248
  misc_feature (1)..( 3000): 2750-1469P.txt file - cDNA_ID_1808799; gDNA_ID_1620775; Annot_ID_167671

SEQ ID NO: 17402 - DNA, 3000 bp, Unknown; identical to SEQ ID NO: 5248
  misc_feature (1)..( 3000): 2750-1469P.txt file - cDNA_ID_1808799; gDNA_ID_2926205; Annot_ID_141688

SEQ ID NO: 17403 - DNA, 3000 bp, Unknown; identical to SEQ ID NO: 5248
  misc_feature (1)..( 3000): 2750-1469P.txt file - cDNA_ID_1808799; gDNA_ID_2926205; Annot_ID_202131

SEQ ID NO: 17404 - DNA, 3000 bp, Unknown; identical to SEQ ID NO: 6757
  misc_feature (1)..( 3000): 2750-1469P.txt file - cDNA_ID_1808803; gDNA_ID_1621104; Annot_ID_55951

SEQ ID NO: 17405 - DNA, 3003 bp, Unknown
  misc_feature (1)..( 3003): 2750-1469P.txt file - cDNA_ID_1808803; gDNA_ID_1620864; Annot_ID_51302
ttattgggggaagaatggaaataaatattgcggcaaaaagataatttaaagaataaaactacttatatccttttatcaattgggtaactatagttgtctacttgtctttgttgtcgtatacccctaattataggaccactcacctaggttcaaatgtcaaaacatatggactattaagttcattgttagtaagtgatatatagtaggcctaacttaatcggtggttatatagtttttaataaaacatgtgtgttttaccaaaagaggactacattttaaaaagactccaaagtgaaccccaactttttggaaatcaggaaccactccaataagagacacaatgctcatataaactcatgataatatatgtgagcatttgtctacatatcacaaacatagtcgaattaaaccatctatattcctttgtacggtctacaaaatgacacaaatttcaattatggtgataaaagaatggaacataccttcaacatcaagctcataatggcatttgtcgactaacaatagtttgcttttatcctgcttgcctctgtaaatgtgagcattaacctgatcagaaagaagtaaaaatgtgcgtacaagcaatgatagattcagagataagagtcacctctcaagaacagagttggaaagaaccgacttgtctacgtaaggaatcccaagaagcatcctcattgttggaatgactagaatttcaaactttgtgcatttctcaaacaaatcttagttgctgacaaaatcttacttgttaaatgcactcttgtatgagaaatatcacttcaaaaaatgatagacattttgtctcttcatattccattgtcttctgagtaaaaagacacgtcttaacgtgaacttggtctctcagagacattaatcaaacaagttgaatgcaaaactgcaagtaacaacaaaataaaatttgggcacaataggagaggaaaacaaacacgagcgactctgatctgtattacaaaaagactagtgtctagtgacataagatcgtcgatgatctgagatgcgacggacgtttggtatctgtacaatctctggctagggtttcttgacttgccgatcacgacaccttcagcctcgcatgggccgctataatagctcaataatggcccactactaaaaatccatatttctgttattgagtaatcaataacttaacacatgttttaaattccccgccaaagtatgatcatgagagagaacaaaaattatgaactttttaaaatggaaattgatcttcttcttctttttctggttaaaacattcaacatttgtattgtagtatatgtagtaaattttatggactaaacgaaagatagaaatatataggcaaatccaagggaaataaaaattctaaatatatatatgaaattgcatggactgccacgcagtacgataaccaaatatccaaatttatacaacaaagaaatagtattgcgtcaaaattaaaatacactcgggagtgaaagaaacaaatttaatttgatagaaagacatcataccccaaagatcatgtatgtcattttcttaacctacgtgatccgtaccgttttacagttagatgtgtcgattatttatttaacaccggaatgttaggaagtcttgatatatatttgtcataactagtataatggtatattagttgttgccttggtggtacgagtgaatagaatttttcacatataaggacgaatcaaccatatcgccattagaaaaccttatacgtccagaaacggcaatgtaacaaacaaacaaaaaaaagaattggtgatatattgtttattaaaacctctacgttggtctgaaaatagatataattgcgtgtcatgaaacaaagaaataaacgagttagataagaaataattggattagcaaggtttagaggaacaagaaatgattattcaaatggaaaagtaaatacttttgtaagaaaataaaagcttattgaaatgaagaattgtgcatgatcatttgataaagccaagtcatggactgattcttctgtttcacaggacggttcaaccaccatgcacctctttttctttgggcgtttaatgacacaaaccacatttatctttttatatccttttttgttttgaatttatttggttacaactgttatttacctcttttatcttccaatctttctcaatttctaagttttttccatactaagtattttgttcatctgaagaatctggcacctttgtacattcaagaaagttttaaatgttttcactgcaagacaaacaatactgtgtgtacaattatgatagaaaacatttatatatggagaataatatagtcatgtgatacaattatgtaccacatctatacatatagaagaaacaaaaaccaccaatttgtcactcccaacttcattcacaactcacaagttaagaaaatacacatagtttctcttacacgcattactatggaaccttctgaattcgtttccagcaaaagttattttcttatttcaaaaataagttccatttttttatgtataaaaaataaagttaattgcaataaattcgccatcttcctatcaacatatatagatttttcgacaaattcatataaggagagtctaaaattaactcacagccacatgttatttagccaatgtttttaataccagaccggtcaaaccggtggatccgtgaccttatatagtaattctagagtctttaacaaaatctcaacttatgacatcatattatatattaatcacgtatcatctatagactatatacattcatacgactctctgattcttcgtttctctccataatatctcctagtctcaactctcaaatagagagagaaaaacagaaagacagagagaggttctatatattatagataaagtacattacacaattgtacaagtggaaaaatcatcacggatctctcttcaaatatataaagaagatttgtatatcaaactctctaagcttttgttgagccatg

SEQ ID NO: 17406 - DNA, 3000 bp, Unknown; identical to SEQ ID NO: 6757
  misc_feature (1)..( 3000): 2750-1469P.txt file - cDNA_ID_1808803; gDNA_ID_1621104; Annot_ID_171528

SEQ ID NO: 17407 - DNA, 3003 bp, Unknown; identical to SEQ ID NO: 17405
  misc_feature (1)..( 3003): 2750-1469P.txt file - cDNA_ID_1808803; gDNA_ID_1620864; Annot_ID_170412

SEQ ID NO: 17408 - DNA, 3000 bp, Unknown; identical to SEQ ID NO: 6757
  misc_feature (1)..( 3000): 2750-1469P.txt file - cDNA_ID_1808803; gDNA_ID_2926184; Annot_ID_140725

SEQ ID NO: 17409 - DNA, 3000 bp, Unknown; identical to SEQ ID NO: 6757
  misc_feature (1)..( 3000): 2750-1469P.txt file - cDNA_ID_1808803; gDNA_ID_2926184; Annot_ID_200510

SEQ ID NO: 17410 - DNA, 3000 bp, Unknown; identical to SEQ ID NO: 6757
  misc_feature (1)..( 3000): 2750-1469P.txt file - cDNA_ID_1808803; gDNA_ID_2926185; Annot_ID_200524

SEQ ID NO: 17411 - DNA, 3000 bp, Unknown; identical to SEQ ID NO: 6412
  misc_feature (1)..( 3000): 2750-1469P.txt file - cDNA_ID_1808894; gDNA_ID_1621093; Annot_ID_55582

SEQ ID NO: 17412 - DNA, 3000 bp, Unknown; identical to SEQ ID NO: 6412
  misc_feature (1)..( 3000): 2750-1469P.txt file - cDNA_ID_1808894; gDNA_ID_2926160; Annot_ID_139692

SEQ ID NO: 17413 - DNA, 3003 bp, Unknown
  misc_feature (1)..( 3003): 2750-1469P.txt file - cDNA_ID_1808910; gDNA_ID_1971820; Annot_ID_58317
ttcgagatcagtcaaattcaaccgttgtttgacatattgagcacaatcagttctttaagtaaaccgattgactcgggaatacgtccttcgaatctgtttccggagacatcgatggttttgtaaatcgtgaaaacactcccaaccaactctattatcgatcctttgaccgtcatagtcactgagttataatagtttcctgagtcacgtccagcatacctactcggcataatatctacgatgtctacggctgatgacattgcactccaacccgcaaagaaatctgatcgaaggactccattgaagcggttttccgaaatgtcaaagattcgcagcttggggaagctcaaagaatctccaagagaagatattggaccatgaaactcgttagaacgaaggacaaaaatctgaagtttgggcaacattctcaaccagaatggaaacttgtcattgattatgttgtcttccacgttcagaaactcgagacgagtgcagttgatcaaagacttgggaagttctcctgataaccggttgcgaccaacgtcaagtgatctcaagtgatcactgatagattcctctggaaactcaccggataagttgttattccgaagatgcaaaaccgaaagagtagtattaaacttctcgaaacaccgaggaatggagccgttgaagttgttgttggataaaacaagtgtatcaagagaaaccaatttgcatatagtcttaggaatctctcccgaaaaccgattatcagagcctaaaaagatcgttgtcgagtttggtaacaaaggaaacggatcttggaatgtgtttgaacttatgtcaagcataagtaattctccacatctttgaataacatctgctggtccttcaaagccactgaaagaattttgagaaatgttaacatactgcaactccggtagactccacaaccattgtggtacttggcctccaattttattggcagagatgtctaaataatacaaagtggtttggttttctagaaaattggggaactcaggaatattgcaagatgataaaatcaaggtgcccatgggtgagggaagacttagagttgaactgatcttcaaattaatcccggaaagatccaaataaccaagtgacaagagaggtgagaatatacttatgtcaaccatgcttcttgtattaatataagagaggtcaaggaacgtaagtgacttgagatgcaagaaagtgttgaaatcgaccatgcctctctttgtgttccataaagagaggtcaagataaaagagaccaactagtttcgatatagactccgggattggcccattgaaattgttttctagaagggacaaaactccaagattagatggtgaagagatattaccaaagtcaagaggaccgttgaagtcgtttcttcccaaaacaagagaggtcaatgaaggtagcatgaagagagacgatgggatagatccggaaaatgaatttctatcaatcccaaaatacaccaatttagagaggctactcatattagatgggagcatacctccgaactggttagaaccaaggtcgatcaacgtaagctcgctcaaattgagtagcatactaggaaagttcccactgagcttggccgatccaagatgcaactctgttagcttgtttaaatgtcccatcgaatccggtagctccccggtgaaatcattaacagaaagatcaagattagtgagataagtaagatttccaagtgaagaaggaatctttccaaagagattacaatcaccaagactcaaaaccctcaaatatttgaggctgcctatggaatccggtagaatacccgaaaaattattcgagccaagatccagattatgaagatgttgtagtctaaacaagctactatcatatctcaaaggaccattaagaaaactgttcatgaggtctaactctaccaccttacccgttttaggatcacaagagataccatcccaagaacagcaatcggtgttgttcctccacttctctgtcttcttaacaccaacaatcccattggagttgaactcatggacataaaactcgttcttaaactccaaaagagcattcttctggtcttgacgacataagtgcttaacatgagaagccaaaaccagttttgaattagaaagggacaagattaaacacaagctccatattgtcatcttcatctgacctcaacaatgcaataaactttttttctttgattttttttttctcagaaagtgaaatgaatgatgttcaatgtttataagtgatggctctagtaatagacccaaagactgtcttacattttgtggaaaaaagaaaaagcttgacttaacaagtctcttgtaaaaaaaatggcgtcatcttccacaaagatatatgaatttccaaatgaacgctccacaaagtcaattatgtctcctcttgcataaaagtattaaccctaaaaataattcaattacttgcggtgtggggttaccgcagtacaaaaagtagagcgtgtggggttacctcagctgtgtggtgagtgctacgcaattgcgcaaacgctctttaacggggcacgctcgtgactcgtgagagagtcagtcacacaccgtaaaagttaccgataaactctcaaaaagtcttttttggctttgccaaatttctaaaattcaatcaacattttctttcttcttttcgtttacatttttgtattaaaaaaaaaactctaatgggctcgtggaggtagctgaagcccaaaatatgggataagggctataaggattgtcgatcatatcttcttgcgccgtcaaaaagcttccagtcgcaaacgatgacaactttccattaaactaaaatgacataaatacccttcaaaatccacatattactctcaactgtttcatctacctccctccctctctccccattcccaaactacacattacacattaccaattctcatattaaaatccacaaaactcaaatccccaaaataaacaaaccctaaaattcaaaacaatg

SEQ ID NO: 17414 - DNA, 3003 bp, Unknown; identical to SEQ ID NO: 17413
  misc_feature (1)..( 3003): 2750-1469P.txt file - cDNA_ID_1808910; gDNA_ID_1971820; Annot_ID_176136

SEQ ID NO: 17415 - DNA, 3003 bp, Unknown; identical to SEQ ID NO: 17413
  misc_feature (1)..( 3003): 2750-1469P.txt file - cDNA_ID_1808910; gDNA_ID_2926158; Annot_ID_139607

SEQ ID NO: 17416 - DNA, 3003 bp, Unknown; identical to SEQ ID NO: 17413
  misc_feature (1)..( 3003): 2750-1469P.txt file - cDNA_ID_1808910; gDNA_ID_2926158; Annot_ID_198563

SEQ ID NO: 17417 - DNA, 2981 bp, Unknown; identical to SEQ ID NO: 12066
  misc_feature (1)..( 2981): 2750-1469P.txt file - cDNA_ID_1808920; gDNA_ID_2214529; Annot_ID_134245

SEQ ID NO: 17418 - DNA, 3000 bp, Unknown
  misc_feature (1)..( 3000): 2750-1469P.txt file - cDNA_ID_1808949; gDNA_ID_1620745; Annot_ID_49708
tttaagggagatcctgcttatgtaagagctgcgtgtgaggctagtttaatgcgagtagatgttgcctgcattgatctctattatcagcatcgaattgatactcgtgtccctatcgaaatcactgtaagcactcttcttgtcaatcttccttcatggttttgcaactttcaaatgaaatggaagttatatagttcctctcacttctcagtgagcttcacacatgtggctagagacatgttgggactaatatagagtcgaagagtttagctttcagaactatgttttctgcttgggtcactctttctgaaattactagcttattcatgaagaaccattgtctggtgaaatgatcttatcatctcccttagaatttttcgtttgaatagactcctttaggtttgactctgagctcacacttcatgacctatattgaaagccagcaactttagctgaacttgacaatctcttttgtctgtcaatttcaaagattggagagctgaagaagctagttgaagaaggtaaaataaagtatatcggtttgtctgaagcttcagcttcaactatcagaagagcacatgctgttcacccgataaccgctctgcaaatagaatggtccttatggtcgagagacgtggaagaagatataattccaacctgcaggtaaccagatttcatttcatcctcattcttgatgcactatctattaaatatgtaacatcttctctctctttcttcagggaacttgggattggaattgttgcttacagtcctctgggacgaggtttctttgcttcaggacccaagcttgttgagaacctagacaataatgacgtcagaaaggcaagtacacaggctttatatgacttgtttgattgatgaactgttggtaatcaactcactgtttatctgttcaattctgtttcttatcgcagactctaccaagattccaacaggaaaacttagaccacaacaagattctctttgagaaggtttctgcaatgtctgagaagaaaggatgcactcctgcacaactagcccttgcatgggttcatcaccagggagatgatgtttgccccatcccaggaaccactaagattgaaaacctcaaccagaacattggagctttatcagtgaaacttactcccgaagagatgtctgagctcgaatcccttgcacaaccaggttttgtgaaaggagaaagatccattagcatcctgaccacgttcaaaaactctgagactccaccattgtcttcttggaaagccgcttaaaatcgtctgagtttctctgattgttgtggggttcatgtcatttaagtggtctaagttatgtcagctagatcaaggtaataaaagtgctgtgtcttcgagagtggattatggtaggttcattcccagggaaagccaaaactatcaagggttgatgcctttaagagtaaataatgtatagagttccccaagtgagaacttcaatttacatttcatacattttgaccaaactctataaagaaagttatgtttagactttttttttgctaaaaatgttaattttcattatatgaataagaggcttttacaaaaacgaaaggcctatacaagagtagccgaggcaaaaaataaaacaaggctacaatagagatttagggaagatataaggttagcgaatccaaagcaccatgaggttgcgccatctctttctgtggtaacgagaggagatgatgttacgaatctcgcggtcgacaatcttgaagatgataataggagcgatcctaagattgttatggaggacattgttgcgctgacgccaaatgttgtagatgatagcatgggctgagacttttctgaggagggaaggcgccgaagaagaggaagaacgcatccaagagaggagctctgcccaagagcaaaacagcctctgacgcggacataagcgagaaaacgctaatctccaaacttgagccgcaaattcacaggaaaaaaggagatggtctctggattcagtctcaatagtgcataagcaacaatcgaaagactggatatggccccaagaggctagcctttgacgagttgggagtctatccaactgactaatccacatgttgaaggcatgcttaggaacagcacccttgaaccaaacagcctttgcccagtccaattccggtgctcttggtctaatagcatcccaagtccttgccgaagagaaaccttgacaaacaacaccaccaacaacccaatcaaaggagtcttcaattgtagcaggagagggggtcgtgatggtagagatgtggtcatggatggcttgagctggagcagaccgagaaagggggagcttccagccattaaccccaagagcctcaaccaccctagcgttaagagggatgcgaagtgatctggagccataatcacccataacctttatcagcgggccaagggaagtccaactgtcatgccagaagtgagctatgcggccattacccaagttgcatttaacaaattgctccgccaaaggtctaaggaacaagagcatacgccaagaccaaggatctgatggggaaggagccacatcccaaaaagacctgcttctaagatgtttagactactgatacaaacttaaataacccaactctatatcgtcaaaaaagactatctatatcgtcacccaactctatgaaggatatgtgcgactaattgtatcggttccttctctttcgttcttgaattttttttttttggaggtttatagtttctcacaagtgagacatgttatttattattattttattttttcccccgaccaaatcacaagtgagacatgtaccaaccagacaaaagcgaccacacggctttttcttcatcatcacattcacaccatcaccaccaacaacaacaactccactaaaaaattcatagctctacaagagtcacctcatagagaagtgaagagacagagatagttgtgacagagagattcatggcggaagcttgcggagtgagaaggatg

SEQ ID NO: 17419 - DNA, 3000 bp, Unknown; identical to SEQ ID NO: 3999
  misc_feature (1)..( 3000): 2750-1469P.txt file - cDNA_ID_1808953; gDNA_ID_1620678; Annot_ID_48301

SEQ ID NO: 17420 - DNA, 3000 bp, Unknown; identical to SEQ ID NO: 3999
  misc_feature (1)..( 3000): 2750-1469P.txt file - cDNA_ID_1808953; gDNA_ID_1620678; Annot_ID_164319

SEQ ID NO: 17421 - DNA, 3000 bp, Unknown; identical to SEQ ID NO: 3999
  misc_feature (1)..( 3000): 2750-1469P.txt file - cDNA_ID_1808953; gDNA_ID_2926213; Annot_ID_142087

SEQ ID NO: 17422 - DNA, 3000 bp, Unknown; identical to SEQ ID NO: 3999
  misc_feature (1)..( 3000): 2750-1469P.txt file - cDNA_ID_1808953; gDNA_ID_2926213; Annot_ID_202771

SEQ ID NO: 17423 - DNA, 3003 bp, Unknown
  misc_feature (1)..( 3003): 2750-1469P.txt file - cDNA_ID_1808967; gDNA_ID_2214524; Annot_ID_134128
aaacagccgtcagttcttaataactatacacttcaaaaataagtacatgatatattttggtcaaaaataagtacatgatatatttatctctaactcttttatacttgcctcttctccaacaacttgtcgatttcaggtaggacacgcttattaacgtagacacgtcattgcgttcgtattattataacgtggcagatttagccatgtcatatatcccaatcactctgatttttttttgccaccgtccccgtgaagatcaaccaattctagtttgcccaaaaaaaaaaaaaaaaaaaagtttattttcaacttattttcttaaagaggttttttctaacgtcttactttattactttgttaatttaaattatggattacatatgtaaacattgcttataagtcaatttactataattgtccacacacaaaaaaaaaaaagattacatagttttggttttatcgataggacaactaatacattacaaatgtttaggtataacaatgtaatcagaaaactatgtataacaatgaaattacacttactttctttcataaaatcttacacattaactaataattatcaaatctgttttttctttataagttaaaaaaaaaaaaaaaaaaaaaaaaaaaaaaaaaaacgagtttcactaaatagccccattggtgcagtatcaccccattggtgcagtatcacatgaaatttcttttcttggaaaaaataaataaaaatttgataaatataaatattaacgtagaaaattgtctgtattcagttaattttggtatcacacttatgttctaatagattttaacccgcggtataccgcggagacaattcattttttaaaattaatatatatataatttgtaaattattttatagtttacaattgttactaagtaacgtcctgccaaacccgtcccgccaaacccgttcacaaaaaaaaatatttattttattaatgttgatcttatttataatatgtttatgaatcattgtcaaaagattttattcgttgcgggatgttgaacccacacatttttcgccaattagttaatatatgttcattcttaaaatttcgaatcacaaaatatgaagaattttgtttttagattttttaaactctatatattctataatgatgttaagtttttttgatatattaaactttttataaatttaaatattattaatgttttatgaattttaaatatataaataataataattaaaaaattaatattttttgccttttaggtaatgatataataactctaaaagcaagaatttagaagatttaaatctttaattaaatattttcatacctaaataattaatgtcagtaccatgacattgtaaataagttcaaataaatgatttgtttatttaaaaaaaaaaagtttagtaagaacaatatttatttaaacaaaaaactttgttttaaaatattgttaacaaaatacttttatgctaattttaagggattgatgtgaagtttgtttggattaaatttgattgataatgtgattgacaatttaaattaagaatttaaagtaaaattaattattttgaaaaaaagatttaatgctaatggcattgggttgtaaataagtcaaactcaaagatttatttgttaaaatggctgcaaaaatgtatatatagattattcgtgaaaataaaaatttaaagatattcctctgctttttaaagaattaataactagtattaaagtaaaatataaaaaaaaatacccgtaaagactatccacaaaaaccataatcatgctcgacaatgaaattaaataacattcaatggttaaatctcgtagcttcttggccatcaaaatcatagggcttagtgtatgccaaagctaatcatctcttcatgtacgaaaatgaaagtaatactaataaatgagaaccatatatgaaatgcatggtccttcctttttatgatttattaatattgtaattattatacgttattatcagataataaatttcagatcatgcaacttatacacatccccacatcgatcaccatcagacatatactacgctttagccaaaattaaatgcatcacgaacataacatttgtggttgatgtgaatagaatagaatacagaagtaacaaatctactcgaccaaaagttgaacggtaatataatttactattcaatattttcaattttcaacaaaccttatctaacacttccaactaccatacgttgataaaaattgttagtttattagtcaatttgcactcctctattaaaaaaacattggagaacttgttagtttatagtcaatttgcactagttctctattaaaaactttttaaaaattaacttttagggtttaaacacataaatagctgagaaaaatctagatatatagaattgagatttaaaagaaaaaaaacttcaaaaaatcaaccggaataacatttaaacagtataatcctttttgataaactacgaatttactggtcgaactacatacatttccctaagcaagatacatttcctagtttaacgcttcagcctaaatatcttactatttttcaaactttttatcgactgcgacatacatacttacattctcatatcgactggtccatttatctatatccttaataaactgtctattaacccaaaagaagagccgtcattagtcaaaattgagcaaacgaattcaattcccaaaccacagtccctaaactcgtaattatacaccaaaacaaatggcaaacaaatcacaacacagaagctgtcatcctcccaacttacttaaacagcctgtcattgtccccacttgtcgttcaaacttcaaaataaatattaaaaacacataatcacaaaaagacaaaacaaatccaatgtggcatattctttttatatatataaacacacaaaaacacatctcacttctcatctcctttctactattcccttttggccggaaaccgagtcgactcattgagtcaaaccaaaccaatg

SEQ ID NO: 17424 - DNA, 3000 bp, Unknown; identical to SEQ ID NO: 3481
  misc_feature (1)..( 3000): 2750-1469P.txt file - cDNA_ID_1808991; gDNA_ID_1620648; Annot_ID_47648

SEQ ID NO: 17425 - DNA, 3000 bp, Unknown; identical to SEQ ID NO: 3482
  misc_feature (1)..( 3000): 2750-1469P.txt file - cDNA_ID_1808991; gDNA_ID_1620648; Annot_ID_163321

SEQ ID NO: 17426 - DNA, 41 bp, Unknown; identical to SEQ ID NO: 326
  misc_feature (1)..( 41): 2750-1469P.txt file - cDNA_ID_1808991; gDNA_ID_1563839; Annot_ID_148384
  misc_feature (1)..(1): n is a, c, g, or t

SEQ ID NO: 17427 - DNA, 3000 bp, Unknown; identical to SEQ ID NO: 3481
  misc_feature (1)..( 3000): 2750-1469P.txt file - cDNA_ID_1808991; gDNA_ID_2926214; Annot_ID_142132

SEQ ID NO: 17428 - DNA, 3000 bp, Unknown; identical to SEQ ID NO: 3482
  misc_feature (1)..( 3000): 2750-1469P.txt file - cDNA_ID_1808991; gDNA_ID_2926214; Annot_ID_202847

SEQ ID NO: 17429 - DNA, 3000 bp, Unknown; identical to SEQ ID NO: 7521
  misc_feature (1)..( 3000): 2750-1469P.txt file - cDNA_ID_1808995; gDNA_ID_1621149; Annot_ID_56830

SEQ ID NO: 17430 - DNA, 3000 bp, Unknown; identical to SEQ ID NO: 13873
  misc_feature (1)..( 3000): 2750-1469P.txt file - cDNA_ID_1808999; gDNA_ID_2214663; Annot_ID_136548

SEQ ID NO: 17431 - DNA, 3000 bp, Unknown; identical to SEQ ID NO: 3022
  misc_feature (1)..( 3000): 2750-1469P.txt file - cDNA_ID_1809003; gDNA_ID_1620620; Annot_ID_47026

SEQ ID NO: 17432 - DNA, 3000 bp, Unknown; identical to SEQ ID NO: 3007
  misc_feature (1)..( 3000): 2750-1469P.txt file - cDNA_ID_1809003; gDNA_ID_1620620; Annot_ID_162276

SEQ ID NO: 17433 - DNA, 3000 bp, Unknown; identical to SEQ ID NO: 3022
  misc_feature (1)..( 3000): 2750-1469P.txt file - cDNA_ID_1809003; gDNA_ID_2926190; Annot_ID_140989

SEQ ID NO: 17434 - DNA, 3000 bp, Unknown; identical to SEQ ID NO: 3007
  misc_feature (1)..( 3000): 2750-1469P.txt file - cDNA_ID_1809003; gDNA_ID_2926190; Annot_ID_200960

SEQ ID NO: 17435 - DNA, 3003 bp, Unknown
  misc_feature (1)..( 3003): 2750-1469P.txt file - cDNA_ID_1809022; gDNA_ID_1621108; Annot_ID_56036
aatagagaagtggtatatcaaacaaacactactgaataaccgtattggttaatatgaattaaaggagactttgttggtttttctcatgtgggagttggtttactatcgaacctttctaacaacaacgtattcaccagttgataagctgagctcgacatctgtcacaccgtgatatgggaacaagacctgaaaacgtttttaaaaagggaaataatatgttataatggcacatcaatgaggaccaaaaggaatctagatgtagcctgtctttttggttctctaatcaaaaacagtttatgtacatccagttcatacgtggagaacttataatccaattatctctttgatacttttactaccaatataaaccaaagttttaactctaaaaggaaggtattaaagactgaaaagcatacctctcctaagaagtaacccatgctatctgttgacgtgtcatgcatctgagatgcaaacactccattagcttcctcatatgatggaggtggcggcatactgtctgcgcttgagggagtagagggagcttctatacgttgcctctcagataccatctgtaggttcaagaatgttccattttgtccttagttgactcatataatgatgaactgattgttcgacaagaatactattatcacaggaaactgaaagctgtaaaactaatgcacaccaacctctccttcgagctgatcaagtatttggaggactctttgatggtaggcgcgttcagattcaacctgtgatcaggaatgaaaaatacagttgttacatatgggtaagtaaatcaaagttgacctagaaatggatcttgtaaccaatcgcactaccattgaaagaagtcgttcaagagtcaatttctgttgttgatcttcaacggaagctaaagcagaagcagcttctttccccaatattgtcatatttgattttaggtcgtgaagttttgcttcagcagattccagtttcatcaagatgtcaggattaccttgagactctctcgcctttgcttggcgtctggcaacttctgtagcctgtttggattaaagcaggcgcataagtaaagttctatcatgcgaataataaaatgactagttcttggaagaggaaaaaacccatattctactaacggtaattaaatagcttcatggtattatctttcaccgtacctgagcttcagcttcttggcgcattctgtcatagcgttgagcaagatgtctagcatcctccaatggagctcccaaaaccattgcccgtaatggctcagcaacctaacaaattcaggattgacatatgattgtagtagccaaaccgcaataaagaaagaaccaagtgaacaccatgacattaattgacttttaaagagtatgtaacaaattattccagataaaagaaatagatcttcccacaaatggcagtcattccactaacaatggcaggaaagtaattatttgtgtagttatattgcatgcaacagatatgtgctattgcttaacactttgatggaagatgaaaaagacaaacctgtgtaccaagagccttcaacatatttccacgttccttctccatttgtgctcgagcacgcccatagttcagtgcagcccgtgttaatacgttaccattcgtacatgtattctctgaaccatatttcctgctatcctcagacaatttcgtacctgatgaaaaatgagtgcaaaatgaaagacaggcctgtgagccaattcaagtctataacagacataaaaaaatacaataagttaaaactcaaagggtcaaaaaaatcacctatttcaacttgttttgaccctgtaactatataaccttccacaccacgaacaatatctctttggtaatgctgaaaacgaagaacgaatgagtccaaaatcaatagtaatcaaaacttcaaactagtcaaaagcttaagaaaaacaaccttagcagcacgagtggatatgtaaagcttttctagcttctgatgctgattgagttctgcttcatcagctaaaccagagccatatccccctcctccaaattgcttaaagacagccttaaccattccacaaaaactaagtcagtgtactaattaacctcaaactcaagaacacaaacacccaatctcatggtaacttggaacatgtagcaccaatatgttaatctatcactacaacatctttcaaatcccagctcacaaaactgaaacggattctcacataaaagtatcctaaattaccctttgacaaaaacttctccaattctacagaattttacccaatctcacatcgaatcaacgtattaatcacactcagatccaattactcattaagtcaaaaaccatcgatccgaaaaaaagctagcccctttatcatcatcacattattgattcattcaccagaaaccaacgactcaacggaatcacaagagaagataaaaacaaaatctagaaaaaaagatacagaatcgggatctaagcaaatgggcaaaccaaaagttaagaactttaacctgctgctgtctcgcaacttgttctctcaacctgctagcttgttttctaattgcatccattcttcaccagatcaagagctattcacaaatcttcttccttctctctttctcctattcttccactttacgagttccctccgattacttggaacaactcagagaagacagagattcgaaatcgtcaaaaatggcgttgagctcagaacaaatttctctgctttcgaacacgaagaaatcaaagatagacaaagtctctgtttcaccaagaaggttaatattgggctctctataatagcccattgggcttgaaaataaaatccagtaagctataaatttatatcatctcaaaataactaaaaagacgcaaaaccctagacatatataaatgaaaagccagtgaattagggctttctctcacttgttgaagccgcttcttcttcttcctcactgtagctcgtcgtcgctacaccatctagaagacccttaaccatg

SEQ ID NO: 17436 - DNA, 3003 bp, Unknown; identical to SEQ ID NO: 17435
  misc_feature (1)..( 3003): 2750-1469P.txt file - cDNA_ID_1809022; gDNA_ID_1621108; Annot_ID_171690

SEQ ID NO: 17437 - DNA, 3003 bp, Unknown; identical to SEQ ID NO: 17435
  misc_feature (1)..( 3003): 2750-1469P.txt file - cDNA_ID_1809022; gDNA_ID_2926207; Annot_ID_141816

SEQ ID NO: 17438 - DNA, 3003 bp, Unknown; identical to SEQ ID NO: 17435
  misc_feature (1)..( 3003): 2750-1469P.txt file - cDNA_ID_1809022; gDNA_ID_2926207; Annot_ID_202339

SEQ ID NO: 17439 - DNA, 3003 bp, Unknown; identical to SEQ ID NO: 17435
  misc_feature (1)..( 3003): 2750-1469P.txt file - cDNA_ID_1809022; gDNA_ID_2926208; Annot_ID_202371

SEQ ID NO: 17440 - DNA, 3000 bp, Unknown; identical to SEQ ID NO: 12448
  misc_feature (1)..( 3000): 2750-1469P.txt file - cDNA_ID_1809029; gDNA_ID_2214552; Annot_ID_134695

SEQ ID NO: 17441 - DNA, 3000 bp, Unknown; identical to SEQ ID NO: 12448
  misc_feature (1)..( 3000): 2750-1469P.txt file - cDNA_ID_1809029; gDNA_ID_2214552; Annot_ID_185594

SEQ ID NO: 17442 - DNA, 3000 bp, Unknown; identical to SEQ ID NO: 6828
  misc_feature (1)..( 3000): 2750-1469P.txt file - cDNA_ID_1809097; gDNA_ID_1621108; Annot_ID_56018

SEQ ID NO: 17443 - DNA, 3000 bp, Unknown; identical to SEQ ID NO: 6828
  misc_feature (1)..( 3000): 2750-1469P.txt file - cDNA_ID_1809097; gDNA_ID_1621108; Annot_ID_171662

SEQ ID NO: 17444 - DNA, 3000 bp, Unknown; identical to SEQ ID NO: 6828
  misc_feature (1)..( 3000): 2750-1469P.txt file - cDNA_ID_1809097; gDNA_ID_2926207; Annot_ID_141798

SEQ ID NO: 17445 - DNA, 3000 bp, Unknown; identical to SEQ ID NO: 6828
  misc_feature (1)..( 3000): 2750-1469P.txt file - cDNA_ID_1809097; gDNA_ID_2926207; Annot_ID_202319

SEQ ID NO: 17446 - DNA, 3003 bp, Unknown
  misc_feature (1)..( 3003): 2750-1469P.txt file - cDNA_ID_1809105; gDNA_ID_2214498; Annot_ID_133615
acaacaacaacaacaacaacaacaacaacaacaacaacaacaatacatggcgagcttcttcaggttttggcccgatgacggttacaatggctcaaccaccacctgcacctagccagcatcagtatctgaacccgccttgggtattcaaggacaatgataatgatatgtctcctgttttgaatttaggtcgatacaccgagccagataattgtcagataagtagtggcacggcaatgggtgagttcgagttatctgatcaccatcatcaaagtaggagacagtacatggaagatgagaacacaagggcttatgactcttcttctcaccataccaactggtctctctgacttgtctttgcatcagagaatcttcttacaatgaacgattctgcaatatcttatctttttgcttctttgtttattctgttatctgctatcaataaaccagacaattgttgccagataatggcttttgattttgatttgttgttttatctccatgaaaatccaagttatgagatcagattgatttctttagcacatcaaggttccatataatgaatctataatcatcctagtatattagtcaaagcaggagctaacattaccttttaacttaaggcttaagccatagcattatcatcagctttgctcaaactcaacatcttaaacacttaattagactcagagatctatcgaccaacgaagtgaactgctttttccccaaaaccctaaccacccactttcaaagattcgtcctttatggatttagctcccctgtttccaaatgaaacctcaaaaaacttgaaccatatatactcatcagaagacaacttaactatggcagcttttcaaatatgattcttatctttataaaaatctttcgtcagaaacagtaaaagtaagacgatgatagagacctttcttcctaaagatctctcatcatctttcatggtcgtcagagctttgctacagagacgtgaagagagaatatcataaatgggctatataatgggccctaagaggcccacatgaatttccgtatgattcttgtaattgggctttctctggctctactgactcgtctcctgaagaacaacaacaaaacatatttcattgagctcctccactgaatcgctctcatccttcgcttcttcgaattccaaaggttagactttcctgaatccttcaataatctctcttcgttgtcttctgtaacatttcttctattgttagtgatggattccattattttccttgtgttacaactttgatgagctcaatgctttcacaaactaggtttcggaatttttgtttcaatccaatgtctctatttgggtctttaaaccagattatattgaagatctggaaaatgggtttataattttgtaaagaccgcgactttgaaaacttcaatttggtgaaattctttcaaatccgcatcttgtaaaaatcacatttttatatttttgttgattgatcttgttctctgttgaatgtttaacttgtgtgcgttaggtagaacagtagaagaaatcatggatccagctgaaatgagatatttggaagaagaggatggtccgttgatgaagacaatcaaaggtagtatcactggttttggtgctgggactatttacggaaccattttagccacatggaaagatgttccaagagtggagagaaatgtggctcttccaggacttattagaacactgaagatgatgggaacccatgggctgacttttgctgctataggaggtgtttacatcggtgttgaacagctggttcagaattttagatccaagagagatttttacaatggtgctattggtggttttgtcgctggagcttctgtgcttggctatagaggtaatggtttttcttcttcactcatggttcgttcgttttcattgtgtttgcataaaacaatgtctcgatggttaagtagtttagaactgatgtgattttggtgaagaccatttgaagttactggaattagcagtatgtagttcacttcatgtgttttacgagcttagtagttattgatggacaaacaatgatctcgagtgggagtaactaaaggaattgtaatgggaagaaattgattcttccttacctcaagttaatgttatttggtgcctagtgtagcaattctataggatagcacaagtgtcaagactttgatattgagtgtatacaggaaactctcaaaatcatatatatgtaaagatcgaaagtacatagctttgagtgagagatgatgctatagattcgtgcattcttatgatgctatacttaattgttatttggtttactttggttttcctctttttttacagcaaggagcatcccgacagcgatagctgcaggtgcaacactagctgttacctctgctttgattgattctggaggtcagaccacaagagtagacaatggcagagaatactatccttacaccgtcgagaaaagagctgaagctgattcctgatttctcttttggtcactgagattaataagatgtgcattcgctgatccggggatcttgagataatctcttttgtttattttatctggatatgtgatatcatgatactctttgctcttgtttcttcttgttttcttgagagcgactttctcacatcttttgtctgaatgtttcctgcaataaaaattcaactttgtctgcagatgtaaacaaatgttttagctttcagtaatcattttaatcagacatttgcttgcttctgttaacctcaagctagtttctttatctgaaactataatagatttgaacatgacaagcataaggaaacaaacatgtaacatgtataacaatcagatgatatggatttggagatctacatgtaaaagtagagtgaatacgtggcaataactcattggctatcttaaatttccttgtggtatggctaatctagtggttcttgtccaagtaactatcgcatcacagtgacgagtttttttcctagagacctctgctgcaatg

SEQ ID NO: 17447 - DNA, 3003 bp, Unknown; identical to SEQ ID NO: 17446
  misc_feature (1)..( 3003): 2750-1469P.txt file - cDNA_ID_1809105; gDNA_ID_2214498; Annot_ID_183901

SEQ ID NO: 17448 - DNA, 3000 bp, Unknown
  misc_feature (1)..( 3000): 2750-1469P.txt file - cDNA_ID_1809108; gDNA_ID_1620749; Annot_ID_49756
tttttttcgttttatttatcttcggacatatactaacgtaacttgctctgttgatgtatagaagagggacggtttagcttctccagacaatggaaatgacgattcactttacccacaaaagaaaaaggtgatcactgattagatttggtttaagcccataaagtacatatatttgttgctaaaggaaggtgacatggactattggaaaaggcgttttgtttctagcgttagcgattagaagacgcaaacgccattgatgacaatgggagaataatctgaagaagaaagagacagaaacatggaaaaacaacccttttggctccaagctaacaaacacggcacaatcgagcttcctttgagaattcaaacacatgaccattgattggactttcaactaaatggagccttaattcaattcatcaagctatgaccattatagttttgaatgctagaaaagacagaactcgaattgaactaaaagcaagtgtctttgttccaacacacaattccagaaacaccaacacacaacctcaagcgtatgtaaaaatgaagactttggctccgcaataaattccaaaacagagcactttgatggtaaaaattcaatctttgaatcgaacagagtttgatgagaaactctgataacagaaacagaagatacattaaacagtaccagtacactagtctttagaaggagactcagacggcgtcttggagacgatagaaagagcgtgcaatccagtatccaactcttcccggagcaaatgatagaccaacctgtgtctcttcaccaaattcattccctcgaatcctttagaaacgatcttcacattgaaatgcgtctcatcgtcggttctacctttcattccggcgtgaccagcgtgctgatacgaaacatcttcgatcactaactccactggttcgagctctttttgaagcttctctctcatcctgctcgctcgattctctattgctccagaatccgacccggttttctcaacgctgctcattgctacggatcttgaaccagttcccgtcgattttgactcagagttgaagaatttaggtacggagatgaagacgctcggagaatttaccggcgattttaggggttgagtccggtggaacccagatacgattaacctaatcgaagatgaaaacattgccactgtcgaagaaactcgaaactatattagacgctgtcgttttgtcagcttatcatcttcacgaatctactattagaggcgttatttgcattaaggtccacaaattttcaaatataataacatcaccccacatttgtgagaaaaaaattacaaaaaaacaaacaaactctaaaagtgtatcgaaacaccctcatacttcttcacatttgtgtgagaaatcaaataacaaatacattcgaaaaatgtttgtgtatatgatttaatatttttttggtgtggttaaaaaacttaagacataattaagtaataacaatttacaattgtaacgtggatattttttgaaatgttgatttatgaccaaaatagtattagatgaattctccaagaagatcatggtatgataagaataagatggtatagtgctaaaacatacccaaaactgtaatcagtttttgaagtaaaggcaatatctttgatttgggtaatagtttgtttcgataattttggatgtacaaaattaatttttaaagtggttctaagctgctcatccaaattttttaaggatcctaatctctggtctaaacttcattaatgaatcataaaaaaatctacggaactaaaagaagaaattgattatatccttcaaattttatagacaaacaatcgtgcagattaaattgtaaatatgctaattttgttcctgtgtataatattttacattgtagcatcctttggtagtgtagatgttgagaaaactaatattaattggtaaattatatatttcgaaaaacaaaattcaggtaaatagatttggaggaaacatatgaagttaaaatgttatggataaaaacagaataaacaaattattgtagacgtaatccaaaatagtataaaataaataattttgcagtaacgtaagattgcattcgaccacacgcatctatatcactgcgtttttagctgcagctttcgatagtaggtcctacatcctattcggatctgacgtggatccttgatcacactctctactttagggactcaaacactctcacatttacgagaattgccactaccacgtccctcagtgggaagggtactttcgtaaaaccaaaaaaaccactttccggtttccgcaaaaacccgtcaccgccgctgcatcctcccttcattcttttctctctttcaacgcatatacatacacttatatacgttatcaatatattttatttttaataagtccagtttttgtctgtgcatcgagtttaacaggcaatgctcgtgtctctctctctttatatgtttagattctttatctggaacttggaagctcttttgttagctatatctaatcggtgatctcgaagcttattcaatccctctttcttttttcgtgagtttttatcttcatgttgattcggtttatattggtttatatgatgatgaaacgtttcttataattcttttgcatgtattgatctaaaaaaatctagctttcttctcttctgatctctgttttctttttgttctttcccttttttacccgggaaaaagttacggtttcatgtttaggattggcgttactattatctggtggcctatcatgattggttgattgttttgtgtgttatactggatttgagaaaatgggtatcacggcattggcacttgtggcatctaactaatatcactaaaaagtttgattcttttgaggaattgttttttgactggaaagtgttcctttttgttcctggatggtgacaacaaaggtagctttgctttccttattggcatatttcatgtgaatttagatttgcatatttgtgttgtaggaatg

SEQ ID NO: 17449 - DNA, 3003 bp, Unknown
  misc_feature (1)..( 3003): 2750-1469P.txt file - cDNA_ID_1809116; gDNA_ID_2214602; Annot_ID_135578
gtacctaatgtggagattagtcttgaaaagtgtttgaaaaatatataataagaattaagaaactatccaatgttataaattgacagttttggtctcaagagtaaatatataaattgatgtttagatacagtatagattaattaattgagctattaataaatagatagaaactctaaataaatttacggagaccccactaatcaaacacttggaaattagtacgctcctaacgaaaaggaggttttgtcaaaagatcttaaaatcgagaatatataaagttattattcttaaacatatactgttgttcttaaaagcaggacccatttcgattgcttggagttggactagagatataatcccaatgaacaataatttgtgggcggtcaaatacattctaagatcatcatatacattctaagatcaaaaacatcatggatcttgcctcactcataagatccatatataccatataaagacattacaagcttttcaatgtaatgaaacaacaactaaaagatgagggaaaaaaaataacatattatagataattactgagtaaaccactcgtaagcagacaacgaagagttgaagataccacaaggagattcaagcttgattttgtcgacagccttttagtatttaagtaattaactctagactaagatacttgacaattagagaagcactagttaaaccaaaaaacatttgcagccaataatttgttgttttcaaaaaaaaagaatgagtagaactgaaagagatatcaacatgtgatatgcaaattagttggtcccaaagttattgccgtatcatatacgaaggcgaaactcatattttactggaagatatctagatttaaactaatattttcgttaacgagtccttcatatatatactcattgttctgcaagaaagttttgtatgatttccaccgttaaatctgaaagaaagctatgctaatacgttttctttatatacatacaaatctcagctcatttttttttcaatcttttatgctctgcaatgttctataaatgtcacgatgtaatttaccaatgactaatttaggaaaagaaataactacctcaatgtagttctcttaaaatacttttttagatcatgttgatataaactttctagcttcaaatacaaagcaatgtgtcccaaaaagtgaatctagcagcaagagatctcaacaaacaactagagagcatacagacaaaaagtacaaaatgttaaacttttctagtaaaaaggattagctaagtagaaccaccgatttcctcttatagaaaagatctcggccgtcaatttttctgaacccaacgtgtgaacataacaaaacattaaaaaatataaaaccacagtgttcgatctgaatcatatagagagggaccagaggaaccaaaaaaaagagtgagagtttcagtaccaaaaaatccttagacacaaaaagagatgaggttttcttcatctagacccgtttcgagtccgggtcgaaccgaaaacccgcctctactcatgcggttcttgcggaccaaaagcagaagcagaagccgttctcgttcaagaagacctatctttttccgtcggaaaaatgcttctgctgcggcggagacacaagaaccaacttcacctaaagtcacttgcatgggtcaagtaaggataaaccgatcaaagaaacccaaacccgaaactgctcgagtctccggaggtgcaacagaaaggcgacgccagagccgtcggtgcgggtgggtcaagaacgcttttccctgtcattctttcaccggaataatcaaacctacttgctttagccctgtgtggcgtaaatggaaatcattttctcatgctagtttctcgaaaaaatcagagaagagatcaagttcgtctagaagtgaacctatctttggccgctccacggtggagccagaggaaccagaagagactcgaaaagaagaaaaccaagaagaagaagcaagttcatgtaaatcattcacagctacaccaccgagaaacgcttttttactaactcgatgtagatctgcaccatatagatctccttcatcagctaatagcttatttgaagatcaagaagagacaaataaagctcctttccaacgacacgcttcgtcggaaaatgtatcagtttcggaagaaccgaagacaagcgttacagaaacaacagagagattagaggattcaagaagagaatcagcagcgagtgaagaaccaaaacgaagcgttttgggatcaccacgacagtgtctgatcctcacgcgctgtaactcggagccagcgagactcgttcccgagatgggttatcgacagaacccaaggttgggatttacgtgatgcgtttacattttttttctctttcttttgtattttttcgagaaatttacattgaaacgattactatattctttgctggatttacttggggaagtttcgctgaaatttagagctttaaaagctttctttatcgtagagaatcttgtggttccctgaccatgtaatatttttcaattgtcctatctatgacaatgtaactaaacaaacaatttcgttcgtacacttatacactaaacaaaaaaaagtctttgatatagttttatttttctgttatgccaactatgtttgtgttcttaaaattctacatctctaaaaacagatatattttccttatattacataaaaatggtttacccataaattgatgagttttatcaagagacttgcaaaatattgtggagatcacgaaaatgccttgaggcccagatattaatgggcttttaggcccatatgttaatgagatccaaatatttccaagttaagtaattggtaatgacggtgaaggtgcctttgactatcttaacgcgtacgggacggtcgataaatttagttaaagtctctttcttcttctttactttttcttcttcttttagatcaaagaaatcgttttgtgcagatttgatcttgcgttaattttctaagcaaaatatg

SEQ ID NO: 17450 - DNA, 3003 bp, Unknown; identical to SEQ ID NO: 17449
  misc_feature (1)..( 3003): 2750-1469P.txt file - cDNA_ID_1809116; gDNA_ID_2214602; Annot_ID_187090

SEQ ID NO: 17451 - DNA, 3003 bp, Unknown
  misc_feature (1)..( 3003): 2750-1469P.txt file - cDNA_ID_1809125; gDNA_ID_2214566; Annot_ID_134971
ggtgttccttgggtcagcttcatggtttacttggagatcgaggttttattgatctgggtatctcatcttcttgttcagtggcggaagcgctttctagtcataggaggagaagccatcgcgatgacatcttaaatgacatcgaagaagagttagaaaagcttctgtgtcgcggtatttgcacagaacaagataggtctctttgtcgaagtattgggggtcagtttaaggctaagtttttctctccggaaatttggcatcagataagagaacaaggattagttaagcaatggcacaaggcgatctggttctccggagctacgcctaaattcacgtttatatcttggcttgctgctcatgacagattaacaaccggtgataaaatggcatcttggaacaggggaatctcctctgtttgtgttctttgtaatatctcagctgagtcaagagatcatctgttcttctcctgcaatttctcttcacacatttgggatagactaacccgaagacttcttctttgccgctacacaaccaactttcctgctttgctcctccttctttcaggacaagacttctcaggtacaaagcgtttcctcttgcgctatgtatttcaagcaacgatacacacattatggagagaaagaaacaagcgtaggcatggagatctgcctataccatcagatcatatcatcaaattcattgatcggcaaactcgaaaccgtttaagcacaatcacaaagcaaggcttgcacaaatatgccgatggcctccgcatatggtttgcagcgagagacaacttaacgccaaatcattagtatttctttgtttttttccttttgattttaagtctaaatcaagttaataaatggctgcatatattgtaaaccaggttttttctttgaataaatttaacaatttttcaaaaaaaaaaaaaaagaacatctggatgtcgtacaatagcttcttgcaagatatcaagaagctgatcagcaaagaaaagctcggtaatcttcctcgcgtcttgtggcaccaatcgaaacgaaacagagccactgactccatcgtgtagcatcgcgattccattttcatcgagctttcgcttcttcaacatatccatggtcgaagatagcagccaaggaactttgtgggaagaatgagtgaagttagaagagatcacatgttcgtaggacataattaagcctagctctttttccttaaaatataactatagcattggtacaccaaaagaaattaaacgtattcgtcaaattcatagtttaattgattagagtagatgagaaaaccatttgctgtttcatacccgacttttttccaatcacgtgaaacgtaaaggtaaaacatatttgtaactaaaccatatttttctttctttctttctctcgtgtttgttttagaacctaatctgatctgaatattaacacacaaaaagatgataaatgagaacatataacaaatcatgaaatgagatgagaacatacttctctagaaaattttctaaaatatccgaatcaattgatggcgaacaactaaacagtagaatacaatatgtatattaaacagaaaatcaaacgctaaggaattaaaaatcatgaaaagattattaacacgagagatgagaacttaactctccgaaaatttgtcctaaaacatccatttcaattttctcgcaaagaattaaaacttagaacacaatatatcaaatcaaacgtgtatgaattgaacttaaaaatttacatgttacatcagcatctaaatttttataaattaattcacgacttatggattagtatgtatattcaaaaaaatagttggcacgatcaaaaaagaaacattaggtagctataatctgatagtgaattaaatgaaaagtatttataaaaaactaagaggctgctcatgatttaggattttacctttttacaatttccagaaacacacaaaataagaaaatttattttgtgaagttacattaacatttatatccaatattacacactaaaaaaacgaaaccaccatatattcattattataaacatatggcttattaatctaaatctgttaaactatatatctaaatctgttaatctaaatctgttaaattatataaatatgttattataaacatatccttttattatataaatctgttaaattatatatctaaatctgttattataaacatatccttttatcttctaaatcttactaatctaaatctgttaaattatataagggtgtttaaaaaatggatatatatgtttttgtccacaaatgaatatatacatttatatcgattttttttatatactttcgtaaatgttaattgatgacatgtccaaccgtaatttgctgtttaaaattttatgtggacggcatacgaatcaaatagcctcgacttttctatagtataaattgtatgtaacttgtaggctctctctaaggcggaacgctcccctaccgatgtattttgacatcccacagcttcggcccatgtagtctattggttatttttgtggttcagtttaaattttaaatacatgtatttatcctcaaacttttttttttgcgattctcaaactatttaattcaaatccagaaacggtttatttctccccaaaatacatgtatttatccatgttaatttttttatttctttggcttaagtaataattagatcaatacattttagaccaataaacgtttgaacgtctttttgcatcagaacgtgaaattaatgtcaaacgcaaacgcatgtacaaatcctgaacaaacataccgcttaggtgatggatggttgcgtaagaacaaaacaccttaaacggcagcgttttgtaggagcaccgcttcgcacgtttcttccatatctctgatcacgtgatagtcgtcttcttcagatcttttatcactttcttcttcccggagaaaatttggccctaaatcactttcccgggaaaatcaaactctggggaaagagttgaaacaatg

SEQ ID NO: 17452 - DNA, 3003 bp, Unknown; identical to SEQ ID NO: 17451
  misc_feature (1)..( 3003): 2750-1469P.txt file - cDNA_ID_1809125; gDNA_ID_2214566; Annot_ID_186025

SEQ ID NO: 17453 - DNA, 3003 bp, Unknown
  misc_feature (1)..( 3003): 2750-1469P.txt file - cDNA_ID_1809128; gDNA_ID_1620756; Annot_ID_49884
aactgtctccaccggtcatgcaatatttatctttttgtttcaagatattaaaaaagccaaagaataatgaaaactaaatttttagtaaaaccatagacgtttttcaagctaatattctttaattattatagattaataatatgtcggtattactcaaatttcatttgttaaagagataattcctaatttgatgacataataaaatgaacaaaaaatctgttttgaagcgttgtcctaacttaggtgtacggtgtgtaacctctgggtttagtctgtagttaatgtattaatgattagctttgctcgttttaaaagaagaagaaataatattgagtttgtagtctttaaacatgtggggctacagaaactggctcaaaaaggttacaaaaatttaggtgtttgcatcaacaattttagaactcacttgacccaagacctgatctttgtttctgatgttatcaaatctcagctacctctttgcttccgttgatcctcattgatgatgcgttcattacatagttgtgagttgtgacaatagaatcccaactggttctgttgttagcacatgctgatggtgtttctgcctttacgagttattgacctgcccattcttaagcggcgacctgttagtgagtccagtagtatgaccaaagcttcctcgactgcatcagcttgtttgtctaactcgtagctgcttaactgtgggagaaggctaagctcagataggagtccaattgctgctgcagccgtgcaggtccggtcccatgatggttgtggcctgtacgtcagagatcaaatgaggaaggaagggcactattttggcagacagagactggaccaggaacatgagaaataaagactatttttaccggagtttgtgcattgcggatgcaccggttgcaagagatatacaaggaagatcttcgtctccccatactgactttgcatgatcctacagatgagtttagagtttaagcatattttcgtgtagttctttagagaaagggggaaaagatgaaatccatgtgagatatgatcagcctgtacctttaaacgcttgagcattgcagcagaattgttccacgtgccatcaagcaaaatgaaatgcagagttttatcctcatctgtctgggaaatatagaaagtgtagagtttcactctatatccttccacaaccttatctaatatttttctgtttgaaataagtaacgatagaagaacagagagtccatagtcaaaacattgcaatctttaccgtggatgatacatgattctctgaagccgaactaccaaaagcgtctttaaccgagaaagttacttccgagttgtggttgggatagaggcaacggacttggctttttcctgagcatccatcagaacaaaaagacaagatttttagcaaaatcatggagtgacatctatgtaagattaaacaaatgcatctacactaagacttagaagaatcaacaacctgcacgcttgaattcattccacatgatctcttcgtcttcagctattccaaagacgcagagtgtagctgattggacgccaaatatctgccacaacagcttccctgtgttgttctggcgtagaaaatcctgccaacagctaaacagcatatcaatacataggaattggcgattggaatagctaaaactagtgggtacaatactaaccctaggatgcatatacagccaaaaacgtatccgtttccataaaccacatggcttaacatatgaacacatgcaatcctccatagcaagccaacactgcatattcagaaatgtttcatctttaggtattgagttgtttattcatggcaaaatacaacaattcaagaagagtaaatgaagtaccttctggcataaataacccctgctcccaagcagccgacaagcaacctgtcgagcagaaaaaaaacgaaactttttctccgggtcatctaatgcttcatatgtagccctatgcttcttatcttcgtatgcaccaaacggtccctgtgatagttgtcacacaagtagaagtattataacctcactataacatttaagagctcaaaacatcaagtcagaaaccactggcacatagcaccacatacgtaaccatagctcaaatatctaacttaggttactagtttgaacacaaaaattacaaaaccagattcatagttatccaatagagagcactaaacaatccaagcataaaacgattgaaaggaaacaagcaacgaggtttcattatcatgatagtcatcggcatttacctgtaacttgccaccattaccaccaaaatctatcggagaatccaatttgcactccagaactttcaaatcatccacaatctgtttgaccgcggatggaaatggagacaccggaccccatttccgccactcctctaccgagatgattccttcatcgcaaacgtcgaattccctcgtatgagaacgcaaaatcgaggaagtcataagcaatctctggccaacagctacgagattacggcggtgaaacagtagcgacggagagaaatcggctacggatgctccagcgatacaacgcatcgtttttactgtttgggcttctcgaggaataataatttaattttacggggtaagtgaatactattgggctttaatgaaactaaggcccagtgagctttaaccttgattgatacacttcaagttaattggttcgataattttttgtttttccgaaaacgagaaatattaatgggctttaatgaaactgcggcccaatagtcttagagcttgaataatagggaatttatttaatcggataaaattaaacaatagtagctctaaagaaaaaaggattcctaaaaaatcagtcactcctcttaatcttctcctatctctcattttcgtgggttttgtttttgttcatcttcttcgtttggatattattacatttgggactcaagaagaaatcgaatctatcgtgtgtgtagattgcttctctctatctcttctctcgctacacaacaatg

SEQ ID NO: 17454 - DNA, 3003 bp, Unknown; identical to SEQ ID NO: 17453
  misc_feature (1)..( 3003): 2750-1469P.txt file - cDNA_ID_1809128; gDNA_ID_1620756; Annot_ID_166964

SEQ ID NO: 17455 - DNA, 3003 bp, Unknown
  misc_feature (1)..( 3003): 2750-1469P.txt file - cDNA_ID_1809138; gDNA_ID_2214497; Annot_ID_133594
tgaaggatctatcttgctctttgtagaagaggtattttctgatatgcagccattgatccgttctgttcttgatggatacaatgtctgcatatttgcatatggtcaaactggatcaggaaaaacattcacaatggtaagattagagttgaataaattttgaagactgttaacatttgaagctagagaattttaatgtttccatttttgtaaattttctagagtggaccaagagatctaacggagaagagccagggagttaattacagagcacttggtgatctgtttcttcttgctgaacaaagaaaagacacattccgctacgatattgcagttcagatgattgagatttacaatgagcaagttagagaccttttggttactgatggaagcaataaaagatatcctttttcatgaatggatatacttcttaatgttttgattagatagagagagagagatcattttcatgtttcagtttcatattccttaacattttttggtacgttagagatcaggaatagctctcaaaagggtctaagtgtaccggatgcaagtcttgttccagtctcttcaacatttgatgttattgatctaatgaaaactgggcacaagaatcgagccgttggatcaacagccttgaatgatcgaagcagtcgttctcataggtaaaagacaaaatgttttcaagagcagcgagaacaaaaaataatcttcaagagtcttactcaatataacatttttcaatcttatttttttttgcagctgcttgactgttcatgttcaaggaagagacttgacttcaggagctgtgcttcgaggatgcatgcatcttgtggatctagcaggcagtgagagggtagacaaatccgaggttactggagacagactaaaagaagcacagcacatcaatagatcgctctctgctttaggagatgtgattgcttcgctagctcacaagaacccacatgttccttacagaaacagcaaactcacacaactccttcaggactctcttggtaaaaggatacaagtaatttagtcctgaatatttgcagctaaataaaaactcacctttttcttaacttgggattgcaaatatgttatatcaggaggacaagcaaagacattgatgtttgtccacattagtcctgaggcagatgcagttggggaaacaataagcactttgaagtttgcagagagagtagctacggttgagcttggggctgcacgagtgaacaatgatacttcagatgttaaggaactcaaagaacaggttttttttttctctttttgcattaactgaatctgatggtttcactttcttggttgatagtatttgattgtctcacacacatgggcttttgctttgtttacagattgctactcttaaagcagcactcgcgagaaaagaagcagagtcacagcagaacaacatcttgaaaactcctggtggctctgagaaacacaaagccaaaactggtgaagtagaggtgattcttcttttctcaagcaccttctctatgatttaaaatcagatctcaaagtggacattgttttctgagtgattgcagattcataacaataacatcatgacaaagaaatctgagagttgtgaagtggaggagattacagtgaactcaccaccttggccaccagtagcaagtccaggacaagcctacagagaggatgaccgaagtttcgggtccagcgagtgggttgacaaggtgatggtgaataacagacaagacgagatgagaagagtggagagtctttggggaggagccacaacagagaatggtattggtattctgccggaagatttttacaggagagatttggcttcagacacttcaagaatattctctgaacattcttacaacatcttcatgggaaacaacaacagcacagacgatctagatgcagccacaagtgactcatctgagccagatttgctctggcaattcaaccagtccaccaagatacctacaagaagcaatattgagtcaaaactcaagaaacccgtctcaaaacctataagaagtcctcaatccaggtaagtgtcctttactcggtcaaaaactaaatgaaacaacaatatagaaaatctttaacagtttcttttgaatggttccaaaaaaaatgcaggaacaactcaaacaacacggtttcacgtcctttggcttcacagaaggtagggaatggtcctcgtggcatgaaacagttcggtcctgctgatatgaagcggaaagctactaacgccagacattgaaggccactcactcacacggatacatacatacacactcacatggcttcttattggttttgatttgtttatttttcatccattggtttttattgtttcttcttctctcgtttggttgtgcgagcttttatatacataacacagacaaagacaatagctagacaatgcaacaacagtttcttcttgttgctctctttcttgggttttgttttacttttctgttctatgtatattcttccactagctgaacataaaaaatatgaaagatttgtttgttaactatttgcttgagagtttttttagtatattctataatgcttcaaatcagagacttgttgcatttcttctaattagttacaacttttgcaatctttgctagtataaaaatattttattagaaatatgtaaaatttgggaaagtattatttcacaacagaaaaaaaaaaagcatagtacttttcaaatatcgaccaaccttctgattcgttgaatccgtttctcgaatattataattttatttttgttgtttgccctatctttctttctccctctgctcttgtgcaacttgatccgtcgtcttctctcagctctccatctccgtcttccaaggtttttgtttttgctatttacgtttacagattcgtaatcctatcctggattgagaaatgcgtagtttgatgattcttcgctcgcctctttgttgactgcagttttactgtcaggtagaagaatccatg

SEQ ID NO: 17456 - DNA, 3003 bp, Unknown; identical to SEQ ID NO: 17455
  misc_feature (1)..( 3003): 2750-1469P.txt file - cDNA_ID_1809138; gDNA_ID_2214497; Annot_ID_183865

SEQ ID NO: 17457 - DNA, 3000 bp, Unknown; identical to SEQ ID NO: 6776
  misc_feature (1)..( 3000): 2750-1469P.txt file - cDNA_ID_1809157; gDNA_ID_1621105; Annot_ID_55966

SEQ ID NO: 17458 - DNA, 3000 bp, Unknown; identical to SEQ ID NO: 6776
  misc_feature (1)..( 3000): 2750-1469P.txt file - cDNA_ID_1809157; gDNA_ID_1621105; Annot_ID_171557

SEQ ID NO: 17459 - DNA, 3000 bp, Unknown
  misc_feature (1)..( 3000): 2750-1469P.txt file - cDNA_ID_1809195; gDNA_ID_2910741; Annot_ID_193676
tatatactatatttataaaaaggagcaatacactttgtcaaatttaatccgatcttttagtatttcaaaattacgattattaaactagacctggtttgcttggaaaaactagatctactcaaatgttatcttacctaacctaattttgtatcgtttgggtgagaaatggtggctcgcttctaacaagttttcttcttataatcgggactcgggtagaatcaacttcaaggagattaaatttaaacattcgtaaacgtctggaaatcaaaataataccataaaattgggggaaaaaaaaagaacaagatcatttttcggccttcattattttcttacccaaaaatctttttttcttcatgctttcatgatactaaatattttcattaaaaagtttaaattcttacatgaacaaattgtttaggacatgtgtagtgtgactaatttgttgtgctgactagtttttgtttctcggaaatggttgaataggtcttttcggaatttaacgtttgatacataaaattctttacatattgcattattaaaattagctagcttcttattaattctagaaatatcatcagtatattagttgaataatctctctttttcttggaaatggttgaataaatccagaaaatcatggccataaatcctcatttcttttttgtccgaaagtaaaaatccattctataaaatatgagccgtcaataacacagttgaaaaaaaagaaaaaagaaacagaacccattaattgttgagactttttccatccgataacgtcatttttcactaaaagaatatatactatatgtataattagaaatggatgcaatggaaaatgtgcaaatggattttaagatataaaagcttgttaccatctaatttaatcagaagtaacatgtaataaatctctaatagcaaataagatgaaaacatagaaatcaaagtgcatggaattagtctaaatttttggcagtcctaaacataatttaaaatgagcaactcacctactttaaatagttttcgttggactatatagtttttaaaaataaattgtgttccacaaacacatagagaatcagctaagtctctttcatacaatagctatagcttcaaccagaagattatataaaaaaaatactgaaaactattgaacaaaactaaagaatcaatgattagaatatatctccgtggactaattaatctcctacgaaaaggactttgaactaactaatagcttttattcactttttagctatattttttttaagtagattattttattcttagacggctttagttgatgcaaaaataaacaatcaatctattatgaatgatgacatattaaaaataaataacaaactgtattgtacaacgacataataacataacttctccatcactataacaagatagtattgaacataaatcaccatttgttatccacgaggtaccaaatgttgtctatgcgaaactaaggatcccactactatgatctaggtccattcacagaaaccctccataatttttacgttgataaaaaaagttattgtgtatagtatactgtatataccatgcattacttggctaattttatttttgttgagatgatggttaaattatattcatgatactaatatagaaatacaatggggttaaatatggatacgattacgaatacatggagcatgtgatcctcgaggacttcagatacgaatctctttttttttatttctttaatgtcaattcagtgtcaatttctatcatcaatttctttctatatggaactattattttttgttaagagttacgtctagctgattgttaacttatagactctaactaaatttattgaacttgaatattaaaaactctaatttagaagggaaaaattgttttctttttaccttttttttgttttatgttggaagatagggtaaacatgttttgtaaatgaatggatttaacattgatgaggacgaagaagacacaagacaaggtattaaagaggttaagaaaataagaagattgtttcccataaatggcgacacgtgaagtaaataactcgtctgttctgtaattaaaacgctgtttcttctttaccccgcgaacttgatgggtcaatcacatccccaataacactaatttactgtttctctgtaataataataatcattaaaatggacaaaataaaatattagtaattaaaaacagagaaattaaagagagagaatttaacgggggagaagacttttgggaatgatccgaagaaaacgggttactaaagaaaacagtggtgcggttcttaatatttctcttaagaagatctctctctttctgtttctgttttattattgttattgacacgaaaagacagagaaacaaatagaggcagagagcagaagaaagacgaaacagaggattttcatagagaatcctctttcttcctcctttcttcgccttcttctgttcttcttcttctcctggttagttttcttgatttcatggttaacaaatgattagagttttcgttaaaaacaatacttggttgtgttttcaagattttgtttcttatctttcacgtttcataaaaaattcaaatggctgcatttgttgcgtttgatgttatcgatgtttaatttgtttatttaagtattcaaaatttcagacccaagtaagcaacaaatttaagaaaataaacctcattcgattttttttcttatatgaagggtcttgaagatacatgaaacaacatctcattgttatgaatgttgatgcattcttttatgtaaacttaactttttacaggtgacctctctgaaagattgtaaggtaaaaatagtctatcttttttggcatctgatttttgatttctagacaagatcatgtatatcttggtaatggtcttattcttgttttatgtcttgatacaggttccttacaaaaatttgatttcgtttggtgaatgaaatagttagaaattctccaaaacaaaatatg

SEQ ID NO: 17460 - DNA, 3000 bp, Unknown; identical to SEQ ID NO: 5830
  misc_feature (1)..( 3000): 2750-1469P.txt file - cDNA_ID_1809195; gDNA_ID_1620821; Annot_ID_50683

SEQ ID NO: 17461 - DNA, 3000 bp, Unknown; identical to SEQ ID NO: 5830
  misc_feature (1)..( 3000): 2750-1469P.txt file - cDNA_ID_1809195; gDNA_ID_1620821; Annot_ID_169461

SEQ ID NO: 17462 - DNA, 3000 bp, Unknown; identical to SEQ ID NO: 4070
  misc_feature (1)..( 3000): 2750-1469P.txt file - cDNA_ID_1809214; gDNA_ID_1620682; Annot_ID_48358

SEQ ID NO: 17463 - DNA, 3000 bp, Unknown; identical to SEQ ID NO: 4070
  misc_feature (1)..( 3000): 2750-1469P.txt file - cDNA_ID_1809214; gDNA_ID_1620682; Annot_ID_164482

SEQ ID NO: 17464 - DNA, 3000 bp, Unknown; identical to SEQ ID NO: 4070
  misc_feature (1)..( 3000): 2750-1469P.txt file - cDNA_ID_1809214; gDNA_ID_2926181; Annot_ID_140556

SEQ ID NO: 17465 - DNA, 3000 bp, Unknown; identical to SEQ ID NO: 4070
  misc_feature (1)..( 3000): 2750-1469P.txt file - cDNA_ID_1809214; gDNA_ID_2926181; Annot_ID_200259

SEQ ID NO: 17466 - DNA, 3003 bp, Unknown
  misc_feature (1)..( 3003): 2750-1469P.txt file - cDNA_ID_1809253; gDNA_ID_2214479; Annot_ID_133220
acttatttgtaaatgcgtcacatgtcttcttcgctctgttcggctgcttcatcgagcggaagtctctagccaattaccgtttgttcgtggactcgaggttcgttgttcttagatttcccagactcatctgtttctgcaatccatttcaaagtttctctttttacttaatccaagtcattcgcgcatttcctaattggtctgaggtttagggttttagggcacatagttttgtttgattcgggagtaatcgttgagatgctacgagtttggtattcaagatgattccttttctcaaggtctttatgtaatttgattgatttatggatctcgaattgctgacatgaatttgttgcttaaagttgttggctttgtgggatattctgaggggtcttgtttgatttggatctaatttggtgggcagatattgtggtttcttagcaaagaagatgagtggagttggagagaaagcttctggaacaactaagacacctgctgatttcttgaaatctatccgtggtaaaccagttgttgtcaagctcaactctggtgttgattatcgaggtctgtctctctctctttctgcattttgtgttctcctctaagatgtatccagttcaaattctttttttttttgccttgtgtgatgatatcttatagtttgcttctgattttcggtggttattaagctatcggaagtctatgtaaacttctttatcactttgggtttagatgtctcaatgcctttctttctcgccatgttactggaacctttggatgttggtttacagaatgactcttttctttgtctaagaactgcttgcttgattctcatttgatttgaaagtcccatctctgaagattcatttttgttgagcttgcttgttttttccctatcttgtctctgtgtttgagaaggaataatacatttcggcttgagatatttgctttggattttgagaaatataatctagatgagcaggaaattaacatacggctttgaaacatatgctttttggaatttgagaggaatattagattcagatgatagctttgtgaattgagagagcttctctcatgagataacagacccaaatgtggttgaatttgagatgcatttactcttgcttctgatagaatatggactctcaccttgctatggagcctttatcacctgaaattaagaccttggtctcttgaactctataatataacttacaggactaggagaacttctagcttgaatatctttctttggtttatctacaaaagtcagacttattctttctttggcatatcatgttgtatcaatctacatatgacactttgtctctcttcttgtttgcaggcattcttacttgtcttgatggatatatgaacatcgcaatggagcaaaccgaagagtatgtaaatggccagctgaagaacacatatggcgacgcttttgtccgtggcaacaatggtaaaaaccaaatcacattcatcatcactctttaaatcggtttagtatgtttttttatatccaattctgaaaaatatgctctatgttggccacagttctttacatcagcacaacaaaggggacattgtcagatggagcatagctctctttcatcaccatgaatgttcatcttcttctctacctctggcatatgacaaatgtaggatttgtagcaaccagagtttatcaccactgcatgaattcgacatgtctttttcttccgcaactcagtttgtgtctaaatcatctccaaaattctgagatatagctagatttttatttgttatgaaattttttttaatcactgttggtctttggagcctaattatcgtgttttgatgacgcaatcactgcgtcacaatctgatgtcatcttaacaatcattaatgtattttttttttcttttctcgtaatattcttaattattcttcgacagcaaaggtttaaaaactccttatttcaatcattaatgtatttatgatttgatcgaataacaataatatagcttattttgttctattctatcgtatttgattcttctttcgttttttttttgtttgacttaagaaaccgattgtttatagtagtaaacatttgtttttaatgttgctcgattccagtgcacatgtccaggctagacacttgtcgttataaaggttgctttggttcaatattgatccactagagatgttacaactattgttgacatctgagattgtgtgataagaaaatatgaaactggatttagtgaaagttacaatatataatcatacatcatagataggaaataaggaaatgtcagatatacttgaagaatacatcaaatagacaaggtcctttttcttattgtcgactattatagagccgtacagaaccttttcacgtctttagtaattagtacattctccatttcggctctctcttattttttttccatctcttttacttctccaaataataacaataaaagcttcgattttgtgtgtgtttgtatttacatcttgacatcgatattcttttcatcaattttttaccaaaaatgtaataaaaacaaaaaaaaaccaacgctgaacacagacatggtttctccatccgtttatattcatcgtttgtatgtttacttaacaacttatttcaaaatagtacatatcatggttgtgtttttaaaaaaagtatacagaacagaaaagcacatggtagacaaaataatgaagccaaaattaatacaaagaagaagttcaacttgtatttattaacacattttctttccttgtcaaagacatgcaaattggttttgttttcttattcccattttttttttataataaaaagaagaagagtaaaacaaaaaaactatcatttcttcttatcgcaaaactcttatctaagcaagaaaccgacaaaacctatatctacatatattctcatcaacatctcttgagacatattcattttggttaaagcaaaagattttaagagagaaagggggagaagtgagagagatg

SEQ ID NO: 17467 - DNA, 3003 bp, Unknown
  misc_feature (1)..( 3003): 2750-1469P.txt file - cDNA_ID_1809283; gDNA_ID_1621163; Annot_ID_57165
ttagatcgacgaatcgagagttcgcgaagcttcccggaggtaagtccgactaagtcggtggcggcaaccaaagcttttttccctgaagacgttattaaaccttcgagatctccatttctcgctctttgtaactccggtgactgattatagatctctttcgctacaagcgaaacaccattgacgagcctggtaaagctcttgctccacgaactcatcacgaagccgcgtgcaaagttactcttcttaatcgtggatttgactttcctctttttttttgttttccatttttgtcaatttggttttgaagaattttctcgagaaagtatataatgtgtgtgtttttgcgttagaccacgaagatcggagacgtcgacgaggaaccgaggtttacgtggggagccgataaccagaaactgctcctccaaggtttctagtttcggccggcccaattagcctattctttttttattgtcaccatataaggcccattgggctataaaggagttttacgagtagcttccttaaccatttgtgatgttttgttggattgctcccgtaacatgtagttttaattgtccaaatatatttcatcaatttatgatgtgtttttttgtgtgtgataagaatgtaatgttaataaggtttaggaaacgacatcagtaagatcctagatacattgtcccatgccgaaaaggtaaaaaatatggaagcatagacaatcgagaattagatcatcactacatctttaagccgtgaagctttagacaaagctatgaaatgaacgcgataaaaaaattcctctaagcaaaacatggcaagaaacaagagctataaaagaaaaagaaactttaaaatgattataaagcgaagcgaaaatcccttcaacgtgagccccaacctaagaaggagcgatgcaacatgagctaaaggcggcaggcaatgctgttttctaccaacatccccaatcagtagcatggacaaagcaacttcttatcctccaaaagtcatactaacatcttcagaacactatgaaacaatcctataacacctcaaccaaattgaagcttcagaagacatatactaacacctccaatactaacaatttatgatgttaatcaccaaaaaatattttaaagatatgtatgtattagtaatacagtatcaccaatctttggctggtctaactcaaacatttagagagagaccgaacttaaataagagagactaatggttgtaaataatgagattcatgagactagcaaatcttcatgtctaagttgaaaattatcggatccgtcatgtgaaatccaaaaataacgatacagttttgttttctcagataaagtgaaagtcaaaccaaaaaactatataattggctgctttacattaacagtagaaaaccaacaataattgaattttatgctgctactaccaatgttgtaatatgtataagcgttcattatttaaatttatatacaatggccgccaaaaaaaataaaaatatgcttaagtacaatgcatctccactcataaaaggtaacacgagaaagaaattatataatacgaacaaacaaaattgagacccctaagtaaatatgaaaatcatctttgaaactattaatcttctctaactaattttcttaacgtaaaagaggactttattttaactttcggtgatattactccaatcttagggtacgaacaaatattgttattaaaccatttcgaatataaaattggtcaagccactcagaattgtcaggatggtaggcaatatagtatattggattaattaaaaactataacacagtgattagttggcattaaactacaggtggtcatcattttgtctatacatataaaccaaattgtatttagtcttgagatcttcaaaaacatctgagagctttgacaaaaaaaaagacgaagagaaaaatgtccattagagctcaagaaattcaaacccttgaaggtatagtaactctcaatctctctcttttaagttttaacggtttatacttttaatccgttttacatcatttgttaagcttttgctaacctctctaagatcctgagatccaaaaacatacttaagattttgatccacctggtttatattccatctcttagaagttttatttgctttctagattagatcggtttgactatatcgatcatattatatttgatttataaactataagtataagacttctgtttaggtgaaaatcacaagtcctttagtgatattgttgaagatttcctcttgaagatcattagcacaagttaattcaaatccgttattgtttaaagatcatcaacctaaaacattgccaataagtttcctcaaaagttcatttggatctataattttagttttttttttgtcttttattttcataatgcaaatagagagtcaatgacaatttagtgaaagatatatagttaataactttaagtgggtgaataatattggcattttaaatttacataatttatagtggaagattcaattaatacgtcatattttaattttcttttgggggtattttcattatattaaaaacttttaaaaaagttttttttttattttaatttaagaattataaacttataatatataaagttacatccgaaaaagaagagaaatttattctaaattgtagaccgaaaatgtataaaaatacctttactttaacaaaaaaaaaaaaaaaaaaaaatacctttaaaaaatatctataaatacacagcacaaacaaaacttttaaatgtttccaatctaggaaaaaaaaatattttggtttcgacgtaaaaaagaataatattgtagatagaaaacattttgaaaagtttttaattatgaatatatttaattaaatccataatttatatattttaaatgggcccattttgactttaagaaaatataaggcccaaatagaaagcctatagctcaaagcaagcctgcttttagaccgctttccagatctagaagaaacaatg

SEQ ID NO: 17468 - DNA, 3003 bp, Unknown; identical to SEQ ID NO: 17467
  misc_feature (1)..( 3003): 2750-1469P.txt file - cDNA_ID_1809283; gDNA_ID_1621163; Annot_ID_173766

SEQ ID NO: 17469 - DNA, 3000 bp, Unknown; identical to SEQ ID NO: 7792
  misc_feature (1)..( 3000): 2750-1469P.txt file - cDNA_ID_1809286; gDNA_ID_1621163; Annot_ID_57164

SEQ ID NO: 17470 - DNA, 3000 bp, Unknown; identical to SEQ ID NO: 7792
  misc_feature (1)..( 3000): 2750-1469P.txt file - cDNA_ID_1809286; gDNA_ID_1621163; Annot_ID_173765

SEQ ID NO: 17471 - DNA, 3003 bp, Unknown
  misc_feature (1)..( 3003): 2750-1469P.txt file - cDNA_ID_1809286; gDNA_ID_2926161; Annot_ID_139726
ttcgaattgaatcgcggagaactgtcgccaaatcggcaggtgaaacatctacgagaagaagctagcagtgtcgaggaaggcgaaaaagaggttatcaggcgatattttttagtcggagagtgtgaattcgttaggccggaagtggtggctaacgcggcggcgcgtgggtggtgaaaggcggaagagaagtctaataagatcggagaagattgcattgtttcttctagatctggaaagcggtctaaaagcaggcttgctttgagctataggctttctatttgggccttatattttcttaaagtcaaaatgggcccatttaaaatatataaattatggatttaattaaatatattcataattaaaaacttttcaaaatgttttctatctacaatattattcttttttacgtcgaaaccaaaatatttttttttcctagattggaaacatttaaaagttttgtttgtgctgtgtatttatagatattttttaaaggtatttttttttttttttttttttgttaaagtaaaggtatttttatacattttcggtctacaatttagaataaatttctcttctttttcggatgtaactttatatattataagtttataattcttaaattaaaataaaaaaaaaacttttttaaaagtttttaatataatgaaaatacccccaaaagaaaattaaaatatgacgtattaattgaatcttccactataaattatgtaaatttaaaatgccaatattattcacccacttaaagttattaactatatatctttcactaaattgtcattgactctctatttgcattatgaaaataaaagacaaaaaaaaaactaaaattatagatccaaatgaacttttgaggaaacttattggcaatgttttaggttgatgatctttaaacaataacggatttgaattaacttgtgctaatgatcttcaagaggaaatcttcaacaatatcactaaaggacttgtgattttcacctaaacagaagtcttatacttatagtttataaatcaaatataatatgatcgatatagtcaaaccgatctaatctagaaagcaaataaaacttctaagagatggaatataaaccaggtggatcaaaatcttaagtatgtttttggatctcaggatcttagagaggttagcaaaagcttaacaaatgatgtaaaacggattaaaagtataaaccgttaaaacttaaaagagagagattgagagttactataccttcaagggtttgaatttcttgagctctaatggacatttttctcttcgtctttttttttgtcaaagctctcagatgtttttgaagatctcaagactaaatacaatttggtttatatgtatagacaaaatgatgaccacctgtagtttaatgccaactaatcactgtgttatagtttttaattaatccaatatactatattgcctaccatcctgacaattctgagtggcttgaccaattttatattcgaaatggtttaataacaatatttgttcgtaccctaagattggagtaatatcaccgaaagttaaaataaagtcctcttttacgttaagaaaattagttagagaagattaatagtttcaaagatgattttcatatttacttaggggtctcaattttgtttgttcgtattatataatttctttctcgtgttaccttttatgagtggagatgcattgtacttaagcatatttttattttttttggcggccattgtatataaatttaaataatgaacgcttatacatattacaacattggtagtagcagcataaaattcaattattgttggttttctactgttaatgtaaagcagccaattatatagttttttggtttgactttcactttatctgagaaaacaaaactgtatcgttatttttggatttcacatgacggatccgataattttcaacttagacatgaagatttgctagtctcatgaatctcattatttacaaccattagtctctcttatttaagttcggtctctctctaaatgtttgagttagaccagccaaagattggtgatactgtattactaatacatacatatctttaaaatattttttggtgattaacatcataaattgttagtattggaggtgttagtatatgtcttctgaagcttcaatttggttgaggtgttataggattgtttcatagtgttctgaagatgttagtatgacttttggaggataagaagttgctttgtccatgctactgattggggatgttggtagaaaacagcattgcctgccgcctttagctcatgttgcatcgctccttcttaggttggggctcacgttgaagggattttcgcttcgctttataatcattttaaagtttctttttcttttatagctcttgtttcttgccatgttttgcttagaggaatttttttatcgcgttcatttcatagctttgtctaaagcttcacggcttaaagatgtagtgatgatctaattctcgattgtctatgcttccatattttttaccttttcggcatgggacaatgtatctaggatcttactgatgtcgtttcctaaaccttattaacattacattcttatcacacacaaaaaaacacatcataaattgatgaaatatatttggacaattaaaactacatgttacgggagcaatccaacaaaacatcacaaatggttaaggaagctactcgtaaaactcctttatagcccaatgggccttatatggtgacaataaaaaaagaataggctaattgggccggccgaaactagaaaccttggaggagcagtttctggttatcggctccccacgtaaacctcggttcctcgtcgacgtctccgatcttcgtggtctaacgcaaaaacacacacattatatactttctcgagaaaattcttcaaaaccaaattgacaaaaatggaaaacaaaaaaaaagaggaaagtcaaatccacgattaagaagagtaactttgcacgcggcttcgtgatg

SEQ ID NO: 17472 - DNA, 3003 bp, Unknown; identical to SEQ ID NO: 17471
  misc_feature (1)..( 3003): 2750-1469P.txt file - cDNA_ID_1809286; gDNA_ID_2926161; Annot_ID_198781

SEQ ID NO: 17473 - DNA, 3003 bp, Unknown
  misc_feature (1)..( 3003): 2750-1469P.txt file - cDNA_ID_1809296; gDNA_ID_1621163; Annot_ID_57161
aggcatcaagtaataatacataagagggaatgatggatcaaacggtgttgatggtatcagtaagacatcggagaatgcaaccgagaccagctctctcagtgagtttctcgtgaatcttcaggcactgatcgcaggtgggtcggtccccagtagaaagtcctctgtacaagtacctgagaattttaagcaaaaacattctatcaaagagcacagacagcctgaggatagagctttccaattcatacatattacaaaacgcattacagcaaaaaaaaaaaaaaccaactttgcacttacttcatgagaatgtcgtaatattcgacatcaagagcattgagcattccgtcaatatccttaatggccattaaagctctgtgcacaactatccaattagccgactgcagttgagttttttttggctcagtaaatcaaaaaaaaaaaaaaagatggtttcggaaagagagagaccttgcaacgttcatcgcgagttttcggaggcgaaccttcaagagccgttttcaaagcttctacatgtttgtacctgcacacattaaaacaccgataagggattaaaccaaaaacaaaagaagactttagggtttagctccaaggtctgatattactgtttgagtaggctttcaatcttcctcgatttggtttcgatcctcgcgattattgcttctgcgttatcagcttcaacgaattctgccattcttcgattcgatctttctctccgatcagagatttcccctctttcccttctttaattgaaaaaatgagagagagagaggaaaacaactcaatcgccatttgaccatttcaaaagggaactgagtgccgtttgtcttggccttaaacggcacgtagtcttaaatgcttatgctgccactgaatgatggatgatggaagcttcattttttttttcattttttgtcaataggattttcatcgataggattcaagttgaaatacaagagccggcaagtacaaaccacttccggagacataagccgatgagtacaagaacactcccgaagccaaataccaaacaaggtaaacaaagggaacaaaatccaaacaaaccaattacactatattcattgaaatttcctcgatcaggttctagaaatccaaaaaagacttacaaatcctaagtcatagaaaattaaaacaaatctgagactaaaaaagacacacaaacgggttacaatacaagaatctccttttctttcttggtataacaattttttttttattataaatctctcttataaatttttaatagtaatatttgttggaccgaattttttatatttatactaatgaacttttctttacgattttgttaccattttggtatcatttttacgattttaatttattaacctccttaattaaaatcgcaacctattctattttattaacacaggtcaaaatatatttttttctgcgctcgaccctaatatgttaacaaaatggttgtttctgcccaaatctcattatatttgtatggatagacgaagagcattttgataatactcttttggaatgtttctttatcattctaattaggatcctacatcgaaagtatactataaatggagtaaacacactcatgactgctaagtgctaacactagtatatatggaacacaaccaatccaatcattacccattggttttaaattagaatctgatgaaacttaacattaactttctctaatcattaatgatattggtagtcttataacaaatatattgccaagattcggtctaagaccacttgatagaactatgtataaaacttcttttttttaactgccaaacctatataaagtggacgtgtaaactaaagcatggtgatcacttcacatcgcaccaatgtagtggatctaaacgtctctttgtgtaatcacgtggtcgaattaatggtcaatcatttagcaattaaccaaatttgaaataacatccgaaaaaagtcggtttagtgggaggagaagtgagaatgatgtttcatgaatgctcgttaggaactcttcgaaagacgataacctcggatggatgtttatggtgtcggcttctagtggttaaacataattagatcgtctactgaaaagttggagatgtggttgagaaactcgtaccctacatatggttactcgtctgctggtttaatcgttgggattgatcgtgtactagtctttcttaaaggccaagaattttgtcgtcgtagttaatatatgttggcgtacgttttactgtttttcttgagaaataattggatcttaagcttattaaaaaagtcgtcacgacttggtccaactcgtacatatcacaagttgctcggcgcttttcatgttagttagccaccgacctcgaactttgaaattttatattttttaacttcaaaaacaattctttgatagttttgttttcattgctaatatttctctcaatttttttttattgtttttatttttgtatagaatagtattcaaaatgaaactataattcagtatggaacactttctgttttatttaatatttacttcataatgaattatgtttcaaattttcaaagaatatatttatatttgaatttggttagtaccttccaaagaagcttaattccccacattaaaattcaacttggtcttcatattaacattattcaattgaattcagactgaaatggttcactttatctggtttgaaatatatgtcatgcattttccaaatcaagaatgaatcttcttgaaagaaaaaaaatgagaaaaaagaagaaggagaggaatgggtctcctaacaatgaaaaagagaataaacccttaaataattgcaactatataaaataaaaagtataaactccactaaaaaaagtcaaaacgtagaccaaaacaaaaacatgtaactaagtcgtccactactacatctctatgactctatataacaacaaagccaaaaccacatcttctcacacaaaacacaaaaaagaacaaatatg

SEQ ID NO: 17474 - DNA, 3000 bp, Unknown
  misc_feature (1)..( 3000): 2750-1469P.txt file - cDNA_ID_1809296; gDNA_ID_2926161; Annot_ID_139730
catcaagtaataatacataagagggaatgatggatcaaacggtgttgatggtatcagtaagacatcggagaatgcaaccgagaccagctctctcagtgagtttctcgtgaatcttcaggcactgatcgcaggtgggtcggtccccagtagaaagtcctctgtacaagtacctgagaattttaagcaaaaacattctatcaaagagcacagacagcctgaggatagagctttccaattcatacatattacaaaacgcattacagcaaaaaaaaaaaaaaccaactttgcacttacttcatgagaatgtcgtaatattcgacatcaagagcattgagcattccgtcaatatccttaatggccattaaagctctgtgcacaactatccaattagccgactgcagttgagttttttttggctcagtaaatcaaaaaaaaaaaaaaagatggtttcggaaagagagagaccttgcaacgttcatcgcgagttttcggaggcgaaccttcaagagccgttttcaaagcttctacatgtttgtacctgcacacattaaaacaccgataagggattaaaccaaaaacaaaagaagactttagggtttagctccaaggtctgatattactgtttgagtaggctttcaatcttcctcgatttggtttcgatcctcgcgattattgcttctgcgttatcagcttcaacgaattctgccattcttcgattcgatctttctctccgatcagagatttcccctctttcccttctttaattgaaaaaatgagagagagagaggaaaacaactcaatcgccatttgaccatttcaaaagggaactgagtgccgtttgtcttggccttaaacggcacgtagtcttaaatgcttatgctgccactgaatgatggatgatggaagcttcattttttttttcattttttgtcaataggattttcatcgataggattcaagttgaaatacaagagccggcaagtacaaaccacttccggagacataagccgatgagtacaagaacactcccgaagccaaataccaaacaaggtaaacaaagggaacaaaatccaaacaaaccaattacactatattcattgaaatttcctcgatcaggttctagaaatccaaaaaagacttacaaatcctaagtcatagaaaattaaaacaaatctgagactaaaaaagacacacaaacgggttacaatacaagaatctccttttctttcttggtataacaattttttttttattataaatctctcttataaatttttaatagtaatatttgttggaccgaattttttatatttatactaatgaacttttctttacgattttgttaccattttggtatcatttttacgattttaatttattaacctccttaattaaaatcgcaacctattctattttattaacacaggtcaaaatatatttttttctgcgctcgaccctaatatgttaacaaaatggttgtttctgcccaaatctcattatatttgtatggatagacgaagagcattttgataatactcttttggaatgtttctttatcattctaattaggatcctacatcgaaagtatactataaatggagtaaacacactcatgactgctaagtgctaacactagtatatatggaacacaaccaatccaatcattacccattggttttaaattagaatctgatgaaacttaacattaactttctctaatcattaatgatattggtagtcttataacaaatatattgccaagattcggtctaagaccacttgatagaactatgtataaaacttcttttttttaactgccaaacctatataaagtggacgtgtaaactaaagcatggtgatcacttcacatcgcaccaatgtagtggatctaaacgtctctttgtgtaatcacgtggtcgaattaatggtcaatcatttagcaattaaccaaatttgaaataacatccgaaaaaagtcggtttagtgggaggagaagtgagaatgatgtttcatgaatgctcgttaggaactcttcgaaagacgataacctcggatggatgtttatggtgtcggcttctagtggttaaacataattagatcgtctactgaaaagttggagatgtggttgagaaactcgtaccctacatatggttactcgtctgctggtttaatcgttgggattgatcgtgtactagtctttcttaaaggccaagaattttgtcgtcgtagttaatatatgttggcgtacgttttactgtttttcttgagaaataattggatcttaagcttattaaaaaagtcgtcacgacttggtccaactcgtacatatcacaagttgctcggcgcttttcatgttagttagccaccgacctcgaactttgaaattttatattttttaacttcaaaaacaattctttgatagttttgttttcattgctaatatttctctcaatttttttttattgtttttatttttgtatagaatagtattcaaaatgaaactataattcagtatggaacactttctgttttatttaatatttacttcataatgaattatgtttcaaattttcaaagaatatatttatatttgaatttggttagtaccttccaaagaagcttaattccccacattaaaattcaacttggtcttcatattaacattattcaattgaattcagactgaaatggttcactttatctggtttgaaatatatgtcatgcattttccaaatcaagaatgaatcttcttgaaagaaaaaaaatgagaaaaaagaagaaggagaggaatgggtctcctaacaatgaaaaagagaataaacccttaaataattgcaactatataaaataaaaagtataaactccactaaaaaaagtcaaaacgtagaccaaaacaaaaacatgtaactaagtcgtccactactacatctctatgactctatataacaacaaagccaaaaccacatcttctcacacaaaacacaaaaaagaacaaatatg

SEQ ID NO: 17475 - DNA, 3000 bp, Unknown; identical to SEQ ID NO: 7786
  misc_feature (1)..( 3000): 2750-1469P.txt file - cDNA_ID_1809299; gDNA_ID_1621163; Annot_ID_57160

SEQ ID NO: 17476 - DNA, 3000 bp, Unknown; identical to SEQ ID NO: 7785
  misc_feature (1)..( 3000): 2750-1469P.txt file - cDNA_ID_1809307; gDNA_ID_1621163; Annot_ID_57158

SEQ ID NO: 17477 - DNA, 3003 bp, Unknown
  misc_feature (1)..( 3003): 2750-1469P.txt file - cDNA_ID_1809307; gDNA_ID_2926161; Annot_ID_139734
aagatgatgattctgttacacctgatcctaaagaggaagatgatatctcttattgttcactttgtgatttagaggtttgctttcttttcttcactagtatttacattagcaatcacttttatttaaaagctaggacttatttagacgtttctttgtgtgttttgcttaggttaaacgcagcagtaagcattgcaggacatgtaaccggtgtgtcgaagggtttgatcaccattgtagggtaaggttttgggggttctttccacctgaatcttacagtttctgagtttttgaaactgctaatctttgtgtgtatttggtgtattcagtggcttaataactgcgttgggaaaaagaattacacgacgtttatactcctgatggttttcgtcttgcttatggtgtgtgttgctctctcaactacttgaaacgtaaaccttaaaagttcttgttcattgaaacaatgatatagacttgcttttgttgcaacagctaataatagaaggtggaacagctcttgccgtatttgtcagatgttttgtggacaagaaaggaatggaaatggaattgaagagaaggctttatgtagagttccctcaatgggctcttgctacaatatctgtaaagtttcatatacatatgctgcttcctcatgacatctacgtagcttctttttgtttatgagtttatgatgttttgtcctcttacagattatcttggtcttgttcacggcttatggctcagccgccatggggcagcttttcctcttccatgtagttctcataagaaaggtaactcttacaggtgaatgaatttgatttagagttctttatttgacaagtagtatcaaacatttgcaggggatgagaacatatgactacatattagcgatgaaggaggagaatcaatttacagaagtggacccttttgatgaattagattcgtcttcagatgaaagctcagattttgattcgcctgaaagattaagaccaacgtttatctccaagtttatgtgcaggaaagcaaatgaggtgattcaacttctcatttctccttgtattgttgtcacttttaaggactctcaaagattatattttgtgttttaacagaatcagcagagactatccataaaaatagaaggagatgaacagtcaccttcttccacgctgatcaacaagaaaccggggtttcatgtaagcataaacccatggaaactgataacattaagcagtgaaaaggctctacaagcagctgagaaagcaaaggaaagactgaggaagacgaaaccagtttccgggactgaagaaaattcacttaagccacttccattagagaccaaattcggacttttgttagatcctgacaataacaacactgtgttgcaaccatcaacaactgcagcagtaaagcttcaggtttcacctggaagattctcaagcccacgaagaaggttctcaggctcttcatcttcaactgtgccttcgccgaagcaaaaatacagaactaactttgacttgaagctaactgaagtctctagggagctggaaagttacatctcaagacaggttttatgttctgtgataaaacaagatggaagtgaagcatcaccaagataaaaaaaaaaaaaaaaactgtatttttgggtgttgtgcattaactctgttacttactttctggttgtttgttctcagtctctgagaaatatttaagatctgcttaaacttttgcctcctcttgttcaactttataccgagtatatatataaatatgttcatcatgagatgcaaaaatgtggttatttattaaaattaaaaagtaggacataacactctactaatgaacgcataaagaaacgaatggaattttaaactaaaagtttcctaatgaagccataaacttagcatcttcttctgttgtgttttgtacaagtaataaactagcaatctctggatccatctcttgaaacaattcgttgtgagtagtggctgtttcacaaggttgctgctgttctgtggtttgattcatagtcatcaccggaacattgttttgttcctcaagttgttgttgagaagccaagtttccaaccacattgtgttgttgttgagtctccataggaacgactgaaagatcattgttttgatgatatggctgacagcaatgtcgttcatctatggcttgattcatcataactggaagctgtgaagagagatgtgtggcttgtccaataatcttgttttgttgttgctccattgagaagtgttgatcttgatgatccaatatgtattcttcttgaagctccattggaagttgtgagggatctgtgtcttctactaaaccttcaaaatcaatccaagtatggaccagaggttccaatccgctgatgctcccccatggcttgagccgagagtgaaggatcagtctcttgtctacaaaactggttctggttctcagccatgtttccataaccataattctgatgcacaaggttgctgcggttctttatgagtcaagtgtggtggctctttggtttggttcattgtcataaacagaacatcgtcttgttggtacgtctccataggaaccactgaaatatcattgttctgtccaagagactgatgatatagttgaccataatgctcctcctccatggcttgcttcatcttaactgcaagctgtgaagaattaaaaattatggatcatgccgattgtcacactaaagaataaaaaaattgactatttcttacaagttacaagtggttcattttaataatgattagtgatatatatattgtcacttgtcagtatcatactatcattattgttaatgaaatattataagagcatcgttgagatcaacggagaagacttttgacttttgacttttgagagagaaagaaacccgagatttcagatccaacctttttcttcttccaaatcttgaagtatatacttttttagattcaacctattttcttcttcttcaaaatcttgtagtttacgaccatg

SEQ ID NO: 17478 - DNA, 3003 bp, Unknown
  misc_feature (1)..( 3003): 2750-1469P.txt file - cDNA_ID_1809323; gDNA_ID_1621164; Annot_ID_57185
taccggtttggttccggttattttacccaaaataccaaaaagaaaaaaaacgaaataaccaaatattcgattaacaaaattgtaaaatattaaaaaattaacaaaactctattgggttataggtttgttaaaaatgtagtgggcttagatgtagttttgtatagggttgaccaaatattttttggttagattttggatttccatagatattcggtttgttcagttatacataatattcaatggatagtgtgactgaaatccgttcgaggatatttagtattatctagaaccgaaccggattcctttttcggtttggcttggttcggttcttcggttccggtttttatgcctaagccgttctaacttctatggttaattgaagaatgtgaaatggtggttaatattcaagaaattttaggaagccgaagtactaaatttagatactgaagaaaagaagaagaagcataagaagaggcctaaatgcccagagaattaaacaaatgggcctttaacaatatttttaacaatcagatctcaaaaagctaaagccttaatatataaacaaacatcaatctctggccgtcaaaggttacatctatcgccgccgctgagaccgccacttaaggccgtctcctccgcaatctccgtaaccaaaaccaccggcatcgcctggtaagctcgattttgtaatcatttcgatctcatatgatgtcgatctgttaaatcttgcgaaatcgatctttgttttgttctgagatttagggtttcacgaatttgtgttctaggttttctggcttaatcatttctattgttttttgttcttattggttcttatgcttttggtgacacaaagatctcgactttttcttgactctctatgcgaatttgtcaaaagtcaaaactttgtaacagtttactctctttcgtgcttgtgtttatgtatgaacaatagcttcgctattgggattgtttatttcaccacacttgattaattatacatactattgaaaatgttatcaatcttggcgataaaaaccgtcattttcatgtgtcttagctctagtagcaccttttgtttagagatcctgagtttaaagaagcagtagctagcatctttggtatagtaaattgtttcactgacaaattgtatatcatttggttataactagattagtgaaatttaatggatgagattatgtagcattgttttaattttgtatggagagaactggtggtgggcttatttccaaaattttcctttgattaagtcaagaccctttattttgagaagtgagagagaggattgtctgagtattgtcgctttctcaaaatctttccggggctaagcagagaaaagctgatagttaagcttaggaatgtgatcttggtcttttaagaatcttgaaactagtgggtaacttggatccatcgaatttgttttccgtaggtgagtgttctttagcctatttctgagtctgaattatacagtgtagacatgaaaataggtttttatgtgatggactcttttgttttatggtttaatggatatgttgagttttgtttttcccatgagtctcttataaagttggaatttgattcatggaatcttggatccagattacttcgaatatataaatgaaagaacacttagatgtatcaaagggaacttaagcgtgtgtactgtttagtgtctcacaacttggaatttggattagcgctttcatgttttggagtttgatttatattcgtgatgtttggatttggatagtaccttggtccattgaactatgtatcataataatgctttggatatggatatcgttttgatgacttacttgataactgctcatacttaaaaaacatttgttctagaaatctagattctcgtctatgagtgtttatatgttgaattcatgtcgaagtcatagtttagagatctcattgagcatttccccttcggaagagtgaggagtcttgttttggggattctttttagggctagacctgtgaggaccttcattaattgagttcgttttattttgtacccaaatatgttttttcggcttatcccattggcattgaaaaagttattgtttacattaaaatgttatttttttctttcattgagattaccttgctagtcattggattttatcggttttaaacttttaatagctgaacaaaaggggttttattctaatgtttacttaacactagtctggtcataaacaagtataaattttgggtttaagttatacttcttttattggaaatacatatcaaattagggcgtttcatagatagttgatatattttcttcacttgcatgtagttatgttcggtattatcgagaacttactgtgtttgaagttcctcggcaggaaaatcctgtagagtttgagccaatgttgtcggtgtgaacctcaaaagttgtgggtgtttttcccgccgataaagctgctggcaagatgggttggggttgggtagaatggtgtgtagggcaaggtaaggatgcttcacttacaaaagaatcatttagaaccgtttctttctttgggatctaaatgtgtttttttcggcttatcccattggctttgaaaaagttctctagtttgtttctttgtactaggagcattcttaccattctttaaacattgggcagtgaaagatattttcttggattagtattctgcttcttgtggtgttgtgtgacactcctagactatgttatttcctgttaacactgtctttgtaggacaggatgtgagaaatatgctgtttctgcaggataccctgaatttaccagtttaccggaatcatatcagaaacataaactcttatgttacaaaattgtaatggattagttgatgcgcattctgtgttttttcagttgtaaatttgcagaattgttgaatgttgattgctcgagaagagtcttgtgagtgaattctatttcttaatatatctgattatcgtttttgttgttgatttaattagcagatg

SEQ ID NO: 17479 - DNA, 3003 bp, Unknown
  misc_feature (1)..( 3003): 2750-1469P.txt file - cDNA_ID_1809326; gDNA_ID_1621164; Annot_ID_57184
ttgtgtctctgggggatctatcaatacttcttggcaaaagggtcaacttctgcgacaaggatcgtttggctctgtgtatgaagccatttcagagtaagtcttactggttgcttatgtttgttgaacttaaatcaattacttagttttacgttatgcctttgctgatggatggttttgctgaatgtagagatggggacttctttgctgtcaaggaagtttcacttcttgatcagggaagtcaggcacaagaatgcatacaacaacttgagggggtatggaagtttcatatatgatcggcagtatatatctcattgatcagacaaaagtaggttgctaatccaccttaccttagccacatgttttcattttctacaggaaattgcactacttagtcagcttgagcatcagaatattctgcgatatcgtggcacagacaaggtatggccctggtgtccctttcttgttctcagttgcagttgcctaagcattttgttctgcaattaataacttatttcgttgtttgcaggacgggtcaaatttgtatatttttcttgagcttgtaacacaaggatcccttctagaactctaccgaagataccagattcgggactcgctaatctccttgtacacaaaacaaatccttgacggtttgaaatatcttcaccataaaggtttcattcacaggttagactagtaaactctcttgtcacagctgtaattcccaagcctctgatttcctgcacatcctaggttacttacttttctcatctgatgcgacaaagggacattaaatgtgcaactatattggtggacgccaatggcaccgtcaaacttgcagattttggattggcaaaggttcttttccaataatagatgtttatagcttttactctaacttaattacttggtccatcgtttatcccccttactcaatatatatgtcatttttttcatttaggtgtcaaagttaaacgacattaagtcccgcaaggaaactctattttggatggctccagaggtatacttcgggatccttcctcctgttttgattgttgtgaatacaatgacaaacatatcatatatcaatagcaatgatggatgttatactgttgcttatatatgttgttgcaaccgttgtgatatgggcttgatagcctcaaaaacccccgattatgtttccttcatagtttgattaaatttcctttatttctgtttataactgtaagtatgtttgtgtaattatacgtaacagatatatttgaattccttccactttcattgtagtttaggctatacttgatcaggttatatgttacagtttttcctaaatggaacataataatttgatcaggttattaaccggaaggataatgatggttacagaagtccagctgatatatggagcctcgggtgcactgtgctggaaatgtgtactggtcagatcccatactctgatctagaacccgtaagtcttcaggattttcaaacttttgaactgtcttataatcttaaacgacattgaagggtctacttaatgggattttatgagttaaaggtcagaatttgtgcaaacgcgcaggttgaagccctgtttaggatcagaaggggtacgcttccggaagtacctgatactttatcactagacgctcggcatttcatacttaagtgtctcaaattgaacccggaagagcgtccaactgcaactgagctactgaaccatccatttgtgagaaggcccttaccatcctcaggctcaggatcaacatctccgctaatccgtagatgaatctaattttattagattgcctccataggtgaagcctctagtttcgttttattgagaatatattaggatcaaacgctatattctaacattgatatcttaatgtatgagagcaggggtaaccagaaggtttatgagatattagaccccatagaaactttaggggagacacgagatatgattctttgatacatatgctgttttggttgcgcagcaagagctaaactttctcgagacatatcttcaggtagtttctgtctcattcattggttggttgttgtaagttgtgtcacttgtgtgtgttgagcttatatttaaaactgaagagccttggttaaattagagttttgggtgcataggtttgtttagttttgttaaattatagtatcatgtaatgtataagaagaaccttagttgatttagagtttcgggtgtataggcttgtttggttttgataaattatatagtgtatgcatgtaacccatatcatgtaatgtgtaattatagttggctcttatatagttcctgcttgttgcaactgtttacacatctcatgtctcgatggatttaatctccaatttttcttatatatatatctgaattatacatgcatacatacactataatttaacaaaactaaacttttcttttgggtgcaaaaacataacctatattcatctcttaattattttacgctgaagaaatctgctgtttcaattaaaaaagtatggtcaaaccaacattttctttgaaattttggtgaaagccactctcattgaagtgtatatatgattcaacttgtttcttacaatatttgccccgttgaaaacttttttgccatcgatgagtttctttaagggcaaagttcctttaagaaatgcttttagatttctttgtatacctatgaatttttaatcaagtgatgaagacacggagaaaaatcctaaattgatgctaaatattttatctgtggacttaaccaagtctcccacaaaaataatacaagaatctgcaacaatttttaaaattcagtattcaattattattcagatactattactagattgaaaattcaactcttgtcataagtcgtcgtcaacttcttttgtttgcttcttcctttttctctaacaggtgcagtgttactgccagttgtttggatatttccacttgtgtatttattctctctatctctttgacgtcgtctacagactacaatg

SEQ ID NO: 17480 - DNA, 3003 bp, Unknown
  misc_feature (1)..( 3003): 2750-1469P.txt file - cDNA_ID_1809330; gDNA_ID_1621164; Annot_ID_57183
atgcttgttttagaaggaagaagcctgtgcgttcttgtcaacgatttatatgccgttgcgcgattagagatgttggatattaagacattctaattttgttgtaagatttataaataattttaaaatataaattaattactagttaatgttcttccttgtatttcttttacagtattgaacatgtacaaaagtatgaaaagctaactagtattaccctaatctaataggaacatgtaattggaaactcaagttttcccgccaaatttttgccgtcaaaaaaatattttccgccaaacatttttcccgccaaattttttttttcgtaacaaattttttatcaaccaaaaaaatagttttaaaaatccttgtaaattttttttggcggaaaatagatttacaagggattttaaaagggttttaaaagatttataatgaattttaaaagggttttaaaacaattttaaaactcttttaaaacaattttaaaactcttttaaaacaattttaaacccctgtcaaaacaattttaaaccctttaaaaatctttaaaaaacctttgtaaatctattaaagtcttttaaaatcccttgtaaatcttttaaaactcttttaaaatcctttgtaaatcttttaaaacacttttaaaatcccttgtaaatattttaaaaccctttaaaaattccttgtaaatcttttaaagcccttttaaaatctcttttaaatctatttcccgccaaaaataattttggcgggaatttttggggggaattttttcgaaatttttttggcgtgaaaattttgtcgaaaaatttattttggaatattttaggtaaagaatattaatattttattttgttaacctaaaacaattttcaaataggggtaaaatggtcaattaaaatttaaagagggtagaaataaaaatggctaaaaaaaggtagagttgaaaaggggcatcgtgaaaagagcattagaaagaatttttaataaaattacacatattgtaaataaagttttttgtaaaaaattagttctgaacctataattaatattaaaagaaaatacaatttattttcattgataacttataaaaaacataatatatatacagtaaaacctctataaattattactcgataaattaataacctctataaattaataaattctttcggtcgcgagttggtaccagtctaaaaagtgacacaaatcgataaattaatcaaataataattttttgaaaatcctatataaacatatggtctcattaatatcataaattaataattatataaaaatatcaactatatatatatatgttataattatatataataactttaatgaaatataattttagtattgtttctttttgcttaaactcactttagttatttttaatttgattttagtaatttttactatatcaaaaactgttcgtgttgttttttaaacatgataattgattttatttgtaattagttctagaaaaatatttcaaataatgaatggaagcttatattttcataaaaaagtttttaaaaaacttatcaaattagaaaaatctctatataaattaataaatattaatttatcgataaattaatacttccataaattaatagaattttgcggtcccaacattatttatttattgaggttttactatatatatatccctatatattataaagaattttgatagatttaaaactttatttacaacccctgttagacgacaaagataggcttcacaaataggtagcaaatgaaaggttaaattggcatgtagcatatggaccgaaaatatgcgaataagtactaataaaaactgaggaatatcgaatattttcaaataagaaaccacaatgtcactttaaaaaatagtattttagctaatggcttttaattttgcgactaatttgcaatatctctatttttttaataaacaattaaccatttatatttttaaaatgggaacgatagaaaatgatacttatggtgattggttcaagctttgaaggctttaacttttttcttgtaaagtctttaaagattgagtttttaccaatcacacttttttattttaaataatttaaaagcttttaaagtctttcttataaatctgaactgtaacatataacaataaaattcacacaaagaactttataataaggtttttatatataatatacatcaaatgtaatatttgatattttttaatatctacatatacatttttgcagccactttgtgaaataaattctcaagttgagaattatttacagtggctgccactggcatttaataattatttttgataattagaaagtaaatcttcgaattaaatatttgacatttaactatttttccaaaatctctctacattaactacacgattagttactaaaataaaacttccaaaatatttaacatcatttaaaaattacaaaattatcatttttgatattgtttttttgtatgactataacaattcgattatacgcatcaacctacatagatatttgatagcagttaattaatacaaaattacaaaatatttagataatgattcataaacatatcataaataagatcaacattaataaaataaatagttttttttacggggcggattggcgagacgggtttggtagaacgttacttaataacaattgtaaactataaaataaaaatattttataaatagatacaatttgcaaacttttatatatactaacttaaaaaaaaaattgtccacgcggtataccgcggataaaaaactagtttttatatacataagtggattacttaagaaaaaaatgattaaaaggtactctttactctttactcctttagaagttacaacactatactggattacttaaaaacaaaaactttcatgaaaaagagaaaataataaaattgttgactggaaaataaaaatacaattaatataaagaaatctctctaacaactttaccaatcatcgtcgctcacatg

SEQ ID NO: 17481 - DNA, 3000 bp, Unknown
  misc_feature (1)..( 3000): 2750-1469P.txt file - cDNA_ID_1809330; gDNA_ID_2926143; Annot_ID_139031
cttgttttagaaggaagaagcctgtgcgttcttgtcaacgatttatatgccgttgcgcgattagagatgttggatattaagacattctaattttgttgtaagatttataaataattttaaaatataaattaattactagttaatgttcttccttgtatttcttttacagtattgaacatgtacaaaagtatgaaaagctaactagtattaccctaatctaataggaacatgtaattggaaactcaagttttcccgccaaatttttgccgtcaaaaaaatattttccgccaaacatttttcccgccaaattttttttttcgtaacaaattttttatcaaccaaaaaaatagttttaaaaatccttgtaaattttttttggcggaaaatagatttacaagggattttaaaagggttttaaaagatttataatgaattttaaaagggttttaaaacaattttaaaactcttttaaaacaattttaaaactcttttaaaacaattttaaacccctgtcaaaacaattttaaaccctttaaaaatctttaaaaaacctttgtaaatctattaaagtcttttaaaatcccttgtaaatcttttaaaactcttttaaaatcctttgtaaatcttttaaaacacttttaaaatcccttgtaaatattttaaaaccctttaaaaattccttgtaaatcttttaaagcccttttaaaatctcttttaaatctatttcccgccaaaaataattttggcgggaatttttggggggaattttttcgaaatttttttggcgtgaaaattttgtcgaaaaatttattttggaatattttaggtaaagaatattaatattttattttgttaacctaaaacaattttcaaataggggtaaaatggtcaattaaaatttaaagagggtagaaataaaaatggctaaaaaaaggtagagttgaaaaggggcatcgtgaaaagagcattagaaagaatttttaataaaattacacatattgtaaataaagttttttgtaaaaaattagttctgaacctataattaatattaaaagaaaatacaatttattttcattgataacttataaaaaacataatatatatacagtaaaacctctataaattattactcgataaattaataacctctataaattaataaattctttcggtcgcgagttggtaccagtctaaaaagtgacacaaatcgataaattaatcaaataataattttttgaaaatcctatataaacatatggtctcattaatatcataaattaataattatataaaaatatcaactatatatatatatgttataattatatataataactttaatgaaatataattttagtattgtttctttttgcttaaactcactttagttatttttaatttgattttagtaatttttactatatcaaaaactgttcgtgttgttttttaaacatgataattgattttatttgtaattagttctagaaaaatatttcaaataatgaatggaagcttatattttcataaaaaagtttttaaaaaacttatcaaattagaaaaatctctatataaattaataaatattaatttatcgataaattaatacttccataaattaatagaattttgcggtcccaacattatttatttattgaggttttactatatatatatccctatatattataaagaattttgatagatttaaaactttatttacaacccctgttagacgacaaagataggcttcacaaataggtagcaaatgaaaggttaaattggcatgtagcatatggaccgaaaatatgcgaataagtactaataaaaactgaggaatatcgaatattttcaaataagaaaccacaatgtcactttaaaaaatagtattttagctaatggcttttaattttgcgactaatttgcaatatctctatttttttaataaacaattaaccatttatatttttaaaatgggaacgatagaaaatgatacttatggtgattggttcaagctttgaaggctttaacttttttcttgtaaagtctttaaagattgagtttttaccaatcacacttttttattttaaataatttaaaagcttttaaagtctttcttataaatctgaactgtaacatataacaataaaattcacacaaagaactttataataaggtttttatatataatatacatcaaatgtaatatttgatattttttaatatctacatatacatttttgcagccactttgtgaaataaattctcaagttgagaattatttacagtggctgccactggcatttaataattatttttgataattagaaagtaaatcttcgaattaaatatttgacatttaactatttttccaaaatctctctacattaactacacgattagttactaaaataaaacttccaaaatatttaacatcatttaaaaattacaaaattatcatttttgatattgtttttttgtatgactataacaattcgattatacgcatcaacctacatagatatttgatagcagttaattaatacaaaattacaaaatatttagataatgattcataaacatatcataaataagatcaacattaataaaataaatagttttttttacggggcggattggcgagacgggtttggtagaacgttacttaataacaattgtaaactataaaataaaaatattttataaatagatacaatttgcaaacttttatatatactaacttaaaaaaaaaattgtccacgcggtataccgcggataaaaaactagtttttatatacataagtggattacttaagaaaaaaatgattaaaaggtactctttactctttactcctttagaagttacaacactatactggattacttaaaaacaaaaactttcatgaaaaagagaaaataataaaattgttgactggaaaataaaaatacaattaatataaagaaatctctctaacaactttaccaatcatcgtcgctcacatg

SEQ ID NO: 17482 - DNA, 3000 bp, Unknown
  misc_feature (1)..( 3000): 2750-1469P.txt file - cDNA_ID_1809346; gDNA_ID_1621164; Annot_ID_57179
tatcagaaacgcgaagttatcaaggtagattcaaagctttttatttatcgtaaactatcataaaatttctgtatacttattcttgattcatgtgtttctttttcaaggctacaagaatgacagtgataatatgtcaattgacataacattgttgttaactgaagagcagatgaagctttttctgaataatgatgaaaaaatcgaagaggatgtcttggaattttgagactatccacaaccattaggaccaacaacatgcgtttgttgaacaaaactaatgtccacacaaaatatgaatctcccgagcagagtaagaatagcccatttttcattgttttgtttcctctctataaataattagttatcacttaattaatattaatatcagttttttggtccttcaagattttaaggaagagaggctaaaatggtgtggtgaaaggaaggtatgtaaatcagacactatgggtcttgttttagttattaaggcaatggtcttgttttagtaactaatcttactcctaatacacatgattatatggtggatattttaacttttgagcggaataagttagagtccaaattagcaattgtccaaagagttctcaatggagaaataaacatcagtcccgatcttgatgtggtcttggaaaagaatggtttttaaaaatatggcaagacagtgaactcatcaagaagctatgactacgtcccagaggatcttatctcgatgattagagatccttcaaaatagatgcattaaaggcataattagattacgtgaataaaagactgggtactatcaactctgaaagccagaagcactctggatcaataagctagatgattttgataaagcacttgaggtatgaatgaattagttttatgattctccacaacaaattatgtgtctgttatttgaactgaactttcttaatattgcaaggactctggtcaagactctcaagttaatggcgattataatatttagtgcatagatggcacaaatataatttccattcttatctataaatgattatggtataactgtctaccaaaggttccaaaattagtatttaacaaaaaaaatatttcaaaagtgaaataaaatgtatacctcccatctcttagatctaattttaattttattacatattttaaggatatgccaatttttcgattttttgttagagacaagttatcatatttcaacatttttaggtatctttatataaagatttattctatatttggaaaattattctttcctaaattattattaaaatctgaaacttaaaaaatatataaaaaattaaatatatgaactaaaatttatacaatctttttcatataaattgtgctttttgtacctcggaccatagtagttctctttgcatctgaagtgttgttgtaaccgatccgaagatggtaaacatttacaaggaaaatattattttggagtgggcctttatacaaaactatcaaatcctacctagctcggggatcataatttttgttgaaaatgtttgcatggcgatttgaagcagtaatatgaaatagattttgattgttatcatcaacttccaatagcaggtcgagacacgaacgaagtagaatttctacaaactcaatgtatccggactttacgacctcaacaagtaaattttgaggtgaagaagtaatttataatttatcttcgaaaatatttacaatccttctcatataaatatacaagtttttccatttttttgttagagacaacttttcacataattatctttattttttgaaattttagtattatattgtttttccaactacacattaattacaaaatactccttgatgaatttatctgagaaatttaccatattttgttatattattattaatttaattttgcgtaaacgggagactatacaattaagtttgagtttcctgattttcaaatgttgggtttgtttgtataatttcaaatgttggggtttaatttgcaatattcccgaatcccgactactcattctaaaatataatcagaccttcgcgtcttctttaacagttagttccataccatcgtcgcaagctctcatcttcttcagctcaaaaagccatctcaaaggtaaaagtttctcgagtttgtcttctccgtttgattgcttcttcatccctatcgagattcgtatgatttacgttctaatttcgtcagatcgatgaaagatccattgacattctctagagatctgaataaaatattttctgttatcgttcacagttttgatgagatttttgtttggctctgtagatttctaagtttttaattgttttcaatttgccattatgatctatcattctcatagcttcagtaagagatctgatcgttaagtttttcagattgagaatcgaaatttgacttagaggttatgtagaaaccttaattttaagatcttccctgatgatctagtactctcttcttagatcttggtgtattcagtgctagttttgtttcttagactaaatgtattagatagatttctcagtttttgttctgtgtgtttgtagtgtgtggttataacacttaatttatcactattttcaggtatattttgaatcaaaaacaatggcagggactaatgtaagtacatctctaagctcattgtatactgttaagaatcattatattgttgtctgtaaatagtcttgtgatgctttatggtttgttacacttatgagattctttgcattgtggtgtaatataatctcctctgtttgtgtataagatcactatgttaagattgattttttcttgttttgtttgttgagtgggtaagtatgttttcagaaggtgtgacgaatcttaggttcatgcccctattgttctaagattgtttgcatctttcaatctggaagcataattaggctttgttactgtctaagtaacataagttctggtagatttttgtaaacgttcttttgctgctgagaaaattccaattgcttatg

SEQ ID NO: 17483 - DNA, 3003 bp, Unknown
  misc_feature (1)..( 3003): 2750-1469P.txt file - cDNA_ID_1809346; gDNA_ID_2926143; Annot_ID_139035
taatatcagaaacgcgaagttatcaaggtagattcaaagctttttatttatcgtaaactatcataaaatttctgtatacttattcttgattcatgtgtttctttttcaaggctacaagaatgacagtgataatatgtcaattgacataacattgttgttaactgaagagcagatgaagctttttctgaataatgatgaaaaaatcgaagaggatgtcttggaattttgagactatccacaaccattaggaccaacaacatgcgtttgttgaacaaaactaatgtccacacaaaatatgaatctcccgagcagagtaagaatagcccatttttcattgttttgtttcctctctataaataattagttatcacttaattaatattaatatcagttttttggtccttcaagattttaaggaagagaggctaaaatggtgtggtgaaaggaaggtatgtaaatcagacactatgggtcttgttttagttattaaggcaatggtcttgttttagtaactaatcttactcctaatacacatgattatatggtggatattttaacttttgagcggaataagttagagtccaaattagcaattgtccaaagagttctcaatggagaaataaacatcagtcccgatcttgatgtggtcttggaaaagaatggtttttaaaaatatggcaagacagtgaactcatcaagaagctatgactacgtcccagaggatcttatctcgatgattagagatccttcaaaatagatgcattaaaggcataattagattacgtgaataaaagactgggtactatcaactctgaaagccagaagcactctggatcaataagctagatgattttgataaagcacttgaggtatgaatgaattagttttatgattctccacaacaaattatgtgtctgttatttgaactgaactttcttaatattgcaaggactctggtcaagactctcaagttaatggcgattataatatttagtgcatagatggcacaaatataatttccattcttatctataaatgattatggtataactgtctaccaaaggttccaaaattagtatttaacaaaaaaaatatttcaaaagtgaaataaaatgtatacctcccatctcttagatctaattttaattttattacatattttaaggatatgccaatttttcgattttttgttagagacaagttatcatatttcaacatttttaggtatctttatataaagatttattctatatttggaaaattattctttcctaaattattattaaaatctgaaacttaaaaaatatataaaaaattaaatatatgaactaaaatttatacaatctttttcatataaattgtgctttttgtacctcggaccatagtagttctctttgcatctgaagtgttgttgtaaccgatccgaagatggtaaacatttacaaggaaaatattattttggagtgggcctttatacaaaactatcaaatcctacctagctcggggatcataatttttgttgaaaatgtttgcatggcgatttgaagcagtaatatgaaatagattttgattgttatcatcaacttccaatagcaggtcgagacacgaacgaagtagaatttctacaaactcaatgtatccggactttacgacctcaacaagtaaattttgaggtgaagaagtaatttataatttatcttcgaaaatatttacaatccttctcatataaatatacaagtttttccatttttttgttagagacaacttttcacataattatctttattttttgaaattttagtattatattgtttttccaactacacattaattacaaaatactccttgatgaatttatctgagaaatttaccatattttgttatattattattaatttaattttgcgtaaacgggagactatacaattaagtttgagtttcctgattttcaaatgttgggtttgtttgtataatttcaaatgttggggtttaatttgcaatattcccgaatcccgactactcattctaaaatataatcagaccttcgcgtcttctttaacagttagttccataccatcgtcgcaagctctcatcttcttcagctcaaaaagccatctcaaaggtaaaagtttctcgagtttgtcttctccgtttgattgcttcttcatccctatcgagattcgtatgatttacgttctaatttcgtcagatcgatgaaagatccattgacattctctagagatctgaataaaatattttctgttatcgttcacagttttgatgagatttttgtttggctctgtagatttctaagtttttaattgttttcaatttgccattatgatctatcattctcatagcttcagtaagagatctgatcgttaagtttttcagattgagaatcgaaatttgacttagaggttatgtagaaaccttaattttaagatcttccctgatgatctagtactctcttcttagatcttggtgtattcagtgctagttttgtttcttagactaaatgtattagatagatttctcagtttttgttctgtgtgtttgtagtgtgtggttataacacttaatttatcactattttcaggtatattttgaatcaaaaacaatggcagggactaatgtaagtacatctctaagctcattgtatactgttaagaatcattatattgttgtctgtaaatagtcttgtgatgctttatggtttgttacacttatgagattctttgcattgtggtgtaatataatctcctctgtttgtgtataagatcactatgttaagattgattttttcttgttttgtttgttgagtgggtaagtatgttttcagaaggtgtgacgaatcttaggttcatgcccctattgttctaagattgtttgcatctttcaatctggaagcataattaggctttgttactgtctaagtaacataagttctggtagatttttgtaaacgttcttttgctgctgagaaaattccaattgcttatg

SEQ ID NO: 17484 - DNA, 3000 bp, Unknown; identical to SEQ ID NO: 7818
  misc_feature (1)..( 3000): 2750-1469P.txt file - cDNA_ID_1809372; gDNA_ID_1621165; Annot_ID_57202

SEQ ID NO: 17485 - DNA, 3000 bp, Unknown; identical to SEQ ID NO: 7818
  misc_feature (1)..( 3000): 2750-1469P.txt file - cDNA_ID_1809372; gDNA_ID_1621165; Annot_ID_173835

SEQ ID NO: 17486 - DNA, 3000 bp, Unknown; identical to SEQ ID NO: 7820
  misc_feature (1)..( 3000): 2750-1469P.txt file - cDNA_ID_1809380; gDNA_ID_1621165; Annot_ID_57199

SEQ ID NO: 17487 - DNA, 3003 bp, Unknown
  misc_feature (1)..( 3003): 2750-1469P.txt file - cDNA_ID_1809380; gDNA_ID_1972120; Annot_ID_178941
gacttaaaactaaacaagctcgttgttggaaagaaaaagaatttcccaacgctaaggagctttgtttcgccaattgtccccctcttgaataatttttatggattctgtcatttcgaagcagatttttttaaaaaacgttgataaatctaaatatgtatgttgcatattcgatttaaggttttttatgacatttatttcgattttagtggattcctttacattaatgttacgatattcttattttctataatttaaattcactgaatatcaaccaattacatttctaaataaaaatatatattttataggtgttagataatccaattacagttgccaccaaaaaatatggaatttaaaactaaattacaagtatatgatatttaatttggatggggtttgttaggaaaagataaaataatttgcatagttttagtttttgagtcaaccaaatggatcaatagattaattgagaaaaagaaaagaaaaaagaaatcaatcataatgttttcgaattttttggaaagcttatacgatggaatcggagacgatgacgccgccgacgacgacgaagacaacaacaacgacgagaaaaccccgaaagcctcaacggaaagacacgatttctcgagaaacgccgttcgtttgtcaccggaagaggaggctcaagcgcgtggggttaaagatgatttgacggaacttggtcataccctcacgcgtcaatttcgtggtgtggctaactttctcgctccgttacctgatggatcttcttcttcttcctccgatctatcgaaccatcccaggtttaaccaatctcggtcttcagatcctggattgaatcaatcgcgttcttcagatcgggacgaatcgtgtgttggaagtgatacgccggagactggaattaggtttaggagctgggatttagaagaaaaattggcagaaggcaatgatccggaggatgaggaagaagaagaagaggaaacagatgaagaagaagaagaagaagaagagatcgctgcggttgctcttacagacgaagtgctagcatttgcgaggaacatagcaatgcatccagaaacttggttggattttcctcttgatcctgacgaagatcttgatggtaacgtatacattgagtcaagtctttcgctattagtcttcattgatttgacttataggcatatcaaaagtttgattatttcaacttttatctaatgtagatttggaaatgagtgatgctcaaagaggtcatgctttagctattgagcgtcttgctccgaggttagctgcattgagaatagagctttgtccatgtcatatgagtgttggttacttctggaaagtctattttgttcttcttctttcaaggctcaataaacacgatgctcatcttttgtcttctccacaggttaaaaaaacctgaatctcaatctcttcttgagtcaaaatgattctttgttgttgctgttgtttattcaacaaaatccttttgcttttgcaggtgatggaagctagagcattgtggatgaaagagcttcagaatcagacacattcttcaaaagaaagtagagatatgattcttgaggaagaagatattacaccatcaacttctaattactacaaccatgctcctcctgagtttctttctccaagaatatatgcttttgaacctccttcgattatgtatcgcgattttgaacacgggtttgaaaacgctcagttcatcgataaagctgttattgaggaaaaaccaatccagaagaacgacaaaaatagtgcaagccttagccaaacatctaaagatgttgttgatgatgatgatgatgattggccagaagaagaagattctgctaattcttgggctccaatgtttacagtgaatgaggatgatgtttctttcagtgatcttgaaggagacgacgatataagtagcttagcactcaagtctaagattacatcaaagggcacagaccaaaaaggaacatgaaacatcatctggcttgttgctttgccctgcctcacgagatcgaatcaatagaattgaacataagtactgtgtgctgagtcaaatcgtggaagtcttttgggtgagtttgattgttttgtggatttatgatgtttgctctcaaagagaaggaagaaagaaagaaaaaggttttgattgaaacatgtacagaagatttactttgacactgcaatttcattgtaatgttctctctcgccaaatgtaatgaaatattgaaaagcactatttcattcgcgtggaacttaaaagaaattgatagagaatggcgcaagtgaattcaagtgtaacaaactgttagaatcattattggattggaaaatcatatgggattttattgcttatgttgaggatttgtatgtatgaaaatgggaacaaccaggaggagctatcatcaattaacaaaataactcctatgacttaactaaaaaacaaatctatgttgaaatgtataacatttgtcaaaatgctagtactttgttaataattaaggggtgttattggtttgtgatttatatagagttttagtgatttaaaaatattatatagaatctgatgttattcaattcaaattttcattttttttttttaatttggtattattagtttaagatttataaaaattaatctaaaatcttcgtaagtaagattgcttccctaatacagagaaagaaagaaaaaccaagtaagattggtaatacgatgtcgtttcgcagaataatgcaaagctgaacccaatttaataagctgcacttttctttctttctcgagtctcccgtcgttttttatgtcagaaccaattcgtcaggtcgtgaataagtgactttatcgacgaaccaccactcagctgcagcaaatgatcgtttagctccggcgaagcgtaaaattcttcagatctctctggaattaataatccgtctgtttgatcgatctgattcggcaaatccttgagaaaacaaggagggaagaagaagaagaacatg

SEQ ID NO: 17488 - DNA, 3000 bp, Unknown; identical to SEQ ID NO: 7820
  misc_feature (1)..( 3000): 2750-1469P.txt file - cDNA_ID_1809380; gDNA_ID_1621165; Annot_ID_173830

SEQ ID NO: 17489 - DNA, 3003 bp, Unknown
  misc_feature (1)..( 3003): 2750-1469P.txt file - cDNA_ID_1809384; gDNA_ID_1621165; Annot_ID_57197
gttagctgccaaatgatacatgccatgccgcttcatccacctctttctttgatcttttctacatttcttcacaattttttagtttgtactaatttaatatttgtattggaatctcgcgaatggccttctctaaagccaaccaccaccacatcagtagttcagttaatagatatgcatatctacggacatttaaagctcacaaaatcaaatgtgtgtatgtttgtagatatcacaatgattcataaaaattacacaaccagtttgaccatatgatccaacaatgcaataatgcaaaatcacacaaccagcttgacctcaccatatgattcacaaccgatctcgtattcatagtatggcgtatatatgcatgcacaataaaaaattatcatatacgtgaaaaattgtgctatccacgataaatatatcgcaatgagtttgttttgacatttacgcaaaagtaaactaggattagaatgtataatcgattttggtgctcaatgcttaactaacaagtttaaggttgtttaattttttcttctctcttaagaatccactaatggtggaaatgtggaaggaagaatatggatttttttataatatgattaggatcttgaacctcacaagttatgcaacatatattatagatgctgaatctcaatttttgaaggtttacattgcatattatttacaagccatgacgacaagtatcaaatttatgtttgccacatattaaatttttaacatgcccatgtccaaatggttgtaactatgaagcagaaaacaatatacataccaataccatttgtaaatactagcatataactctgtacgtattcaaattacattatttctgttcttatcctgtataggttttaaatattgaaaaatataccatgcataatcaagggataggtaatgataattggtgggaataaattaaggatggcatgcatggatgggtccccaacataagcactcgagcatgcattgctaatactcagcctcgcgtgccaacactcccatgtccctaacacaaactacttagtaaattaaaatgatctaatctattatttacaattaattagtactaaactttgttatactcttccactaccacagttatactcttcacgtagttgttcatttatatgtatatttttcaagtagaagttaaaatcttatgaagatataatgctctcgaaaaaatgttgtaaaagaaaaagaaaaaagagagagagtagctgacagaaggaacatatagggaagagagtaaagagaaaaagcgaacttcaagaatcaacaataagaaaaagtaaattatttgcaaattcctctttttgtctcttaaaagatacaaaaaatgtttttttttttaaacacacagagaatgcaaactaacacaagataaaacaagaagaagaaacacagaattttgactgtcattatcataagaaacatagcaaccacaagactttcctttatatttggctatatacatttattcaaacaaacataatatgtttcaggctttgtattgctaattgggaacatttcccctcccccaactttttttttctcttttgaccaacttagcttatattaatttgatttcacttataactacatgttgcatacaatttttgcatattcttatctgctaataagtaaaactatgtgatagtcaagatagcatcaaacctacgggtccaaactaaggtttcaggtctaatattaggtatgggatccatctacactttttgttttttttactgagatagaatttacttattagcagatttcattttaggataaattccgataccaggtaaaatacaaacacaatttgaaaaggaatgattattgtttttaaagagattattcattaacacatgagacatttagactaaacaattactccacctctgttttagctagccatatctatataataggttctaataggtgatttaaggaggaagtgtgcatactcatattcttaagccatggaccaacaaagaaagagagaaaagcattgtagttagattttgcttagtcactttatgtcagtggtcttttatgattttgtcatttttatttcatttttggttcctctgtattcttggaggttaaaaaaaaaggaaaggcatgaatgatttcatcactatccaagccaagtacttataaaacacatataaacatttagactattactttaagacaccataattccataaaccccttttgaaactttctctcgtctctctctctctctttcttgttagcataaggccccaagaagacataagagtgttttcatgattctttatttgggttttgttatgaaaaaatttagcttctatagctttggaaatggtgagagcttgagaggattataaaaatcaagggtttttgtcttcttttgctcacttgctcattctttaatatcgagaaaacgttttgggctttgatgggaggtgtgttcgtgttgaggaaacccagaaacggcaataaatgccgtcgtttcgatcgatgcattacaatgagacaaacggaaacagagttgttctcagaagaaacaagaatgagaacaagagaaacaagacgaagaagaagaagcttcttcttagatatgatccttctgtttcgtacttgttcctccaacattcttttcctctctcttcttctcttgtcttcttctttttcctctgtcttgtccgagaatctctcacctagaaaccaaactctcaggccactcgatgagcttaataagctcaaagccattaatcaacatctcaggaagatcaataaaccttcaattaagacaattcatgtaagtttgaattagtattatcgtacgcgatcttctttttgcgttctttttcataaacacaatcttcttcttcctctgtctcagaaaaacaaaaaaaagcacttcctttctctgttcttgattctttatgctctgtttcaagaagtcgctctgttttttttttggtgtaaatg

SEQ ID NO: 17490 - DNA, 3003 bp, Unknown
  misc_feature (1)..( 3003): 2750-1469P.txt file - cDNA_ID_1809386; gDNA_ID_1621165; Annot_ID_57196
agaacagaagatgaacacgcttgaatcactagtgaaatacgcgagaggtctgaaacgaatggtgataaggattctccggatgaagagcaatcacagcagtgcagatgatttctgcgatgatatctgcaagttccggcacatgaacgagcatcttgttcatatagaatgaaataattttttgctgctaatcttattttcagccatttgatttctgtttctctttctggtcgctgagcatttcttatattgaactcttgagtaattgttgtttcctgattcatggttatgatgaacttatgacaattgttttttaaacgaaaaattatggacacatttcttaattagctttcttgttttcttaatctacattaataatatactagtagtgatctagcagaatataattacagtttatgataaagtttgtttttggagtatacttatgtatcaaagaagtattgtcctatgcttaaaaaagataaaagaagataatctccttaaaacaagataaacctcagattgcattacattaaaataaaacgagaaaacgcaaaacgcgcaccaccaacaatttcaaaaccaaaaaaacttgtctatatataacgtgattaactcctgcattgaaaaatgacctggtgataatttcttctcaattcaaatacataaataaatatcaataaaatggcgggccgcgacacattccagctgcgttttgcagcagtcgcggcatccgccgccgtattgatctttctcatggctggtcaagtcgcggagtcgcgtatgatcaatatctgctctcacaccgcgtatccatctttgtgccgacctctggtgaaacgtgtcacgagccctagaaaagccacgcaccgaaccatccaagctttggaggctaagacgaaactagctctagccgaaacagctaggttcaaaaacggtaaccaagcggtcagcacgtgttacgagacattgggcgacgcggtttacaatttggcaagcgcgagaaagagcataaggaaacgtgatgtgccggcgatgaacacgtatctaactgcggctgtgtctgattacggtgcatgtgtggacgggttcattgaaacacaacaggttaatgcgatccaaaatgcagtggttgacttgagaaaaattagcagcaattgcttggcgttgtctacattgattagatgatcgatttaagagaacaattgatttaatttttctcaaaacaaaaactaattaattgaagaaataaaaaatctcaagcaattaaaatttgggtttctttttgttgtttttgttttgagagagatgtttgttgttgatccatcattcgtatgtaacgccactgggtgtaactaattatatttgaatttcgtgtaattaataatcgctagtagattttttcatattcaacaatttgccgatagaaatgttttccattctcctttcttgaacccactttactttttcactatcaacaataagattaagttttgaccgaaaaataaaacaataagtgacaaagacaaacacaaactatagtaatgcacaactttttgttttgttaactactatcactaattcattattgatatggatatcattatgatgtttttagaaagtatatgtgtgattatgttttacttttcccaggatccataacaaaaaaatatctttgagaaaataatttggctatatcatatattggataaaaatattgccatttaaaatggtcttttaactctttttcttaaaatctgtatgtatattatagtttgatatgatcataaaagcattcaataatttttctttcatgcaaaactgatagatcttgctcaatgatcatgtttcaatgtctttaagtgttttaagaaagtgagaattgctttgatttggattgaaaaatattggaccataataaacacacataacattatacaaaattatcctttgcttctatatttaacatacattttgttttccacaatgtgtaaaactctctatagaagaaacaccacacaaaaacaccaaataaggtttagctaggatataattgacatgattgaacaagtgggcttgggatatatatcactacaagaatagaaagataaacaaaaatatcttctgcaattcgtggtttgtgaacacaagagaaaaaaaaaaaaaaacatgtcgaccaataaaaaaaagatacaagagaacgaagcataaaaatatcaaaacaaaaagacaaaaacaggaaaatagaaaaaagaaagaaaaattaaaaaaagctaaaatcaacggtgagaagattctgtatataataagaaaatatcacccaaataaaaaaaaaaggtggagtccacagataccgtccatcaacgtatcactgggctctctttctccgtgccgttcctcctacgtgctcgaataacgatgtgccacgtggtggaatcgaaggataaagtgtcgttttttacttcgattacacgtgagtgtatgtatgtgtgagtgagtgaagaagaacaaagagcgaagaaaccccccagcactcacttcatccataagatcattcaaattctgggatcttctctctttctctcattgtattcagtttcttcgtctcggttcgatcatcaggtatctttttcaattgaattttaccttcaatttcgattgctttcggtgtttttgttatttgattcaaattgcaaattttcttttgatagatattttcgttttgactataaaagacgattcttttcttcttagtgtatattgcacatgttccattcgcagaatgaagtaactgtttctctacaaagtgaaaataaaataaaaataacaagtgtggttctcttgtctaactctgtcagattcttctttttgagacaaatagtataacttgttccttttttttctcatctattgcaaaagcttcattgttttccttattatcttattatataatctctactttacttaacagatccggcaagtttgattcagtgacaagaaagcatg

SEQ ID NO: 17491 - DNA, 3000 bp, Unknown; identical to SEQ ID NO: 7813
  misc_feature (1)..( 3000): 2750-1469P.txt file - cDNA_ID_1809408; gDNA_ID_1621165; Annot_ID_57187

SEQ ID NO: 17492 - DNA, 3000 bp, Unknown; identical to SEQ ID NO: 7813
  misc_feature (1)..( 3000): 2750-1469P.txt file - cDNA_ID_1809408; gDNA_ID_1621165; Annot_ID_173815

SEQ ID NO: 17493 - DNA, 3003 bp, Unknown
  misc_feature (1)..( 3003): 2750-1469P.txt file - cDNA_ID_1809414; gDNA_ID_1621167; Annot_ID_57214
gaccacaattagaagcttcttcggcacaaaattgacctccttcttcccattttcagtctccgccacgaaactcaccgcatctacagctgcttcttcccgtttcctattttccaaccgttcttcaacgtagggctgtttgatctcgaaggagaatcgatcggaaccgtttacatcttccatttttccgaaaggtgtcaaacctaatacaaatccaagaagaaagaagacgagaaactggtaaaacggtcgcctccatggacctctacgcgagcttttaggatcagacgttactccgaggagcttggtgagatacgaaagaaattgcgaagaattgtgtttgctgctactaccaccaatggtgaaacctttgtgtgaacctccattctcgtgagaacgatcgtgatacatcggcgagagagttcgccggattgacgccatcagataatctcactccaccgtcctatttttcacagctcccaaatcaaacatccaaaacagcaattttcgcagagatccgcaccaagtttgcaggagaatccgcgtaggatatagcaatttcaatctgaagtcggattgagtaaggtggttggttctaactcaaagtcaccgatctgaaacacgattggaatggatccgtcgccgccgagatctgaaattgagctggcggagaaagttgcggaaaaagcactgtttgtttgtttgttaaaaaaaaatctttaagctatgcgagttcgtgggacacgtggcgagattatggctcgtacactctggcaaaataatgattacgtttaagtttcgaggaaatggtctactatggtaaaaacaataattaaaacataaattggatttagttgtaattgtaaacgctgccaaaaaaagaaaacatgattaataagtaattctaagttttatcatcatataaagtaatggcctctacttacctattatccactatacttgaatgagttctaagttctaattacattgaaaattttatttattttagcggtaataaaaatagatataactcatatgtcaactagatttactattaaatttagcatgcatttcttacatcattgcaacacatatggtacaaaaagatattatattccgttttggtttttaacggtgcaaaaatattagacaaaattttaaaacatgtgtaatttacagtcctttttcgaaagtttgggttattttaataccagttttctataatatcaagcttggcgacgtaatatttgattaagcgattaattttttttgctgtggtgttttttttctttttctttttttttcaagtagaattagatttagtattgtatgtttgaaagcttagtcaaaaaaatttctcagttgttttgttaaatctatttttaacggtacaagcagatatctagtttcaaaaatagatttacataagtttttgtgtcaaaatattaaaaatttatgtagtgatttttaattatttattaaaataaaaatgtttaggtttacaagatgttaaatctattgatttgatctcatggcaaaaaacagataaaaacataaaataaaaacaatcaatttatcgactcaacgtatgttgtgaagcaaacggtatcagataaacgatacacgattctaaagttcttctaaagtgagctacaaaggaaaaaagatggctatgaaaattgtaaagacttgcaaaacaaaaacccaaagtagcataagcctttcattggagggcttcgtaggtagttcgtccatgaacccgtcattaatgaaggattataaataaatgtgatgaatatactgttcttcgtctccatccttctgatcaaacgacttggatgtacaaatccaaggtactctgaagcctacacaccacataggtgtacaaatccataaaatttgagcaataacccgataatatagcagaaagcaaaaaaatgtaatccaaaacctaagaaagtcctataaatgataatcatataagcacataccttgaaaagctcgaagagcttcttaggatcttcttcttttttgttgaattcctcgcggatccacttctcatccttagtggagaagggtttgtaggaatcttcttctggttgatagttgctttgaaagaagaagctccaacaagcatgtgttataagctgtctttctggtgtgggaaacagaactcttatatgaatatttataaaggtgttcattagtttccttcaatgtttacaatcttcctcatgatttcactagagacatccagagtacaaacgacttcgggatcggatgatttcttaagaatttctgaaacttttgtggatacttcagccatagaacaaggatcaaggattttaacaactgagtcattgcaagttatgtttacttttgcatactctcctccagtcatgatagatgattttacaaggagagaaaaacctaacagagaaaggaaaaaaaatcaaagcgtagagagtcgagaggatcatattcgtttacaaaagaaaatagaagatcgttactttagagatgaagatcgtgatggtttcagatagatagagagagagagacgagcgaggaagtgaaagaaaatacataaacttctattttatatcccaccctttttcttactatcaacaaaaaaagaaaattgtttaatgtcggttttccgattgttaaaaatatccgcttaattttcttacacacattttttattacaaaaaccaacttcaaactaaataattatgagggttatatatatgaaggataacaaacaaattacagattaagaaatactataatgaaggataacaaacaaatgacacattaataagaaatacttaaatttggcatgggtccgagatagttgaagactgacccctgtttaagcggattccaacttttaccaccaatttagctctccccaatcttgcttactactttcccttcccaccatctctatccatttttcctatctctctcaaaaaacaaagtgaaaaatataaacggaggatg

SEQ ID NO: 17494 - DNA, 3003 bp, Unknown; identical to SEQ ID NO: 17493
  misc_feature (1)..( 3003): 2750-1469P.txt file - cDNA_ID_1809414; gDNA_ID_1621167; Annot_ID_173879

SEQ ID NO: 17495 - DNA, 3000 bp, Unknown; identical to SEQ ID NO: 7837
  misc_feature (1)..( 3000): 2750-1469P.txt file - cDNA_ID_1809418; gDNA_ID_1621167; Annot_ID_57213

SEQ ID NO: 17496 - DNA, 3003 bp, Unknown
  misc_feature (1)..( 3003): 2750-1469P.txt file - cDNA_ID_1809422; gDNA_ID_1621167; Annot_ID_57212
gaaagtttgaccaaaaaaaaaaaaagaagaaaaacatgaaaagagtcctgtctcaaaagaatggccacaaaataaaataagggtttagagtcctgtttcatatcggcataatagcggagccattctggtcaattgtcacagatttttaatgcagaagattagagtagagcagaaaggaatataaaacttcaacatacgaactcagacctgatcttgcagtggtaacaatagtgataggtcggttcgaagacagcaaacctaccagaaaaatagagatcagacgaagtaaatttaagtcattcctaagtctttcttaatcggctctatcaaataacgtttctgcgtctctttctctcgtccttagctgctatgtctaacatacgatctggttgtggcaatttgtggaagtctatcttactttcacagaggcatatgtttaaaagtgcatgtatgatgattttatctgaattgatggtttgaaatttgaaacctaagtccaaaatatttaaacactggcaatgtcacagattatacatcaaaagaaaaagaggataatagtctggaaatgtgagaacaacaccagaaagcaacagaaagaaacagagcaaggccgagggagaaaccatggagaaggctagaatcaagaaggaagaaaccactgagcatcgttgaagttgaagttggagagaccgtggaagcgtttgacggtctttgttgcaagattgaagacaccgatgtcgaggcatgacaatttattgtgacagatacgatcatcacgagtgaaataaatggagttaggctcaattccaagggtatggtcagcaggcacggtaatacccaaatcatagaagagggcctcatcacctagagaatgtacctcaagaagccgggtgtcgagggttttcgggtcaagatctttaggatccctcttgtacagatggaacatcctgtgactttcagaggtacctaaatcgtacgtaaagacaaccaaaacttgacctgctcttgtaacagcaatgcctttgttagatgggatagacctcttttgcttcatacgttcacgttccttcattgtcatacttggcatccacattggaagcctatgtttctcggatacatccttgaaaccatcttcatcttgtccagacaaatctaagtgtcgaatgaactcacgggtggcatagacgtaaagattgtaacctttcagtaccatatcgtttaaacctcgtaactccctctgaacctcgagctctgttggaatctcgcggtaatgatcatcccctgtcctgcaaaaccctagaaatgggtacatttcaaactgccacacaacaacgtagtttccattcttgtcgtcaacccacaaacgacctctcagatcttcggcagcatgaggaaattcatcacgaaatggatcctcatcatccattagcatatgcttgacattctcctctccttcacgccaaatcttaaaatggctacccttaaatgattctagtggtggaagatcgatcctcttctcgctaaatacatctataatatagagtttcattcgggaatctaccaccagaaaccacttacctgagtttcccaggaatcgataccctgaaaagtcactcttcgtctcgtaaaccctatcattgtatgggttgtacacactattactacgacaaccatccttttctgcagaaagcatcagcaatggagatctggcttttggccgctgaatcaaattcgaacgcagagccttagcagagtcaagcgttagcgtagtagacctttgcattattgggacggagatcgattatctcgtgctgaaaaaattgagcaagggttaaattgtgcacactgtgtgtaaatataggtaccaagcccaataacagcaacaaaaaatattctaacgggtctgtggcccaatataacatcatcatgaattatttttggttattcaagattttgagaaacgtttgtgtgtaaactcatagtcgtagttattcaagattctcttgatattttcaagttgaattttgcaagagatactctcagttgtacaagcttcattggtgtcattagcatatgtcagatcagtgatagtgttgatgggttctcaagaaggtattaatattatgaggttgggaaaaagatatagaattctttatgaattgaaaggaacctattcttaccaaaaaaaaacaaatgctatgtcacagactgtgtttgaatttgagaattacgttcagttgtgtgtttgactcaaagtagacggtattgcgacgatccgttcatggcttcatagtttttgtgtaggcaatggcatgcgatgtttagtgagacatatagtcgattttgtttccacattactactaattcaataaagctatagttagttcaaaatggctgacttttgtttcgaagttgcttagctttgataatagaattattagtttcgaattttatgttagtctttcaaaacgaactagctagtgatgtaaaatcgaatttatctgcacttgtacatagcaaaaactctttattttggtttgtattttgtaaacatcaatgacgtacaaaattggttatgacaaatttaataaaccaaaagaaaaacaaatataaacatgttgtgtagaatgtagataacaaatttctgcaataaggttattcagctgtctgaatgaacctaaactatgctaagatagtgttactataagtcttagttaggtgaacaaaaacggcgctcattggagctcctacaaagtaaaacgacaagttgtttctgcgtatggcggacctaaaagtttttttagaaaattaattgaagccatccggtttttctgttctgcatttttgtaattgcgtaaatcgcctaattgctcttgtgtgctgctgcttctgtgtcgccaagattcttcttcttcaaccttgaaaaaccctaaaagttaaccgccactgcgatacggcaccgtatttgacgtttccgccggacgaatctagaattcagtaatg

SEQ ID NO: 17497 - DNA, 3000 bp, Unknown
  misc_feature (1)..( 3000): 2750-1469P.txt file - cDNA_ID_1809434; gDNA_ID_1621167; Annot_ID_57209
cacggcgatctcaaactttcttattccagctttaagcgagattgcattaaacaaggttgatgagtcggtttctcgctttctcactgaaacaagaaagaaaacaactaaattattgaaataaacacaagcctaagatctagagaacaaagacacgagactacaaaaaaaaaacaagtaacaccaataatcaaatctgaacaaatcttacgtttaagttcgtcgaggacagatttagacacgaatgattgagtttttagaggataaagatgaatagatgataatgaattgatgaaggagaagagatgtgatgatgaatagattggagaagaatgttttttagatcggagaagggctcacttggtttgcaagaggcagtgaagaagcaaaataaaacaaattagggtaattgactagggttaagtttatatatgattgcatattttaataaaccgatcggtccgattaccgaaccgacccgacccgaaatccgaacaccaaaattaaattcgccgaacggttagttacagtatcttcggttttcgccgataaccgaaattatcagtttaatcgggtcggtttgctcggttcctgccgtaatcccaggcctaggaaacacggatggctctccattaaatagtgccttacgtaaaaacaccctgtcgtcttatctttctagagttgcaatgagggctgttttctgttacctatccaaaagccctttctttaaacgcagtttttatcttttaagacagctttcgttaaactgttaaaagaaaatgaaaatgcgatgtgaacaaattagaaagcaccaataaaaacatgccacatacattttctatttaataatttaattttcataaaaataaatcaaaacaaaattgagatcgtgcaaaacagaaaaaattttttaaaaaaaacaaaattaattattaaccaaaaaatatgggcttagtaatggaaagaaaaactttctaaaaaataaaattcaagccaatattgatatgcaaaaaaaaaaagtgtaaaaaatcctatattccttaatttgctcctaccaaccccttcacgatcaagctaaaatcaaagcatgttttattaaccgattttctctatttaatcattttttctattatcttccatttttttcttctcttgtggatgctatagaaactactatggaaattctattcaagttagcgcttaatttttctttatattcattcatttgctatttaactcatattaattgtgattttattgtacttatgttttccaaattacaaattattagtagtttaacgattttgttgttaataaacaaatacaaatatttgtattttgttgttaattatttgttgcacaaaataaacaaatacaaatattgcaacctgttgttaataatttgttagttttttaagctaatttttcttagttaactttacaaaatttaaatattgtctaaaaacagaaaaataaataggatttttagatagtataggatccacttttattttccaaaccctttaattatgattgaatctctactgctctctatcaacctcaatcttaacttgtccccgtacgtagtacggggtagaatacttgtatattagaaatttgatagtttttttttggagtcagaaatgtgttttatttattgtataaaaccaatataacaggccaagattttacttatatttaaaaacaaacaaacgtaagaatagaaaacaaaagtccaattaagtgaaccttaaactgaagataaagttgtatacagtacaaacacatgtcaattgagaaccaggttgaaagacacgttgaagaagttggagtcaccgatagattgttgcgacgtcagaaagctccaattccaccaaaaacatcataaatctcattcaatttacatatttatatatttgcctaaagaaacaaggtaaaatcccaattttagctttgttgagaatatgactccatttattgtagatctgtaaattttcttcatcttcttcttcaatcaacaacttttcaaccttcaatttttttttttttttacgtcaaccgatattaacttttcaaccttcaaaaaattttgttgttcacaaaatatatacttgtttttattgaaaaagttcttactatccaaaatatttgttccatcattaaaaatcgaaatagtcggaaaaagaaaaaacaaaagcgagaccaaacctaaacggtccggagaagaagctagcctatcattaccgaaagaccgctaaatccgaagccagagccgaccaccaatgttgattaaaccaccgatgtcagaaacatagccggatgaatatgcaaacgaaggcatctacaccggaagcaaagccaatctatatataccgttgagaaagctggtacaaccaaacgacaaacccacctcaaatgagataaaagtcaacgaaaaaatacatcagagaaatctgagagaatgaaaaatgaaagagagaagagagagaaaccttagaaatttgatagtttatacaggaaaaatacattaaaataatttagttttaaattgtaatgctacttgtcgtaaaaaaaagaaaaaaaaaatttcgaaatactacttagtaatttgaaaaaagaaaacaatattcaaaaaatttccatgttagcgcaaaaaaaaaaaaaatctataatcaaaccaaaccaaaccgaaacaaccaaaaccaacattaaacctaaatctcatgatttttgatttgaataaccacgagttcaccaatccctcttctacattcagtatttaaaatctttataaacacagttagacacataaacgtttctgaaaatcttgaataaccaaaaatgatccataatgataatgatgttacattgggccataggcccgttaaaatatttttctcttgctgttattgggcttggtactttatatatacattatcaaaagacgagaaaatctccgtcaagatgcagagatctactacgcttgagtctgctaaggccatg

SEQ ID NO: 17498 - DNA, 3003 bp, Unknown
  misc_feature (1)..( 3003): 2750-1469P.txt file - cDNA_ID_1809446; gDNA_ID_1621167; Annot_ID_57205
ctcggtgccataaggcccgaatgcacccacatatagacctgcacttagaattcagaacatatttcaagttgagttgtacaaaaacattctgagtccaaatcaaaagaaagagaataacactaatgcacaacatgcttaccatcaaaagggtctaagttgctttcaggagttatgattctattaaatgctgtatactcggagagatggtttcctttttgtgcctggtttatagcaagcttgacaatctcatgcacatgtttcgatacctagaacaataatcaaacaacctttatatctaaaaacattaacacgacaacgtaaaagaggttttaaataataacaaactcctagatctgattctagaggttaactttataaaaagcggtgtaaattcaagtaatataccttcaaagaagctttctctccccagaacgcctcggcaacctctggtggcaacagatctgaaagtccttgagctgcaagagctgttacttgttctttggacactctatttttccttgtatcgatatccctcttacttctcccaggaacatgcaatataaaggaatctctttcagtatccattatatttgccgacacacggacaatctcatcatctatagaggaatcctctatgttatgtagaacccctccgatgacaagcttagtgtttgaatgctttccataatctgcactatccatagatgagattgcttcaatactgtcattttcttcttcttctacttcttcttcatcatcagaagaatttgtttcctcagtgccttctccaaccagctcttcagtagcgtcatcactgccaacaatctcttcctcagggattttaataacatccattactttcagttttagccctgggattttatcttttagaaattttatcacatttttaattccttcttcagttggttccccagcatttagttgtgtatcttcttttttatccaccttcagttcacttcctcgtacatctaaaatggatgggtcattgatcgaggatttcgaggattgctgtacttttgaaaaggaattctcggaaatggttaggttttgcttcacgtgttgcacatacaccacctaaacacagcagataggtacatatcacttcaaaagggttaatcagtgattatcgaaacttcagagaagtttagagcagcaattatgaaacactaatcttatacaataatacaagatacaggtaaaaggatatactgtcaccagaactgttacttaattaaatgtgattttctcaaattacctgcataacatatcctccgtcagtgtctttaataacgaaaatctcaaacaggggtgttccagctgcttcagccaccagctgtctgtaagaaacagtaatgagattcaattatcaccagcaactgagaaaagatttaaatcctcagcataacctgctctcaccttggactgtaactcttgccaataaacctaccaacacctggagttatgtgtacaattctgccaaatggttcctcagaatctcgaggtaaaccaacccaccaacccacctatataaacatcagaaacgtgacaaatgcattgaaattctaaaacaatcatcgtctagataaaagcatagattcttgactagagatttgggtaacactgaaaccatgaagcaatccttgataagttgactaggtgaaaccatcacttatgtcaggaaacatatattacttcaactaaccttaactaccttaatagtttacagacatgtaacctattttcttgattcaaatgtgtaagagtcgtctagtaatatcttacaagctaaacaagaaagaacaaagtataaaggacggtaaacaaaattaccagtccacttcctgtctcgttacataacctggaagcatcatggtaacgctcttcgtttactgcagtctgcaaggaagttaatcatatataagtaagaagataacataagagtttgatgtaataaaaaaacacacatatataaacctgtaactggcgcatgatctcagcgacagcatcatcaacagtagcttctgaaatagcttgtttcaacttgactgcttcttcaaagtcttctttttcaacagcatcctcaagttgagactgttacataagctagaagactccaaatttagaaatctataatcaaccaataatcgaacaaaaaatcatcaatagtagacagagtttagatggatagaaccttgagaagagaaacaacgctctcgacttcttcaatctcggagaagtgacggttccaacgatcccaatcccaatcccacttatcctcactcgaactagtatcagctccatcaacagcggcgcaatttcgcagacagcttaaagatggggctttagggttacaggttgatatagaagaagcgaaggaatgtcgtagaccgatagatacggagaaatttgtgcgtttgttggtcgagagctccggctttagagaatttctggggctgaagaggatgtgaaattgaggaacagcgattatttggccgataagacatggttgagttgtcgccatcggaggacgttatcaccggaatctctcaccgtgctgagaggctttgctttagtttttgacacctcaggacatgtatggatggataggttttaacttttaactttagctagagatggtttaagggcaatttggtaaaatagcaatgcaaaggctgagtttttcttattttcctatgattttttttttttttggttctggtattttcactttttgggaaccaaccaatcaatatcttttaaaattttataatattttctgctctttgactttcgttttttaccaaaagggcaaaatggtaattgaaagaagggaacaaatccccagttagagaagaactgacgttgttctaatcgagagatcagacgcggcggagactggcggagatgatgaattcataaattccttcttctcctttcctctcttttcatttgattggcttcttacacagcttcgtcatcatg

SEQ ID NO: 17499 - DNA, 3003 bp, Unknown; identical to SEQ ID NO: 17498
  misc_feature (1)..( 3003): 2750-1469P.txt file - cDNA_ID_1809446; gDNA_ID_1621167; Annot_ID_173866

SEQ ID NO: 17500 - DNA, 3000 bp, Unknown; identical to SEQ ID NO: 7833
  misc_feature (1)..( 3000): 2750-1469P.txt file - cDNA_ID_1809450; gDNA_ID_1621167; Annot_ID_57204

SEQ ID NO: 17501 - DNA, 3000 bp, Unknown; identical to SEQ ID NO: 7782
  misc_feature (1)..( 3000): 2750-1469P.txt file - cDNA_ID_1809454; gDNA_ID_1621162; Annot_ID_57149

SEQ ID NO: 17502 - DNA, 3003 bp, Unknown
  misc_feature (1)..( 3003): 2750-1469P.txt file - cDNA_ID_1809454; gDNA_ID_2926183; Annot_ID_140651
cactatttgacttactataaagtttttgttctaaagtattactaatttattttttcaataataccacaatttttatataaaatctattcaaccaaaataaatttgaaataaatttaaaatataaaatttggatattctatttctaatttagggtatatatttcaaccatttaaaagaaattttgattcatttgaatattagtttatggtattatatttggtttctaattttcaatttagggtatatatttttactatttttctaaaaaattgactcaatttaatattaaattagtgtttgctcttaattttattttctattttatattttcattaaatttaattaaagtttatagtgttagtttgtgaaattttaaaaatattgtgttgattttggaagaaaacctttttggtgctatatttgtcaatagctctattttatattagtcataaaaaataaaataaaaatatctcaaatattttgactccaaaaatattaaattaatgacatttctttgttcattcacacctgagagtaaagaagtgagaaggagaagaaagaagcaatggagaagatagagcacacgacgatatctaccaatggtattaacatgcatgtggcttcgattggttcaggtccagtgatcctattcgtccatggctttcccgatctctggtactcatggcgtcaccagcttgtctctttcgctgccttaggttaccgcgcaatcgctccagatcttcgaggatacggcgattccgatgcgccgccgtctcgtgaatcttacaccatccttcatatcgtcggagacctcgtcggattactggattcgctcggtgttgatcgggttttcctcgtcggtcacgattggggagcaattgttgcgtggtggctttgtatgatcaggcctgatcgagtcaacgcgttggtcaacactagcgttgtgtttaatccgaggaatccttctgtgaaacctgttgatgcgtttagggctttgttcggcgatgattactacatttgcaggtttcaggtaatactttaaactcatgaacacttaattgaaatgaaaattagggtttggtgaagttctcagtggttgaaatcaaagacatacttagggtttattgatgattactgttcatgatttgatcacgttaatgatagattggttgattatgaacaagagttgtggcaaattgctttatagccaatgcttctttggtgtttagttatgagatcaagttattgaaccgatttgagatagatgtatatttaggcgattgctttttgccatgccttgatactgcttcaagaaagttgagctttttatgtgtaaatgtatacacaatgagaaatttcttagccactattagtttctgtttgtgtctatagaaacagagaccagccacctacctatacatagctgaacttagctcaggctctgactctgataatgcaagttgctattgatgattagaaaaaggcaattagtgcttactttaatatagtgcagtcaaagtcaaagtcatttactttatttgagttacttgctttaagtaaatgtagttggatcagtcttgtggtcttcaattgcttaagttggtcctactaaagattttgagtttcttttttctcaggagcctggagagatcgaagaggactttgctcaagttgatacaaaaaagttaataaccagatttttcacttcgcgtaacccacgtccaccttgcattccaaagtcagttggtttcagaggtttacctgatccaccttctttgcccgcttggctcaccgaacaagatgtcaggttctacggagacaagtttagccaaaaaggcttcaccggtgggctaaactactatcgcgccctgaacctgtaagtcttatgaattctagccacctattctacatcatacaatcatcttttcatggttaatcttggacttgaatcaatctggtcttatcctaacctgcagaagctgggaactaacagctccatggaccggtctacaaatcaaagtccctgtgaaattcatagtgggtgatctagacataacatacaatatccccggaacaaaggaatacatacatgaaggtggtttgaagaagcacgtaccttttctacaagaagtggtggtaatggaaggtgtaggtcacttcctccatcaagagaagcctgacgaggtcactgaccatatctatggcttcttcaagaaattcagaacccgcgaaaccgcatccttgtagtagttctccgtctgcacaatgtcaaattcaaggttgattaagcttgatcagggttacttactgtcttagagccctactatgtaatgttttcaaggatgctatctgtgtattgtgcttgtttaataatttagcaaaatataataatagaacaaataatttctcaaatgttggccatctccagttcaatatatccttaaacttttcttatgtccaaattaattttcaaaatgttgaattcctatggtttctagaaaacttcaattaagcatagatgattttttttaggtgaaattaatatcaaaaaactgaaatatatgtacaattttatcaaaaattataaatctactaaggacatttatacctaccaactgaataaattcaataaaatatataataccaatgttttttttttgtcaacagaattggtgtattaattttttggcagtggatattttcaacaaaatctaaagcgcgttcgaccacgcgcctgtgacgcgtaaaactcagtttgacaaatattcacaattaattgaagacgccagtcagaagaaaaaaccactacgcagcttgaaaagacaaacacaccctcgtcttcttccgtcgcaccgcttctacagcaatgtcattttagtcaaaccccaaaattcgagctccctttgaagaaaaaaccaccaaatcagtttcgttgtcccaaatccaaaattcctccttcttcttcgctgtaacgctttatacctaatcggagataaaacaatg

SEQ ID NO: 17503 - DNA, 3003 bp, Unknown
  misc_feature (1)..( 3003): 2750-1469P.txt file - cDNA_ID_1809460; gDNA_ID_1621162; Annot_ID_57146
ggagttcgtcgactttgagcttgttcgccattttcgtcttcttcttcaggagaatagttcgtcggaaagggaatgagactgaggaagtatggttttcgtcagaagtgagttcgcgcgagcatttgaagagtcttcttcttcgttttcttcttcatcgatggcttcccttgaaagctttagggctttttgaaaaattattttaaatttttttgacaaaagttctcgttcatatttgtggatatttcccatataactttttaatctccaaaagaccccaaacttttggattgattcttaaatccacccctgacctttttaaaatagtatttatttcctaccattgatgatggcaagcaatagaaaatcatgaaagataaaaaaaaaaaggttaaaaatctagtaacaggcaaatactttgaaaaggagttgaaattttgtacataggtttaactcttctattaaaagaaacaaaaaatctctatgttttaaaatgtactactaatttataatttaagaacatttttctgaaaattttgctggttgtttaacgaaaagaaaaatatacaaatagtttttggctgtaatgctacgccactactcacttttccaaggacgtgcatacaaattaccgtaaacggattataggacttgtgttgactaatgacacaattcttttttattaaaagagattagtctccttgaagaaaaagggacacaaattattcgtaacatgttaatcaaaccaaggtcttaagtggctaccaaccgcatacgagtgttgagccgagcagtgctgtgtcgagccgggctggatttggcatttggaatatatgaaatgggccaacaacccaaaagataaaatttcgttacttggacagtaaaaactaaacatgcatgtttattagcccgtaatctgcataatcacaacttacgaagaagacataagaatcaacaggcccatcataaagtgggactaacgatttggtttccactattatttggcccatatattgttaatattgtacacttcaaatattatttagttagaaaaaaaaaaaaaaaaactcttgtaaaactggatggttctagtttagttttaaaaaatggttagatgataacgatattaatatacgataaagtttatataaaatatcttttcataaccaaatttacatgacaactaacattcgggtaagccatgtaaaagacgagatagagattttgaccaaagaagaaaagtagagagaacatgcaaaagccaaaaagaaaacatagccaaatggttgagtggtgtagatggaccgaaccaacagacatgttctcagttcatataccaaccgcctaacattacagcctgtccccatcccctatctttatttttctttttggctcatttagcttcaactttttttaataggtgtgattagaacatactaaaaaaaacatatgttttaacttatattatatgaataaagtgttgtttttaatagtttatatttctattacaagtacaatatataggatattttggttaacaattttaaatttaaaagatattgtgagtacaaatcattaagcttaacacaaatgttcattgcttcttaattcttacaatcggaaaatttggacaaaaaatctagactaatctccaaaacattgtgaaaaattgggggttttttttatcatttaaattgtctatagtggtcaatcattattaaaaaaaattgttttttgttgaaattttaaattataaaaaaaaaacacgtttatacataaaatgcaaaaacttttcttaaaccaaattacagagaaaggctatcaccatccttgtcttgatgccaaccacacttgtaatcccaaaatacatacttaaactatactatactaacatgaattggttatacgattatctatctagttagctacataattcatataattagttttttaaaatatacttatgtaatgatagtaactaaaaaatatactatctcgagaaatccaaccaaaatgctatgatagtatataaaataaaatgaaagaaagaggaaccaagttgtgaaaccatttaccaagaagaagaagaaaaaaacaagatggtcgagtctcgtgatagtatgaagctggggccgaaaccacgaatcaaagaaccatttgacgatgcaagtggtcatcgataaccaatcaatagaaactccaccgcctcaaaatatcatagtgctatttaatttttcatactatcatttattgtaggctataacatatttttgtattgtagatggacggctagtacacgcaagttagtcaataaacttttaacaaatggcatcttgacatgcttaaacacattttataattcgaacctcactttgcctactttacacacgtctacttatagtagatgagcatcaatcattgaaccgttcgtataatacaattttttttttgtaatacgttataattagaaagtaatggaaaataagttgaaacacaaattttcaacggttttactaagatttaattttacaattttcaaaatataaccgaattatttaaatcgtattaaatttataattaattttctaaaaaaaaacacagattaaaaaaatatattaaaactaatcataaatatattaatttttgtaatttatatttttttataactttaaactaataatattcaattatttatcttaaagtttacaaattatcaataataactaataaataatgcataaaaactttttaaaaattaactttttgaaacaaatttttttctaaaaaattaaataataaagaacagaaaaaatattattcaactaaaaatattggataataactctgaaagtttgcatttttcaaataaatcattgattttttttgtttgacataaaacattaatttccccttgtaaatcacacatttaaaatctaactatatttaaacaaaaaaaaaaagtccaattttgactttaattatataaaaaaagcaaagctaattatg

SEQ ID NO: 17504 - DNA, 3003 bp, Unknown
  misc_feature (1)..( 3003): 2750-1469P.txt file - cDNA_ID_1809460; gDNA_ID_1621162; Annot_ID_173732
ttatttcctaccattgatgatggcaagcaatagaaaatcatgaaagataaaaaaaaaaaggttaaaaatctagtaacaggcaaatactttgaaaaggagttgaaattttgtacataggtttaactcttctattaaaagaaacaaaaaatctctatgttttaaaatgtactactaatttataatttaagaacatttttctgaaaattttgctggttgtttaacgaaaagaaaaatatacaaatagtttttggctgtaatgctacgccactactcacttttccaaggacgtgcatacaaattaccgtaaacggattataggacttgtgttgactaatgacacaattcttttttattaaaagagattagtctccttgaagaaaaagggacacaaattattcgtaacatgttaatcaaaccaaggtcttaagtggctaccaaccgcatacgagtgttgagccgagcagtgctgtgtcgagccgggctggatttggcatttggaatatatgaaatgggccaacaacccaaaagataaaatttcgttacttggacagtaaaaactaaacatgcatgtttattagcccgtaatctgcataatcacaacttacgaagaagacataagaatcaacaggcccatcataaagtgggactaacgatttggtttccactattatttggcccatatattgttaatattgtacacttcaaatattatttagttagaaaaaaaaaaaaaaaaactcttgtaaaactggatggttctagtttagttttaaaaaatggttagatgataacgatattaatatacgataaagtttatataaaatatcttttcataaccaaatttacatgacaactaacattcgggtaagccatgtaaaagacgagatagagattttgaccaaagaagaaaagtagagagaacatgcaaaagccaaaaagaaaacatagccaaatggttgagtggtgtagatggaccgaaccaacagacatgttctcagttcatataccaaccgcctaacattacagcctgtccccatcccctatctttatttttctttttggctcatttagcttcaactttttttaataggtgtgattagaacatactaaaaaaaacatatgttttaacttatattatatgaataaagtgttgtttttaatagtttatatttctattacaagtacaatatataggatattttggttaacaattttaaatttaaaagatattgtgagtacaaatcattaagcttaacacaaatgttcattgcttcttaattcttacaatcggaaaatttggacaaaaaatctagactaatctccaaaacattgtgaaaaattgggggttttttttatcatttaaattgtctatagtggtcaatcattattaaaaaaaattgttttttgttgaaattttaaattataaaaaaaaaacacgtttatacataaaatgcaaaaacttttcttaaaccaaattacagagaaaggctatcaccatccttgtcttgatgccaaccacacttgtaatcccaaaatacatacttaaactatactatactaacatgaattggttatacgattatctatctagttagctacataattcatataattagttttttaaaatatacttatgtaatgatagtaactaaaaaatatactatctcgagaaatccaaccaaaatgctatgatagtatataaaataaaatgaaagaaagaggaaccaagttgtgaaaccatttaccaagaagaagaagaaaaaaacaagatggtcgagtctcgtgatagtatgaagctggggccgaaaccacgaatcaaagaaccatttgacgatgcaagtggtcatcgataaccaatcaatagaaactccaccgcctcaaaatatcatagtgctatttaatttttcatactatcatttattgtaggctataacatatttttgtattgtagatggacggctagtacacgcaagttagtcaataaacttttaacaaatggcatcttgacatgcttaaacacattttataattcgaacctcactttgcctactttacacacgtctacttatagtagatgagcatcaatcattgaaccgttcgtataatacaattttttttttgtaatacgttataattagaaagtaatggaaaataagttgaaacacaaattttcaacggttttactaagatttaattttacaattttcaaaatataaccgaattatttaaatcgtattaaatttataattaattttctaaaaaaaaacacagattaaaaaaatatattaaaactaatcataaatatattaatttttgtaatttatatttttttataactttaaactaataatattcaattatttatcttaaagtttacaaattatcaataataactaataaataatgcataaaaactttttaaaaattaactttttgaaacaaatttttttctaaaaaattaaataataaagaacagaaaaaatattattcaactaaaaatattggataataactctgaaagtttgcatttttcaaataaatcattgattttttttgtttgacataaaacattaatttccccttgtaaatcacacatttaaaatctaactatatttaaacaaaaaaaaaaagtccaattttgactttaattatataaaaaaagcaaagctaattatgggtcaaaagactcaaaggccagaattgacgcagccgtttatgagaagtgagaagacaatttcggagtcacttcctttatttcctctcttccttcactctctcctatataaaccttcctctcctcttcctctcttctcatctcttcaaaccattttcgaaagccttgagagagagaacacagacgataccaactttcttcaatctcgttgccgcagtataattatctcattcctcggatatatctctccttctgcggcggcgacaagaagctacaagaataaaaagtctgttttctctcttttcaagaaaccacttacttcgaaaatg

SEQ ID NO: 17505 - DNA, 3000 bp, Unknown
  misc_feature (1)..( 3000): 2750-1469P.txt file - cDNA_ID_1809460; gDNA_ID_2926183; Annot_ID_140654
gttcgtcgactttgagcttgttcgccattttcgtcttcttcttcaggagaatagttcgtcggaaagggaatgagactgaggaagtatggttttcgtcagaagtgagttcgcgcgagcatttgaagagtcttcttcttcgttttcttcttcatcgatggcttcccttgaaagctttagggctttttgaaaaattattttaaatttttttgacaaaagttctcgttcatatttgtggatatttcccatataactttttaatctccaaaagaccccaaacttttggattgattcttaaatccacccctgacctttttaaaatagtatttatttcctaccattgatgatggcaagcaatagaaaatcatgaaagataaaaaaaaaaaggttaaaaatctagtaacaggcaaatactttgaaaaggagttgaaattttgtacataggtttaactcttctattaaaagaaacaaaaaatctctatgttttaaaatgtactactaatttataatttaagaacatttttctgaaaattttgctggttgtttaacgaaaagaaaaatatacaaatagtttttggctgtaatgctacgccactactcacttttccaaggacgtgcatacaaattaccgtaaacggattataggacttgtgttgactaatgacacaattcttttttattaaaagagattagtctccttgaagaaaaagggacacaaattattcgtaacatgttaatcaaaccaaggtcttaagtggctaccaaccgcatacgagtgttgagccgagcagtgctgtgtcgagccgggctggatttggcatttggaatatatgaaatgggccaacaacccaaaagataaaatttcgttacttggacagtaaaaactaaacatgcatgtttattagcccgtaatctgcataatcacaacttacgaagaagacataagaatcaacaggcccatcataaagtgggactaacgatttggtttccactattatttggcccatatattgttaatattgtacacttcaaatattatttagttagaaaaaaaaaaaaaaaaactcttgtaaaactggatggttctagtttagttttaaaaaatggttagatgataacgatattaatatacgataaagtttatataaaatatcttttcataaccaaatttacatgacaactaacattcgggtaagccatgtaaaagacgagatagagattttgaccaaagaagaaaagtagagagaacatgcaaaagccaaaaagaaaacatagccaaatggttgagtggtgtagatggaccgaaccaacagacatgttctcagttcatataccaaccgcctaacattacagcctgtccccatcccctatctttatttttctttttggctcatttagcttcaactttttttaataggtgtgattagaacatactaaaaaaaacatatgttttaacttatattatatgaataaagtgttgtttttaatagtttatatttctattacaagtacaatatataggatattttggttaacaattttaaatttaaaagatattgtgagtacaaatcattaagcttaacacaaatgttcattgcttcttaattcttacaatcggaaaatttggacaaaaaatctagactaatctccaaaacattgtgaaaaattgggggttttttttatcatttaaattgtctatagtggtcaatcattattaaaaaaaattgttttttgttgaaattttaaattataaaaaaaaaacacgtttatacataaaatgcaaaaacttttcttaaaccaaattacagagaaaggctatcaccatccttgtcttgatgccaaccacacttgtaatcccaaaatacatacttaaactatactatactaacatgaattggttatacgattatctatctagttagctacataattcatataattagttttttaaaatatacttatgtaatgatagtaactaaaaaatatactatctcgagaaatccaaccaaaatgctatgatagtatataaaataaaatgaaagaaagaggaaccaagttgtgaaaccatttaccaagaagaagaagaaaaaaacaagatggtcgagtctcgtgatagtatgaagctggggccgaaaccacgaatcaaagaaccatttgacgatgcaagtggtcatcgataaccaatcaatagaaactccaccgcctcaaaatatcatagtgctatttaatttttcatactatcatttattgtaggctataacatatttttgtattgtagatggacggctagtacacgcaagttagtcaataaacttttaacaaatggcatcttgacatgcttaaacacattttataattcgaacctcactttgcctactttacacacgtctacttatagtagatgagcatcaatcattgaaccgttcgtataatacaattttttttttgtaatacgttataattagaaagtaatggaaaataagttgaaacacaaattttcaacggttttactaagatttaattttacaattttcaaaatataaccgaattatttaaatcgtattaaatttataattaattttctaaaaaaaaacacagattaaaaaaatatattaaaactaatcataaatatattaatttttgtaatttatatttttttataactttaaactaataatattcaattatttatcttaaagtttacaaattatcaataataactaataaataatgcataaaaactttttaaaaattaactttttgaaacaaatttttttctaaaaaattaaataataaagaacagaaaaaatattattcaactaaaaatattggataataactctgaaagtttgcatttttcaaataaatcattgattttttttgtttgacataaaacattaatttccccttgtaaatcacacatttaaaatctaactatatttaaacaaaaaaaaaaagtccaattttgactttaattatataaaaaaagcaaagctaattatg

SEQ ID NO: 17506 - DNA, 3000 bp, Unknown
  misc_feature (1)..( 3000): 2750-1469P.txt file - cDNA_ID_1809460; gDNA_ID_2926183; Annot_ID_200411
tttcctaccattgatgatggcaagcaatagaaaatcatgaaagataaaaaaaaaaaggttaaaaatctagtaacaggcaaatactttgaaaaggagttgaaattttgtacataggtttaactcttctattaaaagaaacaaaaaatctctatgttttaaaatgtactactaatttataatttaagaacatttttctgaaaattttgctggttgtttaacgaaaagaaaaatatacaaatagtttttggctgtaatgctacgccactactcacttttccaaggacgtgcatacaaattaccgtaaacggattataggacttgtgttgactaatgacacaattcttttttattaaaagagattagtctccttgaagaaaaagggacacaaattattcgtaacatgttaatcaaaccaaggtcttaagtggctaccaaccgcatacgagtgttgagccgagcagtgctgtgtcgagccgggctggatttggcatttggaatatatgaaatgggccaacaacccaaaagataaaatttcgttacttggacagtaaaaactaaacatgcatgtttattagcccgtaatctgcataatcacaacttacgaagaagacataagaatcaacaggcccatcataaagtgggactaacgatttggtttccactattatttggcccatatattgttaatattgtacacttcaaatattatttagttagaaaaaaaaaaaaaaaaactcttgtaaaactggatggttctagtttagttttaaaaaatggttagatgataacgatattaatatacgataaagtttatataaaatatcttttcataaccaaatttacatgacaactaacattcgggtaagccatgtaaaagacgagatagagattttgaccaaagaagaaaagtagagagaacatgcaaaagccaaaaagaaaacatagccaaatggttgagtggtgtagatggaccgaaccaacagacatgttctcagttcatataccaaccgcctaacattacagcctgtccccatcccctatctttatttttctttttggctcatttagcttcaactttttttaataggtgtgattagaacatactaaaaaaaacatatgttttaacttatattatatgaataaagtgttgtttttaatagtttatatttctattacaagtacaatatataggatattttggttaacaattttaaatttaaaagatattgtgagtacaaatcattaagcttaacacaaatgttcattgcttcttaattcttacaatcggaaaatttggacaaaaaatctagactaatctccaaaacattgtgaaaaattgggggttttttttatcatttaaattgtctatagtggtcaatcattattaaaaaaaattgttttttgttgaaattttaaattataaaaaaaaaacacgtttatacataaaatgcaaaaacttttcttaaaccaaattacagagaaaggctatcaccatccttgtcttgatgccaaccacacttgtaatcccaaaatacatacttaaactatactatactaacatgaattggttatacgattatctatctagttagctacataattcatataattagttttttaaaatatacttatgtaatgatagtaactaaaaaatatactatctcgagaaatccaaccaaaatgctatgatagtatataaaataaaatgaaagaaagaggaaccaagttgtgaaaccatttaccaagaagaagaagaaaaaaacaagatggtcgagtctcgtgatagtatgaagctggggccgaaaccacgaatcaaagaaccatttgacgatgcaagtggtcatcgataaccaatcaatagaaactccaccgcctcaaaatatcatagtgctatttaatttttcatactatcatttattgtaggctataacatatttttgtattgtagatggacggctagtacacgcaagttagtcaataaacttttaacaaatggcatcttgacatgcttaaacacattttataattcgaacctcactttgcctactttacacacgtctacttatagtagatgagcatcaatcattgaaccgttcgtataatacaattttttttttgtaatacgttataattagaaagtaatggaaaataagttgaaacacaaattttcaacggttttactaagatttaattttacaattttcaaaatataaccgaattatttaaatcgtattaaatttataattaattttctaaaaaaaaacacagattaaaaaaatatattaaaactaatcataaatatattaatttttgtaatttatatttttttataactttaaactaataatattcaattatttatcttaaagtttacaaattatcaataataactaataaataatgcataaaaactttttaaaaattaactttttgaaacaaatttttttctaaaaaattaaataataaagaacagaaaaaatattattcaactaaaaatattggataataactctgaaagtttgcatttttcaaataaatcattgattttttttgtttgacataaaacattaatttccccttgtaaatcacacatttaaaatctaactatatttaaacaaaaaaaaaaagtccaattttgactttaattatataaaaaaagcaaagctaattatgggtcaaaagactcaaaggccagaattgacgcagccgtttatgagaagtgagaagacaatttcggagtcacttcctttatttcctctcttccttcactctctcctatataaaccttcctctcctcttcctctcttctcatctcttcaaaccattttcgaaagccttgagagagagaacacagacgataccaactttcttcaatctcgttgccgcagtataattatctcattcctcggatatatctctccttctgcggcggcgacaagaagctacaagaataaaaagtctgttttctctcttttcaagaaaccacttacttcgaaaatg

SEQ ID NO: 17507 - DNA, 3000 bp, Unknown; identical to SEQ ID NO: 7772
  misc_feature (1)..( 3000): 2750-1469P.txt file - cDNA_ID_1809467; gDNA_ID_1621162; Annot_ID_57144

SEQ ID NO: 17508 - DNA, 3003 bp, Unknown
  misc_feature (1)..( 3003): 2750-1469P.txt file - cDNA_ID_1809467; gDNA_ID_2926183; Annot_ID_140656
aagacaaagaattattggtctgacagaaaggagtttatcccacatcccaagtcctatacatggctcgaaatggattacggaaaagaggaaaatgattcaccggtgagtgttttggaatcctcacttctctttctcttcttactatttgttgtgtggtatgatccaagggatctgctggaatgaggtttttgagtgcatatctacttttctttttcccgtttaattgcaattatatattttttttctcttcgttcaaatgtgcactttactcagagttcacgattgttttttttctcaggtcaataatgatattccgagttcatcttccgaagttaaacctgaacaatcaaaactagatactcgggttgccaagttcatctctcttatatgtaatgtcagcatgatggcacagcatatgatggaaataggtttgagtctaactttgatcacttcattcaagtgagagcatccattggcagattaacagtgatttttatatgtcgatacattatctctttgttttggtgtcctattacctgcgtttgtacttcctatcttttgtcctatccatttgtttgccattttgctggtttctttacttcttgctgatttttcatacatcttctaaatttggaattgaaggatataacgctaacaaattgccactcggcaagataagcaagtccacaatttcaaaggtaaagatagtaaacagtctgtttggtctcatttccgtaaattatagtttggtgtgatttcagatgatataatctcctcttccacatgtctagggttatgaagtgctgaagagaatatcggaggtgattgatcggtatgatagaacgaggcttgaggaactgagtgggtatgtatctggttaattgctagacaatttttcgcatttagttgattatgtaactgtttcccataaagaaattagatttgaactagtctaactttgtttatcattgatgcagagagttctacacagtgatacctcatgattttggttttaagaaaatgagtaagttcatctgtgctaaggtttacgatatatataactaaacattcactaacatctgaattccgagctgtaacaggccagtttgttatagacactcctcaaaagttgaaacagaaaattgaaatggtaatttttcctactgtttccttacttgactagttttggtcttcagaaaagcaatggtttgtcgctacatgttttgtgtagtttttaatatatcgtttttttgtaaggttgaagcattaggtgagattgaactcgcaacaaagttgttgtccgtcgacccgggattgcaggtaattcagtcagtctatgtggtttgaaggcatgaaatcactccgtcgtatagttctctaagaatatgacattattttttgcaatggctgtaggatgatcctttatattatcactaccagcaacttaattgtggtttgacgccagtaggaaatgattcagaggagttctctatggtaaattttcggttttgtgaactttgaacaaatatctttgatactcgagcatctcaaacatgtctgtgttttaaaccttttggtgtttactccttaaaaccaaaatcaggttgctaattacatggagaacactcatgcaaagacgcattcgggatatacggttgagattgctcaactatttagagcttcgagagctgttgaagctgatcgattccaacaggtatgttatggtatttcgagcttgtcagtaccatacacattattctgatttctcgtttttggcattgtgagactttaatttttcttggcagttttcaagttcgaagaacaggatgctactctggcacggttcacgtctcactaactgggctggtattttatctcaaggtaacatgttactctttttcctcttagtaactactttttttcttctcctcttgggggattttcaattgcatagtaaaatgaacaactatgagacaccaagcaggtctgcgaatagctcctcctgaagcgcctgtaactggttacatgtttggaaaaggggtttactttgcggatatgttctccaagagtgcgaactattgctatgccaacactggcgctaatgatggcgttctgctcctctgcgaggtatactcgcttcttgtctctattcatatagaaaacaacaaaactactgtataactacaggacctctatagccattcaacataactatccttatgtttcctaacgataaaaacttctctaggttgctttgggagacatgaatgaacttctgtattcagattataacgcggataatctacccccgggaaagctaaggtatgaagataatctcattcatatttcacacaagttccttatctcaaaccgcaatgaattatgatttactatttttgtactgtaccttgatttgttatttgatggttgcagcacaaaaggtgtggggaaaacagcaccaaacccatcagaggctcaaacactagaagacggtgttgttgttccacttggcaaaccagtggaacgttcatgctccaaggtttttgtttttgtcttgcttcaacacacattcacaaaatctaactctctcaaatttcataaactgactttatataacttttgcaggggatgttgttgtacaacgaatatatagtctacaatgtggaacaaatcaagatgcgttatgtgatccaagtcaaattcaactacaagcactaaaacttatgtatattagcttttgaacatcaactaattatccaaaaatcagcgttttattgtatttctttcaaactccttcatctctgattttgcacggttcactcgtatattggtacgctaaaccgcaaaccatacccaattttatccggtttagttggtatgattgagaaattcttattctctgaaactcgattttattagtatttaagcgaaagagaagaaaccctacgaaaatctcaatcggaaactaaacggcaaaaaaaaaaaaaagcagaggcagccatg

SEQ ID NO: 17509 - DNA, 3003 bp, Unknown
  misc_feature (1)..( 3003): 2750-1469P.txt file - cDNA_ID_1809482; gDNA_ID_1621162; Annot_ID_57138
gctatacggatttatttgttagttgttactcctacataactgaaaccaaacatatatttgatgtttaatgcagcctacgaaaggtatactgttgtttggacctcctggtactggaaagacgatgctggcaaaagcagtagcaactgaggctggcgcaaatttcatcaatatctcaatgtccagcattacttcgaaggtaactctcataaagtgatatgatttccttttatgctttcttttaatgattgtacttgaccatttacactaaatgctttgcagtggtttggtgagggagagaagtacgttaaagctgtcttctccttagcgagcaagattgcgccaagtgtcatttttgttgatgaggtatgtttgaagatattaaaaagcgttctctgttctctcccacctttgaagccagtctttttatgtactttctcgatctgatgattgtggaaaatcattattcaggttgatagcatgttgggtagacgtgaaaatccaggggaacatgaagctatgcgtaagatgaagaacgagttcatggtaaactgggatggtttaagaacaaaggatagagaacgggttctggtactcgctgccaccaacagaccatttgacctagacgaagctgttattagacggcttccccggaggtaaaaccaccacttttccctctgttgtctgttagttgtgaagaatattgcaaccattgttgatcctctcctgcatactacttctgtgcagattgatggttaatcttccagatgcaacgaacagatcaaagatcttgagcgttattctagcaaaagaagaaatagcaccagacgtcgatttagaagctatagcaaatatgacagatgggtactcaggaagtgacttaaaggtctcgactttctataaccttccctctcaatctccttcccctgtaaaaaaactcacacacgtattcttttttggttgcagaatctgtgtgtgaccgcagcacattttccaatccgagaaatactggagaaagaaaagaaggtttggtttctgtttaatgcgattgcttctcgaatcctgaagtccatttacattactcgcataactcattctttttattattctggctgttgttttgactacaggagaaaactgcagctcaggctgagaaccgtcccacaccgccattgtatagctgcacagatgttcgttccctgacaatgaacgatttcaaggctgcccatgatcaggtaagtcaagacaaagaagccaatgagtttcacatatgtgataataactttgaaaagaaagctaaatgatcagaaacatgtaggtatgcgcaagtgtgtcttcagactcgtcgaacatgaacgaacttcagcaatggaacgagctgtatggtgaaggaggatcgaggaagaagacgtcgttgagctacttcatgtagaagagagacaaaagagagagggagggagatttgttcgtttttgatctctctcgtgttcggtttttttttttgaatctcattttggtcgtttaatttataaatttgtgtacagagagaaagggtgttgttcgttttgctgtctaattcattttctttctcaacataagatgaaaaaaacattcgctgtataatctaatacatgcgtatgtatatagaggctcggatcttttaaggataaggacataattctaaatcttcaaggtgtgtgctttgagagtctttagaaaactaaatagtgcattattataaacttatgatctgatatgtctatacgtctcgtaaccaaaaccagagtatcgaaactaaagataagaaaacgaaacgaaataaagcaatttaatttacttaccattgcacaaaggcaagaagtgtttggtgccaaatgacgggtataacattcgtctccttatgaaatctaaagaagtgagtggtaaccgcatcaatcgcccgatacgccattgcatatctcttctccagaataactttgatgaagaaactgcatccacacacacaaaaacagaatgcaaccaaataaagacacacaatacctatatgtgtaagtgtaaggttagcctgcgttttaccttgttcggccataaaaattccaactccgccaaacttagcaaagcagcactgcagttcataacattagcactgcgttttattcacgcttaataacattagagagacgtttagctattgaagctccatccttggaaagcaaggcatcaagtaacttgtcttcttcctcagtggccatatcctggtaattaagttggatctgaaactcttgagattgctcatcaacatcatcatcatcaatcaaatatcttccaatccatacactgccttcttaataaaggcagtcattgggattttctgacttctatttgctgctcataggctagcttaaggatcttcggcgttagtttcacaaatccatagaatttagaaaccctatcaattccaaaatctacaaaaaggttttaaaatttcccactcaccttcctgaggaggaggctacgacgcgaatagctttacgtttccacttaatcgccattggatatagtcaagaagtagagactatgtgagattgagggaacgcaatttagcatatgaagaagaaaccctacttgactttagccctaaaatctattacgtgacccaagcggctacttgtacatctgtcataacgggcagaatattttggtctaagcccaatgagctaatatgggctttaaatcttaagtccattaacatcaaattcaatttgttcaaacgcgaaacgcaaatcgcattgtgcagctgcgtcccagtgttgaaactcttcgaactcccaaaacgcaaaagcttcgtcttcttcttcatccttgtctcaccttcgattttggcggcaaaacataaaccctaagggttttctcactctctctctctcttctcacacacacagtcccagagtacggtggtgttgattcgattgaggagattcatctgtttatagggtttagcaaatg

SEQ ID NO: 17510 - DNA, 3000 bp, Unknown
  misc_feature (1)..( 3000): 2750-1469P.txt file - cDNA_ID_1809482; gDNA_ID_2926183; Annot_ID_140662
atacggatttatttgttagttgttactcctacataactgaaaccaaacatatatttgatgtttaatgcagcctacgaaaggtatactgttgtttggacctcctggtactggaaagacgatgctggcaaaagcagtagcaactgaggctggcgcaaatttcatcaatatctcaatgtccagcattacttcgaaggtaactctcataaagtgatatgatttccttttatgctttcttttaatgattgtacttgaccatttacactaaatgctttgcagtggtttggtgagggagagaagtacgttaaagctgtcttctccttagcgagcaagattgcgccaagtgtcatttttgttgatgaggtatgtttgaagatattaaaaagcgttctctgttctctcccacctttgaagccagtctttttatgtactttctcgatctgatgattgtggaaaatcattattcaggttgatagcatgttgggtagacgtgaaaatccaggggaacatgaagctatgcgtaagatgaagaacgagttcatggtaaactgggatggtttaagaacaaaggatagagaacgggttctggtactcgctgccaccaacagaccatttgacctagacgaagctgttattagacggcttccccggaggtaaaaccaccacttttccctctgttgtctgttagttgtgaagaatattgcaaccattgttgatcctctcctgcatactacttctgtgcagattgatggttaatcttccagatgcaacgaacagatcaaagatcttgagcgttattctagcaaaagaagaaatagcaccagacgtcgatttagaagctatagcaaatatgacagatgggtactcaggaagtgacttaaaggtctcgactttctataaccttccctctcaatctccttcccctgtaaaaaaactcacacacgtattcttttttggttgcagaatctgtgtgtgaccgcagcacattttccaatccgagaaatactggagaaagaaaagaaggtttggtttctgtttaatgcgattgcttctcgaatcctgaagtccatttacattactcgcataactcattctttttattattctggctgttgttttgactacaggagaaaactgcagctcaggctgagaaccgtcccacaccgccattgtatagctgcacagatgttcgttccctgacaatgaacgatttcaaggctgcccatgatcaggtaagtcaagacaaagaagccaatgagtttcacatatgtgataataactttgaaaagaaagctaaatgatcagaaacatgtaggtatgcgcaagtgtgtcttcagactcgtcgaacatgaacgaacttcagcaatggaacgagctgtatggtgaaggaggatcgaggaagaagacgtcgttgagctacttcatgtagaagagagacaaaagagagagggagggagatttgttcgtttttgatctctctcgtgttcggtttttttttttgaatctcattttggtcgtttaatttataaatttgtgtacagagagaaagggtgttgttcgttttgctgtctaattcattttctttctcaacataagatgaaaaaaacattcgctgtataatctaatacatgcgtatgtatatagaggctcggatcttttaaggataaggacataattctaaatcttcaaggtgtgtgctttgagagtctttagaaaactaaatagtgcattattataaacttatgatctgatatgtctatacgtctcgtaaccaaaaccagagtatcgaaactaaagataagaaaacgaaacgaaataaagcaatttaatttacttaccattgcacaaaggcaagaagtgtttggtgccaaatgacgggtataacattcgtctccttatgaaatctaaagaagtgagtggtaaccgcatcaatcgcccgatacgccattgcatatctcttctccagaataactttgatgaagaaactgcatccacacacacaaaaacagaatgcaaccaaataaagacacacaatacctatatgtgtaagtgtaaggttagcctgcgttttaccttgttcggccataaaaattccaactccgccaaacttagcaaagcagcactgcagttcataacattagcactgcgttttattcacgcttaataacattagagagacgtttagctattgaagctccatccttggaaagcaaggcatcaagtaacttgtcttcttcctcagtggccatatcctggtaattaagttggatctgaaactcttgagattgctcatcaacatcatcatcatcaatcaaatatcttccaatccatacactgccttcttaataaaggcagtcattgggattttctgacttctatttgctgctcataggctagcttaaggatcttcggcgttagtttcacaaatccatagaatttagaaaccctatcaattccaaaatctacaaaaaggttttaaaatttcccactcaccttcctgaggaggaggctacgacgcgaatagctttacgtttccacttaatcgccattggatatagtcaagaagtagagactatgtgagattgagggaacgcaatttagcatatgaagaagaaaccctacttgactttagccctaaaatctattacgtgacccaagcggctacttgtacatctgtcataacgggcagaatattttggtctaagcccaatgagctaatatgggctttaaatcttaagtccattaacatcaaattcaatttgttcaaacgcgaaacgcaaatcgcattgtgcagctgcgtcccagtgttgaaactcttcgaactcccaaaacgcaaaagcttcgtcttcttcttcatccttgtctcaccttcgattttggcggcaaaacataaaccctaagggttttctcactctctctctctcttctcacacacacagtcccagagtacggtggtgttgattcgattgaggagattcatctgtttatagggtttagcaaatg

SEQ ID NO: 17511 - DNA, 3003 bp, Unknown
  misc_feature (1)..( 3003): 2750-1469P.txt file - cDNA_ID_1809489; gDNA_ID_1621162; Annot_ID_57136
ttgttctctctcatgtgtcaaactcgtttcatctacgtagcatcgagatttcagttaatcgaatctcctgttatcatggacatgttatataaaatggatatagatcagtaaaaaggtttccgaatggatatatttaaatggattcgttattatggacaccaaaaaattgtttgttgatttttctttcagtttgcagagacctccaccttcaaaaccttatggacatggaactttggtttctttacaaaacacggttaatcgaatctcctattattattgacatggtatatagaatggatacggatcagtagaaaggtttctgaatggatatatttaaatggacttgttattatagataccaaaaaattatttgttgatttttctttcagtttggagagacctccaccttcaagatcttatggacatggaactttggtttctatacgaaccacggttaatcgaatttcttgttattattgacatggtatatagattggatatggatcagtaaaaaggtttctgaatggatatatttaaatggacttgttattatggataccaaaattttttaccaaattcctgagataatcgagatcgaattgtttaagaaacttctcccatttatttgcagaatcgttatcaccaatttttagtgagccgccgtcataatcgataagaggaatcaaacctagaagttatggagacgtggagagagaaaggcactacaaatgtgagagagagaaagagagagagagagagatctttttttctattttgcgtaaggatcgtggaagagagaaaaaatatttaatttgtgttaaaattcaaaataaaagtagttgtttaagttaggggtaaaaatgtcttaaaaaaagtcaaataatggaaaaagtgtcctcaccctcataagtgcataaaaaagaataagattatctaaaagtgcctaaacgtgtcacatttttatatatctccgtctttttttcttcttttttgtaaaatgacttaattacccttagtttttagtcggtgaagtttagagatcttgtggtaatttggtctttgcattcaaaacgctgaatcataaaaacaaaatattatgctgttaatttgactcaaattttctttgttataaagtataatctttattattattttgttcaaaagctgaagcattttttagacaaagaaagtcataacttagtagatattcaatatttaaaaaatgacattatttcctagattttgtagttaatacatttctatagagttatatattatgaatttatataaagtttttttttaacacaatgaatattatatatatatataagttttatgtatttaagtttccttttgaaggaaatgaacatacacattgtaaccgacttaaattaaattacgaaaaggtcacgtgatgtggcatgcatggatgtatatagtcaaaaagactgattaagagactgaattcatgcgaacacgtgcccaatacaaaacaaacggttagacgaacggatactcccaaagtgtttctgttcatcgaacgaaacgtatgttgctcttgttgttgttgtgtagtagtagcgaactacccggttcggtatttttttttcttctttcaaaaatattctcaacgatttcatgttttttgttttgttttattcatgttcttggtcaaacattattgatttggtttcgataaacctattcttgaggattttattatatacctttgatcaaaatacaaatgggtgactttttctttacttcatttgcttcttttttggggtgttagaaaaaaacacttaaaaaaaaaaaaataggagtgataaaacagagtttgaccatagtgtttgcgtcattgtgagtgaaaatgaatgtggtaaagtaaaaaagatttgactactagttgggagtcaattactccagaaaaagcaagtagatgaagaatcttacctccttatctcttgtatacgtgcttgtggtatttgccccaagggggggagctacaatacctctcgcattctccttttgtacaattataaaaagtgaactgtctttccaaaaaaggaaattattattatattctctcaatgtgaaaattacaatagtttatccgacttgatttcacatattttaggttttaattgttaagtttagaataataacaataatgataaatttttgaaaaagaataactaaaaataataattgatgaaattcatttagtttattcattaatttaaatcagctataagtctttttgttaaattgctaatttttatgtgttttacatgtttgtgcttttccaatatctttttgtttgaaaactttaaaagtcaataaattactcaattttctaaaaacgacaaattaaatttgtcggatgcgttaattccaacgtgtaagtactttttgatttatagataacggaattaccattatatagatcacaaagacataaaaacaaaagtacaatgtttaatccagaattttctcgttgacgaagcgtgtattcattgattatgggatctaaattgtcgtgtgtgtttataatttttttaataattaaaattattataaagtcaatttacattgttaatatgcaaatatatcaatcaaaatacacacataaatatgtggatttaaattcggatattatagtgttcaaattttttaaaaatatggaatatcgatggtcaagttatttatatatttgacccgtaaaatgtacagtaattaatttaaacgcagagagacaataaaaattaaataaaaaaaagttttgcaggtttatgtttaatttataaattgaccatcccagtaatcatttacatgatatctctctgattcttcgatttctctttctctctctctcgctctatccttctcctatctctaatctcttgtcttctctctctttctctatcgggaaaccaagcggctcttctttggatcaaaggcgaagtcaaggcggagaaagaaaagagagggtcgtgagatatg

SEQ ID NO: 17512 - DNA, 3000 bp, Unknown
  misc_feature (1)..( 3000): 2750-1469P.txt file - cDNA_ID_1809489; gDNA_ID_2926183; Annot_ID_140664
ttctctctcatgtgtcaaactcgtttcatctacgtagcatcgagatttcagttaatcgaatctcctgttatcatggacatgttatataaaatggatatagatcagtaaaaaggtttccgaatggatatatttaaatggattcgttattatggacaccaaaaaattgtttgttgatttttctttcagtttgcagagacctccaccttcaaaaccttatggacatggaactttggtttctttacaaaacacggttaatcgaatctcctattattattgacatggtatatagaatggatacggatcagtagaaaggtttctgaatggatatatttaaatggacttgttattatagataccaaaaaattatttgttgatttttctttcagtttggagagacctccaccttcaagatcttatggacatggaactttggtttctatacgaaccacggttaatcgaatttcttgttattattgacatggtatatagattggatatggatcagtaaaaaggtttctgaatggatatatttaaatggacttgttattatggataccaaaattttttaccaaattcctgagataatcgagatcgaattgtttaagaaacttctcccatttatttgcagaatcgttatcaccaatttttagtgagccgccgtcataatcgataagaggaatcaaacctagaagttatggagacgtggagagagaaaggcactacaaatgtgagagagagaaagagagagagagagagatctttttttctattttgcgtaaggatcgtggaagagagaaaaaatatttaatttgtgttaaaattcaaaataaaagtagttgtttaagttaggggtaaaaatgtcttaaaaaaagtcaaataatggaaaaagtgtcctcaccctcataagtgcataaaaaagaataagattatctaaaagtgcctaaacgtgtcacatttttatatatctccgtctttttttcttcttttttgtaaaatgacttaattacccttagtttttagtcggtgaagtttagagatcttgtggtaatttggtctttgcattcaaaacgctgaatcataaaaacaaaatattatgctgttaatttgactcaaattttctttgttataaagtataatctttattattattttgttcaaaagctgaagcattttttagacaaagaaagtcataacttagtagatattcaatatttaaaaaatgacattatttcctagattttgtagttaatacatttctatagagttatatattatgaatttatataaagtttttttttaacacaatgaatattatatatatatataagttttatgtatttaagtttccttttgaaggaaatgaacatacacattgtaaccgacttaaattaaattacgaaaaggtcacgtgatgtggcatgcatggatgtatatagtcaaaaagactgattaagagactgaattcatgcgaacacgtgcccaatacaaaacaaacggttagacgaacggatactcccaaagtgtttctgttcatcgaacgaaacgtatgttgctcttgttgttgttgtgtagtagtagcgaactacccggttcggtatttttttttcttctttcaaaaatattctcaacgatttcatgttttttgttttgttttattcatgttcttggtcaaacattattgatttggtttcgataaacctattcttgaggattttattatatacctttgatcaaaatacaaatgggtgactttttctttacttcatttgcttcttttttggggtgttagaaaaaaacacttaaaaaaaaaaaaataggagtgataaaacagagtttgaccatagtgtttgcgtcattgtgagtgaaaatgaatgtggtaaagtaaaaaagatttgactactagttgggagtcaattactccagaaaaagcaagtagatgaagaatcttacctccttatctcttgtatacgtgcttgtggtatttgccccaagggggggagctacaatacctctcgcattctccttttgtacaattataaaaagtgaactgtctttccaaaaaaggaaattattattatattctctcaatgtgaaaattacaatagtttatccgacttgatttcacatattttaggttttaattgttaagtttagaataataacaataatgataaatttttgaaaaagaataactaaaaataataattgatgaaattcatttagtttattcattaatttaaatcagctataagtctttttgttaaattgctaatttttatgtgttttacatgtttgtgcttttccaatatctttttgtttgaaaactttaaaagtcaataaattactcaattttctaaaaacgacaaattaaatttgtcggatgcgttaattccaacgtgtaagtactttttgatttatagataacggaattaccattatatagatcacaaagacataaaaacaaaagtacaatgtttaatccagaattttctcgttgacgaagcgtgtattcattgattatgggatctaaattgtcgtgtgtgtttataatttttttaataattaaaattattataaagtcaatttacattgttaatatgcaaatatatcaatcaaaatacacacataaatatgtggatttaaattcggatattatagtgttcaaattttttaaaaatatggaatatcgatggtcaagttatttatatatttgacccgtaaaatgtacagtaattaatttaaacgcagagagacaataaaaattaaataaaaaaaagttttgcaggtttatgtttaatttataaattgaccatcccagtaatcatttacatgatatctctctgattcttcgatttctctttctctctctctcgctctatccttctcctatctctaatctcttgtcttctctctctttctctatcgggaaaccaagcggctcttctttggatcaaaggcgaagtcaaggcggagaaagaaaagagagggtcgtgagatatg

SEQ ID NO: 17513 - DNA, 3000 bp, Unknown; identical to SEQ ID NO: 4992
  misc_feature (1)..( 3000): 2750-1469P.txt file - cDNA_ID_1809497; gDNA_ID_1621162; Annot_ID_57134

SEQ ID NO: 17514 - DNA, 3000 bp, Unknown; identical to SEQ ID NO: 4992
  misc_feature (1)..( 3000): 2750-1469P.txt file - cDNA_ID_1809497; gDNA_ID_1621162; Annot_ID_173715

SEQ ID NO: 17515 - DNA, 3000 bp, Unknown; identical to SEQ ID NO: 4992
  misc_feature (1)..( 3000): 2750-1469P.txt file - cDNA_ID_1809497; gDNA_ID_1620751; Annot_ID_166809

SEQ ID NO: 17516 - DNA, 3003 bp, Unknown
  misc_feature (1)..( 3003): 2750-1469P.txt file - cDNA_ID_1809497; gDNA_ID_2926183; Annot_ID_200427
caagagacccataaggaacccgaagcagtaaacaacagccaaatcagcttgagagcaaggaccttattccaagaagataatctttttaaacccaatccaccactctccttagaagaacacactatatcccaagagatttttgcttcacgagctgagtttggagctccggaccataagaacgcgttgcacatctgctctaacttatgaaggcattggttggggaggataaatatcgaagcccaaaagttgattgtggagtaaataacagatttcaagagctgcaatctaccagcaaaggagaggtgccttgcagtccaagacgtgaaccttgaatttatcctatccacaagaggctggtaatcgtgctttttcattttttgggacataagaggcactcctaaataacggacaggcagagaaccttgtgaaacaccaagactagctgccataatccgattcctttcaaagttaccaccatctaaaagtaaggccgtcttctgcagattaattccaaggcccgaacctttcttaaacacgtctagaatatccaggatggcaacaagagaagacagagacccatcacagaaaaccaaaatatcatctgcaaaactcaaatgagtgatcataggagccaaacacttgggatgcagaacaaaccggccctccactgctcccaaatccaaagatctggccagaatatccattactaacacaaacagatgggaggacataggatctccttggcggatgcctttctttcctacgaagaagccaatcaattcaccattataagcgatgctataagagggagtagaaatgcaaacccatatccaatttataaaaatgggaggaagattcaaggctttgaggatattgatgagaaactcccaattgacgttatcataagccttggttagatcaacctgaagacagcctctagaagtatcaccttcagcttggaagttgtccactagctcagacgccaagagaacattttcacagagaagccgccccttaataaatccaacctggttggattgaaccgcttgatcaatgaacaggttgagtctcttagagataaggcgagtaatcaccttgtagattgtggtacaacaagccaccggacgaaagagattgagctgatcagccccgggaaccttaggaataagagtaatggcagtggcattaaaccctttcaacaaatgacctgtcaggaaaaattccttaatagctgcaataaaactttcctttacaataggccaagcttccaagaagaattccactggaaacccgtctggaccaggcgccttgttcctaggcatagagaataaggccattagtgatctcttcatcactaggaatagctgttaactgagtagccaaggaggagtcacacctaaaaggatgaagagactgaattcgttcaacggagaagggggtcacatcatcattagggggcctaacagatgagtataataggagataagcatacccttaagagactggtttgatgtttttcatgatataaactttttcgtaatgtaattagtggttaatgatttttgattgttttataattttcatgatgtaatgataaatagtgatttctgatattttatgagatatttttttcattatgtaatctacatatacatttttggagccattttaccaaataaatcctagatttgaagttatttacaataatgccattagcattaaatctttttttcaaactaattaattttactttacattcttaatttaaattgtcaatcacattatcaatcaaatttaatccaaacaaacttcacatcaatcccttaaaattagcataaacatatttgttaacaatattttaaaacaaagttttttatttaaataaatattattcttactaaacgtttttgtttaaataaataaatcatgtatttgaacttatttacaatgtcatgcttaattatttaggaatgaaaatatttaattaaagatctaaatcttctaaatccttgcttttagatttattatgtcattacctaaaaggtaaaaaatattaactttttaaatataattatttctatatttaaacttaataaaacgttatcaatatttaaacttttaaaaagtttaatatatcacaattttttaacatcattatataatatatagagtttaaaaaaaaatcaaaattttttccgtgattcgaaattttaaaaatgaaaatatattaaccaattgacgaaaaatatgtggttcaatgtcccgcatcgactaaaatatttaaacaaatgattcataaacatatcataaataagatcaacattaataaaataaatgatatttttatatatactaactttaaaaataaattgtttccgcggtacaccgtaagttaaaatctagtacttatgtaatactaataatggtatcttttcatgatgagggaaaaaaaacattttttataaaccatatcacaatataatgaattccaaaagtcatttgggtaacttcctaacctctaattagtaatttaagtatttaactatatcaaacaagttaaaatattatgctatttatgctcctttttcttttcaactagttttctatatataaataaacaaacgagtttgtacaaaaaaaacaacgagttgacttttcaacgctgttagatttttagttttttatagatagatctataactgcatcaacggtcaagataattgatcgcaaatgatacgctctagaacttcgccacgtgtcaacaacgctactaactcatcactaccaccgacaattaagtgaaatcagacaatcttaactgtcgtgtccaaaaacacaaaaactctcctcgcttctcttctcttgttgtagtaagtaactttggtaattaacagtgttattatcaaattcgaatctcttacattaatggaaactcagatcttctcttaaaaacacataaagcacagatcttttacagagaatcttgtaagaagaaagaagatg

SEQ ID NO: 17517 - DNA, 3000 bp, Unknown; identical to SEQ ID NO: 7764
  misc_feature (1)..( 3000): 2750-1469P.txt file - cDNA_ID_1809501; gDNA_ID_1621162; Annot_ID_57133

SEQ ID NO: 17518 - DNA, 3000 bp, Unknown; identical to SEQ ID NO: 7775
  misc_feature (1)..( 3000): 2750-1469P.txt file - cDNA_ID_1809512; gDNA_ID_1621162; Annot_ID_57151

SEQ ID NO: 17519 - DNA, 3000 bp, Unknown; identical to SEQ ID NO: 7775
  misc_feature (1)..( 3000): 2750-1469P.txt file - cDNA_ID_1809512; gDNA_ID_1621162; Annot_ID_173737

SEQ ID NO: 17520 - DNA, 3003 bp, Unknown
  misc_feature (1)..( 3003): 2750-1469P.txt file - cDNA_ID_1809512; gDNA_ID_2926183; Annot_ID_140649
tttaatgcgttagttgagagtatctataaataattgaccctttttcattttaggataatgttttaatttaaataagttataccaatctaaaatcagcaaaaagaaaacaaaacatactataataaaattttcggaaacacaaataccatgaacatgcaagtgcaactaaacaaatgttttattatattaagttaacgtcacagtcaagtctttgggtcagaatccatcgttctcggacagtctgcgtttttaccgtttacgcattttccatagcattccatagtctttgggtcagaatccatcgttaccgtttacctatattaagtttactgtattctccaaccaacaccatattttattaaaaaaaaatttatttacatatattacaaaaccatattaaaaattaaatataaatatattacttttttgttaaaaaaaaataatatatatattacttttgtgatatataattttttataattctaaccaatagtattcaataaatttttgtgaagtttacaattctttaagaataactaataaatattgataaaagtactgtacttatctttttgaaacaacaaaattcctaaaaaaacaatactgtaacaaggagcagaaaagtattatattaaatcaaatactaacaaaataatagctagtatttgataactagtttgtttagtaatacaaacaaaaaaatgttaaatgaaatgcaaaactctttaccattttacgatttttgaaacaaactttttttttactataaaatacaatactgtaacaaaaacaaagggagtattatattgaatcaaaatacaaacaaaataatagctagtctttgataactagttagtaacacaaacaaaaaagtgtaaaaccaactgcaaaattctttacgattttaaatgcaacatcttaaggtggaccatgatggatgattcatgagtcttgactcttcttgaggctcaattatttgggcgtgttgaccaaaaaattgttccattgaaacaattttttctatatcctcatcaaatacatttttaaaatatgttgacaaaaaaaaaaagagaaaaatgcgtactataaatttatgagatctcagtctattaaacaaagaaaaatgttacatctccaactttacaaaaagctgattttatttcttctcatatttttctactggaaatgcaggtgtgttaatgataagtatgtgtagtaaaaattcaaacacaaaaatgatttatgataatgcattgtagattcacatattataaaggtgtaataattgaacaaattaggctcaatcctagtaacggaagcacttgctcttcgcaatgcccttaaaatggcagccgatcaatcggatatagcctctttcacggtattgttggactctcaagtcttgatctcacttatcaatgctaagaaatatctttcaaatctcaaagaaaatcatccatgatattgcttcgttttgtaattctttcgcttctatctctattgcttatgtcccaaagtcgtccaatactttagccgactccttagttaagtcagtccttgtggcttttacttcctcctcccctccaagaatgtaacactctctgtcttttagcaatgcaagttcggtttgaacaaaaacaaattatcacaaaatgccaaaaaatgaaagacaattaatttataattaggctcataagtcaaatagccaataacttgccccatacctaagatagttactttaggcgaaacgacggagaatttaaggacaattgactatagaaaagactctatattatactattcacagtgtcccaaatatatataaattgcctaacacattgccaccgtcgttgacaagttttcttagattcaaaatttagtacatagtatatattatataatttataaacctaagaaatgaaggaaggtggatcttaatatgtataattaatagaggcaagacatgaaggaagatggatctttaccaaaaacagctgggcagctttgaaaatgcaatgttcgatgataataatatctcaataacaaacaacgcgtttttatctcagaagactccaatatattgacttggaaccactaaaagtcgcattattattgttttgttatatatatatataatcccaaaaagtaaacaaacaaaaaataaaatacaaactattgcggaacaatacaatatatatatatatatatatgtaattcttattgattcaattttgaaagaaatttctttgtctatatattattttgatgtttttgtgtttaacctcatgaatagagagataattctccggcttggtaaacaaatacgttggattgtttttttacaaacaaaatctcaatatatttctaactttagccctacgaaccaaactacaggtcaataaacgacgtgaaatcaagctaaatggcaaattattagaattagtccgaataataaacaaattcgtctaaaattgtagaaaattttgggatctaagaatgagactacatcatttttttttatcaacaactacatcattttaaaccaaacttagaattgttaggtctcaaacttctaacaccgatttgctgcaaaaacaattatggatcggatcaagatatagagaggatttcacatttgacttctattgcttactcattccaaaagacggtttggtctagtttttgaaatttaaccaatcttgaaaatacggaatttgtaatgtactttacaaaaattgtatatgctaattataattttgtgatctcaaatattcatgtttatatgataagataagagataacatgaatgcattattatataataccatagaagatagaatgtatacagtctcaaaataacaaaatttaatacggacccacatcccaaacctctcccactctatatatttggtctctataaaacccactaaacctaaacttttccaaaatcataccaaaaaaacatttagtaacatcaaaatttacaaaaaacaaaaaaacatg

SEQ ID NO: 17521 - DNA, 3003 bp, Unknown; identical to SEQ ID NO: 17520
  misc_feature (1)..( 3003): 2750-1469P.txt file - cDNA_ID_1809512; gDNA_ID_2926183; Annot_ID_200406

SEQ ID NO: 17522 - DNA, 3000 bp, Unknown; identical to SEQ ID NO: 7858
  misc_feature (1)..( 3000): 2750-1469P.txt file - cDNA_ID_1809519; gDNA_ID_1621169; Annot_ID_57229

SEQ ID NO: 17523 - DNA, 3000 bp, Unknown; identical to SEQ ID NO: 7856
  misc_feature (1)..( 3000): 2750-1469P.txt file - cDNA_ID_1809538; gDNA_ID_1621169; Annot_ID_57222

SEQ ID NO: 17524 - DNA, 3003 bp, Unknown
  misc_feature (1)..( 3003): 2750-1469P.txt file - cDNA_ID_1809542; gDNA_ID_1621169; Annot_ID_57221
agtgtggtcgtagcacacttgagaaggctatttcattcgtcaatgccaatgataattggaacgctagagttgtatatggtgacactgataggtaaacattaaccaccatctttcatggcactattttaacttcctacaatataaagtatagccagggtttcatgcttgcataagttaatatatattcgtattacttccgagtgtttattatggtcatttcagcagccttgacaagtatgtatcacagtttctttatttacttcttcctcgtggcctcatgcattttaattacttctgtagtatgtttgtcctcctaaaaggacgaactgtaaaagaagcttttgtagtcggacaagagattgcatctgcaataactgaaatgaacccacacccagtcactttaaagatggagaaagtctatcacccttgtttccttcttacgaagaagcgttatgttgggtacagttatgaaagtcccaatcagagagagcctatatttgatgcaaaaggtattgaaactgttcgaagagacacttgtgaagctgttgcgaaaactatggagcaatcgttgagactcttttttgaacagaagaacatctctaaggtacaaatttgatttcttgcactctttcgaattatcagctgaaactgcagtgtcgtacatctgcttttctctattcattgtgcaggttaagtcgtacttgtatagacagtggaagcggatactatcagggagagtgtctcttcaagattttatctttgcaaaagaagttcggttgggtacttacagcacaagagactcttcactccttcctccagcagctattgtggcaaccaaatcaatgaaagcagaccctcggacagagccacgctatgctgaacgagtgccttatgttgtgattcatggggagccaggagctcgacttgttgatatggttgttgatccactggttcttttggacgtcgatacaccctaccgactgaatgacttatactacatcaacaaacaaattataccagctttgcaaagggtatttggactcgtgggtgcagacttaaaccagtggtttttggagatgccccgtctcaccagaagctcccttggtcaacgtcccttaaactctaaaaactcacacaaaacaaggattgattatttttatctatcgaaacattgcatcttgtgtggggaagttgttcaagaatctgctcaactatgcaaccggtgccttcaaaataaaagtgctgctgctgcaaccattgtttggaagacttcaaagttggagagagagatgcaacacctagccacggtaagtactccaaaatctaacgtttatgaactgttacagaacttggtaacgtttacaaccatcatcttactgtctttactttccaagagatcgtgtgcttcatagaaacttgtacactttctgatgtgagcatttgcatttaatcttgcacacactttgaattcaaagagacagtttcatctcatggtagtcgcaaaacaatttatgctaaaaagtggagacttattagtttcagattatctttcagaaatgtttgctattttataacaagaacgagtgtagacctctttccatgtgtgcttaagttgtgaccttggtgaatctctgtagatgcattcagttccaactttgttggtccattaattgatttttctttatattatcttatttgcagatatgcagacactgtggtgggggagactgggtggtgcaaagcggagtgaaatgcaattcccttgcgtgctcagtcttttacgagagacggaaagttcagaaagagcttcgtggcctctcctccattgctactgagagtgagctttaccctaaatgcatggctgagtggttctaaccttgacgaaaactcaaaaaaaaaaaaaaaaaaccagtaatctaactctatcccatacgtatttccactcaaactaatctaaaccatcctatcctgttaagtaacgatgtgaatttttgtatttgcaggattttgagcgaactagtaggtttatatggttgtgatcaaagagcatttttttcaaggacgtgtgaatatgtgtatagatagtagtagcacccacgagtacagtactgtcactcatcattctgttcaactcctttgtgttgtgttgtgtataagcaatcttggaaaaaataattataattttgtatagcataccaagttcacgagaaagatagatagatagataaagaaacaaaaacaacataacaaaaaaaattaacagaagaaacaaaaacgcctacgagtcttttgggtggtggtgagatggtgcaatgcttcaatctctctctttttaagactttcgagcacaaccaactgtttcacacaaaatgggtgataatcccttcaatgtaggcaaaacttatagaatgcttaagaaaactgaataaggaaaaaacctcacctcttcaatagcacgctcccgcaaaatcgtaaagtgcatagccctgtgtttggatataatcttcgtatccatatatgataaagcaactacatggaaactggcagagttatatcaaacatataaatggtcatggatatgagtgtacaaaaagtaaaacagatttggtcatacacaatttgaatttcttcccgtaataaacatattcttaggctctatatatatatattgtatcaatgttattgagatcaataacacataataaagagttttcccccaaacccttctctagttagtagtttctataattttggcaaatagtattcaagtgctcttgcattctcaagtgattaattcaattcctaggtttcggtttcggtttcggtttggttcggttcgtctcggttattttaggaaaagaaaacaaaattagagagcaaacacgattggtcaaagtcaactcttctctaccttcctcacttcccagcttcactgatcatcgccaatcacaaaaccaactacacacattcatcatcatttcgattatattttacccgaccatg

SEQ ID NO: 17525 - DNA, 3003 bp, Unknown
  misc_feature (1)..( 3003): 2750-1469P.txt file - cDNA_ID_1809546; gDNA_ID_1621169; Annot_ID_57220
tggaactctttcaccggatctcaacaagtgtaaacagcttcaacggttgatcctctccgctaacaacttttccggtgagattcctggtgatatctggccggaattgactaatttagctcagcttgatctctctgctaacgaattttccggcgaaatccctaaggatatcggagagcttaagtctctctctggtactttgaatctctcctttaaccatttatccggccaaatccctaattccttaggaaatctaccggtgacagtctctcttgatctccggaacaacgatttctccggcgagattcctcaatctggttcgttctctaaccaggggccaaccgcatttctcaataatccgaaactgtgtggtttccctctccagaaaacttgtaaagacactgatgagaactctccggggactcgaaagtcgcccgagaataatgcggattctagaagagggttaagtactggattaatagtgttgatctcggtggcagatgcagcaagtgtagcttttattggtttagtgttagtttacttgtactggaagaaaaaagactctgagggagggtgtagctgcacagggaatgcgaaactcggtggtggttcggtgaaggggaaatcgtgttgttgtatcacggggtttccgaaagaggatgattcggaagcggaaggtaatgagagaggagaagggaaaggagatggagagcttgtagcgattgataaagggttttcttttgagcttgatgagttgttgagagcttctgcatatgttttggggaagagtgggttagggatagtgtataaagtggtgttagggaatggagttccggtggcggtgcggcgacttggggaaggaggggaacagaggtataaagagtttgttacggaggttcaagctatggggaaagtgaaacatcctaatgtggtgaagttaagagcttattattgggctcctgatgagaagcttttgattagtgacttcgttaacaatggaagtttagctgatgctcttagaggtattacattacttcttccttcttctttttctgcttatcgaattagtctactaactaaagtttgagatccggttctgttctattgacttaagaaatttatgttgactttgactttgtcaacgctagattagacattactaccttagtgagagatgagattagatctgagagatagtttgtgggattgtcaaagcaagagtggaccaagatttctttctctttttaggcatattttggtattttaatttagaatttagtcaagttacatgtaaaagagacatgtcttgtaagagaattcgacatgtccgaataataaatatcttttttaagtattagtatatgatttaagtgtggtagagtcttagagtagaagtaattagtaaaaatagcagaatgaggaaacaatgatgagagaagtttacttgtgggctaagagtaatgattttatacacccactctgttgagcctctagctgtcccgtctttttctcatcgtaactcattacttactttaatattggatacttgtttgttttggtgtgtgaatagggaggaatggtcaaccatcaccgagcttaacatggtcaacgcgtataaagatcgcaaaaggagctgcgcgtgggttagcttatctacacgagtgtagtccaaggaagttggtacatggcgacgttaagccttccaacattcttcttgattcctccttcactccttacatctctgacttcggtctcacacgtctcatcaccatcactgccgcttctgcctcttctaacgaaccttcctcctcctctgctgcgggtggtttcttaggtggagctcttccttacacttccatcaaaccctcagatagatccaacggctataaagcccccgaggcccggctccctggagggaggcctactcagaaatgggacgtatactccttcggtgttgtgcttatggagcttctcaccgggaaatcgccggattcttctccgttaagctcttcctcgacgtctacggtggttgttgaggtgccggatttggtgaagtgggtgaggaaagggtttgaagaggagactccattgtcggacatggttgatccaatgttacttcaagaagttcacgccaagcaacaagtcttgtccgtttttcatctagctctcgcttgtaccgaaggtgaccctgaagtccgtccacgtatgaagaacgtctctgagaacatcgacaaaatctgattcaattattatattcttttttctttaatttttcctattatatttttgtatctccgatagttcttacacgaggtcgttacgtcactcccacgtctgggactagtggtcgatttgtttttattgaataattatttgttatgaaaattgaatcaaatgagttatactttaggctttaaatggctttgtcttttattttgctgtctttttctcatctgttaaaagacaactcctagttaacgggcacttgtcttgtccttcagttgaagatacacatacaagatctaatatcttccaagaaccatccatttgaaatttcgcttttcatagagtttatgcaaatgtggatttgggtttttagatttaaacgggtcacagaatatttaacttggggtaaattttcaaaaaagcataatggataattaaaatttagattggcccattatatttatcaggcccactaattaaatgtttgttgcttttctgctttttgacattttacaccggcaacctttgtcggagaacggttaagtagctgggataactcaggcggcgtcgcggttaggtagagtagaagaaactacaagcaagagagagcgattcactgaaggtaaccacgtcttaaacaaaatgaaccgaactataaccgtttggttagaagatttaaaacggaatgatccggtttgattttttggtttcagattctgcgggtactggcgccaaatcataattcgtggttccggtcaaagtcacggcgaaacagccatg

SEQ ID NO: 17526 - DNA, 3003 bp, Unknown
  misc_feature (1)..( 3003): 2750-1469P.txt file - cDNA_ID_1809550; gDNA_ID_1621169; Annot_ID_57219
ttctcatctttcttgcttgcgtagtcgactagtcgctgaaactctgttttctcaggtgtggaatctgtttaaagagaacaaaattcgtgaggtgatagatctgtctttgagagattctgcgcttgattaccctcaagtgttgagatgcgttcaagttgctctattgtgtgtacaagaaaacgcggaagatagaccaagtatgttagacgttgtgtccatgatatatggcgaaggaaataatgctctttctttgcctaaagagcctgctttctatgatggtccccggagaagctttccagaaatgaaggttgagccacaggagccggaaaatgtatcggcgagtattaccatcacggtgctggaggcaaggtgaattgaaaataagaaaactgatataatgtgaatctcattgttacttgaaatgtttttcttcgtttaatagagatataaacggattatatattcgggaattaggatacatactcttacaagagcaagtaatatcttaagtatcaatatacgtgcatgcatgactcttataaatttttccgttatccgaatccgggaaagtaaaagatctatacatattcatctcaacttaattgatacataaaagaagaccaaattcaagagataacatgtaaaatataacacatggaagtaatatttaaggtctaaataacttggacaagaacttctaaccacattcaccaataatattaatattaaaacatacaactttatatgataagtattgtattatatagaactcgcaaactgaagaaattccgtagaaatctagctactatatgtcgttccggtagaatattaatgatgtattcatataaagtcatgctcataacttcttcttttttgggcaaaatagtattattatgttatacagtacataagtttagcaaaatagggtctacctctcttcttcaaaagacgacataggagccaacataatgcaagatagaactaacgctaattaagataatcgaaaagaatatgacttgggtgcaaagcaaaaggattacggtttcttgagagaaactcatccaccggtggaatcaatgagtgcttcatcttcttccaatatgctgatatcatcattaatattcttggtgtaaaacttgtaacagataatccagacatcattatacctaggaatccatatactcatttctttttctttttatcaattgggtgtgacggctaaatgatgtaagaacaatgaaaaataaaaaaaagagcaaagtagaagggaaaaagcaaaattcgggagaatatttttccaccagtatttgtattggaaattttttgttggtaatacaaaactttaaagagctgctgaagttgagtaatctttacgatgttcattttcaatcttgagactatatctatatgtgttaagattgtatggtagaacgtgatataatatctgtatggtaacacgtgagagtagtttgttggtccattctacaaatcgaactaccacatgacagaaacatgtatgatgtagatgtactgtatattttaacagttgcggacaacattggtcggaaaaaaaaaactcataccaaattggtaagtagtgatattaattttggttcaatttcttgatcatgtgaataatagaattaaaatttagccaagccagccaaaaccaaaagaatccgtaagcatagcaaatataaagccactttcgaaactagcaacaatgacggtgaaataattttatcctagtttagtagactagacagtagaaacatgatgtgataaataaaatgatttaatctcatttctcatacttcacttaaataagatattatcttatagatttcatgctttagttagcttctaagcgtgttttaatgattatagggggacataacgacattaacaacacacctcaaatagtatagtttaaatgtacatttacagaaaattcattttaaactgattctaaaatgtaaatttacagaaaaattaatttaaactaaattgataacccttttatgaaaaatattctaagatgttagtcgcaaaattgaaataataagaaaaagatttataataagaaaaagatttataaaactcaattttaaacacaattattggaaaaaacttctatacagagactttgagagaccagcgagcacgtgtcaaaggcatggcatttacttcgacggctaagtgagggacagggaccctgaccgtaacagttcccaaggagttacaatgttccgtacctccttcatttgctaatccctaacacttacgtgagtagtgttagttatttaccctaatcaacatttggattaggctaatccatgtttgtgaggaccactatgatatttttctctctttttttgtttctttatcattatgatatcattataatgaaaaaaaaaaaatggcgaaaaaaaaatatcattatgataaataaatatataattggcaatcaattacacatgccaccatacttttacctttgttcacaaagtctcaaaattacagtactcacagtcagtcaaaattatagtactcatcaatataaacattactaatttagataattttatgttaatagtggatctaatttatgaacccccaaacagtaaaacttttttttctaaaacattacaataaaaatgatatttgtaataccgctatatattttacgattagtcacaatcaaaacggtatcaatcgacaaaattactgatgaccaatagaaattttggcaaacattattacaaaaatgtgttatgtcaaactaaattaaatgaaaacaaaaaatttgtaattgaattattaaatacgttgccataaattgatgttttgcccttaattaattgattacagtatgattaaaaaggtataactaacataaataaatacccttcaagaaccaaccaatctctcattctttcgtcacccaccttcttcactctctgttattttcacaaaccagaaaaattcaagtacagagaaatg

SEQ ID NO: 17527 - DNA, 3000 bp, Unknown
  misc_feature (1)..( 3000): 2750-1469P.txt file - cDNA_ID_1809550; gDNA_ID_1972148; Annot_ID_179373
tcatctttcttgcttgcgtagtcgactagtcgctgaaactctgttttctcaggtgtggaatctgtttaaagagaacaaaattcgtgaggtgatagatctgtctttgagagattctgcgcttgattaccctcaagtgttgagatgcgttcaagttgctctattgtgtgtacaagaaaacgcggaagatagaccaagtatgttagacgttgtgtccatgatatatggcgaaggaaataatgctctttctttgcctaaagagcctgctttctatgatggtccccggagaagctttccagaaatgaaggttgagccacaggagccggaaaatgtatcggcgagtattaccatcacggtgctggaggcaaggtgaattgaaaataagaaaactgatataatgtgaatctcattgttacttgaaatgtttttcttcgtttaatagagatataaacggattatatattcgggaattaggatacatactcttacaagagcaagtaatatcttaagtatcaatatacgtgcatgcatgactcttataaatttttccgttatccgaatccgggaaagtaaaagatctatacatattcatctcaacttaattgatacataaaagaagaccaaattcaagagataacatgtaaaatataacacatggaagtaatatttaaggtctaaataacttggacaagaacttctaaccacattcaccaataatattaatattaaaacatacaactttatatgataagtattgtattatatagaactcgcaaactgaagaaattccgtagaaatctagctactatatgtcgttccggtagaatattaatgatgtattcatataaagtcatgctcataacttcttcttttttgggcaaaatagtattattatgttatacagtacataagtttagcaaaatagggtctacctctcttcttcaaaagacgacataggagccaacataatgcaagatagaactaacgctaattaagataatcgaaaagaatatgacttgggtgcaaagcaaaaggattacggtttcttgagagaaactcatccaccggtggaatcaatgagtgcttcatcttcttccaatatgctgatatcatcattaatattcttggtgtaaaacttgtaacagataatccagacatcattatacctaggaatccatatactcatttctttttctttttatcaattgggtgtgacggctaaatgatgtaagaacaatgaaaaataaaaaaaagagcaaagtagaagggaaaaagcaaaattcgggagaatatttttccaccagtatttgtattggaaattttttgttggtaatacaaaactttaaagagctgctgaagttgagtaatctttacgatgttcattttcaatcttgagactatatctatatgtgttaagattgtatggtagaacgtgatataatatctgtatggtaacacgtgagagtagtttgttggtccattctacaaatcgaactaccacatgacagaaacatgtatgatgtagatgtactgtatattttaacagttgcggacaacattggtcggaaaaaaaaaactcataccaaattggtaagtagtgatattaattttggttcaatttcttgatcatgtgaataatagaattaaaatttagccaagccagccaaaaccaaaagaatccgtaagcatagcaaatataaagccactttcgaaactagcaacaatgacggtgaaataattttatcctagtttagtagactagacagtagaaacatgatgtgataaataaaatgatttaatctcatttctcatacttcacttaaataagatattatcttatagatttcatgctttagttagcttctaagcgtgttttaatgattatagggggacataacgacattaacaacacacctcaaatagtatagtttaaatgtacatttacagaaaattcattttaaactgattctaaaatgtaaatttacagaaaaattaatttaaactaaattgataacccttttatgaaaaatattctaagatgttagtcgcaaaattgaaataataagaaaaagatttataataagaaaaagatttataaaactcaattttaaacacaattattggaaaaaacttctatacagagactttgagagaccagcgagcacgtgtcaaaggcatggcatttacttcgacggctaagtgagggacagggaccctgaccgtaacagttcccaaggagttacaatgttccgtacctccttcatttgctaatccctaacacttacgtgagtagtgttagttatttaccctaatcaacatttggattaggctaatccatgtttgtgaggaccactatgatatttttctctctttttttgtttctttatcattatgatatcattataatgaaaaaaaaaaaatggcgaaaaaaaaatatcattatgataaataaatatataattggcaatcaattacacatgccaccatacttttacctttgttcacaaagtctcaaaattacagtactcacagtcagtcaaaattatagtactcatcaatataaacattactaatttagataattttatgttaatagtggatctaatttatgaacccccaaacagtaaaacttttttttctaaaacattacaataaaaatgatatttgtaataccgctatatattttacgattagtcacaatcaaaacggtatcaatcgacaaaattactgatgaccaatagaaattttggcaaacattattacaaaaatgtgttatgtcaaactaaattaaatgaaaacaaaaaatttgtaattgaattattaaatacgttgccataaattgatgttttgcccttaattaattgattacagtatgattaaaaaggtataactaacataaataaatacccttcaagaaccaaccaatctctcattctttcgtcacccaccttcttcactctctgttattttcacaaaccagaaaaattcaagtacagagaaatg

SEQ ID NO: 17528 - DNA, 3003 bp, Unknown; identical to SEQ ID NO: 17526
  misc_feature (1)..( 3003): 2750-1469P.txt file - cDNA_ID_1809550; gDNA_ID_1621169; Annot_ID_173914

SEQ ID NO: 17529 - DNA, 1533 bp, Unknown; identical to SEQ ID NO: 7852
  misc_feature (1)..( 1533): 2750-1469P.txt file - cDNA_ID_1809554; gDNA_ID_1621169; Annot_ID_57218

SEQ ID NO: 17530 - DNA, 3003 bp, Unknown
  misc_feature (1)..( 3003): 2750-1469P.txt file - cDNA_ID_1809569; gDNA_ID_1621170; Annot_ID_57248
ggaggtggtgacgcaaaccatggatgatgcagcatatgcgtcgttatgacgagattcaggtttgttgcttctagcctaagtcctattttgatctcttggaaccttagatttataattttagcgcaacttgctgctgcataaagaaagtctctttaggttgtaggtcaatcaataattagttttctaaacgcaatttcataagaggaactagggtttgctcttgtagtcagttttacgaaattgacctaatttgcggttttcttgtctgttatcactttgtttcatttaggacaaattgacctttagttttcttcttgttattgtaggttcgtattcttgattcgccaaatcagtgggtgcatccgcaaaactgtttgtttggattcgtgatagacaacatattttgctatagcttggtaacgactttctatactctgtttcttattctttcttacaaaaaataataattgatttagttgtaaaatgtttttttttatttgatgattggattttttcaaaagctcttttttaatatatttattattattttaaaggttttataaatactaaattaatataacgttgtgaaatctaaccggattttggatcccgccatttaaccgtggtcattagcgattccacaaatccaacatgtttttcacatcttcatatgtatttagcatttgtatttttttttctttaaaggttttcaactctttttttatttttttaaagattttataaatactaaattaatatgactttgtgagatctaaccggattttggatcccgccatttaaccgtggtcattagcgattccacaaatccaacatgtttttcacatcttcatatgtatttagcatttgtatattttttttctttaaaggttttcaactcttttttttatttttttaaaggttttataaatactaaattaatatgacgttgtgaaatctaaccggattttggatctcgccatttaaccgtggtcattagcgattccacaaatccaacatgtttttcacatcttcatgtgtatttagcatttatgtttttattttattttctttaaaggttttcaactccttttttattttatttttattttttaaaggatttataaatactaaattaatatgacgttgtaaaatctaaccggattttggatcctgccatttaaccgtggtcattagcgattccacaaatccaacatgttttcacatcttcatgtgtatttagcatttatgtttttattttttttctttaaaggttttcaactcctcttttatttttttatttttgtaaaggttttataaatattaaattaatatgacgttgtgaaatctaaccggattttggatcccgccatttaaccgtggtcattagcgattgcacaaatccaacatatttttcacatgtatttagcatttgtgtttttttttctttaaaggttttcaactccttatttatttttttaaaggttttataaatactaaattaatatgacgttgtgaaatctaaccggattttggatcccgccatttaactgtggtcattagcaattccacaaatccaacatctttttcacatcttcatgtatatttaacatttatttttttaatttttttttcttaaaagattttcaactcttttttcgttttttaaaagttttataaatattaaattaatatgacgttatgaattctaaccgaattttggatcctgccatttaaccgtggtcattaaggattttataaatccaacatgtttttcacaaatcttcatgtgtatttagtattttttttttaaaaagtttttaactgtttctttttttcttttcttattttgattttttaaaaagtttttctatttcagggtggataaaattagcagaaacaaacaaatggaatagaatcaaatcaaaaatcaaacaaaaaccgaaaaccgaaaaaagaagagtaaattataaacataattaattaccattccccaaaaaccattcccaaaaaaactagctaccatattttcatgaaagttaaatacagaccaatcccaataataaaaaatctctcgaaagtgaagttttgcgcaaagaagtcggctcagatattatttgaagttttgaactatggtagatacttatttataaatcaattacatataaaattaccaaaagctaataaatcgtaagccacataattcacgtaagattcctgtccgtctctgaaagtgtggtcgttactcgttaccgacgaaccgttgattctatggaaacaagaaagtccagaaaaaaacaaaattgcatacacgtgaatcaacaatttatgggtcgacctgaaatatatttagaaaaataatttactaattctttttttgatagagaatttataacaaactttagtgacaagtcataatcaaaatcagatgactcatcattttccaattttcctaggacagtggatttttcatatggaccccttaaaaaataaatatattaataaatatctaaaagcttttgtaaccgttgattaattacttaaaaactcattagaagcttgattattagtggaagacagacaacctttgtacttaaataccttttatgagttttgtctgcctctaatttactctttgctacacgcttctagatccctcttccttcgtcaaaatctcatttttcttttttcttgttgatattgagaaatgacttaatcctatttcgtctccttcctcaattcaacgatgcttagggtttgccccaaaattatataaactcgtcgatacatacaaagcttgtgactagaattcgtttcttcaagagtaaagcttcctcctttcttctcctctgttttcatctctctgaaacaatggaaagaattatgataaatccattgttatcaattcaaaactccccaaccaagttcttgaaaccaccactttcgtccattcacaggcaacaacaacaacaagagaggcagagcaataacaatacccttttcatg

SEQ ID NO: 17531 - DNA, 3003 bp, Unknown
  misc_feature (1)..( 3003): 2750-1469P.txt file - cDNA_ID_1809573; gDNA_ID_1621170; Annot_ID_57247
actgaagatcggctttgtgttttgctgtccaagtcttagtgtgagctcaatttatgtttctcttgcagacagatcttatacatcttcacctagatataagttatagcacataactaaagtgtgtattctcattcactggcctgtcgatctcagtagttcatagcacataactaaagtgtgtgttctcattcactggcctgtcgatctcagtagttcatatagtcaaacacatcactgatatatctgatgatcaaattactttctgttttccatgtatttttggttagtaaattcctgagaattgtgcctttcatcaattatatttcttgcgttatttttcaccaacgagagatccttaggatgcatatttttcatcttgttgtaggatgaggaagatttttctgattcatcaaagaagggaaacgctgaaaaccctaggaaacatcaaattggggagaacatacccaagaaggataaaataaagtttcttgtgaacactgtaagcagaatttttttgtacactaagctatttctttttgcctttctaatggtttgtcgattatgagaattttcatattcttgtttaaccttagttttttactcttatggttcttattttgctctcatctgtgaatgcagcttcttgatattgaagataataaagaggctgtttatggagctctggatgcttgggttgcttgggagcgcaatttccccattgcttccctcaaaatagtaatagctagtcttgaaaaggaacatcaatggcatcgaatggtccaggtatctatcacctgagtgttctatctcttttctgggactcatgaaccatgaataatcaaatatccaagaacatatgtctattgctatagtaactgaaaaagtagaatagaatcttggggaggtgtttatttcttttcccctgtttaatcgtttgtaggtgataaagtggatcctaagtaagggacaagggaacacgatggggacgtacggacagttgatacgggcgttagatatggatcgtagagcagaagaggctcatgttatctggcgaaagaaagttgggaacgatctgcattctgtgccttggcaattatgcttacaaatgatgcgcatatatttccggaacaacatgttacaggaacttgttaaggttctttttcccccttgtcttcactgaccgaaaactaaataagaaaacattgcacattgatacttaactgaactagtaagttactttatttcgtggtgacctcaaacttgtgtttattttgttatgtgggttatgaagctattcaaggatctggagagttatgaccgtaagcctccggacaagcacattgtgcagaccgtggctgatgcttatgagcttttgggaatgcttgatgagaaagaacgggtagtgacgaagtatagccatcttttacttggtacaccatccgatgataaaccaagtagatcttcgaggaagaagaagaaaccaggtaggtgactgcgatttagccattgatatcttcaaccatctttaaagccgtttgatattgaactcatgtgctatagattcttgcgcaaaacaggataagttttaaactgtctaacttgtgatttcagaactgaggattccagaagcaacgacagaaggcgcagttgatgcagcaaaagctgaaatccaagaagagcgaaaagaaaatctggataatcaccaagaatcagaagctgccactgaaaaacaattcgaacatggagcgtaagttgtagtatttaatcgataaagtatcactgcaagagaaacatggactgtaaggatgtatttaatcgatggattgttgacaatgctcacatcccttgggatttgtcgcaatggatggatatagagtttagggtttgagtgcggcactagtattactgagaaataagataacaaaatcacatctacatctgaagttttcgacacactcaacatccaacggtctgaaccaactaccaaccaaaccaataacatcgtctaaaacctacaaactgattgaataaaaagataagctagggaaggtatcatagtggttcggtacggtttgaattggttagatgagattggacccctaccgaaaatagagtcttcggttacatttggtttaataacaagttcatttgaaagttaagaaaataactagtattcgaatttagagattgcgggagattgtatgttcattcgaaatacagtacagagatgcttcgattccagatctgcgtccggtctctaatggccattcgattctcgaccaaagagggaatctttcgggatgggttgatttgtgggaagtgggaaccaaacggaatgggaagacggaagaggaaaggtttaggagatatcaatcagacctccaaggccaaagtcaccttccgatttaggtaaagctttgaaataaagagataaattactctttttcaccggacacgaatgagatatcgtaatttggtaaacttgatagaagatgatcagtgacgttatttctcaccaacactataattccattttaagaaactttttctcattttagttacagttttccagtttgaaatctctcacacctttacgactagactacaaaccatatctcttacccatcaactcttaaaaatcaggcattgctttatcactcagtaattagtatttgacgtttagagtgtactcgattagatagatagctttgcgtccaattctctactttctatttaccttgtttcgtatcgaaattgataacgtaattgactataagaaactcttttgccaatcacttgctgttgtgtttttatgttcctgaaaacagttcagtaactggttttcttataaatgtcacgaagagcttacattttcttataaattacataaatgaattctgccaattttctctttcagacttttcttaaatttgagctcttcgtgcagctaactgttgcctattgattgattaactactttttggttagtttgggaagaaaatg

SEQ ID NO: 17532 - DNA, 3003 bp, Unknown
  misc_feature (1)..( 3003): 2750-1469P.txt file - cDNA_ID_1809577; gDNA_ID_1621170; Annot_ID_57246
tgatttttcgtccttaggttctgaagcttctgattcttcaccctttgcaaactcgatgttccctagatgaaggattgcagccactactcggaagattccatcctacagtagtagaattgtaagaagagttgttccaatgactcaacatgtaaaataactagaaagtacctgctcttcagaattgatcccaacaacgtccatagctttccttgtagctaggtattccttggaatcatcaagcccatccaacgcataacaattagactgatttagatagcgaaatgtgcttggttttcccaacttgtacctctcagtttcctgaaacctcatgaaaaaactatttagtcaacgtgaatctcatgtaaagcatgtacataagatttcgagctaacaccgccttagaagagaccagggcttacctgttctggtgcagcgcaaagcatgtaaaagcaatgatagtttctttcagggtctgagacttgacaaacccgcgacctctctagcaaatatgtcctaatagcagctcccgagattcttcccctctgatcaaactgaatctccacaaatttaccaaaacgactgcaaaatggaatttgcgtaagtatcttaaattgggttcaagaaaatacacaaaatggtcaaatcatcaaacgtgagactcctctcctccaccttgaattattgtttctaacggtttttgcattgccaaaagcttctaaaactggatttgactgcaaaacaggaaagtcaatcagcgaaaagtatgacaagatattactggaggaaactaaccaagtctatcttttgcaagaatgaagccatgtattttaaaaaattcattacctccaaaacttgctgctccacagatcttccttcactctcagctcttcctcccatgtaggcaagatactgcatgagcatcttcgtgctctctgtcttgccagcaccgctttccccactcaccaagatcgcctggctcactccctcgttaatcattttcctgaaaggttatgtttttggtgatcataatgccgaaaaacagttgtaagtgaaacaataatataagctaatttaaacggcaaaagagttacctgtacgcagaatctgcaacggcgaaaggatgtggactcaactcaccaaatgctgtgcccttgtactgtttcattgtctcacttccataaaggtggggcaatctcttaaagggattcacagctatcaatatatttcctgtgtacgtctggatccatcatgaaaaaaattagattgcataaactgtggagacatcttaagatcacgtgatggttaatgtaaacaacaaaattacttgaaagcaagaaatacttgacaactagtaatcgaattgaagcttacatatatttcatttgcattataacggcacttaagattgagcaggacccctggttcatgcaaatatgcaagctttgtcatgtcgtctactccaagttcagggaactcggggtccttggggtagacattatttaactttgccacaacctaagaaacaaatgcatcagaaacgagagctttttttctcaatgctcatgtcataaacaaatctcagataatgcatgaccattaaggaactagttccatggtcacagaactcagaagatcaaaagctaaacgttttccacaataacaaatgtctccatatcaagaaatcatatactccttcggcagattatctaacaagttttatactttcttaccgtctttccagagcagttaactgtgatttcttcactgttaacttcttctacttccccatctatccaggcatcatctggatcctccacccagacatgagaccctaccgttactttggctgaagcagcctgcacataaaccacatcataactacacaatcaaacaggtaactgaaaatcgaagacaacaacaaagagagatgaattttctcaaaaaaatcttttttttctttctttctcatccaaaacaaaatcaatagagagagtaaagttgttcacagctttgttcaatcatatacaaaccaatcaaaaaaggaatttttttgttttttaattcaacgacatatggttccatttttacacatttagaaactcaataacaatttgatacaccatacgaaaattcatgtatcacagtatgataaatttacataaattaaccaaaaaacgtttgttcacagaaaaattaaaattgaaatcacacaacagagagaaatcaaaacgaatcagattttgttagaagaaaccacaatgcgattaaagaagagaaagctcgtaccattgttatgatggaatttggtcagatttttctaaaacgatcccggctcgacaatacccaacaacgggagaaacatcaacacaaacttttgaaaatccaatcacaacggatccatgataaaatcaagaaccaaaatttcactttcccagcttcaaaactttctgatcgacgtcaacaacatagaaacataaacgaggctacatgcgcaaaatttcgtgacgattgcagaggatcttaaacccttgagtttttttccctttgaaaaaaaatcccagaacacataggtctgtttcatccagattttctcgcagaaacctgaattttttttttcttggattttcttgtcccctggtttatttccccccaaaacggacgttggaacttggaaagcgaacgaagaagaatcatgaaactttgtaattccgatgttaccccttttcattaaaccgatccggtttatctatctcgctttcaacggatctaatagaaaagagagaagcgtctttctcgttaatgggccaattcttttcttaatgggctacacgttttatcatctctatttcaacggatctactactacatagagaagaagcttctttttgttattaatgggccaattttttttattaatgggctaattgtaacagtatcatttctgaaaacccctcccttaatacgcctccgtcttcgttggttctcgtagcaccgtctccaatg

SEQ ID NO: 17533 - DNA, 3000 bp, Unknown; identical to SEQ ID NO: 7876
  misc_feature (1)..( 3000): 2750-1469P.txt file - cDNA_ID_1809581; gDNA_ID_1621170; Annot_ID_57245

SEQ ID NO: 17534 - DNA, 3003 bp, Unknown
  misc_feature (1)..( 3003): 2750-1469P.txt file - cDNA_ID_1809589; gDNA_ID_1621170; Annot_ID_57243
ttagtatttataaaaaacctttaaaaaattatttatttaaatgttttagtgaaagttttagttttggttaaaataatttttaaagaaaagaagaaaaaaagttagaatgaagaaagtcctagtgtaacgaaggcctcatacagcaaagcccattccaaagtcctagtgtagctctgtcgtaacattatccaccaattttaggtcaattttgtaaaactaaactacaagatcattccatgggaagcttctctccgatatgcaagacaagacgccaaagaatggcaagatgcagaagagtacacccaccgtttatcatcaaaacctgacagagtaacgtcacaagaaccaacagctaatctctggacaacaccccctattggttggacgaaatgcaactatgacggcacttaccacagcaacgctccgagtaaagcgggttggctcttacgggatgatcgaggaacctttctaggtgcagctcatgctataggctctattactaccaatccgatggaaagtgaactccaagctttagtcatggccatgcaacattgttggagtaggggctataggaaaatttactttgaaggtgacaataaagaagtctcagagattgtcaatggtcggtcttcaaattttgcagtttttaattggataagagatataagcgcttggagatcaaaatttgaagaatgcaagtttacttggacaaggcgattttcaaacatggctgcagatgctctggcaaaacaacaacttcctttgaacactcagttttattgctataactatatcccgtttgtaataactgattttttacatcgcgactttgctacagcaaattattaataaagctgatgtttgaggaaaaaaaaaaaaactacaagatcaaaccctagttcctccgatgaaattgcggttagaaaactaaatattgattgacctaattcaaagagaccttttttgtgcagaaactaaatattaaaaatccaaggttccaagagatcaaataggaatttaagcgagaagcaacatacctgagtctcgtgacaacggcgcgtggtttgcgtcaatacttgggactctcggtgagatccgccatgatttgctagagagatcgtgaaacgcaagaaaacagagagacaaacggtggcgagatcattgatggtgtgatcaccgagttacagttccgacggttctgacggtggtgaaaatggatggtgatcatcgagctttgacgttctcgtgatcggtgagttctttttgtaagagaggaacagaaacaaacagaggctaaaaagacaaaagaagaagaagaaggtggattttttgttttcttctcgtaatccatgctttggaccttgtatcagccacttatgatcatttgctatattgatgctttccaattttagagtattgaaatgggtttctttgacaatcattttgagttagtcatcattccttgttctgaatcaagaattggcttttgttatgttgtctaggttctgcttgtaactagagtaatgctattgtagtctctgttgtttatttgtagaatcatagagagtcgtggaagcatgttttagttgttactctcgatttcttgtcgatgttgtggtgttataaattgagcgttttaaccaatacaagttaggagatggttagtatgtgactatgtgttagtggccatgtatgtagttcgatcagataatctgaatgatgtgctaaagagcttgcataggaagactgcctttgtgttagcttgcatagagacttgttgcaatatatgagactgaaaactattatgtgaaaactttaatttgtgtacaaatatttttaactcttaaaattaaactaacattgtaccaattagcacatgaaagaaacacagaattctgtgaacatatgatgaataactatataaacacattatggattcagttaaggagacagaaacaagaagatgaatttcagatatatagcaatagagtcacttataatcatatcagagcttatactttatacaaattatcactttagtccttaaattaaaaccgatttaatcgacaatcttgttattctttaaaacaatttgttcttattttcaatctttaaattttgcaacaatcgacagaacttatcgttattccgtgtttttattttcatatctttcttaaaatgtttcaaaataatatatgtttaatattttctgatttacaatagttattaagttatatgaaatataattattttaaattttattttatttttcagaaaactcttataagagagcttaccattagaatatgaaaaaaaattaaaactctcttataactttttaaaaattttaataataaaaaaatggagaaagcccgtgaaagagctcttacgaaccaaaaccattcagtccggttaagaattggttatcaagtttggttcctaaaagatatccaagttcaaaagcaaaaaaatatcttcttttctctctctctactctcttctcttcttctcttcttctcttcttctctggctgggcaaccatgattactgtcgtcacctccaggctctctctccttcctccagtcttctccgtcgttaactcttcttcttcgcgttccaaaggtgctcaatttatttctgccacgtcttctctttatagcactctgttttacacacgtcgttgattcttcagttttttaaaagacccgtcttatacaaaatttcagtgtaaccgatccctgaaattcgttaaagggatgaaattttatctaagattcggagttttcttttcgaacatagtggtaatgtttgtcgaatgcttgatttggtcttccacagctgtcactatcgagtttgaagatagaaatcttgtgttaacttagtatgtattactgcataatgtcaattctgtttgaaagcatcagaatttcggaacagatttttgtttcgtatagcatcgatctttgtcttgtgtgtttttatcttctctctgaagcctgcatg

SEQ ID NO: 17535 - DNA, 3000 bp, Unknown; identical to SEQ ID NO: 7867
  misc_feature (1)..( 3000): 2750-1469P.txt file - cDNA_ID_1809597; gDNA_ID_1621170; Annot_ID_57241

SEQ ID NO: 17536 - DNA, 3000 bp, Unknown; identical to SEQ ID NO: 7867
  misc_feature (1)..( 3000): 2750-1469P.txt file - cDNA_ID_1809597; gDNA_ID_1621170; Annot_ID_173941

SEQ ID NO: 17537 - DNA, 3000 bp, Unknown
  misc_feature (1)..( 3000): 2750-1469P.txt file - cDNA_ID_1809609; gDNA_ID_1621170; Annot_ID_57234
gccacttaggaaggtgggaagtagagaaactacttttatgcacacgcaggggtcagatgatttcttcaaaagcaagctgcttggtccacagttgatagttgaggatgtgacgaacgaagtaatttcagataatctcttatcagctactattgtccctcaagtaaatagggagtccgatgatgatcacaaatcctacacaagggagaaagagattacaaatgcggatcatgaatcagaaatggaggtacgaaatttatgttttcctttagattagaaattctggctgtcttggtgtgtgtcaggttggggtttatctctctggtatttttttcatattgcaggaaaagtacaagaaaagcagaaacaccgatgattcattcagcgaagctgcaatggttgaaatcgaagctggaatatatggcttacagataattaaaaacactgatcttgaagacttacacgagcttggatctggtacatttggaactgtttactatgggaagtggagaggaactgatgttgctatcaagaggataaagaatagttgtttctctggtggatcatccgagcaagcacggcaggtttaactcttctctcgagtctttgtacttttgaagggaatttcagaaccgcagttttcactgatgccttactgaaacagactaaagatttctggagagaagctcggatattggcgaatcttcaccatcctaacgtagtggccttttatggagttgtaccagatggacctggtggaacaatggcaacagtgactgagtatatggtgaacggatctttgaggcatgtcttgcagagaaaagacaggtacacaataatctgtcaaatctttgtatgaccttttgtgatatgacattctgagtttactgatggaaaaactttgggcacagattacttgataggcgcaaaaaactgatgataactcttgattctgcatttggcatggagtatctacatatgaaaaatattgttcattttgatcttaaatgcgataacttgcttgtaaacttgagggatccacaacgacccatttgcaaggtaacacttttccccaaaatcaggtaatttcaagccaagttgtatgagtaaagtgctgtatttattagtctcactgttgaatttgcaggttggagatttcggattgtcgagaataaaacgaaacacgcttgtctctggtggagtaagaggaacccttccatggatggcaccagagctgctaaacggaagcagcaatcgggtctcagagaaagtatgttgttgagtccaaaatcaaaacattgaaaatgttaagagtctttgttttaatcttaacatgtttttgcaggtcgatgttttctcatttggtatcgtgatgtgggagatcttgacaggcgaagaaccctatgcgaatctgcattgcggtgccatcattggtaagtttctagcatgagcagttcttcagtctttgaacaagatgaacttggattgagctttggtttatgatctaatttttgatctgtttggttttgataaaaaggtggaattgtgaacaatacgttaagacctccggtgcctgaacggtgtgaagctgagtggaggaagttgatggagcaatgctggtcattcgatccaggagtacggccatcgtttacggagattgttgaacgacttcgatcaatgactgttgccttgcaacccaagcgaagaacctaaaagccctctcaaataaacgtaagttgtgagatacatgagcctttttttgggttggttttaaatttattggttgaatgaaagcagaagatgggaagaatatagatttatgagattgtgtggagtctgtaaattagtattgagaagcatttaccggtttaggtaaaagttgtataccaagaaagttgagggtcaattgtgtaaaaaaacacaacttttttttatgtaaagcaatatgttggagtaataagcccaacccattaaaactcagcccataaattgcaacgttctccattgttgttctcaaacgcgcctcacttaactcatcttctcaaattatttcaaatccagcaatttatgaaacgcgctcttcaacgttaatcatgttgttctcaaacgcgctaacgagaccgtttaagtaaattgtaatctatcttgtagaataatcagccctgacctatatagtaccacctcatgtcgtggtagcataaatatacaagcccaaagcaaattttatagatcgaaagtttcactaacttggcccatgtttacttatttatcgctaagcagatggatctcaatcttctttaggacttgatacgacatcagctcccattctattcgccaactcaggattctcgatttagtttgaccatttgagctgctctttgtttgtttcaatgttaaattattggaattgaaaaacatggacatatgaaattccaacaaaactgttacagcttaatcataaagcatatgtaactaaatgattactacaattgattatgagatactaatcacagattatgccaatgagaaacagaccaaagcaccaaacttaataagtaacaactcataatccatggaaatcaaaaacgaaaaattctccataaacattgagaagaaaaaccaaaaagaaacaacaacagcagggaaaagaagaaagcaaagacttacgtagagaacagatgaacgaaagtttcgaatttgaaagtaggctcgaagagagactaagacggcgtttttagggttaattcataagagaaacgtgccgtcgaagaaatgactgtcgagtttttctgagagagaaagaaagacatcttactctatacgacgtcgtttagcatcaaaaccagatgattgattccgctaaaccctgaaaccgtatatgtatgtaacccatcctaaaccgggatgaagcggtttagttttttttttcctttgtcttttatctgctttacaacgaacggtttagcccagtttgggcttcaaaataatcaaacgaaaacaatg

SEQ ID NO: 17538 - DNA, 3000 bp, Unknown; identical to SEQ ID NO: 7888
  misc_feature (1)..( 3000): 2750-1469P.txt file - cDNA_ID_1809625; gDNA_ID_1621171; Annot_ID_57257

SEQ ID NO: 17539 - DNA, 3000 bp, Unknown; identical to SEQ ID NO: 7888
  misc_feature (1)..( 3000): 2750-1469P.txt file - cDNA_ID_1809625; gDNA_ID_2926133; Annot_ID_138808

SEQ ID NO: 17540 - DNA, 3003 bp, Unknown
  misc_feature (1)..( 3003): 2750-1469P.txt file - cDNA_ID_1809633; gDNA_ID_1621171; Annot_ID_57255
ctcgcttttagttcctttcttcacaaattccaactccagcgtcagcatagccagatcaaaattttcaggaggaacaaatctgcaagaacaagacaatattcagaaaccaaaaacgtattcatgccagaaaattaatataaaaacaagctgtataatcacctgctaacagataccatatcaccagtcgaaactctagcgtgtcgcctttgaatagcattgagagcaatatttccatcacggatgcttccatgtccagtaatcaccagttaagttcacaaaaatcgaaataaatgacacaatgaacaagttcaacattgtcaccgaccaaaggagcctagatttctataatccatgaaaaccagaaaaacctaacttgtactacgatcatagatcaatcaatcattataagaaccattcataaggccgagattcaaattcgaagatcgattttggtaaatttagcagtaattagccatatcacataaacaatcaactcctaggatcgcatttcgcattgcaatgtaagaaatgaatcgtaaaatggaaataagaaaggatatcagagagaaagaatgaagctatcggcaacgttggcgaggaagagatcggaaccgggaacggagaattgacggagatcggaagaagagcagtaagcgaggttagtaaaagctagatctgcggacggagtattggtcacagtcatcgtcatgacttgcgatccgtaacgacccgccatggctggggtttcgatctcaggtttcttcgagtctttttgatttttgtaaccttaacgaataagaaaatatttgagggagaagcaataaacagaagactacgattgcttccttgattttaataagatcttttatttttcgagtcctgatcaatgttttggaaaccagaccaaacattccggttcgaccaatagccgtctgaattaaaccaaaaagcggtaaattaaatctggtcataccctctcggctcggtattagaatccggtttgcaacacaaatcataattcattttttttgttgttcttttcttatttttttttttttttttcagtctaaattttagaatacttgctcactgattattttgagcaagtcatgcatgagacacatcctcacaattcaatttgagttcggattaaccacatttatttatttttcaacaaatagttcaaaacttcaatcgatgatcaattatgtgaaactagaaggtcaacacataaaagctcaaaagatcttggactgtcacagagcaatgatagatgatggatgctaatgaatggaataaacacaatgagaaggaagatgaggcaaaacaaccttcacatagggagatttttaaattgaacaactagctcaagtaaacttataagtaatgttgtaaacatggaatgaataagtttgaaatttggtgcattcttagatatgagaaggtggttaaaagggtatggtgcaaagacatatccatccctagtatttaatagattgaaagaaggaatttttttttggttctagtttaatgagtgaaaatgaaaaaataaataaaaaggcaaatgaagatgaagatgaactcaaacttttgactctctaatgtaatcttataagcaaataaccaacttttctactgaaagttataagaaaatgaggcaaaagttttatttatattagggaatttaatgaaaaaaaccctcaactttggccagatccatttttaaaccctaaactatgtttttagtaaaacaaaccctgaactaaaacctgttaataaacttaaccccacagtaattaaacaacgtttagggttaagtttattaacaggttttagttcagggtttgttttactaaaaacatagtttagggtttaaaaatggatctggccaaagttgaggttttttttcattaaattccctttatattaattgaagccgcaagcatgagcttgacccgtttgtgctcatggatggctctgcttgtatctagttagaagccgaaacaactagttttcagtacgctatgcatgtaactcaaagaatttggtgtaagcaataagtgattctcattcttggtcgtgctacattgagggagatacaacaaccatgggaaacacttatgcctaagcctaacttttgatttgggaggaggcaaatgaactaatgcctaagcctaatattttgcacaactctactcgcgtggcacctcttatcatcttcaaattggtggatcgtgagcttcgcaacctaatcacttctcgacgacatcgcaagcgttggcagcggctaatgcttttatggattcgttaaacacacctaaatcttttctaattctattgtagccttgtttttattttttttgccttggttacttttctataggttgtacgttcttgtattttctgaactctcattgtaatgatattaacaaatttagcaaaaaaaaaaaaaaactaatgtcaaacaaggatcctcaaatgccaaatgtcaaattaagttagtacctttccatgtttacaaatttgaatttgaagatggtaaattagaagaaaaaatgaaattatgatcattttccttaatcaaaagattcaaaactatcatttaaaatttacttcttcattttttgctcttaaaagaaaaagtaaaaaattacaaaaagaggggaaaaaaatttagagagaaagtgaccagacacgacggcgtttttgcatcactttcaccgagattttttttctgcatcccggcgacgagactgtgactccaccaaaccctaaaatcaaaattgcattttttgttcgattttgattttgtggggattttggaattttccccgcactaagtcgtctcgttaaccccacttaacagtttctcactttgacactttctctctctctcaacgcacagtgctttctgtcgccttcaatcgcgactttttgtcacacttgccctcttttctccgatttttctataaatttagggttttgtttgctttcgttgacatg

SEQ ID NO: 17541 - DNA, 3000 bp, Unknown; identical to SEQ ID NO: 7883
  misc_feature (1)..( 3000): 2750-1469P.txt file - cDNA_ID_1809637; gDNA_ID_1621171; Annot_ID_57254

SEQ ID NO: 17542 - DNA, 3000 bp, Unknown; identical to SEQ ID NO: 7912
  misc_feature (1)..( 3000): 2750-1469P.txt file - cDNA_ID_1809649; gDNA_ID_1621173; Annot_ID_57282

SEQ ID NO: 17543 - DNA, 3000 bp, Unknown; identical to SEQ ID NO: 7912
  misc_feature (1)..( 3000): 2750-1469P.txt file - cDNA_ID_1809649; gDNA_ID_1621173; Annot_ID_174066

SEQ ID NO: 17544 - DNA, 3003 bp, Unknown
  misc_feature (1)..( 3003): 2750-1469P.txt file - cDNA_ID_1809649; gDNA_ID_1620779; Annot_ID_167867
cgtgtatgtttaagggtttagtttaaaatcttgtttattctcaacaattttaactcaccaacaaagatgtacgtacattattatacatgtacgtacataacatttttcaaaagtacgaggaacaactatactctgaccatataattttatttaattattatatatgaatagatttatgatgaaaaccccaaaagatattttatctaatcaaaataatcaaaagtttctaatgtacaaactcaataaatattttgtatgtcgcctttacaataaaacaacatctaacatgtttatttctattttaaataatattttatttattatcatttgaagacaattcacgattagcaatatcatataaacatatgtgcgtaacggtaataatatatacgtacacggtagtaatgtgtacgtacacggtagtaatgtgtacgtacacggtagtaatgtatgtagtaatgtgtgtgtacgtataccgtaaattacatatacgtacaaattttttttttaatgaagggtataattgtaattttgcactcgtcttcaacctctgcaaccctaattttgcagccgcttgttaactcattaacatccgaaactcctcgccgccgactactcttctttatctccgccatttgagtatgaacaataattcaagaaaccagaaaatcctctttttgttatcctttatcacgagctcgatcgaaatttcctcaacttaagcaacgaatagaactcgcacagagcctcaatcgaactttcactttcgatcggagtttgtgtttcgtcggaattgttattcgtcttcgacaaacagtttttgattttctttggttgttagaaagttaataacgtatttttgatttaattttaaatttaaattttggtaatcagaaaaataaagaaacgaaactgaaccgcctcctttcatttctcgttccagggcaaatttgtccatttttggctgaatggctaaaatctggttgggcgagcccactttgtctctttgtgaaagaaaaagtcagaaaggtgtcaacggtgaaaatttcttttttttaaacgggaaaaatgtcgttttatacgtgaactttcaaaaagtggacattcaatacgtgaactttgcggtcggccaaataaaacatgataaaaacgttgacccgccatttaacacaaatcaaaatgttgaccaggccaaaatcccgagacgttaactggcattaacagatctgataaccgccgtaagcagacgttaattgtttctgttaaagtcgaaaacgacgtcgtttcacgaaacaataaaatccccaattcaattttgaaatccctaattctatcatcttcttcactcttcttccatagctaattgaaatcccaaattcttctatcttccatatcttcttctatcattttctttaagtttgatttcgaaatctctaattttatcatcttcttccattgtttgatttcgaaatcctaattcttccatcttcatccatctttctagctccgtcgattaccaagtatctcctccatgtgaatatacttataccaaaagtggtccacgtgaggaagaatcttcacagctcaatcccaaacgttcctcgcatggttgacgtctttgttccatagcttcattaagcaaccatggatgataaaagatgatatgaaagctatggaagtttgattaagttagaagatggacgaattagggattgaagatggaagaagatgatagaattagggattttaaaattgaattggggattttgctgtttcattttatatgaaacgacgtcgttttcgattttaacagaaacaattaacgtaattaacgtctgcttacggcgggtatcagatctgttaatgccagttaacgtttcgggaattttggcctagtcaacattttgatttgtgttaaatagcgggtcaacgtttttatcatattttatttgactaatgtcaaagttcacatattgaatatccactttttaaaagttcatgtataaaacgacatttttataaacttgacgaagaatctatctacctccaagatttgttattaacggaacttgataagacgttggcgtgtaaattttttcataatattgtggtaccgatgaaattcaaaaagctgtcactgaacggtgattaatatcgtaataaataactaataaattgtcgaacgattctttttttctttagtaatgttgataggcttatagctaatcgcctaatcccctacgtgtgaacactagaaatagcctgaagagacaagtttactagtactatgccattgaaatgcgtgacatttacagtgatacaaaattactattgctttcctttgttagtttagcaactaaaatttaattaaatggcttctgacaggagtatatttaaaggcttaaatttgatttgtgacaatttaaagtcctttatgatttgtgaaaaattttggattcttttttaaccaagtgattaaaacttatctatatcaacaatggtcttttataactctcttgcttttgtgtttaggtacatttaacgaaagataaagaaacaaaaagtgacgaagaagggtttaattgcaacacttgatactttatggtttaaaatacatcccaaatttagtgagtgatttgtagtttgacaaatttcgaagaagggtttcattgtaacatttgatagtttagggtttaaatcaaatctcaaatttagtaaggtaggtttacataaacaaaaccaagaagttgtgttttgttttgcaattttctcaaagacaagagtacgagactcgtcgacgtctttcttcctcaacttcgacaaaagaaaataggattatttcagaccataagtcattgtctccgcctacaaaatcggcgattattaatcacattgtcttcttctatgtttgatccactttaatctcttcataaacatcatttttcctctaaaagctttttcctttactcatcttttctcttctgatcaaaattgtgaataatg

SEQ ID NO: 17545 - DNA, 3000 bp, Unknown; identical to SEQ ID NO: 7911
  misc_feature (1)..( 3000): 2750-1469P.txt file - cDNA_ID_1809653; gDNA_ID_1621173; Annot_ID_57280

SEQ ID NO: 17546 - DNA, 3000 bp, Unknown; identical to SEQ ID NO: 7911
  misc_feature (1)..( 3000): 2750-1469P.txt file - cDNA_ID_1809653; gDNA_ID_1621173; Annot_ID_174063

SEQ ID NO: 17547 - DNA, 3003 bp, Unknown
  misc_feature (1)..( 3003): 2750-1469P.txt file - cDNA_ID_1809653; gDNA_ID_1620779; Annot_ID_167870
gtatgagaccccacacggctatgaaccatgttaccatatattctaagtgggtttttaatttgataaccacctacctataactctaaattagtctattggatttttctaatgatcatcatataaatttattctctttatataatagtaatcgttgtaaataatatatgtgtgtctcccatcaatccgcatcacattcgtagaatcatacacgtatgtaaacgcatttttgacatacggaaaccatacaagtaggatctgttaggtggttattaattcaaaataaaatctcttttcattagaaaatataaagagactacttttataaaaagattgggattgtagttccttgccaaccacccatataataatactccccaacaccaaaaacacaacacaaacttagaaaaatggaagaagaaaagagattggagctaaggctagctcctccttgtcaccaattcacttccaacaacaacatcaatggatctaaacaaaaaagctcgaccaaagaaacatcattcctttccaataacaggttctcttaatctcttctcatgaatgatttgaatcattcttgttcattgtagatgtcttatatgataataaaataaaaataaaaaacaaaatcctggtaattctacagttttcggagattagtttgggtttcggtatctagttatcaaaaagtatttgtgtatatgttataactagatatggctaaaacagggttgaggtagctccagtggtgggatggccgccggtgagatcatcccggagaaacctaacggcacaactaaaggaggagatgaagaagaaggagagtgatgaagagaaggaattgtacgttaagatcaacatggaaggagttccaataggaagaaaagtcaacctttcagcttataacaactaccaacagctttcacatgccgttgaccaactcttctctaagaaagattcgtgggatctaaacagacaatacactttggtctacgaagacactgaaggagataaagttctggtcggggatgttccttgggagtaagttttaaatcaaacaaaactaattccatttttttttctggaactgaatatgaacttactttatcaaaaattcattttatatctatctacttttgtttttgtcgaatttaacaaatatttttagtatgagttcctaaaaagagtttggccatttctcatcagattattattttcctttaaaggtcatatttttggatatttatctgataataatttgaatcattggacatattaatgatatagtttactttatttgttaggatgtttgtatctactgtaaagaggttgcatgttttaaagacctcccacgccttctcactctcacgtaagattacaattcttacgaaactttttcatacatctcatcacttaattactgccttgaaattaacttatatatttatttattttttcacagctagaaaacatggcaaggaatagagagaggttggccaaaatcatcagttcgatggtttgtttttaatgtaatttttgtggaaactaatggggtttggctttgatttactggttttctttttcacttatgtactaggtttttgcttgctatgttatttcttgttttggttgtaaatatgctgttcgtttaagaaatcgggggttagtatgttatcgtgtgtataaaaatagtgtaagcacgtaagttgattacaatgcctgatatgattcatgccttcgtttcgttttttagtagggaaaatggtatttaattagcgaaatcaaaccgactcattttatgtttttttcagagaggtaaaaatccagagagcctgtttactatgtatgagtaaagattacccgaaataatagagaaatagatacaagaggctatccaagtttggtgggttcgagttttataacaccatccaaaaaaaattgttgttttgtaacacacatgagtaccaattgtttatttcacaaaagacaaaccatttatttcatgaactgtaatcttgttatgttcatgaattatttcggtataacatgtaattaactcgagtaatatcttaaaatagtatttagagtaaagatagtagggagaaagatactttatttttttataactcatataattttaaaaatttcatacacccaaaaattgattatggagtatggaaaaaccatgttaaattacttaaattttggtggctaatactactcgaactcagatggtgaaaacgactttagacttcattaatataaatatatatatatatatatatatatatatatatttatatgagtttttacttattgtcaattggttttggaattagtaatctatgaaacttaacatagtatcagtctatcagaggttgaacattcgctgacccgttaatccaacttggaaaatggtccgattacctctactaattgatgatccaaagaaaaactcaattatgtcgagataggtaaaaaaacattattttaaaagaaataatgaatttaaaattagtaaataaaatttaaaatttaaaaattctcctataaattttgtgtctcacaactttctttcaaactttttttcttcaaaaatataccgtatgctgatgaaatttttatctttaccaattaagaatataatcttttgtttccatctcaaatcatcatcatcacctccaaagcgtttagcaaccccaaaaccaaccacttggcgactacacagtattttactcaaaacatcacaagtttctatgaaacgtaaaacgatgagtttagtaaaaaaaaactagagattatagtcagaaaaactataataataagaagataacattaaacggatagattcatgtctcttttttgaaatccaaaattgggtaaaatccaaaaaccaaaatcttgccaaatgccaataagagcaaaaatccaaactttcctttctcttcactattacacaatgaaatcaacactacattttcacatcaaaatcacattccttccatg

SEQ ID NO: 17548 - DNA, 3000 bp, Unknown; identical to SEQ ID NO: 7909
  misc_feature (1)..( 3000): 2750-1469P.txt file - cDNA_ID_1809665; gDNA_ID_1621173; Annot_ID_57277

SEQ ID NO: 17549 - DNA, 3000 bp, Unknown; identical to SEQ ID NO: 7909
  misc_feature (1)..( 3000): 2750-1469P.txt file - cDNA_ID_1809665; gDNA_ID_1621173; Annot_ID_174060

SEQ ID NO: 17550 - DNA, 3003 bp, Unknown
  misc_feature (1)..( 3003): 2750-1469P.txt file - cDNA_ID_1809665; gDNA_ID_1620779; Annot_ID_167873
ccgttaagatcactagtaagttgtaatttattattagaaaaacaaattaaaacctaggttgcctggaaattcgttttgaggtatgttttccgttttcgaaacgtttcggaaatagagactcgtcggaaacacaaaaaatgttacgaaaacacgtttttaaaaaatctatttttggaaatacgatggatccgaactagtcacacgacaaatcctttttattgactttagaaatttaataaactaaattagaaatattaagattactaaagtatataacttattttgaaagactttgagttttaagatcttttgacaaaccaaatttgatgaaactaattaaaatgagaatgaaaatgttggtctaaattaaatatttgaacttaaacattttaatctatatcttttagaattttaattaacttatttaatattaatgtcttggacttgtgttgtttaagccatttttaatataatttcatgctaatatacatatatatatatatatgtaaatatatgtatatatatttccaaaatgtttctaatctctaattttagaaaaaaccgtttctcatatccacataatcgttttctttccatgcaacataaattaaaacaatataaaaaaaacttcttattttcttttggtaaacaagacttttgggcaactggtcttcaacaaacatattccgaagcaggctaattcggagtatatgagtctggagatcctttaaactttagactatgtatgtcctctgcaaaatttactctctggtttgtgaatcacctgttttaactttgtttataagttcgttttatggtttctgtaagattttactattagctacaatacaaaagattttgtaaattagggaaatttgcatttataacctacaaaaatattataattaagtaaataacattctcaaaaaaagcaagcaatattgtttgtattttctgtaataatgccaatactatccctgtttgaaatacacgcttttcatcttctcccttccatagaaaaccaactattttctttcgccaactattaacttttgaacataggtttggctctaacaaattccagtccaccgtttatgaagcttttgattttgccaacgattaacagaggtatattgggcacaaaaacaagacagttaatttttggaaatgacatttaggttttgctcgaaattgaattagaggttttgatttacagaggcacgactttagattttgttggggtctttggtttttttaagagactttggttttggtttttgaaattcaattagtcgagattctcgctaataagcgctgaatttgatcaatctctgttctctgtttccttcatttgatttctttttttcggtctctctaatttattggcgtcgttgtttccttatcctgaaccaataaatcgattttgattttgagaaatttttgagagatactattctattttgtgaatatactatttacgtataccttgtactatatacgttttaaaatgaattgtttgttttgattaaggatgttaagtgatttgattagtgttttatattaaaagtcttgggttccctatatattatcttagggtttagtatccttccatcaaaaagtatttaattgattatttggattcatcggaataaacgtttctatttaaacaaatatatactattctatctttctatgatgatctgtatagaatttgatatcactattcatttttttaaaaaattcgtttccgttttttaaaattcaaatcatattagataaacaaaaaaaaatctgtttttacaataatattattaactttaaccaaataatattgttaaactaataaagtaaacaaaattaagaggggtgaatatatattagtcatatatatttctctttcctcctgctagtggcttctctttctctccaagcgcatccgtgggaaagagttgagtgtattttcacaactgacatgtgctatcaaataaattacatacattatagtactatatatttaataactttttcaaaaaccgtcattttttgcaattcaccctataaattaacactttataaaaactataattaaaaataaaatgaaactacatgttgatatacagagcaacacctcccaatagaggtttggtgagtaattattatataacaatagtatcaatttattagaacaatcgaatcatattctagattctttcatcaatttttttttaaaatcattctagattatagataactttgactttacttccgacttttcaaacggcacatttttcttggcaatatatttcagagaaatggcctattaattactctttgattttttataatgttcgcgtctttgaattgaacaacccaacttttagcatactagctctttaagcacacttttatttttttcacaatttggccaataatgttctagaaggaccgcatatcatatgattagtcattattggtgcttaacggagactctgttttttgccaaattgaaagttttagatttcatgctaatagataagagtgatgttttaaaacatatttgaaaccaaagttccaaactaataccattagtaaaaatcatttacttataagttataagccctcgtcatggcccattttacatggttttggattttagatcgtaaagagaatacaacaaaactgtagacaaaacgaaatcaaaatttcgaatcaaaaagttgtacttgtacagtatataagtaactaatcgtcaaatgtgtatccagttaaaatcgtcacatatgtagatacaatgacgtaatgagtacccaaacatcaaatctctatttttattacaaaaaaaaaaaacacatctcatcgatgacttcacctactcttctctataaagacttgaaaaaaacttgaaaacttcttcaaagtttgtatccatttcacattcacagtcaaactcggttgccgaagaaatttcccggcaaaacctcaacaaacaaaaattagagaatg

SEQ ID NO: 17551 - DNA, 3000 bp, Unknown; identical to SEQ ID NO: 7903
  misc_feature (1)..( 3000): 2750-1469P.txt file - cDNA_ID_1809695; gDNA_ID_1621173; Annot_ID_57267

SEQ ID NO: 17552 - DNA, 3000 bp, Unknown; identical to SEQ ID NO: 7903
  misc_feature (1)..( 3000): 2750-1469P.txt file - cDNA_ID_1809695; gDNA_ID_1621173; Annot_ID_174044

SEQ ID NO: 17553 - DNA, 3003 bp, Unknown
  misc_feature (1)..( 3003): 2750-1469P.txt file - cDNA_ID_1809710; gDNA_ID_1621173; Annot_ID_57263
ctaatgaagaagctttcaacattttcttggttataggcttttgttagcgaatacgctgtaaacaaagcagatgctaaaaatggcaaccttttggccgctcttggtgaagcagctttcctccttggtttggaaaagaacaggttttttttttctcaaacctctatcttcttctttggttttgaaaagaaaagttaaaacactcactgtcatgtttttgttgcagtgacattgtagaaatggttagctatgcacctctctttgtcaacacaaacgatagaaggtatctctcactttagtttcaacggtttttatcggtatatcttgaatgcggtaatcagaaacaagcccgttgcttttgttttgtttttcaggtggatccctgatgcaatagtttttaactcgtctcatctatatggaactcctagctattgggtccaacacttcttcaccgagtcaagcggagcaactcttctcaattctacacttaagggaaagacttcttctgttgaagcatctgccatctctttccaaaccaatggcaaagattacatacagatcaaggtttgcttatctcccatacgcacaaaacaaatgtctagaaccaaatgaatgttctgaccaaatatgaatacacaggctgtaaactttggagaacaatcagtaaatctaaaggtagcagtgacaggattgatggcaaaattttatggatccaaaaagaaagtacttacatctgccagtgtgatggatgagaactctttttcaaacccaaatatggtaaaacatatgaagaatcaatcatacaagagttagggcttagtattgttctgaatcttgaaaacgttgctaagttgttttctctgttcttttctgtagattgtgccacaagaaagtttgctggagatgactgagcaggaagaccttatgtttgttctcccgccgcactcgttctcttccttcgatttgttgacagaatctgaaaatgtcatcaagatgccaatatctgattcatacaagaaaacttcaacaatgtgaagagaaacatcatcttggagactttcatgtcttttgtctttactcttcagtggttattaaacacataaacctatatgttcgtgaataataccaaagttagttgattataatcacgttatgcccttagattacttgatatgcaagattactcttccttggtaaaaaaaaaacaatggtaacacattagaccctaaacagttcagtcaaaggaacttacattgtgtcgtcaaaatgcagctaaaaatagcccaaagtttaattctttattgtttaaaatccttatctaacaaacattgcttctcacagtttcttgtttttttcttttcttcaaactataattagaaagacatcgagaacatatcttaatacttgagaaactaaaatcccctaaattccagcaatttatctgtcctttcaaagcaattttaagattaagagaaccataaaattaaattccattactctcacacaatttttgattatattataacattttgtatgttggagcaagatggctcccttcatcgccttattcaccggcctttgtggcttcaagaaaaacgctcggccattgggaacgattgagacgatgtatcagtcatctcctcgggagaccaaagaaagagaacaaacaaataatgacttgcagatcacgaaaagtgatgacttgtggaacaaggaaagcgatgatcgagatactaatgcatttaatgacgatagtaatgaagcggactctgagcttccgttgcctccaggaagaaaaggaacaatacgtggaacatattcgtgtaacaacatggtgttaagaagatccttgtctactaagaagaaactgagtgcgagcctaacgatccaaataccgagatcattgtccatggtcctcaaacgtgacaaggaggaggataaatctgtgaggaagaagaaactgaacgcagataattcgattctggtactcccaattatacttggagagagatgtagggttcttgatgcggaagaaggagatgaagatcaaagccaaagaatggcagagaacagaatatatcgtcctagatccatgagttcgatctcgatttcgagaaccaagtcgaacatcgatatgaatgctattcccgtagaagtaacatcagaagaacaaaaaatctgatattatgatgtctaaaatgaactagcttcatggtgattaggggttaattacttaattgttaaatctcatgaatctgagtgacatcatcgtgaaatatttcgatggagagtgatatcaccaatttagtttgaaggatcatgataaagaaaagtactcaatgacttggaagcttttttgaaacaagtagagttgtaatataaataccggttcacaaaaatgtaaacgaattgatttggtttcatatatagacatatagctaaagtgcatttggctaaagaatttcactattagacattgtttcaaatcattaaaattcacaagccaacatatttgtctttttttaatacatgtaaaatttattcgaaaaaacgtttttacatcaagtgcaacatttggtaaataaattgcgtacaaatttccaagttttcatggatctatcttctatctcattgttaacgaatagaggagatccagtttcagacttgtttgtcgagttatcgaagcaactgtacgtgctggtggtattggtgtctctccaaattattaaactctctaagatgcattcattgtaatttttattttttttctgatgaagataattttatattcatccaaaaaaaactatctaatttgggtaaaaattgagaatgacttaaggattatttagaaaataactcaaaatgtatcaaatagggttttggaaattttccaaaccgaacgaactaatcataaacaatgctgtttctgtttttcaattcaaatttggataaaccaaacaaaaaccggttcatgttcttataatttcggtttttgattccggtatg

SEQ ID NO: 17554 - DNA, 3003 bp, Unknown
  misc_feature (1)..( 3003): 2750-1469P.txt file - cDNA_ID_1809729; gDNA_ID_1621174; Annot_ID_57304
tcgcttatgatttccatgtgattggggtgtggaacaggaagagaaataaaagaaaaagtggaaatttgaaagagaagtgaacattagggaaataaaaagaatcatggctcaaagtttataagtgtagaaagaaaaaaagtgtttatgtgtttatcaccgagaattctctcaatcttttttttgtgaatcagatttttctcaccttttttttttgtttttttcttttctttctgtctgatgaagagaaaagagttaaatatatagagtccaacggttccggcgtacatttgcaacattacatttaataaattaaccataatctcaatagttgcaatggttagagagtaaccgcttataacacttaaatctccaacatgttttgcttgcagtttgtggcactaattgttataagagttagctctctcagtagcaccaaactggtaagtgagtttctgatacaagtgttgttatataaaaatccaatgtgattgatcgttggggatgatttaacaaagagaatgatcagttctgagaagagcatttaaactttccgttaagtggagtgatgaagatgatttattggtgtaaagacaaatgttacgttgctatctattttggggaataatgtaactttttttaccgtgctatctttactatgtagacgtatataatttctgtcaaacatcttacttcgattttccataactctgttgttacactttcaagagatcatctataactctttcaagagatctaccaagttattcaaaggtaggaaatgcctacaatgtgaaacttaaaaatttaacatattccctcttatttagaggtctagttttgattttcatgtgaggagaacgatttagtgtataatggttttaacttactctgtgttagttaacacatatttatgagtaaattaaatatcaaatgttggaagttgctaagcatattggcctcatttactttgctagaaagttaatactctacatgttttcactataaacccttatcatcatgcatattgctgacaatgttattttagtttttatgaaattaaaataatatgtgaaatagtgaattctgtcaactaaaaattatttcagtcaaaaaataaaaattataaataaaaattaattcgaaaaacaaatatgagcatattattaatgtaatttttagcctaaatggcaaatttttccctacacaaattagctcattatttttcttaacattaaaattatttgtctaaaacctgcattcttctaatagagtgaaacggttttgggtttaagacatgtgagattgaacaaacaagacgttgacttgtgagtagaaggaacatgtgaacttatatggaccatgtgaccttcaactacaatcattggaatgttaaactactgtcttctcttatttggcatctaaattttgtttttattactctctaaacaaaaacgaattaacaagatttctgcacaaaaatgtatgcattttgttttacgtacaatcatctaattcgaaacatatggggtgaaattttttactttttaaagacaacaaaccaatcaatcacacgtgaatattgccagaagagatatacacttggagaggataatgaaccattaggtgtccccaagtactaaactagacctctacggtgccaaagaaaggttccggagttatgagtggtcacctctcctacctctttgaaagacatgtatatcgctttaactccttaattattgattcttgtgtgtaagggcaggcaacctatgcaaatagacaaattcatatttttcatcgtgatcatagtaaatactacaattttttttttttttttttttttggtaaaatattacaaatttagcaaaagacatgcaaagattaaagacgctatgataagaaagaaaactaatcggatatataactaaaaagacgttgaaaatggcaaatatcaatcatcaatccaaataatattcatatacctttcatctatgaactaaggttttttaactaatatatatatatatataccgtatgattacactgtcaaactaaagtataaaatgcaacaatagaaaatatgagaaataaaataaaatatattaattatttgcttttcaactactttaatatcttaatttaccatgagaaagaaatgaaaatatgagtcgaaataaaaaaagaaaagaataagtagtttgagaacaattttttaaaaaagggtaaaagactagaacatatagtcaattgatcatctacacatgttgttgttagaagaaaaaaaccaaaagaccaaaaatccaaaaaggaatttctcttcacattatgtgtatggccataaataaaaacttatctatctatctcgcgggaggaaaacaaactgctcgtgttggtgcttttgtaattcgtcttttcttatgtattatctttaagaaaagtcttttgcattgtgcacctacacaacattccgttttactaaaagttaatataccaaattgcaaataattcagctccagtttactcttgtttatttagtttgattttgggtgcatttgatatctttttcatcgaacttatgtaaattttctctaataatcgtaaactttttctaataatcgtaaatttattatcgtcaaatattccaatttgttattgaaatgttttcgtaatatacctcaatttcaaatttaaatattttattttaattttaaaattgcgtaaccgtaattttaattttaaacttgctcaccctaagatgggttttattttctcccgaatttaatatttaatttactaaaaatgatatgataagcctttatgtatgtaaactttttttcttaccattttttttaatacttccattgctctttttttctgacgtcttctttaatttattctactctatacatatctgccatatatgtgtatatagagagaaatatacttcaattcgtttccaaacctatactctcctctctcacaaaaatgaacaacaccaaaatg

SEQ ID NO: 17555 - DNA, 3003 bp, Unknown
  misc_feature (1)..( 3003): 2750-1469P.txt file - cDNA_ID_1809749; gDNA_ID_1621174; Annot_ID_57298
gcatcacaatggaaaagcattaacagacagtagaaaacttgcactccatatcgaagagatagataagcacataaaaagctaacctgcgaaccgaggccaacagcgacaatccgaggactgcatctaaccatataaacagtagatctaaacctcaaaacatgaacatagttatgcgatctaagcgaataaaatcgcacaaccgtgggagagagtgcaagaggatcctcataaccatttctaacagatccatctctactagtaacaataggacctgaacctttagcttcatcagcaacagctaaaagtataggatgtgatgatctaaacccttcaactccatcacatttagcaggtaatggctgcatctgtaaaaatgtaaccggatcatcccgcctcgacacgaattcggtaacatcatttgaatcatcgatatcaagaacttgaaacccgtttgtataacctagtaatagaacgttcttgaaagatgattcacttgtgtgcaatctatcaaatgaagaccacaacacctgcttcaccaaacacaaggatcacaacaagtcaaacctatctcgataaaaaagactcacactttttcctaatctgatcaaaatcacataaacccaattggaaaatgaatcaaaaacccccaaattccaaaatagagaatcacgaattggggaaaatcaaaattgaggtcaaaacctgatctttaagctcgtgagaatcagaagagagggaagcagcgacggaggcgctagctgagcgaacaccggaggaagcagttctgatgcaagtagagatgaattttaacgaattgggcaaaaagccattagtaccattattcttcgtttgattatgattatctccgttgttgttgatgttgaccttggagttactcttcatagtaattatgaattcttcgtggaagataccaccggagatacaccggagaagagacaacgatcggaaacagcataagccggcggcgatttcgaagaagaagaataagtaaagagattgtttaatttgagaaattttgaagctttgccattttttggtaattggggttaagcggtggtgtgttttttgaccttcttcacggaagaagaagaagaagcgaagaagatgatgatgatgatggagaagaaacggttctttgcttttttttggtttctgttttttttttttttttgggtttgctttttgttttgttctttgggcctttgtggctttaagttttagttagttttgttttgtctatttggtttttgagtaaaacttaaaagtcactgtcctaaaagaaagagttactgtagtgctttggcgtctacgggtgttttagattgctgtgtaagcaaacaattttttgtattttttatctcgtgcatgttcacattattacctttttttttgggaatgtttaaatattatcattcaaaaattacaccaaattgattaattgaatcaacaatagatctatttattgtttaagaaatgtagagatcgtgcaagcttaatgttccatataatataggtcctagggctagttgttacttatttggtgtataattgaaataggttttagtttgcacgtcacaactcaaagaaaatcaaggcatccctcaggcctaagccttccatgtttagacccatttgcaccaaagcagttaatgcccaacgactagtgatttgggtaatcaattgctttgtatgttgaatcatatctttcttttttaggttagatttttttttttcttagtcaacatgaataatcagattatataccctaaattttttagaaattgctacactataatttcattcaccctctttattctagctaatcagaagctatcccctaatttttaaaaaatatatttaattattattgaatttgctgttcaccatttaaaaaaatgtactccctctagtcaatgtgttctcaactatattacatgcattaataaagacttaaagagtgactaattcgaaatcttgtcagattattgaagtaagagttttattacgtcgttgttagtatacagattatataacaaacaataaaatgtggttcccgtgtaaagataattataagttataaccttatattagacgacaaaaaaaaaaatgttataaccttatattatttgagaagttacaaaaaaagattaaataaatatggacgaacaagagaaactatatctgtatatagtacttaagttataaccctataactcacacattctttcagtagcaatgagtttaatcaaaatgattccttagacttgtatttatccactcacacggtttagtaatatattaaatgaaaaaaagctctaaaaggaagttgctcctatatatcttattcttcttttatatggttttacaaattcataaaattcaccaaaatgacagtaccatgcatataccaaccaccctacgatcaaacagcaaggctaaaacataactgtaagtgttttcactattttgtttcatgttttcaccctcttggttacgaaggcaactatgccaaaacttattagtaaactttgattaactgacttttgttgagaccaaagaacagttccaaatcttgcgtctacccgtctccaattatttaaagaatattttgtcagagttgcacgtttttacgaacaccatttcattaatataactatatgttcttttaaaataaaggccaataatttcaccaaaaaacttaaaaataaaagccaactactgtttttttgtcctacactcctacttgatttgtttttcgtcctttgttaattacccacgatatcttcaagcctttttaaaaaaaaagtgtctaaaacttctcaagatcctatataaatgtatgaagagttttgaacttagtacttgtcacaaatataagtgacaatatcctcttaagtctcttactctatctctctctttaactgtatcttaaacaaaaagaaagagtatgatcatcagaagaaaaaagaaacaacaacaatg

SEQ ID NO: 17556 - DNA, 3000 bp, Unknown; identical to SEQ ID NO: 7926
  misc_feature (1)..( 3000): 2750-1469P.txt file - cDNA_ID_1809753; gDNA_ID_1621174; Annot_ID_57297

SEQ ID NO: 17557 - DNA, 3003 bp, Unknown
  misc_feature (1)..( 3003): 2750-1469P.txt file - cDNA_ID_1809761; gDNA_ID_1621174; Annot_ID_57294
gacagtcctattccttgcatatggtactttcaagtcgagctctagatttgagtaccacctacaaaaaaagaagaatcgacaatcattatggtagtctctccatatataagagttttaaaatgtatatataatctatcttgctagctcataatggcacctgaagacttggcaaagctctttgcggtgcaaaatttgcagaagattgaaatctatcttagcaaattctagcaaggtttggtcgtgcagatcttcttcttcatagtatgagatatattgtcgtgtctctatccttgatatacccctagggtatgcatgtttgagggcatttttaatgcggatggacataggtggactagattgatcagccagtccttccaaatgagacctagagaaagcaagagcttcatcgagaatgtcttcaccatgggtgctccaatgtgcagcttcataaaggcataaaagacctcttgcatcctcagctaggtgctccttgaactttccatccttattcttgaagttgttaaacacatcttacacatataattttttgttagtaatcaagtttaataattaacattgacttggtagatttactaatcattatgcacagagagtacaaagtgagtataccttgcgcttccacagtattaatatgatcgaattaggtgaagttgaaaaagaagaaaaaatacgctcgctatacttatgtcagttttcacattaaccaaaatgtaatatagttcttagaccaaaaacaaaatactactaacaattagcaacattctctttcatgactttttcttagtaatatcaattcaaattttttttaacccaaaaaatatggaaacataaataagaaacttattcatactgataaattaattaacatattacgctcgataattctaacattagagtgacttaccgacaccaagtttatagccaaattgtctaaaaatttggaagacgagggagacggtgtataaatcgaactcattgcctcttatcatctgcataaaaccatgacaccaaacatcgtctctaactgcgtgaagatgtctacttcaaagtggtaggaaacaccaaggcgacaaagagcatcaatgaatttgatgttctctatcggctcttcttttgaagccattaacaatcctcttacggtttcctttagtgaactcagcttctcttcgtttatctcactctcctatatacatcaaaataatggcacgagagaagacatcataatatagagtatattcatagtgttttgtgaacaaatttgcctaattgtgacttcaagtcgtgtgggtacgtaccggatccaaaacagaaaaagagatcaagggatcttcccatatattcaccggaaaatccgctaatggccgatatatttcttcagtcgtaagcgctgacaaagtatttatcagctcctgcatgcttaagttctttttctgaataaaagtgtatctataatcacacttcaaggttttctaaagctttggtaaaactgtggctgcacttgatacatatagaggccatatatagggagatgagcctccctctcttcttttggtgtttctttttttagtaacctttatcttaattttgtttatttctatggtattttcttttaggcgtgtaaaaatgagtcattgattgggactcttagccgacacgatagatatgaacacattggccattttacttttctagtactccctctgttttaatatatttctagtttaaaggtgtttttttttgttacaaaataaatgttgcttttatatttttttatgcaaaaattaaatatatttaatagttttaactaattatatttaatagtatattttcgaattaattttatttgataatattttataaaaaatagatatattaaagaaggtttttatgttttttcttttaatttgtatgaaaaatctttaaactataaatcaaataaaattgagggaataatagacaagtgacagattttcttcggttactaaaagagcaaaatcaattcattttaatattttgacgaaaacaaaacaaaaaaaaaaatcattttaatattttatgtccatcagcccgttgaattaggcttaaatggcggcgacacattaaagcttctttaattgcgccactaatatgatatgcgccactaatatgatatcccctacctcatatcaatcattgtaagtgtcattatagtttcttacatatattaacataacaattaaaaagaaagggttgccttccatgccaagccagcacatggaccgaattgttactcgctacagtgaggtgactggtgagatgggaacaagttgccatgatgtatgcaggtaagtgagggatgaacgcctgtctgtgttgctgcatgcctgcatgtgctatttgtttgtttccaaggtggtgtgatctgcccccgaggaatgtctaggagaagggttttctgctgtgattgctgaaggcaaataataatcaagagtcgaggaacaaaatttgtttcaaataaagtggaaagaaattcatatttgaaactccttcgttttttaaacagttcaacatttgatgtagattttaaaaatgtaaattctatttaataggctgttcttttttttatataatatgtgaaatctataaaaattaaataactatttgaaaaaagcttttaaattgattataattttgtagtgggttaaaatctagaatgtcaataaaaatataataaaaaaaccgaattaaaaatcactaataaaagccttcgaattcataatcccaatgcttttttaatctttttcttctacacaatttccagaagatgattactaattagaacgaaatataaaatacaaaatttgtccaaaaacttggagatgcgggggatcgaaccccgtgcctctcgcatgcaaagcgagcgctctaccatttgagctacatccccagttgttgagttacaatgcttcacgttttataaattcgaatatctaaaccaacatg

SEQ ID NO: 17558 - DNA, 3000 bp, Unknown; identical to SEQ ID NO: 7924
  misc_feature (1)..( 3000): 2750-1469P.txt file - cDNA_ID_1809775; gDNA_ID_1621174; Annot_ID_57288

SEQ ID NO: 17559 - DNA, 3000 bp, Unknown; identical to SEQ ID NO: 7924
  misc_feature (1)..( 3000): 2750-1469P.txt file - cDNA_ID_1809775; gDNA_ID_1621174; Annot_ID_174083

SEQ ID NO: 17560 - DNA, 3000 bp, Unknown; identical to SEQ ID NO: 7923
  misc_feature (1)..( 3000): 2750-1469P.txt file - cDNA_ID_1809783; gDNA_ID_1621174; Annot_ID_57284

SEQ ID NO: 17561 - DNA, 3003 bp, Unknown
  misc_feature (1)..( 3003): 2750-1469P.txt file - cDNA_ID_1809791; gDNA_ID_1621175; Annot_ID_57328
ataaaagagaaaataactaaataacggtttaagtaatcactaatcagttagtgaataaagtgtttttaacatcatcaaatttacttcttagtttctgtaacgattttgtaaactcgttttaatatcaataaatttgtttagcggaaaattaaaccaattttttttgcattattgaattaaacaattgtttactgcattattaacaaaaaaaagtacttaaacctaattttgggaaaatgttaaaaagaacaaaaaaaaagtagatctgggagaaagtaggtagatagattgggaagatgagtaggtagctgtcttttttcatctctctcttctccaatcactctctccacacgctacttccttcacgtacctccacgtgtcctttcttatgattttatcacattcctctctcctttgtctcttcaattataaaaacatgaatattatttagattagttggataactgaattattgggtttgggcatgtgtacttggtccttcttctactgttgtgtctcttaagtttttttttatattttattttcggatttcacattgtaacgacggtccaattaaagaatacatttttaaaatgaatttactagtaacttgtaaggtacttaaatggtatcaatcaacattgggatgatttttcttggaaattggaataacgtcgctataacaggcgattagataaattagtcgcatagaatcgtataaatgttaaatgtttttgtctcacacgccccatacgtattttagtcctttgcacttttgcagaagttatcagaattcttttcaatatttaaagaggagttgaattttacaacagtgatgtaattctatctaaagcttaatttcataagtttattatagttctgtttttctttctcaatcgtaaacattttttcttatatagaaaaccccgtacaatctaactactattcaacgtaatttaactactgttcaatcttcaatgttttgtcataagctagtaatctatgcttaattaagaaagaaacataagaagagtcatgagcggatgggccttttgttcatagcattgtattggtcatgggccattacttgcaaagcccaacatggctaaccgcaaacaagcttctaatttcatcacgctacgccaaatgccaaacattgttgtacaacacttctaccttctgagtcttcctgactattggctaacatgaactacgacgttcaaagaaaggttcttcggaggtacactgatcgatatggaattggaatcgaaggttccctatgcacaaaagaacatggcgaaaacacgattcaaaaaaacataacgtccgaagcgcaactaaaacttaatatttcgtgttaaaagccaactaaaagttacatttccgttttgtaagcagaaagtgtgactattttatgtgttcttaacaatatatcatttttttttttactttgttaatatcactttctcatttctaaacgctttgtaatattctagcgaaaatataatttattaatgatttttatttttacatgcaaattatacgactgaaatgttataggaatagagacatgtttgtatcacaaaattaacttatgtaggaaaaacaaatagtataagtctatcgttcccctctctgttcaggcgtcaagcctcccttgccacatttaggacaactcttcataccaaatccttgacaatcaaaacatctgcacatattcaaaatcccaaattaactctccttaagtactcattgaactgtaaatttttagattgatatttgagaaccatgtgacattgttagttattacttacttccacctctcaaacatatttccgttcttcttatttttacctgttccctgtagacaacaagagaattttgtctagtatatgcataaatatagagtaagaaagagtaaaatgaataggtatggtctggaaaagattgatcatacactaaaggtattagtttattacatagtatctagtaatgaaaatcaaattagtaccttgcaaccgggacattcaattgctcctttggctccacaagtctcacaacttttgaatatctgtttatataaaccttttgaagaattaacaaaactcttcattgacgatgataacatatcatattgtatatggatgtatagtgaaatcttaccgaaccaagagagaaatttccgatttttcccgcagaaactttgattgtatcgcgtcgccccgaaacaagctgactttcaaaagctagaatcttcggttctaaagataactcactgcaacaaagtggaaatttcaacatttttgtaactcaaattagaactaggaagtaagatatctatgtacatctatatgcatatctatgcatacaagtgatagtgaatatggatggtgtgagaaagctaaagaatttgcttggttgtggtttgtggatattgaaacggatcatgtggagggaatatgttgacaaggattattgacttaaaatacataagtgaaagaagccaaaagaccctacaaatatccattgaaacaaattaaattataatttttacctaactaataaacaatatcaatcacaatttaattctttattttaaaacagtaaaaagcataaacaattaagagcttaacaatcattttttaatcaaaatatctaaacagtatacattcaagtaaatattactttatgcatgcaaaatgtaaatctgaattctgaatatgttaatttttctttttacaatgtatcaaattttataaattaagaataatatattttcttataaatttatccaattttaatttaagagtaagatattagttcaaaaagataaagaaagggacaaaggataattaattcaatgaacacgatcctaaaatagaaaagtacgaaaacaccccttatcttccgaacacttttccgatcgcaaaatgatcgcctgaaaccatcgccggcttcagagtgtttgatcgtttctccagatagatagattgatccaatatg

SEQ ID NO: 17562 - DNA, 3003 bp, Unknown; identical to SEQ ID NO: 17561
  misc_feature (1)..( 3003): 2750-1469P.txt file - cDNA_ID_1809791; gDNA_ID_1972024; Annot_ID_178156

SEQ ID NO: 17563 - DNA, 3003 bp, Unknown; identical to SEQ ID NO: 17561
  misc_feature (1)..( 3003): 2750-1469P.txt file - cDNA_ID_1809791; gDNA_ID_1621175; Annot_ID_174143

SEQ ID NO: 17564 - DNA, 3000 bp, Unknown; identical to SEQ ID NO: 7940
  misc_feature (1)..( 3000): 2750-1469P.txt file - cDNA_ID_1809825; gDNA_ID_1621175; Annot_ID_57318

SEQ ID NO: 17565 - DNA, 3000 bp, Unknown; identical to SEQ ID NO: 7940
  misc_feature (1)..( 3000): 2750-1469P.txt file - cDNA_ID_1809825; gDNA_ID_1621175; Annot_ID_174127

SEQ ID NO: 17566 - DNA, 3000 bp, Unknown; identical to SEQ ID NO: 7938
  misc_feature (1)..( 3000): 2750-1469P.txt file - cDNA_ID_1809829; gDNA_ID_1621175; Annot_ID_57316

SEQ ID NO: 17567 - DNA, 3000 bp, Unknown; identical to SEQ ID NO: 7937
  misc_feature (1)..( 3000): 2750-1469P.txt file - cDNA_ID_1809833; gDNA_ID_1621175; Annot_ID_57315

SEQ ID NO: 17568 - DNA, 3000 bp, Unknown; identical to SEQ ID NO: 7936
  misc_feature (1)..( 3000): 2750-1469P.txt file - cDNA_ID_1809837; gDNA_ID_1621175; Annot_ID_57314

SEQ ID NO: 17569 - DNA, 3000 bp, Unknown
  misc_feature (1)..( 3000): 2750-1469P.txt file - cDNA_ID_1809845; gDNA_ID_1621175; Annot_ID_57311
tgtactgactgagattgtcactgtaatgtaaacagaaaccatcgtggtctgaggcactactggggtctccgtgtacgtggacagcacaccaaaaccaccggacgccgtggaaagactgttggtgtttccaagaagcgttaaaaagagtttgagcttggttcaatggctttgttttgttttttttgtattgttgttttttgcagaagagatagtttaagagatgttgtttcatcaaaagacggtcttagcttttacaatatataattgaatccaaaaactagtctctatttattacattctcttctctcaaaatctgctttaaacaaagttaataatagcacactcctccatacgcaagaattatataattagagaaaacttttaagtgtcacaagcggctgtctctataatgcgcaaatacatcgttatcagttttaatcactatcagtaactttactgaacttaattgatcattttaatttttcatgttactctctccttcttcttcacttgttctctttctcatcgcctcttgattcacgcgaacgagaaagcgacgatcgtaaccaccggcgctgaccaaaaagtaatcgattctcttcccgagctgatctctcaggtgcgtgaattcacttttttttttttcgatttttcccgagaaaaaaatccagcaaagagtagtagcgatgaagaagacgaggtttgaattgagattcgtattctttcggtggcttgaagtagcttatgcatgtttaaactcttgttcagttgtttgctcatgattcgaaaatggctttgtagatcttctaatataatctcttctctttatcaattcactagtgttctatatctgaagaaatttacggctacagatccaatctcatttcgtttcgttacactatctctactaagattttgttttttgttttttttccctctttttttgcgttttagatctcctccatgattgaagttgatccatgcttttgagtttaagtgatttatttaagatcctctaaacttttttttcttcacttagtggtggttccagtcaatttagcaagtaagatgttgtatgtgtcaatgctataactgtgaattttcagctattgtagtttgatttttgtctttgttagcttcaggtgtcttgaatctgaatctgtggctatatttggtgctcggtggtgagcaggaagggagggggatattgtcagggttttaatgtacgtcagatgaatagagcaactaatgttactggcagtagaaggagggggtttattctcagcgtccgcgtctgggtatagtaagggattgacccttcttttctctggtgataaagacgtagataggcccatgagagttgtcccgtggaatcactaccaggtggttgaccaagagcctgaggctgaccctgttcttcagctggattctattaagaaccgagtttcccgcggttgcgctgcttccttcagttgttttggtggcgcttccgcgggacttgagaccccttctcctcttaaagttgaacctgtgcagcagcagcatcgtgaaatatcatcaccagagtctgttgttgttgtttctgaaaagggtaaagaccaaataagtgaagctgataatggcagcagcaaagaagctttcaaactctcgttgaggagtagcttgaagaggccctctgttgcggaatcacgctctctagaagatataaaagaatacgagacgttgagtgtggatggtagcgatctcactggtgacatggcaaggcggaaagttcagtggcctgatgcttgtggtagtgaactcactcaagttagagaatttgagccgaggtacgtgtgatatgttttcctcttattgagttgcttaaatcccaatacgagttaatttaagtagatccattgttttatgccaataggatccttgttgtgaatcttgagcttgtataattagatccattgttttatgcaaataggaatgttagtcttgagctttaacccctattgctcaaaatggatatcctttaattcatttagatttcagagtttcacatgtgcgtagtgcccggcaaactcactacatatatatattctttgttacacatcatggttttgtagagacatttagctgtgtttccttttctttgtgatcctcccacggtttgttattaacttccaagaaacaaacttgattttggttgcagtgagatgggattatcagatgaagaatgggaggtaggacgacaaagaacatgttcgtgtgtgatcatgtaaattcagaaatcatcggtatcactctttactcatgtcttgtgtgcattgctcatatatttaaagtgtatctgttattacaaaagttctcttcaaggttttggcttgtacattattccctttgttttgagtggcaacttgttccgggtttctgttttctaaaaacgataagacaacatccaaatcgatgcaaagtggaagagagtggcaataactcttgttcttgtaacgctctcaaccacattacgtacgtgtacaacaaaactagaatgcttatataactagtccactaactgcaaagcgaatctgcaatggtttcgcaacgatccaccatgttcgttagttctatcgttcacattgtccttaaggaactgatcaatcatgtaaacatttaatggactttacaaagaatcttgagtcctctgttgtattaattgtttaccaattaccagcttccatagcgtttctggttgcaagtacttaaccatcttggaggcgtaaacagttttgccagagaaagttgataatccatctgattctaatgacaacataggggttaaaacgtaaaattaaaaacaatagggaaacattatagaatatagataaacttcagggatcaaaatgaaagaatacaagacagagaaatctaccgtctcttcttcaaaccaaacccagaacctccgtccgaccaattccggtgcagctaagaaccagagatagagagatagagatg

SEQ ID NO: 17570 - DNA, 789 bp, Unknown; identical to SEQ ID NO: 7961
  misc_feature (1)..( 789): 2750-1469P.txt file - cDNA_ID_1809853; gDNA_ID_1621176; Annot_ID_57344

SEQ ID NO: 17571 - DNA, 3003 bp, Unknown
  misc_feature (1)..( 3003): 2750-1469P.txt file - cDNA_ID_1809861; gDNA_ID_1621176; Annot_ID_57342
tcaaaaaatttatgcaaatagtcgaaaattcatcaaaatacccaaaacttttacccaaatatccgaattttatctgaataaccggaattttgtctaaatatccaaaaacaaattataagtatctttgattaatatattgttaaaatttcatttgtgatgtcgatgtttaattaaatttattcggttaactataaaatagttaaattaaaatatgtaactccaaaactaccaagctttcatcaaaaaagattatttgccatgatacttgatgaaaaattcagaaaaaatcaatccaaaatagttacataacgcaccaaaaatcaaaactaagggtccattagatgttagattcacatattcaaaagaagtagtcataaaatagtaataaaatcgatattgttgtaggctctgtcttgtcgtttcaagatcgttgctctgttttcaatattattgctctgtttttcttgttttgtttttgagatatatggagataaactggatagcaagaaatataatgcatatcaagtattgtgaatcgtcaacgtcctttaatgaagtaaagtctgcccgaaaaatattcgcagtgtgtagatttaagggtaaagaaactttatcccagttgtgatagacttgtaaagagtttttcccttactaacttttcacataactccattgtattcagttggttaattaatttgaatttttcggaaaagaaatcgttattttgttatagtaaaattatttttgacaaaaatcaaactgaatctaaatcgaataccaaattgatccaatacaaaaatcaaattaaaccaaaaccaaattataaaagaaaattatcaacaaaaaaaatatcgttttagtttttataatactactgataaagcaaagaccaaaaaaaaataaaaaaaaaataaaaatacatcaaatttccatcttttaagtatatcaatatttgtttaaatatgttatccattcgcaagctagtttccaatagtttatttttatttttggtcggtctttcacctatggaaccaaatgaacaatggtctgcacatccaatagcctctctacgctcgcagtcttcaagttcatcaatagtgaagtaaaaacaccactgctagaatagataggaaaatctttttgaaattttatgaccttgttgctgcgatgaaaactggaatccttgttttttctttttgccaaggatccaaaatgttgggctcgttactaattgtaagacctaattatcatgttaatgatatataccctttcgcaacaacttggtcggtctttcatggcatatttcaatattatcttagacaacaattaaaatagaaaaacaattatcagacaaattaaatgaatgtcaaagtaagtcctagttaagttttggtgcacctattcccattgagtcttagactttgattaacaaataaccacatacgcattacgcatataaatatgcatgtcatgactccacatccaaaggaggaacttgaagcaacaatcttttcttaaattattttcgatctaaagatcttgaaagcaaagttgatttcgaagaagaagataacttcgctaattatctgttcttttctgttgtttcttcttccaatcgcgttttctaggccgataagaaacttagatggaccaagtggaagagctccaactgttcaacaaataagaaacaaacatgggactagagaggtgatagtggacaacgggattattagtgtcagtttctcgagtccccaaggacttataactggcatcaaatacaaaggagtcaataatgttctccatccacatcaacgagctcgagaatactttgtaccggagccatacaagaacacaatgaaccctttatatctaaaccacacggacaagtttaggcagtacggattatggcaacgatacacagagttatatccaaaccatgacctcatctacacaattggagttagtaactatagcaaagactggttctactctcaagtcacaagaaaaatcggtgattcaacgtacacaccaactacatggcagactgtgtttcatcttccatatgtaaacatgcgaggtagctacacattgcagctagctttagcctcggctgcatgggctaatctacaagtacgtttcaataacgaatacacgaggccatttttctcaacgggatatattggaagagataatgctatagcaagacatggaatccatggactctatcggctttatagcatcaatgtacctggaaggttgctacgcacgggaaccaacacgatttatcttcgacaagctaaagcatcaggaccacttgaaggagttatgtatgattacattcgtctcgaagagccttctagagaatagattcatatagtagatacttttttttttttttttttttttcacgattggttttatgtgccattgatttaagtttgagatataattactttatttaattatttctatataaccatcaaccatgcatcttttttcaaagtttattctttatatgctcttttgaattttgacattaacgtaacagaactaattaaccgaccctcaaccgtacttgatcttaatcgaaccggtttgggagattagggttaatttcgtcattttcgtttagtaccttctcctttttagcgtcttatgtagcatcgtcctctttctcttgaattcgtatttttgagttctcagatttcaaacacaaaagtttcgtctccgatttaatctttctacgtcttggtttatgaggtaagcttgtttcacaatctttcgttaggatttctgatgatgacgaatctaccaattttgtttctcgtggaaatttgattcagatctcatctcttccttcgattttgcattcttctgaatttgtttataatccttatagctattcattgttcttaattgaattagatttgtctcgaatctatgaattacggttgaaacgagacttgtttcgactgctagggtttcgtatgtatattcaggatg

SEQ ID NO: 17572 - DNA, 3000 bp, Unknown; identical to SEQ ID NO: 7958
  misc_feature (1)..( 3000): 2750-1469P.txt file - cDNA_ID_1809866; gDNA_ID_1621176; Annot_ID_57340

SEQ ID NO: 17573 - DNA, 3003 bp, Unknown
  misc_feature (1)..( 3003): 2750-1469P.txt file - cDNA_ID_1809923; gDNA_ID_2926130; Annot_ID_138718
agtatccatataacttttcattttggttatggatttttaattaagctgttaaactaaaaagtgaactattaaaacgaaagactaaataaaaaattgattaaagttgatctaaatacagtcagtaagtaccttatcaacttgttaagctgacagttaaaccacatgttgccattatggtccatactttctagggtttatgattgtctattacatcttccttaccattttatcattaggtctaaacttgttctttcgattaactaagaaaattataatcactttttagtctaacaactccggtccttcaacacaaaaaaaacaagaaaaagtgatgttcgtttcgcagttagtaacgacactaacacaatgtttttccttttcatagttttttttttttttttttggtcaaactagctttttataaatgattctactctccaacaatggagaaatggttcaacaagtacatcaaagaggctacaaaggccaaagaaaccactgctacaaatggcatacggaaagcacgaaagaaaaagatagaagcatacataacagttaagcaactaaagttgaagataccaatagtgctgaaacatgagatgagctttcggaaataagagagcacacatggtgatctgctgtccggagatgcaacatcctctagtggataaaacgcatcatgaaatacggctacgatagcataggcgacaaagcaccaacttcttgagcctacgagatgtgagaaaaacctcaatttcggagaggtgtggggttgcgaaaaccaccacttctcgatgaacaaatctggagtccaagacccaagatcatttcttgttaagacgtcatatgtcttttcctttatcctgcgtgaaatttcaagaaaccaaaccaaagaaacaataacatgaattgctcttaaccaaagtttttgaataacatcctcataatgaggtaagagaagcctaagcttatacagaatcaaaccaacctcatactgaggtaaaagaagctgaattcgaagtccaatcgaaaacaacacatcctcataatgaggtaagaacagcttgagcttaagcaagatcataacagcctcatactgaggtaaaaccagcctaaaactagtagaaatcatcacatcctcatggtgagggaactgaagtataaacgaaggcatgttccaaaagaaggtaaaaaattcaaagaaattactacctttcagagagacaaaaccttttgatagagtgactagaggatgagagaggtgtggaatagagaaccaaagctccaaacaagcgagaggaaatacttggtaccacgaactgcacacagcagtaatagatcgtaaagcaaaacccagatctagagggctcaaagcctgaacaagatctgatcctagatctgaagacctcaacagcaaaatcgagagaaaggagttggaagctccaacgagatagtctggtgggtctggagggtcgggaggttcagaaggagagaccaaactggtcaaatcttgcggtagagcacacggcggcggattcggagaagggaggagcaaaggtggagcaggagcccgagcaagcatcactaaagccatagaagaaaggaagaggagggagaaagaggaagattctcgccggtgggcgagaggccacaccaacggcggcaaggagaagaagaaaccctagtcgtcaagttgagagagaaaaaggggttttggattgacgatgtcccttttcatagttattaacaatatatatttaacatttttttgctcgatttacattcactcagtttttgacaaagattgatgcaacgcctaacaattttcattgctagattgcttttgaaatttgctcgttattattatcaccaacggctaccaaacaaacatgatttagtcattgttgttatcgataaataaaacaaacatgatttagtcattgttgtcagcttcaaaatttgcatcaaaaggagattgatccccggtctctgaaaagggtacagtcgcaagttaagcgagaaagatctcgcatggtccagtactctaacaaaataatagtccaattttgtatccttccaatatttccatcatccaaatatgattaggttgcccttatactagaatcagagagatacccactagatcaatcaaaatattaaagcggtcaaattttcactatttggatatacggttaatcagatcgttaacataaaaagatatagatttatttgactatcctgcttttcgcatagtggaccaaaatatcttgtaacttgagatccaaccaaattgtagtgttcgtttctaaacctatagttatttttagttatgattagcatgtttttttagttaacgctgcggcagtggcaactacggagtaaaacgacgtattatgaaaagtaacatttaagtaaaacgacaccaaaattgaaaataacagatttagatgattcgtagatgacagacgatgagttgcaacagcatcggatgagtcgctcaaatttaatagaagcaccttaatcttcattggcgttcatcatgtacgacagtttttctctcatcactgtacattcttctctctgcttaaatatttttctttttttttgccgctgccgctgcgttaagtaaaagaacttgaccgatgttaatggttaagagcggttttgtcgctataatactcgctacgagaaagaggattttgactgttgatgtgaagtacgatttattccaattgtgtgatacaacatcaatactacaatacaataataatcataaaaaaaggttttaaatttcaatgtttacaaattagaacgaaaattgcagttattgaaattccaataaccatataaaacaataaatgaccaaatttggcatattagaatattcggaaacttgcaagttcattatccacttgaagaagacttatccaaacactttctgacacacacttctgacattcacagatttttgtaggaacaaaataatcctaatactcacaaatg

SEQ ID NO: 17574 - DNA, 3000 bp, Unknown; identical to SEQ ID NO: 7965
  misc_feature (1)..( 3000): 2750-1469P.txt file - cDNA_ID_1809923; gDNA_ID_1621177; Annot_ID_57356

SEQ ID NO: 17575 - DNA, 3003 bp, Unknown
  misc_feature (1)..( 3003): 2750-1469P.txt file - cDNA_ID_1809975; gDNA_ID_2926129; Annot_ID_138707
cccttttaaaatcccttgtaaatatttttaaacccttttaaaatcccttgtaaatctttcagaacacttttaaaccctttaaaaatctttaaaaaatctttaaaaaacctttctaaatcttttaaaatcctttaaaatctcttgtaaatcttttaaaatccttttaaaacaattttaaaccctttaaaaatcttttaaaaacctttgcaaatcttttaaaacccttaaaaatcccttgtaaatcttttaaaacctttttaaaatcccttgtaaatctttttaaaacgttttcaaatgccttgtaaatcttttaaaagccttttaaaatcctttgtaaattttttaaaacccttttaaaatctcttgtaaatcttttaaaaccttttaaaatcccttgtaaatcttttaaaaccttttaaaattccttgtaaatcttttaaaacccttttaaaatcccttgtacaacttgtaattcattaacgaccgtggaagttgtactcaagaacagtgatcattttgtctttcattgacaaccacattgacccggctggttggttcccatgggatggcgagtttgcgctctccacattgtattatggagagtatgcgaatactggtcctggagcggatacgagcaagagagtgaattgcaagggatttaaagttattaaagactcaaaagaggccgaacaattcactgtggcgaagcttattcaaggaggattatggttgaaacccataggagttactttccaagagtggctttgattttaatgtctacttgttcttgtactttgtgttgtgtcacctctgttttagtttaatgtattttctgttttgttttgtatgacttacccaataaataacatgctctgtttcgcaagtattaggttaatgcatataatattttgaataactttaacactaactaattgaatattttcaatatataatcatactcgcactcatcagtcataacaccatcaatttaatttttttttatggggttattatatgtactagatgactaaaactttgagaatattttcatgaataatatgaattttgtttaagttgattacattatttatcaggaacagtagttaccaaaaataatagtttcatattaaattttacacgttggtcatataggggatccttgcttattgcattctgcatggcatgtcagcacagtgtatcagcatgtgatataattttactataagtagagcattcatcggtcgtaaattttcggaatattcagtgtatttattttctatttttttccgttttctattatttctgtatttctcaatacaataaaaattcaaactaaccaaaaattcagaaaagatcactatattatatataaaatcaattgccgcccaaaaagaaatctgttttacaatgaatataactgaacaattatacatatatctagcaaatctatcttttggcatttctaaattaataatctccattgaagagctgcaactttgtgcttgctaaaactttttcacctgcaacaaaatgagtattatgggagatttaaaaatcaacataggcatacaaaaatattccagaaagaagagagagacaataaggacaacaaattttgagtcatatcatatttgttgtgatgggctccatcccattgataaataccttaatcaaccgattgtcagctgaattcctcatgctaatacctaactatacaatattataattgccatatactggaaaactagcagattgcacaacaatatagaaaagacacaagcataagaaagaagcctacgcgacaattactacaacatctccatattgaatggtcttctgatatacaataccattccatgcgcgcagactgagactttgtaagtatgtgaagcatctcacgagagttctcagtcaaatgcaactcaacaaagaaatcataagaaagcattaaatattgaaagcattgagaagcaaattagttcatgaaccacatcacatcagcatcctggagaccaaaaaaggaagacaatgaatcactcaatagaagaactgataagtttttgctttcactgccaagagtgtaagaaacataccgcaaaaacagactactaaacccttttcaagaacaatccgaaggaaattgattcttctccacatcatttagcatccaaagcaatgaccaccatctttagttgcagctctacgcagcacatctaaagctttcttgttcttttaccaattctaaaaatctcaaagaagagatcgattccagatacaatagctgcataagattcattcaaagttgtcaaaattacagtaccatttttttacggaggaatgacaagttatgagagtgcttttattatatcttttcgggtaaacattgtaacgtagtgaaagttgagagtgaattgcctaacaaccgatagaatcaaccaaaaagaaaaaaagaacatcttttctaacgaccaaaaaaaaaacctaggggttttctatttattaggtgtatattgtcttttctagtactaaaacaataatggctaagtctcatcctcacacgtaagagattaaggttgagaatatattgtattgttgttagcataacctaaaatggatgaaaccaatttctaccaaattcatttttttttagccatttagagtacagtggaaaacaagtatttcaactaaagtactctaagacaattcttcttctatcttttatgagctgaaaattttggaccacttttcttttctgttctttgtggataataaaaccaaacttcactgaattatagcttcaattcacattgcactgaatttttagattgatctcaaaataaagtttttttcctaaatattgtcatttattgaatacaattaattaaatgtaaattgattaagttgctttgctttgtatataagaccaccatcgctccctcctctttcatcagttaagataatataaattcagtaattaagagagaagaaataaacacaaaaatg

SEQ ID NO: 17576 - DNA, 3000 bp, Unknown; identical to SEQ ID NO: 7974
  misc_feature (1)..( 3000): 2750-1469P.txt file - cDNA_ID_1809975; gDNA_ID_1621178; Annot_ID_57368

SEQ ID NO: 17577 - DNA, 3003 bp, Unknown; identical to SEQ ID NO: 15843
  misc_feature (1)..( 3003): 2750-1469P.txt file - cDNA_ID_1809987; gDNA_ID_2926129; Annot_ID_138710

SEQ ID NO: 17578 - DNA, 3000 bp, Unknown; identical to SEQ ID NO: 7972
  misc_feature (1)..( 3000): 2750-1469P.txt file - cDNA_ID_1809987; gDNA_ID_1621178; Annot_ID_57365

SEQ ID NO: 17579 - DNA, 3003 bp, Unknown
  misc_feature (1)..( 3003): 2750-1469P.txt file - cDNA_ID_1810002; gDNA_ID_2926129; Annot_ID_138704
agtggttttttttagagctttgtttgatattactagtatttccccatccgaaactaataattacccctataaccatggttcgtttccgaacaggagcacccaaaccacctttactcttttttagaaaatcaaaaaaattaaaccctaatattttgagatattttcgaccgattgttttttgtacccgttaagattttgcgatatctctccccttctccttagaaaccaaagaaattagcctcaaacatcattcccaatttaaaatcaattaatcgattttgttcttctttcattcttgtaacctttaagatatctcagattagagatgccgcctaagaccagtggattggcacgaaaaagaaagagagtaccgccagctaagaatgagagagataaggtaatggctgaggagcagtcaccgactcaaccggcggtaatgttgttgccggctccgccggctcgaacgacttcgacgacgacggttactacggctccaacgacagcgatagacgcgacggctccaacgatgcctcataagacgtgatgcttgaggatgatacgttttatgatgctttagagaaaattcccagaagaaatttaaaagaatgttctaacttgaatggtggatgagaatgaaagagaagcatgtgaaaaagaagaatcattgagtagtagccgaaccgtgggctctgattccaattcagaggagacgaatgcaaacgatgacctctcgtttgctaatcctgtggacgaggaggatgagagagacgatgaagtcatagtgaataaatccctagaggatgagagaggcacgaacgtcataggggaaaagctcgtggaggagaggaccgtaaacaaggacatcccaatggcgaatctcatggatattgtaagtattccaagtaaaatcccttgaattgggtaataatataattgtgaactgtggaaagtactagtaacaaaactgaaatactaggttgatatctaagaaatattgtcggaagtgggtaatactacaattgtgaattgtggaaaggactagtaacattggaaaatacttgcagattattgagatatacagaataatactgttaatgtgatttcatgtagtactggtagaacaatggtagtaaagataggctgcggatgggggtcctttatttcttaacaagcattattgtcgtgcttactaagaccggggagaagggcagtccagttgataatttctgtttaagggctgcaagtgatctgacgtttagtaagacttttccttggcggaggtattcctttgagttcatgttaaaaccgatctcacacacattggatcattttaatggtagtgtcccgaacattcagtcacattagcctgttcccgggttctgtattccacttgaggtaagttacatgttttatcattgttacaatttcgtgtttaatcgaagataacattaagatttgcatatatgattttgtgtagtttttagcattggaggcaattccatcacttagagaacaattcatagaaaaaaaggagggtgcatataccggttgttcaaggatgtgcaaggtgaatttcaaacggaccgagataaaagggtttactctagagcaaattaacaatgtcttggatacaactgaggttagtattcctagtattcctacagttaatatcaggattttatgtatttctaatattcattgtttattatgtccgtaggtcattgagagtataataaaacagaagttgaagaaatacctcttttggctcaaataacaggagtagaggatgatgttgataagcatgatgttgtagttgatagttggatgaggcgtattggtgaagggcgtgaaattagatttgaagaggtgtacaacgaggatgtgcagacccgtactaaagccccaactgaagaggaagttcccgcagttgttgggcccggacacctgacgcttgttgatttaatggagaagcttgatagcatcaatgacaagttgaatgaagcttttgtagctcttgcagatatgtagaaaaaacatgcaacgttcgaagattttatgaatgacatgaaagctaaggtaagattgggagataccggatatactataccatagtttgtaataccacgtaataggagtgacaattacttaatctgttttatagatgcctgcgaacccaccacaggagaatgatgcaacatccaaggacaagcctgctgctcctgttgtgaccaagcgagtgacccgttcaaaccgtccaagctctagtttaatgtaaaaactaatcctataacccgggccttattttgatttcttgtactttgaatgtggtttcagattttgtaataactcgtaatactatgtttggatttattaatgtattaagattttatatgatggaattatattgaaatccaggaaataccttgtaatactacgtttgagagaaatccgagaaatacctcgtgctaccactacaagaaaacagacaaacaacgactacagaaagcgacaacagatgtagtcgtcgtttttggcgactacgtcacgtccgttttacgacgcatatacgacaacatgaacattagtagtcaattagtcgttattttacgactaaatatgttagtcggcatatactcgtatagtaacgactatttaacgattatattatagaagaaaaacgtttgtcgttacatagtcgcaaatggacgacaacattttccgactgcggttgttagtcgcccaatcggcgactaacatacgacacatatctgtaatcgtaaaatagtcgcaactgagtcgcagaatagtcgcattaagttgttggaaaacgttttccgcattgccaagttggtacacctaatttgtttgttgtagtcgtaaattagttataaaaattcgtctatataatcaaaattcacgacactcttctttcgcaaacaaatcaaaacaacaatcaaaagaaaaaaaaaagaaaacaatagaaatttagtttattctataatg

SEQ ID NO: 17580 - DNA, 3003 bp, Unknown; identical to SEQ ID NO: 17579
  misc_feature (1)..( 3003): 2750-1469P.txt file - cDNA_ID_1810002; gDNA_ID_1621180; Annot_ID_57374

SEQ ID NO: 17581 - DNA, 3003 bp, Unknown; identical to SEQ ID NO: 16044
  misc_feature (1)..( 3003): 2750-1469P.txt file - cDNA_ID_1810035; gDNA_ID_2926130; Annot_ID_138735

SEQ ID NO: 17582 - DNA, 3000 bp, Unknown; identical to SEQ ID NO: 7996
  misc_feature (1)..( 3000): 2750-1469P.txt file - cDNA_ID_1810035; gDNA_ID_1621181; Annot_ID_57384

SEQ ID NO: 17583 - DNA, 3003 bp, Unknown
  misc_feature (1)..( 3003): 2750-1469P.txt file - cDNA_ID_1810069; gDNA_ID_1621182; Annot_ID_57404
acacggtgcaggactacttggcatcctccaatggaccggtatttcattgatctgatgttggaccaagcgaggagaggaaaccagattgaaggtgttttcaggaaacaagcatggactgagatggttaatctcttcaatgcgaaatttgagtctaactttgatgttgatgtgttgaagaaccggtataagtctctgagaagacagttcaacgcgatcaagagtattcttcgatcagatgggtttgcttgggataatgagcgtcaaatggttacagctgataataatgtatggcaagactatataaaggtaacttaatcgctctgatctatgctgtgtggttagttacagtgttttcgtctctgttttgatgtgtgttcttgtctgaattaatcacaggctcatagagatgcaaggcaatttatgactcggccaattccgtactataaagatctgtgtgtgctctgtggcgattctgggatcgaagaaaacgaatgctttgtagctatggattggtttgaccctgaaactgaattccaagaatttaagtccagtggtactacagatttgtctatttcagctgaggaagaagatagcaactctcttttgtttgaccccaagaacaaaagagatcaacttgctaatactgatacaagccctataaacccgaaaaagcctcgagttgatgaaacccaaaccatgtcaatagaggacacggttgaggctattcaagcgttaccagacatggacgatgaacttatattggatgcttgtgatctgcttgaagataaactcaaggcgaaaactttcttggctctagatgtgaaactacgcaagaagtggttgttaaggaaactccgacctcaagtgacttgaggattatgagctgtaaagaagcaaagtagaagtttgacgataaacagaagctcattggcttatactacagagtacagactactttgcgagagtttcatatacaaagacttatgctcttagaagttgtaaatgtgatcaaatatggctgatgatattaaaccttgtacaaactctctcttctttgccttctctagtagctctgtatctgacaagggagacggcgattcccagtctctgagcacacagaaatacgaaatgtatctttagacaaggtttaagaagatgagataaagcaagcagaatcaagaaaatgtcaaagaattacttacttttctgttgaatcccttattaagctattgtcttccatgcttgcttcactagatgaatcaggttgtacaagcttggacttctttggtgacggcggattgtatataaatgataataatgggtccagaacacttttagatgtatgattagtagacaacggctcatcgattagagactgtaagtatttcctagtccctggagaaaatgctgaatatgactcatccttgtaaagtctctgcttttgttcaaggtaagtattcgtcaaggaacacaaatgtcagataaccgatataaaacataccaagatatagaataagcacaaaaagacttacaagttttctactaaatggtaacgaaagcaagaagagtaaataaaaaaggataccttgaagacatctctatgctgagtggtaatgtgatcaaccatatgcatcttcactcgtctgctacaaaccggacatatctacatcacaaccaaagctgaatttgtgagaagttattacattcatcatcaccaaaagactgttttcatttctcacaccaaacacttcacaactacaaaatggttcctcatagcatcaagcaaataatccaagtgaactaaaatccaagaagtccctaccaactctccttacagaatcacaatcctgcctactaaagtaaccattagagtacaacaatgaacatcacacgataaatagtctaaatttacaactaactgcttcatgtaaaaactcaaatgtatagtttaaagaacagtaactgatttgggagatggatacgagttgcaattaccccattgttggcgtctagttgatgctcctcatcgatatggtgacacaattcaactaaatcataatcatctgagcaaaacgggcatggataatccactgccatttcatcatcatcttcaaactcaatacatgaacctaaacaaaaatttcaccatcacaaaacttttatcaattacataacataaagtttacccataaagtgacaaaatttaaactcactagaccttaagggccaaaagaattgaaatttgataaagaaattaaaaccacctgcatataaagcataaaccctaaaacaaagctaaatgcaattgggaaaaagaatggatctttacactaacccgactgatacttggcaagttcttctaatcgatatttcttcgacgaatcaaacccacaaatgcccaacaaatcttcttccattttgattctgaatccacacgaacttgaattgaaaaatctcagataataattaaaggagcatattcttcctccgtgtatttattagcatctgtcagtactttgttcagcctgaaagtgcgaggaaacacaccaaaaaggcaagacctttaaatgtggtctttttctctggcgacatgagggaatccatggacacgaatctattgagctaaatccaatgaccaaactacccctaaccggtcactatagcctcttttaccctgaaccaccaacgtccctctgttgacttttagccgccacgaatctacgggcattttcgtctttgcgccaccgtcttaaaacgtgtgctccacacacttatattgaccctatcgcgcaagtggactataagcccaatatataaatgggcctaaaaaggcccaaatacttctccttcgttgctaagtctgtaacacgcgctaatgagaaacgattttgcgattcagattcgtttgcttttgccgacgacaaaagctccgattttgtttattttctccgggaaattttactttcgagattctgttgagaatcaattgatttggtattgatg

SEQ ID NO: 17584 - DNA, 3003 bp, Unknown
  misc_feature (1)..( 3003): 2750-1469P.txt file - cDNA_ID_1810073; gDNA_ID_1621182; Annot_ID_57402
aggaaatagaggatcctaagttgtctgactgtatagttgaacccagacaaactcttccttgtaacttaagctcgagtcacacgagttctcacaagtgtacaccacgattgttgcccaatcgagagattccctctcgttcttcccaccgaagaagaacagtagctgcggcatcacctgataaaaccgccatcgaaatgatcaagaacagagccaagcttccaatatgcaagaacagagaaatgaaatggggaaaattgtgtgttttattggtttaaagttgatttgattcagctaaaattgttggccaattcttgactggtttataaaataagcaaaagaagtgactaagaccaagctaatacaagtttataaagaagagaagaaagaattacctgaaattcaaaacaacgaggaccaccacaagatttgcaactgggaagctcagatttagagactcgtccgcttgctattggccaaaggggtttagcaccagagctccgggaatatctgtatcaatacgtatttcacaaatcgatgttatgggagaatcaagatcaaaagtatgcagaaaatcataagcgtttgaatcacacctcagaacttgttcaggggctttgtctacgcgttgctggaaattaacccaattctttttatcagcatctccctgtacaagcatggaaaatgagaatcatttgaggccttttgaagtttgcaaaaatggccatgacaagtgaactgtttacctcaaaatcgttcattagcgatttcatttggtcgtcaacttctctctttgagaccaaaggtttagctacttcatcatctcctgacatctcagtatcatactcactttcatcctcattgatcaatacaaattctttccataaactcttactcgcaactgcacaaaccgaaaaattcatatcactagttatacaaagtttcagggctaggaaaagtttgtgaattcagctaacctttctgcttttcagttggagcaaccccattattgacagggcctgagtcagatgtttcgctaaccgttcgaagctgttggcattcggttttatgacccaagcgccaatgcagggcctggaaattagaaacaacacagattgttcaaatttgctcaaaagagcagaatctagcggaacaaaagaaactacgatgcacatatgcacacacctggtgtttcggtgaacagtatcgagcatttttgcagccgctacatagtttatctcctttccatgttccacaccaagtgcaaagcggagctaaagtgaaacaaacaatatcaagaattgacaattaaaagagaattctcggcattcagtcaaacccatcaatcagttcataatacctccatgacccaatggcttgtctgttccatcgtgctttggagcctcactcgagtaaaaaggattagctcgaggcaattggcaacggaaaaccttcgtacttcaggaacaaaaaaaacagtactttagtgtaacaacccacttggagaggagacaaacaatacaaagatgcaatatatagtaagaggtttctttctacctccgcatagccttctctggggcacgtttccattgttcatgttgatcacgaaggagacaagacatagatggacacatgaagagaaacaatgtccgatgaaaagctgattccttgtctgttaaaggagcataaagctgccaaatttccacaacaaatttcataaataaaccgacaaaaaacatgcaagaaacaacaaaatagtttgtatgaaacttacttgaagtacaaattgcataggttcttcacatagatcacatagaattgacttccctgatggtaaattaactggatccaaccatgcctatattgacaaatatcaacccaaagaatcaatacctaagaacataaagaagaaacagtttttgattgcacaaattgaaagatgttttaacttagtaccggaacaccaccagctaaattagggaacagttgacgaagatttgaccatgcgaatttaggactctcaacgaaacctaacatcacaggttcataatcttcatcatcttcctcatcatcatcatcaaattcatccatatttataggttccaccgcagtttcatcatcgtcatcatcatcaagctgagttattcggaggcctttgaaatcatccatggagtctccgttgaagctactcatcgaatcttctgtgttgaatttgatgaaatgaagactgcataacagagcaaaggaattgaattctagggttttactctgtttcataaacctctcaaaagtatttggcaagaaacaacgcacaaatcataatctgttaatgggtctttcgcaaaatactaaactcactaatttttcaagatttagagctcaatactcagctaattacaaatcccagaattggtacgaacaaatgttaaaaatgagctcactagtcagtatcaacaagaatcaaaatccaaaagaaacttacaacaccaggcgatgatggagatgttcttcagatagcctttaaaggtcgaatcttcttctatcaatttaaacagcaaaattttgtaaacatctttcacgaagacgaagacgaagacgacgacgacgacgacgacgaaaggaaaacaaacgtcactctggcccaaaaacaaaccctagaatagacgatgtcgtttaacataggcctataatagactaagcccaataaagtaatataagcccataaaggtttctaaattggttacgaataaaagtataaccttatcccggacaaccttatccttaaaatctcaccggtactccaactcccgttcaccggagctctgactctctgtaagcgaagattctctgctctttagctaatttagtcgaatctctattatgggtctgatccagtttcttacgagaatctgatttctgattttataacttgatttctcgatttcaaatttgtgttcttgcaatcgatttttttgcaggtaaagaagaagggagaaatagataatg

SEQ ID NO: 17585 - DNA, 3000 bp, Unknown; identical to SEQ ID NO: 6270
  misc_feature (1)..( 3000): 2750-1469P.txt file - cDNA_ID_1810073; gDNA_ID_1621085; Annot_ID_55376

SEQ ID NO: 17586 - DNA, 3000 bp, Unknown; identical to SEQ ID NO: 6257
  misc_feature (1)..( 3000): 2750-1469P.txt file - cDNA_ID_1810073; gDNA_ID_1621085; Annot_ID_170514

SEQ ID NO: 17587 - DNA, 3000 bp, Unknown; identical to SEQ ID NO: 6270
  misc_feature (1)..( 3000): 2750-1469P.txt file - cDNA_ID_1810073; gDNA_ID_2926183; Annot_ID_140638

SEQ ID NO: 17588 - DNA, 3000 bp, Unknown; identical to SEQ ID NO: 6257
  misc_feature (1)..( 3000): 2750-1469P.txt file - cDNA_ID_1810073; gDNA_ID_2926183; Annot_ID_200391

SEQ ID NO: 17589 - DNA, 3000 bp, Unknown; identical to SEQ ID NO: 8008
  misc_feature (1)..( 3000): 2750-1469P.txt file - cDNA_ID_1810080; gDNA_ID_1621182; Annot_ID_57398

SEQ ID NO: 17590 - DNA, 3003 bp, Unknown
  misc_feature (1)..( 3003): 2750-1469P.txt file - cDNA_ID_1810080; gDNA_ID_2926183; Annot_ID_140642
ttttcttcttcttcttcgtcacgtaattcaactagtttaacaaacagactcaaaaccatcttcaaaaaagctgaagagctttcgattctctgtgctattgacgtttgcgtcatctattacggaccagacggtgaactgagaacatggcctaaggagagaaatacagtgaaagacatggcttcgagatataaagaggccacaaaacgcaagaagagtctcaatcttcatgacttcatcgagaaggagaaggacaaggacaaagacaaagacaaatgacaaggggaagacgaattcgaaaaagaagaattatgtgaagaattggtatcctgactttgatcattactctcctcaacaactctctcaattgattcattccttagaacggactctttctactctgcaagaaaggcttcgtattgttgagtcgcagaaacaacaaaacaaaaacttggtgcatcagagtttaacaccatcgtatctgaaccagatccaacacttgaatcctagcaacttctcgccgtatatgtacaaccatggagatgctgctactctctcacaactcccactgtctgcttcactctccaatcaactccaattacctgaatcacttgatgcggcatggttttggtcagaacatgtgtttggacaacatcaccaacaacaacaactttcaacatcctggcgtgtcaaacacacaagaatactcaccgtttctttcggtacaagcatctgcagtgaataactacgggttgaataatcacttgatgcagcgacaggatcagcttcatggttttgatcagaacatgtgtatgatgagtgaaatcatcaacaaaaacaacgttctacaatatcctaatctctcaaacacggttccacatgaattctcttctggtttcaaccagaacacttatggtaatgctgtcggtaacactagcttctctcaagacatgttttcaagctatgatccgagcagtctgcttcacacatcttctctgccacctctccacaacaattctaacagttattgtttttctgacaactcaagacttctctgctaacaaatctgtctaaaagaaaaaacattgaagcttccttaagagtcagtcaattgtgaagtagcaagcggatcagagagagattgaagctgtttttgcttctaaattccttctgccacgttttttttcttgtttttttaagtatttctataatgaaacagatctatttgtggagattttgctttgaattttaagttgatttttttttcagtagtattcatatatatatgaacttccataaaaatctttcacaaaaacttgcatgaaacaaattataatctaaaaacattgatggtgacaagactgtttcaattgctataagttgatacaagctgcaaagtcaaattatataactcttgcatctaagaaacttgcaacttagtatccgtcttgtctgaatcagctgatacaaggagatggagattagctctgagttcgtacaaacaaggcttgtaccacaaacaaagaaaacccctaaatcaaggaaactgaaactgcgtagtcttgtttaccagaaggaggattatcatacacccaaagcagagacacaataatcgaccacaaacacaatcaatcctttagcaaacagataaagatgacaaatcacccaaaagctgaagaacactcctccaacaagcttactcgaatgcagaaaacggactgtacatatgaagatgagaacttgatgttcacattttctagtatacaaggtaaaggcaacgataactatagcctctgcattgttggccaataaggagaatttgtccgtttgtaaattcaaaaggaacgtctggaagctgcactagggagcagagaaagaacaagcaatgtagatctaaggagattagatcataaggggtgagagaaactgtaaagtataactgtatatgctttggggtagtttttcaagtagtacatgatggagagtgagtctttagctagagaaaagttttagacgttcactagtattatcctgtaatcaccctctttctccttcgttgtgaacaaatacttgtgtgctcctcttcttcctattctgctctgttatttcctctacttctttatatcttgcttactctgtttccgtgagttggtgtggatggcaaaggtttaagcttgatgtgttgtagagtttaacaaaacctaagagtatctccatcaaggagaaacccaaaaagtttctcgaacaagaaaaatattagtattttattataattttattatatgattaaatttttattttagtgtaaaaattgaatcaattaaaagaagagaaatgtaatgatggcttgtagagagtatctcatagtttctcacttgagaaactttctacactctctcttctctttttattatttctgttattttaatagtgaaaaactctcttgagagattaccaatgtagatggtctaacaatacatagtctttgcaagccccagcgcaattgcaatcaaattcaccattatgattgttcatggatgaaccatcaaaaagcttcatatcacaacatccaaaaaatcatccataaaataataaattatttagactaaaatatataattattttagacccaaacatacaacaatttttagtatttttacccattgtgatttagatcaaaactacacatcccaaaataaaaccatggtaggcccatcattgactatgtacaaatgtgcgttgacctttttctcgtatcacacaattctctccgaacccaccaaattaagaaacatggcaaaaactaggaataacctaaaaatagaatgaaagaggaagaaaagaacttaaaaatagaataacagatgtaaaagaagagttggataaaaaatagaatcaacccaaaaatacatttctcaaagctctttaaataaccaattttcaatttgtttgtaacaattaataaccacgagaagagaagttgagaaagaaaaaatagtaacgatg

SEQ ID NO: 17591 - DNA, 3000 bp, Unknown; identical to SEQ ID NO: 8000
  misc_feature (1)..( 3000): 2750-1469P.txt file - cDNA_ID_1810086; gDNA_ID_1621182; Annot_ID_57396

SEQ ID NO: 17592 - DNA, 3003 bp, Unknown
  misc_feature (1)..( 3003): 2750-1469P.txt file - cDNA_ID_1810090; gDNA_ID_1621182; Annot_ID_57395
aacatcaacggctgcgaacaaagtgaaaaacttacaattttcagcagtttcataacatctttaattagcaactaaagaggttttataggaaacttacatgacctttgtacttatgaactctaaggaaatcaagcagaggctccaagcaatctttgttacggaacataacagaagacaagtgacgattcagaaactgaactccattaccaatcgaagacgaacgagaaggacgtggcacgtttgcgttaaagggctcgaaatcaagctcaagacaaaaagggtcactattaggtccatcaacgagttcttctttgaaacgaagatactcagagactgttaattgttcaacacttagctcgaagacattaacacgaacatattcccaaacaccaggtcttggtctaacggctaacgcaacaaaaggtggtacaactatagcttcctacaccaaaattaacaatctattattagtttcaagatgaattttgaagaagaggaaaagttttttttaccattgctgatttaaggatctctccaaaaggaccatcagagagactcttctttgtttcatcgtctccgataacagattcgagttcgtcaattaagttatgtggttgaagaatccctttcccctgatccacataccttcacaaaaccaataagaaactaaattaaaaagaaacgagctttgccgggagaaagaaacaggggaataaggatcttgacgacgaacctggagagaagagcaacgagttcgttgcggtgagcggaaagcgtgtcttgcacgcgatcccttgtgcttagaaccctagtgagcttagggtttgccatgaatattcagatgatcactaaaaccctagaatcctagtccgagaaaagtttggtttttcgaatcaccaacgattgctactaaaaggaaaaatcattgattaaaagggtaaaaagcagagtgattctggaattttaggcgacaaagagagagagagaaaagaagacgtgtttgatcttctctttttcttgatactgttttcgctacaagtgacgtgtttatgttagaggagagtacatgtgactctgagagtgtatgtattttattatataaatgaaagcagtcacagtttaaaggaaaagtaaagcagtggaggctccggtgtcgtctcttttgctctgctttgaaagcggtttcaacgagataatcagagcaagaagacaactggtgctctgctttctcgccacgtagtttctagagaaaaaaatgatttttgattttttgcatgatttcatgaaaaggaatgaataaccgatcaaataatatttttaattcctaaacagatgtgtgaatcaaaattttgatggatctcttctgagttacttttaatatgtttgggcctacgtgaaccttattgggcctctaatctatataaattacttttattgtatctaaagagaaaaaatcagaatatgttttggtcttttgggcctttttggtaagctgagcacaattgtgcattttagtaatttaggagattcgctcggatctacattgaattgttcggaagaaagaagaaggaattgtttggatctttgggaatgttaaaacaggctatttgggcccaatctagcccagtccaacacatcgaagcacacaagttgctaaattggtccgattagtcttagagcttgattggttctccctctgtcacccgcaaacgctgcgtttgcgggtggtagcagttgttagcgtttgacaccaatcataaaaaccgttagataccgctttggaccgctcgaaatcgccatattttaaaagttccttcccgcaagcgtttgcggttgcgggcggtagcggttaggttaatttttttttttaattaactaaaataattatgtcttccacccaaaccctatatatcttattcttatcagaaaatcctaatcaatatattgaaaccctattctctcaattatggcatctacccaaactaacgaaaatcaaaatcaaaatcaagaatcaaacgtaagtatgatctatcctttcatccattcattagctagtgtaattctctgagtattttatggcatcgtcattttatttattttgtatttttttgagttttttgattgaatacatgttttgatttgttttctcgattagaaaattatttggtcagacgagatgacccgtttcttgttagaactttatcatatgtatagaggcaatccggaaaacccacgagttcaacgttatttacagtttattacactacttgatgcaatttttggtgatgtaccaaatgcataaagtactaagctttttcttacaaaatttatttatttttgaatttaatgttttatttatggttttaattattaagcatgtttaatttttctaatattatcaatttatcataataatatattgtatttttttcttttactagtaatatattatatttattttggttattttttatttaattactatcgcacccgctggtttaccaatcataaaactcccgcaaacgcactcattatcaaacgctcaaccagtcgttcaaaacacttgataacgcttgaaaccgcaaccgcctgtttccgcaaactcccgcaaccgcaaccgcatccgctgcgtttaaaccagtcaggcccttatttgttagagacatccgaacttttaaaagttaaaactgatatgcttgtccatccataatgttagaaccgtctttggaattggtaatccacacactataatgcgactcacgtcgggacaataacactattgtctaccgtgcatacacgttgttcttatttcaagttttgtttggttttactattacaagttgctcgttttcttattagttaatgtacactaaaccaaataatttaattagaaaattaaccttctttttcaacgcaattaatctataaaacccaatagttagttttcaaaaaacttcacttgcttaagcaacatataaacaaagcaagcaaaaaaaaaaaatg

SEQ ID NO: 17593 - DNA, 3003 bp, Unknown; identical to SEQ ID NO: 17592
  misc_feature (1)..( 3003): 2750-1469P.txt file - cDNA_ID_1810090; gDNA_ID_1621182; Annot_ID_174311

SEQ ID NO: 17594 - DNA, 3000 bp, Unknown
  misc_feature (1)..( 3000): 2750-1469P.txt file - cDNA_ID_1810090; gDNA_ID_2926183; Annot_ID_140643
atcaacggctgcgaacaaagtgaaaaacttacaattttcagcagtttcataacatctttaattagcaactaaagaggttttataggaaacttacatgacctttgtacttatgaactctaaggaaatcaagcagaggctccaagcaatctttgttacggaacataacagaagacaagtgacgattcagaaactgaactccattaccaatcgaagacgaacgagaaggacgtggcacgtttgcgttaaagggctcgaaatcaagctcaagacaaaaagggtcactattaggtccatcaacgagttcttctttgaaacgaagatactcagagactgttaattgttcaacacttagctcgaagacattaacacgaacatattcccaaacaccaggtcttggtctaacggctaacgcaacaaaaggtggtacaactatagcttcctacaccaaaattaacaatctattattagtttcaagatgaattttgaagaagaggaaaagttttttttaccattgctgatttaaggatctctccaaaaggaccatcagagagactcttctttgtttcatcgtctccgataacagattcgagttcgtcaattaagttatgtggttgaagaatccctttcccctgatccacataccttcacaaaaccaataagaaactaaattaaaaagaaacgagctttgccgggagaaagaaacaggggaataaggatcttgacgacgaacctggagagaagagcaacgagttcgttgcggtgagcggaaagcgtgtcttgcacgcgatcccttgtgcttagaaccctagtgagcttagggtttgccatgaatattcagatgatcactaaaaccctagaatcctagtccgagaaaagtttggtttttcgaatcaccaacgattgctactaaaaggaaaaatcattgattaaaagggtaaaaagcagagtgattctggaattttaggcgacaaagagagagagagaaaagaagacgtgtttgatcttctctttttcttgatactgttttcgctacaagtgacgtgtttatgttagaggagagtacatgtgactctgagagtgtatgtattttattatataaatgaaagcagtcacagtttaaaggaaaagtaaagcagtggaggctccggtgtcgtctcttttgctctgctttgaaagcggtttcaacgagataatcagagcaagaagacaactggtgctctgctttctcgccacgtagtttctagagaaaaaaatgatttttgattttttgcatgatttcatgaaaaggaatgaataaccgatcaaataatatttttaattcctaaacagatgtgtgaatcaaaattttgatggatctcttctgagttacttttaatatgtttgggcctacgtgaaccttattgggcctctaatctatataaattacttttattgtatctaaagagaaaaaatcagaatatgttttggtcttttgggcctttttggtaagctgagcacaattgtgcattttagtaatttaggagattcgctcggatctacattgaattgttcggaagaaagaagaaggaattgtttggatctttgggaatgttaaaacaggctatttgggcccaatctagcccagtccaacacatcgaagcacacaagttgctaaattggtccgattagtcttagagcttgattggttctccctctgtcacccgcaaacgctgcgtttgcgggtggtagcagttgttagcgtttgacaccaatcataaaaaccgttagataccgctttggaccgctcgaaatcgccatattttaaaagttccttcccgcaagcgtttgcggttgcgggcggtagcggttaggttaatttttttttttaattaactaaaataattatgtcttccacccaaaccctatatatcttattcttatcagaaaatcctaatcaatatattgaaaccctattctctcaattatggcatctacccaaactaacgaaaatcaaaatcaaaatcaagaatcaaacgtaagtatgatctatcctttcatccattcattagctagtgtaattctctgagtattttatggcatcgtcattttatttattttgtatttttttgagttttttgattgaatacatgttttgatttgttttctcgattagaaaattatttggtcagacgagatgacccgtttcttgttagaactttatcatatgtatagaggcaatccggaaaacccacgagttcaacgttatttacagtttattacactacttgatgcaatttttggtgatgtaccaaatgcataaagtactaagctttttcttacaaaatttatttatttttgaatttaatgttttatttatggttttaattattaagcatgtttaatttttctaatattatcaatttatcataataatatattgtatttttttcttttactagtaatatattatatttattttggttattttttatttaattactatcgcacccgctggtttaccaatcataaaactcccgcaaacgcactcattatcaaacgctcaaccagtcgttcaaaacacttgataacgcttgaaaccgcaaccgcctgtttccgcaaactcccgcaaccgcaaccgcatccgctgcgtttaaaccagtcaggcccttatttgttagagacatccgaacttttaaaagttaaaactgatatgcttgtccatccataatgttagaaccgtctttggaattggtaatccacacactataatgcgactcacgtcgggacaataacactattgtctaccgtgcatacacgttgttcttatttcaagttttgtttggttttactattacaagttgctcgttttcttattagttaatgtacactaaaccaaataatttaattagaaaattaaccttctttttcaacgcaattaatctataaaacccaatagttagttttcaaaaaacttcacttgcttaagcaacatataaacaaagcaagcaaaaaaaaaaaatg

SEQ ID NO: 17595 - DNA, 3000 bp, Unknown; identical to SEQ ID NO: 17594
  misc_feature (1)..( 3000): 2750-1469P.txt file - cDNA_ID_1810090; gDNA_ID_2926183; Annot_ID_200398

SEQ ID NO: 17596 - DNA, 3000 bp, Unknown; identical to SEQ ID NO: 7998
  misc_feature (1)..( 3000): 2750-1469P.txt file - cDNA_ID_1810092; gDNA_ID_1621182; Annot_ID_57394

SEQ ID NO: 17597 - DNA, 3000 bp, Unknown; identical to SEQ ID NO: 8025
  misc_feature (1)..( 3000): 2750-1469P.txt file - cDNA_ID_1810115; gDNA_ID_1621183; Annot_ID_57417

SEQ ID NO: 17598 - DNA, 3000 bp, Unknown; identical to SEQ ID NO: 8017
  misc_feature (1)..( 3000): 2750-1469P.txt file - cDNA_ID_1810125; gDNA_ID_1621183; Annot_ID_57413

SEQ ID NO: 17599 - DNA, 3000 bp, Unknown; identical to SEQ ID NO: 8017
  misc_feature (1)..( 3000): 2750-1469P.txt file - cDNA_ID_1810125; gDNA_ID_1621183; Annot_ID_174334

SEQ ID NO: 17600 - DNA, 3000 bp, Unknown; identical to SEQ ID NO: 8018
  misc_feature (1)..( 3000): 2750-1469P.txt file - cDNA_ID_1810129; gDNA_ID_1621183; Annot_ID_57412

SEQ ID NO: 17601 - DNA, 3003 bp, Unknown
  misc_feature (1)..( 3003): 2750-1469P.txt file - cDNA_ID_1810137; gDNA_ID_1621183; Annot_ID_57408
gagttaccagtaattagaaaactttgcaaaaaccaaaaaagaaaaagagtgattagccaaatgcactttcaaatagaaaatcaacaaaatacgcaaatatagaggtttaccatatatgtaaaaaaacatctgaaaaaagttcgtcacaataaagagaaaattttggacaatagagatattgacggagtacatgtatgtgatattgttgcaaaaggatagcctcaaactcatattcataggaaaagaccacaaactttatttgttatgaatccatttagttacaacgtcatgttaagtagattcttaaaaaactatagaagtaattattatcctaaatagtatcaacataagacaacatattcgattgagataatagttggggcagtccgtagtcgtcagagaaagattaacatcacatacttttttggcttatcgttcacttttcattttaagtggtagttgggttttacactttatatattgaacctagataacaactgttgtgaattctctgtttttgattcgaccctcttttgaaccatggttatataattgttctcgacagacctcaagatttttttgttttaaactgattacaaaaatcttatatacacatgcacatagtaaagtctaaaccaaagcaatataatagatataaatgttcagtcagagtttctattatcaatcttgcaaagaaatgaaaatatctttcgatagatgaagattaagattcagacaataacatgcaacctttttctttccccccaaaaacacatcgatcacccaccatcaatccatcatggatcgatcatccatttagggacctatttacgtttgattttttttttcctataactttctttaataaggacaacaaggccaagatcttcatcgtgtgtttcgtgtgtctcaaaatccctctaaactttttattgtagtttggtgagacttgtttggtggtgctgatgatgatgagagagagagagagagagagcgcgcgaggaaatcatggctggtaaacagaagaagagacatgatgattactgattgaaatattatatatgtacaccattgaaataagttataaaagtgtcgtaaatcgtcaaaagaatcagtagtatatatctactctatatgatctatatacaccattcatatataaaagaatcacaagtatgttattgaggatgtgtgtcaatgaagccctacgagaaaggtctgtgcactaccaaaaaagagacacatagtttgtttgagtttttttattgggttcatttgttaaatttatatccataaatacctccttgaggtatagccgtacagggtttttttgcagttcaagatatggcatttgtatgaaacttatatacccgccaaaaaaaacatacctaggtcacccgtgggtattttttgattgggacaaactggctgtagggaaagaaaaaacagacaacgttaggtgccttgtctctcaaatcacttatcaggactcaggagcaataatttgttcgaaccaattgtacgttgtaacatctaaatgggtccataacaatcagataataaaattttatcatctttcttaatttatttatttccaaataactttctttatcatgtttcttaattacgttgatgcatgtttagatagccgaaacaaatcactattactttgattcttattatttatttatcaatttctggattcatgacatttgaaaaactaaatgatgtattactgtgcatttgcaattcaatcgatcttaaagtcttaaaatcaactagacgataaaacggtctatttccctatagaactagatatatatactatgcattgtgatatagaattaagagattactgtttctttggatgtatgatcttttatcagaataaacttcttattttgtcttcagaaataatcttgacttcgatcaatcattatttcgtaagcgataaaaacttctgattatctaccaaaaaatgatttcaatatattgtgacattgttgcaatacgataaccacaaactcatattcatagggaaatgttttaacaaactttgttacaaattcatctacttacaacgtgatgctcaatcattgatatacattataaaaagaattattatcttaaaatagtatcaacataagacaacatgctcgatcgagataatacatgtgccagcgcagtccatagtcgtcagaaaaagatcaacatcaaatactttttaggcttatcgcgcacttttcactttaagaggttattgtgattacactttacgtattgaacctaaatatcaatttcacagttggaagtttacaaaaataatgccagtgtcgatcctaggatgatgcgaaaccaaaagatgatgttacatatatatacacatgcacatttagtattctggttatcaagataaggatgaaaagactaattaaaccaaagcagtgtctatgacattgcaagcattctccaacccataagacaaaattgattctacaaactttcatatcatcagaatctatgaaatgaatcaacaactatcacatctcagcagcaaagttaaaggactttccacatgatctatatttataagggtatcgttaagatcttctcacatgtgtggcacgtgacatatttaatattcttgatgggcttttctgttttttatgggccttttcgaatttcagggttttaaataagttagaaattagataaataaaaaacaaattagcaaaaaataacgaagtgtctcgtctcttctctcttgtcttctccagatcagtgtttgtggggttttcccaatggagcttcttctctcattgtctctcctcctggggttttggtgtaacaacaatcctcaattcacgaggcatgaatcattattctccccatttgcttattctctggctagaatccccagattttactgtatcgactttgggaatttaactggagaaccatttccactcaaactgggaaacaaaaacctgttattgaacaatg

SEQ ID NO: 17602 - DNA, 3003 bp, Unknown
  misc_feature (1)..( 3003): 2750-1469P.txt file - cDNA_ID_1810155; gDNA_ID_1621184; Annot_ID_57424
aaagacttttgtcacaaaataaagtttcaggaggccgtgtcactctttgattcaatggcctacatgggattcaaacctaagattgtcatatgcaacattgtgactaatggtgtttgcaaaaacagagatctggataacactagattgctttttcatttttttataaatgattttattttgcttttcgttattaaaactatctaaatttaaagacgtttaatataaatggtttagtaactgtttaaatagtctttttattgggtttagttcaaaaaccgattaaaccaagtttatggagaaataagttccgaactatcgatttggggagatataagttgggaaatttagtttccgggaggggggggggagggataatggcctatttggtacgttgtaatactttttgtggagaaatatactatgttgtttttctatttcttcactaaagtttttacttttttattctctggattttttttctgtttttatttccttcacgttgtccccatgaaaaaaacaattattttttccacacaaattaattttgagtgaagtttctagctactctcaacagcatttctcttgatatttgatagttctactcttttttttatcttgatcaagaattggaagaaaaatgctcagtggtaatggttcgatccatatcgaacaataatatgattaataaaattacaatttctttttaaatcaaatgagctttttctaaaattctatattttattccaaaatcaaataattttttttccaggaattgattaattgcttaacccatacaagagcaaattgaggagaaagatgagaagatgatgaagagaaaagatagttgagcaatggaggaagaagaagttgttctatgaagaagaagaggaagtgttgtgaagaagaagaattatgactttagtcacaattggattaagaggctattggggtagaagataagtaaagcccaaatagaagttggtttgttttgtttaatagaaagttgaagcaccagtgatgtagattggagagaagaagcgtctaatgtattgagcttatatttttctaatttgttttttttggcccatctctaacttaacctccctttatataataaacgtaaaagttaaattaaaacctaataaaaaacgagataaaaggtattgttatcgtaattatgatttttttttccaaaataaaaaactagaagaaatagtaattaatgtgtatctacatatatatttttgcagccattttgtgaaataaatcctatagttggaacttatttacaataggtgccactggattttaatgtttgtttttgataattagaaaaaaatcttcaaattaaatatttgacatttaacaatcttccctaaatctctccacattaactacacgattagttactaaaataaaacttccaaaatatttaatatcatttaattactacaaaataaatggtttttttacgggacggattggtgggacgggtttgacaggacgttacttaataacaattgtaaactataaaataaaaatattttatagatagatacaatttgcaaactttatgtatactaactttagaaaataaattgtttccgcggtgtaccgcgggttaaaatctagttttgtaatacaaccgtagtttgttgtttccaaaatgttgttcgcattgtgtataatgatagcttattgtctaattgttgtgatctgcttcttttttcatgtttttatttttacttttgagttatacatatagattaacatatatgtcaatgttttttaacccgactcgcacgatgaaccggactactttcgtgatcaccggttcattgagtcaatccagttcgatgacgggtcaatttcttaaagttttttttaatgttacagagattatatagtttttatatataaaagatatatcatatttaacaaagtaatatatttaacaataataataaagtgattaattttttaagtccaactaaagtataaagccgtaacaaatatgaaaatagtggagatcaccgatgacataaataaactaataaaacatcgcggatttaaaacaacgaatctcgattttctctctcatcatttcattcactcttaaggcgggattgtgaagtcttcatcaatttaaaacatcaaatgagtatatgaactagaaaaagttataaaaataatataatatagtctaaaatcttttattttagactttttttccgagatatcctatgtatttttttttttcttcattaaagtttctaattttctatcctcttggtttttgttctgttttcattttcttcccgttgtctccatgaatttttttttactttttcctcataaattaattttaagctgtgttctaaaaagcggtttaggcggcactacgctcttaagtgactcgtagacaaccgctttgaccgcctaaatttgcataagttccggtttactgtattgttttttatttttaactatataaaactttcttataagtcttaactcaatatatattctttgatatgaatttaactaatttttgtttatgatttaacattttaatttttctaatagatagttatatataatttattatctataatattatattcaatatgtattatattataaacttttaaactgtataaaatcgtctaaactcctattaagcattgtaggcgttaggcgctatgttaccgcctgcctagcgttttcttcgacactgattttaagtaacatttcgagctagtctcattaacgcctctatttatatttgataattttactaattcatttttttatcttgatttgaaagaaaaatgttcagtggtaatatgattagtaaaattataaaaaaatttctttcttttattaaatacaaaagttcttaaaacgtgcagacttgaagatctccacaaacctccaaaagtctattcaaatggcagagacagttgaatccatcatcatcatcatcatcgtcttctccaaatg

SEQ ID NO: 17603 - DNA, 3003 bp, Unknown; identical to SEQ ID NO: 17602
  misc_feature (1)..( 3003): 2750-1469P.txt file - cDNA_ID_1810155; gDNA_ID_1621184; Annot_ID_174370

SEQ ID NO: 17604 - DNA, 975 bp, Unknown; identical to SEQ ID NO: 2783
  misc_feature (1)..( 975): 2750-1469P.txt file - cDNA_ID_1810155; gDNA_ID_1620594; Annot_ID_161488

SEQ ID NO: 17605 - DNA, 3003 bp, Unknown
  misc_feature (1)..( 3003): 2750-1469P.txt file - cDNA_ID_1810214; gDNA_ID_1621187; Annot_ID_57441
tggtaaaatagagaacaatgaattatatttcacaagatcttccttttcaaattatttaatttaatctttgcatatttagacttgcagcaactgtcaacaagtcggacacaacaaacgttcatgcaagcgtaaagcagtgccaaaaccacccaagaaacctcaaggacgaccaaggaaaaaacagaaaacaatggatgaagagaaccttatcactcagccaatacaatcttctcttcaaagttaatgtttgacaagtctttactttagaatatcttgtccctctgaaacaattgtttttttttgtgacaaatattgttgtgttgcaacagcttcgatagttatgttggttggatttatttaagcatgactctttggattattttaagttgttgtgtctttctttcagcttctaaaatccaaactaattaagcaattcaaaatcatttagaacgtttttttgtaataaattcaaaacagttttaaagaacataatgtggtttttgcgctaaatacaaatgtctcgttgttgttttttttggaaattaatatcccattaatatttaatttttgtggggttaagtttattaacaggttttagttcagggtttgttttactaaaaacatagtttagggtttaaaaatggatctggccaaagttgagggtttttttcattaaattctcatatataaactctaacaatcaaatcttctattcttttttttcggatctaaatcatctctttatatttactttctaaacatactaactaatacatatatttctttgcaatgatcatcaattgtttcaacacgaaaactaatctgttcgattgaccatgtcatgaaagaaaccatggcatattctttctctgttatatatcacttttgtcgtaattgtttcagtataattctcgaatccccaattttttagaatagtttgttgataaaattttatttactacagtacaaacaaaatattatttctagttccaatccttattcaaactagaattggtttcttttttttgttacaacaactttctctatatatattgtaaacatttcttttcacttgttttgcttccagagtgaagagaacagaaaaatatcgagatggctaaccaagaagaaggaagcatcttgaaagctcttgacgttgctaagactcaatggtaccatttcacggcggttgtagtcgccggtatgggtttttcacagactcatatgatctcttcgtgatatctctcatcacgaagctacttggccggatctactatcaggttcctggctcctcctctcctggaagcctccccgacggcatctctgtagccgtgagtggtgtggccttcgccggaacgtttctcggacagatattcttcggatgtcttggtgacaagctcggacgtaagagagtctatggtttaacactcttgatcatgactatttgctccattgcttctagtctttcctttgggaaggacccgaaaaccgtcatggtaactctctgcttcttccgtttctggctcgggtttggcattggtggtgactatcctctctcggctacgatcatgttcgagtacgctaacaaacgtactcgcggcgcgttcatagcatcggtttttgctatgcaaggagttgggatacttgccgcaggaggggtttctttacttgtctcgtatcttttcgagattgagtttccgtctcgggcctacatattggacggcgcagcctccaccgtcccacaggcggattacgtgtggaggatcatcctaatggtcggagccttaccggctctcttgacatactattggcgtatgaagatgcctgaaaccgctcgttacaccgctctagtcgccaagaacgcggagcaagcggctttggatatgaataaagaaattttcacagaagtggacgaaaaaagatttgctctcaccatttgtcaaagtgagaactggttttcacggtttgtcttttcattcaatttcggaccaaattaccctgggaaaacttaataatggcacaaaccaaaccgtgcagcagttcgtatcggttcagttaacggcgtaaaccaaaccctacagcagttggtttcggtttagttgatgcggttcagttttgaaaaagacaaaaaaaaaaaaaactgaaacgaagaaacccgagaaaacgaaaaagagaagagagtaacggagagatttgagagagaatcagaaagcgaaacgaaattcagtatccattgcttcaaaattcgacataacttcgaattgttgggtagttgaattgagccactgaactcccacatccggggaagtgaaagttactgtttttcccggcgaagccaagagaaagttactgtttattccggcgaaatttgaacctccggcgagatagcatctttagctatagctgggaataaagctaacgacgaagtcccgaggaagcagcatggtccagggaaggagaagcgggtattaagagtttccccgcggagaaaacgctctgcgacaaaggcaacggaggaactgggttagaatctctaatttaccgtttgttgtctttgggtgtatcagaattgtaaagcttgtttgattaaagggttagaacttgtcggaatttagcatatctttaggatgaaaaattgagaagtagaattggaaatgtctgtttccgccaaaaatatgattttgagttataatctggaaaatgtctgtgtacgtacactacttcggtttgcttaacagtatatgacttttaattgcaggtagtccaagtgttgctccgactgaagatcttacagttgaagagttaccaccaagactctttgctctagaccggtacccttccgagacgaagatgaacgcgtactctaaaccagagatgtagtttcttctcgattctccatttggggaactttttaaaatacccaaaaacaaggcatctttcaatgctaagcttgtccttggactaatatgccgtcagttagtgacaaagaaggtgaatgagatg

SEQ ID NO: 17606 - DNA, 3003 bp, Unknown; identical to SEQ ID NO: 17605
  misc_feature (1)..( 3003): 2750-1469P.txt file - cDNA_ID_1810214; gDNA_ID_2926145; Annot_ID_139070

SEQ ID NO: 17607 - DNA, 3000 bp, Unknown; identical to SEQ ID NO: 8061
  misc_feature (1)..( 3000): 2750-1469P.txt file - cDNA_ID_1810226; gDNA_ID_1621188; Annot_ID_57455

SEQ ID NO: 17608 - DNA, 3000 bp, Unknown; identical to SEQ ID NO: 8061
  misc_feature (1)..( 3000): 2750-1469P.txt file - cDNA_ID_1810226; gDNA_ID_2926216; Annot_ID_142245

SEQ ID NO: 17609 - DNA, 3000 bp, Unknown; identical to SEQ ID NO: 8071
  misc_feature (1)..( 3000): 2750-1469P.txt file - cDNA_ID_1810242; gDNA_ID_1621189; Annot_ID_57477

SEQ ID NO: 17610 - DNA, 3003 bp, Unknown
  misc_feature (1)..( 3003): 2750-1469P.txt file - cDNA_ID_1810256; gDNA_ID_1621189; Annot_ID_57471
tcagtacggtgggttcaaaacagtagacgataccgaattctccaacgaaactgtctctgaagttgttgttaagcctggatcatctgaaaccatcgaaatcccagctcctgaggtataattagaaaaccaaaccctaccttattcctgaagttgttaaaccctatctttctaattatggttttttgttttgtggttgttttcatagactgaaggtacattggtatgggacatagcggttttgggatgggaagtgaattacaaggaagagtttgtgccaacagaagaaggagcttacacggtaatagtccaaaaggtgaagaagatgggagcaaatgaaggaccaatcaggaacagtttcaagaacagtcaggctggtaagattgttcttaccgttgacaatgtctctggcaagaagaagaaagttctgtacaggtacagaaccaagactgaatcctcttcctgaagtggaggatttcatgtagtctctggatatataatattcttttctaaatttaaacgtttggtgttattatttatttttgagtgatatgtaagagaaagagatactcccattatttcattgatattcaatcttttgcttctttctttttttggtaaggtcaatcttttgcttctttggtatgagatttttcctctcttccctatttgatttatttgattaaaactgtatggataaataaatatgttcgaatattcagagttttacatgggctgagtattggcccaatggcctttcagagtaacaccaaagaagaaatatgtgatatgttttgtatggttgttctgaaaggttttacagtgagaaaaacagttgaacaaccaaaagaggaatggtttgatgattaataatttttcttttgatctaacattcattatattataaaccccaaaaccgggaaaaaattgaaattcggatggaaaaaaacataacaactctatccatagttaaatcttttttttgtttgtcatctctatccatagttaaatcttagttcttacttatgagtaaatgtccttagactactcatgttacgatcgatgatgcatgtgtgtgaacttaccttaatggatatacgcggcgaaaacaaagactgccacaaaatctactctttgtgttgttattggtacacatcaatggatgaagaatagtggctcgaaccgcttcattggccagaaaaatataagattagctactacatttttttctaaagtaaaatcaattttgttttttgggatcaatttttgcagaattctatgtagtgattacgacaccacacgcatgcatggcatcatcagagaaaaagattatagatgactagacgcactgatccttctacctttttttctttaaattgaatgattttaatataaacaatttgtaacttgtaatagatttgcacttctcctcctataaatgcgttcgtcaacatctttgctttcgtacggtaaaacaacatctctcgttgaaacaaaatgtgtttgatcattttaaattttctaataccttacgtcttttattttaatttctataagaattgtctgtatggaaagtttttttaagatttttgttgcattttttttaatggacagcttagtcatgcttctctctaatctatagactaacatgcgggtaacatataaatggcttatataaatatattcttaacaaaaaatatcaatattcttttcagcatatcagtgttataattaatttagaatccacgtctagtttatattttcttctttatttgcggccccaataatactacttttggtcaacaatatgaaagtcaaaccagccgctcaaatgtatccttcatgagttcatgttatatttcagtcaatacttttcatatttaaacacttattataattacgtaatatttttttgcccaaaaaaaaaaattacgtaatattcaacatctctaccttgtagagttccaaaacattgtcacaaaatatttataaagaatttattttaactaattaggtcgttaattgtccaagggtttttcatagttgatatagttctgttcaaatatagccatccttaatcgattcatgggatcgtaaattactacttcgagtgttgtaaaaaaaaatgaaacttctacattacaaactcgaatttaatgcatctggagtgatactataaaagtagggatgctctcaggtcgcatttgagagacacagaaatgattttaatggaattaatatattttcagtttttcacaaaaaaaaattgtgtttataacaactgcagattcaatgctgattttatgagtctcacctatagaatttatatttctatattcatagaggcagtataggtgttgacccaacatcgaaagaacacttcgtaaaaaattctttggaacaaggctgaaaatttactcccaaatttagctatccgatgaagataaatcatttaccgtttattaaagaattatcgagattttagtccaaaccaaaagagattatgagcctaagattttgaatttgtattggtaaaagaaattgaacgaaaatttcagaaaaaaatattaataaattgaacgatagagttcacttactacatagtcaactagtgcctagctataatagtttcaaaagacaaaaaaaaacaaaatcggttaactacttccgtgacataattctcattttgatttttgaatccagtctaatttgaaaagtatattcaaaatctttaaatccattaatgataacttttataatacgttgacacacgcaattgtatatacaatattcttgaattttaaatgtaaattctagaatatattgcgatcaccacactaatcaaaatctttgggacaacttgaacccacatttgacttttcttggtcaaatattttggcatcatgcatgatcttctctataaaaaccaaaaggcctcaacgacattcataaactcagtcattatatttatttttgttgtatttcaacgttcaatctctgaaaatg

SEQ ID NO: 17611 - DNA, 3003 bp, Unknown; identical to SEQ ID NO: 17610
  misc_feature (1)..( 3003): 2750-1469P.txt file - cDNA_ID_1810256; gDNA_ID_1621189; Annot_ID_174536

SEQ ID NO: 17612 - DNA, 3003 bp, Unknown
  misc_feature (1)..( 3003): 2750-1469P.txt file - cDNA_ID_1810260; gDNA_ID_1621189; Annot_ID_57470
aaaatattttcactgaataccctctttcctttctgaaacatgaaagattaatattcgttttgataggacggagacagagtatgtcagccagatgcttacaaaaatcaaacgcttttcccaacaccactcctgccatgtctggtttgtcgctcatccaaaacagttgcaacattgggatggcggtgcaccaaacctttacgatattagtggcagcgcacattttataaacaaatgtgacaatggtattatagttcacagaaaccgcgacgaaaatgctggacctcttgatctagttcaagtgggtaccaatcccttcatcttcatctgtaatgtattattttaaaaatggccttcttattgtgtaaagttactaacctttttgtatgttttagattggtgtgaggaaagtacgaaacaaggtggcaggacaaattggtgatgcatacttgtgttatgacaggtacataaacttttcaactaccttcttatttctactaatctaacttaacggactaaacaagttttcacaagaacttatgatagtattttgttactttggcatcgaaaactagctgaagttattccgaagtacccaaagcgtagagacctttgcctagaacaccaaacctttatcaaaactctgttcaaagttacaatcgataattctactatgttggttcagtaatgaaatctttattcgacaggacaactggttcctactcggattctccagtgacgcctggaatgccagagaggagatcacccaagcggtactgatcagtttggtgaatttaaaggccgtcaaacacggtggacatagcgtatcgataacatttgtcaactaaattttatcccttttgggttaccattggtgaggaaaaagatgatcttgtgagattcttacctttgtgttttaacagactgtcaagattcaagaacaagattatgtctctactatgtaatgtggaattatgaatcatggtgtttctctattgtgtctggtaggtctgatccaaaatgtgactgaattcgatttttgtacagctctgtgatctttttgtgctctgtctgtttctgtagtttgttctgtttctctctgtctctgtctcctccttttgttgcggctgatttggtgttgtgaattagctgtataactgttgacttcaactacctctctgttataattatgcaaactctttgcaaattgattcaattatttccaatgttatactgctttgtgttacgtctatctagttgatttctttgagtattaatctaattgtcacgcaaatattttataatagaatcagttgcggcggtgcactataaatgtcgatcatatataatcattgcgaacgtaattaatatagggaatataggtgaaagttgtggaaatagtttattctcgtcaaaggatatgaccaagaccaaaattattggtattatctaatttatcaatccattgtttttttttcacacatttgcttattctgatatatttagtattgtttttaattatacatcataaagacataaacatcatagacaaaacttttattgagaacttatataaataatcattttttgtgtatgttaatcacatatttacattaggaaataactaagtttagaatttttcgaccaatattcaaatcacttaatcatctgatttacatgcaaacatttgatgatatgaaaccattcatatgaaacagcaactcattaatataaaaatataatgattagtgtctttgttggcatattttggtgtcaacagctaaaagagacatttacttaccaataaaggagaccgtatatccaattccgactgtttaatgaaaatcatgatatattaaggaacaaatatttgattgagaaccgttacaacgaagagattcttctccactatcacattatacatggtactttctaattatattaaaatgggacgtaatttagaattaagtgataactctgtaaaattagaaaggaaacaaaacaaaataaaaccatattaaaatgaatttcacacaaaaagtgactttggtagtgaatatatccgtccgttgcgccgaacatactctgtcgaatagcaccacgtgtcgtgtaaacagatcagcatcgacgaccgttgagagaacatgagaagcgaaacgtgggacctcaccaatatctttgtttattaatttatatttcttggtgctacgtaaaatatttgttctgcgattttgagaatttgccaggctggcaaattggggccaggttggatcatccaacggctgtggttggttcttcatgtttactggtagggtccatcatgtgaccgttgctaagggcggtgtggaccacctctagtcctagggttttttccttctctgcataaagctcccttctttgttcctcctcctctctcttctcttatttattcacaaccccccattaatctctttctctgctgcagcttaaactttaaaaaacactacaagaacaacttcttcaggttctataaagagattccgaagaagaatcttttccagaaacagtgtaagtcttatcttcttctttaggttggtttctctctttttctctctttagaagctgttaaattcgaatcctttttgggttttagttctattgtctctcttgatttctcgatttttatatagataaacttagaaagcttcgaatttgagctaggtttctctcgccttcaggaaaaaaaaaaagaaagtttcaatcttttcctcctgagatttagttctgcagagttgaaattggattctgtgttatgttgtttgagttcgtttaatcgttagggtttatacaagaattacgtttttgattttagatctctactaatcaggaagaagaattaagcttgtttcttttagatctcaactaattcaacaaggttaattagttctagggttactactttggtgaattgtataattggtgactaaatattgtttgaatcgattctgaatgacaggctttaagatg

SEQ ID NO: 17613 - DNA, 3003 bp, Unknown
  misc_feature (1)..( 3003): 2750-1469P.txt file - cDNA_ID_1810264; gDNA_ID_1621189; Annot_ID_57469
actgacggagatggacctggtcaagctctagcggaagaacttgcacggcgtttggggaaagaaagatgttggcttgtcaaatggccgaagaaaagtgaagatgaacatttcaaagatgcaaacgaggttagtgtagattatatgtaaaatttatgaaattgcttttgtggttactctggtcttaatgaccattacttggatgattttcttaggtgcttatgtctaagggacctcatttactcaaggaagctattctaaatgctgagccttaccctttgaagtcatgaagtgtgtccaagtcatgttcttcatatttgtcttattaatttttcggaactagcattaagagtataatttttattttctttctaattttgcatattatacacattctaaatttaattattaaccaagaaaatatattaattgaactttttgatgaaacagagtacatagcacttttggattaaaaaaccaacgaatttacattagttaagaagacaattaactaatggttaaactctaactaatattgaaactaccaaggaacaaattagaaacagacagaacatagacaaatctaattcatcagatttgttgacaacaatttgttaatgtctcgagaaatcttagggtttgtcaagatgcattcttcggcttttaggacttgaaccatttcccttggaaccacacacacttcttctgtagatagcttctcctggatttcttgagaaccaagcaaaaactgcatttctcttcccacctttgaactatccagagtctgcaaaatttaaacaagtatcgtataaaaaaaggaaggaaaatactgcaaggaaccatttggatttagggtttatcttatacctgcattttggtctgcttcagttggagaatctcaatttgagcctgcaagaacttgacatatttagctgcggcattgaacatttcggcagtgttgtgtttctggcttccagggattagttttcccagctcttgagtcttctctgtgattcttcttctcctctttcgtgctgcgatgctctgagcagatagctctcgcttcttggtgtcgccttgttcagtccacccaaccttgaacgtcgatgagaaatcaggagcttgaaacttggaaatgttggaagcttctgtgatgtaagaatccaagaggtaattagattcagggctaggggaaaaagggtcgtgactgttgaaatggaagctggagtcaatgagtttctggtgttttggcgtgtggaaggaatctaattcctgtgactcgttgaagactcgggtcttagggctaggaaggaagatttcttgagatggaagaaacgactcgtagaaatgatcatagtgatcaaacccgaagagagacggtgaaagagcttcgtcgggatacaatggctgatgttgcggttgctcttggaagaagaaactgtcagtttcagggataatcatatccacatcagggataaagcaatcctgaagctggattacatctgagttggagaagtagcttaagcagtccatagttaagaaatagatgatgaatttttagcaaatgaagaatgtgaagcaatcaggagcagttacagatggggaggttttgagtaaatggtttaattaagacttaattagctttaattgctgctaatcaagcttagagagagtaaacgcagaaaacaaaggaaaggacaggagaagatatatgagagaagcagggattctgtcttttgttttcttttgagtgaagtaagacaattcaggtagtaagtttgtaacttgtaacttaactgtcacgaaataaatatgaaagagagagggagaagttagggttttggcgaggattaaggaagggctatagtgggttttaacttttagatttagcttaacaacctcctaaatattaggcctcgtttattttctttttcttaattccatttcaagaaatatatacttatattagcttgacgttattttggtacattttattagttcttcaaagatactagattaggaactaaaaaaaagtttaaaatgaagttagagttctacagcctctaaagcctcagtaggctactaccaatcagcccaaacaattttaatttgccaataacttttttattcgtggaatttcacgaaatatatacaaaaaatatataatttctttatattataccacgaaagcatacaccacatttcacacttgaatcccaaagagaaatcagacactactttctaatgaagaattagttatctagtaccatagaaatgtaattcacaaaccgcatttagtttatcctcatgaacttatgtttagtagtataaattcgcaaaaacatatattaaaattcattaattctacaacatctaaaattcattatgtatattagttcttagtattatataatagcatattgggctattacatttattttttactattttaaaacaatttaagaaaaatgaattaagtaagtaatttgtgtcatattttagcgtttttcttttatcggtggcgcgatttactcggtaaaagaagagctactacggttttagcggctaaaaatgttgagattggtggttccacgttgttctctctgactttgccgccaagtttcctatctcaactaattaaaaatgggccaggcccaatcgctcttctacgtgccacacacgctttgactttgttgccaaggtttttcttaaggaaataatgggtcgaaataaatgctaacaggcctaaagtaacaattaatgggcctttttgcttcgaagcccatttatctcaaagagagcgaaatcaaaatcttccttcgtcttcctccataagacacggatacagaggagggaaagaagaacccctaaaacccttgagcaaccactatgaatggataatagctgaagagcttttactcaaatcgatacttcgagatgcgatttttgcttcgtttaccacaaattcattttcggaaactctcgtgctcgatgtctgtactcatg

SEQ ID NO: 17614 - DNA, 3003 bp, Unknown
  misc_feature (1)..( 3003): 2750-1469P.txt file - cDNA_ID_1810274; gDNA_ID_1621189; Annot_ID_57465
tcgttttcaaaagtctgccttttgtctcatcagttatggagattctggatttcaaggaacaagatctgtagttctgttggattcgaaactcaatgaaaacaaaagcttcagtgagaaatcaaagtaaaatgcaacatatccaatggaaaaaactgtttatctatgataatttcaagatagggtcggtaataatatgatgttcttctggtagatcataaggcaaattgattccatggactttgaggtacttcaggcgaaagattgaagtgctctctcgaagttatcttcagctgatgctgctcgcttcacaaggacgtgttctggatgtgaaagtttcagctggctgcaaaaggattggaaatggaggaataagtcagcttactgatgcacttgttgttatgcagaaaatgcaaaaggtcatgaatatttatactttaggtagcgagaagatgatttcccgacgtgaagactgcatacaacgaggtttgcaagagtttctgggtctttagcatcctgcaatgagaataaacatctatgatttcaaacttgtccattttataataaacggaatagttgaaaagtttagatttggtgtaaggagttttcaagtatcctcatagatttaaatcgagtgagcatttccgatgacatgatattgagaatgggttgtgtcgatacagatttaaggaaagaaagagtaggttcatcactcaccttgttgagtgcttcaagtagtagagtctcagcttcttcaaaattacccatatgcatgcagcaaactgctttgccgttcaagatcaagcttgtcattgggtacttctcagagaaatcctggaagattagataagcttcctgtatcttggaaccaccctgagatcataaagaacaatttcatattaagaaacacattaacaaacttctctacactatatggaaaaaagaaatggatattcatatcatactactgccagattcaaccacgcgctcgcgagctgagtgagtgtgtggtcttcatcaatctgttgcatcactctcagttgtttctccgcaaaatctgatctgtgcatctttatgaatatctggacattcaaagcatgcctaaaatatgcagaaacaacaatcatttatcgagtaaacgaaaagagatcgctgtgacaagacaaaacaaatcgaaaagctcacagatccatggttcctccagaatgagtgtgcttcagagcctcattatagtcttcctcatgcatgaatatagtaccagcaatcaacctgataatagcattgtttcctacagttggatctgccaaccattccctcaagctcgaaatggttgattcctaaccaaaatcacagaaacaactacgtattcaacaatgcagatcactaaaataagatcaagatatattcaattccggatctctgaagctaaatcatcaaaagaatcctagaattctactaaagttatctgaaattccgctaagcaaacgttacagaagatgaattgaaacatctcaaaatctcttgaattaccttgttttcaggactcgatagatacatagcaaggagtttcactgcctgtagaggagtagcagcggcttcatcgatctcactgatgacaagctacgaagacgaaatttgaaaaacgtaaatcagcaaatgatcaaaacaaattgaaatccaaatcgaaaaacacgagacggaagcaaaacctggtaacttccgagagcgatgtaagcgcgatggacgagacagtctcgctcgacgatatcttcctgcgaaagattagggatctcgctgttgttgatcgcagcttgataagcacccaagtagaaatggtttctcaaattgaagagatgatctggtcctgccatggatgccattgtcttagcttcttcttcttcttcttcttctagatctcacagatccgtgtctaactccaaaataaagaaaactgaagtgtgaataatcaaaaccaaaaaaatatgacgccttaagatgtacataaagccccatacattttgaatgttacaattgacactcattgttatctattttaggcccaatgggcttttcgatgacccaattagttcgacactctgcttctctttacacgtctcctacatacggacggtgacaatcttgtcttaccaataaaacgcgtttttatccaattcgcgcgggagttgttctaatgacgttagcaaaccactccgttcaatcgtgctgtcacgttatgtcgacaaacaaatccaacaatttactgacacgtgtcatttagcttccccaataaatgacccgggaatagttaaaagccggtttaccagtattggttttaatcagccaccgagtcatcgtgactgtaacttaaacggcgtttactgcttcaagataaaatacgctttgcccaaaaaacgttattagttcgtaatccgtttttgctctcccttttgagatcttttaattaaaaaaattccgttttaagtgaatgcgtgtaagcaacagttcgaattcgaagcgagagctaaaatcaaaatctctctgatttgttgttttgttgatgtaagtttctttgatcctttcgcgaaatttgtcatcttccccgatcgagttttactttttctttgtgaatagtttgacttttcgtttttcttcttcttcaatctcgcatggtgtttgtgcgtatcttgtttggaattggagtttgtaactatttgattataagcaagttttgattcgaatgcatgcgtgcaatccacaatccagaactagatgtatatgtatctctatgtcaagagtgattaaaatcgattcgtgtggaattaacttggaagtgaaagttttaatattgtttccggaatttacggtgagattttaggtgttgaccagcgttgttagacaagaatttgtcatcaatttgatttagttttgaagcatttgggttttggaattttgttttgattttctgcaggttttatgaagtgatttgcattagattggattgaaatg

SEQ ID NO: 17615 - DNA, 3000 bp, Unknown; identical to SEQ ID NO: 8063
  misc_feature (1)..( 3000): 2750-1469P.txt file - cDNA_ID_1810286; gDNA_ID_1621189; Annot_ID_57461

SEQ ID NO: 17616 - DNA, 3000 bp, Unknown; identical to SEQ ID NO: 8063
  misc_feature (1)..( 3000): 2750-1469P.txt file - cDNA_ID_1810286; gDNA_ID_1621189; Annot_ID_174525

SEQ ID NO: 17617 - DNA, 3000 bp, Unknown
  misc_feature (1)..( 3000): 2750-1469P.txt file - cDNA_ID_1810290; gDNA_ID_1621189; Annot_ID_57460
tcttcctatggtctacatgcaggctttactccggtattacaattcttctctgttgagggaaaatggttcagggaagattgttgggtctgcgtctgttgctaaaattgttggtggcatgaggcctacctatggcattacagctcccaaggtcatgtatttctctgctaggggacctgacccagaagatgattctttcgttgatgctgatataatgaaacccaacttagtagctcccggaaacgcgatatggggagcttggagtcctcttggcattggtacaaatgattttcaaggtacacataccctcatttctctttatcagattactcattatgtgtttctagtagtctttttgagatcttgaattggcgatatttaggtgaacgttttgcgatggaatcggggacaagcatgtctgctccacatgtaaccgggattgcggcgctcatcaagcagaagttcccacatttcactcctgcagccattgcatccgcactttcaacaacggcttctctatcagacagaaagggtgagcatataatggcgcaacgcactgtcttaaaccccgacattagtcagtcccctgcaacaccgtttgatatgggtagcggatttgttaatgcaactgcagctcttgaccctggtttgatttttgacataggtaaatactttcttgaacccccaatgttcatattattttaccttgagcatatgaaaaaggagatcaatcactgatatgaaatgtggctgcaaatgtaggttacaatgaatacatgaagtttctctgtggtatcaacggatcatctccagtcgttctcaactacaccggtgaaagctgctcgtcatacaactcttcccttgcagcctctgacttgaacctaccctcagtcacaatagctaaactcgttgggactcgagccgtcctaagatgggtgactaatatcgcaaccacggctacaaacgaaacatatatagtcgggtggatggcaccggactcagtctcggttaaggtctcacctgccaagtttacaataggaaacgggcagacacgggtcttgagccttgtctttcgagcgatgaagaatgtttcgatggctagttttgggagaattggactgtttggagatagaggtcacgttgttaacattccagtggcagtcatctacaagattgctgtctgaaaaaataggtttgttacatgcagaggtttttgtgtgatgatgaaacaaacttaagggagttgatcaaattctttttctttttttggggttagttatatgtttttgtgcattgcttaaaaagctttagagagatttgtagtttgtaaatgcttttggaatgatgaagttgattgaatattaatctaatccaatcttttggatgtttgagtattttaaagtggtctttttcttgaatcttgagctttgtttgccaatgtggggtgctgagagtgacaaacagtagttaaatacccaaacacaacgaaacaaaaaataaggtccaaacaaacaaagaataggggtattttcgtcattagcttcataaagaagggttaaattgttaattttgagggtttcgcgtaggcttgggcattcggttaactcgggttaatcggttcggtttaatcggtttttcggttttttcggttctttaaaattctgccgaattgaaccgaataaagattcggttcgggtcggttcggttcccaatttgttcggttcggttataggctttaaaatcaactccgaattaaaccgatttttttttaaattcggttaattcaaaccgagtaatcccaaaaacaagatattgggtcaaaaaaattgtagaatgggccaagataaacaaaaaattacagttacaaattaataaaggggccaaaacgaaaataaacttcagcccaaaataaataaatttaagcccattaacaattagggttcatggtatcttgccgccgctaccctcttctctccctccagcggatctgcgaaggagacggtgacgacaatggcgagggatgagaatatctccgtaacaaaatctgcccctaacgtgctaccatagtcaacaccacatgcaatggagagaattgacttaaaatagccatggatgaggatgattaggctactacgttttaattctctctagaataacactggcatggatcgatgtcgaggcggagtaagaagaagagaacaaaagaaaagggatggagaaggaagagttatgaaaataacgaaggtgcaagaagaaggttgaaggagaaaagaagaaacgagatagagaacaagaagctatgaagattagatctaggttttttttatctttttataggtagtatctattaaccgagaaaaccgatcggttatgtctgccgaaccgaaccgaaccgagaaccgaactccaattataattttgccgatcggtttagccttctcttcatagtcggtaatcggaaccgaaaaaatcggtttgttcggttcggtttgttcggtttaatccgaaatcccaggcctagtttcgcggatccatcgaacttcttctctcttcttcttctgactccttagccgacgacacagagaagaagaagacgaagacgttggagagtcacatcaaagcttaaacctttcgtgatttattctcctttttcccgggttcggattaatttttcaaattccgacgaaattcgctatcttctggtgcttgagctgcttagctaagtgaagcagagagagtacaattgtttatcttttgtgagttatttaacctttgtttatgatggtttctggttttgatttcaatagtaggcgtcgttacttggtttagaagcaaattgttagggtggtttcttaaagggggctttatacataatctactgtttactttcgtgctccttgcattttgatggtttgttttgttctttagtaggttaaattaaggagattcttggcaaaattctgaagtagcagcagtagctgtgttttgtgttcatagagaatg

SEQ ID NO: 17618 - DNA, 3000 bp, Unknown; identical to SEQ ID NO: 8083
  misc_feature (1)..( 3000): 2750-1469P.txt file - cDNA_ID_1810316; gDNA_ID_1621191; Annot_ID_57496

SEQ ID NO: 17619 - DNA, 3000 bp, Unknown; identical to SEQ ID NO: 8081
  misc_feature (1)..( 3000): 2750-1469P.txt file - cDNA_ID_1810344; gDNA_ID_1621191; Annot_ID_57485

SEQ ID NO: 17620 - DNA, 3003 bp, Unknown
  misc_feature (1)..( 3003): 2750-1469P.txt file - cDNA_ID_1810360; gDNA_ID_1621192; Annot_ID_57500
agctcggtgagctgatcgtgtactgacccagctgggtggtccggtcagctgacactcgagctggtggactgtggtagctcacgggtgaagaggtgtctcggccaaaaggtgtaaggtcgagcgggtaccaacgaacggttgcatcgcctaatagatgcaaggaacggatgtgaccttttggaaggatgcaaggaacggatgtgacctttcggaagggtgcaaggaacggatgtgatgcttcgggaagcatccattcgccccctatataaaggaggacgcccaaggcctttggaataatctcacatcatctcacaatctcacaatctcacatcatctcacaacatccaaaacaccataaaacgttcttaaaggagtcccaacacatcctagagttgttggtcggaaaggggatgcggctcggcgagtataactcgaccgaactgatgcacatgctacctcccgatccaacggttcgatggagtgtagaggatggagagggtagaccgttcgtcttagagacgaatcggatctagtagaccgatcgttggatcggatcggccagaccgatcgtaagacggatcggccagaccgatcgtaagacggatcggatcggccagacggatcggacagaccgatcgtcggacgggtcggatgggacaggccgatcgtctgacggaacgggtcggacagaccgatcgtcggatgggatggatcgagaaaagtgttcgaggaagcacaaggataagtgcatccgaacacacccaagggtcgcccatggatgcaatcttaccggtaaagggagaaagcaccaagaatgggtaaggaacgtgattcaccatataagatcaacatcgcggccgccttcatgtatctatctcctcagccatggtgaaaccgatcagagatcggtaagaccaaagggtgactcgacggataaccaacgggaaagtccacggtgggaaccgatggacaaaacagatgttggacccgcgagaaaacctaaggccgacggaagaaagatttcatgggctagcctacgatgatctagtggatgaatccacggacccttgggtgtgataaggatatagttcggatcgtatggatggatcaataagccaaaagctttatcgaccaccatagaccggacggataaacggttagtaaaccgtgggcggtcgtagtaaatgacaggatcggaaacatggatggttcgataagccaagggctcaatcgtccaccatggaaccgaaggggagtacgtttggaggacggatggaccaataagccaagagcttgattcggtcatcgtgaaccaagggaatcgtacgatccccaatctctatcgttgtacttagaccagtggggttggttggttgtatggctaagtaatgatagggattggttcatcaattcacgaccgatgacgagtcgttgaatgaatggagtaaggcgacaaacgggctaaggaatcaaatccgcatattggccaaggtatgtaacgatctagcttattagttaagatagacgtttggtaattgaccgtgaaagtaagataaaggaatatgcgattgtttggcttagaatggttagcgaacatatgcatgtcttgaccgagtaaaggatcgatcatagaattaaacgaaggttagaaagacttccgctgtgtaataagagagcaattatagaatttagcctcgtaaaggcaattctatgttgaatcgcgaaaaattaagaggttcggccggggagaggcgcgaacttgagtacacagtcgccggacaccgagacgtccgggactgggtctcacagaaatcatgcgggctaagctaggatcgtaaagaaatcagctgggtcagctcgcccaaagctcaagctcagctggaaggagtgacggttactcaggttaagtgacagtccagctcgggcagctggacgagtgacggttgagcttgaggtagctggacgagtgacggttgagctcgaggtagctggacgagtgacagactagatgggcggttatgggcgaagagatacaactcttcggaaaggtgcaactcttcggaagggcgcaactcttcggaaaggtgcaaggaacggatgtgttgattcgggaagcatccattcgccccctatataaggaagggcgcccaggaccattccactcaccacaacacaccgaaaacacaagaaactcaccattaaaactctctccctcttgggagaataaatagtcttaggattcggtagtcgggctgtggccggcaataaagaaggagggtcggatcgacctaacctcgagaaggaaggtaagggatcctagactttgagtctaagggttctaggatgtgagttagtagtcggatccttgaaaggatcaactagagggctgggtagtatccgggtcatgtgcatcctacacaagactcggtccgggtagggatcggctgaggcggggacgcggctcggcggaggaccggcgggtcttaactgatctgccgagaatcggccggactgatgtgcgatcttcccctctctgaattctctccacggatccgagtagtgtatggcatatagagcattgcatggacttgcatatgattaagtaaatgagattacttatggctctatgactttcaggaacgaatggtgatcgtgggaaggacttggcttaggcgcgagagactcaagaccgggatgatgggtggtgatagttcggatagtctagggatcgattatatgacttgtaatagcttatatgcaaactcataggttgtatcgaatcctttgcttaatcaataaagtatccgattgtttgtttactctattcgtctcatatattgaatcacggaatcatatggaacggattagactaggaaagaacctcataaacggttagggccgagtcacttagtggcttgggtcgagagaactcgtccggaatttaggcagtccggatcggggcctttcaaaaaccaaggtcctgctgctcccgatgctgaaatg

SEQ ID NO: 17621 - DNA, 3003 bp, Unknown
  misc_feature (1)..( 3003): 2750-1469P.txt file - cDNA_ID_1810372; gDNA_ID_1621193; Annot_ID_57524
taccatcaacatcaacatcatcaaacagcctgtctttgatcttatcctcagcacttctcctagttccacctctactatcaaactcatcatcggatgattctccctggccatttccctgttccctttgagctttcttcaaccgcttatactgcctctgtcatggttcaagaaaaaagtcaaatgtattagtactgcacatatatttttagtgtatctacaaaatcctgatgtattgttatatacacaaatatgactaacctttttgaatttgacgttgttatcttgtagaagcaaataatcatcttcatcaagaccttcgtccctattaaaattatcataaatggaaggttagtcagaaagagaacagacctgctatagttcgtctaatggtaacttacatactcatcacaaacaatgtatgaaaatcacaaataaagactgctgagaattaagggaacatttcttcaaaagtatcatgcatgtcaacactaacatttagtttttcatatgttagaaaaggataaaatctaagagaatgagtaaggatataaaatattcactttttctttcgtttcttcttctttttctgcctctcctcatcgctatctttcctttcttcgtcttcttcctcttcttcctcttcgtcttcatcattcactatgaacccatcattctcatactcattcccaactacaaaacagatatacggatcccacatcatggaacaaaaatagcctgaatctaagttaaaaagcctagaaagaaaaagaaaaaaaaatactcaaacccaaggtgagagaaatgtgtgcagctcaaaacttgcagaaaccatgaagtctaaaaaggaacaaatcaagcaaccgtatgaaacagagaatatagaaacaagaagtggtagaaggagagactttgcagcagataagtaaacatctaagaaacaagatgcattcactttttttttttttttggttgccaaatccagacactgcatcttctaatggagcaaatgcagcagaatttctccaaatgaatcgattttaagacaaagaactgcatgcgcttcagtactaaaccaaaccataccactaatttccttcgatgcaatcagactctacagcttccagatttagggtggtaagcaaaaagaaacgaaagacgacacatttctcactgggagaagtcaaaatcaaggaaaaaacttataccgtcatcatcatcttcttcatcatcgttttcatcatgctcagctggatctccatgaactggctctccgtcgtcatcctcaagctcatgatcctctacgcaaaagagaaaaggattcaattttttcatacaaatcagaagaaataaacaaaaccctagtattattacggcgtttcacacagaaaaaaattagggtttgcgacgaagcgattaaggtaccttcatcgtcagagattgcgttcctcgccatgtttatctcaacaaattagaagtacgataacgcagaaattagccctgcaaactgcaaaaaaaaacgaagagattgtgattatgatttctgattttgcgaagagaaagggggaagaaggttctcgcgattactagggttcttcgaaaagagaacccagaaggagctagagaagagaaatgggtttggtaaaggaagaagctttaccagtgtgaatttttcataagcgaaaggcgacgaagaactgataaacgaagaagaagacggagacgatgaaattacaagtttatactgacagatttgcctcaattttttctctgcgttttagaaatattttttttttaataatgtttttaaaaattattatactttttgaagaaatgtaaagaaaaaaaagtcgagactaaaaacaaaacaaagtttattcaacttatcttataattagagtggagaatatttaattcgataattcgaaatataagaaaatagacatacattaataattaataaaaaaacgttacatcggctaaaatgtttaaacaattatttaaatttatatgataaataaaattaaaataaatctaaatcggattcaaatttaaaagtttgtctatagattaatttaatttttagttaaacaatttaattttatcaaaaatataaaattttaaactgtgaaaaagttttaaatcttataattgatatatttaaaattaaataacaagttgataataatataaacatttggacatatataaaaataaatataacactagacaaattatattgtaggacaaattttacacatgaggccctaaaaactttttatattaggtggcctaaaacaaatgtttcggcttttttatgaacgggccgggcttggattcggccatattttgagttcatgccttttaatatggcaagaaaaaggttagaaactagactaattgtagattgtaagtttgtaaccgtaatgagatactgcaaatgggtaaaaatcgtattattccataaaccacaaatggagaagtcaaagtttggcaaatatcacaacaaaaaggttgatatatcacatgcatattatgtagctacaccgacatatcaaagttctcctatcaaattttaaaaaacataaatcaccaaccctactcacacccaccaatgcagcccatcattcttcccaaatctataaacacaacacaataatacaacagtgacaattttagcttttaaagaataacgttttcatgtgactggataaaaacgacgtctacgtagcacgaaactgctttgtttgttcttgtaacgatccgtaccatatctttttttattaaaaagtcacatttattatgggatcaataatttactctccatggattatttcatactataatgtacacgtacattatcataaagccaagataaaattaaaaacgccttttactacgtgttagtctatataatatagattaagtctgaaacccaaatcacaaacttcactcaaaacctaattaacttagagagaaagagagagagagaagggttgcaaaatg

SEQ ID NO: 17622 - DNA, 3000 bp, Unknown; identical to SEQ ID NO: 8106
  misc_feature (1)..( 3000): 2750-1469P.txt file - cDNA_ID_1810376; gDNA_ID_1621193; Annot_ID_57523

SEQ ID NO: 17623 - DNA, 3000 bp, Unknown; identical to SEQ ID NO: 8098
  misc_feature (1)..( 3000): 2750-1469P.txt file - cDNA_ID_1810380; gDNA_ID_1621193; Annot_ID_57522

SEQ ID NO: 17624 - DNA, 3003 bp, Unknown
  misc_feature (1)..( 3003): 2750-1469P.txt file - cDNA_ID_1810384; gDNA_ID_1621193; Annot_ID_57520
ttttggccacctaaagtttcaagcaaaacaacaaaaatgatcttttagaataattattataataataacgacgattaatgaactctatatatctcacaaaagaaggacatgtttgcaatcccaaccaagaagataaacaccttagcaaattcaaagaagaatatatcaaacatcttttgtttctaagaaataagctctctgattatgtcgggagcatcttctgtttcttctatttgttcctctaatgtatcattgatccctacgggacctcaagtgttcatcaatttccgggggaaagatttacgaaaaggcttcatgagctttcttaagcctgctttgaaaaaagaaaagatcaacgtgtttattgacgaacaagaggagaggggcaaatacctaatcagtctttttgatacgataggtgagtcgaaaatcgctttggttatcttttctgaaggatactgcgagtcacattggtgtatggacgagctggtgaaaatcaaggaatacatggatcaaaacagactcataatcattccaatattctacaggcttgatctcgatgtggtaaaagatcttacaggaaaatttggcgataatttttgggatttggtagataaatatcaacctgaaccaaaaaagctccataaatggacggaagctttgttctctgtttgcgaattgttttccttgatcttaccaaaacacaggtttttatttttccacttttatatgttcttattacttgataaattaagtgttatctgtttaactgtaacaatttctgttcactcattgacattttactctcttttctttgtatcatagtgacatttcggatagagattttgtaaagtcaatcgtcaaggctgttaaaaaagtgcagaagaatttcttccaacgaagaaatggagaaatagaatatcaagatttctcagtccctgcatgtaaactcactatcactatgcacgagtcaccaaagtaagtagtgcctctcttacgatttcatttaggaaaattaatgatattctgatgaaacatacattgcttcagtggtatgtcatgtgaaagtattgatcgaatagctaagttaaatcattttagctactagtatttccacaaagtaataaataaaaaaatgctaaaagcttgtgtagtagattgttaagttttacttttattatatttttagtacatctctatcatattttaacttgtataaaatgtctactatattttccttcatcatttgctttctaatttattattggaaaaagttcaacattttcttcttaaggatagattagaaactgtgacattaatttgcatgaaaagattagatcccctaggtctcgtttcctgataactttttttttttcatttcgatgtttctatttatgtacagtgaggaagccgttcaagttacggtgctaaatgaattttaccagatgaagaatcagtcaccagtgccctcatacgaggtcctaatttacatttgctgtcttgttagttgattttctttatatatgtttattggtatcatttcatgaactgacatggagatttatatatcgacagttcaaattttgggtcgaccttacgagaccaaagggtaacgttttcatgattgacgcaagagatctttccattgcatggtcagaggactccaaccattggacctggctccctctcccaaaccaaaattcaaagtaaaacttctcttaaaagtatttcttatataaattgaaagaaatatcttaaatcacgaaaatatataccttataacgataatatttctagatttattgtctaatactaagcacaatactttccagtgaatcagtgatggaaattgcatttttgaaaagtgctagctggctagacgtagctggaaagtttgacactcgatatttgaccccgaggacaaggtacgaggtggtgttcgtagtgaagttagaatacacattcgaatgggagacactagtgaagctaaagctagacttgccgaatacttgggagaaaccgcaagaacagagtgtggacatgtttgactacataagtgaccaatggctcgatattccagttggagagttcaccacatcgaagaaaaacgtcggggaaatctcttttgcaatgtacgaacacgagtgccaactgtggaagtcaggcctcttcgtcaaaggtgttacaattcgtcccaaatactaagtcattttataagcatgtatgttgttggtctgagatatatatagtggaaatgctcgctttgaaccataatcttagtttcacctcccaaatgtttgttacaatgttacttgtgtagatagtttgaccggtttcaaaacttatactctatttactctcttctgcattggttatcacatccataaccaccaaactattgaattctataactgaccaaacccaaaccgaatttttagaatatccgaacagttcccgactctctatcctattagacccgaaaccgaaaaaaaagaactgattgggacgagtatccgaatgcccaaacctaccaaagttgtaggcctagagataatcctatcgaaaaatgaccaacaacattttgcaaaatttgatattcaaccgattttaattaaagtccacaatagtcatccataaaaaatattgtttacaatgataaggtgcggttcgatactaactctattttggtattcggatgattgatcaacaacattttgcaaacattgaaaagaaaacgtaaatttcgtttcctaaaaaaaaaaaaaattcgtttcctcacaatataataaataatttacaaagaaaaaaacgaaaaatggcaatgtgactcactcaatcggtgactcgctatagtctgtgaagaaaggccaatttcgccataaagttcacacctttgatctcctttgtttctgggtttctcctaaatcatccaaattggtatcgaatttgcccttctccgattcaatttcttcacgatctcaaaacccagaagaaagaatcatg

SEQ ID NO: 17625 - DNA, 3003 bp, Unknown
  misc_feature (1)..( 3003): 2750-1469P.txt file - cDNA_ID_1810388; gDNA_ID_1621193; Annot_ID_57519
ctcggtttcaactgaaatatggtttcggagaacctgtgataactttgccaaaaccattcactaaaccataaccaggttaatacttatctgagtcagaacaagaattccgaaggtttgaagagctgaccaaagaacaaaacggtcccggttttgtcttctcggataaggaaaataaatggatgatcagccacaaaatctatcttcttaggaggtggccccatatcaagagcacaaccgtcatcttctacatcagcagttgcagccgcagcttcagcaccttcttcatcgatctcgacacaagctttatggtacattgacactgaatgcagtactcccacttgattcaaaacgcttgtagcagaaaaaccgaattcgatcttaaactttggaattctaaattcctcaagttcaactttgtatctcggaatgtgactatccaagaatccaggtgtagatgctattttcttcaagagataatccaatccatctttcttgtcagggagatagaaatacattgagaatttgcggttggtatcatcacggcctcgtcggtaaggaccttgaaaccgttataagctcttactttttgtgtctcgtagctggtcatgaatggcacagagactgtagtgccattgaccatgtggaagtctctgtcttttgtatagtacttttcaaatggtctcttccaagctcccttgaaatacaatgcgtttgcgtaaatcttgttggttcggcttgtcacagattcacgaggaagaagatctttgatgagattattggtgtgatcttcaacccatgaattcacctccttacgcacttcttcagccttcaaacaaaaaaaacacatattggatgatttttgaaaacagtctcctaattcgaattatgatttgggaatcaacatacattacgaactattaggtttccaatttgactggttgagtatgttctttaagtcaaacagctattacacacttcatctagaaacaccaaataacgtttctgcaaaaccctaattatatttcttcgaaaccctagtttcttttttgctgttaaagtggaaaattacctttgatcggaaatctacgggaacgtaaacagccttgaagaagttctcgaagagagccttgtatttgggatcaatcggtagtgatttctcaatccagaggccattcaccgccctcatctttgggccgccactagcgctgctgtcggcgtagacgatggatgatagttctcggaagacggatttgagctcatcgattgaagaagatctgaggaaggagaggatttcaccggcgactaagccacctccggaaccagcggcgtgcatggtgatcgcagagtttattgacgccggcgagaagatgacgttagattccgactcagaagataagacgtgcctcccaaggatcatcgcgacgtcgttttgcttcttcatagcctttttcacattcatctttggtctctccaactagatagagaacttgcaaaagggtggaggattatgcatggtctatggagggacagttatatatagtgaacaaatccattaagaaatttttaattattattagggtttcttggaaaactagtcactttgcaatccaggtgtataaatcaaacacttaaaaatgactactttgcaaattgtaaatagtaatatgactactttcccaaatatgtttgaaaaaattaaaatgattacttttcacttatctcaaattatttttacaatggaatataaatagatttttctatactaaacctctgtaaattaatactcgataagttccacttcaaaaaacgaaccaaaggtcatatttcatccatgcatgttcgaacatgcaaagagaacttactaataatgtttggtcccaaattcaagtattctctggttctctttgcatggatgaaagaagatggccatatttttataggaatgttcagaaggagaattcacaatgtggagaagatagtgctactggtttatattgaagtcaggttaaggtttatgatagtttcaaggacattgatgcggactaattggcatcagatagtcgtgcttccaagactaatatcaggcgtaatgggttttactaatacgattatgaaacagcctcaagaaaaaaggcaaaaaaatcgtattggagcaaaaaagtcgaagaaatatcacgaatatgtgttttcgttagcgaataaggcgttttcgtccaaaacgcatcgtgaatcttatttttcgtatttttttcagaaaatggctcacatatctgcttgtgtaataattttggttctgtagtcttgtataactttaacactttaatttcgatataatggaatgattttaaaaggaaaaaaaaataataaaaaagaagtaaataaatcgatttttattaaattagaaaacaatttaattttggattgaaaaaaattaacgtactagttcaaaacgccaagttaatatctcggatagtcctactttctcatgattcagttctttatagaccatctaaatcaatccgtctatggatctaaaatcgttcttgaaactaacatgatgaaacggtccctagataggttggccgaggcaaagaagaagaagtcagctcttaactctaaaaaccaaaaggaaaaaaagaagtcagaccttactcgttttgtaaagatttagtcagcgaagaagtcgactagtgttcgagtggggaaacacgttgtcaactcttaagtctaaatctttgaccccaaaaaagagagcaagttgtccactataattctgtcttcttatgcaactttcatttttggccacctaaagtttcaagcaaaacaacaaaaatgatcttttagaataattattataataataacgacgattaatgaactctatatatctcacaaaagaaggacatgtttgcaatcccaaccaagaagataaacaccttagcaaattcaaagaagaatatatcaaacatcttttgtttctaagaaataagctctctgattatg

SEQ ID NO: 17626 - DNA, 3000 bp, Unknown; identical to SEQ ID NO: 8095
  misc_feature (1)..( 3000): 2750-1469P.txt file - cDNA_ID_1810408; gDNA_ID_1621193; Annot_ID_57514

SEQ ID NO: 17627 - DNA, 3003 bp, Unknown
  misc_feature (1)..( 3003): 2750-1469P.txt file - cDNA_ID_1810432; gDNA_ID_1621193; Annot_ID_57506
gtatttgtagaatctgctgaaaggagatgacttttatcggattcggcttccatctaatgtggttagtccaccagggagagagtttgtgattgcatcagtgagagctgtaagtctatgtctacctttttggttgatttctttgtgattgttctttgattgtttgctagtgctttcccatgtctggaggtgtaaattacaggctttgttttaagtctatataaaagactctttgtaaccatggtggttttgttttagtttcactctttgaactcttagtaggctacacctttctagtaataatctaattctactctttcgagatatgagagcttgtttatataattggatcggtatgaaatggttagtcgttttgtaatacacttacagatttgtttctaggctagactgataaagacaacactcgtttagacacccttcttgctttttcccacttttcagtcagtttatgtgtctgttatagaacaatatacttgtttgattgcagagatgtctaccacgggatggcttggatgagcatttcattatacacatggtaatgcccttttttggtataaacttttgttgagttcaaagtttagtttgcgccttagcattttaactactacttgagtgtattacagagaaagttgggactatgaatatagttcaaaactgtgttcggcacagtttgtttacttgctaattgctatactgtctccgtttgcaggaaggtgctaacatcttggcagttagttatggttctcctggggcgtgtcaatatcctcgccaattgaaacttgtaagtgaactcgattatcccagcttctctttttatttacactctaactgagataaattggacatggactgatcctttcttgccttcggtctagaatcagataatactgatacaattatgaatgcggatgatgtaattgagtcattatctttccattcaccaatattttctgtgatttaatatattttgagtcatattctagagtacagtatcgcaccctctttctctactgtgcctaggtattttcagcataagtggactatctataagtgttctgtaatatgttgatagatccgcagaaacttttgtgaggaaatagtaataccgtcagaagattagatatgtgagagtatggtcttaggatcactgtaagcattccataatgttgtgattttgcggtgtggtgtgaagtaattagtgttgggtgactgtgccatgttctgtgagtttttttgtgctggtctctctaagtgtcactcatagtgatattttctgatagaatccgaccttgggttctatcacatctcttgtctgaacactgaaaccgtatattcatgaaggaaaaaggttacattatcgttagagcttctgactttgattatgtatgcgttctaatctacgtttttcgttttgcttactgtagccagcaaaatggtcgtttaactctcacacaattctgaaaagcagtgagcaggcgccaaggtagaataattattgtgttttttttttgcatcaaaatggcttaactttgcatgatcctggatgtctatattcgacttgtgttctatagatataaatatatttgtcagttcatcaagttatatcaatcaagaaataccattgcttctccaccctttagcccaataactaatatttttttatcttatccttacctgactgtttcacagaactccaatattcactgaggagattctaggcagtgagaatgtagagggagaagttgaaccaccaccagagagatcattttgggcgaaatatgtgagtaatacgataaagatcttttgatgattccttctttattttaggtcttgatgtaactttcatatgatacgcagtggatgtatttgataccgctgggactcgtagtgatgaatgccgtgacacaagcatcaaacatggctgaagaacctgcgggtggacaggcaggaggtgcacaagtgcaaccagctgccaggagaagatgattccacttttacttctcccaaagcaatgaaaggtagaccacgccgcaattactatgcacaaatttctcttttacctagcagtctttaaatcttatgatcctaggagaatacatttatatatttgtttggctatcttcgcagctgtggatttatattatttggttgtaacttataagtcacgtggaattaaatgaattcggagtttgcatggaaatatcaacaaggtttaggaagctgtctttgaagtgcgttataagatcaaatctgatttttagcttatgttgttgtagctgcagctggttagagatgatgattcaacagatcttcatgtaaaccatcttgccatcatttggttttatgtaacctttaattttaatcctcgatcggtgtgtttttgtactcaccaatcgggaaatcaaaaatcttgtcttcatgacatatcaagaacaaagacatttagcagcttccatatcttgttttgatcgcatttcacctgtccaaccacatgtttgtcaatttgtatttgttagtaaatttaagggaagtcaagtcgtttacaggccatgagagaaatcatttataaaataattataaactgaaaaaataaaatatataaagggtttattttctcaaaacccagtttttagggatgttattatggaaatgcgggcctaaacgggcctttagcaattcaaatattagcccatagaatgtacaacttttattttttatttttcttaatcataaacgacgcagttcttgtgtcgatcttcgctcatctcttctaccacgagcagactgtagccacggcgaccaaaaggggaacaaggatacgattacgacggaatactccgccggaaagttatttctcgtccttaacggtgccggagtagtgtagaacaggtcaatagttaatttccacgttttagtttggtgatttgagggattttaggctcttgattggttttggaaaatctgattcagggattgaacaatatg

SEQ ID NO: 17628 - DNA, 1398 bp, Unknown; identical to SEQ ID NO: 8135
  misc_feature (1)..( 1398): 2750-1469P.txt file - cDNA_ID_1810443; gDNA_ID_1621194; Annot_ID_57545

SEQ ID NO: 17629 - DNA, 1404 bp, Unknown; identical to SEQ ID NO: 8115
  misc_feature (1)..( 1404): 2750-1469P.txt file - cDNA_ID_1810443; gDNA_ID_1621194; Annot_ID_174681

SEQ ID NO: 17630 - DNA, 3000 bp, Unknown; identical to SEQ ID NO: 8116
  misc_feature (1)..( 3000): 2750-1469P.txt file - cDNA_ID_1810451; gDNA_ID_1621194; Annot_ID_57541

SEQ ID NO: 17631 - DNA, 3000 bp, Unknown; identical to SEQ ID NO: 8116
  misc_feature (1)..( 3000): 2750-1469P.txt file - cDNA_ID_1810451; gDNA_ID_1621194; Annot_ID_174677

SEQ ID NO: 17632 - DNA, 3003 bp, Unknown
  misc_feature (1)..( 3003): 2750-1469P.txt file - cDNA_ID_1810455; gDNA_ID_1621194; Annot_ID_57540
tgtgacaatgttttggaggattatgacttattaacagtcgatcgatttatcgaatttagtgttatatattaaaatattaattattcaaaaaaattggatcagttatgtttcaaaatagcgttagattacatggctctatgccaaagttgggattttatttttgtttgtagtttttttaagtggggaaaagataagaaggttagaaggaatatattcatttcggagaagaaatcccaaagcaccatcacaaaaagatgcttgaagttcaagcaactgtggcctctatttttttataagccgacttactttattgtcactaatttcatttctttctttctttaagctcttagtttgcttcaacaacaattagctaaaagttaaacattagctttacttggtttaactaaaaacaaaaactttggtttctttttttcaaagcaaaatacaatttagcttaaaatcattattgaaaacattaataaagaaagatgagaacttaaatgattttagggcggatgatttgctaatgctaatatgcatcatatcactatgaatcaattttgtagataatagtgatgatgattgtgaaaacacaaatatcgtgataatataagtaggaataatatatgtgtgtatctatactcaaaaagtggtaagaaaaaataaaaagtctagtaaactatgtaaatgtggctggccaagtttatacggttggcatctatcgcgggagttgtattttcattttttaatattgttggcgcaataagaatctatctttattcatcaaagaggagaagaatcgattccaattctcatgcaatttgaactttgatttaatatttaaattcaaaagttataaccattttcttattttatcttggtcagaattgtgtgcggtaattgattaatttaatttattgtacaaataattcgtttcacagccaagatttttaacatttctggcaaagaaaaacactgtttttttatttattccaagaaattaatatctgaaaaatgtgttaccatgtatagctgcacaatcgtcagtcctacaaaagccaaaaaaggttatagccccagcaagctttaaccaataaattaaaatggagaaaagaagaaaaacatatggtaaaaataaaaagaataaaagagctttaataagtagaagaagaggtccccaacgttaactctatctttacacattgatgcataattctccacatattaatagtccgtgtttataatatgtataactttaaaaaattgttccatattcttatgttaatttttttgttttaattcaatattcattgactggtattggtctacattttaacatgtacatgctttcccttaattaatacttaatatataacctctaataaatttctgattcaattcaaattttattcttagataatattctctcttttttgtgtgtgcatatcagcctcagccatattcattgacttattcttgttctatgtaaatatgctatgggacctcccactcatatatatttaggttgaccatttattttacatgcatgcaattgaatttaggggttaatctaaatcgttgcgtatatgaattatatatgattttagtttgtatattgaaaaatgcatcgtcgttctatacataagctagtttagtagctaatagggcaatattaacaaagttgattttctggtttgtagtgtccatacaagtaatttagttaattatctcgtttgttcacctttttgtttcttttttcttttgctagctagttaattgcggatgtaaactacatcttttactaatcgatgaatggaaaacgtttttgtcgtagacaaatattccaccgtacctaacggttttggattgcatgtatataataaatttgttccaaaaatatacggtctattaatttataacgaagctcatcattgcttagaattgtatattcacctcataattagccaaaaaggtttaccctaccataaatgataaaatccctagccttgtggaatttgtttcgttaagatatttgtatgtatgcctccaattacgatatatgacgatgtagacaaactataagtctagtatacgactctcctcgtgcggtcttaattgaatagaatacatagaactttaatatattcactttaaaagtttatattttcctataaagaaaatatttacaaatctttgattactatttactccaaatcaagcatgattaagaaaatagtatatagaacaattgtatgataaatttggatttaaaaattacttctaaattataaggtagtaaagaaaaagaaaccaaaaatataagaataatagatgtgcaatatctttgattcaggtgaattatattttaacttagatatctcaagtcattttaatgtttatatcaggaaataaagaaataaaaaccatcatgcaacaaatcatgcatatatattagatacatccgtaaccgctttttttcgtcttttttttttgtttttttcgtcgtcacatccataaccgttttgatatgagatctccgatgttcaaaattcaatttcccccaaagatatcaatttaatatctaatatatactattattttaagtttgcgcagtaatttaataatctgagacagacatgatttacttaatgtatacgtatagtggcttttacacacattttatattgaaagaaattcaaaggtattcaagctaagaggataaaaaacacaaatgaaaaagatagcgacagtatcttttcacaaaggaacgtctgtgtactagtctgaaactttagttctcttccttactaacgataaaacatatttaactaaaccataatttatttacaaacaaaacaaaaaagacgagagagagaaaaaaaagccgtcatctgatctcttcaaaaacgcatcgtattctctcacatttttgcatcacattcgtttcttgaatcccctctttcagagagagaaagagagtcagagagagagagagagagaatg

SEQ ID NO: 17633 - DNA, 3003 bp, Unknown; identical to SEQ ID NO: 17632
  misc_feature (1)..( 3003): 2750-1469P.txt file - cDNA_ID_1810455; gDNA_ID_1621194; Annot_ID_174676

SEQ ID NO: 17634 - DNA, 3003 bp, Unknown
  misc_feature (1)..( 3003): 2750-1469P.txt file - cDNA_ID_1810459; gDNA_ID_1621194; Annot_ID_57539
tattactgtaaacctccagcacttctgttccacgaaaggtacgaggggtctccgagttgcctgaaaccattaatacagaagatcatttcactgtacacgttccaaaatctgaaaagtgtaataatgtcttaacaaaatgaagcatgcatgaccctgagagtgacgtaccttggcttaactagatacaatacggcaaatgtaacagccaagaacaagcaaatactgcctacagtcagataagcaatcccgaggaaatcattccttccgccgagccagctagttgttgacagcactagcttcttctgcccattgaagctgtaagtgttgtagttgttctgcaacaagaccgttatggtatcacccgcgtgtaggtctgtctcaatcttcccatacagcttcctaaacgttggcaaagccgcggttcgcatccagactatgaggtcttcttgctcactcaactatccaacagacaactcttacacttgttaaaatcctatcagaagaaggaatctaaattgatcgatattcaaggattttttaccggtttagaaatattaagagttccaccgcctattggtgctcctttctgaaaatttttagggaagacatttttcccaaacttgttttctctgtcactcttccatgagatacctttcttattcacaagaagttgttggctatttcttgaaaagctataagtatcgttgaacaaactccaagcaacaagaccacatggcacaattggttctccacccacattatcctcaggtgcacaggtcttcacatcatgctcttcttttggacttcttagttgtgcatcgtttcgacttttcacatacctaatcatatacaatcaaccagaggagtaactgtattaatgcagggaaagtaacaggcaaaagcgataactattactaagcagataaggcaaagtaccgtctatggttttggtagaaattctcaagttggtagtatacatagacaggatgcttcatagcttttgtcacctgaaaaaaatgaaaggctttagaaagagccatacctagaagaacagctaatatacacaatcatagaaggaactaaattgccatagaagaagacatgtaccgttattgttctcttacagatcttatctccttcaccctgtatgtaagcgaccatgttgtttctagaagatgttggaatacagtctgtgtcatatcgatcaacaatctcgactaccttcaagtatgaatgaaacatatcctcaataaaaccacaaaaccgaagctggaaaataaaccattagaaaaggcagaaaaacaatagcatgatgcacatactccctgagaagcaaataagcagatcactccaaggggaatgaagacaaccccagcgacaagaaatgtcaagatcacctgcaaatggccatgaacaataagaaaacagcaaaaagagtaagagtcatccttttccactattgtaacattgaacttacccatcttggagtaagaattggcttgcacgctggaagctcttgctgagtaaacctagaatctggtaaagaaaattggttccttgtgaagttaagaacagagaatccaaagcaaccatacagtttgtttaatgggagaacaatgtttaaagttttcgaacaaaagatttcaaccaatgtcacatcaaaacccaacaactaaacgtgagtttcaactacacggtgtaggacaacttgaaaaaccaagctgatgaacctatacacctcttgtatatacgaatctacatcaaacccagagtatacaagaatgctattagaaatcaaagaaacatgcaaaaacacatggtgatcgaggtatagcaacaccatcaacagagaaatttttgtcaattcaatacgaattccaggaaagaaagaaaaaaagaagacgaaatttctaaggacgatccatgactatacaaaaagttcgaccaaatcagaagattagaaggatagatagagatagaaagatcacattttggtcgcttggaggtttttttgacaccggaaatctcagacgatccgcctcctccgacggtggaagatgccgcggtggaactcatcaccgaagaaattgattagaaatgaaatctcctctacaactatattccgaatcgaatggacggcatgagtcgttttgggaagaacagatcctacgcgaatgaggggaagaatgttaggttaggcttatgaaacatatctacttggggaagatgtatagatcttttagatgaagaagcaaaactctcgacaaggaaaaaagaaagacgactttgacaaatgctgttatcatgggagggaaaaataaaataataataagccaatttttatgttattttttaaagggcaatttgggtaaagaataaaaaacggaagttttcgaacaaacccggcaaatgcggttaaactgccacgtggattacacgtcattaataattaacccactcgaatacagtcaaataacccacctgtcatttttgacggatccaattttgaagatattttacttgtaaaaaatctcttgacaacatataatttcgttgcctagtagcttcttcacagcttctgatctcactagtgttcgtcatctttgttcgattgaagtttgggaagtggtgatggtaataggagcagcagcgcgtgtagccatcggcggttgtcgaaagctcatctcgtcacatacctccctcctcctcgtctcttctcagtgtcgccaggtaaatcgtctgtcttctcaatcgattcttctgtatttacatatttactcgtggattcgtccgcagtctctcacggagaaaaggatcgagtggtttcaaaatcagaacaatggttatatatctgaattcagtttttctagtatttctcggatcttgtggtctcatggaggaaaagtgaattgggtttcctccggatgtttttgttaaagaacaaatgtgaatacgttatgataatgatactctgttaattcaattgattatcagatgagtatg

SEQ ID NO: 17635 - DNA, 3000 bp, Unknown; identical to SEQ ID NO: 8129
  misc_feature (1)..( 3000): 2750-1469P.txt file - cDNA_ID_1810467; gDNA_ID_1621194; Annot_ID_57537

SEQ ID NO: 17636 - DNA, 3000 bp, Unknown; identical to SEQ ID NO: 8121
  misc_feature (1)..( 3000): 2750-1469P.txt file - cDNA_ID_1810479; gDNA_ID_1621194; Annot_ID_57533

SEQ ID NO: 17637 - DNA, 450 bp, Unknown; identical to SEQ ID NO: 8112
  misc_feature (1)..( 450): 2750-1469P.txt file - cDNA_ID_1810491; gDNA_ID_1621194; Annot_ID_57526

SEQ ID NO: 17638 - DNA, 450 bp, Unknown; identical to SEQ ID NO: 8112
  misc_feature (1)..( 450): 2750-1469P.txt file - cDNA_ID_1810491; gDNA_ID_1621194; Annot_ID_174661

SEQ ID NO: 17639 - DNA, 3000 bp, Unknown; identical to SEQ ID NO: 8141
  misc_feature (1)..( 3000): 2750-1469P.txt file - cDNA_ID_1810509; gDNA_ID_1621195; Annot_ID_57554

SEQ ID NO: 17640 - DNA, 488 bp, Unknown; identical to SEQ ID NO: 8136
  misc_feature (1)..( 488): 2750-1469P.txt file - cDNA_ID_1810524; gDNA_ID_1621195; Annot_ID_57547

SEQ ID NO: 17641 - DNA, 3003 bp, Unknown
  misc_feature (1)..( 3003): 2750-1469P.txt file - cDNA_ID_1810528; gDNA_ID_1621196; Annot_ID_57580
gactggttgaaacgcagtgcctgcatttgtgactgcatgagtttacggaatcagacagttgcggtttcaagcattataaacctttttgaacgactggtttaacggttaaaaattggtgcatttttggaaggtttatgactggttaacggatttacgtttatggtagaaaaattacgggtttatgtttttagcaagctaattacgggtttacgtttttggcagaaaaattacgggtttacattttttttgcggcaaaattacggctttacgttttttggcgggaaaattgaaggtttaggttttttggcggaaattacgggtttacgtttttggcggaaaaattacggatttctttttttggcgggaaaattacgggattacttttttggcaaaaaaattaagattttatgtttttggcatgaaaattacgagtttatgataatgttatcatcaatgatgatatctatcatgactatggtatgttgatatgatgatgaagaagatagtatgatgatgatggtgatggtaatatgatattatgagagggtaatgatgatgatgatattgtgttgataatgaataaattgatgggttgatgaagccatttgaattttttttgattatattcaatcggtttagagattttagtacaactaagatgtcatttttgttttttaaggtctaattaaatttatctcttttctggtatggttattcgattctccaataatataagtttcaattttcaagttttgaaaaacaaacaaacatagcttttagtttttttatacttcttcaacgtatgaatcaaatatgcatatggaacatcaaaatcaaatatgataactccatataacatattcttaagaatcttcaatgactttaacctcaccagaatcagcacctggtgatttttaactcttttcacttttgttttttaatgactcttctaaaaagatgttcgtaatacaaaaaaattagcttccaaaacttataaaagctatatagatcttactttaaaaaattaacaaatgcattgagctcttaatcactttctaatgaattcttttgttctacatatatcatgaatcatgacaaataacattcaatacctacatacaacttaacaaaattacattttttaataaaaaaagcccgcgatttggttcgggtttcgccctagtactaactagagaagaaagagattttcgaagaaaaaatatggaacatgtgaaaagtttagaaggtatgacacatattgcttaaacaaaatcataagaggatggaaagagacactgtaagaaaaaatgaaacaaataaaacgagtgcttgcaaaaagatagggagagtgatagctctttgtaaaaaaattgtgaagacagaaattcatatacatattgaaaagaatgtgagaaaatatgagttgttaaagtaaagtatagataagcttatgaatatacttctatataatatcttatttttagacgagctatactaactaatgcagcgaagataaacaaaaaagaatagtaaatttacggatttcaaaatgagaaagtcgtcgaagttattttccataaaacaatttatttcatacataaaaagacgtcgtgatcctaaatatctaaagctaaagagagagtcatgagccaaaaaaatgttcttttgataaatgttgtaaacctaaaagttgtattaaagttatttttagttttgtatttaaattgtaactattgtcatggtaattttaaaattcaaagagtttataatattaacaacaagtagacatataaaaacatatcttttaaaaaatttctataataattttattcacacaaaaaaatattaaaaagttttacaaatagacccatgcgtagcgtggattcataacctaggatttagaacgactaatcgggagttgccacataaataattaacatatttagtatctaattaattaacatttttgaaaacaaccaatcgggagctgccacatcaataattaacatatttagcatctaattaattaacatttttgaaaatagcaattactttatattttaaaatgtaaaaacaaaggaactaacaaatattaaatttaaacttataaaataggaagctatataattataattatgtaataataaactcaaacccttataggattttatacaactaatccaacatttttttaatataacttaaagaaacgtaacaaggacgtggtttgatggtggtgtttttaactgtatcaatttgaatcaagttctcgaagatatgctcgtggcaactaccatgagaattccactttttcggtcatgtgacaaccacacaaatttccgagtttcacgagttcaaaatcggtgtttcaactcgtaacttagccttgaacgcataaaagcgaactgaatgaattagagttgtaatgttgtatttatttttgtagattgttttaatccgcttcttgctaatctctgtatttctgtcaaaaatcaaaaataatataaaatctaattgtctaccaaaaaaaaaatcattcatagtccatgagtagaatcaaaacaagatagattcaaactttatcaagatagataaataagctaagaaatgaaatagttcctcaaaactaaatttagtgtcaccaagaggcaagatcaaacttttcaaataagggaaagaagagaattgcaacgtgattaattgatgaggtcatagtaaaagtcaaaaatctgtgtgactcaaaacgggtaaaaacaataattgggatgtagttgataactctaaaaaaaaagggacaaaaatgagatttgcataaagtagagatacaaaattgagaagaaaaaaaaatcctcttcactaaaaaaaaaaaaacttccgttatcgatctctatctctctcttcccccacaagggtggcgattcgaggagtttccatggtggaacagaaaccctagagcctttatgctgccactaattatcactcttcactattgaattggggatg

SEQ ID NO: 17642 - DNA, 3003 bp, Unknown
  misc_feature (1)..( 3003): 2750-1469P.txt file - cDNA_ID_1810543; gDNA_ID_1621196; Annot_ID_57576
attagtcacgtgtataggaaagtgcagacgggttagctaactatgcttttttttgtcattagagttttattctttggaggttgttcctattgattttgtttctgttgtaagcgatgatgtgcttaggttgggtctacgtgactaaggcaagtgtctatgtagtttttttttgaagttttaataaaatttagatagattttttcccggtgactagaagcttcatcgagataggagcgatactacgaataaggtatatggggcagagtgccctaccaaaaaaaaaacactaaaaaaataatgaagatatgtggagtttaatgtagttattttgaaaagaaatgtgattgaatcctaactatactcatctaaccaagcttataattcgtataattcgtataattcgtattgggctgcatgtttgagaaagactgaccatattttttagtatcataaagttcgatcagtaaaaataagaaatgatagcttagttagattctagtaatactatcatgttttaattgtttatatataacaattgtatcttacgtaatataattcatataacaattgcatgttgtaaaattataaaatatcttttcatttaaaagattcgactaaatacatatctcaaaaatgacatttttagtatttattaaataacaacaattgtttttaaaacacatgcaatttgaattgaatgaatgaaaataacacaacatcactagaatataaatcactactttagaaaatcatagtcaatgacatactttttaaacaatatttttgcaggaggagagagctggattaagatatgagataacttgcacaaaatgtgatggacatctaggtcatgtcttaaaaaatgaaggttttccaacaccaactgacgaacgccattgcgtcaacagcgttgctctcaagttctcttccgctatcacatctcagtgataaacggatccggtttagttctccggaatcaactctatctatctatgaacgttgattactaagagacctttctacttctgttagaatgagaacgttgtgttcttcaattcatcgcatttatgaactattataaaattgaatgttttgtgttttcattatttttagtaatgcttatgtacgtatcattgaaattgtttgtgtcatatattgtgccatttttctattgagtgttaatgtattatcgtatttaccaaaattatatatagttattgtctaagtctgcgaatcatttgccatttggatacacatgcatgtctaaacaaacgtacacatggggatgtgaccgaactatttttttgtttgtttgttcttttaatatcattgacgtttttaccttacttctcaattgttcttctttttccgtaatcgacaccgtagagtttcgacgatgacatgacgcggccaaattcaaagcaattttaatccattcagttcttgtctatgattagatgccttgagttccttcctgtcatcaaaacgaatttaactagatccattggattttcaatatgttggtggcggagatgtatttttttaatcgcaaacaaaagagataaagtttgtgaaattggtagagaatgtgttgatggagttgacagatatggtgatggagttgatggagaatgctttgatgaagaaatcacggtgttgatgaagtaatcgcggtaaaacaaagtgatggagacaggaaaaaaaatgacggaaacgatgatgaacggtgtttgagatagggtaaaattgtcaataaaattttaataagtatccaatcctgtaaacccaataagagagtgtcatttttcaaaatttttggccccaaatatatctgattgtataaaagtccctaccaatcacaccctatgttttccgttattgttttagtcatatataccatattcaaattttatgtaaattttatgtaaatatgttcttcaaattttttaaaaaatcctggctgacccggtccaagtatgtcagttagctaatagttgtgtttgttagtcggagaagtctatttagctatataccacctttcatgatactattactatcccctgttgttttttttactaatacgttattgggatgagatgccatctaaaaggggaacttctccaattctgttcgttgggaccactccagattttacaatcccggcttatgagttttgagaccactctcacttattttatctacattttgtaagagtgccgtgtttcatacttagttatttctctgataacaaacaaattggggttctgttcttaaaatatataaaagcccgtgaggcccaacaaacggaaagtttggcccgtgaaagaaagaaaaacaaaacttatttattgaaaaatgacacgtgcagaatcatttactaaaccagacaataaccggttaacggtttaatagttagcaacagaagaaccaaaggattgtcttcttccacaatcagaatctgtctgtgtggcttgtaacgcttcaatgtcagtgaagtctttagctatatccacaaaaataacataacaagattaaaaaaaagagagaatattttatctctctagacttgacaatttccctctctttctcactccctatacctgtatatgtatatagaatcgtatatatctggagaaatacacgaggtgttctcgtctctgacgacgtggtctattgtcttcctcagctttagtcaatttcttctttcggaaacttggttctgtgatattatccaaacttaaagtttgagtctttagggtttatgggtgacaacaaaagtacatgcctttaggctttagttttgtgggtttcatctcaaaatggcaattagtactatgttagggtccatctcttgttgcccctctcccaaggtatttccttccttgtgcttacttgtgtatctgtcgactgaaaaacctctcctttatgtatttaagtttatgtgcaaagccttaattggtgattgaatccttagttctgatttgatttcaggggtatgagatg

SEQ ID NO: 17643 - DNA, 3003 bp, Unknown
  misc_feature (1)..( 3003): 2750-1469P.txt file - cDNA_ID_1810547; gDNA_ID_1621196; Annot_ID_57575
tttcaaaggagaaggttacggtaatccaaccgatgaacgtcattgcgttaacagtgtttcgatcagttttaacccggcaaaatcttcctctataatctgaggatatgattgatcgatcatacaacatcttctaatcagattgtgttgttaaaattgtcatcatgtagtgaatatgcactttctgtggtggtcaatataatgcaacaaataataagactcattagatattggatggttactggtttctcttaatatgttatagaacatttaataacgatttaattatctaagggatcattactagtgtttcttaattataactctttagaactgaaaaaaaatattatagagatttcgttttgacagaaaaaaactcaaaccgatccattttactttccattttgagtgtgttgattttaaaaaatatgatacgtttttattactaatgaaaatagaagatattatttccaatagtggatctcatatgtgtatccatatcattattttcataattgcgtaaaatatctcgtttcatatatatttgtgtgagataatgggttgagattaggagtgggcattcgagtaagcgggtcgggtttgggtaaaatccaatcgggtacgggtttttcgggtagataaatttaggacccaatagggtaaatataaaatatcggttcgggtttaatcgggtttggctataaatttttgggccttattttgaaactgatagccggatttccgggtaaatacccagatttttcgggtaaatacccggattttcgggtaaaatttcgtgtttcaggtaaaatttagatttttgattaaaatattcgggtatttttgggttcgggtttggatcgggttcggattcggtttttcggatagaggaatttaggacccaataaggtaaatcttcgggttcggtttcggttccaattttttgggtcagtttcggttctggttgttggttccgattttttcccagcccctaattgagacgttggtttgtttgccaataatttgtcatgtggaaaagtactcgaatgtgtttttgattcactataaatggttgtcccgttttgagtttgataattcattagcatgtgactatatcatatatctatttattacactagaagcattattctctttttaaagcaatattctctgttcgaattaaactctagctatcttttacatacctactaatggatattttcatttgggatatcgaccaatcaaaaccacaaattttagctgatcaagatgggatctcaagtttggtaggtatggaaaaatacatacgtacacatccagagagcgaagaatttgtgatgaatttctaataaatatatgagttgttgagaaaacaatatttcaactaatcttatatttataatggtcccatgcatgatacaaacgtggtcgttatctcgtccatatgaccagtgaccacatatgtttcaatacgtgtttcatctcaatgcttcacaacctccatttgtattgttccgcacaacttaatgttatgtacaagttgaatatgcttattatgtagtaaaatgtaaaagacataaatcaattcattagtagtaaaacaatatattctcgttgtcatcagtcattactcatcatttggcaccaaaatgcggaagccaagccagctgtgaatggtaagtatattaatctctattcacatgcaacatgcactagtgtgtcagtaatttggtccatgacaatacacatgtgtgatctagatgtccttgcttcttcaaaggttacagcacaaccatatctagtatattactagaaagagaaaagaaattttgttatagcattcatctaaaatgatcagagaaaagaaattttgttatagcattcacctaaaatgatcagaacaaatctgaatgaaaattcagtatatatatatttagacgtttagattgtgcagacaaaatgtatttagtgctacaactgatgtgtaatgtatggactactttcataaaaagtgcagaataatatgcacggaacaatattattacaagttctaagattattcatatctacaaagattgatatttttaataataaataattcgagtttccaaatcgatttttaccatttttattttaaattgaaaaagcaaaacattcatgcaagaaaagttaaaaacaagttagtggaaccaacaaaaaaaaaacagtgttaatgaatgtcccaagtccgaacttttataatggtatcttttcccatgatttattcatgatttagacaataatagggatttacggattttgccattttttgctataatttttacgaatttgttattttgttaaaattttacggatatactatttttctatatattaaaaaatgttcacatttatgagtctttttttgcttaaatacacattttataagttataacaaataataaattctataaacaaatagaaccgattaatttaaatataataggtaaaacacatgttaaatcgtatttttatattataaatttttttttattcataaaactttagacaaaaattgcaaaatccataaatatcactaagaaaatggcaaaatccgtaattgattccaaaaatatgacaaacttttgaatcttttaaccaaaaaaagaaaacagaggtttttataacaagttcagtttacaattttcaacgtgtggtttctctattagaaccaaaagaataatatatatccaaacgtgcacaacgtgtcaatttttttgttacaaaatgtgaagaacaaaaaaaagtgtgaaaagctggttatgagttatggatctgcgcctataaatatacaaacatttctccatccactccatagccaaaccatactctccaaagtccaagctcacaatgaacacttcgtaagtctctctccctctctcaaaatgttctttttgtctgaaatgtaaacacaattttttgttgctctcgttgctcagcccaaaaatggaaatggaaatgaaaatg

SEQ ID NO: 17644 - DNA, 3000 bp, Unknown; identical to SEQ ID NO: 8151
  misc_feature (1)..( 3000): 2750-1469P.txt file - cDNA_ID_1810552; gDNA_ID_1621196; Annot_ID_57571

SEQ ID NO: 17645 - DNA, 3000 bp, Unknown; identical to SEQ ID NO: 8148
  misc_feature (1)..( 3000): 2750-1469P.txt file - cDNA_ID_1810562; gDNA_ID_2926132; Annot_ID_196992

SEQ ID NO: 17646 - DNA, 3000 bp, Unknown; identical to SEQ ID NO: 8148
  misc_feature (1)..( 3000): 2750-1469P.txt file - cDNA_ID_1810562; gDNA_ID_1621196; Annot_ID_57568

SEQ ID NO: 17647 - DNA, 3000 bp, Unknown; identical to SEQ ID NO: 8148
  misc_feature (1)..( 3000): 2750-1469P.txt file - cDNA_ID_1810562; gDNA_ID_2926132; Annot_ID_138791

SEQ ID NO: 17648 - DNA, 3000 bp, Unknown; identical to SEQ ID NO: 8148
  misc_feature (1)..( 3000): 2750-1469P.txt file - cDNA_ID_1810562; gDNA_ID_1621196; Annot_ID_174739

SEQ ID NO: 17649 - DNA, 3003 bp, Unknown
  misc_feature (1)..( 3003): 2750-1469P.txt file - cDNA_ID_1810633; gDNA_ID_1621198; Annot_ID_57614
ctcatctcaaaccaaagtagaaagggaaatctactttaacattttttctttaaacttgacccggagacccaaaacccgtctaacttcagagctggtgtgagtcttcaagtcatatgggtcctgaggtctctccccaaaagttaagtatcttatctactaatctctcactgttctctgagtcattccggaggaaattcgtatctactatacatttagtaccgaattgatgtatattcagtattggatagttaaacttgttccttaagaaaaaaagaaatcgagttcatggactgagatttgcaaacgaggtcttatcatatcttcttgtaaaatacccgggttctgttctcaaataatttcaggtatcaggtattacatgaaccgaaattgatatccgtgagtattttttattacccgaacatatatatacatatgaggacatatatactgataacttgagtttgtgaattgtttaatgattggattatggaacaagttaaaaacaaggtttatttcttgttttttattattgtaataaaggaaaacttgttataattttatggatagttttatatatgtttgggtatatctggacaaggttttggtaaataatattgaaacccaaaataattttggttatttattgggttcttcaacctatacccgaagagaacctatagcttaaataatacgtataatcgaaccagtcttaaacttctaaaccgaacccgaaagactcgatccaaacccgacccgaatacccaaatttcctcaccttagactaaaacaaatggactcctcccttatcaaaagaaaaagaaaaacaattgggctccttgactctaaaaaacacaatgggcttcgtgagataatataatgagtccattagtcatctataaattcagtgactagcgaaaaacatgagaaacatatcggaagcttcttcaccaacctggaaagagaccaccggtaacgtctccaacttatttccctcttctttccatttttttttcaatttacttcttcttcttcttctccagtttcttctatcggtttatttttcaattccatcttcattgtttcgcagacccatagataggctttgatttagggattttaatttcaatggctgcgatcgcgaatccacgcttgctgcttaattattcctgcgaatgacattttcttaagtttaacctttttattttctgttatgttgtttgctcgtttcgaatgaggtcactttttaactcgttcatggatttagcttctaaaaattgatctttttttgcagaaatatgaattaggcatatatatatatatggttttagaggtcaatatacattgtattattcgtttgcttcattcttacaaaagtagagctaaaaaaacctgagcttttaagtcaaagccttattcaaaaatgtttttgctttctaatttctaaagcttaagcattgatgttactgttttgtgatgttcaggtggactggaatcagttttggtagagagcgttgttaaagtttcgtccattaacaggctgaagagttcttcctcaatctgtgtaaccaccacttcgtgctcctcctctatctgtttctcattccagtctcgtctttcgatttctctagcacatgcttgtctcctctgctcacttgttccgcgttcaagctctgattctctctttccctgcaaccatccttttgcctcgcataccaattggttctcaaagtgttgagtttcgtggaatgagtttgtcctttgcatcaattcatctctgaaatagtccattatcagatgttcttcgtggatccaaatggcgtgtctttctttgactcggttccatagctgtgctgccttctcttcaacctcatcattgtattcatcttcactctctctatcaacagtatcacaattctcatcatcatcatacttggtatctgtctcttgtcctccttccatgcaagatgcttcatccattgagccccattcatccaaattgaaaggactaatgttggccaaagactcaaaccgctgaatcgtttgcatgagcttttgtttggttcctgcaaaatcatttacataacgtatgtttcagaacttcgaagtctgaaaaaatctaagaagagaacttgcttcgattgcaatgaaggaaatctatactcactttccacattgtcaaggcattgactgaaagaagagtctgatgtttcgtcatattcctcatgttgaatctcaaacactgagacagggctgttgtgctccttttcacactgtaagttctcctgaccatgatcattacatattaggccaaccaaatcatccaactagtaaagtgcatagggtaataatttcagtatgttaaatgttactcttataagactcattcattaagttgttagattcgtagtcataaaggaattaaagggtacatgctattatatgtaccaaggacaaagacagcttctgttttgtcttcatgtgaatttatattaacaaacagctgcacgtgcatttagagacagcatgggcgaccttacggttgaagcaaagtcaacccataagatctctattctcagatcacattgtcactttatttctttcttaattttgatttgattctgttttctctttatttatgcatgtagtagtcaaagtatgtgattaattaatgttataagtacgagtttctatttctcttaatatagtattcttacctcaggtcccacttcagtgtcggctagtattactgctgtgcaagaatcttcgccgacgcagtgtaagttgtttttaacactctgtttttcaccgcactcctcaacgttacttccccatgatgatggtaaaaactccgatgtaaaatccaagtcagaccaactgctgcaggatgtgccgctggtggtggaggatcctgtggttgttgtcgtgttcttggttgtgtactgatgaggttcaaaatgtgatatgtcctcatgcaggtccttagacgagtgccatcgcacgatg

SEQ ID NO: 17650 - DNA, 3000 bp, Unknown
  misc_feature (1)..( 3000): 2750-1469P.txt file - cDNA_ID_1810633; gDNA_ID_2926139; Annot_ID_138962
atctcaaaccaaagtagaaagggaaatctactttaacattttttctttaaacttgacccggagacccaaaacccgtctaacttcagagctggtgtgagtcttcaagtcatatgggtcctgaggtctctccccaaaagttaagtatcttatctactaatctctcactgttctctgagtcattccggaggaaattcgtatctactatacatttagtaccgaattgatgtatattcagtattggatagttaaacttgttccttaagaaaaaaagaaatcgagttcatggactgagatttgcaaacgaggtcttatcatatcttcttgtaaaatacccgggttctgttctcaaataatttcaggtatcaggtattacatgaaccgaaattgatatccgtgagtattttttattacccgaacatatatatacatatgaggacatatatactgataacttgagtttgtgaattgtttaatgattggattatggaacaagttaaaaacaaggtttatttcttgttttttattattgtaataaaggaaaacttgttataattttatggatagttttatatatgtttgggtatatctggacaaggttttggtaaataatattgaaacccaaaataattttggttatttattgggttcttcaacctatacccgaagagaacctatagcttaaataatacgtataatcgaaccagtcttaaacttctaaaccgaacccgaaagactcgatccaaacccgacccgaatacccaaatttcctcaccttagactaaaacaaatggactcctcccttatcaaaagaaaaagaaaaacaattgggctccttgactctaaaaaacacaatgggcttcgtgagataatataatgagtccattagtcatctataaattcagtgactagcgaaaaacatgagaaacatatcggaagcttcttcaccaacctggaaagagaccaccggtaacgtctccaacttatttccctcttctttccatttttttttcaatttacttcttcttcttcttctccagtttcttctatcggtttatttttcaattccatcttcattgtttcgcagacccatagataggctttgatttagggattttaatttcaatggctgcgatcgcgaatccacgcttgctgcttaattattcctgcgaatgacattttcttaagtttaacctttttattttctgttatgttgtttgctcgtttcgaatgaggtcactttttaactcgttcatggatttagcttctaaaaattgatctttttttgcagaaatatgaattaggcatatatatatatatggttttagaggtcaatatacattgtattattcgtttgcttcattcttacaaaagtagagctaaaaaaacctgagcttttaagtcaaagccttattcaaaaatgtttttgctttctaatttctaaagcttaagcattgatgttactgttttgtgatgttcaggtggactggaatcagttttggtagagagcgttgttaaagtttcgtccattaacaggctgaagagttcttcctcaatctgtgtaaccaccacttcgtgctcctcctctatctgtttctcattccagtctcgtctttcgatttctctagcacatgcttgtctcctctgctcacttgttccgcgttcaagctctgattctctctttccctgcaaccatccttttgcctcgcataccaattggttctcaaagtgttgagtttcgtggaatgagtttgtcctttgcatcaattcatctctgaaatagtccattatcagatgttcttcgtggatccaaatggcgtgtctttctttgactcggttccatagctgtgctgccttctcttcaacctcatcattgtattcatcttcactctctctatcaacagtatcacaattctcatcatcatcatacttggtatctgtctcttgtcctccttccatgcaagatgcttcatccattgagccccattcatccaaattgaaaggactaatgttggccaaagactcaaaccgctgaatcgtttgcatgagcttttgtttggttcctgcaaaatcatttacataacgtatgtttcagaacttcgaagtctgaaaaaatctaagaagagaacttgcttcgattgcaatgaaggaaatctatactcactttccacattgtcaaggcattgactgaaagaagagtctgatgtttcgtcatattcctcatgttgaatctcaaacactgagacagggctgttgtgctccttttcacactgtaagttctcctgaccatgatcattacatattaggccaaccaaatcatccaactagtaaagtgcatagggtaataatttcagtatgttaaatgttactcttataagactcattcattaagttgttagattcgtagtcataaaggaattaaagggtacatgctattatatgtaccaaggacaaagacagcttctgttttgtcttcatgtgaatttatattaacaaacagctgcacgtgcatttagagacagcatgggcgaccttacggttgaagcaaagtcaacccataagatctctattctcagatcacattgtcactttatttctttcttaattttgatttgattctgttttctctttatttatgcatgtagtagtcaaagtatgtgattaattaatgttataagtacgagtttctatttctcttaatatagtattcttacctcaggtcccacttcagtgtcggctagtattactgctgtgcaagaatcttcgccgacgcagtgtaagttgtttttaacactctgtttttcaccgcactcctcaacgttacttccccatgatgatggtaaaaactccgatgtaaaatccaagtcagaccaactgctgcaggatgtgccgctggtggtggaggatcctgtggttgttgtcgtgttcttggttgtgtactgatgaggttcaaaatgtgatatgtcctcatgcaggtccttagacgagtgccatcgcacgatg

SEQ ID NO: 17651 - DNA, 3003 bp, Unknown
  misc_feature (1)..( 3003): 2750-1469P.txt file - cDNA_ID_1810641; gDNA_ID_1621198; Annot_ID_57611
ggaacagtcctctcggcatcacctttgcctgatgaaaattttggaagctccttggtgtcttctaaggggggtaactctgcagttccatccagcagtataagtagcatgatgggaggtgttgttggggttggttcgacttggaagctctttaatgaggattcaacttcggtggaagaaggtgttgtcatatttgccacctatcaaactggactagtggtaaatattccagatatttgttcatagtcaatttactggttacgcttctggaaatgatccttttctgtttttgtcaggtaaagctcattccaaatttggaggtgtatgcacaacttcctaggccagaaggggttcgggaaggttccatgccatacactgcctggagacgctcaacaggtaattcttctcctggtataactgtgtactttacatgtactgttttacgtaggtaaaattttgcagaaaattattcgaaggaggcagaagatagggtttcttttcttgtcattgcctgggatcgtcgagttcaggttgccaagttggtaaaatcagacataaaggaatatgccaaatggtcacttgacagcccagctattggtgttgtttggctagatgaccaggtgtgtatactgatataagttttttctaagcaaatacatattcatgagttttcggcttttctctgcatattcagttgctggtgatcccaactgtgacgggccatttgtatctgttcacaagagatggtgtggtaattcaccagacaaacttttcagtggctggttcttcagggaatgacctgatttcctatcatacgtactttactaatgtctttggaaatcctgagaaagcttatcacaactctatgggtgtcagaggggcttcagtgtacattctcgggactgcacatcttgttatctccagacttttgccgtggaaggagcgggttgatgtgttaaggagaggaggtgactggatgggtgcatttaacatggcaatgtcactcttcaatggtcaagctcatggagttgttgacctccccaaaactgtggatgccataagggaagccatagcacccagtttagcagagttgctactttcctatgtagatgaagtattttcttatatttcaatagcattttccaatcagattgaaaacaatggagtaactcatgagccaagtagtggaatcaataatgtcaatttagagatagaagaacaatacaatcgtgttggtggtgttgccgttgagttctgtgttcatattaacaggatggatttgctctttgatgagatattttccagatttgttgctgtacaacaaagaggtatatttttcacatctagatgtattaccatcaacttccttttttttgtgctacattttattaaggaacaggggtcagtatcattccaactatataataattgtttaaaagatgttactacgataggatagtaactacttttctataggttgtctgattctgtatctttatttttttaaatccttagagagctttggtccaccgatcttgaaatatcttattttggtatctcctttgggttggtgtttttcttatgcatgccgatttctataatacatacacatacgtgttgtgctgtgtgtttgcatgtatgttctccattacttttagtttagttcttctgtaaatggtttagagtaattgtatagtttgctaaatgaaacagcataatactttcatatggataaattgcaatgctgagtataatattttgattccttgaggttagtaagtaagatataaacgttctttggaaactgctttccttttccacctcagtttggtactttgatctttgtttaaatctattgatgacaattaattccttgtgtctaatgagatataataatttctcttgatgactagatacatttttggagcttttggagccttatattttaagggatatgctcggatctcttcctccagaggtatcttttgtgaaattataagatttcctcaagagtgccgttgtattttattttatgatttttttgtttcatctcagatcatgcaagcgctggtagaacattatagtaggaaaggatggctacaaagaattgagcagtgtgttttgcacatggatatttcttccttggatttcaatcaggtcacgtttgtagacaatttcacgtgttctgttcggtccttttcttcaataagttgatgtgttgatttagtattatggttgaattttgatgttttcctcattgacacttaggtagtcagaatttgccgtgagcatgggctttatggggccttgctctatcttttcaacaaagggttggatgatttcaggtcacctctggaggaactcttgattgtcttacggaacagtgagaaacaaagggctacagccattgggtatgttatgttaagtcgttgtactttgttctggctgaataaaaccttacatgcaaaactgaactcgagagcctagaattcaaactgctcattcatttctacctaacatgcaactaatcctagagcgcacctatgcatatatctaattgcaatattattgttgtgtaagaaaattttgatttcctttatgacgcaatatagttgtctgaactaaggtatattttgcggccacataaatgatgagttctttttaactctgtttctttttcaggtaccggatgcttgtttatttaaagtactgctttcttggtttggcttttccaccaggtaggattctgttatggtttcactgcatgttatgatctgcaatcgaccttattgtatccagtgacctataactttatataggcattttcctctcacaaacttatttggagttttatctgcaggacatggaactctaaatcctacacgatggccatcacttaggagtgagctgattcagtttctactggagaaatcaaatgcccatgattctagtacatgtgtaacatctcgattgaattatttgaacctctaccatctgctagaaatg

SEQ ID NO: 17652 - DNA, 3000 bp, Unknown
  misc_feature (1)..( 3000): 2750-1469P.txt file - cDNA_ID_1810641; gDNA_ID_2926139; Annot_ID_138965
acagtcctctcggcatcacctttgcctgatgaaaattttggaagctccttggtgtcttctaaggggggtaactctgcagttccatccagcagtataagtagcatgatgggaggtgttgttggggttggttcgacttggaagctctttaatgaggattcaacttcggtggaagaaggtgttgtcatatttgccacctatcaaactggactagtggtaaatattccagatatttgttcatagtcaatttactggttacgcttctggaaatgatccttttctgtttttgtcaggtaaagctcattccaaatttggaggtgtatgcacaacttcctaggccagaaggggttcgggaaggttccatgccatacactgcctggagacgctcaacaggtaattcttctcctggtataactgtgtactttacatgtactgttttacgtaggtaaaattttgcagaaaattattcgaaggaggcagaagatagggtttcttttcttgtcattgcctgggatcgtcgagttcaggttgccaagttggtaaaatcagacataaaggaatatgccaaatggtcacttgacagcccagctattggtgttgtttggctagatgaccaggtgtgtatactgatataagttttttctaagcaaatacatattcatgagttttcggcttttctctgcatattcagttgctggtgatcccaactgtgacgggccatttgtatctgttcacaagagatggtgtggtaattcaccagacaaacttttcagtggctggttcttcagggaatgacctgatttcctatcatacgtactttactaatgtctttggaaatcctgagaaagcttatcacaactctatgggtgtcagaggggcttcagtgtacattctcgggactgcacatcttgttatctccagacttttgccgtggaaggagcgggttgatgtgttaaggagaggaggtgactggatgggtgcatttaacatggcaatgtcactcttcaatggtcaagctcatggagttgttgacctccccaaaactgtggatgccataagggaagccatagcacccagtttagcagagttgctactttcctatgtagatgaagtattttcttatatttcaatagcattttccaatcagattgaaaacaatggagtaactcatgagccaagtagtggaatcaataatgtcaatttagagatagaagaacaatacaatcgtgttggtggtgttgccgttgagttctgtgttcatattaacaggatggatttgctctttgatgagatattttccagatttgttgctgtacaacaaagaggtatatttttcacatctagatgtattaccatcaacttccttttttttgtgctacattttattaaggaacaggggtcagtatcattccaactatataataattgtttaaaagatgttactacgataggatagtaactacttttctataggttgtctgattctgtatctttatttttttaaatccttagagagctttggtccaccgatcttgaaatatcttattttggtatctcctttgggttggtgtttttcttatgcatgccgatttctataatacatacacatacgtgttgtgctgtgtgtttgcatgtatgttctccattacttttagtttagttcttctgtaaatggtttagagtaattgtatagtttgctaaatgaaacagcataatactttcatatggataaattgcaatgctgagtataatattttgattccttgaggttagtaagtaagatataaacgttctttggaaactgctttccttttccacctcagtttggtactttgatctttgtttaaatctattgatgacaattaattccttgtgtctaatgagatataataatttctcttgatgactagatacatttttggagcttttggagccttatattttaagggatatgctcggatctcttcctccagaggtatcttttgtgaaattataagatttcctcaagagtgccgttgtattttattttatgatttttttgtttcatctcagatcatgcaagcgctggtagaacattatagtaggaaaggatggctacaaagaattgagcagtgtgttttgcacatggatatttcttccttggatttcaatcaggtcacgtttgtagacaatttcacgtgttctgttcggtccttttcttcaataagttgatgtgttgatttagtattatggttgaattttgatgttttcctcattgacacttaggtagtcagaatttgccgtgagcatgggctttatggggccttgctctatcttttcaacaaagggttggatgatttcaggtcacctctggaggaactcttgattgtcttacggaacagtgagaaacaaagggctacagccattgggtatgttatgttaagtcgttgtactttgttctggctgaataaaaccttacatgcaaaactgaactcgagagcctagaattcaaactgctcattcatttctacctaacatgcaactaatcctagagcgcacctatgcatatatctaattgcaatattattgttgtgtaagaaaattttgatttcctttatgacgcaatatagttgtctgaactaaggtatattttgcggccacataaatgatgagttctttttaactctgtttctttttcaggtaccggatgcttgtttatttaaagtactgctttcttggtttggcttttccaccaggtaggattctgttatggtttcactgcatgttatgatctgcaatcgaccttattgtatccagtgacctataactttatataggcattttcctctcacaaacttatttggagttttatctgcaggacatggaactctaaatcctacacgatggccatcacttaggagtgagctgattcagtttctactggagaaatcaaatgcccatgattctagtacatgtgtaacatctcgattgaattatttgaacctctaccatctgctagaaatg

SEQ ID NO: 17653 - DNA, 3003 bp, Unknown
  misc_feature (1)..( 3003): 2750-1469P.txt file - cDNA_ID_1810645; gDNA_ID_1621198; Annot_ID_57610
aaatttcaatcatatacattcaattttactatacattttaactatttcttttatcataataaactgccttttaactctatacactccaacttattgatgatatttgaattttaaatagtaactcatatttttttcagtatttaatttagtatttctttaaaataaattttaatcttacaacttcgattttacaatacaatttaaatattattttttatcataatagaatacaatttaattcgattgtatacaattcaaatacaatccaaattttcaatacaaatacaatttaattctatacactccatcttattgttagttttcctttttaattaataaaattataagttaaatttttagatatagaaatataaattagtatatgtaaatatgtttatttattttttaaagaattttttttgacatatgtcaacatctcaatgatagacctgacacgtgtcatgatctcgtgagttagtaactttcaaaactgtactttatataataagatatatgcttatatgtttcatatatatatatatatatatttattagatcgacaataacattaaactatcattactagtttacttttttaaatatgattttaataagtatcatataaatgtacaaagtgtatacaatacatgtttttatatatatatatatatatatattttttttatatataagcataaatatatagacgaacaaacaatgtagacagacctaggcacctagctatgatctatgcatacggacgaaccctattatacgtacgcatgattattgaatataccttcaaatataaacttgtgagcgtaaggttattatgttttcaatactgacgaatgacgattgtgattcatgttttgaaaaattaataaagtttaaaccatcgaatgcgtaaaccaattattcatcttttaccttaggaaaaagctggatatcattatcatatatttattaagcatattaaaccagaccaatgatttaagtcgaaaatgacagctttcaagctttgcttattggccaataaataacaaactaaaaaaagaagaaattttttaaaacgaactggtgaagtctcgtgttatcacgtgcatggagccagtcagacagagacatcatcaggtgcatgatggaccacggtagtccatttcttccctacaaccatacacgtggcctttttacatttaacagtcaaacatctggtcaacaacactctcatctgggcttccttacatcaaaccctactttttttttgtttatcaaaggcccaattgtatataagtgaaaagtttccaatgggcctttcaaggattattcccagcccaatatttctggagattaggtttatttatcatcgccaccaaagaaatttgagccgaagcttcataatcgtagtctgaggtatttttctcgatcctcaaacatttccaacacctaaaggcttattcgttacagatttctcaccaatcttcggatttattgtgctcgtacgataagcatatattagtaaatttagtggctatttaggaaatttctcgtttgatttcttgttgttgttgagatttgaatctgttgtttatggtttttgtgattacttggttttgcagagacaatgtcgacagtcggagaacttgcttgcagctacgctgttatgatccttgaagacgagggcattgccatcactgtatccttaaatctcttgacattttctgaatctcatgtcctagctattgttgtcgctatatcttgttttggttggatccttttcattatcgagacaacatggtgtgagtgtttattttaggtttatggagctctcttttgatgaaatagtcagtaccaagattcatgtttgctttggcacactcaattgttgggcatgtgttaaatgacctatctgcaaagttgttggtttagggttaggaattaggattcttttttactggatttaagaaacgtgtttgttctattagttttgatatgtaggttcaatgtttgggttaggtatccttaaccctattattgatagtctgataagattgcgactttggtcaaagcggctggtgttgagattgagtcttactggccaatgttattcgccaagatggctgagaagagaaatgtcacagaccttatcatgaatgttggtgctggtggtggtggaggcggtgccccagtgtctgctgccgcacctgctgctgctggaggagctgctgctgctgcccctgctaaggaggagaagaaggtacaaatttaaagaaacaaaaacattatattgttatatcttttagctaggtttgcttattgatactctctatgttgtttaattgtttgtaggacgaacccgcagaagagagtgatggagatcttggtttcggcttgttcgattagttgtctcctttcattttacgtttcatatgttctattgctttagttgctttgagattttaagttttgtcatttcgacactactacagtttactcttatatcatgtactggagttagcaattggctcacgaccttctttgtagttcatgagagttatcttatgctcaaaatgcattggagcttattgaatttgacttttggattcagctgcgtcttctttcctaccaaatctcagtctatttataatttgatcttgaaatagaaaagaagaacaaaaaatcaggaaagatatgaacatctgttacaacttgataattcagtggatacgcaggtttcatgaaccatggtttctcagaagttttgtaagttttttactgattatactaatgttgtcaaatgtataaaaagtaaaaattgaaccttctgcataatccagaggctttcattttttttttcttttcttcttgtgatggactcgttttagctgaaattagaacgtcggttagtaccggcggagaatgttcggagtcgagtcagtcagagagttctgataataccaaacggctactttgaagttcacggctattaagaagtcgcacatg

SEQ ID NO: 17654 - DNA, 3000 bp, Unknown
  misc_feature (1)..( 3000): 2750-1469P.txt file - cDNA_ID_1810645; gDNA_ID_2926139; Annot_ID_138966
tttcaatcatatacattcaattttactatacattttaactatttcttttatcataataaactgccttttaactctatacactccaacttattgatgatatttgaattttaaatagtaactcatatttttttcagtatttaatttagtatttctttaaaataaattttaatcttacaacttcgattttacaatacaatttaaatattattttttatcataatagaatacaatttaattcgattgtatacaattcaaatacaatccaaattttcaatacaaatacaatttaattctatacactccatcttattgttagttttcctttttaattaataaaattataagttaaatttttagatatagaaatataaattagtatatgtaaatatgtttatttattttttaaagaattttttttgacatatgtcaacatctcaatgatagacctgacacgtgtcatgatctcgtgagttagtaactttcaaaactgtactttatataataagatatatgcttatatgtttcatatatatatatatatatatttattagatcgacaataacattaaactatcattactagtttacttttttaaatatgattttaataagtatcatataaatgtacaaagtgtatacaatacatgtttttatatatatatatatatatatattttttttatatataagcataaatatatagacgaacaaacaatgtagacagacctaggcacctagctatgatctatgcatacggacgaaccctattatacgtacgcatgattattgaatataccttcaaatataaacttgtgagcgtaaggttattatgttttcaatactgacgaatgacgattgtgattcatgttttgaaaaattaataaagtttaaaccatcgaatgcgtaaaccaattattcatcttttaccttaggaaaaagctggatatcattatcatatatttattaagcatattaaaccagaccaatgatttaagtcgaaaatgacagctttcaagctttgcttattggccaataaataacaaactaaaaaaagaagaaattttttaaaacgaactggtgaagtctcgtgttatcacgtgcatggagccagtcagacagagacatcatcaggtgcatgatggaccacggtagtccatttcttccctacaaccatacacgtggcctttttacatttaacagtcaaacatctggtcaacaacactctcatctgggcttccttacatcaaaccctactttttttttgtttatcaaaggcccaattgtatataagtgaaaagtttccaatgggcctttcaaggattattcccagcccaatatttctggagattaggtttatttatcatcgccaccaaagaaatttgagccgaagcttcataatcgtagtctgaggtatttttctcgatcctcaaacatttccaacacctaaaggcttattcgttacagatttctcaccaatcttcggatttattgtgctcgtacgataagcatatattagtaaatttagtggctatttaggaaatttctcgtttgatttcttgttgttgttgagatttgaatctgttgtttatggtttttgtgattacttggttttgcagagacaatgtcgacagtcggagaacttgcttgcagctacgctgttatgatccttgaagacgagggcattgccatcactgtatccttaaatctcttgacattttctgaatctcatgtcctagctattgttgtcgctatatcttgttttggttggatccttttcattatcgagacaacatggtgtgagtgtttattttaggtttatggagctctcttttgatgaaatagtcagtaccaagattcatgtttgctttggcacactcaattgttgggcatgtgttaaatgacctatctgcaaagttgttggtttagggttaggaattaggattcttttttactggatttaagaaacgtgtttgttctattagttttgatatgtaggttcaatgtttgggttaggtatccttaaccctattattgatagtctgataagattgcgactttggtcaaagcggctggtgttgagattgagtcttactggccaatgttattcgccaagatggctgagaagagaaatgtcacagaccttatcatgaatgttggtgctggtggtggtggaggcggtgccccagtgtctgctgccgcacctgctgctgctggaggagctgctgctgctgcccctgctaaggaggagaagaaggtacaaatttaaagaaacaaaaacattatattgttatatcttttagctaggtttgcttattgatactctctatgttgtttaattgtttgtaggacgaacccgcagaagagagtgatggagatcttggtttcggcttgttcgattagttgtctcctttcattttacgtttcatatgttctattgctttagttgctttgagattttaagttttgtcatttcgacactactacagtttactcttatatcatgtactggagttagcaattggctcacgaccttctttgtagttcatgagagttatcttatgctcaaaatgcattggagcttattgaatttgacttttggattcagctgcgtcttctttcctaccaaatctcagtctatttataatttgatcttgaaatagaaaagaagaacaaaaaatcaggaaagatatgaacatctgttacaacttgataattcagtggatacgcaggtttcatgaaccatggtttctcagaagttttgtaagttttttactgattatactaatgttgtcaaatgtataaaaagtaaaaattgaaccttctgcataatccagaggctttcattttttttttcttttcttcttgtgatggactcgttttagctgaaattagaacgtcggttagtaccggcggagaatgttcggagtcgagtcagtcagagagttctgataataccaaacggctactttgaagttcacggctattaagaagtcgcacatg

SEQ ID NO: 17655 - DNA, 3000 bp, Unknown
  misc_feature (1)..( 3000): 2750-1469P.txt file - cDNA_ID_1810649; gDNA_ID_2926139; Annot_ID_197367
cttaatgctcttcttgcctatataattcaaagttaaatccaaaacctgtttgattactaattaatcaaatgtagttaagggagaattttgctcaccaaatagcctctgaaaccagtttggattacaacagctgcgtaatcttctcttgcggtataagtacgtcttgtaagatttggtaactccttcgttgtcgaaggaggatgagtttccgatgcggcggagacggtggccggcggtgtagatgcgtcgtacctctgttctgtaacagaggataaaacggttgggttgatgatcgtcgttgtttctgtggatttctgcgccggagcgtcttttccgacgccggaggtcttcaccggagagtcatgattcgtagattttctaaataaccaacgtctcttctctttcttctgcagaaacagagcatatgaattatagtaatatacaaaacagagaaacaagaaacagagcatgtgaataaaaaaacaagaattaagaagcaagatctcgagactagagaaagtatacgaaccttgtcttcatcttcgtcgacttcattaccatgagcattgttgttgtgttctttcttggtgggagatcggaaagctcgtttcacggcagtgagccaagaagaagaagaaccgctcttcttacccattggaggttaggtaggatttaagattctcaacagagtcaagacatggtagtagtagtagttatgttcctgttttgggacatagaagagaggatgagagatttggtttagattcttgcgcagaaatgaggaagagagagaggagagtggtgggtggatcttgggaaacagaaatgtcaataaatttggaaggttgcttaagggagacttctgactctgaccacctctttaactgcgaccatgacagcgatgactcttcctcttcatttactttctccacttcatttattttgttatttttgtttaactcatttcactaaactagttatatcacattattattattatatcatgtacctacttgcatttgttgtacattcaattctagaagatttgttgctgttaaattgaaagatagagttttgttgttttgagagttaattttaaacaaatacaatataaactaattctatttcattatgcaaaacaattcttctttcccttggttcgattatgcaattatatttcatacattctaatttttgggttttcttaagatatgcatgaatattattctacttatatatatatatatatactagataaggcccgcctaagatataaatttattcaaatatgtattgataatatttaaaatttgaatggtaaatagtgatccacacttttctaatgttaaatttagtaatttttgaattaaataaaatttcaatcatatacattcaattttactatacattttaactatttcttttatcataataaactgccttttaactctatacactccaacttattgatgatatttgaattttaaatagtaactcatatttttttcagtatttaatttagtatttctttaaaataaattttaatcttacaacttcgattttacaatacaatttaaatattattttttatcataatagaatacaatttaattcgattgtatacaattcaaatacaatccaaattttcaatacaaatacaatttaattctatacactccatcttattgttagttttcctttttaattaataaaattataagttaaatttttagatatagaaatataaattagtatatgtaaatatgtttatttattttttaaagaattttttttgacatatgtcaacatctcaatgatagacctgacacgtgtcatgatctcgtgagttagtaactttcaaaactgtactttatataataagatatatgcttatatgtttcatatatatatatatatatatttattagatcgacaataacattaaactatcattactagtttacttttttaaatatgattttaataagtatcatataaatgtacaaagtgtatacaatacatgtttttatatatatatatatatatatattttttttatatataagcataaatatatagacgaacaaacaatgtagacagacctaggcacctagctatgatctatgcatacggacgaaccctattatacgtacgcatgattattgaatataccttcaaatataaacttgtgagcgtaaggttattatgttttcaatactgacgaatgacgattgtgattcatgttttgaaaaattaataaagtttaaaccatcgaatgcgtaaaccaattattcatcttttaccttaggaaaaagctggatatcattatcatatatttattaagcatattaaaccagaccaatgatttaagtcgaaaatgacagctttcaagctttgcttattggccaataaataacaaactaaaaaaagaagaaattttttaaaacgaactggtgaagtctcgtgttatcacgtgcatggagccagtcagacagagacatcatcaggtgcatgatggaccacggtagtccatttcttccctacaaccatacacgtggcctttttacatttaacagtcaaacatctggtcaacaacactctcatctgggcttccttacatcaaaccctactttttttttgtttatcaaaggcccaattgtatataagtgaaaagtttccaatgggcctttcaaggattattcccagcccaatatttctggagattaggtttatttatcatcgccaccaaagaaatttgagccgaagcttcataatcgtagtctgaggtatttttctcgatcctcaaacatttccaacacctaaaggcttattcgttacagatttctcaccaatcttcggatttattgtgctcgtacgataagcatatattagtaaatttagtggctatttaggaaatttctcgtttgatttcttgttgttgttgagatttgaatctgttgtttatggtttttgtgattacttggttttgcagagacaatg

SEQ ID NO: 17656 - DNA, 3003 bp, Unknown; identical to SEQ ID NO: 16283
  misc_feature (1)..( 3003): 2750-1469P.txt file - cDNA_ID_1810649; gDNA_ID_1621198; Annot_ID_57609

SEQ ID NO: 17657 - DNA, 3000 bp, Unknown; identical to SEQ ID NO: 17655
  misc_feature (1)..( 3000): 2750-1469P.txt file - cDNA_ID_1810649; gDNA_ID_2926139; Annot_ID_138967

SEQ ID NO: 17658 - DNA, 3000 bp, Unknown; identical to SEQ ID NO: 8160
  misc_feature (1)..( 3000): 2750-1469P.txt file - cDNA_ID_1810653; gDNA_ID_1621198; Annot_ID_57608

SEQ ID NO: 17659 - DNA, 3003 bp, Unknown
  misc_feature (1)..( 3003): 2750-1469P.txt file - cDNA_ID_1810653; gDNA_ID_2926139; Annot_ID_138968
tgtttttgtttctttaaatttgtaccttcttctcctccttagcaggggcagcagcagcagctcctccagcagcagcaggtgcggcagcagacactggggcaccgcctccaccaccaccagcaccaacattcatgataaggtctgtgacatttctcttctcagccatcttggcgaataacattggccagtaagactcaatctcaacaccagccgctttgaccaaagtcgcaatcttatcagactatcaataatagggttaaggatacctaacccaaacattgaacctacatatcaaaactaatagaacaaacacgtttcttaaatccagtaaaaaagaatcctaattcctaaccctaaaccaacaactttgcagataggtcatttaacacatgcccaacaattgagtgtgccaaagcaaacatgaatcttggtactgactatttcatcaaaagagagctccataaacctaaaataaacactcacaccatgttgtctcgataatgaaaaggatccaaccaaaacaagatatagcgacaacaatagctaggacatgagattcagaaaatgtcaagagatttaaggatacagtgatggcaatgccctcgtcttcaaggatcataacagcgtagctgcaagcaagttctccgactgtcgacattgtctctgcaaaaccaagtaatcacaaaaaccataaacaacagattcaaatctcaacaacaacaagaaatcaaacgagaaatttcctaaatagccactaaatttactaatatatgcttatcgtacgagcacaataaatccgaagattggtgagaaatctgtaacgaataagcctttaggtgttggaaatgtttgaggatcgagaaaaatacctcagactacgattatgaagcttcggctcaaatttctttggtggcgatgataaataaacctaatctccagaaatattgggctgggaataatccttgaaaggcccattggaaacttttcacttatatacaattgggcctttgataaacaaaaaaaaagtagggtttgatgtaaggaagcccagatgagagtgttgttgaccagatgtttgactgttaaatgtaaaaaggccacgtgtatggttgtagggaagaaatggactaccgtggtccatcatgcacctgatgatgtctctgtctgactggctccatgcacgtgataacacgagacttcaccagttcgttttaaaaaatttcttctttttttagtttgttatttattggccaataagcaaagcttgaaagctgtcattttcgacttaaatcattggtctggtttaatatgcttaataaatatatgataatgatatccagctttttcctaaggtaaaagatgaataattggtttacgcattcgatggtttaaactttattaatttttcaaaacatgaatcacaatcgtcattcgtcagtattgaaaacataataaccttacgctcacaagtttatatttgaaggtatattcaataatcatgcgtacgtataatagggttcgtccgtatgcatagatcatagctaggtgcctaggtctgtctacattgtttgttcgtctatatatttatgcttatatataaaaaaaatatatatatatatatatatataaaaacatgtattgtatacactttgtacatttatatgatacttattaaaatcatatttaaaaaagtaaactagtaatgatagtttaatgttattgtcgatctaataaatatatatatatatatatatgaaacatataagcatatatcttattatataaagtacagttttgaaagttactaactcacgagatcatgacacgtgtcaggtctatcattgagatgttgacatatgtcaaaaaaaattctttaaaaaataaataaacatatttacatatactaatttatatttctatatctaaaaatttaacttataattttattaattaaaaaggaaaactaacaataagatggagtgtatagaattaaattgtatttgtattgaaaatttggattgtatttgaattgtatacaatcgaattaaattgtattctattatgataaaaaataatatttaaattgtattgtaaaatcgaagttgtaagattaaaatttattttaaagaaatactaaattaaatactgaaaaaaatatgagttactatttaaaattcaaatatcatcaataagttggagtgtatagagttaaaaggcagtttattatgataaaagaaatagttaaaatgtatagtaaaattgaatgtatatgattgaaattttatttaattcaaaaattactaaatttaacattagaaaagtgtggatcactatttaccattcaaattttaaatattatcaatacatatttgaataaatttatatcttaggcgggccttatctagtatatatatatatatataagtagaataatattcatgcatatcttaagaaaacccaaaaattagaatgtatgaaatataattgcataatcgaaccaagggaaagaagaattgttttgcataatgaaatagaattagtttatattgtatttgtttaaaattaactctcaaaacaacaaaactctatctttcaatttaacagcaacaaatcttctagaattgaatgtacaacaaatgcaagtaggtacatgatataataataataatgtgatataactagtttagtgaaatgagttaaacaaaaataacaaaataaatgaagtggagaaagtaaatgaagaggaagagtcatcgctgtcatggtcgcagttaaagaggtggtcagagtcagaagtctcccttaagcaaccttccaaatttattgacatttctgtttcccaagatccacccaccactctcctctctctcttcctcatttctgcgcaagaatctaaaccaaatctctcatcctctcttctatgtcccaaaacaggaacataactactactactaccatgtcttgactctgttgagaatcttaaatcctacctaacctccaatg

SEQ ID NO: 17660 - DNA, 3000 bp, Unknown; identical to SEQ ID NO: 8168
  misc_feature (1)..( 3000): 2750-1469P.txt file - cDNA_ID_1810656; gDNA_ID_1621198; Annot_ID_57607

SEQ ID NO: 17661 - DNA, 3003 bp, Unknown
  misc_feature (1)..( 3003): 2750-1469P.txt file - cDNA_ID_1810656; gDNA_ID_2926139; Annot_ID_138969
aatcttacaagacgtacttataccgcaagagaagattacgcagctgttgtaatccaaactggtttcagaggctatttggtgagcaaaattctcccttaactacatttgattaattagtaatcaaacaggttttggatttaactttgaattatataggcaagaagagcattaagagcattgaaagggctagtgaagttacaagcactagtgagaggtcacaatgtgaggaagcaagcaaagatgactttaaggtgtatgcaagctctagttcgagtccaatctcgtgtgcttgaccaacggaaacgcttgtctcacgatggtagtcgcaaatctgccttcagcgacactcaaagtgtgctcgaatctcgttatcttcaagaaatatcagacagaagatccatggtgagtgatctctataagtttcagaacaccattgttgctctgtttcaacgaccatttttgctctgtttcagcaatcagctatataaagctaacattttgaaatgccttttttgttgttgtgtagtcaagagaaggaagtagcattgcggaagattgggatgatcgaccacacacgattgaggaagtgaaagcaatgttgcaacaaagacgagacaatgcgttgagacgtgagagtaacaatagtatatcacaagctttctctcaccaggtaatagatatgaattcatattaatcgtttgtttgttttcggtaatttgattcgtttcggtgtttgatttcggtgaaaggttcggagaacaagaggtagttattctacaggagacgagtatgaagaagagagaccgaaatggttagacagatggatggcttctaaaccgtgggataaacgagcttcaacggatcaaagagtaccaccggtttacaaaaccgtggagatcgatacttctcaaccgtatttaacccgcggtaactcgagaaccggtgcaagtccaagccgtagccaaaggcctagttcaccatcaaggaccagccaccattaccaacaacacaatttctcatcagctacaccatctccggctaaatctagaccgatacaaattcgatccgctagtccgcggatccaaagagatgatcggtcagcgtacaactacacatcaaacacacctagcttgagatctaactatagtttcacagcaagaagtggttatagtgtttgtaccactactactactgctacaaatgctgcattgccaaactacatggcgattacggaatctgctaaggctagaatccggtctcagagtgcaccaaggcaacggccttcaacacccgagaaagaacgtatcagttcagctagaaaacggctttcgtttccagttccaccgctgccgcagcaaatggatggtcagagtttaaggagtccaagtttcaagagtataggtggctcacaattgggtgcattggaacaacaatcaaattactcttcttgttgtactgagtctcttggtggtggtggagagatatcacctgcttctactagcgattataggcgatggttaagatgattccataatccaaccaaatcaaccggtcatgatttttttcctcccttttttttttttgttatatataaataaaaacaatttgacaaaaagaaccataactttttcagtttttattgatgatctttgagattggtgtgtaattttgtttgtgtttatgtttgtgtgtgtgaatttgtagcttataattggaagtgtttactaactaatctctatataaatatgtatgctcatatttttatctataaatgttgcaattaggatgtgaacaatagtttatcaatctgtcatggtatctttgttaattatatggaatctttttagtataaaataacgaaaattttcactggccttatttgtttttacatgcaaagtgaagttgttaagaaaaccataaaaaaaagctgcaactttgcaacttgagatccacgagcaaggaacattacccatgtgacatgattcctacatgatcagtcttgtcttctacgttatacactactactctatatccacctaaatataaattaaatgcttctgaaatggaataattttaaaacagcacgtagttttcatatcaccaaagaaaacggcagggctggcaaaatcacgaattttttaaacaggtataataaagaactagaaaacactaggcccaataaaaacagtgggcttaaaaagcgttttgatttagggttaatgtgtgcgtaacatgtgatcatagcccacgagtgggtaaggagtgtcttcatcttcttctaccggagatcgagaaatagccgacgaagttttgttttttgagtaaaacagtattcgtcggacaaccgaagcgaaatccctaatttcccacaacacgaaataccaatttccccaattcgaaaacaaacacggtctggtatgccgagaaaattctccatttctacttttcttatacatttgttttggttgtttcatataaatacttctcatcttcttcgattttgttaccctcccccaaacaatataaaaaaaaaaggataaaccctagtttctttctcagactgtttcaagttcagatttttatttctgagcttaactggtgagtaatttgctttctggagagatgtgtgagttacgatctctaatttcattggttgcttcggttatggcttgattcttctctctgttatcaatttggatctggaatcatatatatacatacacaaaaactctgctctttttcaaagttttgatttttatctcatttgacgcttgtttcgtgatagcaatgaactacaattcttctgtatctctgccactaaaagaacctgaatttagtttgaaccatcctttcttctccacatttttttaaacgaaaaagagcagttctcatatcacccattataagcttttttttttggtgtatggtcctatagcatttttttaacagtgattacctgagcttcgtggttaaaaaagagtatggttattggatgaccagatg

SEQ ID NO: 17662 - DNA, 3003 bp, Unknown
  misc_feature (1)..( 3003): 2750-1469P.txt file - cDNA_ID_1810664; gDNA_ID_1621198; Annot_ID_57603
taaataaatctcggtcttcatttcatcttatcttaaggtgtggcttgttgttgttgttgttgttgttgttgttgttgttgttgttgttgttgttcatatatatatatatatatatatatatgtctcatgatgattaattgtacgcttatgcccgatcataaaaatagaaaatcatcatcttgtaataatattaaaataatatgtatgttgaacaattaatatttagttatttactatactcaatctcttctatgagttgacttgtcaattgaaattttataattttattaatgatttggagaagaaagtaattttacatttttccatttttattttaaaaatcatttttattttaaaaatcactttagttcaggttttttgttgctaaaatgtaaatattcataagaataaaaatgtttaggtttacagttatatattttagacttatagacttggtcttatggcaaaaaaaaaggattaaaacatggaaggaaaaacaatcagtttgtcgactcaacgtatgctatgaagcaaacaatgttagagaaaaagataaagtgatacaagattttgaagttcctccaaagtgagttacaaaagatgaaatttggcaatgaaaatttataaaaacttcaaaagtggaagcctttcactggaggccaatggactgattctatcggctttgccaaactattctacaacaggttaatcatttggagaagaaagtaatttagtggttatttcacatatataccaccattcatcaatataacttctatgttacgtttccgttcataaagatatgtgaaaacgaagttcctgtaaatgaatgattaagttaagaaatttattcgctaaatctataaattcatctgatcaacattgttgtctacgcaattgttgttcattaaatctttacggtcacaaaaataacaacctcatgatatgttagaaaaactttaatcatacacttgcaaaaaaaagtgaagcaaaatctaccataaatatgcaattgtgcagtggtcttctcctcttaattttgtttgaagtacgtatattcgaaactttatttcgattataatttttcgtacgattctttataagtaaagcaaaataatgatggattgaagaatcttgaaaatggaaagaaatggacgagaggcttttgaccatttgtatggccagaataacaacactcactaccaaatacaataacgtgattttgtttaatagattagatgcggtaggaatatattattcttcgtgaactaaaaccatgttttataacgacaaaaaaaaacccatgttttataagtttatgggccaaaattgggcttttgtattataaacatgtttacggaagtattcagctaagtatatataaaaaaaaacaattacactaatttatttaaattttattattacctacttacaattagtaaaatttaaaattaacaaaaaaaaaacttttacttacttttagttattgttttaagaaaaaacatcattaattaccctacttttttttttaatactaggaggttctaagccaaaacatcttaattattatattgtttatatgtctaataatatccataaatgtattaaaaaaacttaaaacataaactaaagggtaatagatcataatattattgaatggagtaagaaaatgtataaattataattcaaaaagagaactataatctgcttttctacccaaatgaagtaaaataagacatcaatttgcatttcaatggtcagttttaaaggtaaaattaaagacgttaaacacgtgtaatgtaaaagagatcactcatgagtcatgaccaaccatattcttagtttatataagtaattcacaccccttaaaaagaaatatagtctataatcaatcatacttagcatgaaaacgatgatcaagtttctgctgttaatactggtgatctctcctatgtcgatatgcgccgagaaggacatgatgataaatgaatgccacaatgcagacgtcccagccatatgcatgcaatgtcttgaatccgacccaaactccattcacgccgaccatataggcatagctggcatcgtcataaactgtcttgaatcccacctccatatcatcaccaagcaagttttcacttacaaattataaccaatatacagaaatatcctctaatatatcaattttttcatttgtgtagtaacataacgaatttatcgtcaaagaaagataaaggtgaagtgaaaacagctctggagatttgcaaaaaagacttgtcgacgaatgcatctacaatactgtcggaagccaaaacaagtttgaaaaccggtgattatgataaaaccaacaaatcgataaagcttgcgcttggctttcctctgagatgtatgttcaatctcaaacgtgtcaagttcacgtctccccaactatttagtcaaatcaatatctatgctcaactctctgacgctgctatgaggatcattgatcgcttctaataagtaataactccttattgttttctatataactcaacttcgatcaatgcttaccccaatttgaataaatcatttcctttatgaaatttataaagtcacatatatccatttgttgtagctctcatgttttttttttcttttcaaatttgtcaaaataagttttcgtttgaaccatcattcaatataaatctaaatgatatattgtcttttttttttttttttttttggcaaagaatgatatattgtctatttcatcaaagttggaccactatacgataaattgttgttcttataacgttaaagtaggaaaacagttcagttttcacgtgactaacttactactattggaatatttatcataaactttaattcacgaaaatcattaatgaaaatttgatattactactataatatcgtcttctctattaatttagaatcttattcatccttttccacttgtcttctctaaccctctaaattctctttggtcgggatcactggaaagaaatg

SEQ ID NO: 17663 - DNA, 3000 bp, Unknown
  misc_feature (1)..( 3000): 2750-1469P.txt file - cDNA_ID_1810664; gDNA_ID_2926139; Annot_ID_138973
ataaatctcggtcttcatttcatcttatcttaaggtgtggcttgttgttgttgttgttgttgttgttgttgttgttgttgttgttgttgttcatatatatatatatatatatatatatgtctcatgatgattaattgtacgcttatgcccgatcataaaaatagaaaatcatcatcttgtaataatattaaaataatatgtatgttgaacaattaatatttagttatttactatactcaatctcttctatgagttgacttgtcaattgaaattttataattttattaatgatttggagaagaaagtaattttacatttttccatttttattttaaaaatcatttttattttaaaaatcactttagttcaggttttttgttgctaaaatgtaaatattcataagaataaaaatgtttaggtttacagttatatattttagacttatagacttggtcttatggcaaaaaaaaaggattaaaacatggaaggaaaaacaatcagtttgtcgactcaacgtatgctatgaagcaaacaatgttagagaaaaagataaagtgatacaagattttgaagttcctccaaagtgagttacaaaagatgaaatttggcaatgaaaatttataaaaacttcaaaagtggaagcctttcactggaggccaatggactgattctatcggctttgccaaactattctacaacaggttaatcatttggagaagaaagtaatttagtggttatttcacatatataccaccattcatcaatataacttctatgttacgtttccgttcataaagatatgtgaaaacgaagttcctgtaaatgaatgattaagttaagaaatttattcgctaaatctataaattcatctgatcaacattgttgtctacgcaattgttgttcattaaatctttacggtcacaaaaataacaacctcatgatatgttagaaaaactttaatcatacacttgcaaaaaaaagtgaagcaaaatctaccataaatatgcaattgtgcagtggtcttctcctcttaattttgtttgaagtacgtatattcgaaactttatttcgattataatttttcgtacgattctttataagtaaagcaaaataatgatggattgaagaatcttgaaaatggaaagaaatggacgagaggcttttgaccatttgtatggccagaataacaacactcactaccaaatacaataacgtgattttgtttaatagattagatgcggtaggaatatattattcttcgtgaactaaaaccatgttttataacgacaaaaaaaaacccatgttttataagtttatgggccaaaattgggcttttgtattataaacatgtttacggaagtattcagctaagtatatataaaaaaaaacaattacactaatttatttaaattttattattacctacttacaattagtaaaatttaaaattaacaaaaaaaaaacttttacttacttttagttattgttttaagaaaaaacatcattaattaccctacttttttttttaatactaggaggttctaagccaaaacatcttaattattatattgtttatatgtctaataatatccataaatgtattaaaaaaacttaaaacataaactaaagggtaatagatcataatattattgaatggagtaagaaaatgtataaattataattcaaaaagagaactataatctgcttttctacccaaatgaagtaaaataagacatcaatttgcatttcaatggtcagttttaaaggtaaaattaaagacgttaaacacgtgtaatgtaaaagagatcactcatgagtcatgaccaaccatattcttagtttatataagtaattcacaccccttaaaaagaaatatagtctataatcaatcatacttagcatgaaaacgatgatcaagtttctgctgttaatactggtgatctctcctatgtcgatatgcgccgagaaggacatgatgataaatgaatgccacaatgcagacgtcccagccatatgcatgcaatgtcttgaatccgacccaaactccattcacgccgaccatataggcatagctggcatcgtcataaactgtcttgaatcccacctccatatcatcaccaagcaagttttcacttacaaattataaccaatatacagaaatatcctctaatatatcaattttttcatttgtgtagtaacataacgaatttatcgtcaaagaaagataaaggtgaagtgaaaacagctctggagatttgcaaaaaagacttgtcgacgaatgcatctacaatactgtcggaagccaaaacaagtttgaaaaccggtgattatgataaaaccaacaaatcgataaagcttgcgcttggctttcctctgagatgtatgttcaatctcaaacgtgtcaagttcacgtctccccaactatttagtcaaatcaatatctatgctcaactctctgacgctgctatgaggatcattgatcgcttctaataagtaataactccttattgttttctatataactcaacttcgatcaatgcttaccccaatttgaataaatcatttcctttatgaaatttataaagtcacatatatccatttgttgtagctctcatgttttttttttcttttcaaatttgtcaaaataagttttcgtttgaaccatcattcaatataaatctaaatgatatattgtcttttttttttttttttttttggcaaagaatgatatattgtctatttcatcaaagttggaccactatacgataaattgttgttcttataacgttaaagtaggaaaacagttcagttttcacgtgactaacttactactattggaatatttatcataaactttaattcacgaaaatcattaatgaaaatttgatattactactataatatcgtcttctctattaatttagaatcttattcatccttttccacttgtcttctctaaccctctaaattctctttggtcgggatcactggaaagaaatg

SEQ ID NO: 17664 - DNA, 3000 bp, Unknown
  misc_feature (1)..( 3000): 2750-1469P.txt file - cDNA_ID_1810672; gDNA_ID_2926139; Annot_ID_197382
ctaaaagcaagtgatagaaccaaatcttgattggaatctacaatgtatctagagaatccttatgtcgccatggcaagcaagaaagagatcaaggaaaaataagatcgtgactaaacattggccaatgttctgtactttttggtgaatattatagaatatgtgttcacctggaaatgctggtgtcacaagctttcctttttctcttgagaggtttaaggccaaggttcagagctaaatcctcaacaggaaccttgatcacatcgtttctaacaccgatatcagtagcatacctactcatacaatacatcccagcagtgacagttgctacaccaacaggatttggaatcaacaatgtgagaggtgacgagagtagtgcagctagaggagcacctatgatagaactggcttgaccacttctcccaaccccgttcttatccagaatgagcaatcctgtcttgcagtagagagcaaaatcttcgcagttattctggaagacattgtagttaccaaatccgttttggagaaggtgcattgctctatggatgactgtttgaagcgggtcagatggagcagttgtgcacgtgccaccgcggaatctggtgaggaaaatcgatgagctgactccataatcaaaacggtagagagaacctttcttgagaaagcagtctaggcaagaaagtactactccactctttggtcgtttatatccacagtcaggatatgtaggacaaggagcttctgaagaatcattaacctctgaaactgaagaagacgaagaagaagaagaagaagcgagtgtaggagatatcaagctgtgctcaggtttgaaatgaaccactttgcaaccaccaacaaatacgcctacaaatgtggaaaatttagaagaaaacaaaatgctttcttcagttgaaatgtcaacaaaagcaatcaaaatctatttgctaccaccattgactatagaaggacaagtcatcatcagtacgattgaatccagagaaaacaaaagatgagactttttgaagatccgtttcaataaagtcaaaaactttggcatgagggaaaaagacctaataacaaaacagagtttttgacacaataacccaataagaaaccaaatgacggtttgtttcttcatctctgcaacggaaagaggtaacataaaccctaaaatttacacaaagaagatccaaattgaggaaaaactatggatgattcatgccaaaagctcattgatgatgaaatcaaaaggaagaaatcgaaggtaccgtggtgagaataagcgaagacggctcgataagtgtagatgtgatcaccaggtttaagctcgtctctctcgactttgttcgtgagtacacccattgcttcgtcttcctcaaaataaaagctttccctttggcttgtggaaattgcagtgtacaagtagattcttacgtcagcggcagagatatgattgggcgatcaaaccggagactgttgaaccaatgccgttacagaatcttttgacggcgttaactgttagatgacgacaatcgctgtggagggtaatatggtcaatatacgaaaaggcttttgtgaacacgacgccgtttttaaagtgtccctggaatcttattcttcctttcttggtgtattggactcatattgggcttaaagaaaacgctctacggcctaaatatcgaaaagcgtattatttatctatcaaccaattgttattttgctcattgccaactaatgaacaatgcttagaattaatcaaattttctaatctgaacgaaggaagatataagtaggagttttatacaatcgataattgtatacttaattattattataagctatattggttaatgagtttctttggagtgagtatataataagaaaaatatatatagagccgagcgtagtggaggtagatcaggcaataatggaagaaacttcgaggaacttcgctttttgttgtaaccacaaaagcgaatataacaattaatacggtttgagtaggcttgcagattttcagacagcactcctactgacagatgtttgaaaattaaaatatttattgcgattattataacaacactgtagtaaggaacttttgggttatttcattggtttattaaagtctttaatcgttgactttttaatttcattattatctgtaaactcgtattttaagtgattttaataataataatttgaaagtaaaatggaatatcccccgatatcaagcgagccgtacgggaaagggaaagtcaaacatgtaataacagttttaaatgaagggtactacagtcttttcaaggggttaataacgttccgttttctttatggacagccaatcagatgggaccacgtatatcactattaccaaaccttcgcttttctggaaagtggaaagcaaaaccacagagagaagagaagaagaacaaagcaaaatatattcaaaatttaagcaataaaggcaaaaattaaaagacaacgagtttcaaacacgaaaccacgacttgtccaaatcaagatttgtcctttttcctttttagtggtagaacgcgaatcaaatttgggaataaaattttacttcttactttttcaaaaattcttgggtcttcttcagctttgtctccaagcaaacttttagtcaaatcatttttttctttcttgatggactttctttcatgtttgatatttcaatgacgaaagctctaactggtttttcttggaatttaggtaagaatttatactctgtttctctctctgtttaactcagttcttgttttgggtttctgggtttgtattttttttagatctttgattatttattatgttctatgttgtaaaagatatcaaaccgtcaataaaaactgtaactttatttgttgtttaaaaattgatatttcattgtttgattgaaatttttctacaggaatttgataaacggtttctcacatacacaagaagaaaataaccgttttgagttaaagtaaagcttttgaaccaatg

SEQ ID NO: 17665 - DNA, 3003 bp, Unknown
  misc_feature (1)..( 3003): 2750-1469P.txt file - cDNA_ID_1810672; gDNA_ID_1621198; Annot_ID_57600
aggctaaaagcaagtgatagaaccaaatcttgattggaatctacaatgtatctagagaatccttatgtcgccatggcaagcaagaaagagatcaaggaaaaataagatcgtgactaaacattggccaatgttctgtactttttggtgaatattatagaatatgtgttcacctggaaatgctggtgtcacaagctttcctttttctcttgagaggtttaaggccaaggttcagagctaaatcctcaacaggaaccttgatcacatcgtttctaacaccgatatcagtagcatacctactcatacaatacatcccagcagtgacagttgctacaccaacaggatttggaatcaacaatgtgagaggtgacgagagtagtgcagctagaggagcacctatgatagaactggcttgaccacttctcccaaccccgttcttatccagaatgagcaatcctgtcttgcagtagagagcaaaatcttcgcagttattctggaagacattgtagttaccaaatccgttttggagaaggtgcattgctctatggatgactgtttgaagcgggtcagatggagcagttgtgcacgtgccaccgcggaatctggtgaggaaaatcgatgagctgactccataatcaaaacggtagagagaacctttcttgagaaagcagtctaggcaagaaagtactactccactctttggtcgtttatatccacagtcaggatatgtaggacaaggagcttctgaagaatcattaacctctgaaactgaagaagacgaagaagaagaagaagaagcgagtgtaggagatatcaagctgtgctcaggtttgaaatgaaccactttgcaaccaccaacaaatacgcctacaaatgtggaaaatttagaagaaaacaaaatgctttcttcagttgaaatgtcaacaaaagcaatcaaaatctatttgctaccaccattgactatagaaggacaagtcatcatcagtacgattgaatccagagaaaacaaaagatgagactttttgaagatccgtttcaataaagtcaaaaactttggcatgagggaaaaagacctaataacaaaacagagtttttgacacaataacccaataagaaaccaaatgacggtttgtttcttcatctctgcaacggaaagaggtaacataaaccctaaaatttacacaaagaagatccaaattgaggaaaaactatggatgattcatgccaaaagctcattgatgatgaaatcaaaaggaagaaatcgaaggtaccgtggtgagaataagcgaagacggctcgataagtgtagatgtgatcaccaggtttaagctcgtctctctcgactttgttcgtgagtacacccattgcttcgtcttcctcaaaataaaagctttccctttggcttgtggaaattgcagtgtacaagtagattcttacgtcagcggcagagatatgattgggcgatcaaaccggagactgttgaaccaatgccgttacagaatcttttgacggcgttaactgttagatgacgacaatcgctgtggagggtaatatggtcaatatacgaaaaggcttttgtgaacacgacgccgtttttaaagtgtccctggaatcttattcttcctttcttggtgtattggactcatattgggcttaaagaaaacgctctacggcctaaatatcgaaaagcgtattatttatctatcaaccaattgttattttgctcattgccaactaatgaacaatgcttagaattaatcaaattttctaatctgaacgaaggaagatataagtaggagttttatacaatcgataattgtatacttaattattattataagctatattggttaatgagtttctttggagtgagtatataataagaaaaatatatatagagccgagcgtagtggaggtagatcaggcaataatggaagaaacttcgaggaacttcgctttttgttgtaaccacaaaagcgaatataacaattaatacggtttgagtaggcttgcagattttcagacagcactcctactgacagatgtttgaaaattaaaatatttattgcgattattataacaacactgtagtaaggaacttttgggttatttcattggtttattaaagtctttaatcgttgactttttaatttcattattatctgtaaactcgtattttaagtgattttaataataataatttgaaagtaaaatggaatatcccccgatatcaagcgagccgtacgggaaagggaaagtcaaacatgtaataacagttttaaatgaagggtactacagtcttttcaaggggttaataacgttccgttttctttatggacagccaatcagatgggaccacgtatatcactattaccaaaccttcgcttttctggaaagtggaaagcaaaaccacagagagaagagaagaagaacaaagcaaaatatattcaaaatttaagcaataaaggcaaaaattaaaagacaacgagtttcaaacacgaaaccacgacttgtccaaatcaagatttgtcctttttcctttttagtggtagaacgcgaatcaaatttgggaataaaattttacttcttactttttcaaaaattcttgggtcttcttcagctttgtctccaagcaaacttttagtcaaatcatttttttctttcttgatggactttctttcatgtttgatatttcaatgacgaaagctctaactggtttttcttggaatttaggtaagaatttatactctgtttctctctctgtttaactcagttcttgttttgggtttctgggtttgtattttttttagatctttgattatttattatgttctatgttgtaaaagatatcaaaccgtcaataaaaactgtaactttatttgttgtttaaaaattgatatttcattgtttgattgaaatttttctacaggaatttgataaacggtttctcacatacacaagaagaaaataaccgttttgagttaaagtaaagcttttgaaccaatg

SEQ ID NO: 17666 - DNA, 3000 bp, Unknown; identical to SEQ ID NO: 17664
  misc_feature (1)..( 3000): 2750-1469P.txt file - cDNA_ID_1810672; gDNA_ID_2926139; Annot_ID_138976

SEQ ID NO: 17667 - DNA, 3003 bp, Unknown; identical to SEQ ID NO: 17665
  misc_feature (1)..( 3003): 2750-1469P.txt file - cDNA_ID_1810672; gDNA_ID_1621198; Annot_ID_174776

SEQ ID NO: 17668 - DNA, 3003 bp, Unknown
  misc_feature (1)..( 3003): 2750-1469P.txt file - cDNA_ID_1810684; gDNA_ID_1621198; Annot_ID_57596
ttttctctattagtggagtttcgtgagtgagtgatcttgtgccatcgggattttgatcgttcctacttaaatttgagccggtatcgatctaaaatttcaagtaaacctagatttgaaaatcggatgctttaatctggatcactcaaatgtcgttgatgtagacatattatcacaacttgacgtttataaatagccagaatgaaataagaagatcgcttgaactttaagaactaatcgggggtgataattgagcagctaggatccattgtccttaaaacgttgtttatttagttgaatatgtaacggctatggagatctataatccggttttacatttcacatactctagattagtttcatataacggctatggaaatctttaaccatctatctaccagtatgcataagctaatttaaccttttaccaaaaaaaaagtatgcataagctattagatcatagcgtagtgttcattttgcagtagtcttgtccttgaaccgtactacatgagtccaccatatgattttttttttctcggctatggagttctagttcctttagtctattcttaatttgcagaatatctaggaagagttgctaattaattcccatgtttttggtattcaacagaaacattgttcaacagagatattaggaacaatcattcacaaaatgagaaggtaatttccgtatcaacagttactggatgaatctttatcttttctacttccactgaatagctttttctcccaattcagtgtactctctgattaaaatcgtgagtcattttgaactatatcattctcctttccagattttaatttattctaaaaacggtagaaactcagaatatgtagatcttcttttttttgtacaccaaatagataccttaaagtcagagtatgttttgcgcatatacatagattgtgagtgcttcgctaaagaatcagccgagacatttgctgatctgggaataaaactacaagagaagctagaaagcctattaatgcagataaatatgtcactcagaatatgtagataaatagtttaatttgctgacctttttggttctatgatttgaaattattctctgagacatattcttgattgatcaagttctttttcaccttttatgtccctctttttcccctataattcaaatcagattcttcttttatgatattacatctagttctttgttttttgaaattgataagtggagggataacaacgagactggacatggaagaaagttccaaaataaagtagctcatagtctgaggataataatctttaaatgtttctttggaaccttcattttcatttctttattacttttgtttcttgtctgtgctcgtttcaaatcgagtccattgcattacaaaactctctttcgggcctttgtgctctgccttaattttcttttgttatttactcttttctttgtcagaacaacaacaatatctaggcaaataaaagaggtttttaaattctataatcgttatcatagtttcattatttctatatgtttagacagaaatgttgtcttgattgaatcaaggttcctttcttagaaaaaaaagaaatgcatgtcggctttcatcttacttttaattggaataagtaaactaaaatctttattcatcacatgcatttgcatgtatatatatatgtatacgttatccattgcttttgctaggttcatgttcttttttttgtgcaataatggcttaatttgttaatccagcttgcagattgcaatttgactgcaaagtttccccacttccataactatatgtatgtgatatcaaatcaattcattatgacgagcgaactcttgacaactatctttgtcagtactctgctttatttggtcgtttttattttgcatgaaaaaggtcaaaaaaagctttactcatttggatattgattagtattacacaaagtcttagtttggatatattttctcaaatgtttccactgctttcaacattcatttgctttggggataagtcaaataccttgacaattaactaattccctaactaaatatctcacctttgtttattagtgcttttttggtgaattaagtgtttttaatttatcccgaccccattgtgatcttgttctgtcacatttaattacgtatatttagtagttttattactaccattttgatagacatatattcatgcatgttaagtaccaaacaatttgttgacagtttaggtatggcgtgtttggaggatttgaaaagttgatggagctccaagagaagatccaagtggctcatgtttcttcaggttactttgctttcatgttctattaacataaataatctctttggttggttccttatttttttcttctttatcggaaagttacatattacgttgtttcttagccacgcctgatttgaattaaaggctcactgaccaaaacatccaagcccaacttttgctaaagcatataagcatatacctatgtcagtttccggcgacttttcttttttgctcttttttgaaccaaaacaaatttctagctaatgtagaaatttatactttttaagaaaattactggacttgtaacaccattagtaataagataagatgagacatttgttttgtttatatgaaaatatagtcagtaataactgttttttatgttctcttttcaacttatttttaattctttttggctttcaactttgcttctttttgataaaagacacatatattgttcctaatctttattgtctttaattttgaaaaatgccacaattaaattttgaattaaaacttcttttaattgcccctttaatgttctccctgactcccaaatctacacgaaacactaggaatagagaaaaaacaaccctcgggtaaagacagagcataaaacacttgtagtgtagatataaaagacacacctcagagaagagaagagcagagagagagagagagagagagagagaaagaaagatccaacttccacaaagaaccatg

SEQ ID NO: 17669 - DNA, 3000 bp, Unknown; identical to SEQ ID NO: 8184
  misc_feature (1)..( 3000): 2750-1469P.txt file - cDNA_ID_1810708; gDNA_ID_1621199; Annot_ID_57629

SEQ ID NO: 17670 - DNA, 3000 bp, Unknown; identical to SEQ ID NO: 8183
  misc_feature (1)..( 3000): 2750-1469P.txt file - cDNA_ID_1810720; gDNA_ID_1621199; Annot_ID_57626

SEQ ID NO: 17671 - DNA, 3000 bp, Unknown; identical to SEQ ID NO: 8177
  misc_feature (1)..( 3000): 2750-1469P.txt file - cDNA_ID_1810732; gDNA_ID_1621199; Annot_ID_57623

SEQ ID NO: 17672 - DNA, 3000 bp, Unknown; identical to SEQ ID NO: 8177
  misc_feature (1)..( 3000): 2750-1469P.txt file - cDNA_ID_1810732; gDNA_ID_1621199; Annot_ID_174827

SEQ ID NO: 17673 - DNA, 3000 bp, Unknown; identical to SEQ ID NO: 8176
  misc_feature (1)..( 3000): 2750-1469P.txt file - cDNA_ID_1810740; gDNA_ID_1621199; Annot_ID_57621

SEQ ID NO: 17674 - DNA, 3000 bp, Unknown; identical to SEQ ID NO: 8175
  misc_feature (1)..( 3000): 2750-1469P.txt file - cDNA_ID_1810748; gDNA_ID_1621199; Annot_ID_57619

SEQ ID NO: 17675 - DNA, 3000 bp, Unknown; identical to SEQ ID NO: 8181
  misc_feature (1)..( 3000): 2750-1469P.txt file - cDNA_ID_1810748; gDNA_ID_1621199; Annot_ID_174816

SEQ ID NO: 17676 - DNA, 3003 bp, Unknown
  misc_feature (1)..( 3003): 2750-1469P.txt file - cDNA_ID_1810748; gDNA_ID_1620804; Annot_ID_168753
agatcagactataccgagacaacaacattagtaagttttggcatgttggtaaatattattgctctcaagtcttaagaaaatataatcaagttaaaaaagaaagattaagggggtgttattggttagtggattttaatagagttaaactctaacccaaatctaatgttattcattcattgattttaaatccattatttaaatcaagtgttattagttcttatacttacaatatcttcattaaaagactttaaaattaagtgttattggttttcatatttctaatgtttatattactagagtcttaattctaatgttattggttctcatattcacaatgattagttcaagtttcatgttattcatgtttgatagattttcacaaatacttttatttgaaaagatttgaatgaatctcaaactgatttcatgtgtaaattatagcaatcaaaatattgccttgtatcttgagattttcacaatcatacagtctcatgagaatattacatattgccttgttcctttgccaaaaactttctttttccttccacatctaggttcacgttacatctcggactttcttctctccttcttctttcttcttccctttcacggtaaagtctatctcttttcatcattatagtagtcatggctcgtgaatttgcttgagaacaaagtcacttttatcacttttgatcatactattatatatatttttattgtaggttttataatggaacgaaatctttgtgaggaagatgattcagatgtagatattatgttattgatggtggttggatccgttgatgcttatgaaagtcaaatcccacgtccgatgcgacgacaaatcacaaaaaagggacacgcttatatacaaaaggctttgaaagatgatcctattcattttcgtcaactatatcgtatgaatcctgaggtttttgcggaattatgtcatcttctccaaatgaaaacaggtttgaaaggtacaccacatgtatgtgtcgaggagatggttgctacctttttgataacagtgggccaaaattcaagatattgtcacacaatggacactttcaagagatcaaaattttcaacaagtattaatttccacaaggttctcagagctttaaacatgcttgcaccaacattgatggccaaggttacaaatacagtgccctcaaaaataagcaaaaccacaagattttatccttacttcaaggtacatatctttttgtgtgaataatatttcttgaagtcttatataaacagtttttaatttatgttaggactgtgttggagctattgatggcacacacataaatgcaatggtacaaggtcctgaaaaggctagttatcgtaatcgaaaaggagtcatttcacaaaacgtattagctgcttgtaactttgatcttgagttcatatatgttctaagtggatgggaaggttcggctcacgattcaaaagttctacaagatgctttaacaagaagaactaatagattgcaagttccagaaggtaatagattacaagttctaaaaggtgatttatcatatgataatttatttctaatagtgtgcttccatgtttcaggaaaatattatttagcagattgtgggtttccaaaccgacgtaatttcttagctccactacgaagtactcgttatcatctacaagattttcgtggtgaaggacgtgacccaacaaatcagaatgaattgtttaaccttcgccatgcatctttaagaaacgttatcgagagaatttttggtatatttaaatctaggttcttgatttttaaatctgcaccaccgttttcttttaagacccaagcagagatagttctttcatgtgctgccttacataactttcttcgacaaaaatgtcggtcagatgaattttcaagtgacgaagaagatgaaacagatgttgacaatgcaaatcagaattctgaagaaaatggtggtgaagaaaatgttgaaacccaagagcaagaaagagagcatgcaagacattggcgagcgaccatagctgcagatatgtggagagatgctactaatattggtagccaaagatagtaattcactttttataaagttcatgtatttgtctttctttggtgttgatggagacacttttcccgtgtttgagctgaaagatttatttttgaaccctttacactttcttttattattattatgaacgagttcttgtcgtgaaatgatatatgacatgcttccgggctaatctcatcgacataattagaaactgagaagttggccatgggaaaatggtacaagacatacaaatacagaaatgacaatgatgtcagcatgacacttgaccataacgttttaaattatgttctactcatatcggtggtggaataattataccttgacctaagaagtatgggtttatatgtattcttttgtaaacgtttaatactattaattatgaacgagttattctacctctatcatctatgttacagctaagcttttggagttatactgtaaaacattgttcattattcaaatcatatcaattaaaataaaaagtacaggatcatatcaattagaatattactttgatcatcataatattctagttgctactaaagaatagaatcatattacttagaatatatattaccatgatcatcataataatatcacaatctttttgttatattaacgtatatctttacgatcgcactatctctataaatgtcacgtacatctctcttctcattctctaagcatacaagctcattcgactgcaaagaaaaaggttcacttgttcttacttttttcttttgttcttatttacagaatcatatgttggaagtgtgatattgattaacttttgaatagttaacttttgtttcccgtctcactatttccttgttttttgcattgacgtatggttattttttattaaaatattgcaactttttcatgttttaacgtatatttgtttttccaatttgtcataggtatcactatg

SEQ ID NO: 17677 - DNA, 3000 bp, Unknown; identical to SEQ ID NO: 8174
  misc_feature (1)..( 3000): 2750-1469P.txt file - cDNA_ID_1810752; gDNA_ID_1621199; Annot_ID_57618

SEQ ID NO: 17678 - DNA, 3003 bp, Unknown
  misc_feature (1)..( 3003): 2750-1469P.txt file - cDNA_ID_1810760; gDNA_ID_1621200; Annot_ID_57638
attagttaggtgaaaacatgtttgagaaatcggcggggattgtgttttcatggtcataaaacatgaccataaacactgaaagagattatgattatgctgagggagtgtgagaaatcggcagggattgtcatcatatagtactagactactagtactttgtataacgttctcaggaacatgtttcggtcagaattccgatggtgggatctagtcgatgacgtaataaacaacactttcatgcccgcctaagaggcagctgtcgcagactaagcaggtttcaacatgtgaggggccaaggcgctggctagtggtcaaaagacggaacactgagaatatctgtatcattccatatgatccaagcgcctagctttgctcaagtgtcaagactattgattactgaatactaaattcaaagccatttttcttttaatgggcagagagacaccaaatttgctaatgagggaaatcaaacataacaaggggttattgtgagagagaacagaggatcttatacaagttgaaaatccgcaaccaaataatcataatctactctcggtaaatggaatgtcaatccgcactgaccatttgctctctcttgctcctctaccttgttacaggatgcctcctcctgcgttccaaagttgaatgtgtgtatgttatatcatctcctttgtacttatcatctcactcatatctaatattcgttacctctttggtcggatcccatcttcttcgtagtccatcactccacttggttccccaaacatctccttattccctctgatgtcaacatccccctgcccacaacgtaagtaagactatatcgaccaccacccttcccaatcatatttcagacacaaaaaaccaaacgaaccttgtttcatttcatttaacaatcagacaataaccaagtactaccattccaaacaattcatgtcctctaatgactttaacacttcactaacagccgttgtgattgcgttccttgtttgtttttaattaaagaaaacttcataatatatgtttacatccaacatgtaagatttcttgttccacgaaagaacggttaaaaaagcccgccacagttggctgatcgattcgtttgttattaagaaacataactttttaatctatgataggactggacttggaaagctcaaagacctagaaagatttttttatcaagtctctcccatccccgcttacatagacctaagctattaataagaagaaacccactacaattctctgaagaaatataagacagaatagctgactggactctaactcatggtcacaagacagtaaccaagaaagaatgtaaccaatattagttacataatatacttagtagggaaaagtgaagccaataggactccaagcgcgactgaccttcatggacagagacttcttcacttcttccaccccttcttctgcttccttacgatgttttttgtccatctcactcatattgtccgcccatttgatcttgtcttgaattgaaatgagcagattctctgacgtgttcaacctagacatcaatttgggccaacacataaaagagtaggacgtcattagccatgtattctaacatcacgtacaagttcttataattagatatagaaggcaaaaaatcctggatctaagggaagaagaaaactaccagttggacaatgtgtgtaacatattccctagttgacctggccttagatccctaccagctgcaaacggaacctgcatggttgcaagagatatatgatgtttagaagggggggctcgtacgtttagaaacaaagcacaatggttaaaataggaaaaggaggcccaaaccaaaacacacctcaaaacatctttttaactgatccagttttcccctaactataccctgcaaagtgtaaaagaaaaaaaatgagcaccatgcgttgtcacagttagttgtcaaatagagattagaagactgctaaagagtactcaccgcatacatgcattcattgataagaaagtcctcgagttcgcgaacattggaaacatctaactcgaccattagtgtatcatagggcaatacctataacaagcagagtgagagagacattcagttaggcaaacagcaggggaaaaagataatggaacagagtagatagcaggagcaaatcatgaacctaagacaaatataccttgttagactcagcaagggtgaggacagtgagctgcttaagcttaagaatttggtcaggggacaagtgcggaagacgggtggcattgcctagtgtttcgatgaaagcaagtcaagaggagagaatatgacaaaagggaaaacgaattgaaatagcatatgacaaaggggtcatacatttgtagtctccccaggtgccatgggcaaacaagcgtagtagatccaggtacacagaatctgtggttccttcaagctgcacaattacgattaatcagctactagtatctatcaagttgttatgatcagcgaagaacaaaagcatgtaaaaccctagatcgtgaaaagcataaagtagtagtacctgggcaacattgggtagagccaaaatctcggagaaggcgaagagagaaggatgcgatgtggcttcgatgatgagcgggcccagagcctcggatttgcaagtagaagctcgcttcacgagctgatcaatgatctcggcttgcttctgctcgatatccatcttccaaacaaatcgatttccggtggtttagggttttctttcttaccacactaataacgaataaaatcccaaacttcttctctctgctccttccttcttccgtttttatattactgttttttttatgtgaccgaccgaattcttctagaatcttgtttaataattgggctcaaatttcgtagtttctgggccaaggcctactaagagaaatattagaaaccgcgtctggtgagcccaaacaatcccggggaagagagagactattgaatattcttcttccttcattttggctgagagagcgacgacgatg

SEQ ID NO: 17679 - DNA, 3003 bp, Unknown
  misc_feature (1)..( 3003): 2750-1469P.txt file - cDNA_ID_1810764; gDNA_ID_1621200; Annot_ID_57637
cttttttaatttgctctctccgtagtctaattatacataatttaatcacacagtctcgaaagagtagtatgattatagtaagtcttctaatacctctcgtttaggtggaactaacacatgacatctttgagaagcttgtaccttcgtgtggccgtcttaggcgacgtaactccgcctccatctccagcaacgcccttggctacttgatcgtgacggttattgttatgcttgatccggtggccgggcgaatattccgatctgtttgagaagtcattttcatatttaaccgaagaagaaggcttctttgaagaagaaccgccatgtctagcaacgttgctcagcttccggtcgtcgctgcggcaccagtcgcaaatctcggtaggctccgcaaactggccgtagtagttgctacaataactatatatatatatacacacatatatgatcaattaagaaacccattaatagccgtgaatggtcactctgatatacatatgcatgaatgatgaaggaggactacttacgagtgttggaagcggcagcggcagtgaccgcagctgaagagcttgtcggagaaaccgacatcaccgcacatgcaacacactctctccatgatatatcttcacaatctttattatttatatatatcgacccttgtatatatatgttaggccgtgatgtttaaagtaattatacaactatgcgtgttagtaaaaatgtacaggtagactagagagtttgcttgccgtcgttttcacttttcggttttagagagaaagccaaccttaaaatggggagtttttcggaaatgactgttttctccttccttttgtgtttttcccctgtcttgtcattttctagttttttcactcttcgtgcacatatggtggatggatccttctccatgcctacggaaagcgcaatgcagtgacttgtggtcttttctttctttcaaattataggctttcaaataaaataaatgttgtatatcacgtatcatcaaattcattagaactcgatcgaccatcagtttttttaactttataacgatgttgacgtgacgaaacgcatgctgctgtgcgagtgagagagtgttaagcgatgtgaacaacagaacaaacagtttgcgacaataattaacaacaccaattttttcatccaacttagtagtagtgctgctttttctcccttttcacataaagcggaaaaaatatattgggattatctcttggtggtgatgtatagatcgcacactaacatgtaagttagtgggagttcaggcttgaagatctagttctttagcgagtcttcgttggtccggcggcttattatcaacgtacgtgtacatgatgagctctagctatagtagggtccaacttgtcgccaagactgattaattcgtcatatactagttaattactctaaacgtatagctaaagaagaacattatatatagaatattttgttaactatgatttgtttatggtgttagacatataagtttgtttaatgtaacttcaaattatgttgatggatagagatggatttaatgaggagggttaggttatatacaatttggtacccatttattgtttgctttcccaatatttattgcggtttgcatgttttataaaaactggttaatatatttttcgggagattaaatataaggaaactttgatgcgactcgacgactttgagtgtaaaattgattaaacgcaccagtcacatgatatggaggcaatcggaggggaaacaaaaccgacggcgatgtgaagttcccggtggtttcgctaacttggaacctaaacggtcggagagggatccacgtggcagaattcaggagatatttttggagtttggttggccatgttaagcacatgccctgtcttcttctccctatctctcatcctttgcgttgcttcctcttttcactgatactatattttttatttccacctatcagtcatttaccatgtacattagtacgcaacgcacaattcggtgccaaattagagtttcagggtctcacctctctctaatctgtttgtataaactttgaatggagggagacttagaccatgtacatgggtgatatttttagagtatcatcagtttaaaaattatttttatattaaccaaacaattagaatgagcttgattagtatcattccaatgatttttttgatattactatcatttacgtggcatctcctgattggtcgcatttgtcaaaaataagaaaaaaatatttatctattaaacaaatattataaataatactaaaattttttaatgatagtttgttagtatcacctataaccatgctcttaataattaggatataaaacatgtgaatgagagaagtggaccctagtgatctttgtttgtagtggcctcaagattttactttagtcccaaattcggaggaaattatttttgttaattaatcatttattctttcttttgttctacctcattccaacttacaaattcagtatccaattcataagttgaaccaaaaggaaagacatcattcaacccaagattagaccaactgtctttcgtgacacacttgcaattaatatgattcttaaaaaatgttaatgattttgtttggaaccaaaagacaataagttagcagtcaaaaaagcagtaaatgtaattagaaagaagagacatggtaatataatagatattatggatggtgtgacgaataattgatctaataatcatttcagacaagtggacaaccctacctcctgagatgatctttttagcattctatgtatgtactggttaaaaaaaggtttcagaatcaaaatgatgatgatcgtatatttgaaaagaagccaatgatctctactttgaaagaagagaagatgaaaagaagccaattatgaagatgaagaaagggcataacagaagattgagtgttatcctttgttgaggagtgcccaacacaaattaaagaatgcttcttttcctttgttggatataatg

SEQ ID NO: 17680 - DNA, 3000 bp, Unknown; identical to SEQ ID NO: 8186
  misc_feature (1)..( 3000): 2750-1469P.txt file - cDNA_ID_1810768; gDNA_ID_1621200; Annot_ID_57636

SEQ ID NO: 17681 - DNA, 3000 bp, Unknown; identical to SEQ ID NO: 8186
  misc_feature (1)..( 3000): 2750-1469P.txt file - cDNA_ID_1810768; gDNA_ID_1621200; Annot_ID_174855

SEQ ID NO: 17682 - DNA, 3000 bp, Unknown; identical to SEQ ID NO: 8185
  misc_feature (1)..( 3000): 2750-1469P.txt file - cDNA_ID_1810780; gDNA_ID_1621200; Annot_ID_57633

SEQ ID NO: 17683 - DNA, 3003 bp, Unknown
  misc_feature (1)..( 3003): 2750-1469P.txt file - cDNA_ID_1810788; gDNA_ID_1621200; Annot_ID_57639
aaattgtacgcctacctctttctctcttctttaattagggctcttcttttttttttgttgttgttgtggatctttgagcctagataatatttttaaaggtcttgtgtcaaaaagggatatatgaaagacgactatgttcatctctttgtgaaaagacctgttcgaagatctcccatcattaatcgaggttacttttcccgttgggctgccttccgaaagcttatgtctcagtttcttctaagcgggacaagttctaagaaacagatactgtctctcggagctggctttgatactacctattttcagttgctggtgcgtcttctttttcttctcctttttgttagcttttaccaaattcaccattcttcggcttattccagggatctctcgcttcttctcttctcattttgtaggatgaggggaatgggcccaatctctatgtggaacttgattttaaggaggtactactggatgagcgtgctgacaaaagtatccatcatgtgttttgagtctaatgcctaaatggatttgcttcttacgttaggtgactagcaagaaggctgctgttatacaaaactccagccaactcagggacaaactaggagccaatgcatctatttctattggtaagagccttttttccccccatgtattattatgtagaatgatccttttcattatgatgcatttcagcttgtgcactcatatttttcttcattccgcttctactagctactaactcaaccacccccttttactttgtaccgttagcgtctagtttcagttgcttactcttaactcgttgggctgtttatctctacagacgaaggacaagttctcagtgatcattacaagttacttccagttgacctgcgcgatataccaaaattaagagatgttatatcctttgcagatatggatctaaggtatccatgaataatttttatttattttacacactgttatcttgaaccttcaaccctcttcttctacccgggtttaagatatatggtaacagatacttactggtgatagacctacttgatccctaatatcattatcagtctgccgacgtttattattgcagaatgtgttttgatttatctggaccccgattcaagccgtgccatcgtcaattggtcgtcaaaaacgttttcaactgcagtatttttcttatatgagcaggttagctcaactgtgattttccttgtctgcataatattgcagatacgaatcttattgcttatgtgtctaacccgttgggtttctgtttgcagatccatccagatgatgcatttgggcatcaaatgattagaaatttggaggtaagaacgtgtactctactactctagttacagcgacatcttcattagtaaagcttttttgagatttttgtcaaaatatggatactagtatgacactaaaatattctagtattgccacatgggttcatgttgtactgatcaattaccttcatttaaacttgttctgaaagcttaacggtgtttctgttcttcagagtcggggatgtgcactcttaagcattgatgcatcaccaactttacttgcaaaggagagattgtttcttgataatggatggcaggttcgttttgcagttagaatattatgattaaagcagggctaactttcatgtataatttctgatataaggactctcatttctttaccctcttctttattctggtgtttcagagagctgttgcctgggacatgctaaaagtgtatggtagttttgttgatactcaagaaaaacgcaggtcagtactgtacgttttgttaaaactgtgtaagggcgttatgttattcatacctagtatctggctgaactctgtcaagaaatatctaaaaaatgctgttgcccgtgacttttgagctttccaatgttttttagatgaacctcttacagtcttactatatatatcctgttttttgttttttcttctctctcactctctctctcactatcctgttttggctctcttgtttcttcaattcatgagctttcattagaaagcctacttctcttggaatatatcttaaatgagaatgtcgtgtttctaggatcgagcgattggagttgtttgacgaatttgaagagtggcacatgatgcaggcaagtctgtctatacctcattaactagatgttgcacctctatgtatgtatgggaaagcataaaaagaccaaaagatgattggtgttgaatatcaacggtatccattatatatttttgatgatgcatgcgtcagatcttgttctagtgtgtaggtagttgagcattatttaaccgtttatattcaacaggaacattactgtgtcacatatgctgtcaatgatgcaatggtacgtacatgagtctctacaagtcattgtactttttagattctggaatgtttttttgattaaaaaaatgcagggaatatttggtgatttcggtttcacaagagaagggggcggtgaaagaatgagctcatcagcgtcatcaccttgaaaaggaggagggtttgtattgcattgaatccccggaacttgcaactggtacgttagttaatacagttggaggaaaacccctggtggtgggtagaatctgatagtgcttggtttacctaatttgtaaggaatgatgattgattgcacaaagttagaaaggcctttctctgggtgctgagcagaaaacgaaggaaacacgaacttgtctgcgttatctgtgcttttgatttagtttaggctcatggtcgagatatgtgggccgggcctccccttgttttatttttggttgtattttctaataattgtgcaaaacaaagaaacctcacctcggtcaagaaacgctctgaaatctgaactctgaaggttgtttttcttcttctttcggtggtgaaaaaattatctttatgaaaagacaaaaaagtttttgaaaaaaggaaatttttttcaaaaaaacagactgagagagagagagagagagtgtgttgttggccatg

SEQ ID NO: 17684 - DNA, 3003 bp, Unknown; identical to SEQ ID NO: 17683
  misc_feature (1)..( 3003): 2750-1469P.txt file - cDNA_ID_1810788; gDNA_ID_1621200; Annot_ID_174862

SEQ ID NO: 17685 - DNA, 3003 bp, Unknown
  misc_feature (1)..( 3003): 2750-1469P.txt file - cDNA_ID_1810814; gDNA_ID_1621200; Annot_ID_57645
tgggatcctctccatcgtttccatcatgggatacattacttacattgacttcatgaacaacatgggacattgcaacttcgagcttttccctaagcgtctcttccacctcttccctcccctcaagttcctctgttacaccccctcgtacgtcgtttgtaaaaacactactatttatttggatttgaatatatgcatgcatttataacatggcatcaaatatgttgaaggtttcactcgctccaccacacgcagttccggaccaactactctctgttcatgccaatatacgacttcatctacgggacgactgataatttgaccgactcactatacgagaggtcgttggagatagaggaagaatcacccgacgtcatccacctcactcacctcaccacacacaactccatctaccaaatgcgccttggtttcccgtccctctcctcttgccccttgtggtctcgacccccatggtacctcacatgcttcatgtggcccttcactctcctctgctcatttgccctcacttcagctatccctttgcgcacctttgtctttgagcgaaaccgtctccgtgacctcaccgttcactctcacctccttcccaagttttcctttcacgtaagcattttacacgcatgcatatgcactttccctctctctcgctctcttgacacaaacgggtttacttattatgttgtacttcacaccactattttccaaactttcacacacaaaaaaaacattgattctcacttaacttgtacgtactacgtaggaaggacataaccttttatacaaaaagaaaattaaaacaacctaaaaatgaacaatgaacattttcttgtgggtataccttttgtaagttgcatctaaagtttattaataattttgcctcataaacatgcggcggtagtataaatcacagcgccaccatgagtccatcaacactatcatagaggaagctatccttgaagcagatgaaaagggtgtgaaagtaatgagtcttggcctgatgaacaatgtaagtttatttacttcaaatccccctaaatatatatgaatcactattggataagtactgtaactaattacacacgctggcaaaagaaaaaagtaactaatcaacacacaattaattaatgagagggaggaactaaacgggtctggagaaatgtacgtgcaaaagtatccgaagttgaagataagactagtggacgggagcagcatggcagctacggtggttatcaacaatattccaaaggaagccacggaaattgtctttagaggaaatctcacaaaggtggcttcggctgttgtctttgctctgtgccaaaagggcgtcaaggtttgtgaatatatgagggaattggaatatatatactcagcttctcatatcaaacaaaaaataatgtagtaatgtgtatatataggtggtcgtgttacgcgaggaggaacacagcaaactcatcaaatctggggttgacaagaatctggtactgtctacaagcaatagttattactccccaaaggtgtggttggtgggggatggaatagagaacgaagagcagatgaaagcaaaagaaggaaccctctttgttcccttttctcactttccgcccaacaaactccgcaaggactgtttctaccagtccactccagctatgcgtgttcccaagtctgcccaaaacatcgactcctgtgaggtacatctttgaattcttatagatatatctgtaacttttatattatataagctgatagatgtgttcatctataatgaatgaatggttgttatatatatatagaactggctggggaggagggtgatgagtgcatggaaaataggaggtatagtgcatgcacttgagggttgggaggagcatgactgcggcaacacttgcaacgtcctccgtctccacgccatatgggaagctgctcttcgccatgatttccaacctctcccaccatctcctctatgagcttttttcatattcatacatctatgtcccctttcttgattatatctacttcccttccatcattgtttgctgtttactatgtttttctatcgacaatatataagtacccttgttacccttggtgccacgtgcttcatatatgttagaaagggcaaaaaaattcgtcgtatgatatgcttagttaaattttataaaactcaataaaaatcttcagaaacagtgctatgatcattacatcttaactaagtgatatatatctgcgtgcctatttaacaaaataaacaaaaaaacaaaacaaaatatatttgggtgcatcatcaaatcaaagtagttgcaaaaactggacgaggtttttacttaaatggtccttaccccgcatggtccacttgctacctaattaaggattggtagggtgcgtatacgtatataaattgtggcggtgggagatggagttactaaaaacgaaacgtacaagtattattcatagctctcgtataaggggttagtccttagatctagatattttcacttttctttcatttatgtcggagcaacagacactagctggcgcttcaacgtgcatgatcttgattggctagtaaattccaagcatcaatacctaacacatgcccaacttggttcattagtattctttcattggtaaaatacccttacctttcaataatatccagaaataaatatatgaagccatccatcaaccggtgcatttcctcaaggcatggatatgatatcagaacatcgatgaaggtgggagggggtaattagctgagtgtcataaatgaggatccatgtggagatcatcgaatggtagtagtacatgtttggtcttagctggccccaccacaaggaattggactggtgggaagataggggtggttacgtcattccacatatctaccaattaaggagtttaatataaaccttgctatataatgtaccttggctcacaagagttgaagagacacagtgacgacacaaacatattacattcgacggtataatg

SEQ ID NO: 17686 - DNA, 3003 bp, Unknown
  misc_feature (1)..( 3003): 2750-1469P.txt file - cDNA_ID_1810818; gDNA_ID_1621200; Annot_ID_57643
tctctcgaagaagacggcagcaatcgtgtgctccatctcccaggtttatggctacggcacggtggactacgagagaaggccgattgtccagtggaatgccatctacaagaagatttcgctgatggagaagccagagcttggcgctgcttccgtcttgaatcagtgggagaaagccggccgcaagcttaccaagtgggagctctgtcgggtcgtcaaggagcttcgcaagtacaagcgtgccaaccaagctctcgaggtccgtgtcctccttgtatttgccctcgctttattttgtatctttaacactacttacttgatcgcgtatcgttttcataggtgtacgactggatgaacaacagaggcgaaaggtttcggttgtctgcaagtgatgctgcaatccagctcgacttaatcggcaaagtgcgtggcattccagacgccgaagagttcttcctccagctccctgagaattttaaggaccggagagtttatggttccctcctcaatgcctatgtgagggccaagtcgagagaaaaggctgaagccctgctcaacaccatgagggacaaaggttacgccctgcacccgcttcccttcaacgtcatgatgactctctacatgaacctcagggagtatgacaaagtcgacgctatggtcttcgagatgaagcagaaagatatacgtctcgacatttactcctacaacatctggctctcctcttgcggctccttaggatcagttgagaaaatggaactagtgtatcagcagatgaaatcggatgtttccatttatcccaactggaccacgtttagcacaatggccacaatgtacataaagatgggtgaaactgagaaagccgaagatgcactgaggaaggttgaagcaaggattactggtcgtaatcgcattccgtatcactacctcttgagtttgtatggcagccttggtaacaagaaagagctgtaccgagtctggcacgtctacaaatctgttgtcccgagcattcccaatttgggttaccatgccttggtctcgtcgctggtgaggatgggagacattgaaggggccgagaaggtatatgaggaatggcttccagtcaagtcttcttatgaccccaggataccaaatcttctgatgaatgcgtatgtcaaaaacgaccaactagagacagctgaggggttgttcgaccacatggttgaaatgggaggaaaaccaagttcaagtacgtgggagattctagctgttggtcataccagaaagaggtgtatttcagaggctttgacttgtcttagaaatgctttttcggctgaagggtccagcaattggaggcccaaggtgttgatgctgtctggtttcttcaagctctgtgaagaggaatcggatgttaccagtaaagaggccgttttggaattgttaaggcagtcgggggatcttgaagacaaatcttacctagctcttattgatgtggacgaaaacagaacagtaaacaacagtgaaatcgatgcccatgagaccgatgcgcttctaacacagctacaagatgatttgtaatctgatagtcctagatctttgctttaaaaaacgaatcttgtaaccggagtcaactgaggaaatgcgaaatatgtataatgtacacaagagactgcctagtgaaacatgaatgtaagagctgtgtccctttttgtgacagctatttggaattagtgttgcttagggaactggattagcctttgttctcttgtttgattgttgttacttgttaagactaatattggagaggttaggttgtgctcttttattttgggccggacggataaaaggcccgatattgaatatataagtctgagagtctcaaaggcccatctccattaagatatcttcgcggaatcggttgtgagagagagagacggtgatcgggaaatgtcgacgaaaggcgcggcggcggcgtaccctagcgcggctcggatatctgattctccatgttatcttcagtactctgcttctctcaaatgtgagtcatgctcctgatctcaccctttgtgattgtttcttcgaggataggatttgacatgttatcttcagtactgtcaagttccataacgaattagcattgattagatctcatctatttcattatgcttcctcaaggtgattagattagtgggttgaatcccatgtcagtgattcgatttaggtcccatcaattgataacgtcgggtttgattcctgattgtttatgtgtttccgttttcattagttatgcctcttagcttgaccccttgatttcttatcaggtcttgaagaatttggatcagacaagagtaaatgccaggatcattttgatgtgtacaaggaatgcaagaagaaagaggttgttgttgtgaatgaatatttaggcttttggcgtttccaacttctttgctgctttacctatgtgttattttgtttctcagagggaagctcgactggaacgcaataagacacggtcgttgttctcgtgaatgcagatcctcgaataccaatgatgtctcagaacatcacctagctagtagtatcctgttgtttcatttgcaatggctgtgtttgtatgatctatctaagtaaacaagtggaaagtgtttgttaatgttactttttactccccattggtgaatcatggtgtatacctgttaaactttgagagcaagtggttatttatttagttagagagttagagcttctccaccaccatattgaataagaagatctttctctcattcttttactttactctggcgtctgaaacagatccagggattccagtagtgaattgggcttaaaaactgttatatgggctttcgaaagtaaaaggttcggtgagctgccaaagaaaagtcagatgcctttaatcgcatttgacgacgattctttacgtgcgccattgactgcatcgtcgtcttcctcacgcgatttggtaatccgattcgtcttcatctgattccctcccttccgagaataataatg

SEQ ID NO: 17687 - DNA, 3000 bp, Unknown; identical to SEQ ID NO: 8189
  misc_feature (1)..( 3000): 2750-1469P.txt file - cDNA_ID_1810822; gDNA_ID_1621200; Annot_ID_57640

SEQ ID NO: 17688 - DNA, 3000 bp, Unknown; identical to SEQ ID NO: 8189
  misc_feature (1)..( 3000): 2750-1469P.txt file - cDNA_ID_1810822; gDNA_ID_1621200; Annot_ID_174864

SEQ ID NO: 17689 - DNA, 3003 bp, Unknown
  misc_feature (1)..( 3003): 2750-1469P.txt file - cDNA_ID_1810839; gDNA_ID_1621201; Annot_ID_57676
tgatgtgtgtcattgttctatagtgccacgaccgggggaattctagatcgagctatagaagctgaggacaggaagcatggagatttcttgagactggtatagttctgaatatagttcactgtttaacaagtctaaggctagctcttatcttcattctcattactcacttgttttttataggaccatgttgaagggtacctagagttgtcaggcaagacgaaaacttacttttctacagcattttcgatgtgggatgcagatttctatgtcaaagtagatgatgatgttcatgtcaatataggtaagttctaaaatcaacgaattgaattggttttctttatgtcattttgcataccttatactggcaatactaatgggttcaatgtttcactgaaatgtctgcagcaactcttggggaaactcttgttagacaccggaaaaaaccacgggtctatattggttgcatgaaatctggccctgtcctctctcaaaagtaaagcatcttccagtttcctccttcatatcaattttgtattcttgttaagtcatctttgttttatggagcagaggggtgaggtaccatgagccagagtactggaagtttggtgaaaatgggaacaaatacttccgtcatgctactggacagttatacgccatttcaagggacttggcttcttatatatcaatcaatcagtaagatgaagatgagattacattgtatcatagctcatttgttaactcatgtaactcttcgttcttatacatgttaaatgtttcaggcatgttcttcacaagtatgcgaacgaagatgtttcgctaggagcttggtttatcgggattgatgttaaacacattgatgatagaagattatgctgcggaactcctcctggtaagtcttaagctcttttcatctcctgcttgctgtgataccttttaagatgcttcaaaaatcaatgtacatattttgattacttagacagaaaaaacgtcaacatctttggtgttggggacctaactacaataatatctgctttaaagcaaaaggcttaaaaatgaagagaccttaacctatctaaagagatgactcgtccctatcaaaatctctactgatacaaagtcttaccaagaacctaaatgatttaagtttgacaataacatcaaatctttcaacctgaaacatactgaaaatatgttaaaagattcagttttggtatttgcagattgcgaatggaaagcacaagctggaaacatctgtgtagcatcattcgactggagctgcagcggaatctgcagatccgcagatcgcatcaaagaggttcatagacgttgcggtgaaggtgaaaaggctctttggagtgccacgttttgacatataaacagaggaatggtaaaaacataacggttttgctcagcccccaaaaacagctcaaagatcagaggaaggtcgtccagatatacaattccaagagatatccacttttgtattcataggtacatagaatagaagaggcaggaaggattagagataagtgtgaaaacctctggcaagaatcgcaattgcgtattgtgattgtggcgtttccattttggtataaggaaactgaacactacagtgaacacccctgctgctttgttcgttttgggtggcttgaaaatgaagcaacttgtggatttttacatcaaatacaaaacactatgccctgattcttttggatccataaaactattgcatagacagaaatcggatactgtgtaataacctctctggaaatcattaggcgcagtaaactgtaaaacttaacaatgtctctaaaattactttgaaaagtataaaacttgggaaagtaggataaagttagagacttttatttgttggtcttggtcacatgtcaaaacagacactttggttctattggtttgggtttcggtcgtctgaggcccgaaagctgcttcttactcgaaagtcgaaacccttgtgagagaacttggtgatgccgaagatggtaactccgacgagtactggaaccagtttattgagccattcgcagaatctgagggtcaagtggtctcttctctctcattgctttatcttaattaaggtctggttctcttttactttatcgattcctctccatgtgtgtctaccaaagttttgattttttgttgttgttggtgtctgaatccgagtgtgaagtagtcgtacaccctaatcgaaatttccaggatcaaacttagtgaaattcacttgttgatctacgtattgaaaattacgttcagagaggtcgaatcaacggattttttagttgtaattaagctttaactgatcaaaattaaacaacttgaagaagaatgtggacaaaaaaaaagaagagaaattgataagaaaaagtttagtattaattttagactaattaatcttcttggagtgttttgtttctctgttgtttaacgaatgtgttcactgttttgcatttggatctacatttgctacttagttttagtatcaacgggatcttatcgatgaattagtatactcatgctcgacacatgtagagatgatagtactggttttggtgaattaacttattttcttgaagaagaatatacagagaggcatttgccatatagagaacccaaaatggaagtaatttcggttaatccttaggagctagccgtgtgtccctttgtatcttcccaccacaaattagataggaacactcgttttggttagaaatctctttcataaataaattctatcccgctaagattctctcttgttctttagaaacaaaaataagatataatattactaccaggaattgcatggacaagattttttccagattaaaagatattttaccagttttacttgtagactttccaggtattgagtaatgtaatacacgtatctacatgaagatgaggatataaatatccatttatgagaaaagaaaaaaagggacaaacaaaagttggcaagtttaactaagtgaaaagtctatg

SEQ ID NO: 17690 - DNA, 3003 bp, Unknown; identical to SEQ ID NO: 17689
  misc_feature (1)..( 3003): 2750-1469P.txt file - cDNA_ID_1810839; gDNA_ID_1621201; Annot_ID_174926

SEQ ID NO: 17691 - DNA, 3000 bp, Unknown; identical to SEQ ID NO: 8235
  misc_feature (1)..( 3000): 2750-1469P.txt file - cDNA_ID_1810843; gDNA_ID_1621201; Annot_ID_57672

SEQ ID NO: 17692 - DNA, 3003 bp, Unknown
  misc_feature (1)..( 3003): 2750-1469P.txt file - cDNA_ID_1810854; gDNA_ID_1621201; Annot_ID_57667
taagcactgatccatcacaaccctacatgtacatgtatatatatccgtcattaattagtttcgtagttattcagaatgttccactatataaagaaaaaaagaaaaaaaaagagggaaaagaagagtttactcggacaaaacagtcatggaaatgcattctaatgagagcagcagcaagagaaggagcattagaaacgtggtttgaaacaaaatcttgaacaatcttttcagcattaggacaagaattggcatagaaattcatctgcaattgagcttggatcggtccaacaattcccacaagaaagaaagagactgaaagagctatagctatcaagcaattcatctttaaatttgttggtttaatttttgagactctctctgtttgggaggattatgttgtgtgatgtattgagacgttaacataggtttatatagaagagtttgcatgtttggtagtagaagtgggtccatctaagctaactaacatgtgctctttttctactttatttttctggctcataatcagcgccacaataaaaatttgagaaatttttattcataattacaaaatggttttttaatactcttactaatgaagagataatgttacacttcaatgaggcaatttggaagagtttttttataaaaaaaagttaattaaagtttacgtctttccacttatatttattttcctgtaatttgtaaaactaatttgtaatttgtatgttctaaaacacgtagcgaatttgttttctaatatatattaaccaaaatatcaaaaatatactctgatactaaaaatatcaaaagtattagatatggtaaaagatggtgaatgtttggtccataaatcaagctatagtaagttagtaacatagaaagtcttgattttaatgaccgttatgatgtcataatcaacgatttttgtttttttatataccaaaacgcaatagattgtgttgagcgttatgatgtcataatcatcgatacaaaaagtcaagccaacagtagattttagtgagttagtaacatagaaagattagctgaatgtaattaaaagtatcgagtgttctgatgtcataatcaacaactgtaattttttttataacataattgagattatatggaatcttattttggattcatttattttagtcgcgatcgagtactagaatattggtaatcttgaatactctaaatttttggatgatcaatcacctcaagacataacgtactttgatttttcactgaagaacaactcgtttttgccgacatcttcccatccaaaaaaaaaaaaaaaactcgtttcgagagtgatattttttttaattccaaaactacaatacgtactcgacctaatccgcagtagtacaactaaaagaaccgcaaaagaacaactgctaatgagcaagagagtattccaagattattaaccttgttttatattcttaagatcttcttttttttttaagttctttaatgtataatagaagtatataggattaactgcgacttggtagatagactaatttcagatgctaagatataccatatggtaatgatcctagtaaaattacttttgttaaacatatatgtacgaacagtaggacacgtatagtcatgttttctgatagacgattagtgttgccgttatatcattatccgaattaatcttgtaatgcatgtttttaagtgaaataaaatttcaaattacaacgtagtttaataatataagtcataaccgatacaatagtcactagaacataaaactaatatatatgtccaactttacaacgtatactctttttttggaatttttgttttgtcctaaattggtgtttcttatatcttgatgcctaatctttgttttgtaacatgcgcaatgatattaaaacattatattatactaggggaggagaacaaattaaaatttcacacaactactctatagaactgaattattcataaacggacgagagcatttcaactgctcgaaatattttcctatcatcaggagtggcgtttcgtcagattaccacgccaatttatttctttaagtctgtcaaacgttggcatcttctaataaactgatatatatatatgtggattctaaacaaacaaaaaaaaaacttgagaggatatttttagattttcatcctggaaaaataagtgaggctagagaagattttgatgaaagaaatctttaaattttaaactcttttggaaatatcttgaaaaaggattttccctgtaatttataagcggaaacaattcggaccggggccaaaacatgttagaaatatgtggatttgcagatttctgttcgggtcggccggttctgcctagttgtctagttgactaaggttttgtggacgggttcgttatttttctagcgactaagtaaacatgccctcttccatgacctggcgtctagaagaatagtcacggaacgtgtgttccacactcgttatagaccgtattcaactattcaatttttcccaaagaaattacttaagaatttaattagcaagttgggtcttagtaactgaaaacagatacatatttctaatgttattttatgagttgtcgtttgaacaatgtccactaaatgataacgtgcaagacattcgtgaatgtctaatgtgaaaaattccgttttataaggcgaaatgaccattattttatcttataaacaatagtcaattgtgtttcataggaaatttaatatattcaattgaaacaccagcagagatcaagaagatagtggaaggccatgcaatgtcctcctcgagctcctcttgtatttcaaccctcattaagaaacagaggaaaaatgcaaatgggattatctaaatcttgtttggcatttctccatggactatttcaaagccgctgggtgatctataaaaggcctgagaatgtctccttcatcttcatctccaaagctcgttctcaccttacttggcaaacactcaacgaagaaaggagagagagacggtaatg

SEQ ID NO: 17693 - DNA, 3000 bp, Unknown; identical to SEQ ID NO: 8214
  misc_feature (1)..( 3000): 2750-1469P.txt file - cDNA_ID_1810854; gDNA_ID_1621201; Annot_ID_57668

SEQ ID NO: 17694 - DNA, 3003 bp, Unknown; identical to SEQ ID NO: 17692
  misc_feature (1)..( 3003): 2750-1469P.txt file - cDNA_ID_1810854; gDNA_ID_1621201; Annot_ID_174913

SEQ ID NO: 17695 - DNA, 3000 bp, Unknown; identical to SEQ ID NO: 8214
  misc_feature (1)..( 3000): 2750-1469P.txt file - cDNA_ID_1810854; gDNA_ID_1621201; Annot_ID_174915

SEQ ID NO: 17696 - DNA, 3003 bp, Unknown
  misc_feature (1)..( 3003): 2750-1469P.txt file - cDNA_ID_1810866; gDNA_ID_1621201; Annot_ID_57662
atcatggctcatatctctcttcttgttggagcaggggttatgtcacttttagctaaatgggcttaaatgggcctaccattatgcaatatggaattcaaaatgactctactacaaccaattcactaatagatgacacgttatatgattcacttatagtttatagtctttgtttttttttgacacaaacttatagtttatagtcttgtttcatacaaattatatacccttctcgtttcttgacaattattggtttcaaaattttgttttttgtttcattttatcgttttatgtttttagtgtaaacttgtaaacaaaattcaagttttagtttcctatagttaaagagaaaaatttaaagtgtattaataaaatgtatggtcaaatatataaatcccttattggagtgaattttattttcaagatgacggttacactgccaagtgccaacgaaatgttagtagttcgattcttctaagtaggtgaacagaaagttggaaaaatgttccggtgtgaactttactgatactgataaaaaaaaaaaaaaaaaaaatctttactgataaagatctcaaaaaaaaataaaaaaaattgaacgttgactgtttgttgacaaagtaaacgttggccgtatctagatatcaaaattataagatatcatacgtgtttagatgaaatttgacaaatagatggagattagtatcttactgacttttacagttactgaaaaagaaaagagtgaaataggatagtttttagagtatctttttaaaaaatatttttacattctagagatcctaacattactaattagctatgatttttttaatcactttggacaaattcagaaaaaaaccattatccttttcttttgtcatccgaaaataatccattatccttgttaatcgcaatggataatgtaagaaaagaaaagaaaacataatatttgttgcaaaaaatagaattaaatacgttttgtgactgacaaaatactgttagaaaagcttaacagactgtggataaaacacaacttaaccaaaactgaaacgttttatctattacaaacaaaggaaataaaaataaaaatcatatggaaaagaatcgaaaatcaagcaaataaaatccatttgcattaaatgaaatcgaaattaagcaaattataaataatatgtaaaatccagtcagaaatataattaaaaaataaaaagagtaattaattaaaatgtttttcatctccggcagaacgagaggaatcatcttcttcttcttcaaccgcgattgattctcacgcgcgcatgaagacgacgatctctccaagtgttaaccgccgcgcgccgctttttccggagcggagaaggatcgacggaacccaacggtggcggccgtctctttctgccatttccgaagacggatccaccaccgtattcgccggagaaactcatcgctcttttggtaaatttgtagccagagaaacgacgtcgttttcccgcagatatacgacactgaagagcgcctggtataattcatgatttttctattttccaattcattttatttgctgatgttttgtagatgatgatgacattatcataaaatatttgtttgatagtatatatgagaaatatgaattttggttgaatgcgcgcaggagaaacgcaatcacataccatatagcatcgccagggtttgctccttctccgttcatgtattaaaaggtatagtgtgtattcttcttcaccttctgtaacgtcaaaaggtttttacgtagaaccctaatttaaacgaattaatttcttgtaattgtttcgggagccttaattgttatatttaaaaaaaaaactgttttatatttagcggacccatatgtaaatagtgctttttttttgaacaattcatgatttttcatatggttttaagttttaacgttagagaagtttatgtagtgttatgtagaggctatgttgttgaacttttctacagtttcgatcttatctacaaattatattgatccaagttaatcttaccccaaaaagatagttcaaagatgttggtggacatttcatcacgatagatgtcttattttgtgtgtttggattttgggggttgtttcatgtgaaattctcctctctgcatacaaatatcatcacataatggttaggaaagggctcaaaaagccaaagaaataacttgtctgaaaattatcaagcattatctgatttaaaatgcttgaggctctaaatccttcaagtgttgttttgcttgcctgatcctccgtgtcagtttatttttaagttccacatgtttgatactgaagctaataatttatcgctgttagggtaacatgtgtaaatgatacattatcatcatagatattatgattctatatattacaaatgatgattattctgataaatatgtgtattgttagaagtagaatatttcacaaattttgaattgctaaattgattttagatattattatgaattcataacgtttgtgtatttattttgtatttttcatttttgtattgatttatatatataatttttaaaagactacactaataataataactttgttaacaagagtgaaaatttattttggattgattgttttttgtaattttatcttctataactactgtgaaatagatatctataggtatttaaatagattttggtgaaagatattattgttttgttactttaattatatctacttatttctattggacaagtgtgacgatttgattagtattagatccatgtaaacatgtataagaatcttataacttataaattaccccacatgtcataatactgtaaaacaacaattaaaataggtttgtttagataatatttctatttaaacttaaaaaaaaaacctttcacacaagattctcaatttaacaaggaatctgatcgcttcttcttgattaaccctttttctttaacctcttaaaacaagaaaacaagaagacaaaacttgttttataatagagaatg

SEQ ID NO: 17697 - DNA, 3003 bp, Unknown; identical to SEQ ID NO: 17696
  misc_feature (1)..( 3003): 2750-1469P.txt file - cDNA_ID_1810866; gDNA_ID_1621201; Annot_ID_174908

SEQ ID NO: 17698 - DNA, 3003 bp, Unknown
  misc_feature (1)..( 3003): 2750-1469P.txt file - cDNA_ID_1810868; gDNA_ID_1621201; Annot_ID_57661
catatgttcaaaaacttaatgagactcaagttgctctattaattaacacgtcttttattgatggagatcaatggttacagttttctgacctttaaaggaaatatatcaaccaaaactcgttggaatatactctttttatatatcttgaatcggaacattatgattggagaaagtgcaatttttaccaatgatttaaactgaatcattgcaggttaaagttcaaaatggttaaaaaattatttatatatatatgatacataacctccaaattataaagattacaatcgaattgaaaagtctctaggaacaaattagaaataggtacattaattgttgacgacaacgacgactatccaattgtgactacattaattttactaaaccgataaaatagatccgggttcggactttaccggttcggttcaatatatcaacatacgacatgcgatcacaacggagagcaccgccgccggagtattcgcctccgatatacgatctgttccacttagattcacactcgatctctcgaacagacgaagaaatcgtctatctctcttctcaacagatttcctaatttttgtctctatggattttgtttccgtaaagaagatacatctttttgtgtaaattgtcttgtagaaagaaacattgattcagtagagaaataggataaatcaatctctgtacttaaaacaaaagtatcatatatcattcgtcacaaccacacaaagttgttgaaactcagtttcaaagtttgaacgattaattatgcagtcttcaactgctgacttttgagaagattattgatttgtctcaggaatacaaaattgtcaaagtgattcattataaatggccccattcattaatcatccgacggctttcacgttatatagggtttggcactcatatatcgatgggctatatgctacttgtctcgtctaacttggaagaagaaaaaaaaagttttatcttctaatgaaccaatggatatcaaaacttggattttgaatacatgcaaacattacttgagtaaagtatcaaaaacttcattaccgaagcttatgatatagtaattgaattcgtactattgccataataataataaaaaattcatgtactaccacaattcaaagtagagacaaattactatattaaactctgaaggtatttgtgtgccgttgacacaaataaaattatcttagtatgtttttattttgaggcacaaattaatgatcaaatcgttaaaagatgaattctgggaagtatatactgagtggatattttcatttttgttggtagataatatccctcaaatcaaatcagcagtatttcttttcttgtaaaaggttttcagcatattagatgagatccacaaaaacaaatatctacacatcataaagcaataattctttgccaaaaaacaaaaaagcaataattaatttcgctaaaaaaagcaataattaaagaagttagaaattcctgagttttggggaaaacaaaactcgtgatttttaaagctcttccaggttggacgagatatatagtactgtagtctcttgtgattttttgtgctatatttttgtgtattgcgtcgcatatgtatgaccatgccgcatggtatgcagcaactacaaaacattcaattttaatttgtacgaagtccgaatgcagtaaacatatgtactatgtagtaatgtcacacgattctgaaataaaacatatcatggtcaataatcaagatgacatcgatgccattttagatgattttagctctggtttattaagacttgcatcttttcaaaaaaagcaaaatatctatgcgtagacctaaaggtaacaggatagagatttagatagaattattaaataatacgtaagacatacatgttaaagtccaaatcgaggaaagggaaattgggaaaatagagtcataatatcgacataatcagacgtttgagtcggttgacttcacatgtgcttaagtaaagagagaagggaaattgtgttttagatagttccgtacaatttatgtcgacattctctcgacatatagttaagctctttattttagtgtttgttaagatataatcgtattttttaaagtattcacgagaaaaacagtttcatagttacacgtagcatgtatgaacgtagtagaggatctttctcacttttaaaaatctattccctaaagattcgatttttcttttatttcatcccctcaaagtagctctcaactatctataatttaatttttaacaaaaaaaaataaaaaattagtagctccaagactaactatttgtagttttgtaccatggctaaaatttttaaaacaacatgttcgatggccgcatacgcatttcccttttcttatcaatttaaaattaattattgtttagattcttcgcgaatttgattacacagatcacatgggccatttgatcatcatgaccaaaatgattgcgaataatcgattattatttgtttatgttcgaatgaggatagacaaaaaattctgctcagtttttgacaacctcgagtaagttattttagaatcattttcttgaatcacatctattacaaattatttatgaaatatacaactaacgttcattcgtttttatttaaaatttaaatgttttaatttatttcgagggacaaaaacaaatacgggcctagtgatttttcatgtattttcttctttgaattatggagtcaaacttgtttgagttctacagagaaaaaaaagcaaattaaaataaatattgaatgtcatattaaagtatataatataacaaaaaattaaagaaataagtcttctcttagaacagcacctgttaaaatataactatataactgtgtaacacacactttgagataaatacatcgatcactcccaatctccccccgtattttgtcctttattcttccattcttcgcgtcgtcatcatttatcattatcatcgagaagagattcaaattcaaaccctaatcgataagatg

SEQ ID NO: 17699 - DNA, 3003 bp, Unknown; identical to SEQ ID NO: 17698
  misc_feature (1)..( 3003): 2750-1469P.txt file - cDNA_ID_1810868; gDNA_ID_1621201; Annot_ID_174906

SEQ ID NO: 17700 - DNA, 3000 bp, Unknown; identical to SEQ ID NO: 8220
  misc_feature (1)..( 3000): 2750-1469P.txt file - cDNA_ID_1810875; gDNA_ID_1621201; Annot_ID_57659

SEQ ID NO: 17701 - DNA, 3003 bp, Unknown
  misc_feature (1)..( 3003): 2750-1469P.txt file - cDNA_ID_1810881; gDNA_ID_1621201; Annot_ID_57656
attgatatcagaagatactggaggcgaagcaatcaagtacttctctttcattaagcggagtttcgctgtgagctcaggcaatgcagaagcaaaaccgggcacaaagctcagaatatatatcagctcattctctacccagtcaagaagctgattattacagacgcatatgatgaaaaccgtctgcaaaagataaaatgttgacaatgagatgaaacccaaagaatgagaacgaaagtgactcaaaacaaatagggtattacagaaacgctcacaaaacctgtatatgtgtcttgatgattgcctttccaatcaaggttgcaaggaaaaactcccaaaacggtttctcgaattgtccacacatgattccagcaaggtcgaataatgggttaggaacctgaatgtaaggcagaacgtaattgtaataagcacatcataagtttcccggaaccttaaacacacacaaaaagtctatgcaagaagcattggattgttcagacgactcatctaaaacataccgaagcaagaatcaggattgtgaagaagttgagatattgtgaatgcgacaataaccagcttttgatctgatttacgcgtttagcaatgaatccgttatcgtcaccagaacatgtctccaattctttcattttgccaccggaaagacttgctgtataaagtcagagcattaataatcaatcttgatgcaaaaactgtttcatctcctgttcatgtactagatttaaactcgacacctctaaaaccatttaattcattcccacttagtcacttagatatagctcaaacatcaagaagcttctaaaactgggcctcaaagtagatatcttaacactaaccatacacattgagttgtcaataaaaaaggtcggcagagtgaattttcacctgctctggagataaagtaaggaggaagttctcccaacgctgttcctagaccccataggatggcttctatctgaacctgtggtagtatactgctaagaggaactccagaagaaaaaactggggagccaaactcgtggcatggtttatcaagccatgaagggcttctcttcaactgaattgtatcatatatagcactctttaaatcgactcgcccgcactgcattacttttatggtaaataaagcaatatggggacccaaataaagaacaaatgtatgcaaaccagatcctggaatcataaataaaagagaaaagagaactatgttagtaacatctcagcaataagataaaccggaaataagaaactgacacagaatgtcctggagggagtaaaacatattcttaccaagaccaattgatgatgcaacacctaagaatatccaccatagtccaaacctggtgtactcagacagttcttcaacatgctgcacgaggagaaaattagaaaattttaccgttttcttcatctaagaaaacaaaagaagctgataaactaagaatgaaacaaatatattgatcatcactcatgtctttcgatatatgctcttatccccaatttcaatagcagtagaaaagccgtagctgtaggatttctcatccagaagctttcggagatttcttataccaagcaaagaaacatcactagctaaacctacagacagcaacagtctgaatctgtttaccttgacgtgaggcccatctagggtcacaagaagagctgcaaatgcaacaaaaatgctacaaaaaagtataagccagccaacatttgcaagaaggtaagaggaccatcttctaacatagagaaaaacagcaacaacaaataatctcaaggttttgaatggttgtgaggtcaatgtcagtttttcaagatcctgttgatgcttttcacgcaaacctgcaaaacccttagacctattagtcgccaatgtaagaagtgctatatcgttaacattaacactcaagtcactttaatttcagattctaagaaattaagggtcggctcatgattcaaccaaagaccgaaaatttctggtctaatcataacaactggataatcatccaagggaatcgcacacagatgtatatttctaaacaatgtatgcatcgattacagaattttcaatgccgcaactataaaccctaaagtttcaaattttaggaacaaaaacagaaaaagaagggcacctgagatcgcaggagttttagaagaagctcgatttccataacccatatctctttcgcatgctacgaatcaataaacccctaatctgaatatgaattttcaggtgcaacttctcgtcgagtctctactgaagaaactggtctctgattctacaagatgtgtccgtcagacaggaaattagatgaagaagagcattgggtctgaagattttggatggattgagaaaggatccatcaatctcgatctcctatgtttaaggtatgcgaccaaaatcaggttcccgttttgttggatgtgatatggcgcattctattggttcttctcttcggtttaccggttatttataaaccggttccaaaagaaccacgtgtcatttcataacgtgacaaggaatcaaaggctataggagatgttagtttttttgttttttgttttgttagtctttatcaacttcgtaacgacccaagcttggcccattgtgatctacaaatattcattttgatctacaaatttttttaaacgggctttctaaagctaccgtggcggtggctcgttcgtcatccgtcatcttaagcgttccctgaagatacgtgacaaaaattctaggagagtgcaaccgtatacgtgaactaatgggctattttgaaggcccagtgtgatccacaatctttaaaacagaccggataaatttatgttccttccttgttattgcggtcaactttttttgtttttttttgtttggtgaaatcaataacgtctttggctttaaacctttgtgactttgtgtacaaattccggagtgtctctctcccaaatcagcatcgcagattcgatttctcatcctaagagagctgaaaaatg

SEQ ID NO: 17702 - DNA, 3000 bp, Unknown; identical to SEQ ID NO: 8224
  misc_feature (1)..( 3000): 2750-1469P.txt file - cDNA_ID_1810885; gDNA_ID_1621201; Annot_ID_57655

SEQ ID NO: 17703 - DNA, 3003 bp, Unknown
  misc_feature (1)..( 3003): 2750-1469P.txt file - cDNA_ID_1810897; gDNA_ID_1621202; Annot_ID_57724
acgggaagcggtttgttggcccaataacgtctctgattttgcaactacgcaaagaactgtacttacagccttatgaagaaatcaattggatgaaagtccgccatctttgtgcaaaggtaagaatgttaggatgtatcgacatttctctttatgattttctttcatggaaaagaacacggatacattcctctactttaccttaggaagatacatattatccccgtccactggttcaagagttggtatgggacagtctttacatctttgcggagcctttccttgcacgttggccatttaacaagcttcttagggaaaaggctcttcaattggcaatgaaacacatacactatgaagatgaaaatagtcgttatatcaccattgggtgtgttgaaaaggtaaaaacaccttaccttaagacacaaagtattgagcatctggagttaacttcagtctctttctgcaggtactatgcatgctagcttgttgggttgaagacccgaatggggattatttcaagaagcacctctctagaatctccgattacttgtggatggctgaagatgggatgaaaatgcaggtatgtccatggagattggaaatccaatttgttacgtttactaaccttgagttggtaagaaatcgaattttttttgattatgcagagctttggaagtcaactatgggatacagggtttgcgatgcaagctttacttgcaagcaatctctccagtgaaatctctgatgtactcaggagaggacatgagttcataaagaattcacaggttcgatatctctgcagcatatactgtagcacaaggaactatttcttttgaaaaatggaacattagcttaaaattgataaacaattgaaggttggagagaacccttcaggtgattacaaaagcatgtaccgtcatatttcaaaaggagcatggactttttctgaccgagatcacggatggcaagtttcagactgcacagctcatggcttaaaggtaaccagccgttaaaactaaacacattgacatgttcttcagtggcatgagtactacatccttgctgttttctggtctcatagtgctgcctgctgttctcgatgttggcgccggatattgttggcccaaaacaagaccccgagagactacatgattctgttaatatcttgctctctttacaggtgagcattatcagacatagaatagaaccaacatcatcaaagaaacacccattttcaggtcgtgacagtttcacttgtttgcagagcaaaaacggaggtatgactgcctgggagcctgctggtgctcccaagtggttggaagtaagaaccaaaccccataattattttcaaacaaccaaaagatactttttaaaacatttgcggtcatgtaaccttcttcatgtatttgtctcagttgctcaatcccacagaaatgttttccgacattgtgattgagcatgagtacagtgaatgtacatcgtctgcaatccaagcattgagtcttttcaagcaactctaccctgatcacaggacaacagagatcaccgctttcatcaagaaagctgcggaatacctagaaaacatgcaaacacgtgatggttcatggtacactagcgattacgatttatctgaaattgttcacggaaatccaaactaacaagaaatgaaccattgttctttgaatctacaggtatgggaactggggcatttgcttcacgtacggtacatggtttgctcttgcaggcttagcagctgcgggtaagacttttaacgactgtgaggcaatacgcaaaggcgttcagtttcttcttgcagctcagaaagacaacggaggctggggagaaagctacctctcttgctccaaaaaggtacacacttgcacattttgatgaaatcaacttgatgtaggatcattcagtcactacaatcctcttgatctatgcagatatacatagcacaagtaggggagatatcaaacgtggtgcaaactgcttgggctttaatgggtctcattcactctggacaggttttaatcattcaatattgatcgacgaaaatacaattaattaatgaatcagtactatatatgaccagtgctttacacaacaggcagagagagatccgattcctcttcaccgtgctgcgaaacttatcatcaattcacaactggagagtggagattttcctcaacaggtacgtttcctacaccaaaatggctactatcatcttaaaacttccaaattctgtaatagctttactgatagaagtggaaaaaacaaagctaaaagctaattgtagtttgtttaattactttttcagcaagcaaccggagtgtttttgaagaattgcacattacactacgctgcatatagaaacattcatccgttgtgggcactcgcagaatatcgcgcgcgagtttcgttgccatgacgacacttttcataaacttttctttatatcagagaacatgtgaatttattaacctatcatcagtctattacaagaattcgtgtatgcgatatgtcaatgtttttagtcaatgttttctttttgtgtaccgtccattggaaggcatgtttcacatggtgaagatacagagatgcgtgatcgtctaaatttagactaggccatttgttacacttttttttttatgtttcttccaatttttcaacatgttgaacaaaagagtcaaaaccacacaaatgtgttattgtttctttatcttttttttgtgttatagaatctgaaattagattatcagccaaaaataaaacccttaaacaacaaccattagaaaaagaggaaattctccaacccattaatcttgcatctctacttcatttgcttcctccataaagaatctttgatcaatcaaactctattttttttttgtcaaatcaaagtgaagttttctcttttgcatcataaagactcaagagagggaagagatacttttcttccttttgttcaataataataatatatatatagagaagaagagaatg

SEQ ID NO: 17704 - DNA, 3000 bp, Unknown; identical to SEQ ID NO: 8272
  misc_feature (1)..( 3000): 2750-1469P.txt file - cDNA_ID_1810905; gDNA_ID_1621202; Annot_ID_57722

SEQ ID NO: 17705 - DNA, 3000 bp, Unknown; identical to SEQ ID NO: 8255
  misc_feature (1)..( 3000): 2750-1469P.txt file - cDNA_ID_1810909; gDNA_ID_1621202; Annot_ID_57721

SEQ ID NO: 17706 - DNA, 3000 bp, Unknown; identical to SEQ ID NO: 8256
  misc_feature (1)..( 3000): 2750-1469P.txt file - cDNA_ID_1810909; gDNA_ID_1621202; Annot_ID_174986

SEQ ID NO: 17707 - DNA, 3003 bp, Unknown
  misc_feature (1)..( 3003): 2750-1469P.txt file - cDNA_ID_1810916; gDNA_ID_1621202; Annot_ID_57719
ttgtcatccagaaattcagaagacgccaaaatctgataaactacgagagtggtcagttcatttacctttttgggatgaacttcgtaaactttcatatgaaaaagtcatttacatcatccaactgcccacgttgttattcgcaggtacttagcaatgttgagaaaagcttcaaaggagggcattgttgcagaaactatcaatctatatgaccattttttcatgcaaactggtgaatgtagagctaaggttacagcagctaggctcccgtattttgacggtgactactggccaggtgcagcagaggatcttatataccaaatgagtcaagaagaagatggaagaaagggaaataagaaaggaatgctcaagaaaaccattactaaaagggctctaaaagcttctggtcagactgatctatctgggaatgcttccaaggatctgcttctaatgcatagagtaatattttctttctatgaatattgcttcctttttgtatatatttttttctcatttgttttgtttttcttgttaatcatattcacctgttttaccgattcccagctcggtgagaccattcacccgatgaaggaggactttatcatggtccacttgcagccttcttgcactcattgctgcatactgatggtatctggtaatcgttgggtctgcagccagtgcaaacacttccagatttgtgacaagtaagaattctttcgaggtctttttgctctttgattttataatcccttctttgttgtattgcacataagattatgtagaagtcccgagagatacatttattggatgggctatgtgtccttgttactgattaagttcctctgaatctaaaatgtcattcttctttttaggtgttacgaggctgagcagagacgtgaagacagggaaaggcatcctgttaattttaaggataagcatgcgttgtatccagtgagttgcattttcttgttgaggatagtgttctttagctttgtctatgatcagttttgtgaatattggtggtattgatatcgcaggttgagattatggatattcctgcagatacaagagacaaagatgaaatactcgaaagcgagtttttcgacactagacaagcatttctgagtctttgtcaagggaaccattatcagtatgatacattgaggcgggcaaaacattcgtccatgatggtcctttatcatctacataacccaaccgctcctgcctttgtcacgacctgcaatgcgtgtcatcttgacattgaaactggtcaaggctggcgctgtgaagtatgtccagactacgatgtgtgcaatgcctgtttcagtagagatggtggagttaatcatcctcacaagttgacgaatcatccatctttagctgatcaaaatgctcaaaacaaagaagcgaggcaattgcgagtcttgcaggtatacactatactgttcctttctaaaactgatggtgcttctctcttggtcctgaaatttgtatgcaaatagtaacattttttttttgttctcttcttttggttttgcagcttaggaaaatgctcgatcttctggtacatgcatcacaatgtcgttcggcacattgtcaatatccgaattgccggaaagtgaaagggctattccgacatggtatcaactgcaaagtacgtgcttcgggaggttgtgttctatgcaaaaaaatgtggtatctcctgcaactccatgctcgggcctgcaaggaatcagagtgccatgtacctcgttgcaggtaaacaaacctcatgaaattacatcaaccttacatttaagacgtgaaacatatttggtccatttgattttgtgttgatgatcattgtgaacatctctgtctctctgttcagggacctaaaggagcatctgagaagattacagcagcaatcagattcacggcgcagagcagctgtaatggaaatgatgagacaaagagctgcagaagtcgctgggggctcaggttaaaaaaaacttgtatatttagaaagatcaattcaaagttgcaaaaactttcatccttctctcgaaggtaacaccttttggaagaagaagaagaagagccagttagagagagacagattgtgaaattagcttagattggtatttaacagtcacgggtcagggattaacatgcgagctttaaaccaaggatgccactttccagaagaagaagaaagagagcaatgccagccttcttcacagatgacaagagtgttgagagattcaggtttgatggggtttggttggctgatcttctgattctatctatacatacacacacgcgcacacacacacttgcccacttctatttttggtaatttattgtatttttgtaaaattgacatttctgattcgggaatggcaagagtgtaacatatacagtacgttaacgtgtttttttttttttttgttttttttttgtgtaagcaaagtaagataagagagaatagagagtctttagattctctaccactctttttttttggtaatttgtattgatgaaatttgtattcacactttgaatcaataataatttagttctttgattagatttgtaaacgtgcatgttttatttgcagttagtgtgttactgtgattgagaagaaggtttagagagacgaatcttaatgccacgtaagcaggagattctgataagtatctaactgggcgtttggtggagtttgagaagtatctaaattccaagccaccagaaacggacacgtgtctaaacaaggatagagtgtagaacgagaaccacttagcttaagcaagacagagagtctgatgagaaaactgcacaagaaaatcagcaagagtaatgataatacactgtccttcgtcatctctctatcgcgcgaaattgttatacaacagaggtagtagtaaatctcatcagtgtcagtgtcagagtcgcttggtgactcgatctgcggctgttcgtatatccacggcgacgatcggggctatagccgcggcggttatgatg

SEQ ID NO: 17708 - DNA, 3003 bp, Unknown
  misc_feature (1)..( 3003): 2750-1469P.txt file - cDNA_ID_1810920; gDNA_ID_1621202; Annot_ID_57718
aggaacctaaatcggaatttgggtgctccatcaatggcttcgattttggctcgcaggtcactgaatactctccgtgctcgacatctcgtatgaatcttgttcgctcttgttatttcttcattttgtgtcctttagttagagttatttgaatgcctagaaatgggaatgtctcctggagttttgggagcttaagatgattctattcactctctgtgttttgttttgtgtcgacgagattctggattttatctagctgatcgatgaaatcatgtagggagatttgaatttgatcatggttcatcttaagggctttcgttttacttatggtttccttattctttttcgcatttaatttttgtgacgaaagccttttcgcaagtcaatttttttttgtttttttttgcgagctttaatcctttcattagcttgatatggtgtgtatgttctgaatacctctctgattacttctcgacattgataggttttgtcagggcaagctttacagggatctcatctgtctagactgcagtcccgtggtatatcttatggcagcaacaaaggtatattttctgctcttgtttggttttctttggtaaatcaggtttaattgtgaatctaccccttttccaacttgtattacgagattctgattcatatatgacttatggtttgcgtatgtaatattcagatgatgaagaagcagagcaactttctaaggaaatctccaaggactggaatactggtaatccatatgatctagacaattttactttttttctcctttcttcttttcttgtacgtctatcttccttggtgttttcctccccgagtattagtgattcctgatattctcaaatttgtagtctttgaacggagcataaacaccctgttcctcacagaaatggtccgcggtttgtcgctgaccctcaagtacttctttgatccaaaagttactgtgagtgatatcttttctagtcttccaaacttagattgaaagaaatctgtgttactgaagctctttcgtgtatgcagatcaattatccatttgagaagggtcctctgagccctcgcttccgtggtgaacatgctcttcgaagatatcctaccggggaagaacgctgcattgcctgcaaactctgtgaagctgtgagttttgagatcgatatgaatccttcatttaatttaacgttctctttgttctgatatggtactctgagtctatcaaattcatcttagtaattaggaaagctatttgagtatgagtaatatttactgtttagtctctagagttctgatgaaatggtcatattagctgacaatgatctatttagtgtgtataaaagttcaccacggattgtaattcttgtgagggatacttgtccttttcatcaggtatgtccagctcaagcaatcacaatagaggcagaagagagggaagatggaagccgcagaaccactaggtcatcatccctttagttctcatttatcaaccatctgctttctttattaccctttcatgatgatttgagctgtatcgtacaggtacgatatcgacatgacaaaatgcatctactgtggtttctgccaagaagcttgccccgttgatgcaatcgttgaaggacctaactttgaattcgcaaccgagacacacgaggtctgtttttcacattttctagaccctaataattttcgaggcatgcttattgaaatttttgttatattctctatgataggaacttctctatgacaaagagaagcttcttgagaatggagatcgatgggagacagagattgctgagaatctgaggtcggagagtctctaccgctgaaccattctacaacagtctctgcttcattcaacttgtttttcccggggaaacattttcgttgcttctgtttgaaaataaagacgagatcatatgcgtgtgaaaactcttttgtaatccagattttgtgctgtgtaattgaattgtttgtaaccaacctgactttgattttcggttcatgagttccggttattaggtgttttcggttcggagaaagagcatttaatttggtcaaagactgaaaacagataagtcttaagctacaagggtatatctgtacattaagaaatatttgatcggacggacaagatcatgtcttttttttttttacggcggacggacaggatcatatgcttatagtttatcctaatctgtccgatctaaacataatgcttgtcgattttttcatttatttgccttttggttgcgccaattatcgtattcagacagcaaaattaatattttaatgtgtattttttgttgagttactattttagaaaaacaacgaatccctagaaaggaaagaaaaaaaaaaacaaaatccccaaatcgagcgagtccaaagaaaaatcccaaattcgacgaacctacaagcccagaacatcccccgatttgggaaaacctgaattcattcgcttttgatttgccatcttctttctgggatttgtctactgcttgatcctaatttctgacctcgcttttggtttgagttcacacgtgccgcatcggctgttcaccggctttgtttcattgtgcagactccaatcatcgtacaatctgtagcaaccggttggtctccgtcaaatttctccactttgttgccaaattttactcctttttgtatcaattcaaagattgggggtgaatttttagggtttatcattttgttcatttttggtaactattttggggtttaattacttctttagttgatactatgattgatactatctcccaattaatatgagatcaaattgtgacaatttcagttctctgattacaccaagtttttttagcaggacattctctaaggtgctaaatcaggagatgaaatttggatactgtgacttctggaggagaggaaagttatgcagtgtttgttactgttaattaccagaagaactaggacaaggcgacggagactgaagaggtagctatgaatgttcaggctcacatg

SEQ ID NO: 17709 - DNA, 3000 bp, Unknown
  misc_feature (1)..( 3000): 2750-1469P.txt file - cDNA_ID_1810956; gDNA_ID_1621202; Annot_ID_57707
acctctcaaacctaactccttttatcttattcttatgcatctacctatcttccctagatagtttccaatataaatcacacctaactattgtcatttatatccgataattgagatcccatttatgatttgagtaactcgatgggaacttcttcaagtttgaaaacgatattacatgaatacatccaatgtaaaagttgtcacgaaatgttccaaagtcataatgaatgtatggactgagtaattttacggtctcggattttgaaagaagagttcatcaatgtacatgtttttagatcacaactcttaattactttcgatattagttagttattttttttaccttccgattaagatgttagatccaaagatgtatccgttaggtcacgagcttctcatgtatggaccaaagtacatgtgatatgtatgcactagtaagccccaacaattaatgaaacacatgtctttaatgggacgctttacacatccagtgaagcctcttttgaattgttgtaagatctaggtgtgtgatatgatgttggaacaaaagcataattaaagtcactattatcaaaaactttgatacacgaataattatgtatatgaaccgaaagataaatcaatatatagttcaaaatgcatgaaaccttttctttacaacaaattaaattatagtggttcctttaaggaaagatgaagtttctaggtaaggcaccctttaagattcttacaatggttgtagtagtttcttcttttcttttgaaatgttgatatcacatgaataacaccaacaccaactttaagttgaatcaaataagaagagaagaaaaagaaagaaagtgagaaccaaagttattcaaagagaaaagaaaaggataccatacaacaaagtcaaggtgcaatgtcacttgctcttcaatcaaagacgaaaccacaattcaagatttcattttttttttaatggtaagacaaagacatcatatatttttaatagtacatatgatcaaatgtaacaggcacctattacttaatgtctcgttaatgtgttgaaataaacctccttaatgttggtcgtctcgtataatatataacaaattcgaatggagatcaatattgaaatttgaaagaaaccaaacacgtatttaagttgtgcatcatggccactcttttactttacaaagtctactttttttttaattggactttgtaacacaaattaagatggtggaaacttaaaagcttttagaggacaaaggcataatgttttcactttttattgtgtaggaaagaaaatataacaaagcaccaaaaatatgtaaagaagaaggaaaaaaatagagtaaaagagacataaattaaagtaggaattaattcttgtgtgttactttctatcttatatcatcttcaataagaacatgtctccatctttctttcttcacctcttggttctcttaattttatacatctcaggatggatacttcaacttttagtttattttgtttagattcaattcgaggataatggagccaatccaatttatccagtttataagaacaaaactttatctttatcttttattttccatagtattgttctttatttatttatgaaaattgagtataatttgaaaaacaattgaattttatcaggaaataataaaattatcaacattgtttatttactgaaataaatggtttctactaaatttgttagaaatagtttatctttttttggttattagaagaaaaaaaaaaggtccaagaaagggtcaaacagaagtagccaggatgtttcaccacgtggcaccacatggcgccaaactcgtacgaaatagtagtaaaaacagtgttacaaaaaaaggaaaaaagtaagattttacccattttaacggtccgtacaaaagacagtatgtgggtcccaaggaaaagtgttcgccacgctggaatgcttacatggcaatgcgtaggactcttccggaactttttacacgtgtcatattctcattgcatatatcgtcaaaacaaaattaacttctatctttttacggtgatgaatgtcctaaactacccctgtaatggcggtaaattcacagtctaactgttctaacaccatttaattggtacggtgaagttaaaagaaaaaaaccgaatccgagcgttactcctaatagtatgaccagattacaaaagaagcgattcaataacttttccgccaatttcgatacaagttaccacttcaaaattttgtaataataactgaaaatatttgtgtgtttcaaaatcaccacaataaccgatactacaatcaaacaaggattgcaattcaaagcattaggcaacaaaattaccaaaaaaaagtgaattcatatatttatgattgactttgagaaagtgtgtaaagcaaatgagaaaatttaccaaaaagataaatataggcaaaaaatcaaagatatatcaaaccataagaaacatggtaagttaattaaaaaatttccagtatgtaaataaaaatagatttacctttgaacaaattaaagatatgaaaattccaaaaaatgggtaattaatactatttgtttgtccctaaaaataaaatctctcttcacgttagtcgcatcgatgtgtataaataggaaacaaccatttggttgaggttcgtttcgatttggtcttccctcaccaaataaaaaagaaaagagaaaaaaaaagcaaagccatccttcacgcacatcaaagcaccaaaaacaaaaaccgaaacgcatgcatttctaattttctatcttctttttaacttcctcttctcccaccattttcatcatcttcttctctctaaacctctccttcaatggccgtcgatgctcaccatctctttctttctcctcctcaactcttctccaacaggtatctaacgctctctctgtacaatctttggagttttctttgtgattttatcaacgtaactgaatcttttcttatttgtatttttgcagagaattaacgatg

SEQ ID NO: 17710 - DNA, 3003 bp, Unknown
  misc_feature (1)..( 3003): 2750-1469P.txt file - cDNA_ID_1810966; gDNA_ID_1621202; Annot_ID_57704
aaaaacgaacatttaatcgtataatatttaatactagtagtaatcaattgaattttttttaaaaaatactattatataacgtgccgcatttaattttgccccatagactttaaaacaatttctacatttcggcccttaaatattggctccgtctatataactctctctgcgtttacacatccccccattactctctctatctctcgatgattcttgatatggctgctgacgtcagctctctcgtacggttactaagcggttacaaagatgatcgagcggtggttaaagattctgccggagccaaatcctcggcggcgctgatgactcgtgaccttcttggaaacggcagaggaggaggaggcgatcggtctttagagcttgacctcgaccttcaagtccccaccggttatgaaaaacgcctcgacttgaaggttcgtgttgaattgatggatcctctttagtctttcctttagtggttttggctgattagatcgtatcattgttgttttttttaacagtcagggaaagtgtatttgcaacgatgcaattcaacgagctcgtcgtcaataacaaacgcagaccaaaccaatcaaacagtaccaacgtttcaggatttgaattttcctcctccgactttgaacaattctcctttgttgaacctcttcgacgatacaacgccggaactgaagctacttccgtcgtctcgttcttctcgtccgaacactagtaatttacagagtgtatgcacactggacaaggtgaaatcagctctagagagggcagagagagatcctgctatgttcaagaaacgtcaatcaccggatgatacggtttacgatcattataggacggaggctgtagcgtcaccggtggttgccggatgtcctggttgtttatcgtacgtgttggtgatgatgaataacccgaaatgtccgaggtgtgataccattgttcctttgcctacaaatcctatgaagaagaagcctaagattgatctcaacatatcaatctgaatgttttggagtttatattggaacatttttgtaaatgatagataacaattcagggggtttattttgtaaaacttaagaaagaagaaaaaattgatggtaaggaaggaagattagaaggatgttaatggtgttttttgtaaatgcgttagttgaacaacaacaagaattttatttagaaacatagtaattcacggaataaatgagtcaattaaatgacgacaattaatgttacaattatcttattttctacttttgaataaactcgtagtccatggttggttggaaggtagtttgaattcattgtatatgtccatctaaatgcactgtctttttatgaaaagaaaaaaactattattaatagtgttatttgtcaattttgttatatattttaaaaaactccttgataatgtttggcttgaaattgtatccaaatgcctctcttatctgagtggttatgatttcctgaaattgatgactactaattactaaatgaaatgaggaagttgtgtttgcatgcatgcatgatatcttcaacaaacatgtttctcaacccaattaaagataaattttcaatctctgtgtttggacaaaaattgattataagaaaaaggcaaaaataaatgtgacaactgtttaatttttttgaaggacattcaatgttgtaatttatgtgaggtttaactttttaaggtcattcaaagttatgctgacctaacttcaaatgcttaggtcaacagagcacacatattcacatactatacgaataactgcaagtctgcaactaacgtaataaatcgcggctattaaaatccgatatgcatgtagacatgtagtagtaaacttatcttattagtatttttttaaaatgtcaacgaggtaaggaaatgtagaaatgcaaatactcacgacgagcatatattacatggacgtaatttctccgatattatactacgaccgacgagtagatgagttagatttattacgatagaatttatactaacggtggacctgaaataataatatttcgtaggtagtatagtttttgcattaaacagttttgtatgtgtgtggcattaatacattactccggatgggatacgtatcgtatagattgtatggtttgatattcatctttatccataacaaaaaaaatctagctagtgtatatttttcgtacgttacaagtttcgaaaattaggtttacgtctataattatatgacaaacatattttaaatatctaagtctcatcttcaatggaaactagtcctaaactcctaagttgatgtacgattttttttctcgttaggtggatttcagattataggaaaatgatatagaaaaagaaataagaaaaaaagaagagaaatggagaaactcatcctaatagaaacgaattcaattaatgggatcgtgacctctaataaattgtaattaatgctcctgctacatttatgaactttggtcatttcctttacgaaaacaatgtaaattccacgtgtcaacttatttgccatctctccattaattgattttggcatatttgtttcatctcgtgcttttcaggaaaaccaccaaaacaaaataagacgagaaaaacgatatcgtatgaaaatgtgatttctcatagttacatgtaattataagtcatacgtatatccgaaaatgtgaacaattcattatttgtccatgtttttcattattgaagcacgtacgacaacgtttgaccagcacattttttggcccaatatgaatccccatagagagattcttttttggcccaattaaacagcggtataaataaatgggcctagcccatgttgtttttatttttatactattttattatttccaccctcttcacaaaaaccctaaaccctaatttgaagttgttcgattcgatatccttgtgtgtgtgtgcagacagttttcattttccaattccattactgcctcttctttgttgctggttctgagtcagtggtgataatg

SEQ ID NO: 17711 - DNA, 3003 bp, Unknown
  misc_feature (1)..( 3003): 2750-1469P.txt file - cDNA_ID_1810979; gDNA_ID_1621202; Annot_ID_57699
aatcatatacagagaggcgaaactgagcaattcacataaaacttcactacctaatttatgattacaaaactcataagtccaatttcaaactttgataagaaaagcatcgattgacatagacctcatcaacaattaagcaattctctatagtctattcaacatttcaaaagctcgaaaacccagtagaaccactgtcaaatcatagaaacaatccaaacgctcgaaatcaatccagacactctcaaacccagaagctaacgagtggtcaaacgaatggctaattgagaacagatcgcgaatcagatatcgacttacactgagaaaggtggctggattaaagatcttttgcggaagagaaggagtaatcagtcggtgactagcagccaagaaagttctggagaaaagggtcgaggccatatccacctcaaatattctctcgataaaatgcaacagagatgatgggttgagttagaaagacgccaaaactatttgctgtcagattgattctcttcaagtactaaacccaaaaaggttgcaactttgcaaacgtttttatcaataaagaggattttgtcactgccgccacgaacgggtctggaagagagacacgtctagggcgtctttggcgtttcgtttcaccaaacgtgcttcttcgcgttttgtgttttgatatttttctattccggtttaactaatctgatctaaaccaaaacatgaaccgattcaaaagtatccattgataaagctggaaaattctacacaatgttacatctttaatgaacatatccaaagaaacaaaagatgaaaaagagattcaaaaggggaatcctttacggatgtatttcttggatttctcagctaaacgtttcatgtttttggatttctcgtaaaactccatcagctcggttgcaatatcttgtggatgacacattacataaaccttcaagaaccgtttctcgctcatccttaccgctctgaaaatgctcacttcttttatcaatggctttagacgcatttccaagactctcttaacgagatccgcacgaggttttagacgagactcgaggttgaggagaagcaaacaagggtgcttaaccacggaatgagctggaagtttcatcgaggctatgacgaaagtcatgtttctctgaactttctcaacagagagagagagaaggattgggcattttccatacaggtgccaaatctcttcttccgagaacccaaacttttccaagtttctaactttctcttcgattgtctccatcctcgagaccccgatgatgactgcaacatatttaaacatcttggattctctggtgactccagttttctcaatgtattcaaacttctcattgttaaagtttgttcttggaatcaacgtgggtcgcgatatcaacattgcgacaagatcctgttggctaaagcccaaccctttgtagtattctatcgcgggtttgatcttgtcatcgaggtcatacaacatgagtgacggattccggataatgactctgcgcaacacctcttttgaccccaaaatctccatgaagtagttgatcctttcatcaaggacaagacggcaactaaagaacctaggacgacagttaagaatcttcacaaggtctgaagacgtgattcccagtggcttaagaaggcttaacttaaactctaactgagcaacattggctctctgcaaagcaggcctacgagtaaaaagcttggatatttcatcatcatcacaaccccatcttcgtaaaacttgtaaaggactactagtaatatctctcactttctctttttcaccaacttctccaacataatcaaatttttttctcctagacgatagatcagaatcctcaatgcattcttcagattcattcaggcataacgtcgaacacctggtggtaaaggtagcagaaatgagatttctacaaccagcctttctgaccaagctcgaactagtaaacaataatctgataacagctaagaaatttctcttcccggtcgaatgcatttcaagggcgtaatcgagagtttaacaaactggagaaataaaggagcaaattttctctaagaatcaacaatggctctgcctcaacgacacaatcagcgacatttacacgcgtatttcagatgcttcttccatccaattttccgaaatagctagaaaaaatggaacaattaccagtacacgaagcttgtgatgaacgagcgaagaaacaaactccgaccaacggaggagagtttgtcagagaagaaggaggcgatggagagagacacagccaattcggaccaggtttgagtccgagtcgggcgtggaagcgagagagagtaggggactaggggtagtaaataaataatgtggttcaaactgaaaagagatataaaatattggactattatgtaagatacagtaactgtgaagttgttaaaacgccgccgttttggtttttttgtttctctcgttttctggcgtcagactctcaccctttgtgcaagaaaccttgagagcttaaaaattcttcacttgggtctcttctctctctcttctcttgcgaccattccgttcgatccatatatcaaaggtatgttgctttgattgaatgggtttcttttgttgaatttaaattgataactttaaatatattgaatttggggtttaagaaaagttttcaattttcgtctctgagtttgagctaagagctgatctttgagtttgagtttgtgtttgatttgattcactcacaattcttaattagggttggtatatcttgtctttttcatcgttttccttacacattgcccatggcgatgagactcttccgggtttttaagctttgtcagatttgaacgcttcagtctacttacttgctcagacgtggtttcttttcatttaagtttgaacattgttgatgaagaacagatttagcttccacgtttctaaatttccagagatgacactatttcgcattttttgcagcttgatttagttggttttcaatg

SEQ ID NO: 17712 - DNA, 3003 bp, Unknown
  misc_feature (1)..( 3003): 2750-1469P.txt file - cDNA_ID_1810992; gDNA_ID_1621202; Annot_ID_57692
aggtcccaaattgaagcaatgaatatccaaatgtccactttgaagaatgacctggagactgaacatgagaaatggcgtgttgctcagagaaattatgaaagacaggttggttaaagctctctatttcaagaaacattttgaccatcatgcatattcacgttgacgttggtttttattatatgatgctagaaactgactagattttattacccatcctgttgatccatttcatgaaactgttgttttctgaatactctattttactgcacctttgtcatatatccgaggatatcttcaaatattttctgaattgtgttttacattacattaaatcattgttaggtttttcataacttaaggtcttactgccatcagctaattctgttcttctctctttccatagatattacaactatcactctttttgtttcctacttctttttggagtgcaggttattctgctgtctgaaactattcaggagcttacgaaaacatcacaagccttagcagcccttcaagaggaggcatctgaactacgtaaattggctgatgcacggggaattgaaaatgtaacttctacttgtacacaactttttgtgattcaattcttcctacaattatagttgattcgtgaaacatcaatttctattttcttggtgtttatcagtctgagcttaatgccaagtggagtgaagagaaattgatgctagagcagcaaaagaatctggctgagaaaaagtatcatgaacttaatgaacaggtggccactgctctctgatctcttacgttgtagcttttatttgagcagccttattatttagtgtgttcaggatagtctttgacgatagtctttttccaattctttatgggtcaataatgcttaatcctccatgtgaatttgtgtagactttaattcatggtcatgttacaagtactcacgtatcttaattgatctctacatcagaacaaattactccatagcagacttgaagctaagcatcttaactcggctgagaagaacagccgttctggcacaatatcatctggaagcactgactcggatcaccttgaagattcgggtttgcaaagagtagttcattatctacgcagaaccaaggaaatagtaagagaacttcctttgcaggattgcttttcctttctttatgccccttctttgtactgtggggttatctaagtcatgtgcatcctttttgacaggctgaaacagagatctcactaatgagacaggagaaacttcggttgcagtcgcaagtgagttgttgtctcctctcttatgcctaatttgctacgacatcccttttaagcgacaacctttctcaatacacacatgcaaagcgaaaacctcctctattattcagagttgtggctgcggtatgatttttttttttgcaatttgtttgtctagcttgagagtgcattgaagatggcagaatctgcccggggttcacttactgctgagcgcgccagtacgagagcctcattattgaccgacgatggaatcaaatctcttcagcttcaggtaaagttgggtgattcgatatctgataacatatgaactaatgatctaattagtctttgtattggttgggttgaaacaattttcatttgctgactttaaattctccttgcaggttagtgagatgaacttgctccgtgaaagcaacatgcaactcagggaggaaaacaaacacaattttgagaagtgtcaggtttgtatggaacctttctttatgtctctcaaatgaccaaaccacattacaccacctgattttgttagctgtcttagagaaagctgataaaaaatttaaaacatcaggaaatgcgtgaggtagctcaaaaggctaggatggaatctgaaaatttcgaaaatctattaaagacaaagcaaacagagttggacttgtgtatgaaagagatggaaaagctaaggatggagacagatcttcacaaaaagagggttgatgaggtacgtcatatatgtatgggctcatacttacaattactttttgttactggttcatacttacaattacttgatgctttgtgaagttgcgggagacatacagaaacattgatattgctgactacaaccgcctcaaagatgaagtgcggcaattagaggtatgcttataaagataatatgacgttgtctaaatttctgcaatagtgggtgttttccaagggtgtgcatggatatgatatccctaccctttcactatatttgttgtcgtgaaattagttacaatgttaatggagatgataccatgtctgctgaaggtggttagttcttgctccttgatccctactggttaaagaacataaggtgctttatctatttgatattgggatggtcaatgaaccatgtgtgggatgccctttgagagagcctctttgtctcctagtttgggactactccctatcttgtaacctactctttaaatttcctccatctcgctggaacaccccaactatatgttgatttccacagttgcattattgatcattaatcgcatatagaattctagtgtacggtaattctcaattttgctgatgagaatttttggtgaagtcttagtgatatttgttaatattgtgtcattttggtttcgataatttgttgaatttgaattctgggcgtcccactggtctttagccctgcttttcctctaagttcttatatcaattgtgacgccatgatatggtttttaggagaaactgaaagcaaaagatgctcatgctgaagattgtaagaaagttctgttagagaagcagaataagatatctcttttggagaaggagctaactaactgcaaaaaagatctgagtgagagggagaagaggctagatgatgctcagcaagcacaggtagaatgagaattgagaactatctcgctgagttcattttagcttttacatgttgaagaagtactatcctatgtagatatattcatctgtctctgttacttattgtaggctactatg

SEQ ID NO: 17713 - DNA, 3003 bp, Unknown
  misc_feature (1)..( 3003): 2750-1469P.txt file - cDNA_ID_1810996; gDNA_ID_1621202; Annot_ID_57691
gtaaagaggtttgcaggctgttacatgctttgctcataaaattgaatcatagtctcagtggcactctagcttttcgaatgggtgacagagatgtattcttgtagctgtagtgccaggaaggaagaacttcttacatctgcttgaggattcagaggtatgacagattgctaaatcattctattctcttctttgttgtccacttttctagggtatcaaatttgttgtttggaactcaccttattggctgaattgcttgttccaggaagctactaaaagagcccaagaaaaagcttttgaacgcatccggattctcgaagaagattttgcgaaggctaggtatatttatcatcctcttgtcttttgtctttcatttcttactgggcaagtgattatttttgtgcaaaaagttttgtttgataaactagggtacctctgggtatgtaacacattttctagttggatagtcaagttgagagctaggacccagactatactagcgaaggaaataaagtgtggaaagcgtagtatctagtgtgaaacgtgtttgcagatgcaggtggattgctgaaaatactaatctgagcttatgtgtttgcaatcccagtgtcgatgtcctatagaagttataatcgtacgtcttgatacatagagaaacaacatgaaaaactggattgtatcttatgcagcatatccatgaaacgtaaactgtagttattgatttttgtcattgtttcctgtaaatttattttactgaacattataaactgcgttgttttcatctttcccctttggatttttaggagtgaagtaattgcaataaggtctgaacgggataagttggcgatggaggcaaattttgctagggaaaaattagagggcatcatgaaagaatctgaacgcaaggtgatttttatcacaaattcatatcatcagaagcttgtggtttcttcaaaattttcaccttatctctgtttatcttagagagaagaaatgaatagcgttttggcaagaaacatagagttctcacagctaatcattgaccaccagaggaaattgcgcgagagctccgagtctctgcacgcagcggaagagatctccagaaaattatctatggaggtagtataccatcacccgttaagtttatgattttttttgctttaatactaacagtcatctataggtctcagttctaaaacaagaaaaagagctgttatcaaatgctgaaaaaagagcgtctgatgaagtctctgctctatctcaaagagtttaccgtcttcaggttggaaacatgagaggagtgcaatttgatcttaagctgtgcgtactctttttttttttgctgacctgttgttctgcaggctaccttggatactgtacaaagtacagaggaagttcgtgaggtaagaaaacgacctttgatattagtttactaattctattctgcaataccgattaaaaatgttataactttatcaaaatactcaggaaacaagagctgccgagagaaggaaacaagaggagcatattaagcaacttcaggtctatataatatttgataagtctttcaaaattattatgtaagaagagtagaagttaaccgatgtgttggatgggttgtcacagagagaatgggctgaagccaaaaaagaattgcaagaagaaaggagcaatgcacgggattttacttcggaccggaatcaaactttgaacaatgctgtaatgcaggtagaagaaatgggaaaagaattggctaatgccttgaaggctgtctcagtggcagagtccagggcttctgtcgctgaggtactgtttcaagtctattttacctttcttaataacttagaccatgaatacatgaaccaattccatactgcatcgaggtggtgcgcatcaccagcatctttcagtgtttactctgtccgtctcctaggttgcataccctaattgctttcccaggtcgacattaaattcccattttctggtgctacttttgcgaagtgagtctttgcatgtggtttggcaattggttttacgacttgtgaataggcccaaaccaatttctggaaaatcactacatcgtcaatccactagatttttcagctgtttgccgtccattcacatattggcatatgatcatttttgcctgtttactattattgactattactttacatgtgtaaaattaggctagactttctgatttggagaagaagatacgatcttcagatcctaaggtaaatgttttgatttttctaatcattgaattgtggtgtttacttctaacagcaaagtcctggatggaatttgctattgcgagtttgtaacgattttcattttttcacttttagactcttgatatggatagtggtggaattgtctctctttcggataaggaggtcagtgaagtccttcatttttttttcccgcaattttaaattctgacatggggatttaagttccgtaattatggtattgtttgaaatttcctggttgcaatctatctgtaaaaggctgctcttgttattattctggatgttgtacataagattcaggcaggatttaggataggatctgcagtacgtattactgagttagttgaatttgatcatgtagagttaaggctttcgcataagctattgtttgagttaccttttacttgttgctatatggcaatccaatatttggttgtgtaaggtagtctgttaatctttttttttgctgtggtgattatttactctagatgtccatcgaactgcgtaccgcaaaggaagaaattgaaaaattgaggggagaagtagaatctagtaaaagccacatgctccaggtacttcctgaattggctaagttagtttcgatttcaacatgactattaattgaccttgtgaaccatcatgcagtacaagagtatagctcaggtgaatgaaactgcattaaagcagatggagtctgctcatgagaacttcagacttgaggtatttgtgattatgtttggatgaaacaatg

SEQ ID NO: 17714 - DNA, 3003 bp, Unknown
  misc_feature (1)..( 3003): 2750-1469P.txt file - cDNA_ID_1811007; gDNA_ID_1621202; Annot_ID_57688
acaaaaataaattatcttcattgctttaaaaagcttaaacattattctatttaaaaagttaagaacatttgaacacaacttgctgatgttcacactataacgagcataaaataaaataaaaatacattcttcgatttaatagtagactttacttgatccattcaggtcttatcaatgaaaacaaagactacagagagcttgttggtacataataattagcgtagatgaagggtaatattccaaataaacatgatcttcaagaatttatttcaataaatcaatttcataagagattacataccatttttttttaccatgttcactagaagtctagaatccaaaaaatagacttgcgcgaaagaagagtctctaatcagtaaccacaccatatagttacttagcatataaacggagcattcacaaagcggtcattgcaatacaatcctggtctctgaataaacatctgtttcttcagaatctctcttgccctcaataccatttccttgtttgtaatcttatctttatgatcagtctctgacaaaaccatttggatggcattactaaacgctccaaacgcttctcctttcttcttaacatctgctgatgtctcatctgtttgacatccactcaacagaatccctcggtcaggaaacaatccgttgcttgatcttcctccataaatctcacgatcgctcttcacttgtgcctgcattgcgggtttcatgtagtgttcatcgttcagcgtctcttctatataccctcgagcactttcttcgatcttaccaagtagcgtactttggtcatttgttttccttagcttggtaagaatcactttcatgaacttctttatcttcgggctcgaatcttcaccaaagacatcaaaaagggtgggtctgattttcccaatctcgatattgtcttgcccagtttgttgtttgagaagttcaataaacctctccaacggcagataccttgatctgacaacttcatctccctcgcctacttctacgatctcgcgcgtctctacatgagaacttccgattccacaaaaagcaagcagtttcacaaaaatgctatgcaaacagtttttaaactcgaattcaaaagaagaaactttggattctcgatttggcttcgtcgtggtactctctccgatctgttccttagcttcatcaatgagcccgccgctgtgacaagagtctgatacgatagttatctgacatccctctggaacttgttccactaaatccctgaaatcatcatctggcaatgcaacacacaaaacagcgtagatatataaaaaaaaaaacctcaatcatttctattagtgtccatgtcaacataattcaaaactagccttgagacttaacagagtcaaagagaggggtaaacagattctaaacagagcactctgttttaaacagagcactctgtttttcttcattaaactaaggaaccattccataataaactcttaccaggaattggattcaagtcggaaggaacaatacactcatcaaaacctgtatcatcctcttcccctgtttccggtgggactctcgtgccgtgtccgctgtaatgcacgaataaaacgtcaccggattttgctggctttatgagctccgacaaagcctgacggatgttctttcctgtgggttgagtgtaagattcgtcggtgtcaatcagcacagtgatatcttcctccgcgaatccgaaccggtcaacgagacacttatgcattctatggacgtcattgacgcagccttgtagctcctccgtggttcctggatagttgattcctatcaacaacgctctctttgccattcttgcaaccttcaagagttctttgtcggagaaaaaacttccgctggatctaacgattcttcaatgagatttgtgatgaagattaacattaaaatactaaacattattggcttagtgggaactaactttatgtttctctatttaaatgatggcacgtgaaaattgtggactaattatcaaaaaacataaaacaaatcgccgtctgtggggatcgaacccacggccacgtggttaaaagccacgcgctctaccactgagctaagacggcgagctgatacaacatttcgtaattaattattaaacttaattttaatccgcatgtgtttaaggttcttctataattagtctaagttagcaaaaattacatagtgatgatgatttgtaaggccaagtgaaactatatcatcaggatcgtgatcctataatggatgtttttcttaagtgattttatagcaaagccaaatgaaatcttaagttattctttttttacaaggttcagtgttttaggtcttatcttttgtgtaacacctactttcatataatgatatttatactcttagcgaaaaaaaaatgaaatcttgaacactaatcagtaaaaattgtcaaaaaaaaaaaagaacactaatcagtaataacctattgcgatgagtatcaagtcgacagcaggttcactttaccatttttctcacaatgttggggaataagaaatgaagaattaaaaagaatttttaagttttgcctattttttgacagaaagaaagaatatttttcctatatattttaaaaacaaatcaaaacgccgtctgtggggatcgaacccacggccacgtggttaaaagccacgcgctctaccactgagctaagacggctgaacaataattaaatcataataacattcaaagcataacctaatcagatatgttgaagcccaacaagaggcctaatatctctattcggcccaactaacataacaacgacgtttaattgacgcctggggttttctgtctccggcatagcataatttttcgtcctcccgaagcgctttttcatcttcctttgttctgggtttctctccaaaaatcgccggagaaattcaaatcgtcatctctaattcgtcggagaatccaccgttaggtatataaacacggtttgtttctgaaattagggtacgaaaaaatg

SEQ ID NO: 17715 - DNA, 3000 bp, Unknown; identical to SEQ ID NO: 13669
  misc_feature (1)..( 3000): 2750-1469P.txt file - cDNA_ID_1812229; gDNA_ID_2214643; Annot_ID_188421

SEQ ID NO: 17716 - DNA, 3000 bp, Unknown; identical to SEQ ID NO: 13669
  misc_feature (1)..( 3000): 2750-1469P.txt file - cDNA_ID_1812229; gDNA_ID_2214643; Annot_ID_136306

SEQ ID NO: 17717 - DNA, 3003 bp, Unknown
  misc_feature (1)..( 3003): 2750-1469P.txt file - cDNA_ID_1813111; gDNA_ID_2214662; Annot_ID_188915
atctcataatccttcgtttttcacaaagagtcctcggtactaaaaaaatgaactttatattgtacggacaacatagaagaagaataagctgaaattagttacctttttttctctgacaaaatgaactttataaacaatacataattcatctctcttaaatttccaaaatctaagagatccgttttattctaaactttgatttataatttaagagatttaaagtttgatcaatttttttttgttgcgtctaaaaatctctaaacatcgaaggatggagactgaattgtggtccgttaaaaattggtatttgtaaacaagaaaacaacattacgtaaattgtaattcataaatttgcgtgctttgtgcttgtctacctccacaccggcttacgatgaaccacactctttttaatattcaagacttctatataatcattatatcgtatattcatatatatatatatatatatattatataaataaatattcttttctgttttctgtgttactaacttttattatatagagagagatattcaattatacccaatacaagcctatataattatcaaaattaagtggttttttatttaccaatttgaattctctagatatcttacatacgaggatgtgcttttagtcaaatggacttaaccatttgattccgccttctccaccggaattcgatttcactaagttgcgttatcccgcaatcccgcatagtagggattgagtattgatcgggtcttgtcgatacaaagatgtaaaaaaaaaaattttacatagtcttttttttctgttcttattcttttttttgggggtaaatatctgttattgaacattataattcaaacacttccaaaactttttttaccttgttctgatattgatgcagcgtatcttgaagacaaatgctcctccggtattcatcacgtccgaggagattgtttattgctttacttttgggtttagtttcatatggacttaattaatgtatatttgggctttgaatatttgatattagtttgcttattctttaggctagggtttccattctttttctcttattttaagagatgtaattcattattgtaattagtttttgattattgaataaacgagttttaagagagcttgtctaaagcctagagaggaggactctcaaccctaaaagcttgtgttcaagccctgcaaggaggatttgcaaaacctcatcgatatcgttatcgatctcgaccttatctctattgcttcttcatcaagtttcggcgttctaaacaaaatccgttcgttaatccgagttctcatagagattttgtgttttcgtccgttatttagcttccgctctccatcagatattacttttgttcagtagaccattcataaatacctgccttggatccaaaaataggacaaataaacatcatttgcatcattttattattcttaaaagaaattgcaaatttttgaccaaattgcaaatattttgtttttaggttatacccaatacccacatactgtattatagtcgtaataaaaaaaggaaaagttgcaaaataagtagaggacagtgagaagttggtaactatatatgttttggttaatttagttatgggtatggagtctataacgtatggtttcgatatttccaataattagcaatcgtgtatcttcgttagcatcaacattgttgtattttatttagtgcacaccttctcataatttctaaatcaataaaattttaatatcattttatcttggtatatgtcactatgtatgtggttatttttatgcttccatgtttttattttttttgccatggaaccattagcttaggttgaaaatcatcgattgtaaacctatcatgttttcatttttatgaaatattaggtgatcatccgcgctacaccacggttttttcggatgtttttgtattgtttaatttaaatataatttttatttatcttatcatttactcatgcaataagcaattacatttagtattaaaatatttttttctaaccacattctcaacaatgcatcatacacataatttctaaacaatgtttatcttaaaccaatttaacagagggtagtgttggattctataaacctaagaatttaatgatggagctccttacatattcttcaccctcagttatttattatataaatatcaatttaagagaatataaacatcaatttaagagaatataaacatcaatttaagagaataacttagttaaattattaagtaatatactcatactttgagtttggattaccataaaaatcttcgagtatgagaaaactattaaaatgattttattaaaaaatcatgtgatattaaaataaatttagtaaaagtacaattaaatatgtataataaaataatatgtaaaattaaatataaatatatcattaaactatagatttgaaattgaagagattacattaattatttaataaacacatgtcaaatgctaaagtgatgatgtgtctatcatatgaagagagttggccaactttcatatatataatttacgaaaaaaaaaaaaaaaaacaaatattcaagatctctttcttgatatgggccaatttgatacgaaacattttccagccataacctttcgttttactttatacgggctataggcccattatgggttaacgtgtaggcccaataaggtgttttttcaatttggtttgcatttggtgtgtgtgtgtgtgtcagctacaatttctcaaggagaggcgcgtgtaaatcaaacggataatcctacggttttgatgaaatggcttctcgtagacctcacaatctctaaacatctcttctctttatacgctcttcttctagaaacctctcttacctcactctccttaaacctttaatagggtttttaggttactctttgttcaactactacaaactcttttctctttagagattgagagattgtaaaaaaatctcaaatcttttccttcacaactttcaaatctaatg

SEQ ID NO: 17718 - DNA, 3003 bp, Unknown; identical to SEQ ID NO: 17717
  misc_feature (1)..( 3003): 2750-1469P.txt file - cDNA_ID_1813111; gDNA_ID_2214662; Annot_ID_136537

SEQ ID NO: 17719 - DNA, 3000 bp, Unknown; identical to SEQ ID NO: 6247
  misc_feature (1)..( 3000): 2750-1469P.txt file - cDNA_ID_1813791; gDNA_ID_1621084; Annot_ID_55350

SEQ ID NO: 17720 - DNA, 3000 bp, Unknown; identical to SEQ ID NO: 6231
  misc_feature (1)..( 3000): 2750-1469P.txt file - cDNA_ID_1813795; gDNA_ID_1621084; Annot_ID_55348

SEQ ID NO: 17721 - DNA, 3000 bp, Unknown; identical to SEQ ID NO: 6231
  misc_feature (1)..( 3000): 2750-1469P.txt file - cDNA_ID_1813795; gDNA_ID_1621084; Annot_ID_170467

SEQ ID NO: 17722 - DNA, 3000 bp, Unknown; identical to SEQ ID NO: 6244
  misc_feature (1)..( 3000): 2750-1469P.txt file - cDNA_ID_1813805; gDNA_ID_1621084; Annot_ID_55345

SEQ ID NO: 17723 - DNA, 3000 bp, Unknown; identical to SEQ ID NO: 6234
  misc_feature (1)..( 3000): 2750-1469P.txt file - cDNA_ID_1813809; gDNA_ID_1621084; Annot_ID_55343

SEQ ID NO: 17724 - DNA, 3000 bp, Unknown; identical to SEQ ID NO: 6234
  misc_feature (1)..( 3000): 2750-1469P.txt file - cDNA_ID_1813809; gDNA_ID_1621084; Annot_ID_170459

SEQ ID NO: 17725 - DNA, 3003 bp, Unknown
  misc_feature (1)..( 3003): 2750-1469P.txt file - cDNA_ID_1813832; gDNA_ID_1621084; Annot_ID_55336
tacctagaaaaaatataaaacaatgtcaaaaacgaaaaaaatctgacaaataaaattaaaattagaaaaccgacattattgtataatggtttgtgctagtaattttgttatgttgctattcggattcaaactcttgtatgttattgacaaataaaaaaatccgacaatcatgtatttttctaagttttgaaagaattaacttattttaaatttctatattggattattaataaaataaaggactgagtagataatgtcaaaaaaaaaaaatgagtagattaataaataaatgagagggaaaaaaaaggcgagattggcggtggtagatgtaggagaagaagagaacaaaacaaggaggatacagttggctatggaatattatggttcataatgcaaccaaacacatataattgaaatgaaccacacacacgcttttaattatacacataagagtgatcgagcaccattacattttctttctttgcttcgttgtaaagccgactttatattatcatctctttttatgtaaaagaaagttgtaatgggttttaataatatatataaacagaatgggtcaatctaataaatattcggaccacaatgttaaaaattagttatctgtttttttccggccggaaacaattatggtgatttaaaagattatcatcatcaatttttattttttttgacgttatcatcaccaattattgattggtatatattcttctacggtttctgtaaatttatcatgaaattccttactatgcttttttttggttaaagaattatttactgtttttgataggaggaaaaatgatcgtccacgttcagtatacggcatcatcagcaaaaccattcaaaaatgtttttactggaacggccaaatatggtataacgacttatagcattgtgtacgtgtgttatacaataacaagttctctaaatgtttcgaagtttacatggtataagagcctctatgaaatggaaacctaattcgttatcatggagctcgtccaatggtgagaaagaactcagcaccaagttggtggaattatcaacatcataagagagttcttctagctctttggtgcaagtgacatgtgagaattacaaaaaatgggttaagaattaaaaatgcactcaaattattggtttgttagaatgaaagtggatcacaaatagaatgtggtcgtggagctagaaactggagggtagaggctcatatcagaactcacctcaaagtccatatccgtgtcaaggcaggcgtggacgaggacatcaattaaggccgtagtactgtcccgtattaaacacaataataaaatcgtaccttgaaagctataagaaaatagaagagagtgaacaatcgacaaatgacaacgagaaacatttaatgaaatgaaaatatctatgctccagacacagagataacccacgggcagccaatgaagcactccacttgcgaatttgtaatagaccctacttgacaatgagtagaagagccatatcatgtatatttaatatttaagttggtgtgttgtagaatacgtagaattgttttgtgccataaaaattaagaaagtgtttattttgttttcttagctcgtgtataatcaaatttaagtagttgaattcgtggaattgtagtaagtaactgtgtgcttcgactaagtgtatggtgtgatggtgtcgtggtgacatttcttcggttcttccaaaggaagttaaaccttgcactgcccgcttgatcccgtttgagagaaatgagtccaataattaaagatatcataaatttcttaagttaaaaacagtgtgttgaccgatgaaatattatacaaaaatgtcttttctacctaattgagagtcacacatctttgatccaatttttctctattacatctttgatacaatttattacatctttgatccaaattgcactctattacatctttgatccaatttttctctctatttttctaccgattacacaataacatattaatttgtccataaagattgttatgaatggttcagtgttacaaaatctccattattccaccttgcatattgctgcggaatgcccaagaaacaagactaaagaggcgaataaatcacagaagcgaaaacgctctaaaattcctaatctaatagacgcattcgcctctttgatttattcgccacaaacaagttttgttagtataacaaataaaaattttcccttcgcagaaacaaagtcgagattcgacaaaacgttcaccattcgaacaccaacaacgacgaaaagaagctaattaataaaccaaacagaagagaaagccttggcctgcaaataaccgtcatgacttagtgctggctgcaactaacgccatgaatggtctatcaattaagaactcttttgatgtaattcactacaaaatctaaatttttgacccgctacaagatttaattgggagatacgttgaatctcaaaaaaaatcgtaagaaactacaatcttccttcctataggcatgaagcttgttgtatgcttcgccaacgttacgtgtatgacttataatgccacgtgacactctcttagttggcggtttttgtctaaatcttttatgtgacgtggtgcgttctgatattcttattggtcaattatttttgctgatgtggtatgagaaaagtcaaaatcgtttcaaggagatttgttatcttagctaaaacaaaaagaagttattacaggaatagaaagagagagagacgaaaatttacgctgatgacgtggtaagggaacgacggagtggggaaccacaagccgttcttgatattcaacgtggtttgctcatggcggcgcgtggtagactcgtggtggcgcgtgggaacagaagcttttcatctataatcagaaaatactcattgaaaagtccatttccctctattttgttctttcttatttcttgcaatttcatctctctcatttttttttctgataaaggtgcaatctcatctcttgcaatatg

SEQ ID NO: 17726 - DNA, 3003 bp, Unknown
  misc_feature (1)..( 3003): 2750-1469P.txt file - cDNA_ID_1813832; gDNA_ID_1621084; Annot_ID_170450
aaaattagaaaaccgacattattgtataatggtttgtgctagtaattttgttatgttgctattcggattcaaactcttgtatgttattgacaaataaaaaaatccgacaatcatgtatttttctaagttttgaaagaattaacttattttaaatttctatattggattattaataaaataaaggactgagtagataatgtcaaaaaaaaaaaatgagtagattaataaataaatgagagggaaaaaaaaggcgagattggcggtggtagatgtaggagaagaagagaacaaaacaaggaggatacagttggctatggaatattatggttcataatgcaaccaaacacatataattgaaatgaaccacacacacgcttttaattatacacataagagtgatcgagcaccattacattttctttctttgcttcgttgtaaagccgactttatattatcatctctttttatgtaaaagaaagttgtaatgggttttaataatatatataaacagaatgggtcaatctaataaatattcggaccacaatgttaaaaattagttatctgtttttttccggccggaaacaattatggtgatttaaaagattatcatcatcaatttttattttttttgacgttatcatcaccaattattgattggtatatattcttctacggtttctgtaaatttatcatgaaattccttactatgcttttttttggttaaagaattatttactgtttttgataggaggaaaaatgatcgtccacgttcagtatacggcatcatcagcaaaaccattcaaaaatgtttttactggaacggccaaatatggtataacgacttatagcattgtgtacgtgtgttatacaataacaagttctctaaatgtttcgaagtttacatggtataagagcctctatgaaatggaaacctaattcgttatcatggagctcgtccaatggtgagaaagaactcagcaccaagttggtggaattatcaacatcataagagagttcttctagctctttggtgcaagtgacatgtgagaattacaaaaaatgggttaagaattaaaaatgcactcaaattattggtttgttagaatgaaagtggatcacaaatagaatgtggtcgtggagctagaaactggagggtagaggctcatatcagaactcacctcaaagtccatatccgtgtcaaggcaggcgtggacgaggacatcaattaaggccgtagtactgtcccgtattaaacacaataataaaatcgtaccttgaaagctataagaaaatagaagagagtgaacaatcgacaaatgacaacgagaaacatttaatgaaatgaaaatatctatgctccagacacagagataacccacgggcagccaatgaagcactccacttgcgaatttgtaatagaccctacttgacaatgagtagaagagccatatcatgtatatttaatatttaagttggtgtgttgtagaatacgtagaattgttttgtgccataaaaattaagaaagtgtttattttgttttcttagctcgtgtataatcaaatttaagtagttgaattcgtggaattgtagtaagtaactgtgtgcttcgactaagtgtatggtgtgatggtgtcgtggtgacatttcttcggttcttccaaaggaagttaaaccttgcactgcccgcttgatcccgtttgagagaaatgagtccaataattaaagatatcataaatttcttaagttaaaaacagtgtgttgaccgatgaaatattatacaaaaatgtcttttctacctaattgagagtcacacatctttgatccaatttttctctattacatctttgatacaatttattacatctttgatccaaattgcactctattacatctttgatccaatttttctctctatttttctaccgattacacaataacatattaatttgtccataaagattgttatgaatggttcagtgttacaaaatctccattattccaccttgcatattgctgcggaatgcccaagaaacaagactaaagaggcgaataaatcacagaagcgaaaacgctctaaaattcctaatctaatagacgcattcgcctctttgatttattcgccacaaacaagttttgttagtataacaaataaaaattttcccttcgcagaaacaaagtcgagattcgacaaaacgttcaccattcgaacaccaacaacgacgaaaagaagctaattaataaaccaaacagaagagaaagccttggcctgcaaataaccgtcatgacttagtgctggctgcaactaacgccatgaatggtctatcaattaagaactcttttgatgtaattcactacaaaatctaaatttttgacccgctacaagatttaattgggagatacgttgaatctcaaaaaaaatcgtaagaaactacaatcttccttcctataggcatgaagcttgttgtatgcttcgccaacgttacgtgtatgacttataatgccacgtgacactctcttagttggcggtttttgtctaaatcttttatgtgacgtggtgcgttctgatattcttattggtcaattatttttgctgatgtggtatgagaaaagtcaaaatcgtttcaaggagatttgttatcttagctaaaacaaaaagaagttattacaggaatagaaagagagagagacgaaaatttacgctgatgacgtggtaagggaacgacggagtggggaaccacaagccgttcttgatattcaacgtggtttgctcatggcggcgcgtggtagactcgtggtggcgcgtgggaacagaagcttttcatctataatcagaaaatactcattgaaaagtccatttccctctattttgttctttcttatttcttgcaatttcatctctctcatttttttttctgataaaggtgcaatctcatctcttgcaatatggtattaggagaaacgaataagaaagtgatcaagaatgtgattaagctcttaacgatg

SEQ ID NO: 17727 - DNA, 3000 bp, Unknown; identical to SEQ ID NO: 6240
  misc_feature (1)..( 3000): 2750-1469P.txt file - cDNA_ID_1813836; gDNA_ID_1621084; Annot_ID_170449

SEQ ID NO: 17728 - DNA, 3000 bp, Unknown; identical to SEQ ID NO: 8011
  misc_feature (1)..( 3000): 2750-1469P.txt file - cDNA_ID_1813843; gDNA_ID_1621182; Annot_ID_57401

SEQ ID NO: 17729 - DNA, 3003 bp, Unknown
  misc_feature (1)..( 3003): 2750-1469P.txt file - cDNA_ID_1813843; gDNA_ID_1621085; Annot_ID_55377
catttagtagaaaacttgtaagtctttttgtgcttattctatatcttggtatgttttatatcggttatctgacatttgtgttccttgacgaatacttaccttgaacaaaagcagagactttacaaggatgagtcatattcagcattttctccagggactaggaaatacttacagtctctaatcgatgagccgttgtctactaatcatacatctaaaagtgttctggacccattattatcatttatatacaatccgccgtcaccaaagaagtccaagcttgtacaacctgattcatctagtgaagcaagcatggaagacaatagcttaataagggattcaacagaaaagtaagtaattctttgacattttcttgattctgcttgctttatctcatcttcttaaaccttgtctaaagatacatttcgtatttctgtgtgctcagagactgggaatcgccgtctcccttgtcagatacagagctactagagaaggcaaagaagagagagtttgtacaaggtttaatatcatcagccatatttgatcacatttacaacttctaagagcataagtctttgtatatgaaactctcgcaaagtagtctgtactctgtagtataagccaatgagcttctgtttatcgtcaaacttctactttgcttctttacagctcataatcctcaagtcacttgaggtcggagtttccttaacaaccacttcttgcgtagtttcacatctagagccaagaaagttttcgccttgagtttatcttcaagcagatcacaagcatccaatataagttcatcgtccatgtctggtaacgcttgaatagcctcaaccgtgtcctctattgacatggtttgggtttcatcaactcgaggctttttcgggtttatagggcttgtatcagtattagcaagttgatctcttttgttcttggggtcaaacaaaagagagttgctatcttcttcctcagctgaaatagacaaatctgtagtaccactggacttaaattcttggaattcagtttcagggtcaaaccaatccatagctacaaagcattcgttttcttcgatcccagaatcgccacagagcacacacagatctttatagtacggaattggccgagtcataaattgccttgcatctctatgagcctgtgattaattcagacaagaacacacatcaaaacagagacgaaaacactgtaactaaccacacagcatagatcagagcgattaagttacctttatatagtcttgccatacattattatcagctgtaaccatttgacgctcattatcccaagcaaacccatctgatcgaagaatactcttgatcgcgttgaactgtcttctcagagacttataccggttcttcaacacatcaacatcaaagttagactcaaatttcgcattgaagagattaaccatctcagtccatgcttgtttcctgaaaacaccttcaatctggtttcctctcctcgcttggtccaacatcagatcaatgaaataccggtccattggaggatgccaagtagtcctgcaccgtgtgacactgcttccttttgagttagacctgactgttgacgattcacatattctgttgtacccatcatcttcctgaatcagtgtcttggattctccctcactaatactctcctcagctgaaacatacatattcattcacaggttacttaagaatctttgatctttggtgacaagaatgtacaatgaaggattcaagtaacaatcaatagattaaagattgtacctttgtgctcagacattccatctgagtaaaccaagcacagatctttgtaacaaggtatagactttatccgaaaagatctcgaatcaggatgaatcttcaataacccaaaagcaaaaacaaatcaatccctgagaagaagacacaaaatcacaagtaaacaaaacgcaaaacgcaccttaagatactcatcccaaacgcagttatcagcaacaaccatctgtctagtatcatcccaactaaaaccatcttctatcaaaagattattcacagatttaaacaagttcctcaatgtcttatgcctgtttttcaaaacatctttgccataaagaaacttgaacttggcagtgaaggaacaagacatgaacttccaagctcgtttactaaacaaatgatcttcaaatctgttgccttttctaacttgttccaccataagctcgatgaaatactgatccatttcaggtgtccacactgttcttaatctctcattgccgtttctactgctcattatctatttctcccttcttctttacctgcaaaaaaatcgattgcaagaacacaaatttgaaatcgagaaatcaagttataaaatcagaaatcagattctcgtaagaaactggatcagacccataatagagattcgactaaattagctaaagagcagagaatcttcgcttacagagagtcagagctccggtgaacgggagttggagtaccggtgagattttaaggataaggttgtccgggataaggttatacttttattcgtaaccaatttagaaacctttatgggcttatattactttattgggcttagtctattataggcctatgttaaacgacatcgtctattctagggtttgtttttgggccagagtgacgtttgttttcctttcgtcgtcgtcgtcgtcgtcgtcttcgtcttcgtcttcgtgaaagatgtttacaaaattttgctgtttaaattgatagaagaagattcgacctttaaaggctatctgaagaacatctccatcatcgcctggtgttgtaagtttcttttggattttgattcttgttgatactgactagtgagctcatttttaacatttgttcgtaccaattctgggatttgtaattagctgagtattgagctctaaatcttgaaaaattagtgagtttagtattttgcgaaagacccattaacagattatgatttgtgcgttgtttcttgccaaatacttttgagaggtttatg

SEQ ID NO: 17730 - DNA, 3000 bp, Unknown; identical to SEQ ID NO: 8002
  misc_feature (1)..( 3000): 2750-1469P.txt file - cDNA_ID_1813843; gDNA_ID_1621182; Annot_ID_174317

SEQ ID NO: 17731 - DNA, 3003 bp, Unknown
  misc_feature (1)..( 3003): 2750-1469P.txt file - cDNA_ID_1813843; gDNA_ID_1621085; Annot_ID_170516
ttgacgaatacttaccttgaacaaaagcagagactttacaaggatgagtcatattcagcattttctccagggactaggaaatacttacagtctctaatcgatgagccgttgtctactaatcatacatctaaaagtgttctggacccattattatcatttatatacaatccgccgtcaccaaagaagtccaagcttgtacaacctgattcatctagtgaagcaagcatggaagacaatagcttaataagggattcaacagaaaagtaagtaattctttgacattttcttgattctgcttgctttatctcatcttcttaaaccttgtctaaagatacatttcgtatttctgtgtgctcagagactgggaatcgccgtctcccttgtcagatacagagctactagagaaggcaaagaagagagagtttgtacaaggtttaatatcatcagccatatttgatcacatttacaacttctaagagcataagtctttgtatatgaaactctcgcaaagtagtctgtactctgtagtataagccaatgagcttctgtttatcgtcaaacttctactttgcttctttacagctcataatcctcaagtcacttgaggtcggagtttccttaacaaccacttcttgcgtagtttcacatctagagccaagaaagttttcgccttgagtttatcttcaagcagatcacaagcatccaatataagttcatcgtccatgtctggtaacgcttgaatagcctcaaccgtgtcctctattgacatggtttgggtttcatcaactcgaggctttttcgggtttatagggcttgtatcagtattagcaagttgatctcttttgttcttggggtcaaacaaaagagagttgctatcttcttcctcagctgaaatagacaaatctgtagtaccactggacttaaattcttggaattcagtttcagggtcaaaccaatccatagctacaaagcattcgttttcttcgatcccagaatcgccacagagcacacacagatctttatagtacggaattggccgagtcataaattgccttgcatctctatgagcctgtgattaattcagacaagaacacacatcaaaacagagacgaaaacactgtaactaaccacacagcatagatcagagcgattaagttacctttatatagtcttgccatacattattatcagctgtaaccatttgacgctcattatcccaagcaaacccatctgatcgaagaatactcttgatcgcgttgaactgtcttctcagagacttataccggttcttcaacacatcaacatcaaagttagactcaaatttcgcattgaagagattaaccatctcagtccatgcttgtttcctgaaaacaccttcaatctggtttcctctcctcgcttggtccaacatcagatcaatgaaataccggtccattggaggatgccaagtagtcctgcaccgtgtgacactgcttccttttgagttagacctgactgttgacgattcacatattctgttgtacccatcatcttcctgaatcagtgtcttggattctccctcactaatactctcctcagctgaaacatacatattcattcacaggttacttaagaatctttgatctttggtgacaagaatgtacaatgaaggattcaagtaacaatcaatagattaaagattgtacctttgtgctcagacattccatctgagtaaaccaagcacagatctttgtaacaaggtatagactttatccgaaaagatctcgaatcaggatgaatcttcaataacccaaaagcaaaaacaaatcaatccctgagaagaagacacaaaatcacaagtaaacaaaacgcaaaacgcaccttaagatactcatcccaaacgcagttatcagcaacaaccatctgtctagtatcatcccaactaaaaccatcttctatcaaaagattattcacagatttaaacaagttcctcaatgtcttatgcctgtttttcaaaacatctttgccataaagaaacttgaacttggcagtgaaggaacaagacatgaacttccaagctcgtttactaaacaaatgatcttcaaatctgttgccttttctaacttgttccaccataagctcgatgaaatactgatccatttcaggtgtccacactgttcttaatctctcattgccgtttctactgctcattatctatttctcccttcttctttacctgcaaaaaaatcgattgcaagaacacaaatttgaaatcgagaaatcaagttataaaatcagaaatcagattctcgtaagaaactggatcagacccataatagagattcgactaaattagctaaagagcagagaatcttcgcttacagagagtcagagctccggtgaacgggagttggagtaccggtgagattttaaggataaggttgtccgggataaggttatacttttattcgtaaccaatttagaaacctttatgggcttatattactttattgggcttagtctattataggcctatgttaaacgacatcgtctattctagggtttgtttttgggccagagtgacgtttgttttcctttcgtcgtcgtcgtcgtcgtcgtcttcgtcttcgtcttcgtgaaagatgtttacaaaattttgctgtttaaattgatagaagaagattcgacctttaaaggctatctgaagaacatctccatcatcgcctggtgttgtaagtttcttttggattttgattcttgttgatactgactagtgagctcatttttaacatttgttcgtaccaattctgggatttgtaattagctgagtattgagctctaaatcttgaaaaattagtgagtttagtattttgcgaaagacccattaacagattatgatttgtgcgttgtttcttgccaaatacttttgagaggtttatgaaacagagtaaaaccctagaattcaattcctttgctctgttatgcagtcttcatttcatcaaattcaacacagaagattcgatg

SEQ ID NO: 17732 - DNA, 3003 bp, Unknown; identical to SEQ ID NO: 17729
  misc_feature (1)..( 3003): 2750-1469P.txt file - cDNA_ID_1813843; gDNA_ID_2926183; Annot_ID_140639

SEQ ID NO: 17733 - DNA, 3003 bp, Unknown; identical to SEQ ID NO: 17731
  misc_feature (1)..( 3003): 2750-1469P.txt file - cDNA_ID_1813843; gDNA_ID_2926183; Annot_ID_200393

SEQ ID NO: 17734 - DNA, 3000 bp, Unknown; identical to SEQ ID NO: 6258
  misc_feature (1)..( 3000): 2750-1469P.txt file - cDNA_ID_1813847; gDNA_ID_1621085; Annot_ID_55374

SEQ ID NO: 17735 - DNA, 3003 bp, Unknown
  misc_feature (1)..( 3003): 2750-1469P.txt file - cDNA_ID_1813855; gDNA_ID_1621085; Annot_ID_55372
ggaaatggaacacggtttcgtggaaactagaaactacaataaggagacagccgcaacaacatgattcaacggcacacaactaaactaatcaagccttccttatctcccaagttttttttactagacctctaattacttttaattatagtccttctttaattaatcataatgaaagttccatacaatatttatgtatttgttttcttctaagaaattaattaccttcgcaagttcagtagtgatccagcttaccagattattatagagttgcaactattcgtttataatattattcaaaatataattgcatttcgtaaaagacaaaacaatttaaactctttctagtcagtcataaattctcttaactcttttgttatttcttggttgtaggcttgtagcatttacacaatttggtaaaccattatgtaacgtaattaacatttatatttcaataacaatttttatatataaacaatatctaaacgtaacacatctggagacagaaaacgtgaaactaataattaggtgaaaccaacaaagaatactaaagatgttgaacgtatttacttttaaattaaaaagcacaacagacgaaataaatcgaaaaatgcgtaattgagaaacaaaacggctaaacacagctaagatatggtccacgtccagccgtgacccacatgaacttatttgtaattttttcgtaaaatattattaacaaatatttttttcttttgaaaaattatgataaacaaatttatatgatgtattatacataattaataatacatattgaagcatgtaaggtttaaaaaaaattcggatattagtgtctatggaattttattactttttaaatcaactataaaactatctttttaaaataattcatacaaagaaatactttaattaaggattaaataattaatgtcagtcacgtaggatattatatatttttggagttaaatgtgataatttatttttatttgttactccgcgttgggcaaaattgcaaacagcaagcaaaaagctgcatacctttgtgtatataatacacatacacacacaatcatttcatgaaccataagcaacacacaacaaaaacttcatcatcaaggaaaaagaaaactcatctctgatcaaaaatcgagagtataataaatcatcaatggcggattcgtctcagaagaaaatcagaagaaacgcgataacacataaagcatggagtctcatgaagatggctcttctatggggaagaaaaggtggagttttcaaaaaatggccattgttcgaactacgtagcttgttcttcaagcatctcaaagccctagctcatcatcatagtaacggtgaccgttattacggagaacgccagctttcctttgatgaaacgccgttatttaacgtcaagaagaagatgcattgtcctacttcgtctatgaggttcctcctcctcccctgctttgctcctcccgtagattttgactatgactttgaaatggacggtcaagattattccgacgaggtacaatcgtacggttacgatgaatcttgttcggaagaagagaaaggggtggatgtgagagcagaggagttcattgctaagttctatgagcagatcaagttgcagagacaagtgtcttatttgaaatacaaacaacacaacgacgccgtattattatagatttatgatgatggttttatttactaatatgaatgaatgcagcttgtttttgtagataactgagtctatatatcatctaattacaacaacaaaaagatgtttcatttttgatttcatatgtacttcattttcctttttttttatgaatttccttttaccgtattgttgtttcaaacaaatattaatagataagtagtacattgtttgttaactggaagtcagtacccaatttgccccaaaacctaaaatattagtcaaatgcagtacgatgcaatcttaatagtttaggataggtgggcgcaatctagattgaatcatccaatccaatcatatatataatttaattcaagtttttttttcaatcttcctacacaaaaaataacaaatattacccgttttggtaatttaatatagagagttagggcatctccaaccctattatattttagagtaaaaatgcaagattcttctccaaccctactttataattgactcagagatttctgcagattgactctatatatagagcaactttatttttgagttcaactttttttatttatactttaatccctcaaattcaaacttttttatttaatacatatacacatagttttataaacttaacaatcaaacaagtactaaatttaaaataaacaacataagaaaactaaaacataaaactaataatttaatagtccggtaaattgtttgtagatccgccaaacatcatttttttttgaatcttcaaatgatcttttcgttgtgcacttgtcttctttagttcttctaaaagtttttttatttccttcttctaaggtgttgataaccgacgttgttatatgatgtaattttttcttaataaataattagtgtttaattcaaattatatcaaattttatgggaattttgcaaatctataatatatgaggtcaaattgtaaattatataattaaaaggtattagtatataaagtaaaaatagaatatttttaagaatattattttttagagtagaaatcctaactctattttaaagtaagatataaaactatacatttgagatgttcttagatacgaatttacaaaccatcctaaatatcaaaactagttaaataattaaaattttccaaggtacatgtcactataaaaacagccaaaagcttttctacatgctagtgtagaaactgacccaagaggtatcattaggggaatccaaattcaaaggggatacattcatcaaaagcagttggtgagcctccgttttttctagcatcatcggtcttctttgcgataaaagatgcaatgagatctagagccgagatg

SEQ ID NO: 17736 - DNA, 3003 bp, Unknown; identical to SEQ ID NO: 17735
  misc_feature (1)..( 3003): 2750-1469P.txt file - cDNA_ID_1813855; gDNA_ID_2926172; Annot_ID_140186

SEQ ID NO: 17737 - DNA, 3003 bp, Unknown
  misc_feature (1)..( 3003): 2750-1469P.txt file - cDNA_ID_1813875; gDNA_ID_1621085; Annot_ID_55361
ctcagggatttttcttcccattccttacactgggtttaaggcacttcgagctggcttagtagcagacacctatctggaagcaacgtctgttactcatttcaagaagaaatatgaggagtaaggcgttgttacacctttacactaacgaaacattctgatttagtaacctattccatgtttttctgcatttgcttaagatacaaagcagctttcgtgtgtgcacaatatcagaaagcatctttatacctttttcattatgatctacagatatgagtttcagaaagatgaggaagaacagattgcacgtttggctgaggatggtgacatatacaataagctgtcgcgatccctggcccctgagatttatggacatgaagatattaagaaagctttgcttctccttcttgtgggtgctcctcacaggcaattaaaggatggaatgaaggtgaactttcctgtcctctgatttattctggcaaaatttccatgatattgctatctattatgataaagagtaaagactgtacactgattagaaagcagttgcttgctttagttcatctccgactatattgttttacctatttccatacagtgtccgcagtcttcattgattgagttatggagctttattatttacaaacatgttcagtcattcaagagcacattgcacttgattggaacacattttatctgtgaagatttaaaaacaatacattcattaattatcttttgcagattagaggagatgtgcatatctgtctgatgggtgatcctggagttgccaagagtcagcttctcaagcacattataaatgttgctccaaggggagtctacacaacaggcaaaggtagcagtggagttggtctaactgccgctgttatgagagatcaagtaacaaatgagatggttttagaaggaggagcactggtgagagacaatgcccttttgctttggatatattttagaaaatatgatgtaagagctatgtgatttagaagtttgatacaatctctatctcaggtgctggctgacatgggaatctgtgcaattgatgagtttgataagatggatgaatcagatcgtactgctattcatgaggtcatggagcagcaaactgtaagcattgcaaaagctgggattaccacgtctttgaatgctcgaacagctgttcttgctgcagccaatccagcctggtaagtgaactctcatgatatgaattaaaaactcatgaatgttgagtgatcattgctatcattattgaactatgtatctttgtgtttatgaaggggaagatatgatttgcgaagaactccagctgaaaacattaatcttccaccggcccttctttcaagattcgatctgctgtggttgatcttagatcgagctgacatggacagtgaccttgaattggcaaagcatgtgcttcacgtacatcagacagaagaatctcctgcgcttggtttcgagcctctggaacccaacattctccggtaagttaaatcgcttttacagcattcttgttctgcaaagtcagaaactttaacatgagcatatttggttctctagtgcatacatttcagctgcaaggagattatcaccatacgtcccagcagagttggaggaatatatagcaactgcttattccagcatcaggcaagaagaagcgaaatcaaatactcctcattcttacacaacagtgaggacactgctcagcattctgcgcatatccgctgtaagtagaatttgtgtaggaacttgagtaaattagttggactattgagtgttaatatatttccgatttgttctataggcattagcaaggttgagattttcagaatcagtggcacagagtgatgtggatgaggcgcttagactaatgcagatgtcgaaaatatcattgtatgctgatgaccgacaaaaagcaggactagatgcaatatcagacacatactcaatcataagagacgaagctgcaagatcaaaaaagacccatgtgagctacgcaaatgccctgaactggatctccagaaaggttagtttcttccttcatcttcatcttcatgttctttctgaaaatggatgatcactgagacgagagatttggggtgtgaaaacagggatacagtgaggctcagctaaaggagtgtttggaggaatatgcagctttgaatgtttggcagattgatcctcacacctttgacatccgttttatctgagtaacaccacccaaaaaaaaaaaatggaaacaaaccaagtctctcttgttatgttgtgtgctttatctctattatcttatcacatttcttaacgtagagaccttagaagtggaatctatagaagtgatctcttgattgcagaacaaactttacttttggaaatttagatgtgactttgtactcttgcagttcttttcactctcgcaaatttactacggttttgatctaggtttgattaaaacacttcttagtctaattttgtatccatgtcagtaatatactttcagtttggtataatttgatttcattattacaatcataaaatattgtaagtaccatgctaacatattttcaaaaaaattctaaaagtggaattttgggatttttatgacaattttggaaaacagaacaattttcggtttagtaacataacagatcggttctggatcggtttaagaattaatgggccatattattatacttttaagcccattaatacagagcaaagcccatttacgtcgttgcaatatctcactcactccataagcttttaacggcatgaataattcgattttcgagatggcacagagagagagcgagtattattactagagcgttgtttcccgccaattagcaactttcgccggcgtattttcccggtgaaaaattcccgcgcaatctcttcactccataataagcttctctcatcaatctcgctctcttcgccgactgtttcactccccttctctctcactctctgtgcgctttattccactctccgatg

SEQ ID NO: 17738 - DNA, 3003 bp, Unknown; identical to SEQ ID NO: 17737
  misc_feature (1)..( 3003): 2750-1469P.txt file - cDNA_ID_1813875; gDNA_ID_2926172; Annot_ID_140175

SEQ ID NO: 17739 - DNA, 3000 bp, Unknown; identical to SEQ ID NO: 6252
  misc_feature (1)..( 3000): 2750-1469P.txt file - cDNA_ID_1813879; gDNA_ID_1621085; Annot_ID_55359

SEQ ID NO: 17740 - DNA, 3000 bp, Unknown; identical to SEQ ID NO: 6252
  misc_feature (1)..( 3000): 2750-1469P.txt file - cDNA_ID_1813879; gDNA_ID_1621085; Annot_ID_170491

SEQ ID NO: 17741 - DNA, 3000 bp, Unknown; identical to SEQ ID NO: 6252
  misc_feature (1)..( 3000): 2750-1469P.txt file - cDNA_ID_1813879; gDNA_ID_2926172; Annot_ID_140173

SEQ ID NO: 17742 - DNA, 3000 bp, Unknown; identical to SEQ ID NO: 6252
  misc_feature (1)..( 3000): 2750-1469P.txt file - cDNA_ID_1813879; gDNA_ID_2926172; Annot_ID_199591

SEQ ID NO: 17743 - DNA, 3003 bp, Unknown
  misc_feature (1)..( 3003): 2750-1469P.txt file - cDNA_ID_1813887; gDNA_ID_1621085; Annot_ID_55357
caataaagtaaacagagactcagaagctgatgcaaaagaagtaggtgagcctattccagacaattcggtccatgatggtggttcctcaatttgtcagccacaccatggtagtggaaacggagcaataatcattgcagaaatgtctgagacaagtcgaccatctacagagtggaatcctatcgagaaggatctttacttgaagggagtcgaaatctttggaagaaacaggtaaactggatcttggtaaattattatctttaaacacagaacacctataacgtatttacatctagtatgttttgtccgtgctatctcagctgtcttattgcaagaaacctgctttctggcttgaagacatgcctagatgtgtccaattacatgcgtgaaaacgaagtttcagtttttcgaagatctagtaccccaaatttgctgttggatgatggcaggactgacccagggaatgatgtaagctcttgatcttcctagggtcttttgtcttttcaaattttctgcagtatctgcgactttgggcattgttgtattgaaagttagcttgtcagactgatagggttagagatctattccagaagaaaaaagttctgatccggaaaagccaatttccttgcttaatttttccctgatacctgcattggacaagagaaaacgatagttgaccataagttggcttagacaagtgattattttatttgagattttattgatattagcatgccatgtctgtcagaatcatattttggtttaccgctctcttactttacttgacagaatgatgaggtgcctccaaggacaagattgttccgtagaaaaggcaaaacccggaagctaaaatactctacaaagtctgctggtcatccgtctgtctggaaaagaatagctggtggcaaaaaccagtcctgtaaacaatacacgccgtgtggatgcctgtcaatgtgcggaaaggattgcccttgtctaactaatgaaacttgctgcgagaaatattgcgggtatgcaaacaaattaacgtcaattgaagtaacagaggatcttcttataaccatccattgatttaattcaggtgctcaaaaagctgtaaaaatcgtttccgaggatgtcattgtgcaaagagtcaatgcagaagtaggcagtgtccctgctttgctgctggcagagaatgtgatccagatgtttgcagaaattgctgggttaggtagtcattttaaatctagatctcttgatgtgccatatacaatcaaatctactatttgatgagtaacttaagatgccttgcttattcactcagttgtggagatggttctctcggtgaagcaccaagacgcggagaagggcaatgcggaaacatgagacttctcctgaggcaacaacagagggtataatactgtcatcaaatcatgtatttactaaaaataaaatgcattcattgttgataaatctagtttctcatgtgctatatttaccagatcctattgggaaagtctgatgttgctggatggggtgcttttctaaaggtaaagcatgtgaatatcttcctcattaacttctgtttcatacctcttgtatgtaatctgaacctcatctgatcatcagaactcggtcagcaaaaatgaataccttggagaatacaccggtgaattgatctcacaccatgaggcggataagcgtgggaaaatatatgaccgggcaaattcgtccttcctctttgacttgaatgatcaggtgaccaaatctctcacccttctttctgatagtttcctcttgaatttcgcatatgtcagtaagcttttgatatttgcagtacgtcctcgatgctcaacgcaaaggtgacaagctgaaatttgccaatcactcagctaaacccaattgctacgctaaggtactaaatgcttctctctcatatccattttggtatgaaaaaaccacatgatcggttagtaattataccttctttctcacctctagccactcaaaagttccatttagaaggaggactaggattataacattttgtagaaactaatcgcaattagcactatagaaaacagatgatcaaatctagctttgtaggttatgatcaaaacacacttgtttctacaatctttatgattgtaatgtgtaaagtaacatgtgtatatcatctgctagatttattcaacccttttcgaaaggtgttaattatttacaaaaaagagcgattttcagtctattgtcgtagtaaccatggtctcatcgcttcccgcataagtacggtgtctttttctgtgtggtgtaggtgatgtttgtagcaggagatcacagggtcgggatttttgcaaacgaacgaatagaagctagcgaagagcttttctatgactatagatatggaccagaccaagcaccagtgtgggctcgcaaacctgaaggctccaagaaagatgattcagccattactcatcgtagagccagaaagcaccaatctcattgatgattactggctaagagaagtaacttttataaaaataacttatagagttgtgagagatgatatttgaagtttgataacttaagcttgtctttattaattaattattatagagttgagattttattttattttgacatcgagtttggactttgtataggtgataaaacaatttatgaattattggggtcaataagtaaaaatgtatcatttcgaaaaatagtttcaaatttatggatttttgaacagctaaagccaatctatgtacttttcaacgaataaaactgatttaaaataagtgaacgaaccaatcacactaaaccagtgcctaatctcataaaaagtaatccgactgctaaaccgtattccggttcgaatcggatacggatccgtttcccagttgattagtcggatccagtttcttcttgctttttcaattcacattacgaatctccgacgccaaaattctgcttccggtaacagatattttcgtcgtcgagaagaagcaggagtttagaaaaatg

SEQ ID NO: 17744 - DNA, 3003 bp, Unknown; identical to SEQ ID NO: 17743
  misc_feature (1)..( 3003): 2750-1469P.txt file - cDNA_ID_1813887; gDNA_ID_2926172; Annot_ID_140171

SEQ ID NO: 17745 - DNA, 3003 bp, Unknown
  misc_feature (1)..( 3003): 2750-1469P.txt file - cDNA_ID_1813895; gDNA_ID_1621085; Annot_ID_55355
aaattggaaaccacagttcagagaattacctgaagagtatgtagactgttgcgaaagcattctcgagaaaactctctgtgatcaatgagagaagaatccagtctctgtcttcttatacgaacatgatctgcaacaataagaagaaaaaaacaatgttaggtaaatatacaagtctttgatcgcttaactgtactcaaaattaaattcacgattacagatattgaaaccctaattcaaagaatcaaacacaaatattcgattaattggaagtaaaatcgagtaaatcaaaacaaaaaagatcgcaagatcttaaaagaaaagcgatttttgagaatttgaaaccctaaagagttaattcgatgaagaggattatataaatctttgtttaattttacccaaattgaagagagaaacgagagaaagaacttaaaggcgaatactaaccgaagagaaaaccatcaatctccgattagttatactcaaatcgagtacaacaagggaaagaacttgaaaatttgaaaccctaaacatcgattacagaaattactgactgaagagaacgataagtcatgataaatccagatgaaaccgaagatttgaacgaaaacttacagagcaaaattcaaaatcgccgatcaaagagtcgcagagaaagagaataatgaaaacctttttttttggcattataatagaaatctcagggaatttgatacgcttatatacgccacgtggcacattcctaacgttgtcgccaacgctaataacggctacattacgttttagaaacaaatgttttgatttttgcgtgttgtgattagtgaatgtggccacgtcataagcgttacatgtaaaatttgttaaatattaaattatagcatgccaaaaaagaacaacaaaaaaaatattaaggaaaaagcaaattacaaatacatcttttatgtaacacgatcacattatcattaaataaattaaaatattattattcaaaagtgaaacatgtggacacaaaattatttaccgaaattatttattcttcaaatcctaatcatcaaatagtatattttaatgtttgatgattctgattactaaccatctagaatatttgctaaagtttgtattccctctatttcataaaatttgatgttttacgttttgcacgaaaaagtaaattttttattttttaagtattattttgttagtttaataatattattgttatctcttccttttaatattggccacaaacaaaattaataattatacttttacaaaacattaatcttttgtggaacaagtaaaagaacccaaagcatcaaataatttggaagagagggaaaaattaacaacgtaacaaggtttttataagtcgtccattgttaagaaattgggctatagtctaaatatttttttaacaatgggtcttaaaagttaaaacataaaaaaaaatccaaaaattgtgatgagcttctgcaccgatgcccctttattctacccatttttggtctgggtctggtcttcacgtcggctcttggtacactgccactataaattccgaaagctgctcgtcgaatctctacattactgacatgtttggttagctatctgttcatcgtcttattcaccgggcagaatcattcaagctagctatctattcttgagaaaagctttcgaaaatattgtactgccacttcacctttagaaccttaagtaaattgttcgataccattgccattgtaagaaaggattttttattttttccggtttaacattggttttcattttaacttttaacggatcaaaatattaacagagaagtccgatagtgactgactgactgactgtgacgctttttgtttttagctaccgttaatgtttgttttccgttaacggcgtattttagtgtgcgtggacatatacgctcaagtacgccgcacgcttctcttctttttgtcgcgcattcaaaaaccgaaacgatcagaaaaaaaaaaaaagaatattaaataaacattttggactaaacaattaatttttttttaaaataatttctcgaaagagaaaaaaagagagagagagagagagatggagcttctacagtactaaaagctgagtgaatccgaagaaatctccgccaacggaatattttttttctgggagctgaaaatcgttggtgacgatggcggattctctttctagggtttacggaactctgtttagtggtgttaatatatctctcttctcggatccaccgttgaaaaccccctgaagagtgtttttttttccgggtttaaggtcttttacgtttcgttttttcttgagatttcgtcttccgctgtgagtttctgttctcgcggcgagtttttgtgtagatctgagggttttcaaggcaagagaaagtgtcggtgatgtcgattttctcactcgcgagctcttctggtaaattctcgtttatctattagcttcttatactgtctcttccaagtgtagtgatctcgatttttaaggaattttgaaattggaggaaaaaaagttgtgatgtttcggatttctaattttgtctatgggacctatgtgatatctagttactttgtttctttatctgttaggtcactctgattttggttagtgaatatcaagtcacaatatagatttggaatgtagtttggatttgaacttatcgtgctcaagatttttaggtttatagtttctaaatatatggtacatgatctttagctctggacctatatgttagattatccaggctcaaaaaggcaaagtatgttggaagtgatttgggttttggaccatgtctttgtatattttcatgaatatagaatagtaggttgaattcattaggttgcttaaagacattctttcaaaattactcccgaatggttgcaatacctaatcacatggctagctttagttctgttcttgtcttagctctatctcactgtttttaacgatataacaatcccagattcacaaagagatgacctaataatg

SEQ ID NO: 17746 - DNA, 3003 bp, Unknown; identical to SEQ ID NO: 17745
  misc_feature (1)..( 3003): 2750-1469P.txt file - cDNA_ID_1813895; gDNA_ID_2926172; Annot_ID_140169

SEQ ID NO: 17747 - DNA, 3003 bp, Unknown; identical to SEQ ID NO: 17737
  misc_feature (1)..( 3003): 2750-1469P.txt file - cDNA_ID_1813903; gDNA_ID_1621086; Annot_ID_55380

SEQ ID NO: 17748 - DNA, 3000 bp, Unknown; identical to SEQ ID NO: 6297
  misc_feature (1)..( 3000): 2750-1469P.txt file - cDNA_ID_1813957; gDNA_ID_1621088; Annot_ID_55455

SEQ ID NO: 17749 - DNA, 3000 bp, Unknown; identical to SEQ ID NO: 6297
  misc_feature (1)..( 3000): 2750-1469P.txt file - cDNA_ID_1813957; gDNA_ID_1621088; Annot_ID_170592

SEQ ID NO: 17750 - DNA, 3003 bp, Unknown
  misc_feature (1)..( 3003): 2750-1469P.txt file - cDNA_ID_1813957; gDNA_ID_2926212; Annot_ID_142028
ttgtgtaaatatttctttataagtttgtgatttttggtagcaaacattttgttttatggactcattgtctttgctttcatgttttttgtttttcgtaggaccaaatttataggttatacattcatctaaaaccttaaaaaaatcaactaaagatttacattcttactgatcatagcaagtaaattagtctcctttgtgttgtcgaaatgactcaacctcacaacatgatcacactttctgatccaagagctatccaaaatacaccggttacattaaactacgaacacatttcaatgataatgaacagttaaacacattacatagctttggttataagacgcagaaattaaaaaatcaatcaaaatattcgatactatgaaattgaatgttcatgtgaggtcgaaaagcggaaacgtgtcgaaataaaaatgaagagactaataaatatgttgaaggttagacaattgacaccattgaagatatgataaagcagaggaaaaaggatccattacaagttggctttggtgggtaaagagtataaatgcctaagaagaagatcctctccacacgtacgaaaaaggaaggttcggcacgtaacagatagttgtgcatacgtgtgaaaggagggtgggattcacgtgagagagattgaaccatttctatttcagaaaggaaaaaatagaaaacgagaaaaaatatcggtaggaaggtagaaaggttaagctgtcaattgtcattccaggttttgtagttggaacataaaacttttgtagctataattttaaaataaaacctgcaacgtatttttatgaaattttacgtttctagggaatattaaaatggaaaaacagagtgtttttattttattttattttaattactactccgacatgaattaactgtgtaaaaataaaaaataaaaaataacagaatttgcgtgctgatatgattttgacatgaaagattcccacatggtgtcacacaataaacaaaattcaatgttattatataagtggagttacacttgtgctttcgacatttccattaattatttatcccaatatggacttatgcctacggtgcgatatctaatactttctctaaccatttgtgggatatgcaccaaaactcgaatttgggaatgctatttttttagcaagacagacgtgatacgaaatatgtcaccgctttaagaaagaaattccgatatctatatattaaccatggaattaaaaatatagtctagccataccaaaaaaagaaactcaagtactcgaactcaaagctgttgaaccaaaaaaacggttatgtgtcgatttcatcggttttctagattatcccccacataaacctaattaacattttgagcacttgacttctgaaccgtcctcctacctttcacacgttccaaaccacaactcccgctcgtgcgaactctcatcttttattgtttatttgatacaccaaacaaaaaaaatgcacaccgaatttcattacattatccttcaagccattcatagttacatcgtactcgaccctcaagtagtaaaatttaatttatgatcacaagatcgatggccggaaaaaatagtttgaatatatactttttctagcctttgcattattttgcatgagtattattacttcggccatgctaattgttagaaaatacagcttacattttatttaacactgtattggtatatatgtatgtgggatatattatgttatcattagaaaatgctaattaatatgtaactaatttgtcatttccctgaaaagtcgattggaagggataattaacttgtggttagaacttaaaatcaattgattatatgagattaatttgttgtggtgttgtgattacgaccagtcgtacggagttttagagagtcatattctcgcataaagtaagtaaattcaattttgatgtagtagaaaaaaaaaattaacaaacgttaagaagattttttttttttttatgaagttttttatttacgaagatcttttagggtattccaggttaagataatagagatatgctacatttaaaataaatgtgtagactttaaattatgctgatgaggactggggagctatgcaccaacaatgaccagttacgtaaatatggacttaattgaccctatctgcgagtcagtccagtgaaatcagaagaatgacagatgagggtattatgggaaatataaatatggcagtattttaaatattatatatgttttttttttttgtcacgatagtattactaaaatttatggtggtggttcgtatcattgagatatgaccttgtactcacttaaaaaaaaaaaaaaaaaattacgaaaataaacatcttcaaattgttaatggcagaagacatttacgtgaaaaaaagacgcatcttagaaatttctatccttcaatcctactattaaccttttcaactaaatctttcataagaaaccatagtttaaaaaatcaccgattttttttttgcacgagcagctttatatatatataggaaaccaactaataaagaagattggtgggctaaaaagggtgacgaagaagaaagaagagtgacctctctctcgcatatttttctttccgatatatatatcttttataatatttgtgaattctgaataaactcttagtaagaaagaaaaggagagtccagaaaaagaaagcgagaaagagagagagaaaacgatacctaagctcaattatcttctctgcaacaaactccaaaggtattatcttcttatgctctctctttgcatacatacatatatatagatacctacatatatatatctctatgtctttgttcatcatcagttatataggtgatgtagatagatggacaaaaaaacagcgtaagacctagtttctgacttacatatgttttaaattctttgtctgaatcattacaggatccgagagagagagctctggaacgatattaacatatatcatgaagaaaaagattgaagtattgatatg

SEQ ID NO: 17751 - DNA, 3003 bp, Unknown; identical to SEQ ID NO: 17750
  misc_feature (1)..( 3003): 2750-1469P.txt file - cDNA_ID_1813957; gDNA_ID_2926212; Annot_ID_202690

SEQ ID NO: 17752 - DNA, 3000 bp, Unknown; identical to SEQ ID NO: 6324
  misc_feature (1)..( 3000): 2750-1469P.txt file - cDNA_ID_1813970; gDNA_ID_1621088; Annot_ID_55449

SEQ ID NO: 17753 - DNA, 3003 bp, Unknown
  misc_feature (1)..( 3003): 2750-1469P.txt file - cDNA_ID_1813970; gDNA_ID_2926212; Annot_ID_142034
ttttgttttttttttggttttgattaccattggttaaagcagagattcaacgttagacggatttatctcgacacaactctaattcagtttgaccggactgaacacttttatcaatattaatgttgagttgttgacctatatattattgtaataatgaataaacaacgccatgattgcgtactatctatcagactttatagagtaactactttgattaaccattacattttgtttttatgagaatgttttcagttatatatctttatcaacacagttgaaacctgttcttctatgttaaagcctttgaatttgagtaattttacttttgatagctagcctttttaaaatgaatgattatattgttaggttccaagtggggagttgtcttggggatctcatttgacgtgtgatcttgaatttttgatagagatcctaatgatctcgtggtccctctcgcagagtttatgtaaccatctaatatataacttcatgtctggatatggagaatccaaaacttaagaaatgcacgtattagcattcgtagttgtatatatgttatgtattttgcgtcaaatgcagaacaaaataaagcaagaagagaccaacaatcttcatatggagaattgtaaattgtccaaatcagcaatatatagatgtcttgaacaataaaaagataaccgagtttaacattagaccaaaaaaaaagaaagataaccgctacagaatttgtgacgaaaagaaaaaagctttggagaaaaaaacagagtaagaactgtttttgttgtgtgagaagagtttgtccttaggtcgcataatcttttaggatgtagttatatgtgttaagtgtaacacatgcatatcatttacttctgcaatatatctcttctggagtttcgtaaggtacttatggttggtttgtcttcgaaactaccaacgaacaacttaaaaaacattgatctttttaatagcgtgagtttgatttatgttatccttgttatggtgcatatgtattacggaaactttggtctgttttagatgggtaaatagttgtatatgagtaaatatgatattgccagtgttttatataaagaaaaagggaaacgatgataaaaggtgaaaaagaagtttaggatcatctttgttttttattttgttttccgactttcaaatcagacaagacaacgaggtatgggtcttttaacatacagagactcaacttgaaaattctatcaaaccaccaattaaaaaaccagagaaaacattcaactatcttcttagaatctagacaaaataaaaagtgtatcatgctgattttgaacaaattattaaagagatctcaaccatcgtttcattaatatctttgacaattctagaagccgtagtaaatcttgtctttttatgtgtatatcttgttgaatttgataaggatattcaaaataatgagatatgtatgttgagtaattgagtaaaatcagatcccttgtttaatttgacgattaaacgcttttttcattattttttttcgcattttgttgtgtatgttctcaattacaaattccactataagcatttggactctacaatgtcactttctaattctgatatttaataaaacaattattttgtatatgtataaatagtaccagaaaaacgaacttaataaaataattgaatcaaaagcagatgctgaacaaatagctgcagcttttagcaattgtctcccatatgcttttcctttgtttcaaaaattgtatatacgaggttaagtgaatgttgcaatgaaataaatgatgcagtttgtgcattcatcaagcgaacaagtacgattgatgttttcagtgcaaaaactaaaataaaatactactaacaactatatagtgtaaatatatataactttaacttctttttttttaagtcttcatacgctgcgaacgatcaaaatatatttacaaatttacgaccaatattttaaaaatacttcattaaagaattgatgctgctgtctgcacagttgagaacgcaattggaaactttcgtgcattcactttgttcgccgcaaattggatatgtgaacgtggtcatcattatttatagaattattctataaaacttactataaaacactagatataaagctggatcatataaaatgaatttactaaaaattcgatagttaattatagcagatgttatgttccaatttgaaagcatacgaacgaggtatatagttgaaaacacacaccgtaaagttaataattttcacaacacaagaacaaatcaaagtcgcaagtaatttaacgcatgtcagtagcatgggcttcttatatactagtcaatagaataaactagcaaacaagcaactaatgtattcttgtttatcacgccacgggttacaatatcatacaaaatttgaatactaattaatggtaacaagtaaaaaaacaaattactagaaatggaaatacttttgtcaaacaaccaagacgtataacttttgttttctatagattaatggacttcttaaaaatctctccatcagattaaactttgagatatacaaatacagtttttgttttcttctaaatgatatgaatattaactttatcgatttcatccgtagcagatttccattttaaataataaactatgagaaaacagataaaggttgtatattatttgttaccccaaaaaaaaaaaaaactaactacgagtagtagtttagtgtgtctcacgtgcgacgaggaaaagttttgggagagtaaaaacatttaatatttacgactagtttgaaaaaccgtgagctgacacaagctcattgctaatgctacagtaacagctaccttcacttttaactaaatgacagaccaatcattttaacctctgttttcttagctggcgcgtgacagacactctccctctctccatgcccataaaatctcaaagactgtttaaaaaaaaaaatgttttagctttaactgctttttttttgttgttggtgtaatg

SEQ ID NO: 17754 - DNA, 3003 bp, Unknown
  misc_feature (1)..( 3003): 2750-1469P.txt file - cDNA_ID_1813974; gDNA_ID_1621088; Annot_ID_55447
ttttgccggtaagcccataagaatcaatgggccataagaatcaatgggcttatcttaattgggtttaattaggccttataatataacaactcagccctcataatgggcttgaatctttttaacaaacataaaactaaatcatatagcttaaggtatatggagttttaaaaccaaaatacatagtgaatataaattgattgtgtacaaattttttatttggatactagcaaacaatagctgtaagtatatcatatattctattctgtttattttaggaggaaaaatgtcatttaaatcaccactttgccattcgtggtgatttatcatgaactttgctttttatgattaaaatcatcaattaggtgttgacttcaaataaaatcagtaactttcgttgacaaagccaaattagtcataacgttaactgaataatacgaagattgagataaagattgtgatgaaattggatacgaagctgctggcgaggaagacggtgaagatgaagacggaaatcttgatgacttgcacgaaaaagttagtgtcgatgaagaagttgtgggtacggatgtgactaatttggctttgtcaactaaagttattaattttatttgaagtcaacacatcattttaatcacaaaaaacaaagtttatgatttaaatcaccacaaatggcgaaatggtgatttaaatgacctttttcccatttattttatctcattaaattattcatcttgtgtttactttaccacgtgaagcctgaataaaatttgaaattcgaattaatgttcgtaacttcttaatttatcattcacttccataataatataattttatattttttattctttattaaattattcaattttgtcttgtttattcttcttttgtttaccacgtgaaatctgagaagaagatttgaaattctaattactgttcgtaacttcttttccccctagattaattttgtttatctttgtcccatgtatttttattttattttgtcattcactccaataacttaacttattctatatattatttttactttttgtatttgttagtttctttcaacattcatcttaattaaccttatgtattactcttgtgtttaccacgtgaagcctttgatcaaaatttaaattctaagtaacgttcgtatttttagaaaatagttttaaccatttcactctaataactacttccacatgttatatatagttttcacaattgttagttaaaaaagaaggatttattgtgcttttttacattcctctattaatctatatgactatatgtcaattatccttcatttataagtttttgtgcatataaacaactcatactaatcataatgaaaatgaaggttggtgcatctaataatggtaaacggtcaatttttaagtaataaaagagagagagaagtcgccatgcaattgttgttatcgtttaatcattgaccatacttcactactccttatggtggaaatttcaattggttacgtcaaagtttatataacgtccgtgtgaataaatttgacatgtttcaatcgtctacgagtctttcttttattcacacgccattttatgttttttattttattttattttgtggcgaccacttcagagttcacaccattttgtcttaccaaaatttgtaataattaagtataaatttgggtcatttctttttgttttaattcagatcattgtaggactactttaagcatatatggatttaaaataaataaaaactgtgagagttcgattaacattgttggcaagtcacaaagtctttaactacaaggcattgtgggatttctggtactttgattaaatgtcttttaaatttttatcaagctataattaccgatgtggacttatcatacaaagtgttataggtttgctaattattgttaatcagatttcttgccatagaagtgatatattgagatccgtacgtatgttattagtttctctaacaaccaaaagatttagaaacatttatgagtttcatgaatattccttatcttacgtataacaaattctcaagggaaatcaatctaagtttattctatatccggagaacactaaacttgaaaatggtctaaactaaaaccaaaatcaagatattatttgcaacaaataattcagcaatgagtagagattttgagcatgcatgcacatgttttttaatgacatgtgtgggtgagattttcacaattgttttctaaaatcaacactgtttctacaagagaaaatcacgcatcaccatcaccccatcaataaataataaccaatattcacagccatataaatactacttcacacggtagggaaaaagaatctcaaagaaaaatttgacagaatcttccatccgatttttacgctactaagaaaaacgcgaatcacatggtagatcttgaaacaaacgtgtacaactacaaatctaatttatcaaatcaataaaatagaaaaacatcaaacaattataaatatacatctttaaatattcattaaatttacaggataacaatatatctctatcttttatagctaaaaatcatatttaagaaacactatcttatcaaagtacaatttagtaatcaaattacttaattttatatttttatagtgctatactgctatagtttatttttaattaatgattttttttttgttattctacagtgggcaacaacaagaatcttctcacaccacccacgtttcctttatggaccgctatttcttctcttggccaagagcaaattcttataaattggtaaaatatttttttagataaatccatatacttatataatcacgtgcattaattacataaatacacttgtttacaacaaactattaactttttttcttcttaagaaaataaatatctcaagagtatatatataaaaacagaggtagagttggagaagaagaaagtgtagagaaactgtttcataagacttttttttcttcttcttcttctctgttaaactaatg

SEQ ID NO: 17755 - DNA, 3000 bp, Unknown
  misc_feature (1)..( 3000): 2750-1469P.txt file - cDNA_ID_1813974; gDNA_ID_2926212; Annot_ID_142036
tgccggtaagcccataagaatcaatgggccataagaatcaatgggcttatcttaattgggtttaattaggccttataatataacaactcagccctcataatgggcttgaatctttttaacaaacataaaactaaatcatatagcttaaggtatatggagttttaaaaccaaaatacatagtgaatataaattgattgtgtacaaattttttatttggatactagcaaacaatagctgtaagtatatcatatattctattctgtttattttaggaggaaaaatgtcatttaaatcaccactttgccattcgtggtgatttatcatgaactttgctttttatgattaaaatcatcaattaggtgttgacttcaaataaaatcagtaactttcgttgacaaagccaaattagtcataacgttaactgaataatacgaagattgagataaagattgtgatgaaattggatacgaagctgctggcgaggaagacggtgaagatgaagacggaaatcttgatgacttgcacgaaaaagttagtgtcgatgaagaagttgtgggtacggatgtgactaatttggctttgtcaactaaagttattaattttatttgaagtcaacacatcattttaatcacaaaaaacaaagtttatgatttaaatcaccacaaatggcgaaatggtgatttaaatgacctttttcccatttattttatctcattaaattattcatcttgtgtttactttaccacgtgaagcctgaataaaatttgaaattcgaattaatgttcgtaacttcttaatttatcattcacttccataataatataattttatattttttattctttattaaattattcaattttgtcttgtttattcttcttttgtttaccacgtgaaatctgagaagaagatttgaaattctaattactgttcgtaacttcttttccccctagattaattttgtttatctttgtcccatgtatttttattttattttgtcattcactccaataacttaacttattctatatattatttttactttttgtatttgttagtttctttcaacattcatcttaattaaccttatgtattactcttgtgtttaccacgtgaagcctttgatcaaaatttaaattctaagtaacgttcgtatttttagaaaatagttttaaccatttcactctaataactacttccacatgttatatatagttttcacaattgttagttaaaaaagaaggatttattgtgcttttttacattcctctattaatctatatgactatatgtcaattatccttcatttataagtttttgtgcatataaacaactcatactaatcataatgaaaatgaaggttggtgcatctaataatggtaaacggtcaatttttaagtaataaaagagagagagaagtcgccatgcaattgttgttatcgtttaatcattgaccatacttcactactccttatggtggaaatttcaattggttacgtcaaagtttatataacgtccgtgtgaataaatttgacatgtttcaatcgtctacgagtctttcttttattcacacgccattttatgttttttattttattttattttgtggcgaccacttcagagttcacaccattttgtcttaccaaaatttgtaataattaagtataaatttgggtcatttctttttgttttaattcagatcattgtaggactactttaagcatatatggatttaaaataaataaaaactgtgagagttcgattaacattgttggcaagtcacaaagtctttaactacaaggcattgtgggatttctggtactttgattaaatgtcttttaaatttttatcaagctataattaccgatgtggacttatcatacaaagtgttataggtttgctaattattgttaatcagatttcttgccatagaagtgatatattgagatccgtacgtatgttattagtttctctaacaaccaaaagatttagaaacatttatgagtttcatgaatattccttatcttacgtataacaaattctcaagggaaatcaatctaagtttattctatatccggagaacactaaacttgaaaatggtctaaactaaaaccaaaatcaagatattatttgcaacaaataattcagcaatgagtagagattttgagcatgcatgcacatgttttttaatgacatgtgtgggtgagattttcacaattgttttctaaaatcaacactgtttctacaagagaaaatcacgcatcaccatcaccccatcaataaataataaccaatattcacagccatataaatactacttcacacggtagggaaaaagaatctcaaagaaaaatttgacagaatcttccatccgatttttacgctactaagaaaaacgcgaatcacatggtagatcttgaaacaaacgtgtacaactacaaatctaatttatcaaatcaataaaatagaaaaacatcaaacaattataaatatacatctttaaatattcattaaatttacaggataacaatatatctctatcttttatagctaaaaatcatatttaagaaacactatcttatcaaagtacaatttagtaatcaaattacttaattttatatttttatagtgctatactgctatagtttatttttaattaatgattttttttttgttattctacagtgggcaacaacaagaatcttctcacaccacccacgtttcctttatggaccgctatttcttctcttggccaagagcaaattcttataaattggtaaaatatttttttagataaatccatatacttatataatcacgtgcattaattacataaatacacttgtttacaacaaactattaactttttttcttcttaagaaaataaatatctcaagagtatatatataaaaacagaggtagagttggagaagaagaaagtgtagagaaactgtttcataagacttttttttcttcttcttcttctctgttaaactaatg

SEQ ID NO: 17756 - DNA, 3003 bp, Unknown
  misc_feature (1)..( 3003): 2750-1469P.txt file - cDNA_ID_1813982; gDNA_ID_1621088; Annot_ID_55444
tattattgttaaaattattagatgtcaaattatattttaatctatagttgagtttataaatcatttaatatatgcagaaatatgtaaatgctaaaatatgttgagtcgccaatcaaaacaatgttattttaaaacaaacacgcacgaaaagagaaaattatatacttgtgtttttctagaaagttttaaaattaacagatttgtaattttttttttttcaaatatgacgggagacggaaagatattttatacaatacaaattgcgactttgttaattagttttgtttctattatatttctttttgtatatttaaatgtgttcacctaacacatttcggcttcatttcacatttaggcaccaatgagcttcatttaccttttctttttcaatatatgtgtgtctttagactaaacaattcggataatatattttaacgtgtgagtcgtgacaaattcaagttcttaaaatacccatcgacatctacgtcttcattcttggatttatttccaacacctttggcttttatccgcatttttattatcattcattgataacgccacggctaagtatttaatatcaatcaaagacagtaaaatcttacctaaatagttggcatggttgaagaaaaaaggtcttagagagacgagtattcatagtttacacaaattcaagtctccattggagaaagacgatatcaacgtgtgaaaatgtcgatagttgcatgcacatctccatatatatggacctcatcatacaaatcgtctatttttaaacgctatataattgagtcagtatacttattttgcaagttatagtagaatttagagctaattatatatctatataaatgattcagtattttgtgaaccaaatactcctttggcattgataaatgataaatatttgcgacctttttcatgtcgatagagtttttgttttttttcttaattcaagctagttgaggtatctcattttagacttctatacttcacatttactaacagcgaattgtttcctcttcttttacaagaaattacattctgttaaattgtgcacaatgatagaattttttttctccacatagaaaagtcggaatgaacaattttgacttcgtgaaatactattcaagttgatagtaaacaagaaacttctttaaaacatgcatgtattatgaactacattgttttttttttgttttttttacattagtttttactcaaaaatcatctaacagcttaaacggaaccatttactgtattttataacaaagaaattacagattctgactttatgttgggataaataattaatataatgcggatggtaacacatcgatgacattaacacaaaccactatcttatatagtatgtagtatttgaaaaaaaaaaaatggaaagaaaacaaattagaaaactatcggaccaaaagcataattactccgactttcgttatcataaaaatcttcacccattaactcgaattcaatgaactaatggcttaggtcctttttaaaacaattttggaccatttattcagttcttctatggaaagttcgaactaatttctagggtttggacctttggtgacatgagaaaaaaaaagaccacttgaccaaactcactgaagtcagagtaatggtgagtactctcgacacgcgtcaagaaacatccattttttttgttataaagaaagaaacatggatttgaaacgtaagtctattattttccacgaatctttttgatggaacttgaaagatgagtcatggtaataatataattgcgtttgttgagtattagaatgtttgagttccattccttgttcccatcatgacttttaaactttactttcttccatattctcatcttaacttttgagtcgacaaaaactgttcataaacacattcaaaatccaatataaactaacattgtaatatgttttacggtgaaaagaaaacattatacatacgaatattcaaatgcttatatcaacacattttggggttacagaagcaacgataaaaatatacatgaagctatatcctattatccatatctaagtaggatttgtgtcaaattatatcacttaaagctaaacttcttttactactactttaacaatacttggctacttggctacaatgaacgcgttaaaattttttttttttttagatttcacattttttgaagattaatatgattttagtttgaaaattttcagtatctagtttttagtgatcactccgattcaaactaaaaaaaacataaatgttcttctcatgacctcaaatcaagtggtccaactaatgggatatgatatatgaattaaatgcaatatgattattatgattaagttcatgtaattattatgtacgccatatgttaacgtcatacgttgccactacactcacctcaaaaacaaatgatcaatcacagcttcctgaatgtttggtcaccaccactaattcatttttttctctctcaatttgcagttctataagcgaagacaaataaataaaaaccatttttgcattataaactaattacttaaaaaatgaaaagaaaatatttttaactcgtgacacagctctttcaacaaccggattaaggctttaaacaaaatacaattttttctctaaaaaactatataagtaatttttatttttctgaatctcattattggctttttactcgatcacatgcaacatgcttctaccattttaaaagttggtgtggagccataaaaacacacacacacacacacacaaaactacatactaaaaaatattaaattgagtaaaacttctacatgaatcagaaggtttcattaaaataggggacacgtggaaaacctagatctattttcgctttacatcggacggtccaaattctctgtaaactagtcgtcggaaatataaaattatcgccaaaattcgcctgaaaattttcccaattcgaagagctaattagggtttcttctgagcttagagagcaaggacaagatg

SEQ ID NO: 17757 - DNA, 3000 bp, Unknown
  misc_feature (1)..( 3000): 2750-1469P.txt file - cDNA_ID_1813982; gDNA_ID_2926212; Annot_ID_142039
tattgttaaaattattagatgtcaaattatattttaatctatagttgagtttataaatcatttaatatatgcagaaatatgtaaatgctaaaatatgttgagtcgccaatcaaaacaatgttattttaaaacaaacacgcacgaaaagagaaaattatatacttgtgtttttctagaaagttttaaaattaacagatttgtaattttttttttttcaaatatgacgggagacggaaagatattttatacaatacaaattgcgactttgttaattagttttgtttctattatatttctttttgtatatttaaatgtgttcacctaacacatttcggcttcatttcacatttaggcaccaatgagcttcatttaccttttctttttcaatatatgtgtgtctttagactaaacaattcggataatatattttaacgtgtgagtcgtgacaaattcaagttcttaaaatacccatcgacatctacgtcttcattcttggatttatttccaacacctttggcttttatccgcatttttattatcattcattgataacgccacggctaagtatttaatatcaatcaaagacagtaaaatcttacctaaatagttggcatggttgaagaaaaaaggtcttagagagacgagtattcatagtttacacaaattcaagtctccattggagaaagacgatatcaacgtgtgaaaatgtcgatagttgcatgcacatctccatatatatggacctcatcatacaaatcgtctatttttaaacgctatataattgagtcagtatacttattttgcaagttatagtagaatttagagctaattatatatctatataaatgattcagtattttgtgaaccaaatactcctttggcattgataaatgataaatatttgcgacctttttcatgtcgatagagtttttgttttttttcttaattcaagctagttgaggtatctcattttagacttctatacttcacatttactaacagcgaattgtttcctcttcttttacaagaaattacattctgttaaattgtgcacaatgatagaattttttttctccacatagaaaagtcggaatgaacaattttgacttcgtgaaatactattcaagttgatagtaaacaagaaacttctttaaaacatgcatgtattatgaactacattgttttttttttgttttttttacattagtttttactcaaaaatcatctaacagcttaaacggaaccatttactgtattttataacaaagaaattacagattctgactttatgttgggataaataattaatataatgcggatggtaacacatcgatgacattaacacaaaccactatcttatatagtatgtagtatttgaaaaaaaaaaaatggaaagaaaacaaattagaaaactatcggaccaaaagcataattactccgactttcgttatcataaaaatcttcacccattaactcgaattcaatgaactaatggcttaggtcctttttaaaacaattttggaccatttattcagttcttctatggaaagttcgaactaatttctagggtttggacctttggtgacatgagaaaaaaaaagaccacttgaccaaactcactgaagtcagagtaatggtgagtactctcgacacgcgtcaagaaacatccattttttttgttataaagaaagaaacatggatttgaaacgtaagtctattattttccacgaatctttttgatggaacttgaaagatgagtcatggtaataatataattgcgtttgttgagtattagaatgtttgagttccattccttgttcccatcatgacttttaaactttactttcttccatattctcatcttaacttttgagtcgacaaaaactgttcataaacacattcaaaatccaatataaactaacattgtaatatgttttacggtgaaaagaaaacattatacatacgaatattcaaatgcttatatcaacacattttggggttacagaagcaacgataaaaatatacatgaagctatatcctattatccatatctaagtaggatttgtgtcaaattatatcacttaaagctaaacttcttttactactactttaacaatacttggctacttggctacaatgaacgcgttaaaattttttttttttttagatttcacattttttgaagattaatatgattttagtttgaaaattttcagtatctagtttttagtgatcactccgattcaaactaaaaaaaacataaatgttcttctcatgacctcaaatcaagtggtccaactaatgggatatgatatatgaattaaatgcaatatgattattatgattaagttcatgtaattattatgtacgccatatgttaacgtcatacgttgccactacactcacctcaaaaacaaatgatcaatcacagcttcctgaatgtttggtcaccaccactaattcatttttttctctctcaatttgcagttctataagcgaagacaaataaataaaaaccatttttgcattataaactaattacttaaaaaatgaaaagaaaatatttttaactcgtgacacagctctttcaacaaccggattaaggctttaaacaaaatacaattttttctctaaaaaactatataagtaatttttatttttctgaatctcattattggctttttactcgatcacatgcaacatgcttctaccattttaaaagttggtgtggagccataaaaacacacacacacacacacacaaaactacatactaaaaaatattaaattgagtaaaacttctacatgaatcagaaggtttcattaaaataggggacacgtggaaaacctagatctattttcgctttacatcggacggtccaaattctctgtaaactagtcgtcggaaatataaaattatcgccaaaattcgcctgaaaattttcccaattcgaagagctaattagggtttcttctgagcttagagagcaaggacaagatg

SEQ ID NO: 17758 - DNA, 3000 bp, Unknown; identical to SEQ ID NO: 6295
  misc_feature (1)..( 3000): 2750-1469P.txt file - cDNA_ID_1813986; gDNA_ID_1621088; Annot_ID_55443

SEQ ID NO: 17759 - DNA, 3000 bp, Unknown; identical to SEQ ID NO: 6295
  misc_feature (1)..( 3000): 2750-1469P.txt file - cDNA_ID_1813986; gDNA_ID_1621088; Annot_ID_170577

SEQ ID NO: 17760 - DNA, 3003 bp, Unknown
  misc_feature (1)..( 3003): 2750-1469P.txt file - cDNA_ID_1813986; gDNA_ID_2926212; Annot_ID_142040
acttaatcataataatcatattgcatttaattcatatatcatatcccattagttggaccacttgatttgaggtcatgagaagaacatttatgttttttttagtttgaatcggagtgatcactaaaaactagatactgaaaattttcaaactaaaatcatattaatcttcaaaaaatgtgaaatctaaaaaaaaaaaaaattttaacgcgttcattgtagccaagtagccaagtattgttaaagtagtagtaaaagaagtttagctttaagtgatataatttgacacaaatcctacttagatatggataataggatatagcttcatgtatatttttatcgttgcttctgtaaccccaaaatgtgttgatataagcatttgaatattcgtatgtataatgttttcttttcaccgtaaaacatattacaatgttagtttatattggattttgaatgtgtttatgaacagtttttgtcgactcaaaagttaagatgagaatatggaagaaagtaaagtttaaaagtcatgatgggaacaaggaatggaactcaaacattctaatactcaacaaacgcaattatattattaccatgactcatctttcaagttccatcaaaaagattcgtggaaaataatagacttacgtttcaaatccatgtttctttctttataacaaaaaaaatggatgtttcttgacgcgtgtcgagagtactcaccattactctgacttcagtgagtttggtcaagtggtctttttttttctcatgtcaccaaaggtccaaaccctagaaattagttcgaactttccatagaagaactgaataaatggtccaaaattgttttaaaaaggacctaagccattagttcattgaattcgagttaatgggtgaagatttttatgataacgaaagtcggagtaattatgcttttggtccgatagttttctaatttgttttctttccattttttttttttcaaatactacatactatataagatagtggtttgtgttaatgtcatcgatgtgttaccatccgcattatattaattatttatcccaacataaagtcagaatctgtaatttctttgttataaaatacagtaaatggttccgtttaagctgttagatgatttttgagtaaaaactaatgtaaaaaaaacaaaaaaaaaacaatgtagttcataatacatgcatgttttaaagaagtttcttgtttactatcaacttgaatagtatttcacgaagtcaaaattgttcattccgacttttctatgtggagaaaaaaaattctatcattgtgcacaatttaacagaatgtaatttcttgtaaaagaagaggaaacaattcgctgttagtaaatgtgaagtatagaagtctaaaatgagatacctcaactagcttgaattaagaaaaaaaacaaaaactctatcgacatgaaaaaggtcgcaaatatttatcatttatcaatgccaaaggagtatttggttcacaaaatactgaatcatttatatagatatataattagctctaaattctactataacttgcaaaataagtatactgactcaattatatagcgtttaaaaatagacgatttgtatgatgaggtccatatatatggagatgtgcatgcaactatcgacattttcacacgttgatatcgtctttctccaatggagacttgaatttgtgtaaactatgaatactcgtctctctaagaccttttttcttcaaccatgccaactatttaggtaagattttactgtctttgattgatattaaatacttagccgtggcgttatcaatgaatgataataaaaatgcggataaaagccaaaggtgttggaaataaatccaagaatgaagacgtagatgtcgatgggtattttaagaacttgaatttgtcacgactcacacgttaaaatatattatccgaattgtttagtctaaagacacacatatattgaaaaagaaaaggtaaatgaagctcattggtgcctaaatgtgaaatgaagccgaaatgtgttaggtgaacacatttaaatatacaaaaagaaatataatagaaacaaaactaattaacaaagtcgcaatttgtattgtataaaatatctttccgtctcccgtcatatttgaaaaaaaaaaaattacaaatctgttaattttaaaactttctagaaaaacacaagtatataattttctcttttcgtgcgtgtttgttttaaaataacattgttttgattggcgactcaacatattttagcatttacatatttctgcatatattaaatgatttataaactcaactatagattaaaatataatttgacatctaataattttaacaataatataaaatatgagatttataaattacgaatataaatattcaagggagagaaaaagtagaacataattcaaaagataagactttttagacttttttaacaatatttttgatggataaaaattattcaaaagagaagaaagtaagaagaaaagatgtttctgagaatttctagaaacagcatccgtttttataatttaattttcttacaaaggtaggaccaacatttgtgatctataaatcttcctactacgttatatagagacccttcgacataacacttaactcgtttatatatttgttttacttgttttgcacatacacacaaaaataaaaaagactttatatttatttactttttaatcacacggattagctccggcgaagtatggtcgtcgtcttcatcttcttcctccatcatcagatttttccttaaatggaagaaaccaaacgaaactccgatcttctccgttctcgtgttttcctctctggcttttattgctgggattgggaatttctcaccgctctcttgctttttagttgctgattctttttccttcgactttctatttccaatctttcttcttctctttgtgtattagattatttttagttttatttttctgtggtaaaataaaaaaagttcgccggagatg

SEQ ID NO: 17761 - DNA, 3003 bp, Unknown; identical to SEQ ID NO: 17760
  misc_feature (1)..( 3003): 2750-1469P.txt file - cDNA_ID_1813986; gDNA_ID_2926212; Annot_ID_202703

SEQ ID NO: 17762 - DNA, 3000 bp, Unknown; identical to SEQ ID NO: 6317
  misc_feature (1)..( 3000): 2750-1469P.txt file - cDNA_ID_1813988; gDNA_ID_1621088; Annot_ID_55440

SEQ ID NO: 17763 - DNA, 3003 bp, Unknown
  misc_feature (1)..( 3003): 2750-1469P.txt file - cDNA_ID_1813988; gDNA_ID_2926212; Annot_ID_142043
atcttctccggtacttgcgacgattaactctgtttttcagttatgagatcgaaattgactgttttgcatgcttgttttagagctcaattgcttgattttaagtagaaacagacttcaatttcgatgtaaatcataaccctaaaaaaaaactttttagagaatcttaaagtttgttttgttttgcagattgattttgttataggaagttggatacattgcaagatcccaacaggagtatctttgaatataacaagcatctctggattcttaaactcatcaacaaaagctccaaactttgtggtcgaactaatacagagcagttccaagtcgcttgtgctaatccttgacctcccacatcgtaaagatcttgttcttaacccggattatctcaaggagtattaccaagacactgctcttgattctcatcgacaatctctccttaagctacctgaagttaacccttatgtgtctccttctctctttgtccgttctgctttctctcctactgcttcgatgcttaagattgatgcggaggaagaggataagttggaggagatattgagagatcatgttagtccagctgctaaggaggttctcgaggtttggttggagcggtgtgtgaaggaagaagaagagaagattgtggttggggaagaagagagaatggagttggagagaagagataaaagctttagaaggaagagcatagaggacgatttggatttgcagtttccgagaatgtttggtgaagaagtttcctcccgtgttgtacacgctattaaagaagctttcggtgttctctagattatgtaactatatatatacatcagttaatgttcattgtactaaacatttactttcatcaatgtcacaagaacgcaagatgaccatcaaacaagtcctgttttctcctaagaacgtctttgttgtgaatcatctctgaatcggattccttctgattcattttaatactatgggattgtaaatttatcaatcaagtttctaatttatctgtaaaaaaaagtcttgaattattgtttttctcatggattttaaagtttttttttcactattttacatggatgttttgttaaatttctcgttctctagatcatgtcattttacattagcaaaaccaatataatatatagattaatattaacgaaggaacataaacgtgcaaaactaaaagttttaaagctaaatcgctttcaaaagagttagtaaccagacaaaaaagagacagatcatcggcaactaatctcgtcatcgcatgcatcataaaccaaattaactaaatcatccatttaatccatttgttcttatcagatcatccttttccttcctacacaagaaatggttagtgttttcttttctcgattgtctcttagtttagattctttatccgactactttgttcatcggttttgtttttctttttgtcttccggaaggcgaattacatgtcggaagcagcacagctcagaagaggtctaaagcctaaagggaagacttatgggttgaccaatcagaagagacgagagatcagagagatctttgatcttttcgacatagacggttcaggtaaactattaaaccgattctttatccgatttacaaagttattgctcacatgatttagtgcatcatttcatatgtaggtagcatcgatgctagcgagctcaacgttgctatgaggtcaacggcaatttttctttctttttcaaagttattttcttcaagttctagttaagtatagtactaaaaaattatcagctgattacaggtctcttggatttgagatgaataatcaggtttgtttgttttccttccttttttcttctttgttttaatttcatggtttagatcattgtacgtagaaccaacttgtatttagtttggtcatgttcattgttgcagcaaataaacgaattgatggcagaagtagataaaaaccaaagtggagccatagatttcgacgaatttgtgcatatgatgacaaccaaattcggagaacgagactccatagacgaattgtctaaggcgtttaagatcattgaccacgacaataatgtgaataaatctaaacctgtcattatttcattctttttaatattatctttttttgtttggattgatttcattgtgtttgactggacaacttttggaatgttttaggggaagatttcacctcgtgatataaagatgattgctaaagaattgggagaaaatttcacagataatgatatagaagaaatgatcgaagaagcagaccgtgacagtaagcaaaaacacataataattttgcgttttatctataatcggtccctcaagttcatgtttttgccttaacctacgcagaagatggagaagttaacttggaggagttcatgaagatgatgaagagaacctcttacggctaagtataaatcaattagtaatggttgtgaataatatttgttaatcaccttgatttataataataaagaagtttgatttgtggcttggtcgaataaaaatgtattgttgtataaaaataataatgtaattcacatccattattttgaatatgtaaatgtccttgaacgaacatttgttttatcattttttatgtataaatgtctttgaccaaaaaataaattatgtaaaatatgaaccagaaacgatgttgtttagatctgatacttacatataaccaaacgacgacgttgctagagtaataaatctcaaaagactggaaacgactgcgtataagtccgtgacctggttaccggagcgtaacttctccggcgaattggacaattttgagaaagacggattatggactccatggaagctccatctctaccatttcaatctccctctcgttccaggttttaattttgagtttataaggattatctcataccttctaacaaaaaccctaaaaacccaatttgtttttttggtttgcagtcaacaattgcatttctacctcgccgtggatcgtccccaattcaaaatg

SEQ ID NO: 17764 - DNA, 3000 bp, Unknown; identical to SEQ ID NO: 6298
  misc_feature (1)..( 3000): 2750-1469P.txt file - cDNA_ID_1813991; gDNA_ID_1621088; Annot_ID_55439

SEQ ID NO: 17765 - DNA, 3003 bp, Unknown
  misc_feature (1)..( 3003): 2750-1469P.txt file - cDNA_ID_1813991; gDNA_ID_2926212; Annot_ID_142044
atatgtcttttttttacgtacgttctatatcggttattggtcaatttttttggttgtttcggtttttagtcggttatttcggttttggtttatttatggttaccaagtttaatatccgaaccgttcctcaaatatccaaatggtttttatattactataagtgaaataaccgaaatcatgcgcaaccgaaccgaaactgaatggttaaccgaatgcccaggcctaattcaacttgtttttcctattattatgtagatttagcattccagtttttaattttgaatttttaaaagttgttttccatattttgtttttttttttccggattttaaaaaccttttttgtgtttgtttttttttttaaatttatttgcttgaattttaaatttatataatgataggaaatctaaccaaattttggattcaacattaatcgcgatttcagacattcaacatttatttcctattattatgtagatttaatattcaagtttttgattcagatttttataacgagcatctttgcaaatgcccacaaaggaccttttatgtttacaaaattaaattttaaatttaagggaaatttacaaaactagcctttttttactatcttttgcattaataccctattgtgttgtccatttttaaaaataccccttccattgaacagaatgaccaaattaccctcatctaataggaatatttaattggaaactgaaattttcccgccaaattttctttttcccgctaaaaaaatattccgccaaactttttcccgccaaaaaaaagttcgtgacaaattttttttcagcaaaagaaatgcttttaaaaatccttgtaaattttttttggcgggaaatagatttacaagggattttaaatgatttcaaagatttataagagattttaaaagggttcaaaaatatttacaagaaattttaaagggctttcaaagatttataaatgtttttaaatgatttttaaagggtttaaaagtgttttaaaagatttacaaatgattttaaaagggttttataatatttacaaaggattttaaaagtgttttacaagatttacaagagattttaaaaggttttaataaaatttacaagagtttttaaaatgttttcttgtaaattgtttaaaaatcttttaaaaatccttgtacatcttttaaaactcttttaaaatttcttgtaaatctttaaaaccgttttaaaatcccttgtaaatcttttaaaacgcttttaaaccctttaaaaatcttttaaaaatctttgtaaatcttttaaagccctttaaaattctttgtaaatattttaaaaccttttaaaattccttgtaaatgtattaaaacccttttaaaatcacttgtaaatcttttaaaacccttttaaaatcccttgtaaatattttaaaaccttttttaaatcgcttgtaaatctttttaaattcttttcaaatcccttgtaaatctttttcccgcaaaaatatttttgaaaaaaagttttggcgggaatctttttttcaaaaaattttggtgaaaaagtttttggcggaaaatttttggtgggaattttattttggaatattttaggcgaaaatattaatatttcattttgttaacataaaataatttctaaatagggtaaaatggtaaataaaaaattaaagagagtaaaaataaaaatggcaaatagaaaagggtagaattgaaaaagggtagtgtgcaaaggacattatcagcaattattctaccaaatttaaatacataaaaacaaaccagacttaatatttcatccttaaatccgtaagtcttgtggtaccatattttaacatatttttacataattaaatttaacacttaaatgctttcacaaatattgtcctaaatatttttaattttatttttaaattgcaaactttcgtgatcctttactatttttgtaaaatataaatgtttatcggttttcattttgcgacgaaatttcctttagaaggtcaaaccgaagcaacacatttttaaaaagcattaactaaaaaagggcactccttagttttgactttgacaatgagtttgtcgaatgcacacctttgatccccaactgctatttacatttctttatttggattggaaacaatgaagattaaaatataaacacaacgatttaattcctaggatgtcacatatatacagaagaaaataatcaaatatgatatagttcattatcgcatcatgaaaaccttaaaatacaatgaatctatttcatccgtcttgggtataaatttgatgtcaaaataaacgagtttatgtgatttttcatcattcttattaaaacaaaaaggaaaaacgatttgtttgaatataaagagttaacgtacttttgtatcatatatttggtagttgaaatttttgagtttggatggaggatctacttagcatgagaatttttttcttttttttaaaaagaaatctaattagcatgagaagtaacattaatgacaataaacgataacgagattaattctagagtgactaaaaccataaattcagactattcatttagtatgtataatgactttatccaacataaaaaaaatcagtaaaaataatgaatacaacagtaacattcagagaggcacatagtttgcttggcacgccattaataatatctgcaaccaattccaatgacgtctttacacacgtctgaccactttttcttcaacaatttctcctatcaactatatataacttattcatggaacattcaaataaactataaaaaaattctctcaacatttttatctaatgggttctcgccttctcggtgtttgagtctttgcgtttcttgtcaattgtcatcacccctttgtctttttcctgatttcatctcttttgtagacttggacaacacgcctttctctctctctaatttttccacagctataaaatttgtaaaaattgatacaaaaatatctgagctttcctttccggaagactatg

SEQ ID NO: 17766 - DNA, 3000 bp, Unknown; identical to SEQ ID NO: 6299
  misc_feature (1)..( 3000): 2750-1469P.txt file - cDNA_ID_1813993; gDNA_ID_1621088; Annot_ID_55438

SEQ ID NO: 17767 - DNA, 3003 bp, Unknown; identical to SEQ ID NO: 15995
  misc_feature (1)..( 3003): 2750-1469P.txt file - cDNA_ID_1813993; gDNA_ID_2926212; Annot_ID_142045

SEQ ID NO: 17768 - DNA, 3003 bp, Unknown
  misc_feature (1)..( 3003): 2750-1469P.txt file - cDNA_ID_1813997; gDNA_ID_1621088; Annot_ID_55436
aaaattaaactttctcggtatacataggaactcgatggagaagaggcgaggcttgcggattacttcgacgtgatagctggaactagcaccggtggtcttgtgacggcgatgttgactgtaccggacgagaccggtcgacctcatttcgcggctaaagacattgtgccgttttaccttgaacattgtcccaagatatttccccagcccacgtaaagaaattctatttctctatatacacactaattacaaaaacaataataattagacacttgtatttctgtttagaatagaaaaactttatgttcacaatttcgaaaatagtaaacgttatttaaatttttttaaggaataaatcaaccagtattttggtgtctcatataattgtttgttttttcctaatgaacaattggcatataaattaaacaaattccaacgtaacaattgaaaaaacattctaatgaaaaatgcagaggcgtgcttgctctgttaccgaagcttccaaagcttctgtctggtccaaagtacagcggaaagtatctgcgaaatcttctgagtaagcttcttggagagacaagacttcaccagaccctcacaaacattgttatacctaccttcgatatcaagaaacttcaacccactattttctcctcttaccaggtctctcttcttaacactacacacatgtatagactaaaatctaaagctcctaattaacaaacttaattagttcactttctgtttttgaagctgttggttgaccctagcttggatgtcaaggtatcagacatatgcatcggcacttcagctgctcccactttctttcctccccattacttttccaacgaagacagtcaaggcaataagacggagtttaatctcgttgatggcgcggttactgctaataacccggtactatcaaaaacaaagagaatacaaagaaattgataaaacctttagattttcgaaaatcaaaacagaactaactccgttgtgtttggtcctgtaatcctgttatagactttggtggccatgacagctgtgtctaagcagattgtgaagaataatcctgatatgggtaagctcaagccgttaggtttcgaccggtttctcgttatatcgataggaacaggatcaacaaaaagggaagagaagtacagcgcaaaaaaggctgcaaaatgggggatcatatcttggttatatgacgatggatctactccgatattagacattaccatggaatcaagccgcgacatgatccattatcacagctctgttgtgtttaaagccctacaatctgaagacaagtacctccgaatcgatgtaagagctacatattaacatatatgtatgtccttatttctgattgatcgtttaatttacaattgcaggatgatacattggaaggagatgtaagcactatggatctagcgacaaagtctaacttggagaatcttcaaaagattggagagaagatgctgacaaacagagtcatgcaaatgaacatcgacactggtgtatatgaacctgttgctgaaaatattaccaatgatgaacagctaaagaggtgattaagcaattatgaatgtttttcttcttggattacaagtaatctcgatattttttatttattaaaataaaataaattaataatgggcctcccaaacaaaattgggctgggcctaggacattacaaaagattagtaatctcgatctttgatataggtatgcaaaaattctctcggacgaaaggaaattaaggagactaagaagcgacacaatgattaaagattcatcaaatgaatcacaagagataaaataaaaggaaatcattcgtgcttttgtgtgaaattgtttgttgcatatgttttacgtggtgacgtccattactttatatgctgtgagatgaaattttttaaataaaattggttatctaaatttagttctacaagtaataagatgaaacagcagaaggccagaagctaatcctgagatcattttattctatgacaagtgtactcagaacaagtctctcgacatggagggagatataggtcctagattcaaactctattacaatatattttcttcgtaaatttagctcatgacagctcaagctaaacctacattaaaataattccacatggaaatatacaaattctacaatcatgattagcacgaaatatgtatgaagaaaagtctgaccaaatagttttatcttttagtatatactactacacgtgaagtttattttttttgtcaaaacataatttaaatactaatgctaacgtcaattcatatttaaatgcttgttggttttggattttttccgctaacctaatttttttgaaataatgacccaaaacaaaaacacagtttttacatatattttgactttttcgaaaaacttcaaatttcgctgatgaaacttaatcacgtattacgggttttactatttaagacactagattaagtgattcctaccaattaggttttctaatgtaaatagataactgatctccaagcaaaccaaataactcattattagttatgattcgtggcattagttgtagtttccaattgatagatgtctttagaacaagtctgaatagtggattcagaagggaaacgagtcgcagaaaatccaaaaaaaaaacaaagtcagtttctggctgtttatttttgattaattgcaaagtccacgaaagaaaatatttgtttcttaattcaaatttatctattgcaactatttctcgtaaattaatttgtgacagcccaagctcgatgaccctaattaatgatagggtaatattacttgctttaaattatcatattccacataaaacatatatcagcttgtatgaagaaaagtctgaccaaatagtgttaaatctatgcaaatgaaattgtgcatttgtatatatatattgacctctacatccaaaacttctaccaaatttcgattcaaaatcttgtagttcaaaagaagattgatcaactataatg

SEQ ID NO: 17769 - DNA, 3003 bp, Unknown; identical to SEQ ID NO: 17768
  misc_feature (1)..( 3003): 2750-1469P.txt file - cDNA_ID_1813997; gDNA_ID_1621088; Annot_ID_170570

SEQ ID NO: 17770 - DNA, 3000 bp, Unknown
  misc_feature (1)..( 3000): 2750-1469P.txt file - cDNA_ID_1813997; gDNA_ID_2926212; Annot_ID_142047
attaaactttctcggtatacataggaactcgatggagaagaggcgaggcttgcggattacttcgacgtgatagctggaactagcaccggtggtcttgtgacggcgatgttgactgtaccggacgagaccggtcgacctcatttcgcggctaaagacattgtgccgttttaccttgaacattgtcccaagatatttccccagcccacgtaaagaaattctatttctctatatacacactaattacaaaaacaataataattagacacttgtatttctgtttagaatagaaaaactttatgttcacaatttcgaaaatagtaaacgttatttaaatttttttaaggaataaatcaaccagtattttggtgtctcatataattgtttgttttttcctaatgaacaattggcatataaattaaacaaattccaacgtaacaattgaaaaaacattctaatgaaaaatgcagaggcgtgcttgctctgttaccgaagcttccaaagcttctgtctggtccaaagtacagcggaaagtatctgcgaaatcttctgagtaagcttcttggagagacaagacttcaccagaccctcacaaacattgttatacctaccttcgatatcaagaaacttcaacccactattttctcctcttaccaggtctctcttcttaacactacacacatgtatagactaaaatctaaagctcctaattaacaaacttaattagttcactttctgtttttgaagctgttggttgaccctagcttggatgtcaaggtatcagacatatgcatcggcacttcagctgctcccactttctttcctccccattacttttccaacgaagacagtcaaggcaataagacggagtttaatctcgttgatggcgcggttactgctaataacccggtactatcaaaaacaaagagaatacaaagaaattgataaaacctttagattttcgaaaatcaaaacagaactaactccgttgtgtttggtcctgtaatcctgttatagactttggtggccatgacagctgtgtctaagcagattgtgaagaataatcctgatatgggtaagctcaagccgttaggtttcgaccggtttctcgttatatcgataggaacaggatcaacaaaaagggaagagaagtacagcgcaaaaaaggctgcaaaatgggggatcatatcttggttatatgacgatggatctactccgatattagacattaccatggaatcaagccgcgacatgatccattatcacagctctgttgtgtttaaagccctacaatctgaagacaagtacctccgaatcgatgtaagagctacatattaacatatatgtatgtccttatttctgattgatcgtttaatttacaattgcaggatgatacattggaaggagatgtaagcactatggatctagcgacaaagtctaacttggagaatcttcaaaagattggagagaagatgctgacaaacagagtcatgcaaatgaacatcgacactggtgtatatgaacctgttgctgaaaatattaccaatgatgaacagctaaagaggtgattaagcaattatgaatgtttttcttcttggattacaagtaatctcgatattttttatttattaaaataaaataaattaataatgggcctcccaaacaaaattgggctgggcctaggacattacaaaagattagtaatctcgatctttgatataggtatgcaaaaattctctcggacgaaaggaaattaaggagactaagaagcgacacaatgattaaagattcatcaaatgaatcacaagagataaaataaaaggaaatcattcgtgcttttgtgtgaaattgtttgttgcatatgttttacgtggtgacgtccattactttatatgctgtgagatgaaattttttaaataaaattggttatctaaatttagttctacaagtaataagatgaaacagcagaaggccagaagctaatcctgagatcattttattctatgacaagtgtactcagaacaagtctctcgacatggagggagatataggtcctagattcaaactctattacaatatattttcttcgtaaatttagctcatgacagctcaagctaaacctacattaaaataattccacatggaaatatacaaattctacaatcatgattagcacgaaatatgtatgaagaaaagtctgaccaaatagttttatcttttagtatatactactacacgtgaagtttattttttttgtcaaaacataatttaaatactaatgctaacgtcaattcatatttaaatgcttgttggttttggattttttccgctaacctaatttttttgaaataatgacccaaaacaaaaacacagtttttacatatattttgactttttcgaaaaacttcaaatttcgctgatgaaacttaatcacgtattacgggttttactatttaagacactagattaagtgattcctaccaattaggttttctaatgtaaatagataactgatctccaagcaaaccaaataactcattattagttatgattcgtggcattagttgtagtttccaattgatagatgtctttagaacaagtctgaatagtggattcagaagggaaacgagtcgcagaaaatccaaaaaaaaaacaaagtcagtttctggctgtttatttttgattaattgcaaagtccacgaaagaaaatatttgtttcttaattcaaatttatctattgcaactatttctcgtaaattaatttgtgacagcccaagctcgatgaccctaattaatgatagggtaatattacttgctttaaattatcatattccacataaaacatatatcagcttgtatgaagaaaagtctgaccaaatagtgttaaatctatgcaaatgaaattgtgcatttgtatatatatattgacctctacatccaaaacttctaccaaatttcgattcaaaatcttgtagttcaaaagaagattgatcaactataatg

SEQ ID NO: 17771 - DNA, 3000 bp, Unknown; identical to SEQ ID NO: 17770
  misc_feature (1)..( 3000): 2750-1469P.txt file - cDNA_ID_1813997; gDNA_ID_2926212; Annot_ID_202710

SEQ ID NO: 17772 - DNA, 3003 bp, Unknown; identical to SEQ ID NO: 16383
  misc_feature (1)..( 3003): 2750-1469P.txt file - cDNA_ID_1814001; gDNA_ID_1621088; Annot_ID_55435

SEQ ID NO: 17773 - DNA, 3000 bp, Unknown
  misc_feature (1)..( 3000): 2750-1469P.txt file - cDNA_ID_1814001; gDNA_ID_2926212; Annot_ID_142048
cttttcgacgtgaaaaatattattctaaattatttatcgcaaatatgtttccttttactcttatatataaaccatgagctttttaaacccaaaatatgttagatatccatctctatttccaacgtcggattataagtccatgttttcatattttacatgataattcgactctagacaagttaggctggtgacattggactacttcactaccatgacaaagaaatatatcccataattttgaacaccactaagaagataatgtcatcaatatcttctgttgtcatttaattttccactcttaatgaaaatatattcaaaatacacaattacaaacaactttacaaactaatgttgaaaggttttaactcattaataactacccaaaccaaaaagggtactataaatatagttaatcatctaatagtttctccaaaattcttatacgatcatatatgatatctatagatagatgtaataaatatattagatgacacataattgtcacctctgatcatctagcctcttcccatcacatgccattaatggacctatgcggtgctgatagtaacgtataaccatgacgacgtctgagactcagaggatcttactctaacataattaaaaacataaacttgcactagtgaatttgtaatttcatataaggaaacattttggagcaataaacattatatccttttttcctttccctgtatattgccacatttatgcacataaaatcagctcatatccatcgatcggtccccaatttttcaatgattagtcaattttttcttccttttgataaccgctgtggtccaataagacaagtgaatagggtccatttagggctagcgtacgtggtacatcgcatgttcactatcacttatgagcgcatgcaagtgaaattacatgtcaaaaaaccttacgctatatataagtgtatatggtatctgtcaacattactatacaaaacaaatcttttatttttattgatcacatattttgtcaaaaagtatttgttttgtatcattaggcccaaagaatgtttttgtgtcagttttcttttcctaataaaacagaagaaataaacaataagattcaacttttcacagttaatacagtatttgtaaaaattctgaacaacagattttcaaaactacgacatttaaaattagaacgaagattaacacgcattagtgagtatcaaacgaattcaaaaacttatgtaaatataccaagaatatgtaattataattaactaaacatttttaatttttaaattaaaatgttaaatttcaatgctatttagaacattttggttatgattattaaaatcgtgacacgatggatagtaactaaatgaaagaacaaataggttgaaagctatagggaaataaataaatgaacggtttatagtaacatctttatcataaagctggactgtctcgttgtgatataaaacaacgaagataagtaaggagatttagtactgttgtcattcgccaacgtcaacttcactaatgatcactagtccttttagtttttagagagtttccatcagaatttgcaaacgtaattacaaatattgggccttaatttgaaacctacatagagggccgagtatttgatgaagcccaatcgtctaaagtcgaaaaacatgtaaatagtcaacacacagtgaaaatataaacatatgtaaatacgtttgtgatccaaattaaattacgatgataagatggaacaacagaagctaaccctgagatcatcttctatgacaggtgttacttagaactagtctggatagggagggagatatgtgtcctagaaacttcaaataattcaaactctattatcaaaaaaagtcagaaataaatatagtcttgaatcagttatgcagatctcgtttgttatgtttttggacagtcgacgaaagaactcctagttaattaatattatctattacaatatattctcgcaaaattaagcttatatgtgacagctagagctcagcgttgatattgcctccacacttacattatataattctaacgggaattatatacataaactataatcatgattagcacgaaatgtacgaagaaaagtctgaccaattagttttatcctacacgtgaagacttgaagttgatatgtattaccaatatatcatcaaattattgatataataataagttgttgtttggtcgagaaagcgtgcttgcatgctataatgctaattcatatttaaatgctttgttgctttgattcgctaattaacccaaaattttgaaaatgactcaaaacaaacatacagtttttacatatactattctgttgatcgtgcatgcagagataccacagtttttctgaaaacttcaatattccgctgacaaaactaatatttcacgtgttagtttttagttttttactaattaagacactagactaactgattcctactaataggttttctaatgtaaacaacataagagactctagctagaaaagagaggaaaaacaataaaagcaaatcttgagatcttctcagtcaattgacagatgtctttagaacaagtctaaatagtggattgagaagggaaatgtgtcacagcaaatccaaaaaatccaaactcatcagtttttgaaacttttggacgcaaaactcgcttggctgtgttattcattatttcaaagtccacgaaagaaaataattgtctcgtaaattaattaattaagcttatgacagctcaaggtcgacgacataattgattttgttccttactataaattatctattcaaaggaaaatatatactagctatatatataatccttattcgtacgaaatgtatgaagaaaagtctaaccaaatatttttttcgtttttttaattaaatctatacgaaattgtgcatttatatatcttgacctctatatccaaaactttaccaaaatctcgatttataatcttaactcaaaagaagatcgatcaactattatg

SEQ ID NO: 17774 - DNA, 3000 bp, Unknown; identical to SEQ ID NO: 17773
  misc_feature (1)..( 3000): 2750-1469P.txt file - cDNA_ID_1814001; gDNA_ID_2926212; Annot_ID_202711

SEQ ID NO: 17775 - DNA, 3000 bp, Unknown; identical to SEQ ID NO: 6302
  misc_feature (1)..( 3000): 2750-1469P.txt file - cDNA_ID_1814016; gDNA_ID_1621088; Annot_ID_55429

SEQ ID NO: 17776 - DNA, 3000 bp, Unknown; identical to SEQ ID NO: 6302
  misc_feature (1)..( 3000): 2750-1469P.txt file - cDNA_ID_1814016; gDNA_ID_1621088; Annot_ID_170561

SEQ ID NO: 17777 - DNA, 3003 bp, Unknown
  misc_feature (1)..( 3003): 2750-1469P.txt file - cDNA_ID_1814016; gDNA_ID_2926212; Annot_ID_142054
tccattccttcctggagattacgcattaatatatttagatcttaggtcttattagcttctttattcgcacttttttttttcctctactcgaagcttaacgatcgtaacaatcatggcgacggcttcaggtaccatgattccttcaatttcttcttctaatactttaacctaattctcgatttctctgttaattcccgttgatgattaagaatctcgcttctgatatcttcttctttctttaaatctatatattagtaaattagggtttttactagttttgctattggctagattcattttggctaaattctggcaaaattgattttatttttaatgtttgaatgttgttctgatatatgttttctatgggatctgcagttgcttttaagtctagggaagatcacaggaagaaattagaattagaggaagctcgtaaagctggtctcgctcctgctgaggtagacgaagatggcaaagaaatcaatcctcacatacctgagtatatgtcaaaagctccatggtatctcaagtctgaacagccggtatatgcgaaaattcttctttctcttgcttctctgcattgtcttggttgagaacattcacactcatactctgtgatttttttttgtacagagtttgaagcatcaaaaaaattggaaaattgaacccgaacccaaaaagatatggtatgatagaggtaaaaagatctatcaagctgaacaataccgcaagggagcgtgtataaactgtggtgcaatgactcacagttctaaagcatgtatggatagacctcgtaagattggagctaaatacacaaacatgaacattgctgctgatgagaaaatcgagagttttgaacttgactatgatgggaagagggacagatggaacggttatgatacttcaacctaccgtcatgtggtagatcgttatgatgctaaagaggaggcacgaaagaagtatctcaaggagcagcaacttaagaaactagaggagaagaacaataatgaaaacggtgatgatgcaaccagtgatggggaggaagaccttgacgacttgagggtcgatgaagctaaggttgatgagagtaggcaaatggattttgcaaaggttgagaaacgtgttcgaacaactggtggtggtagcacaggaactgttaggtatggactactcttcatcaaacatgataacataagtttaaattggtgtttctacttgatgcactaatggtgttaccttttcttaatttcaggaatctgcgtatcagagaagacactgctaaatacctgttgaatcttgatgtaaactcagctcattatgaccctaaaactcggtccatgcgtgaagatccacttccagatgcagatccaaatgaaaaattctatttggttagtttgtgatcatcgtgaatcatgtagttgtatcttatattttgatgatatgagaatactaactttttttttcttcttatcatctatccagggagataatcaatatagaaacagtggccaagctctggagttcaaacagataaacatccattcatgtgaagcatttgacaagggacatgacatgcatatgcaagcggctccatcccaagctgaattgctctataagaactttaaagttgcaaaggaaaaactgaaaactcagacaaaggacaccattatggaaaagtatgggaatgcagctacagaaggtgaaattccgatggagcttttgcttggccaaagtgaaagacaaattgagtatgacagggcagggaggattatgaagggacaggtatagtttttgatggttctttcttgagtcgagtgatagctgttgcgatatgaacagcttgagataagtttgcttaatacgtgttgtttattgtgtacaggaggtgataattccaaagagcaaatatgaagaagatgttcatgctaacaatcacacaagtgtttggggatcatggtggaaagatcaccaatggggatataaatgttgccagcagacaattcgcaacagctattgcacaggttctgctggaattgaagctgcagaggcgtccattgatctgatgaaggctaatattgctcgcaaagaagcttctaaaggtttgtgttgttgactctgtttgttcttctagtctcttatttgttctcattgtattgtaacatttcggaatatgttttgtaacattggtttgtattttggtgatcagagagtccgaagaaggttgaagagaagaaaatggcgacatggggaactgatattcctgaagatttggaattgaacgaggaggcacttgcaaatgctcttaaaaaggtaagaaagacgccacagtttcagttcatattttctcttgccaagactcttgtttctctgccctgcaaggtttatctgacgtgttgttgtttgtgtgcaggaggatctaagtaggagggaagaaaaagatgagaggaaacgcaaatacaatgtcaattacaccaacgatgtgacctccgaggagatggaagcttacagaatgaagagagttcaccacgaggacccaatgagaaatttccccggctgataaatgtcttttccctttcaccatattaagctgaagaaaccttgtttttaagtttcatgtctttaaataagacccttgttattcatgtcattatttgttactgtcttcatgtccacccaaagattcattatataacgtatgaaactagaataaattttcttagccaaatcaaattaaccatgttgtatataaaccacgaccaagctttatatgaattttggtccaatcaaaccgaaatcctttattaagacaaaactgataatgtattgtttgcaaaagagccctccaaatttgttaaaatgtgaaagaaagctaattaaatatcaatttatctgtgtttaaagttttaacgagagggggcttttgaatttttttgctcaacttccaaatcgtcgccggcgatagaaaccctagatttgattctccgtcggttatatccagcaatg

SEQ ID NO: 17778 - DNA, 3000 bp, Unknown; identical to SEQ ID NO: 6305
  misc_feature (1)..( 3000): 2750-1469P.txt file - cDNA_ID_1814031; gDNA_ID_1621088; Annot_ID_55423

SEQ ID NO: 17779 - DNA, 3000 bp, Unknown; identical to SEQ ID NO: 6305
  misc_feature (1)..( 3000): 2750-1469P.txt file - cDNA_ID_1814031; gDNA_ID_1621088; Annot_ID_170555

SEQ ID NO: 17780 - DNA, 3003 bp, Unknown
  misc_feature (1)..( 3003): 2750-1469P.txt file - cDNA_ID_1814031; gDNA_ID_2926212; Annot_ID_142060
atagtgtttgtaaaatattatagattcttcagaatcctctttttaagactaatttgggaaaatattaaatacaggataacaggaatatgagaatcttgaatgagaagagcactaaaaacaaaataaataacaagtttcccaaaactgaaaattgtaatataattaatagccgaattaaaaggaaaaaaatccttaaagaaaaatataaaaaaagagaagaataaatatatataagtgagtgtaacgattcgccgcgtgtgtacgggcatcacaaaaagattctttcttccatttaaagataaatctaattttaatattgacaaaaacaccctcaagtctccacttatttacagcggctacggttcaccgcgtccttcttcttcttccctaatctcattttttttttgttctcatttatcttcttcagcatcttcatcatcttcttctatatatacctctttaagcttgcttctctttgtctttatcttgtccgatggttcaaacagaaaccgatcaaaggatgggtcttaatctgaatttgtctatctactctttaccaaaacccttatctcaatttctcgatgaagtgtcgaggatcaaagacaatcattccaaactgtctgaaatcgatggttatgtcggaaaattagaggaagaaaggaacaaaatcgatgtttttaaacgagaactccctttatgcatgctcttattgaacgaaggtatcttttattaaaattctctccttttcttttttttatcttctctaatcgattcgtgtttttgtttaaagagattgtttttctctgtgtagcgattggggcgttgaaggatgaggctagaaaagggttatcactgatggcatctaatgggaaattcgatgatgttgaaagggcaaaaccggaaactgataagaagagctggatgagctctgcccagttatggatctcgaaccctaattcccaattccgatcggtacgatcaaaaagcaaccctttttatgttttgtgaagaatcatatgttgtgtgattgatcttgttgaccttatgatcatgttttgacagacaaatgaagaagaagaagatcggtgtgtgagtcagaacccatttcagacatgtaattaccctaatcaaggaggggtatttatgccatttaaccgtcccccacctcctccaccaccagctcctctgtctctcatgactccaacatcagagatgatgatggattatagcagaattgagcagagtcatcatcatcatcaattcaataaaccttcttcacagagtcatcacattcagaagaaagagcagagaaggagatggtcacaggaacttcaccgtaaatttgttgatgctcttcataggcttggagggccacaaggttagtccttaaccttagtaaaggatcaaactttgctttagatttgattgattgattatactgagattgttttgtattgttgttgttgttgttgttgttgttgttgtgagacagttgctacaccaaagcagattagagatttgatgaaagttgatggtttaaccaatgatgaagtcaagagccatttacaagtaaaagttctcatcttttacagtaacttaaactttgatgtgtggatgaatgaatgattttgacagtgcggtgaaatgaaattgttattgcagaaatatagaatgcatatccgtaagcatccgctgcatccgacaaagactttgtcatcgtcggatcagccaggtgtgttagagagagaatcgcagagcttaataagtttgtcgaggtcggattcgccacaaagcccacttgttgcaagagggttgttcagtagtaatgttggtcatagctcagaggaagatgaggaggaggaggatgaagaggaggagaagtctgatggacgtagtagctgtagaaatgatgaaacaaagaagaagagacaagtgttggatcttgagctttgaaagtctgcatagtgaatgatataatctttaccaacttatgttatatatgctcaaaactttgagtttgttcgggagtttttgtagatgtaaacatgagagttgaaataaggaagaggattttgagcaaaaagtagggtttgtttttgcaagaggaaatagatagagaagagtgttcgaaatcctctgtgttttttttttttttttttttttacttcataagtaagataaactcatatatcaaagattttgtttttatacttattacagtctcaaccatgtgaatgaaggagtcatttgtttagttttaccagctcgtcatactaattaccttttaccttcgaaaacagaggatgaagaaacatcacaatctttgtctctttctgtaactcatcgttttctacaaatctacgtaatctgagagaataagtaaggggaaaaaaaataagaatcttttattgcataaaatcgtacgaaaagataagatttttcgtctgaaaaacgacaagatttattttcactattgaaggaattgacaatgtatatagaaaaaatctactcactgattagtgatttgatgaatagtttacttccacgagatttgcatgttttgtggataaagcttcttgcaccatgtaacatacattagccaatagtatagggtagatatttatcttttgacataattttcttcaaatttgttatttttattcaaaaattcaaatagttactctctgcttttcacaattaatgagtgtatatactaaagacatttaagcggcaatggaatatttgttcaaattggttcggtcgattcagtttctaaacccaaccggtttattcacccggttatttcgagtcaatttatgtggttttgtggtctctgggcctcacggggccgcctctccgtcttcatcaacattctcaaactcttttacaaatctaggctcgacgagggtttaagcaatcaccggagctcttagtctcttacgctgtgagctaagaaccgaccttttgcttagtttctttcaagtctccaatcaaacaaccatg

SEQ ID NO: 17781 - DNA, 3003 bp, Unknown; identical to SEQ ID NO: 17780
  misc_feature (1)..( 3003): 2750-1469P.txt file - cDNA_ID_1814031; gDNA_ID_2926212; Annot_ID_202723

SEQ ID NO: 17782 - DNA, 927 bp, Unknown
  misc_feature (1)..( 927): 2750-1469P.txt file - cDNA_ID_1814031; gDNA_ID_2926213; Annot_ID_202742
gcaaaaagtagggtttgtttttgcaagaggaaatagatagagaagagtgttcgaaatcctctgtgttttttttttttttttttttttacttcataagtaagataaactcatatatcaaagattttgtttttatacttattacagtctcaaccatgtgaatgaaggagtcatttgtttagttttaccagctcgtcatactaattaccttttaccttcgaaaacagaggatgaagaaacatcacaatctttgtctctttctgtaactcatcgttttctacaaatctacgtaatctgagagaataagtaaggggaaaaaaaataagaatcttttattgcataaaatcgtacgaaaagataagatttttcgtctgaaaaacgacaagatttattttcactattgaaggaattgacaatgtatatagaaaaaatctactcactgattagtgatttgatgaatagtttacttccacgagatttgcatgttttgtggataaagcttcttgcaccatgtaacatacattagccaatagtatagggtagatatttatcttttgacataattttcttcaaatttgttatttttattcaaaaattcaaatagttactctctgcttttcacaattaatgagtgtatatactaaagacatttaagcggcaatggaatatttgttcaaattggttcggtcgattcagtttctaaacccaaccggtttattcacccggttatttcgagtcaatttatgtggttttgtggtctctgggcctcacggggccgcctctccgtcttcatcaacattctcaaactcttttacaaatctaggctcgacgagggtttaagcaatcaccggagctcttagtctcttacgctgtgagctaagaaccgaccttttgcttagtttctttcaagtctccaatcaaacaaccatg

SEQ ID NO: 17783 - DNA, 3000 bp, Unknown; identical to SEQ ID NO: 6283
  misc_feature (1)..( 3000): 2750-1469P.txt file - cDNA_ID_1814035; gDNA_ID_1621088; Annot_ID_55420

SEQ ID NO: 17784 - DNA, 3000 bp, Unknown; identical to SEQ ID NO: 6283
  misc_feature (1)..( 3000): 2750-1469P.txt file - cDNA_ID_1814035; gDNA_ID_1621088; Annot_ID_170552

SEQ ID NO: 17785 - DNA, 3003 bp, Unknown
  misc_feature (1)..( 3003): 2750-1469P.txt file - cDNA_ID_1814035; gDNA_ID_2926213; Annot_ID_142063
tagcttgaacaaaagcggagcagtttagctagactaaccgttagtgggataacatacgcattttttattcgtatattttagtgtttaccgtgaatattttaattaaaacataaaaatattttttcccctaattctttaattttggttttcattttcaagtccgccaaaaaaagcgaagagagggttttaatacgattccactcttctcaacaaatttgacgtttttgttcttcgaaattcaaattcacccagaaaaaatctcaatccgcgatggttgaagaatcagcttctgcgtcggaagcttcggtgatacaaaccctaaccgagccggcgacggagattgcgcaaaccctagaacctaacctagcctcaatcgaagccaccgtcgaatcggttgttcagggaggcactgaatcgacttgtaacaacgacgctaataacaacaacgccgctgacagtgctgctactgaggtttgtgatgaggagcgtgagaagacgcttgagttcgctgaggaattgacggagaaaggctctgtgtttttgaaagagaacgatttcgctgaagccgtcgattgcttcagccgtgctctcgaaatcaggtatctttttgggagattcatttgagaatttgtagtcgagaacctctcaatcaagggtttagggtttcagatgtttctgaatctagtttatgctcgaatgatctaatcatggttctgaatttttagttgagtttcaattgtgtgttctctcgactgaattctttagtatctggtccttttatcaaaggatctaatgaaaacattgcttgttttaatggtatggttagggttgcacattatggtgaacttgatgctgagtgtataaacgcatactatcgatatggattagctctcctggcaaaggctcaagctgaagctgatccacttgggaacatgcctaagaaagaaggtgaagttcagcaagagtccagcaatggtgaatcgctggctccttctgttgtttcaggtgacccagagagacaagggagttcaagtgggcaagaaggtatggattattgggaattgtcttaggttaagcttatgggtatagatgcttctgcttctttgtttgctgacttcttttctccctcatgtataggttctggtggtaaagaccaaggagaggatggtgaagattgtcaagatgatgacctatctgatgctgatggtgatgctgatgaagatgagtctgatttggatatggcctggaaaatgctggacattgctagggttattactgacaaacagtctactgagacaatggaaaaagtggatatactctgttcgcttgctgaagtgtccttggaaagaggtattttttcttcctttcacctttgcattgtcttattttctcatgtcagctattggttggttttgagttctgttgtttactatgcagaggacattgagtcttccctgtctgactacaagaatgcattatccatcttagagagactggttgagcccgacagtcgacgcacagctgaattgtatccttgtggtttcttaaattgtacctgattttcgtttctgtcaattcagttgttggattatatcttaacttgaacgtttcagaaacttccgcatctgcatttgtcttgagactggatgtcagcctaaggaagcaataccatattgtcaaaaagctttgttaatatgcaaagctcggatggagaggctcagtaatgaaatcaaaggtgcatctggttcagcaacttcctcaaccgtctctgaaatagatgaaggcatccaacaatcatccaatgttccttacattgataaatctgcttcagacaaagaagttgagatcggagacttagctggtctcgctgaagatctagaaaagaaggcaagtaaactaaacctatcagttcattaaaatatctctaaacccatactaatgtccaacattttttttctgcagcttgaggatttaaaacaacaagcagagaacccaaagcaggttcttgctgagctaatgggcatggtatcagctaagccaaatgccagtgacaaggttgttcctgctgctgctgaaatgagctcttctaggatgggaactgtgaacaccaatttcgggaaagatttagagtcgcctacagtctcaaccgctcataccggtgcagcaggaggaggagcagcatcaggtgttactcacttgggtgttgttggaagaggagtgaagagagttttgatgaatacaacctcgattgaatcaagtgcatcaaagaaaccagctctagagttttcagacaaagcagatggcaactcctcttgaaaccggaaaaaggtataaaaattcctgttactagtgaagtatctaacctaagaaaactgagaaaaacatttggtatcttcctcatgaatcttccaagactagattttcaggttcatgttttgtaatggagtccgtacttgctacttttttaaatcgctgagatattttttactttttattcttgtttaatcagtcttattttttcaaagtgttttttagtttaggcacaaaagcagaatcttattatcacattatcagttgataatcatctgatgagaaatagttctttggagatcttttagggaattttataagtaataattaagggataattggatatcctttattaaaaaatgtaggctacttgtagaattaaaaactggaatcttataatatgattagtataataagattacgctatatctggattctggagatatcatagataagctctgtctatgaaaacgagacccttggggaagccacgtgtcaaatctatctctgtcaccagcgaagcctacgtggcgagcagctcctagaatatccaaattcacaacagtatttttttttctttcgttctgattcaacagttgtcacaaacagccaaggtgttttgtgattggttataaatactctgctatgtgagagagtttactacattcacaaacaaactaaaacttaaaaatg

SEQ ID NO: 17786 - DNA, 3003 bp, Unknown; identical to SEQ ID NO: 17785
  misc_feature (1)..( 3003): 2750-1469P.txt file - cDNA_ID_1814035; gDNA_ID_2926213; Annot_ID_202745

SEQ ID NO: 17787 - DNA, 3003 bp, Unknown
  misc_feature (1)..( 3003): 2750-1469P.txt file - cDNA_ID_1814041; gDNA_ID_1621088; Annot_ID_55417
ttgtactttaagtctttaagatacattatgcttaaaaatgacagttaaaatttggtttgtatactacttagacgaattctttgactgttaatattcaaatatatttgcattctctgttatttcattcatatccaataaatatatatattatttattatagtatgatataaactaacacataatatatacatagatatatttcgtttaaagatgtggtgtcaatcgtattttttatagagcaaaatttcgaggtaaattagttttttcaaacatctacagtttgtacatggcattggacttaaataaaataatgtcacgtagctatcgacaaaaagaaaagcatctgatgtagctatgaaatttacaaccactgctaaacaaattgtccacttaataaatagtttatagataatttgggaataaagctgacaatgactgtgtcggatatcgttattcgccgaagctaacattcatataaacgaataacgttttttgttttttttggtcgaaataaacgaataatgtataaaatgaaattttgtttacaccaaaaaaagatccaccggtaacaagaaaaaatcttagtgctctgaattagaagaataaattaattatcacaaaaaggaaaggccgtagagaagattgtaagctttaaaaagcccaatatttttggacaattttcgtttggttacctgtccccgttcgtcctttcaagtacatcttcttctctctcgatttagcttgaggtataaccagtcaaccgccacatttccttgtattacaatgaataattgggcctttaaagcccataaattggcctctaaacgtttcattcggttaagtcccttgcattttaagatttcatcttgtcatttcacctacaattacaaaacaaaattacaaatcatctctctgtttcagagtcaatggttgaaggaaaaaaaaaaaaaactcactgtacttttatttttatggatcaaaagtgagttgttctatgatttactttttgtttcacaaacagataccgttttgtttctttaatacaagtttaaaaaaaaaaatgtaatcgtcattatgatttaagtttattatttccataactgtatactgtatagtgtgttgagaaaaacatatgatataaattttagatgttttcttaaaacgagggaatttaaatcatttaatagcatatcgtaagtttaaagtcaactagaggagtgaatggcaggctaattattcttcttcttctcaacccaactcgaggaaatttagctgaattagcataaacaatacgtaaggaggaacatgatccattgattaggcaaaaagtttaggttacaaattcatacatttgcatcttacttaaaaggagcaatagaattcctagttccaaggtcaagagtcaatttacatttccattttttaaaaataattttgtttgatgttataagttataacttaagtaatagatacaaatcatggggacataaacatagatgagcttttcttatggttgaaagaaataaaaatccaaatggcgaaggatcaaatggccgactagcattgattgaattgctaaagcgagactttaccttttacattataaatcatttgatttgacctcatttgtgacttaagttatctaatagcgattttttctctatgtttttttttataataagtttttggttgaagattaagatgtagatcataattcagggaaaagatcatctaatgaaaattcatggtccaccacaagactaacaaggctgggtttgtggcttttactattggactcattatagttgatgaactttattgaatctttttcaacccaaattttgtattttataaagaagtgggtagagatcacctccaacctttacaaaagaaactgtttaacagttataaagaatgcaaaaagggaataataagagactaaaatgatgagttatggagtatggaccatgtgtgcactcgtatatctaattattgaaaacctttacacttttttttccagggatgccttaaatacaatttacccacctcatgaatcatgcttatccaaactcaaacatatccaaaaccatgtaactgatcttcaatttgttaccattttataacctcgaagtaaatgcgtatttttttgcttataatattgacaatttcaatttccttacatataatcattcatataaagaatgtgaagctcttttaaactcatggagtgttatattattttccctccaattaatcatatgtagcttgaagacaaattattatttcgtacagaattgaatgcagaatcttccggacgactgaaatagctctacttattacaaaaaaaattgtaatcaaacgaataaaaacaaatgataataagcagcacatggaaaccatttacagagtaaaatacttgtaaagcatccataaacaaaaaaaaaatccccaaaaaatggaaaacagcagagacattcgaaactatattctaaaaacaaaaaccaagaacatgcccttatttttctaaaattcaaaaacatccattatattcgatttagattccttcgagctatattggttgtgtgaaccaaaaacagaagaatatcatgtaaaagtcaaatttacaactttagctatagatgatataaatgtcttgtagcttactgattctaagaatctatctactcgtttcttcggctcactaaagaaagagagagagagagagaaaaaaagaaagtacaatttcataataataaatgaagaagaccgtaacaagaagtgtgtagtcgtattgattatagaattaaagaaactctgcaatatttttgcagagagacagagacacaaagaaagagagagagagagcatttagggagcaggaagtggagtgtttggttacgtgagctgttttctctttctctatctttaactcccttcacacctctccctctctcttcttcatatctctctctgtcacaatagtgtgatgatgcaatgagaatg

SEQ ID NO: 17788 - DNA, 3003 bp, Unknown; identical to SEQ ID NO: 17787
  misc_feature (1)..( 3003): 2750-1469P.txt file - cDNA_ID_1814041; gDNA_ID_1621088; Annot_ID_170546

SEQ ID NO: 17789 - DNA, 3000 bp, Unknown
  misc_feature (1)..( 3000): 2750-1469P.txt file - cDNA_ID_1814041; gDNA_ID_2926213; Annot_ID_142066
tactttaagtctttaagatacattatgcttaaaaatgacagttaaaatttggtttgtatactacttagacgaattctttgactgttaatattcaaatatatttgcattctctgttatttcattcatatccaataaatatatatattatttattatagtatgatataaactaacacataatatatacatagatatatttcgtttaaagatgtggtgtcaatcgtattttttatagagcaaaatttcgaggtaaattagttttttcaaacatctacagtttgtacatggcattggacttaaataaaataatgtcacgtagctatcgacaaaaagaaaagcatctgatgtagctatgaaatttacaaccactgctaaacaaattgtccacttaataaatagtttatagataatttgggaataaagctgacaatgactgtgtcggatatcgttattcgccgaagctaacattcatataaacgaataacgttttttgttttttttggtcgaaataaacgaataatgtataaaatgaaattttgtttacaccaaaaaaagatccaccggtaacaagaaaaaatcttagtgctctgaattagaagaataaattaattatcacaaaaaggaaaggccgtagagaagattgtaagctttaaaaagcccaatatttttggacaattttcgtttggttacctgtccccgttcgtcctttcaagtacatcttcttctctctcgatttagcttgaggtataaccagtcaaccgccacatttccttgtattacaatgaataattgggcctttaaagcccataaattggcctctaaacgtttcattcggttaagtcccttgcattttaagatttcatcttgtcatttcacctacaattacaaaacaaaattacaaatcatctctctgtttcagagtcaatggttgaaggaaaaaaaaaaaaaactcactgtacttttatttttatggatcaaaagtgagttgttctatgatttactttttgtttcacaaacagataccgttttgtttctttaatacaagtttaaaaaaaaaaatgtaatcgtcattatgatttaagtttattatttccataactgtatactgtatagtgtgttgagaaaaacatatgatataaattttagatgttttcttaaaacgagggaatttaaatcatttaatagcatatcgtaagtttaaagtcaactagaggagtgaatggcaggctaattattcttcttcttctcaacccaactcgaggaaatttagctgaattagcataaacaatacgtaaggaggaacatgatccattgattaggcaaaaagtttaggttacaaattcatacatttgcatcttacttaaaaggagcaatagaattcctagttccaaggtcaagagtcaatttacatttccattttttaaaaataattttgtttgatgttataagttataacttaagtaatagatacaaatcatggggacataaacatagatgagcttttcttatggttgaaagaaataaaaatccaaatggcgaaggatcaaatggccgactagcattgattgaattgctaaagcgagactttaccttttacattataaatcatttgatttgacctcatttgtgacttaagttatctaatagcgattttttctctatgtttttttttataataagtttttggttgaagattaagatgtagatcataattcagggaaaagatcatctaatgaaaattcatggtccaccacaagactaacaaggctgggtttgtggcttttactattggactcattatagttgatgaactttattgaatctttttcaacccaaattttgtattttataaagaagtgggtagagatcacctccaacctttacaaaagaaactgtttaacagttataaagaatgcaaaaagggaataataagagactaaaatgatgagttatggagtatggaccatgtgtgcactcgtatatctaattattgaaaacctttacacttttttttccagggatgccttaaatacaatttacccacctcatgaatcatgcttatccaaactcaaacatatccaaaaccatgtaactgatcttcaatttgttaccattttataacctcgaagtaaatgcgtatttttttgcttataatattgacaatttcaatttccttacatataatcattcatataaagaatgtgaagctcttttaaactcatggagtgttatattattttccctccaattaatcatatgtagcttgaagacaaattattatttcgtacagaattgaatgcagaatcttccggacgactgaaatagctctacttattacaaaaaaaattgtaatcaaacgaataaaaacaaatgataataagcagcacatggaaaccatttacagagtaaaatacttgtaaagcatccataaacaaaaaaaaaatccccaaaaaatggaaaacagcagagacattcgaaactatattctaaaaacaaaaaccaagaacatgcccttatttttctaaaattcaaaaacatccattatattcgatttagattccttcgagctatattggttgtgtgaaccaaaaacagaagaatatcatgtaaaagtcaaatttacaactttagctatagatgatataaatgtcttgtagcttactgattctaagaatctatctactcgtttcttcggctcactaaagaaagagagagagagagagaaaaaaagaaagtacaatttcataataataaatgaagaagaccgtaacaagaagtgtgtagtcgtattgattatagaattaaagaaactctgcaatatttttgcagagagacagagacacaaagaaagagagagagagagcatttagggagcaggaagtggagtgtttggttacgtgagctgttttctctttctctatctttaactcccttcacacctctccctctctcttcttcatatctctctctgtcacaatagtgtgatgatgcaatgagaatg

SEQ ID NO: 17790 - DNA, 3000 bp, Unknown; identical to SEQ ID NO: 17789
  misc_feature (1)..( 3000): 2750-1469P.txt file - cDNA_ID_1814041; gDNA_ID_2926213; Annot_ID_202748

SEQ ID NO: 17791 - DNA, 3003 bp, Unknown
  misc_feature (1)..( 3003): 2750-1469P.txt file - cDNA_ID_1814045; gDNA_ID_1621088; Annot_ID_55415
cgtcgaaggaagagacggcgagtgacggagatacggcgagcggtggcgcctcaccgtccaacgacggcagactcttctcggagggcgagcgtgttctcgcttaccatggtcctcgcgtctacggagccaaggcaaataaaaaacctctctctctctctctctttctctgtgcatcgtcagatgttcgcataatttgaattctagagattatcttgttcgtgttaatttagcaattcttgtatttcacgtgggttttggttgtatccgactacggaattaactggtttcattgaattgagatctctctgctagatttggcttaggggtttcttggtagatttcggtttcaagttacgacgatccgaaagatgaacccattgagattggattcgagttttctttttttggtaatggattcatgtagcattagagctttttagattggaatgatcataaatgcttagtcgtaatagatgcaaaagaataattcacttgccgttggagcaaggaattcaataaattactcggaaaatagggcaagctaatctacttgcatgtttattttttcaatcatatattatataggtcactggattgagtctcattcatatcaaatgtgtgtcgttgttatgctaaatcttcatagttttgaaaaaaatctgttattgcatagtgttttcagtgtgtgggcagacctgatagattattgacattccattacaggttcaaaaggtcgagcttcggaaaaaggagtggaaatactttgtgcactatcttgtgaggcctccttcttctgagctattatagtttcattatcctgtttcatgtactagctattttcattttggtttgcagtaataagtgatacagcgatctttgtctgcagggttggaacaaaaagtgagtatctctctctgctctcatgtcgattctggtttatgtagcaaaatcagtagattgggacccatgacatgattgtcttgccaacagttgggatgaatgggttagtgcggatagattgttgaaacataccgaggagaatcttgtcaaacagaaagctctagacaaaaagcaaggagttgaaaaaggtaccaagtctggccgttccgctcagacaaaaactagaagctctgcaggtgagttgttgcctccacattgaccatgctgagagtacatgatacatattttggtcatccaggctaagaaactaactatttctttctgatcttgcacttgcagacacaaaggctgataaagatgacaccaagaccaatggtaggcaacatattaatttacgctccctttgtagttcagggttctcccaacaatttccaaggaaatgatttggtagactgggtgcaacttaaattatttaagctggtgtatagatgattacattttctgttgcagctgcaaaagggaagaaacgaaagcacgagtcaggcaatgaggtcaggcttgcaaaaacttagagatgtatttggttcatacctgttaggtctttgttaagattatattttacagtacaatagatggctgatgtgttgttatgcatatacacacatacgaaaagggtcaatttttcaggtcttctaatatcgataaggtttttgttttcatttgtaatctatagaaggataatgtaacggcggagaagctaatgaagatccaaattcccgcatcacttaaaaagcaactcactgacgactgggagtatattgcgcagaaggacaaggtatcatcaattttctctattttgtgcacatacttttagcactattagaattgttattgaatcagctagacttgaaagttaagagacataagtgtgtatttgtagtcgaatgaattgtgtataccaaagtgaagggaaattgatgtttggtaatctgtcttcaaatgattatataggttgtgaaacttcctcgttcacctaacgtcgatgagatattgtccaagtaccttgaattcaaaaccaagaaggatggaatgtgagtcttttactcgaacacagagtttgatatatttgaatcttttccgaaatccaacgatacaaaattttgtgtttctgtttttgtgcagggtaactgattcggtcgctgaaatattgaaaggcataaggagttatttcgacaaggcattgccagtgatgctcctatataagaaagagaggcgacaataccaagaatcaatcgtggatgatacttcaccttcaactgtttatggcgccgagcatttgctccgtctctttggtaaaatctcattaagttcttatttggacagtaaaattcgatgttctgaaattttatttttgctttttttaaaaatctgcagtcaagttgccagatcttttttcatatgtaaacatggaagaagaaacatggagtcgcatgcaacaaacattatcagacttcctcaagtatatatctaatctctctgtttcatcactaccattttgatttctcggttttaacggttaaattcacaatttctggaaaaaaatctttacaggtttattcagaagaatcagagcactttcttgctaccatcagcatatgattctgataaggtttcagatggtaaaggcaaaggaaaagacgactgacatctccaggaaaaaaatattgttgtaatttagaattccttcatttttctgatgaattcataattgtaagatttgcagctgaatatgaaatattttacaggcctttgaagttaactatttggttcatgtaaatttctttaagtggtcaataaaacatccggaacaatggaaccttggttggtagaaggcaacaaaaaaaatggaaaaaataaaaaagtgtatgagatgagattatttatgtggctaatgtcatcggaataattacattggttctccttctctgttattattctttcatctttttcaccaagacgaacgactcttacacgcagagttcgcgagatcagaatcaatggtggcatgaaaaacgacgcttgagctcaaattcgtcgaccatg

SEQ ID NO: 17792 - DNA, 3000 bp, Unknown
  misc_feature (1)..( 3000): 2750-1469P.txt file - cDNA_ID_1814045; gDNA_ID_2926213; Annot_ID_142068
cgaaggaagagacggcgagtgacggagatacggcgagcggtggcgcctcaccgtccaacgacggcagactcttctcggagggcgagcgtgttctcgcttaccatggtcctcgcgtctacggagccaaggcaaataaaaaacctctctctctctctctctttctctgtgcatcgtcagatgttcgcataatttgaattctagagattatcttgttcgtgttaatttagcaattcttgtatttcacgtgggttttggttgtatccgactacggaattaactggtttcattgaattgagatctctctgctagatttggcttaggggtttcttggtagatttcggtttcaagttacgacgatccgaaagatgaacccattgagattggattcgagttttctttttttggtaatggattcatgtagcattagagctttttagattggaatgatcataaatgcttagtcgtaatagatgcaaaagaataattcacttgccgttggagcaaggaattcaataaattactcggaaaatagggcaagctaatctacttgcatgtttattttttcaatcatatattatataggtcactggattgagtctcattcatatcaaatgtgtgtcgttgttatgctaaatcttcatagttttgaaaaaaatctgttattgcatagtgttttcagtgtgtgggcagacctgatagattattgacattccattacaggttcaaaaggtcgagcttcggaaaaaggagtggaaatactttgtgcactatcttgtgaggcctccttcttctgagctattatagtttcattatcctgtttcatgtactagctattttcattttggtttgcagtaataagtgatacagcgatctttgtctgcagggttggaacaaaaagtgagtatctctctctgctctcatgtcgattctggtttatgtagcaaaatcagtagattgggacccatgacatgattgtcttgccaacagttgggatgaatgggttagtgcggatagattgttgaaacataccgaggagaatcttgtcaaacagaaagctctagacaaaaagcaaggagttgaaaaaggtaccaagtctggccgttccgctcagacaaaaactagaagctctgcaggtgagttgttgcctccacattgaccatgctgagagtacatgatacatattttggtcatccaggctaagaaactaactatttctttctgatcttgcacttgcagacacaaaggctgataaagatgacaccaagaccaatggtaggcaacatattaatttacgctccctttgtagttcagggttctcccaacaatttccaaggaaatgatttggtagactgggtgcaacttaaattatttaagctggtgtatagatgattacattttctgttgcagctgcaaaagggaagaaacgaaagcacgagtcaggcaatgaggtcaggcttgcaaaaacttagagatgtatttggttcatacctgttaggtctttgttaagattatattttacagtacaatagatggctgatgtgttgttatgcatatacacacatacgaaaagggtcaatttttcaggtcttctaatatcgataaggtttttgttttcatttgtaatctatagaaggataatgtaacggcggagaagctaatgaagatccaaattcccgcatcacttaaaaagcaactcactgacgactgggagtatattgcgcagaaggacaaggtatcatcaattttctctattttgtgcacatacttttagcactattagaattgttattgaatcagctagacttgaaagttaagagacataagtgtgtatttgtagtcgaatgaattgtgtataccaaagtgaagggaaattgatgtttggtaatctgtcttcaaatgattatataggttgtgaaacttcctcgttcacctaacgtcgatgagatattgtccaagtaccttgaattcaaaaccaagaaggatggaatgtgagtcttttactcgaacacagagtttgatatatttgaatcttttccgaaatccaacgatacaaaattttgtgtttctgtttttgtgcagggtaactgattcggtcgctgaaatattgaaaggcataaggagttatttcgacaaggcattgccagtgatgctcctatataagaaagagaggcgacaataccaagaatcaatcgtggatgatacttcaccttcaactgtttatggcgccgagcatttgctccgtctctttggtaaaatctcattaagttcttatttggacagtaaaattcgatgttctgaaattttatttttgctttttttaaaaatctgcagtcaagttgccagatcttttttcatatgtaaacatggaagaagaaacatggagtcgcatgcaacaaacattatcagacttcctcaagtatatatctaatctctctgtttcatcactaccattttgatttctcggttttaacggttaaattcacaatttctggaaaaaaatctttacaggtttattcagaagaatcagagcactttcttgctaccatcagcatatgattctgataaggtttcagatggtaaaggcaaaggaaaagacgactgacatctccaggaaaaaaatattgttgtaatttagaattccttcatttttctgatgaattcataattgtaagatttgcagctgaatatgaaatattttacaggcctttgaagttaactatttggttcatgtaaatttctttaagtggtcaataaaacatccggaacaatggaaccttggttggtagaaggcaacaaaaaaaatggaaaaaataaaaaagtgtatgagatgagattatttatgtggctaatgtcatcggaataattacattggttctccttctctgttattattctttcatctttttcaccaagacgaacgactcttacacgcagagttcgcgagatcagaatcaatggtggcatgaaaaacgacgcttgagctcaaattcgtcgaccatg

SEQ ID NO: 17793 - DNA, 3000 bp, Unknown; identical to SEQ ID NO: 17792
  misc_feature (1)..( 3000): 2750-1469P.txt file - cDNA_ID_1814045; gDNA_ID_2926213; Annot_ID_202751

SEQ ID NO: 17794 - DNA, 3003 bp, Unknown
  misc_feature (1)..( 3003): 2750-1469P.txt file - cDNA_ID_1814049; gDNA_ID_1621088; Annot_ID_55414
aactctagaatttttcaaaaaacgaacaaaacataattgtcatgttggttcgtgggcatgagaaaaagaagggagataacatagacagacaaattcggtggtactcacacaaaatacttgtatggacggacggactctaactctgcttcatagttgtcatgataacaatattggcatctatcttcttcctctttttcctttttgtttttaaacgtcacttcccccacatgtatgatgtaccctcaattttatttcattatcaatcttgcatcttcgaatcttttttaaaaaaaatcgagtttgcagaactaaatccataattatttctaatttcgattttttaatgtgaaatatttagtggtcaaatatgaatataagtactgtttatggacgaaccatgtgaacatatcatgttttcgatatacaaattatgatattgcattgtgcagtcacaatttggttcttttgagatgttatagttgtatactaccttaatccctagagatacatatctgctatttgaatggattaaagatttgcttttatatagatttaagtaaataattgaaattcttttgtccaaagatatttgttcaagaattatattaatttcatgtaattggaaggaatacaaaagactggaatcttgataatgaatttattaatgcagaatttgattccattattaatggactaccacgtccgaactatacatagttaaacattttttcttcttgtattattctggcgtggtcttacgccacttataaactatattattttggccaaaccaatatttataaaatcgaaataaaacattaaaccgggttttaagtactttgtttgtattattcaataattggttattaaactaagttaataatttcaaaatagtgatttcaccttaaaatatgggaaagagtttcctgatgctctggaatttggtttctttgtcttatactctaactgcggataaaaaggagcgattttgctataaaaaggaacagtttgagatgatattacactttattccggtaaattatttggctaccatcaataatatattcttcaaaactatcaatcttcctttttttttagaaaataaataaatttcatcacaactctgtttgaaaaatcgtttatgaacttgagacggaaaaattatcataattcaacgtcatatagcagcaagagttgaaataaaaattaatggttttgtcttttcataggatagatttcttatttctacctaacaaaaactaaaatttggatgttgaattttgagtagtataaagtttggttgttcaatgttttttgcaagaaaaatcacgtgagaaggaactatttttggtcgtgcaagaaaaataacaccaaagtgtttgaacttttgaagcattgatgattaggtttggtgtatctaacaatattataaaacaaacacatgagatccgactcatagtcaatttagcttatgtcactccttaaatcagctggtttaaccgaaccagaaaccctaaccaaatttttaaaaaaaattcaagttatctgattttaaatttattttctatatataaaaaatttggctgaaagttgaaacgaaaccaaagctagagatgtacattttctagtaaagtaaaataaagtaaacaaattcaatctgaaaccaacaatataccataatatacttacgaaaaccaaatctaaaccggctaacgatatatgtgagtgtgactttatatacgttgcgagtttgaaattcaagcattatttttggtctacacaactacaaatctaccttaatatttagctgccgtctgctccaaacaatgaaacttcatgtttggtctacgatattaaattctttatttctaatattcaattccttatccttttcttcattgatggctttcactattttgtgttcaataaatacacacaaaattgaatgctcaagaaacaagttggtattttcccaggaagcagcatactaactaatttcaatgatcacattcttttcaattcaaacttagtcaagaataaaaattcaaactttgcatctccacgaacactactatatagtcacattctcaactcacaaaacactcacaacaaaattcattatctgccaaagagaaagaaaaccatattttttataaacagagttaaattgttcttaaacatgatgatgaacaaaaacgttctgagttcgattctgttcttcatgttgattggttcggttcttgtcgagagtcgtccgcttggtctaacaaagaccgaggagaagttcgtggctagtttattcgatggcttatcacttggttcgatcaaagactcaggtccaagtccaggcgagggtcataaggtcgtggacaggaaggatacgtttcgatttgttaagcactcaggtccaagcccaagcggaccgggccactaatgtttcaatctttagttcaaaccgggccggttaaagtgcccatacccatctaggtcgagaaaattatttcatttttttgttccagtttcattagtggaaaatattatacatgtctcatgtttctgatcgatacataggaagaagaatggcaaaaacaataattattgtctcatttttctatatttaggattattgttttgttagtgaaataaagttacttgaaaagtatacaaataaaatgtattaatcaatttttttatatttatttgaatgtaataatagttaataaacatcagtgtccaaagtgaaatatgagtccaactgctcaacgaccaataaaggcataaatttttttaaaaagacaatgctttataaatgggcgacgagtatatttaaaaggtttaagagatttaatcgaactattgtgaaagttaagggactcaattgaaaaactattcgcaacgattcagtcattcagcagttgtcgtagattcatttatctagacggttaaaggggtgccttgtgatgtgaagatctttgcctctcgctctcgctttcggtgacaatg

SEQ ID NO: 17795 - DNA, 3000 bp, Unknown
  misc_feature (1)..( 3000): 2750-1469P.txt file - cDNA_ID_1814049; gDNA_ID_2926213; Annot_ID_142069
tctagaatttttcaaaaaacgaacaaaacataattgtcatgttggttcgtgggcatgagaaaaagaagggagataacatagacagacaaattcggtggtactcacacaaaatacttgtatggacggacggactctaactctgcttcatagttgtcatgataacaatattggcatctatcttcttcctctttttcctttttgtttttaaacgtcacttcccccacatgtatgatgtaccctcaattttatttcattatcaatcttgcatcttcgaatcttttttaaaaaaaatcgagtttgcagaactaaatccataattatttctaatttcgattttttaatgtgaaatatttagtggtcaaatatgaatataagtactgtttatggacgaaccatgtgaacatatcatgttttcgatatacaaattatgatattgcattgtgcagtcacaatttggttcttttgagatgttatagttgtatactaccttaatccctagagatacatatctgctatttgaatggattaaagatttgcttttatatagatttaagtaaataattgaaattcttttgtccaaagatatttgttcaagaattatattaatttcatgtaattggaaggaatacaaaagactggaatcttgataatgaatttattaatgcagaatttgattccattattaatggactaccacgtccgaactatacatagttaaacattttttcttcttgtattattctggcgtggtcttacgccacttataaactatattattttggccaaaccaatatttataaaatcgaaataaaacattaaaccgggttttaagtactttgtttgtattattcaataattggttattaaactaagttaataatttcaaaatagtgatttcaccttaaaatatgggaaagagtttcctgatgctctggaatttggtttctttgtcttatactctaactgcggataaaaaggagcgattttgctataaaaaggaacagtttgagatgatattacactttattccggtaaattatttggctaccatcaataatatattcttcaaaactatcaatcttcctttttttttagaaaataaataaatttcatcacaactctgtttgaaaaatcgtttatgaacttgagacggaaaaattatcataattcaacgtcatatagcagcaagagttgaaataaaaattaatggttttgtcttttcataggatagatttcttatttctacctaacaaaaactaaaatttggatgttgaattttgagtagtataaagtttggttgttcaatgttttttgcaagaaaaatcacgtgagaaggaactatttttggtcgtgcaagaaaaataacaccaaagtgtttgaacttttgaagcattgatgattaggtttggtgtatctaacaatattataaaacaaacacatgagatccgactcatagtcaatttagcttatgtcactccttaaatcagctggtttaaccgaaccagaaaccctaaccaaatttttaaaaaaaattcaagttatctgattttaaatttattttctatatataaaaaatttggctgaaagttgaaacgaaaccaaagctagagatgtacattttctagtaaagtaaaataaagtaaacaaattcaatctgaaaccaacaatataccataatatacttacgaaaaccaaatctaaaccggctaacgatatatgtgagtgtgactttatatacgttgcgagtttgaaattcaagcattatttttggtctacacaactacaaatctaccttaatatttagctgccgtctgctccaaacaatgaaacttcatgtttggtctacgatattaaattctttatttctaatattcaattccttatccttttcttcattgatggctttcactattttgtgttcaataaatacacacaaaattgaatgctcaagaaacaagttggtattttcccaggaagcagcatactaactaatttcaatgatcacattcttttcaattcaaacttagtcaagaataaaaattcaaactttgcatctccacgaacactactatatagtcacattctcaactcacaaaacactcacaacaaaattcattatctgccaaagagaaagaaaaccatattttttataaacagagttaaattgttcttaaacatgatgatgaacaaaaacgttctgagttcgattctgttcttcatgttgattggttcggttcttgtcgagagtcgtccgcttggtctaacaaagaccgaggagaagttcgtggctagtttattcgatggcttatcacttggttcgatcaaagactcaggtccaagtccaggcgagggtcataaggtcgtggacaggaaggatacgtttcgatttgttaagcactcaggtccaagcccaagcggaccgggccactaatgtttcaatctttagttcaaaccgggccggttaaagtgcccatacccatctaggtcgagaaaattatttcatttttttgttccagtttcattagtggaaaatattatacatgtctcatgtttctgatcgatacataggaagaagaatggcaaaaacaataattattgtctcatttttctatatttaggattattgttttgttagtgaaataaagttacttgaaaagtatacaaataaaatgtattaatcaatttttttatatttatttgaatgtaataatagttaataaacatcagtgtccaaagtgaaatatgagtccaactgctcaacgaccaataaaggcataaatttttttaaaaagacaatgctttataaatgggcgacgagtatatttaaaaggtttaagagatttaatcgaactattgtgaaagttaagggactcaattgaaaaactattcgcaacgattcagtcattcagcagttgtcgtagattcatttatctagacggttaaaggggtgccttgtgatgtgaagatctttgcctctcgctctcgctttcggtgacaatg

SEQ ID NO: 17796 - DNA, 3003 bp, Unknown
  misc_feature (1)..( 3003): 2750-1469P.txt file - cDNA_ID_1814052; gDNA_ID_1621088; Annot_ID_55411
agtctctttagttttcagtcaattaattttcgtgttttaaaggccacaaagtacccatctggtccatctcgatcccacacacgacacaactttacacaaaaagaaagaaaaacccaaaaacaaaagaagcaatcaacaagaaaatggacctcacccaaatcctactcctctcctttctctttctcactatctccatcaaactcttgctcacaaaatctaaccggaaacctaatcttcctccttctccggcttaccctttaccggttatcggccacctccacctcctcaagcaaccggtccaccgaacattccactccatctctaagtcccttggaaatgctccaatcttccacctccgcctgggaaaccgcctcgtttacgtcatctcctcacactccatagccgaagaatgtttcaccaaaaacgacgtcgttcttgcgaaccgtcctgatatcatcatggccaaacacgtcggctataactttaccaatatgattgcagcatcttacggcgaccactggaggaatctccgccgcatcgccgccgtcgagatattttcttctcatagaatcagtaccttttcttctatccgtaaagacgagatccgacggctcataacacatctctctagagactccttgcacgtacgtaaccaccttcttatttaactcattatttatcttttatttactttggcattactaaaatttaccaaaaaacaaaatatcaaaaatcaaaatttttatttatcgactattgcggttgaatttgtccatgtgagtaggattttccactttcaagccgcccttctttattatattaacacgcatatttaattatttgtcgcttattggctggaaaataatatatttatcagttaggttacttgtatgcatcaaatttgtcacgacagaaaataaaataaaagctctcagtcgtcatagatggaactgaactatacacctttgatatagatctattaaaaattacacaatgtaataaacttgactagtaatcgtcccactgcagggatttgttgaagtggagttgaaatcgttattaaccaacttggcattcaacaacatcatcatgatggtagccggaaaacgatattacggtaccggtacagaagacaatgatgaagccaagctcgtgagggaacttatagcggagataatggccggcgccggttctggaaatttggctgattatcttccgtccataaattgggtcacaaactttgagaaccagaccaaaatcttggggaatcgactcgatagagtcctgcaaaaactggttgatgagaaacgtgcagagaaagaaaagggtcaaactttgatcgatcatttgctttctttccaagaaaccgaacccgagtactatactgatgtcatcatcaaaggaatcatactggtaagttcttattaactaatattatcctccttatatgtggagtgggtttacttattagagatatatatatacacaggctttggttcttgcggggacagatacatcttcagtgacgttggaatgggcaatgtcaaatttgctgaaccatccagagatacttgagaaagcgagagcggagatcgatgataaaatcggttcagaccggttagttgaagaatcagatattgtaaatctccattatctccaaaacattgtgtcagaaacattacgtttgtatcctgcggttccactactactccctcatttctcatcggatgaatgtaaagtggcgggctacgatatgccacgtcgcacgttgttattaacaaacgtatgggcgatgcatagagatccaggtttatgggaagagccagagaggttcaagccggagaggttcgagaaagaaggagaggctcgaaagctaatgccgtttgggatgggacgacgagcttgtcctggagctgagcttgggaagcggttagtgagccttgctcttgggtgcttgattcagtctttcgagtgggagagagttggtgcagaacttgtggacatgactgaaggcgaagggatcactatgcctaaagctactccgttgcgagctatgtgcaaggcacgtgccattgttggtaaaacgatataattgacgtatgtaggatctattgtgtagaaacctatatagtttcttacattccacgtgttcatggaaaataaaagtattctgtggtcaattagttggatgcagagcaatgtcacggcttctatagaaagttcaacagaaccaaaatttcactgtttccatctctccaatgttggtttcttgaaatttagaattggtttggtgacttggtcatgtagtgggcatgtgttgggcctcgtcaaaatgttgtctttctctgcattttaaattaaatacccattaacaaatctgtatacatatgttcttcactgtctgaactagtaattcagcataagctaaaagtataatattttttttttaataaaaggactgttgttaaaaacgaaaagtttggatttcatgttagtgttggtaccgaatctgccacgttttgatgattatagttgtagaaaatgtcaaccaagcaatattattgtaaagacaataatggatggaaatctaagaatttcgattgaatttttatcttatcgagaactttcaacaaaaccttttggattgatcaaatgaaagagacataagtggttatacattagacttgttcacgacactccaatgtagtatgatttttctgtttgtttgtcaaattcattgtttacttgtcttataggaattttccttattttacaaaaacaaaagaaataaaagaaaagaaaattggtgcttgtttttccaaattagtacgctaattttatcactattgtatgcactattttgttatttgactttgtaaatgcatgaattaaagagtgtttaaaaatcagtatcttatactatattatttaatagcgcacggaggagaaaccaaaatatacacaaagttagagaaaaaaagaagagaaaaggagttatatatg

SEQ ID NO: 17797 - DNA, 3000 bp, Unknown
  misc_feature (1)..( 3000): 2750-1469P.txt file - cDNA_ID_1814052; gDNA_ID_2926213; Annot_ID_142072
ctctttagttttcagtcaattaattttcgtgttttaaaggccacaaagtacccatctggtccatctcgatcccacacacgacacaactttacacaaaaagaaagaaaaacccaaaaacaaaagaagcaatcaacaagaaaatggacctcacccaaatcctactcctctcctttctctttctcactatctccatcaaactcttgctcacaaaatctaaccggaaacctaatcttcctccttctccggcttaccctttaccggttatcggccacctccacctcctcaagcaaccggtccaccgaacattccactccatctctaagtcccttggaaatgctccaatcttccacctccgcctgggaaaccgcctcgtttacgtcatctcctcacactccatagccgaagaatgtttcaccaaaaacgacgtcgttcttgcgaaccgtcctgatatcatcatggccaaacacgtcggctataactttaccaatatgattgcagcatcttacggcgaccactggaggaatctccgccgcatcgccgccgtcgagatattttcttctcatagaatcagtaccttttcttctatccgtaaagacgagatccgacggctcataacacatctctctagagactccttgcacgtacgtaaccaccttcttatttaactcattatttatcttttatttactttggcattactaaaatttaccaaaaaacaaaatatcaaaaatcaaaatttttatttatcgactattgcggttgaatttgtccatgtgagtaggattttccactttcaagccgcccttctttattatattaacacgcatatttaattatttgtcgcttattggctggaaaataatatatttatcagttaggttacttgtatgcatcaaatttgtcacgacagaaaataaaataaaagctctcagtcgtcatagatggaactgaactatacacctttgatatagatctattaaaaattacacaatgtaataaacttgactagtaatcgtcccactgcagggatttgttgaagtggagttgaaatcgttattaaccaacttggcattcaacaacatcatcatgatggtagccggaaaacgatattacggtaccggtacagaagacaatgatgaagccaagctcgtgagggaacttatagcggagataatggccggcgccggttctggaaatttggctgattatcttccgtccataaattgggtcacaaactttgagaaccagaccaaaatcttggggaatcgactcgatagagtcctgcaaaaactggttgatgagaaacgtgcagagaaagaaaagggtcaaactttgatcgatcatttgctttctttccaagaaaccgaacccgagtactatactgatgtcatcatcaaaggaatcatactggtaagttcttattaactaatattatcctccttatatgtggagtgggtttacttattagagatatatatatacacaggctttggttcttgcggggacagatacatcttcagtgacgttggaatgggcaatgtcaaatttgctgaaccatccagagatacttgagaaagcgagagcggagatcgatgataaaatcggttcagaccggttagttgaagaatcagatattgtaaatctccattatctccaaaacattgtgtcagaaacattacgtttgtatcctgcggttccactactactccctcatttctcatcggatgaatgtaaagtggcgggctacgatatgccacgtcgcacgttgttattaacaaacgtatgggcgatgcatagagatccaggtttatgggaagagccagagaggttcaagccggagaggttcgagaaagaaggagaggctcgaaagctaatgccgtttgggatgggacgacgagcttgtcctggagctgagcttgggaagcggttagtgagccttgctcttgggtgcttgattcagtctttcgagtgggagagagttggtgcagaacttgtggacatgactgaaggcgaagggatcactatgcctaaagctactccgttgcgagctatgtgcaaggcacgtgccattgttggtaaaacgatataattgacgtatgtaggatctattgtgtagaaacctatatagtttcttacattccacgtgttcatggaaaataaaagtattctgtggtcaattagttggatgcagagcaatgtcacggcttctatagaaagttcaacagaaccaaaatttcactgtttccatctctccaatgttggtttcttgaaatttagaattggtttggtgacttggtcatgtagtgggcatgtgttgggcctcgtcaaaatgttgtctttctctgcattttaaattaaatacccattaacaaatctgtatacatatgttcttcactgtctgaactagtaattcagcataagctaaaagtataatattttttttttaataaaaggactgttgttaaaaacgaaaagtttggatttcatgttagtgttggtaccgaatctgccacgttttgatgattatagttgtagaaaatgtcaaccaagcaatattattgtaaagacaataatggatggaaatctaagaatttcgattgaatttttatcttatcgagaactttcaacaaaaccttttggattgatcaaatgaaagagacataagtggttatacattagacttgttcacgacactccaatgtagtatgatttttctgtttgtttgtcaaattcattgtttacttgtcttataggaattttccttattttacaaaaacaaaagaaataaaagaaaagaaaattggtgcttgtttttccaaattagtacgctaattttatcactattgtatgcactattttgttatttgactttgtaaatgcatgaattaaagagtgtttaaaaatcagtatcttatactatattatttaatagcgcacggaggagaaaccaaaatatacacaaagttagagaaaaaaagaagagaaaaggagttatatatg

SEQ ID NO: 17798 - DNA, 3003 bp, Unknown
  misc_feature (1)..( 3003): 2750-1469P.txt file - cDNA_ID_1814056; gDNA_ID_1621088; Annot_ID_55410
tatagagcataatttttaaaaataatatatttccttgaccacatgtatatatctccaaaacaatagtaaaaaaaagagagacgaaaagaaagaaagagagagagccccacaaacaaacaaaatggatttgaaccaaatcttgatcctctcatttctctctctttttaccttagccatattcttgctcacaagatccaaacggaaactaaaccttcctccgtcgccggcgatctccttgccggtgatcggacacctccatctcctcaagccaccgcttcaccgtaccttcctttccctttccaaatccatcggaaatgctccggtcttccatctccgactcggaaatcgcctcgtttatgtcatctcttcacgttccatcgctgaagaatgtttcacaaagaacgatgtcgttctcgcgaaccgccccaagttcaccataagtaagcacctcggctacaacgccacctacttactctcggcatcttacggcgatcattggaggaacctccgccgcatagccgccgtcgagatattctccactcatagactcaattcgtttctgtatattcgtaaggacgagatccgacggctcatttcacatctctctcgtgattccttacacgtatgatctccttcaattctttttatttattatttgttctgtattcattactttatctttggtttgtcaactaacaaatttattatttattcattactcgtgacgactactttcatatagtacatacttttatatttattgtggtgataaattgtccatgtgactagtttatttttttgaagcattgcgtgtatattacgatactagctatttattcacgaaagtctgatcactatattcataaatattacatagtttattcacaaattacaaatgtacagaaaagcttaattttaaatttatagaaaaagatgcagtgtaggttttaattgtcttaagttggttgaataattatttggttcaaaataaacacattgttctaatatgttaaggtggcgaatatggaaatgcacaaatttttacatacttaccaaaactcttatctgtttactaatattgtattcgtactctcagggatttgtggaggtagagatgaaaacattgttaaccaatttggcatccaacaccaccatcagaatgttggccgggaagagatatttcggtgaggacaacgatgacgctaaactcgtgaagaaccttgtgtcggaggcggtgaccagcgccggtgcaggaaaccccattgattatctttccattttacgttgggtctcgagttatgaaaaacgaatcaagaatttgggaaataggtttgatacgtttttgcagaaattagtcgacgaaaaacgtgcggagaaggaaaaaggtgaaactatgatcgatcacttgcttgctctccaagacattcaacctgattactatacggatgtcatcatcaaaggaatcatacttgtaagtatcaatcaataagaaagtttttatatatatatagagagagtttaatgattgaaattttgtttagaccctgataattgcagggacagatacgtcatcagtaacactagaatgggcaatgtcaaatctgttgaaccatccagaaatacttaagaaagcgagaatggaaatcgatgaaaaagtcggtttagaccgattagtagacgaatcggacattgtaaatctctcttatctccaaagcattgtattggaaacactacgtatgtacccggcagtcccactactactacctcatttgtcatcagaagattgtaaagttggaggctacgatataccaagtggaacaatggtattgaccaacgcatgggccatgcatagagatccagaggtatgggaagatcctgagatattcaaaccagaaagatttgaaaaagaaggagaggctgagaagctaatctcatttgggatgggacgaagagcttgtcctggagccgggctagctcatcggctaataaaccaggctcttggaagtttggttcaatgttttgagtgggaaagagttggtgaggattttgtggacatgaccgaagacaaaggagccacattgcccaaagctataccattaagagccatgtgcaaagcacgttctattgttgataaactgatataaatgttttacgttgaaaaatgtattctatttaatgacatgtttttaattatgtgttttggtcttcaattcgtccttcaatcttttgttgtatctttgaatcttgcttaatatcatcgggtcaatgaagctgggcttgctcaccgggttagtgggctggctcttgcgttgttggtccaatgttttattgattgatatattttttaatgtgattgcattatagttaggttaaatatagtgtttttaatgaagttgtaaaatcaataggtcacgttgagtcgttgacccgtattttatacttgacccgtattctccagtaaaacgtgaagaatcgtaaaaaaagaactatcatatagtataaaattcacatcacataaagtcactacagattcgataataaatgcattgagtcttgtgattctatattttctattcatcgcccccaattaagctacgtaataacagggacataaattgtctttttaatagattttttaagtcggcaagtactgtcttttagatatttcggttgtcctatgtagaaggtagatatgtaaagggtagattaaaaaaggaaatttaccttctacatcctatttagtatatttactatactaaaaaaggaaatttacctaactttctcattgaaaattagttattaccttctctttcaaaaagcagatcaaaatctctatccaaccatttccaaaaattcaagtctctttagttttcagtcaattaattttcgtgttttaaaggccacaaagtacccatctggtccatctcgatcccacacacgacacaactttacacaaaaagaaagaaaaacccaaaaacaaaagaagcaatcaacaagaaaatg

SEQ ID NO: 17799 - DNA, 3000 bp, Unknown; identical to SEQ ID NO: 4007
  misc_feature (1)..( 3000): 2750-1469P.txt file - cDNA_ID_1814056; gDNA_ID_2926213; Annot_ID_142073

SEQ ID NO: 17800 - DNA, 3003 bp, Unknown
  misc_feature (1)..( 3003): 2750-1469P.txt file - cDNA_ID_1814064; gDNA_ID_1621089; Annot_ID_55478
tactatggttatgaacatgagttcttgcttttttttttctttccatcgaatatttgttcatttggatgtctaatagtgtaagaaacagaatttcttagctgacctggatactaaattatgttctgaataatgtgtatctaggtgtatatcattgattttgggcttgcaaagaagtatagggatctccaaacacataggcatatcccctataggtgatttatggtgctttcatgttcctgtttatctacttcttttattttgttttaacttaaattcttacagatactcatgttgttttctttgcagagaaaacaagaaccttacgggcacagctcggtatgctagtgtcaacactcacctaggagttggtaagcaatacatagaaccactcgagaatttgctccaaagtcatatatacaattcctaaaatgtgtggatgtttgcatatctgttggcagagcaaagtaggagggatgatctggagtctcttggttacgtactcatgtatttcctgagaggaaggtttgtgcatacagatccgtttttgtctgactaaatctttggacatgtttgttctggtctaacttttctggattttcgggttcagcttaccgtggcagggactaaaagctggcacaaagaagcaaaagtatgacagaattagcgagaagaaagtatcaactcctatagaggtaaagacataatatggcttagataccattgactgaagttagatcagccatctcattgtcacataaatgaagggttaattgttctaccatactttaacaggtcttgtgcaagtcatatccacccgaattcgtatcatactttcaatactgcagatctctgcgattcgaagacaaaccagactactcatatctaaagagacttttccgagacttgtttatccgtgaaggtttgcatttgctctgttttggttattttttccctaagggacttcacagtacagttctgtgttgtgacattttgttataccaatgctttttttttatgcctggaattgctttttatctttgattgccctcactagttactgtcaaattttctagatattgaaatcttccttgatatttctataaatgtttcactcttttaacgaatggattcgcggtatcaggttatcagtttgattatgtattcgactggactgcattgaaacaccctcagagtagtgccaggtcccattccagtacacatgaaagggtgagtacacatgtctgtagatttttctatcgagtatgactatacatactcactttcgtttcgtattgatctcttcttcagcatcgtaccggtaaaccagggatgggtgcgggaccgtctgctgaaaaacctgaaaggatttcaggtaacccttgacttttttctacagttaagaatcatataactcttcttcgctaaacggtggtcggttctgattttgtgatcctgtctatgtcttacagtagggaacatccgcgataaattctcaggtgcggtcgaagcatttgcgagaaggaacgttagaggacccagtccccatcaaaaccataccagacatcgaactcttgacgaaattccttcaatgaaacctgctgtggtaaaaaataatatcatcatcttatatatatcaaaattttgatatattgttattacattatagaacgtgcttagtgattttaacacttttcaagaaatcaatcttgctcgttcttgatatatcaatttatttgatattgtcagaatatggtatctgagaaaggaagaaacacttccagatacggcagtgcttcgaggagagcagtagcctcaggaagtagaccaagctcatcaggtgaacaaagggagagccgggactcgagccgcgtagcctcaagcggtggcggtgtccgaccatcagtcttccaaagaacccaagcagcagctgctgtgagtggatacgagtcaaagacagcatctgcctttaaccgcgaccgagtagccgcttcaagaacagcacgagacgaggctctcagaagcttcgagcttctttcgatccgcaaatgaagccttcatcaattggctctttgctgtaaattggattcttctttacatatgttgtttggtcctttgtttccacgaaactcccaatttttcatgtattatcaaattctctggattttgtatcaatttttacacactttattgtaatcatgacaatttgttgagtttaattcaatgttacagttttaattttgtgttacatatgaatttatacctttaaattcgacgacgtcgtttccaagtgtataacgtgtacgccaactatcgtcgtttgaaaccgtcaagtttaacggcagcctccgtcggtgaccttgtcgtgacgcagggccttttcctcgctccaacatttaaattctctgaatttcgattgatcaatacggagtacgaagcacgaagatcgatttagcattctagttcatgatgttgaatccgacaaggtacaaacttgattgcttaaaggttatgtttttgccggaactgggacaatgtttagattgtattctcataagtctggtacttcctttaaaattggagtttttgtttgttggagaaacttgacttttagctacataagatttttaagggtcaattttgattgttgttagttgttttgatgaatttgtacagggatgatagtctataataggtttgctctgaatctggattgacccagagaaaaaaaagtgaagctttgtatgatttgttgtggatttatgtggaaatccggaggtgaagatttgcaaggtttctatccagttagagaagaatgtgtagcagatgttcccaggactcgatttaaatcaagggtttgtctttttcttagaccatctatgttcttgatcaatcaaatttgtttcaaagtttgagtatttcattttgggatatgatcaggctggtaaaactcttagtgctagaaaatggcacgctgcgtttactggagatggacatttggatatg

SEQ ID NO: 17801 - DNA, 3003 bp, Unknown; identical to SEQ ID NO: 17800
  misc_feature (1)..( 3003): 2750-1469P.txt file - cDNA_ID_1814064; gDNA_ID_2926193; Annot_ID_141134

SEQ ID NO: 17802 - DNA, 3000 bp, Unknown; identical to SEQ ID NO: 6346
  misc_feature (1)..( 3000): 2750-1469P.txt file - cDNA_ID_1814072; gDNA_ID_1621089; Annot_ID_55476

SEQ ID NO: 17803 - DNA, 3000 bp, Unknown; identical to SEQ ID NO: 6346
  misc_feature (1)..( 3000): 2750-1469P.txt file - cDNA_ID_1814072; gDNA_ID_2926193; Annot_ID_141132

SEQ ID NO: 17804 - DNA, 3003 bp, Unknown
  misc_feature (1)..( 3003): 2750-1469P.txt file - cDNA_ID_1814079; gDNA_ID_1621089; Annot_ID_55472
acccttgatggccgtacacttacaatcccgatcacaaatgtgatccatccagagtatgaagaggtggttcctaaagagggaatgccactccagaaagatcagacaaagaaagggaacttaaggatcaagttcaatatcaagtttccagcgagattaactgcggaacagaaagctgggtttaagaagcttattgggtgatgattaaagcatctctgtcttgtgatgtgtggagattgggataaatttggtaatatacaatttatagggaattatctccctcttcattaaatttcgtgttgttaaacaagtcttctttttaaagaatagttttttcaagatttggtacatgtcctccataaacaaaaattgaagatcacaaatctttttgttatacaaaagtttttcagttcttgtctagagtatgaaattattctttggtaaggggagatccgatgccatgacggcgtgtagggaacgctaggaagaaggcaccacaaatgacgccgatgacaaaaggtaaactggtaagaatctccttggtttcctcggaaggaacggggaataaacaacgggttacgttctgatcaaacatggagactgcgaagaagacgagcattgacatgattgcgtgaataaaatcaagaatcttgagcttatacttttccttctcctcctccgttaaagtaatcgatccatccatcactaatagcccactccacgttgccaacccgtacctaacctgcaacattaagtttggtgcttatgtcaacaagttgttatgaatggtacaaaacagcggaaaatgtgacagagatatgtatatataccttgccgtttgggtctctaatggagtcggtaaaggagaagaggaagcaggagatggcgcataaggagacgaggaagcaggtgagccagcgactggtgatggtgggacactgaccttgatgggttaggaccggacacattatttgaaaactcattacagaaccggttgggagcagatttgatagatgagctgttcctttgaatgttttcctcacaactctctctactttcgactttggttttcttggtgccgacggcaacgatgctatcaatgactgcttcgtctcctccatcttcaattgttttttcgttaatcactctgcaaattcgaatgattatatatgtttcttttttttgtctctatggttaattctgatttgaaagaattgcacaagattttatgggtttcgatttctttcttttttggtgtttgcttccgttgagttgtttgttcaggtttcaaggttgatattctgttcttccatttttatgtttctgttgcatgtcaggattagcaataaaaaacgtaaaaaccaaataacatttgagtaacgaaacaagaaataggagttttgtaacagaaaggattaaactaaaactctgtcaccgtttcctaagaagatatatcattatcaaagttacttttattatattgatatagtaaaactttgctaaactagtaaaaactagtttttcgaaaataatctagattagaattctccaaagacgtggcttaattctaatctgtctaacgtatggaccataaagaattgtattaaattggtctttgaacgaatttattcttcggctaaaagaggttatcggttgtgaagtggacctgcaatttcatttgtttgttcataagaatatatgaacgagaacttaggtgacctctatttcatataacttttacatactgcatactggtaaatcatatgaaatatggacttttaaaacgaaacaaaaatcacgtataaccctattagtgtatatagagtctctgttgtgttgagactctgttgtgttgagactctatatacactaataaaccctttttacttctttgttccatacgaattaagcttcagaataacagaatttaagagaatatcgttattaacagcaaaagtccaaaacaattaaaaggcagagtgcttgtggagacgtaaagggaatgcaaactaagaagaagaaaagtcattatcgttagaggaccaaagacttaaacattattggattaaggtgacatcatagtgcatagtgcgttgtaccatcgcgcaaactcgtgatattcgatcacggattaaagccatgatctatcattttctcttctttccccccttaaatctcgttgttttttcaaatcatagtgactgttgcttttcccatcgaaatgaaagtaatctaacaaaatctactgttagatcatgtttctccgaccaaccaaatttgaccttgtctacatatacacgtggcttcacaaatgcgcatcaagcaattggaacttggaagcatcactatagttctaaacttccaattaaaagattgttagtcaatctagggttgggatcataggtggctaagttttcggtttaacaaattttcgagatcatcgatataaaatcataggatatgtcctcatcacaatacagtatacacacacacataagtgattaagttatgcattcataacattaatccagaagctttatatgcagactcgaaaagtcaacataaatccagcattacatggcccatttgtctccatcattttgaccatcatagcatttcagttgacttggagagtgaccattggtccattctgtttcttttcaaatgaacaattaaatgtttgttcatttatcaaaaaaatattttttataaaattaccttatgtaattattcataatccgatttttttttaatatcactttacaaatttgtttatgatttatatgtacagtagtactttgctccgtaatcgatttcacatggatgtatactattgcctcctaattcttccaatatcggaaaacatgtctcacccatgtcttgtcacagtgctcgtttccctttttgcttctacaattccttataattaccaatccataatttcgttttattcacaaatccaaagcatgaaaaaagaagaataacgattccttttccaaaaaaatg

SEQ ID NO: 17805 - DNA, 3003 bp, Unknown; identical to SEQ ID NO: 17804
  misc_feature (1)..( 3003): 2750-1469P.txt file - cDNA_ID_1814079; gDNA_ID_1621089; Annot_ID_170637

SEQ ID NO: 17806 - DNA, 3003 bp, Unknown; identical to SEQ ID NO: 17804
  misc_feature (1)..( 3003): 2750-1469P.txt file - cDNA_ID_1814079; gDNA_ID_2926192; Annot_ID_141128

SEQ ID NO: 17807 - DNA, 3003 bp, Unknown; identical to SEQ ID NO: 17804
  misc_feature (1)..( 3003): 2750-1469P.txt file - cDNA_ID_1814079; gDNA_ID_2926192; Annot_ID_201178

SEQ ID NO: 17808 - DNA, 3003 bp, Unknown
  misc_feature (1)..( 3003): 2750-1469P.txt file - cDNA_ID_1814083; gDNA_ID_1621089; Annot_ID_55471
atatgaagattagaaccatacctgcatgttatcaagaaataatgcaatttgcagcgcgtttggatattctgcaaacttaatgtagatcatgtaagcaatatctagaaccaacatgtcatctggtcctggaagatacctggaaaaaaacatacaatatcaacgggactgataatgtgcaagataaccaagcaaagctcatgagagcttgtctcatatgaaaataacataattaagggtgaaacgccagtcgaatgaataagctaaacatattgaaattactttgctgcactcgtgagatagttgcacgtcctcctgaaatttgtattgtcaacatgctcaagtaagagatcaagatcctcaacatccattaaaaggtcaacagcttcggtttcggcattatgctgcaaagaacaaaagggaatccttcaaaaatgtgaacaaaacaagaggcgcaaatttcacgcctatcaatgaaacttatattaatatacaatggaccccttgttattacaagaaaagtaagaatgacaaggatctcaccttcatgtgaaaagaaacaatttgctgcacaagatccattaagtcttcaatagaggactcttcaccctgatataacaaaaagaatgagcattataaccatattcagtaacgagcccattgtcataatattcattaacaaaccataatatccatgacgttgccagaatatgagtgaaactcctcgagctaaagaacattgccaaagaccaaattgtttactaacctgacgtattgtatactcttttgcaatctctccagccaaattcctgacatactcgtgaccccacgatccgatgtcactctctgatccattcaacctatagtttaagctttcctgaaagagtattgcataacaaaggatcagcaacaaatagcttaagtcaaattctaccaagaaccacaaaacacaaatctggtaaggcatatcataagaggaaaacaaaagggaatctagttaaatgaatgtgaagcaaatagcaataggcaagaaactcctacaacagtagcaagaaagcataccctttcaccttcagcagacatggtcagtgccaggacagaaagtatatcagccaacattttctgcaaaaacgagtgcgatcttataatccagactcagtagaacgactaagacggtgttgatgagaaatgacttaaaatgtttgaaatcgtactttgagatcagactctgccatttttgcatgaaattctttaagaactccataatgagggcggagaaacttgaggggttttggaactgatgtcatggagcttgttgagtcacgaatttccttcctacataccaaaagagatcgatcaagattagactatgaaaacagtgaaagcactaaaagcagcaaaagaagtgtcataagcccattaaagaaactccaatagaaaattatcagaatatttgcatctaatcaaatcaaggatgggtttaagagatacaaaaactacctcatgctttcaagagcaatcttctgtaactcaggattggggtcctgaactctctcaacatagagctccagattctgctttagttgcaagtcctcttcagactacaataacatcatatgcaaattgagtcagctgccaatcaaaccagctaaaaccatagccatagtacaaaagattcctattaatttaactccatgtgacttaaaccctaacaagaattgtatcttcccagaacgagttataatgtggatttaaccaacttcttaacctcgctttctaaatagcaatgcgacattcacaatatatcagctaaaccgtacatctcggaaaatctacagcttaatcgtgagttttttccgatctccctggattctttctaactcagctaagcacgattccaactaataatcgaaatcgatataaagaaaactcaccagatcctcttcctttttatcatctttcttcttggaatccttagaaggaatcttcgtcgtagcttcgtcccgcttcgcaccaccgccaacactgttcggatccggaactggagccattgtaagtcagactatcacctgatcaaatcaacgaatccaaacaatgagtatcgaaattcgtaaaactcggaagaatcgagcagcttctatcttatgagctctcgcgtaaaccctaagtctctctggaatggctcgttagagaagaactatgcttttcttcaggaactgtagcaaaaaggttcaactgtaaaaaataaatactatcagataaaaaaaagtacttatacggaagaagattacccctcgatcaagaattccattgtgggctcagcccataataaattgggctattcattgggccatagtattctactatggtctctatataaaacaccttgtctttggcaaacatctctatatataatcaacactttaaaatttattttatttgggcgatatagccaatcacaaaataaaggactccaaaaacatctattttatcggatttacatttgatcaatttaaattcgaagcaactaattcgatcggatttaaattcgaacaacataataatagcaacatttatataaatacgttacatgtcttagtcgacatgttcttttatggtaaagttagcaatattagtcgaactcaaacatataccttcacataatgaaagaggaaataacatttaattgtttttataattaataatataaatgggagaatctgaattacttgagcgataataaaagaagaaaaggaaaagaaatggagaagggaagaggcaagatggcaaagctgtgatttaaaacaccgtcacctccccgtcaacggagacaaacaaagatcgtgttttctcgaaccttccacgagatatactaagccaaagaagaagaagagacctgagacgaacaagaaatccagaaattaccaattccttttttttgtttaatcgaattcaggaaaagtgaagaaacgaaagagagaagacaaagaagaagaaggtgagatg

SEQ ID NO: 17809 - DNA, 3003 bp, Unknown; identical to SEQ ID NO: 17808
  misc_feature (1)..( 3003): 2750-1469P.txt file - cDNA_ID_1814083; gDNA_ID_1621089; Annot_ID_170635

SEQ ID NO: 17810 - DNA, 3003 bp, Unknown; identical to SEQ ID NO: 17808
  misc_feature (1)..( 3003): 2750-1469P.txt file - cDNA_ID_1814083; gDNA_ID_2926192; Annot_ID_141127

SEQ ID NO: 17811 - DNA, 3003 bp, Unknown; identical to SEQ ID NO: 17808
  misc_feature (1)..( 3003): 2750-1469P.txt file - cDNA_ID_1814083; gDNA_ID_2926192; Annot_ID_201176

SEQ ID NO: 17812 - DNA, 3000 bp, Unknown; identical to SEQ ID NO: 6335
  misc_feature (1)..( 3000): 2750-1469P.txt file - cDNA_ID_1814087; gDNA_ID_1621089; Annot_ID_55470

SEQ ID NO: 17813 - DNA, 3000 bp, Unknown; identical to SEQ ID NO: 6335
  misc_feature (1)..( 3000): 2750-1469P.txt file - cDNA_ID_1814087; gDNA_ID_2926192; Annot_ID_141126

SEQ ID NO: 17814 - DNA, 3000 bp, Unknown; identical to SEQ ID NO: 6334
  misc_feature (1)..( 3000): 2750-1469P.txt file - cDNA_ID_1814093; gDNA_ID_1621089; Annot_ID_55468

SEQ ID NO: 17815 - DNA, 3000 bp, Unknown; identical to SEQ ID NO: 6334
  misc_feature (1)..( 3000): 2750-1469P.txt file - cDNA_ID_1814093; gDNA_ID_2926192; Annot_ID_141124

SEQ ID NO: 17816 - DNA, 3003 bp, Unknown
  misc_feature (1)..( 3003): 2750-1469P.txt file - cDNA_ID_1814105; gDNA_ID_1621089; Annot_ID_55464
agagaatgctataaggaatgcctacagatcaacagatgccgtgatattgcagcagtcccttaagcttggtaaaggcggatcaacagctgtaacgggaattctaattgatggtaaaaagctagttgttgctaatgttggagactccagagcagtgatgtctaagaatggtgttgcgcatcagctatctgtcgatcatgaaccaagcaaggagaaaaaagaaatagagagccgaggtggctttgtgtcaaatattccaggtaaagctacataatttgttctaactagttatgcttttggtcttcttggattaagtattaacgttcctaaaatgttgcaggggatgttccacgagtggatggacagttagcggttgcaagagcatttggagataagagcttaaagttacatctgagctcagaaccggacataacacaccagacaattgatgatcacactgaattcatccttttcgcaagcgatggtatttggaaagtaagtttaatgactcagtatcttactctgtttctaaccgtggtttagccagtttctggtctacttcttctaacatgatggacgatctttaactgcaggtattatcaaaccaagaagcggttgatgctatcaagagtatcaaagatcctcatgcagctgcaaagcacttgatagaggaagctatatctaggaagagcaaagatgacatctcatgtatcgttgtaaagttccactaatcttctcttcttcttatcaaaagctattttgtctataagttaccatcaagttgcaagatagagaaatatatgctcaagctgtgtctgtaaaaacccagtaatgaggtttcccagaagatgtaatatattatcgaaatcgcaacagccttaagatacaaaagaaagaactgaaattaaaaaaatgaaataaaacaaatcgcaacagccttaagatacaaaagaaagatgttcttcgtagttgttgtcatcttcgaatctcctcttctctgcagaaatagaaaaacaaaggacaaagtatattgtcagctttaacatacaagcaaaaaaattgtggtggatcaaaggaattaatggaacttacaagcgcatgtgtggtctctagacatggggaagtcagaactgaaatgacactggtcggaaagagccaaaacgtctggcttgagtgattcgatggatgtggtcagaaactccatacaccggcaaagcctgcgcctctccttcccatgcttacggcggcactgaaccaacggcaacactctgcggtgggcggagactcctgatggacgaagaacatcttgcactgttctagcatcacgttcgccacgtctacacactccggtggccaaggacggtacactgcgtcggtagttgtggctgcaacaagaagacacatcattgcaaacgctactttcatcatcatcctagccaaaatgtagcaattgttgttgttttgtttttgtgttggtcttattttatctctacctaacgtaatcgtgacactatcttaacagaaaattcaacttagtaacgcatgcgagattttaatgctttcggccgcgtgggaactatctaaaatttaaatataggcgtttctcgtatttgaaattttaaatggaccattaatggccatgttagtgtatgtgtgtggtgaaattgcgaactacatacagataacaaaaaaaaaagaaaaaaaatctaactttcttacatatgttagttttggaaatgcgtaagaccatatatcacaaacttgaacaattgtgttttatgtataaaaaaaaaacatgaataaatgtgttattctaaactcccatttccaagacgattaaagaaaattgggttttcaatatcgaattttatgttaagttatgaaggatttaaataagttttagagtattttaattagtactgtatctgtatgtaagtaaaactacaattaaaactttgagaaaaaaaaatcaattatacagaaaaaaaaacattcagaatacgttagaagtgggaacctcaatgttactcgtaaccttaaatggtcaccgaccattgcgcggatctagttgtttttatcgtggacgtcaaaaaacccttttttaaaattacctctctaatcttttgacgggaactacacttcgttccaatggccattgttttctcttaatttttgtttaggctaaacaacaacttcaaactgacctcaaatatctgttacaaaagttctgaatccacagaggatttaacttaactaggcgggatagaatataatttaggatcatagttaacaaatgaaagagacacctttgtctttctatccgaaagctcatttaaacctcggtatatatgtaaacattactttgacctccttcacaatgttgagcagattacgtgtgttttgaaggattggttttagggctggccattcttcatctgcatttagcatcgttacaaagctcattggaattcgaggatgactttttgtgttgaagttggctacggttcccacttgccttttttctctcttattaaattgcccattcacgaggtattgtagttttttttgtttttaacaataattttaaaagactctttataaaaagaaagaataactaaaagacaactataaaattagacacctctcgtgaatgcctgaatgacccatttcgtattgatcaataacatgaagatataaagacgtaccaataatcatgtatattttacggattaatctgtgcttatatatatctaagtgataatctaatttatgtttgtgcttgtcgctagtggcttatgggtagcatttaagtatgggttagtgcttgtctgagttgtgtctatgaactcgagtgatcgagcgcacattccaaactgaacacacaaaaaaagcaaaaaaaacatctaatttatgtttcatgcttatatatatgattccactttcacaaaagaataagcacacaaaagaaaaaacaaaccaagaggaagaagttcactcggagcaatg

SEQ ID NO: 17817 - DNA, 3003 bp, Unknown; identical to SEQ ID NO: 17816
  misc_feature (1)..( 3003): 2750-1469P.txt file - cDNA_ID_1814105; gDNA_ID_2926192; Annot_ID_141120

SEQ ID NO: 17818 - DNA, 3003 bp, Unknown
  misc_feature (1)..( 3003): 2750-1469P.txt file - cDNA_ID_1814115; gDNA_ID_1621089; Annot_ID_55460
ttcggtgtaccggtttaatatattgattaaagttaaattgttcaaaccattcttatatgtacaaaaagtgtataagatctatttatatgtttcaacaagattttagtttgtgtggagaagttttattgcatgagctatgtgaactctacatattcgtcgtatatattcatattagtgtgatcataattaaaacacaaaataaaaacattcgcatctaatcaatacaaaaaaacatcttaaatattttctttagtaagaacaaaaacgagacagcggaaacattaaaaatgggttacaagatgcttcaaacatacaaataaaaaggcacataaatatgaaactcaatggtagagtaattaataccctcacaaatttaatgactagcgacaatatataaacccctcaaaacagagaacttatcataatcacaagaaccaccatccccggaccaaccaaaccggccgaattgggagctgtagccggtcctggagctggaacacgagagtttgaatcagatgatggttccactcctggagaaggccccggcgaagacaactcctgatggaccggagacggggagggagaggtatgacgaggagagtggctgtggtggacggtggacaagaccttgacggctagcttctgacctttaagacagttttgagagttgccactaatgaaaaagtaggaacctgagtggctaagtaggaagagagagtctccgtctgagagggaagtcagggggtgtgtcgtgttgcatgtgttgtactcttgttcagtcacctccaacactgaatcttttcccttggcgtacttaaaatcttgtaaaaatcaaaattactatgcattaatattgacacattgtgtatatatagtagagaagaggaaatagacttacgaagagtgtcgttgacttgaaaccggtttcggtgagaccaatgagaataatcttcggaaggagtcgggacccaaccatctttcccaccaacatagaacttgtatccatttgatatcgtaaaccctaaacccatcaacatcacaaacataaggtaaagatcaaacctcatgaccaaacccatctccgatgcaaaacgttaatcaaaccccaacttcttactaactcttttgaagtgagtgtgtgtgtgtgtgtgtgtttgcaacctcaagaggtgcttatttatggtgaaagtaaagaaaacatagccgttaggtcaagctttttgggctgtgcatcgattacctaaagaaatgcgaattaagtagaagcgttttggttttgctcctgtcttcttttgaacacgtctcgacatgcagtggacttaacggctatctacctttaatttttcactttctttctcacaaacaaacatttctcactcagatcttgtaattatttagccatcaaatataaaattgtaatcctttagtatttattattatttaaaacttacgttacatattgttttattttatatttcaatttacaaatcgataaatatcccagtgatacaataataaaattttagtgggcctttcaaatggattgggtatgttgtaagaaaggctttgcagtttcttctcctctacctttaaagcccaactattagtagaagactgaatcctttttgattgtcttgtagtttacacaatgtacacaatctttctcctaattttatactctttctcctctacttttaaaacatcaactactgtagttggacaatattagaaattgtttactttctataatgaggatttagtgggggtgaaggatctaattaaatatttgatgatcgttcctaaactgtgagatcgaaatatacaaatttctacttatgttttagtccaaaaaaaaacgtaatagattggtacaaatcctttttgaggaaaaaagaagttttaaggcgtaaagaaaagacctgagaatatgaaacctcaactaactaatttatcaattgaaccttccttcgtttataacagaaaaagctaataaataaaaataaaaataaaaatcagagagaccaaaaagaagtttcgacttgttcaacaattgagttattgaagaatacgtttgattgagaagcttcaacgaccgcaattgcccaaattcatcaattggagttttttataaaacaaattgcatcttaaggttgttattgttgttgttgtttatctgtctgtaatcatctttctatctgctgtctgatacatctacgaatcttatgctgtcttttgggttttcttacacaaccaaaaccaaagcctagttttgttttgacttcatttgaagcaaacctctttctttcttcagttatgtgggtttttgagctagactcgaatcagttctgatccagtcggattttgtattgagtcataaagaagggatttttgggggttgtgagtgatatgaagaagcgggaacatttgggattagggttcttcgagtggcagattatcttatggttatcgatttggttggcgatttcgcaacaagcgctgggattgagacctattagggagaaacctcgatcatggagtgacgaggtatgtgtgtgtgtttttactttattgatgattgttcgaaagtttcttcatttcgatgtttcccagaaacatatttttatgttttgttcgtaattttgatgtgcctttccaactaagaattcgagcagtttgctgtcaaatgttttttttattgacttgtttctgctcatgatttgctgaacgagaactggtcataattgatgattttttttctaagtctgagattttctgagtttcgaagaaaatggaccatattgaatgaaaatcccggagtagagcagctctgatctaagttttatcttttgatttgattgagcaaagctgaaaatgtatataaactatttacattagctcgattgagctcatcggtatctaagctttgttctgccggcgaatactttgagatgaataagaatgaatctgtcgttagtagtgtggtgtgatgagactacaataatg

SEQ ID NO: 17819 - DNA, 3003 bp, Unknown; identical to SEQ ID NO: 17818
  misc_feature (1)..( 3003): 2750-1469P.txt file - cDNA_ID_1814115; gDNA_ID_2926192; Annot_ID_141116

SEQ ID NO: 17820 - DNA, 3000 bp, Unknown; identical to SEQ ID NO: 6330
  misc_feature (1)..( 3000): 2750-1469P.txt file - cDNA_ID_1814119; gDNA_ID_1621089; Annot_ID_55459

SEQ ID NO: 17821 - DNA, 3000 bp, Unknown; identical to SEQ ID NO: 6330
  misc_feature (1)..( 3000): 2750-1469P.txt file - cDNA_ID_1814119; gDNA_ID_2926192; Annot_ID_141115

SEQ ID NO: 17822 - DNA, 3003 bp, Unknown
  misc_feature (1)..( 3003): 2750-1469P.txt file - cDNA_ID_1814123; gDNA_ID_1621089; Annot_ID_55458
ttatatagtatatctaaaggggaaacattcaagcagaccaattattcttttgaactaccaaccaatgtcattcaataatatctgaagacaaagcaaaccaattcaaagtaacaatacttaaagatgtttgagaattatactcaattactcattgtggatcaagagcattggagtatctttttgtcaaatatgcatcattattactttgaaaactatgcattgacttagattgagtaccttcttacacttgttattaatgttgtattctgaagaattggtgcaactcatcacctatgaagcttttttacttacccaacttcagcttggaccatacctaatcacatgcacttactccttacacaatttttcttcttcttcgtcgtcacattcacaatatatctgtttcacaattactaggctatcatcatcgtactctagtatttggcatctcacatagtttaaatatatttatatcaagtattcagctgatagaaagttataagttagatactgtatttaacgttttcactaaaacagaaaatgagccattgatggtaatcagtaaagcccaaatgggccttcaaacccatattatagttgaggtttcagaagctcttccacggaagagacagagaatgaccgacaaacagagagacgaccaaaagaagaatctgtgttctctctcaaagaaataaacaaaagaaatgtcaataacttcacgtgtcggtattgtgacgtggaagcattcgttttgacatcatcagagaacacatcaatccaacaaagaagatcgatattttcagattcaagaaatcaaatcttgttaaactaaaggacaaataatgaagaaagatttcaatatatacacactttttttttggtatcaatgttaagtttaaaaaaaagaagacgcaaacatgcaaagaagggaatcgaactcaacacccaaaacttgcatggggtgttgtactattttacaacatataccataagataagatgtcaatatattagttatgaatgttttcgttaatgacaaaatgcaaaaactgaatcaagaagatgaagagtaataagagttaaagaagacaaagtaagcaataacagcacaaagaagagccacaaagtttccttctttaagaagaaccttaaacacataaccagcaatttctttcgtcactttccttccttcaatcaccactttcttcctcgactttacggggaacgctattgtcaccactaccgatatccagatcacaacgatcgctggcacagcgatgaacagagctgccgccatagatagaactccgaacaccgcaccaagaagaaccgacgcgtaaatagcaggcaaaccagatgatgtctgatgattctctccgtaccaattcactatcgaattcaacgaatttcttgaagaagacaaaaggaccgcgtagactacaagaaacagacagacccatgttctcctcttgcttatgactctcaaaaacagcttgtacgaggtcatcgtctcttgttcttccttatccgccatatttgagaacaccagattttcttatgattctgtgttggaattgaaactttgattaaacctgaaaaagagaaaagcttcaagtgggaagaagatgaagaaaagagaagaaccaaaagcaaagcaaaaggagaagaagaagttgtcgaagaagaagagtcaacagaagagatgagaaagtcaaagatgaggctattgggctagagtgaagcccacatagtaaattagtaattgtgtgttttggttagtaaatgggctattattagagttgagcccagattttgtgcatatggtgtgcttataattaagctaagctagagtagctaaagagtagttgttaagaggagttgtggtgtaaggtttagtagtttaacgttacttgtggttttagtctagtccttaggaataatcatgtctaagtgggagtagttttaaagctagaatgttaagtgtgtgaatgtgtatcttgtggtgaaataccactataagtatgtgtattgtgtcttgtagagttatccttgtgatccattagtacaatgtagacaactaaaagaaaaaaaagaaaaaatcgtttcttgtgtttctctctaaacaataacaaaaacagagagtgtaacaatgagagagagacataaagaatgagagttctaacctagtgtaaaagggaggtaacattcggtgtctggtttggtaaagttatggtaaatagtaaaacaatatttgcaatgttgcacactgtcaacatctcccaaacgcaccgtttcataaaccaaagtgattagtgattgattagtaatacttgcactgttgcacatagtaataagagaatatcaacttcaatgtttttgaattgaacaatgaacctaccaaaaaagtagttactgttaggcatttgacatgatgattttaggattaatatatactaggtcctattaatactatgatgcttacaggtgacgaataatttgagttatgtgcgatatgtttgaaagaattaaagaggagaatcaagaagaagatgaatatttgacatttcaaagctgacttttttgacgaataagttcatcattattcacacctataaatgtggacagcgaaataccaagtccaacaatttcacgattaattccaagtggcttggatcaagaaatatacaaaaacaaaattccaaatgcttaggaaaataaataaacgagagatcaaattatcacggcggatattatttcgtccacatttgttgttcaaacagatttctaacacatataattagcatatatacattaaacaacattatctccttaataattttgactctggaacagatctttccagtttcagacaatatatttgaacaatcggttcgttgaatcgagaacaaaccaatcaaatctcttttgacaaagctcttcttcttcttcccataaaacttcacaacggcacacgtctacgaaaaaacctctctcagtcatcatg

SEQ ID NO: 17823 - DNA, 3003 bp, Unknown; identical to SEQ ID NO: 17822
  misc_feature (1)..( 3003): 2750-1469P.txt file - cDNA_ID_1814123; gDNA_ID_1621089; Annot_ID_170618

SEQ ID NO: 17824 - DNA, 3003 bp, Unknown; identical to SEQ ID NO: 17822
  misc_feature (1)..( 3003): 2750-1469P.txt file - cDNA_ID_1814123; gDNA_ID_2926192; Annot_ID_141114

SEQ ID NO: 17825 - DNA, 3003 bp, Unknown; identical to SEQ ID NO: 17822
  misc_feature (1)..( 3003): 2750-1469P.txt file - cDNA_ID_1814123; gDNA_ID_2926192; Annot_ID_201159

SEQ ID NO: 17826 - DNA, 3000 bp, Unknown; identical to SEQ ID NO: 6358
  misc_feature (1)..( 3000): 2750-1469P.txt file - cDNA_ID_1814140; gDNA_ID_1621090; Annot_ID_55495

SEQ ID NO: 17827 - DNA, 3000 bp, Unknown; identical to SEQ ID NO: 6358
  misc_feature (1)..( 3000): 2750-1469P.txt file - cDNA_ID_1814140; gDNA_ID_1621090; Annot_ID_170679

SEQ ID NO: 17828 - DNA, 3000 bp, Unknown; identical to SEQ ID NO: 6362
  misc_feature (1)..( 3000): 2750-1469P.txt file - cDNA_ID_1814162; gDNA_ID_1621090; Annot_ID_55488

SEQ ID NO: 17829 - DNA, 3003 bp, Unknown
  misc_feature (1)..( 3003): 2750-1469P.txt file - cDNA_ID_1814174; gDNA_ID_1621090; Annot_ID_55484
ttcttttgaagtcaaatcccgagcttttgttcagttctgggtcatcaccgcggttttggatgaatcaaccagttcctggttcgagtatttacgatcgagtcaatggctctatgagcgaggccctgaagtctgttgttgtcaaggaaagtgaaagactctatggagaagaattagcagtaactgttcttgttactggtaatgtggagaaattgaataggttagatgttgggaacaattgggattttctagatgtgtggttgcatataggtgcatactcgcctttaggcccgttaggtgttggagaaaatgccgcgagtttggctttggttggtcgtggacgagatgtagctgctgctaaatactcagactgggttaggtattgtgcttgttgtgctcatttagctgattcttgaggatactgatagctcaatttttcagggatttagcttgtggattacttgagttttgttgtttctttcttaatctcggtatggtttatgatttaggcaggcttaggaagcctctggagaagtttagacctcctttgaccactgaacttcttttgtcaaacgatggtgatcatttgcttgagggctgcatcacaaactttttcgtagtttgccgcagggtactaacaaaaatttgatttttttttgttcaagcacaagtcacctatgttgtgattaggatgtttattgtcttcatttatgttgcattttagaagtttgaatttcattttaccactgcatgatttactgtttgatctcattttaggtgaagtcatcagagaatctctacggcgggagtttgagcgagtttgaggtgcagaccgcgcctataactgatggtgtgctagcaggagttataagagaccttgtcatcgagtaatatgttagaccattaagaatgttgattatattcgtctgtgtttatggcctgatcaaccaataagatttgcttttctgtcagagtgtgtttaagcgaggggattccataccgcgagagagcaccttcgtggtctgagcgtgagctttgggaagaagccttcattacaagtagatctttccatatccataatctgttttttcatcttctcgcatatatattggcctgaacactttcaatgtgttgtgtgatgtttgtatattttaacatcccaagaactcactgggttcaggtagtctgaggattttgcagcatgtagggacgatcaaagtacccgttggttcaatggagggattggcttgtaacaaacctgaggagattcaatggaaggagaaaaggtttaaggaaagacctgggatgatcactgaattaatcaaggtaaagcttgttacttttattacccttagaatcattggttttgttcttgtcttttgagtcaaatcaaagatagaaatcactttaaagtttttgtttgtcactgttatgttggagtagaaagcgataatggagagaggtattaaagaagggttcccgttgaaggccttttagtgctcttcatgattttgccaaatagctgaaatgttgattcgtctatggtttgtaattgtattgacgccaatatcttcccaaatcatcactcattataattttaacgatctgatgtttaaaaggttctcagttatatatatctgtataattgatcagtagaacatattatttaacggattttatggagatactccggtaacttattaaacagatctcatgaaagtaatcagtgtcaagaaatgtcaagactgtatacatatgttaatatgctaaaccacaacgactatcacttcccaaaacatggttatgatgttgatatgaccctccaaatccacaagtgtgtatgtgtatcaacgtcaaagtattgaatataaagagttgtgagtactaaaaataaaagcaaactaaaaatatagtccgtatggaatgcctttaaaactgcttgtagtggaggaaaatagaaatttggaggacaccaaattttccccctttttttttcttttttttttctagtaaatcaaattaattaatatcataaaaaagattagatgatatataagcatcttttttttttccgtaaatcaaattaattgatattataaaaaagataatggggtgattgacatcgcattgtcaagactttaaaactatttaacaaatgataaatcacattaattgacaccatgtatgttttggatatgtttgataaaaatagtttactagtgaaaaaaaaaatatgatccacacccgagggagtagatttaatttttttttttcttcagaaaatcagctatacattaattatgtattctgacttaataattggtcgggtttgcaaatcttttatttttttggtaaacatgtgaagaaaaaaatagaaggtttgtaaatctttcaatattgtttgtacattttccataaatctttcaatattgtttgtgcttcatcaacatatagtcaacacaaacaatgctacgctcttatgaggttctgcaatatgagtagcttggacgaggtttctgatcaatagatctgttataatattataaaacatatcgattctaacagattttcaatggatatataatccgataactttttagacacatctgatgagtgatcactgtaaaaaaaaatacaaaaaaatcaaaaccatgtgtatatatgctaaactacaaatataaaattaccacacttgtacaatatataataaaaataaacatcataatactaataattacgacactattggtcttggtttggtttatatgcacgactccggctttaaacaataaatccaggagcatgacacttccacgtccttggctagatctaagtttaagtcaacgatgactcatagtggacacgtgtcactcgttcattcgagttatccacgtgacttcttattacagtcttcttgactctttttttttttttttttttttgctgaaaattataaaaacccaaaatccaacaaactttgattacacacacttacatacaacaatg

SEQ ID NO: 17830 - DNA, 3003 bp, Unknown
  misc_feature (1)..( 3003): 2750-1469P.txt file - cDNA_ID_1814178; gDNA_ID_1621090; Annot_ID_55483
tggtttgaattcgttctatgttttataaaattgacaaaaacagaaggcccttcttagtttctttacagaaagtctatagagtctccctctttcatgaataacaacatttatactacaaccgtgcaaaatgaaaagtgcacaccttaagcagtcatattatcggggtctcacgaaaagccaaagctaagtcatcagtcaataatgtggtctggttttggcagactacaaacttgctgcacgtacaggttggaggtttccgacttgcccactaactagaatatcaaatgtagcaccatcgggtaaaatacccttgtcaagcatctcatcgtgaagtctaaaagcctcatcgagatttccttctctataatgtccggcaatcaccgcgttgtagataaggacattcggagtgacattattcttcttcatctcctcaaacatcttaaccacttttacaaactgccccttcttgctaagaccgtttacaattactgtgtaaatgatttcatcagggacaagacccaccgcctgcatttctgtgtacaactcagaggccaggatcaaatttccatctttcaacaatccatcaatcagtgttgtatatgtacccagatcacatcgtagaccgtctttcaacattttcttgtacaaatcaagggctgctaccatgtttcccagattacgaaatccagaaatcaagctgttgtatataggttggcttggattcaatccttcttcaaggagttcagagaacagagcagatgcgctttccatgttactccttttgcagaacccatcgataagagcaccataggctggaatatcgagtttgacacctttgttcttcatttcgtctctcatttccaatgcttgatccattctgttatttttgcataacccattcatcaagctggtataagttatgacgtttggagaaataccattgccacacatctcttcgtatgctgcaaccgcagaatccatttcaccctctttgaaaaatccatctataatgctattgtaactcatgcaactaacacataaccgtttttcttcgatcatatttgccaacaattctcttgctttggatgtctgaccaactttgcataaaccattgataattgtttggtatacaaccccgttgacttcaatattggaagaagtcatatgattgacgacttccaaagcgttttgttcatcatgattcctgaaacatccatcaatcagaatggaatacgtgtagttattcggctttagacccttttccagtatatttgaaaaaacaatacgagccaagtccatgtttttctgtctgcagtggccaagcatcacgttattgtaagaaactacattcggtccaatacctctactttccatcttgcttaataactctgtagcttcgtctgtcttaccttgcttgcataaccaggataatatagtgttacatacaaacacgtttgcaagaccggtttcaaaagactcgtcaaagagtttcagtgcctcttcatgtttctgacctttcaaccacccttgaattatcgtgtggacatgaaagacagaaggagtaagacctaagacttccattttcttgtaaaattcaagcgccttttccatttccccgttcttacgaaaccattctatcagaaccgaaaaagtaacgctgttcggagaggggccttccttttccatcttatcaaacaaaaccaaagcactaaccaagtcattgttcttgcagtgtcccgtgatcagactcgtcgcagcaactacattcatcgatatcccatcactcaacatctcatccttcaatctaattgcatcatccatattaccttgcttcacagaagccaaaatcacagaagtataagtttcctgcgacgggacacacaacttcttctccttcatctctctcaataaactattagccatagccaaatcaagcgtcttgcaacaagcctgaacagcaagactatacagtaaactatccggttctgctcctctctcaatagctctacttaaaacctccaaagcctccgcaggcttttcttctctcaaactagctctcattaacaattgcgttgttacattatcaccatcaacaccaatggcaaccatcctactgtagagttccttagcttcagttaacgaattcctttgaactaaagcactcaaggtcctattcacatatggaaaaaatggaatcacatctagttccaacatctggttgacgatatccaccgcatgatccgtttgcctatctttagaataagcattcaataagtaattaaaagctcgtgaattgacttcaaacccaaatgatttcgccgaatccaccaatttactgaccaaaacacttgccattggagttggattgctcgtagaaacgtaccgtatgagcaaatcacttgcacgtccataggtctcaggagaactgaccagaatatgaatgagtacccagaagacgtcaccatcttcaaaacttccacgccatggtctagcccaattatagaaacgaagagcagcttctgggttgttcctgcgattgagaagaacatcgattacagatgcatcgtccttctgttcaggcttcgcagacaaaagactcactttggaggtaactgggttttcttcagaagtggatccgtaaactagtagtctctgctcttgacttggattctcagattctttgggaaactgagactgtgaacaaaagggtttattgtttctcaagttacgaagacgaatccgtgaagggatttttctaaaaaccaataaagatctcatctttcgaggttcttctctcaactatcttcagcagagaaaagatgatcggagaaataaataaaagagacaacttgaaatcccgaagatacaccaaaaaaaaaaaaaaagaagcttaaaccctaattatgtctattaaacggcgtcgttttggggattattcctttttaaaaacgttctcttttcccgttttatctaatttcctcaaggaagagagaagcaaaaatg

SEQ ID NO: 17831 - DNA, 3000 bp, Unknown
  misc_feature (1)..( 3000): 2750-1469P.txt file - cDNA_ID_1814194; gDNA_ID_1621091; Annot_ID_55527
tttgtgacaaccgaaatagtgtcaagaacttcatatcactcggtggattactttatttgattgaatcttagttgataacgaaatcctttctttttctatgtatttcgattattaatgtaatcagaaaattttaagtattttttcacgttatccaactttgagagtactgtccttgtgttggccaataagtggttgaatatatggtaaaagtataaaagctcccatcatgttggacctactagctttgctatatataaaatgtcctgtcattgcataacgtaccactttctgaatctgttttacgtgcctatcaatgatttgtctttaacacttaccgtaatattctacaattaagttcaagtgcctagattttctaaatgtgtataaagacattatatatggcaaatgatcctttagataaccatttcatttaaatcaagcattcgattcgcattcatagataaaatactattcaccggtccagttctaactagccatccagtctggttagaaagcaaaattgtttattttattttaggttcagttttcagatcggttttctaacactgttttggtttggttctcgtatcggttcaaccggattggatagtcataaagaatttgaagtccttaattaagcccaaaacaagtagagcccatatatatactaacaaagccgtgattagggtttttggttttcgtcagaagatttcaaggtttagggtttctgcaattcaaccatggcagagcaggtttggatctacattacattgtctttatgttataattggggattgctagttgttggattctcgttttctgggttctttgattttggcttttaatgatggattggtgtgtttgcagacggagaaggcgtttcttaagcaaccaaaagttttcttaaggtaattgtcacacctcaaaaattcaactgctttgtattttggctatggtctctttatgcttatgattcaaatgttctatcagctcgaagaaatctggtaagggaaagaggcctggtaaaggaggtaatcgtttctggaagaacattggccttggtttcaaaactccaagagaggctattgaaggtactgtttttatgtctcagctctcaattttgctttaccatgtctagaagaagcttcatttgttaaaaaagttggattctttagagaacttagaggattttggtttagtgtctctaatttggttgttgagacattttctgagtaatctgattttagagtaatgccgctttgttagtattctcattgatctaagacttgggtagtagattggtggtatttgcccaattttaggagctttggggaaattgtttgacatagctatgtttttcttgattttatttgcaggaacatacattgaccagaaatgtccctttactggtacggtttcaatcaggggtcgcatcttgtctggaacttgtcacagtgcaaagatgcagaggacgatcattgttcgtagggactatcttcattttgtgaagaagtatcgaaggtaaaaggatcggttttgttattgtgttcaaattctctcagcttatttgaaaccctccagctaaatgcttaatcctaccagatatgagaaaagacactcaaacattcctgctcatgtttccccgtgcttccgtgtcaaagaaggagatcgtgttaccattgggcaatgcaggttaggagcactaatatctatatacttggtttttcgttcaaaggaattcatgctattgtataatactgcctgaactttgataccatctttatttatcacgcaagtttctaaacttatcaagttaacgattcaggccattgtcaaagacggtgaggttcaatgtcctgaaggtcattccggctggaagctcttctatcgggaaaaaagcattcactggaatgtaaaagagattcagatttgttgaaaaggtgcgaactagtattctaagagtttagaatttttctagcagagttattggattcgtttcttaagatctatgatcaaaggaaaccagattttctgtttcatttagtgattcaagtatcaagatatgtctatggttatagttttactccaatatatctagtcatgagttgctatctactagtcatgatttcgatgaaaagtggaattatgcttttgctatcttgatatttatctttgtctaatcgatatttcttgcttccattacattaatttctgaaaatgatatttaagagaaaacaatacagaagttgcataactccagggaatgctatgaacgtgcagcctcattctatgccatacatttatataaaagctccgattgcaccccttaagcttattaagtcatcttcaaaattagaaaaagaggtgcctaagtcatggcgaaaattagtcgaatgaaaacgacacaaaagattcttcatgtataatatacaaaaatatgaccccgtatttcacatggtatagttttttattacatcacttttccaaacgtaaagttaattaaacgttgagaaatgtgatgttgcttggtaacagctcaattctcgaaaacacgtgaaacctggcgcacttgcttctgtttcacatttgcatacaatttcaaccactaacacgcaaccatctccaaacgcagggccacgtttatctgcgtttgcgttaccaaagtcaatgattgacaaacaaacaaactaacactccaaccaatgacgagttttagataaggtattcgtgattttatacaatgcatcaaacagaaatcgaaccaaacacctccttaagttgtttcacggttcgaccaaccgcatcgaacgccaaattaacgagaagaggttgttgttagttgaggaccacgcacgatgggtgaaataaaaaagtccgaatcttttgggttcgttgagtagcttctgacgtcatttcgcacattctaattctaatattcagtctttaaagtcttaaaggatcttcattgtactttgaagtatagtttctgtaacaacaatg

SEQ ID NO: 17832 - DNA, 3003 bp, Unknown
  misc_feature (1)..( 3003): 2750-1469P.txt file - cDNA_ID_1814194; gDNA_ID_2926198; Annot_ID_141394
ttgtttgtgacaaccgaaatagtgtcaagaacttcatatcactcggtggattactttatttgattgaatcttagttgataacgaaatcctttctttttctatgtatttcgattattaatgtaatcagaaaattttaagtattttttcacgttatccaactttgagagtactgtccttgtgttggccaataagtggttgaatatatggtaaaagtataaaagctcccatcatgttggacctactagctttgctatatataaaatgtcctgtcattgcataacgtaccactttctgaatctgttttacgtgcctatcaatgatttgtctttaacacttaccgtaatattctacaattaagttcaagtgcctagattttctaaatgtgtataaagacattatatatggcaaatgatcctttagataaccatttcatttaaatcaagcattcgattcgcattcatagataaaatactattcaccggtccagttctaactagccatccagtctggttagaaagcaaaattgtttattttattttaggttcagttttcagatcggttttctaacactgttttggtttggttctcgtatcggttcaaccggattggatagtcataaagaatttgaagtccttaattaagcccaaaacaagtagagcccatatatatactaacaaagccgtgattagggtttttggttttcgtcagaagatttcaaggtttagggtttctgcaattcaaccatggcagagcaggtttggatctacattacattgtctttatgttataattggggattgctagttgttggattctcgttttctgggttctttgattttggcttttaatgatggattggtgtgtttgcagacggagaaggcgtttcttaagcaaccaaaagttttcttaaggtaattgtcacacctcaaaaattcaactgctttgtattttggctatggtctctttatgcttatgattcaaatgttctatcagctcgaagaaatctggtaagggaaagaggcctggtaaaggaggtaatcgtttctggaagaacattggccttggtttcaaaactccaagagaggctattgaaggtactgtttttatgtctcagctctcaattttgctttaccatgtctagaagaagcttcatttgttaaaaaagttggattctttagagaacttagaggattttggtttagtgtctctaatttggttgttgagacattttctgagtaatctgattttagagtaatgccgctttgttagtattctcattgatctaagacttgggtagtagattggtggtatttgcccaattttaggagctttggggaaattgtttgacatagctatgtttttcttgattttatttgcaggaacatacattgaccagaaatgtccctttactggtacggtttcaatcaggggtcgcatcttgtctggaacttgtcacagtgcaaagatgcagaggacgatcattgttcgtagggactatcttcattttgtgaagaagtatcgaaggtaaaaggatcggttttgttattgtgttcaaattctctcagcttatttgaaaccctccagctaaatgcttaatcctaccagatatgagaaaagacactcaaacattcctgctcatgtttccccgtgcttccgtgtcaaagaaggagatcgtgttaccattgggcaatgcaggttaggagcactaatatctatatacttggtttttcgttcaaaggaattcatgctattgtataatactgcctgaactttgataccatctttatttatcacgcaagtttctaaacttatcaagttaacgattcaggccattgtcaaagacggtgaggttcaatgtcctgaaggtcattccggctggaagctcttctatcgggaaaaaagcattcactggaatgtaaaagagattcagatttgttgaaaaggtgcgaactagtattctaagagtttagaatttttctagcagagttattggattcgtttcttaagatctatgatcaaaggaaaccagattttctgtttcatttagtgattcaagtatcaagatatgtctatggttatagttttactccaatatatctagtcatgagttgctatctactagtcatgatttcgatgaaaagtggaattatgcttttgctatcttgatatttatctttgtctaatcgatatttcttgcttccattacattaatttctgaaaatgatatttaagagaaaacaatacagaagttgcataactccagggaatgctatgaacgtgcagcctcattctatgccatacatttatataaaagctccgattgcaccccttaagcttattaagtcatcttcaaaattagaaaaagaggtgcctaagtcatggcgaaaattagtcgaatgaaaacgacacaaaagattcttcatgtataatatacaaaaatatgaccccgtatttcacatggtatagttttttattacatcacttttccaaacgtaaagttaattaaacgttgagaaatgtgatgttgcttggtaacagctcaattctcgaaaacacgtgaaacctggcgcacttgcttctgtttcacatttgcatacaatttcaaccactaacacgcaaccatctccaaacgcagggccacgtttatctgcgtttgcgttaccaaagtcaatgattgacaaacaaacaaactaacactccaaccaatgacgagttttagataaggtattcgtgattttatacaatgcatcaaacagaaatcgaaccaaacacctccttaagttgtttcacggttcgaccaaccgcatcgaacgccaaattaacgagaagaggttgttgttagttgaggaccacgcacgatgggtgaaataaaaaagtccgaatcttttgggttcgttgagtagcttctgacgtcatttcgcacattctaattctaatattcagtctttaaagtcttaaaggatcttcattgtactttgaagtatagtttctgtaacaacaatg

SEQ ID NO: 17833 - DNA, 3000 bp, Unknown; identical to SEQ ID NO: 6404
  misc_feature (1)..( 3000): 2750-1469P.txt file - cDNA_ID_1814209; gDNA_ID_1621091; Annot_ID_55522

SEQ ID NO: 17834 - DNA, 3003 bp, Unknown
  misc_feature (1)..( 3003): 2750-1469P.txt file - cDNA_ID_1814209; gDNA_ID_2926198; Annot_ID_141399
agtggtgattggtcaagaataggtgtgatctccaaagaaacagaggaattgttgaagattgctgcttttcttgttgttcctctctgtatcttcctcgccctttcattttccaatgattcaactgattagaggttccttgattccttctatatatagctctgctttatctttcagaaagaatcaattagattagatctttgtatcatgaagcttgaacaatacttgtaggaaattgagtttttgtttacttttgaatatcttggatggtacattgcgtcttctatggggacaaacatacattgatacattgaatgaagtattactaaatgttttacaatgtgttttcgagttaaaaggcacaagaaggagaagcccgtcgaaaatccatgataagaagactggcaacactatgagcaagagctcctaagactacaaacacatggaatatctgatggctatgtcctgcaatatcaaaagccccaggcttccatctttcaggtatgcgggtaacataaaacgctgctcctgttgcatacaacacagccatcgcaagttcatatacgagagctataagcacgtttgggtgatccttatgaaggtaaagcacatgtgtggctggtattacgccagaaaatcccattgttaggaacagagctgctctgaaagatctgaaacgtggagctgagagtgatggagagaggagagtgaagatggcgaggagaccgaggattgagatcgatgagaggtagaagagtcgccagtaagtgtggcatgagaatgcatagtagataggtgcgaagaatgaacagacgatcatgagggagattccagcgtagtctagacgccagaagaagaggttgaaccgtctggagtgacaggcgaagaggtgtgacatggaactgcagatcaagcagcccattgctccggtcaagaacacaagccatggccatttcggaatggcttcgtagttaacatctccttgagaattcaggagcgagcgagtgtgtgtcacgtttaagtcctgccagtagacaccaccaaatcataagtttatgttgacaaaaaaacagcctttcttttcttaaacccgttgaaaaaatcatgttagttggaaagttaggtgagcacaaagaaaatctacagaaaactaaagtgagagaaacatcaaatagttggggcaggttacaagatttatgctaaactaaacaaatccaatcataaagtttgttccttaatttcggtaggaaatcacgtgatttcaaagtaggtgagcataaagagcaagtctagagaaactgaagtatccataaaaaccaaagttaaaaacagaaagatagaaaaaatccaaagagaacatgacatggtgggtgaaagttaccatttagcactactgctaattgcaatcagcacacaacaaaaatgggatttgttatttgaaagcacttatgttgcatgtctactacttaaattagaataaacaatgtcacagaataaaaaaggaagaatctttacgtgatgcagagtttgatcgctggagaagtaaacatcttttgacattgccattgacggccatggccagcgaattgttgctctgtcattaggacccacaaatcccccaaaaagattgaaatttgtttaattttcctcaaaacaaaaaatgacgattttgacctcgagatttttcttacccggagagaaggctaacaaagccggcgaggccaagctccgtcgtctccattgaactcacaaccatcatccaagtaaatatcgcaaatccacacaaatgcctgccaaatttcaaaaccccgtttacaaattttcaaccaagggaaaaaaaaatcagaagaaaacgaaaacatacgtccagatgttgagagtctcattgtgccatgagaaagcgctgaggaaagtttctttgattgaccactcacatcgataatgattgtgtatgaactcgttatctttcaaatacctaggtaactcctcgaacttcatcaatctcttctcagatctcttcttttcgccggaatccatacctttaccatttcttatcttcgtagattccttcaccgttctccgtttctgcatgattcccctccctctctcgcacagctcgtcggggggaaaaggaggagaaatctagctacgaaattgaactccggcgaatcacccaccaccgtagatttctctcttcttctttttattttcagtatttgagaatctgatttgttttttttcgatcttcgtggtatgcttcgtcgcctacttatacggagatgaaacctctttgaattttaaaaacgagcaagcttcgtgacttttatctacgtagcgtctttgaccggtcttttttacacgtgtctcttccttattagtatgttagtttcgccttagtgtgagggaggatacacctgattatttttacccgccgtgtcaatttgaaacaaatattaaagttacagttggaaggtgagaaatgcagaatttgtgggtctctgtttaaacctatagtctataattattaaatcgagaactttgtttttacccctcaagatttttttgttgcctgacccttaataacattgttgagtaactaaaacatatattttcgtttcatttatacgtttcctaaatgatttgataatatggggagtgttgatcaaaacagattaaacgaacgaggtaaattgaaagagtaggtaactttttattggctttatggcataagattctccaaggagggttgattcataagacaagacaacacgtacatacatatctatatttaattggtatgaacatggattatgttattgatttatttaaaacgcgtcaaacaattggatataataattaaaaactgaatgaatggttcgcttaccaaagcaaaatatagttggcccagaattcgatgttggcatgttacgactacattgctacattgttatcatcaatgtttcagattatttttaatttgtactttcatagtaattcaccgcaatg

SEQ ID NO: 17835 - DNA, 3003 bp, Unknown
  misc_feature (1)..( 3003): 2750-1469P.txt file - cDNA_ID_1814221; gDNA_ID_1621091; Annot_ID_55519
cttatgagagcgacgttttttcttactcgggcacttggccatgcgtctctcatatctcctaccacaccatgctctctgcaagttgaatgatgcccaaaagccattcatcagcagtcaaataagtaaatatgctttgatttgaaactagttgatcagtgtgtgaagaatggtttagccattcttgcattaactaggagccctgaaagaaaactctaggagattggtaaaaagcacaaaacttgtgaatgtgatattaaggtacctagatctgcccaacagaaaccgccctgttgttgattccttctgtgtgttgaatcctccacagtacacaaccggcaaagtgggaggtaatgatgctatgtgttgccatgtgagtaaagcacttcgcctacgggcacgagggctgatttcatccaagtttgtgttgactatctgaaacgaaaaaccaggcggctccgctcctttaagttggaatgtgtaggcagcttgtcaaagaaaaccaaaatactgatatataggacaaaaacaccaaaatcataaactaatctaattatagtttaactaaaatgaacccaactagtaaaaaggatatagcccatgtcgctatacaaggaactgcggaaccccatgccgtgcttccagggaccgagggagactctgacaaccaaaaagttccaccctctagcagctctaccttcaattagtataaagtatagtatcaagcagcgtattaattatttagagcgtagttatgtattgtcttatcaaccgaattaatactttttccttgttgaagaagatggtgcagtgttcatcattagcatccccaggtcctgttcttgatatgccaaattgatcataggctgcaagcaaagagtactaccatctatttaagttcaaagaaacaatgcaaactgaagtattattaaggcatgtgaaactagaagctaagctccatggttcacagtaacaaaaaccagataaacaataccaccatcatttcaaagaaagcacctgtaaatgtgagaatatcatgcattccattgccataaaacagatgcattaagtgcactagactccggcttttgtagcctaaaaacactaacttgaacttgatgcaaaaaaggatacggattgacaaattggctatcagatttaagcaataccaacatatactaaaaatagaattaaatctagtagatcacaaatagatttacatagtagattgagaacaagaagagtggtctacgattgataacaagattcacactagtctgtgaacttaagaagaagcagactgctgtatacaaacagggttcaattagacctaactcacaccatttaagtagagattagacttccataaatcaaagagaattcaattatacctggcaacccctgctgaagataatccaactgcgacttcacacctaaccaatgtaaacatgataacaaaagatcaaaacgaaaatcctatctctgttcaatatttcagaaggcaagaaaaagcacaagaatcaatctccagcattcaggaaaaagaagccttcttggagaaccaatataaagaaggaagcaagatctaacaagcattgaatcaccaatacgaagaaggaatcaaagatctaacaagcattgatccattgtggctaaagattattaccttgttgggtacagagaacaatgggggagtaactagtgatgacagtgagacacaaatctttccttttgagccatgaattagggctttcttcaggtagatcatcgtgaagattgaatgacatcacactcaaagacacactcattgttttgtctcctttcttcttcttcttcttcctctagttttctctcttctttctttatggtttggtaagacgaataaaaacaaaggtctctctcacatcagcagcagctcatcgtcgtcgtgacctacatgattttcaataataagtcaaaagcttatcaatttttatgtgaaaaaacagctcaggattcgaagaaagaaaatcaatcaacataatttattatattatattattgaggaatccaatacgaaccttgttgtttcagactcttatcaacaacaacagtggagaaaatgagtcttggacatttgacgacttttgctggaaaatctgtgaaagtcatgccctttgatcaccaaaagtctcttaaagccatttcctgatacatgtataaatcagcaacttcagaaacaaatcaaatcggaaacgggggaagaagaagaagaagagtaactaatcggaggagggaccggtgaagtcacggtggagggaccggtggagtcacggtggactaatcgtcggctttttggtctctctctagatttttttaaggtttaaaattaatttcagacaagcttcgaacccgagacatggaacccctacagacacgtgagtttttaataaccgttcagaccaaacaggagtaacaacaactgtttgagatagttttgttgaataaccgaattaaaccaaagtgaatacaaaaccgaaccgagatttatatttgtaaagatacgacgacgcctttgacgaaaaaggagacgaagaagatccaaacacggcgctaagctaagctccgttctcctcctcaaaactatccgacaaaagacagaagcagaaacctaaccctaatttccttttctcaaaatccccgaaaggtccgtctctctctctatctatctctctaacttagctctcctccaaattcggatgattacccattacgaatttgcagagaagaacaaatcctctctttcttcttcctccgtctctctacccctttcatgtcttctcaagtctacgactctcatccagggttgttggtgcatcaaaccctagtttttgatttcgcttttgagatttctcatgcttctttcgtttcggatctctctctgaatcagattacgtcttttgggctcttgttgttgttgtgctgctcttcaatctcttctccgttgcgttctatgtgccaaatatg

SEQ ID NO: 17836 - DNA, 3000 bp, Unknown
  misc_feature (1)..( 3000): 2750-1469P.txt file - cDNA_ID_1814221; gDNA_ID_2926198; Annot_ID_141402
atgagagcgacgttttttcttactcgggcacttggccatgcgtctctcatatctcctaccacaccatgctctctgcaagttgaatgatgcccaaaagccattcatcagcagtcaaataagtaaatatgctttgatttgaaactagttgatcagtgtgtgaagaatggtttagccattcttgcattaactaggagccctgaaagaaaactctaggagattggtaaaaagcacaaaacttgtgaatgtgatattaaggtacctagatctgcccaacagaaaccgccctgttgttgattccttctgtgtgttgaatcctccacagtacacaaccggcaaagtgggaggtaatgatgctatgtgttgccatgtgagtaaagcacttcgcctacgggcacgagggctgatttcatccaagtttgtgttgactatctgaaacgaaaaaccaggcggctccgctcctttaagttggaatgtgtaggcagcttgtcaaagaaaaccaaaatactgatatataggacaaaaacaccaaaatcataaactaatctaattatagtttaactaaaatgaacccaactagtaaaaaggatatagcccatgtcgctatacaaggaactgcggaaccccatgccgtgcttccagggaccgagggagactctgacaaccaaaaagttccaccctctagcagctctaccttcaattagtataaagtatagtatcaagcagcgtattaattatttagagcgtagttatgtattgtcttatcaaccgaattaatactttttccttgttgaagaagatggtgcagtgttcatcattagcatccccaggtcctgttcttgatatgccaaattgatcataggctgcaagcaaagagtactaccatctatttaagttcaaagaaacaatgcaaactgaagtattattaaggcatgtgaaactagaagctaagctccatggttcacagtaacaaaaaccagataaacaataccaccatcatttcaaagaaagcacctgtaaatgtgagaatatcatgcattccattgccataaaacagatgcattaagtgcactagactccggcttttgtagcctaaaaacactaacttgaacttgatgcaaaaaaggatacggattgacaaattggctatcagatttaagcaataccaacatatactaaaaatagaattaaatctagtagatcacaaatagatttacatagtagattgagaacaagaagagtggtctacgattgataacaagattcacactagtctgtgaacttaagaagaagcagactgctgtatacaaacagggttcaattagacctaactcacaccatttaagtagagattagacttccataaatcaaagagaattcaattatacctggcaacccctgctgaagataatccaactgcgacttcacacctaaccaatgtaaacatgataacaaaagatcaaaacgaaaatcctatctctgttcaatatttcagaaggcaagaaaaagcacaagaatcaatctccagcattcaggaaaaagaagccttcttggagaaccaatataaagaaggaagcaagatctaacaagcattgaatcaccaatacgaagaaggaatcaaagatctaacaagcattgatccattgtggctaaagattattaccttgttgggtacagagaacaatgggggagtaactagtgatgacagtgagacacaaatctttccttttgagccatgaattagggctttcttcaggtagatcatcgtgaagattgaatgacatcacactcaaagacacactcattgttttgtctcctttcttcttcttcttcttcctctagttttctctcttctttctttatggtttggtaagacgaataaaaacaaaggtctctctcacatcagcagcagctcatcgtcgtcgtgacctacatgattttcaataataagtcaaaagcttatcaatttttatgtgaaaaaacagctcaggattcgaagaaagaaaatcaatcaacataatttattatattatattattgaggaatccaatacgaaccttgttgtttcagactcttatcaacaacaacagtggagaaaatgagtcttggacatttgacgacttttgctggaaaatctgtgaaagtcatgccctttgatcaccaaaagtctcttaaagccatttcctgatacatgtataaatcagcaacttcagaaacaaatcaaatcggaaacgggggaagaagaagaagaagagtaactaatcggaggagggaccggtgaagtcacggtggagggaccggtggagtcacggtggactaatcgtcggctttttggtctctctctagatttttttaaggtttaaaattaatttcagacaagcttcgaacccgagacatggaacccctacagacacgtgagtttttaataaccgttcagaccaaacaggagtaacaacaactgtttgagatagttttgttgaataaccgaattaaaccaaagtgaatacaaaaccgaaccgagatttatatttgtaaagatacgacgacgcctttgacgaaaaaggagacgaagaagatccaaacacggcgctaagctaagctccgttctcctcctcaaaactatccgacaaaagacagaagcagaaacctaaccctaatttccttttctcaaaatccccgaaaggtccgtctctctctctatctatctctctaacttagctctcctccaaattcggatgattacccattacgaatttgcagagaagaacaaatcctctctttcttcttcctccgtctctctacccctttcatgtcttctcaagtctacgactctcatccagggttgttggtgcatcaaaccctagtttttgatttcgcttttgagatttctcatgcttctttcgtttcggatctctctctgaatcagattacgtcttttgggctcttgttgttgttgtgctgctcttcaatctcttctccgttgcgttctatgtgccaaatatg

SEQ ID NO: 17837 - DNA, 3003 bp, Unknown
  misc_feature (1)..( 3003): 2750-1469P.txt file - cDNA_ID_1814227; gDNA_ID_1621091; Annot_ID_55515
gagctacaatctccgtgcagctcatgagtctatacaagagaactggggaaaggtactaaccactttcttatctcgtaaatttgttgtgaataacatgacagtaatttgaaccacaacataataagtgttcctttgggaagttaataagacactaaaagtttcctgggctacttcttttggggtgttgttgcagtatacaaacttggctacatggaactggcgattgatgaagacgataatgactgtgtgtcatgtctatgacaaagaggagaactacattccttttgaccggttagcccctgaagaatctcagccaataaccttcctcaagaaagcaatgcctaactacacagcctgattcgccatggtctcaaactagtcttttgaaatctcaatatctttttgcagtcgccgatgttatatgtaagctttccaagcgatgagcttctctaacacttcaccaacgctttatactgttatcttctttccaatcttatcagaagagagaaactggtcaaattatctcagcgattgcaattcttttatcagtttcttagctataagaagattgaacagtctatatagtttgcaatgtactgtaatgtgatgaaaatttagttgatgagaatctttgaagatataaacatcatcttcttactgtgtctgcaatatttccgagaaagtcgtgggaaaaaagccaaaagaaaaagtgaagagagaaaagaaagctaaagcaaaattcttgggacttctttacggaaagtggaaagacaaagtcattcactgtccaacaaaagacactcacatgtccaaaataagggagcgaatcatcaaatctttagaaatctgagactgtggtcacagttcacaccaccatgaaaggagcttaaagctaaaggtcaaaagaggattaattctttacattgagaaagagtcatataaggacaaaacagaacacaacctgaaactggaaacttaaaatcgtattaatatcaatcctaacaaaagtctatgatcatgttctctatgtttatattctcttgactattgctatttctctcatcctatatattttctaacaaccctaaaacattaacaaaagaagcaaaccagaagcaacagaaacagaccagactaagctcaagatatcaaaatgtgaaatcagatgatgggaggaggaagagtctcccacacatcaaacacattctcctcactgtgcaatgcaaacaacctatccccaccaatagagaaatcacaaatggagccgccatagcttcttttcaacctagaagtcaaaacccagtctgatccacaaaacacagagatggaatcattcatagacgagaagagctggccttcatgcaaagcaagtttggggtaacaaggctcatcaggcatcttgcttttcatcaacctgctcctagaactccacctcacactactccctcctccatccatcctcagatcaataaaccctagatcttcaaactcattcaccacacatatcgaattgctctcttccattgctatcgcgtctctcactctcttctcttccgccattgtaagaaatccgatatcagaccaagaccagaccatgttcttctctcggaaatccaacaagctaatataacagttatctttccttggaaacaaagtagctacaagaagacaattcttaccactcaaccattgcaacttatcagcatctcctaaagaccaaccaggactctcgtaaaagaaatctacttgctttccagtactttgatcccaaactccaatcccatactcattacttcttcctttacagctcgtaaagatcttagaatcaggactaaaactcaaagctccagcactataactcttaacctgattatcatgactaacctgaaacttatacctaagctcaccagaagatgagctaaacaatcccattcctccatctcctcttcctaatctctcacaagcagagagtacaatgttaccagaatcaatccaaccaacatcgttcactctctggtaatcaagattaatcgttggatgctcctcaagcatccaatcaaagacatggacgacactcccatgagctatgcagcatccaccatccggaccagctcttatcgccgttccgtctccaggagctatgccggtgacggaacgagataggtggagtctgttaccgtcgaaaggtccccactttgcggttcgtaagtggtctattaagccgtagaacattgcttctttgtgaaggagacgctccgggatattaggcgggatgtttaagtctcctgttcggagaagatcgagaagaacagcgaagcaatctggattcctatcgatgaagagatccccgggttgtgaaagattccaattttcgtcgaataatgctccgaagaaggaatcgcgacctgcgttagcgagcgttgtcgctgtcgtttcgaagattctgccaccaacgttgaatttgatcctgtcatttgataaacccattatttctgatttctgaaaataggtgaaatcaatgatttttatggattcgaaccaaaagcattaatgacaagacaaggaagccatgaacgctcgaactcggattgaaaatattcgaaattcgatcggattcgaagaaattgaatcctgggaaaggataacgaaatgaaatctgatttatgattaatcaaattgaatacgatgatctggactctggatatttttttaaaaaaagctgagattcccagaagagaaaataaaacgatctgtcttggtctcggacatttttccgttgctcgggcatttaaaacgtaagaaacccaactggaacatggtgggacctactagagacaatactcgtgttactaccgtcagatgcttttagatattgtcgtctatcctgcggtcgagatttcgtgtaatttcaaagctaataccgtgatccatgataacgtttctaaagcccatatagatagatatcatcccattaacatatccttttttttgtatgctgaaatg

SEQ ID NO: 17838 - DNA, 3000 bp, Unknown
  misc_feature (1)..( 3000): 2750-1469P.txt file - cDNA_ID_1814227; gDNA_ID_2926199; Annot_ID_141405
ctacaatctccgtgcagctcatgagtctatacaagagaactggggaaaggtactaaccactttcttatctcgtaaatttgttgtgaataacatgacagtaatttgaaccacaacataataagtgttcctttgggaagttaataagacactaaaagtttcctgggctacttcttttggggtgttgttgcagtatacaaacttggctacatggaactggcgattgatgaagacgataatgactgtgtgtcatgtctatgacaaagaggagaactacattccttttgaccggttagcccctgaagaatctcagccaataaccttcctcaagaaagcaatgcctaactacacagcctgattcgccatggtctcaaactagtcttttgaaatctcaatatctttttgcagtcgccgatgttatatgtaagctttccaagcgatgagcttctctaacacttcaccaacgctttatactgttatcttctttccaatcttatcagaagagagaaactggtcaaattatctcagcgattgcaattcttttatcagtttcttagctataagaagattgaacagtctatatagtttgcaatgtactgtaatgtgatgaaaatttagttgatgagaatctttgaagatataaacatcatcttcttactgtgtctgcaatatttccgagaaagtcgtgggaaaaaagccaaaagaaaaagtgaagagagaaaagaaagctaaagcaaaattcttgggacttctttacggaaagtggaaagacaaagtcattcactgtccaacaaaagacactcacatgtccaaaataagggagcgaatcatcaaatctttagaaatctgagactgtggtcacagttcacaccaccatgaaaggagcttaaagctaaaggtcaaaagaggattaattctttacattgagaaagagtcatataaggacaaaacagaacacaacctgaaactggaaacttaaaatcgtattaatatcaatcctaacaaaagtctatgatcatgttctctatgtttatattctcttgactattgctatttctctcatcctatatattttctaacaaccctaaaacattaacaaaagaagcaaaccagaagcaacagaaacagaccagactaagctcaagatatcaaaatgtgaaatcagatgatgggaggaggaagagtctcccacacatcaaacacattctcctcactgtgcaatgcaaacaacctatccccaccaatagagaaatcacaaatggagccgccatagcttcttttcaacctagaagtcaaaacccagtctgatccacaaaacacagagatggaatcattcatagacgagaagagctggccttcatgcaaagcaagtttggggtaacaaggctcatcaggcatcttgcttttcatcaacctgctcctagaactccacctcacactactccctcctccatccatcctcagatcaataaaccctagatcttcaaactcattcaccacacatatcgaattgctctcttccattgctatcgcgtctctcactctcttctcttccgccattgtaagaaatccgatatcagaccaagaccagaccatgttcttctctcggaaatccaacaagctaatataacagttatctttccttggaaacaaagtagctacaagaagacaattcttaccactcaaccattgcaacttatcagcatctcctaaagaccaaccaggactctcgtaaaagaaatctacttgctttccagtactttgatcccaaactccaatcccatactcattacttcttcctttacagctcgtaaagatcttagaatcaggactaaaactcaaagctccagcactataactcttaacctgattatcatgactaacctgaaacttatacctaagctcaccagaagatgagctaaacaatcccattcctccatctcctcttcctaatctctcacaagcagagagtacaatgttaccagaatcaatccaaccaacatcgttcactctctggtaatcaagattaatcgttggatgctcctcaagcatccaatcaaagacatggacgacactcccatgagctatgcagcatccaccatccggaccagctcttatcgccgttccgtctccaggagctatgccggtgacggaacgagataggtggagtctgttaccgtcgaaaggtccccactttgcggttcgtaagtggtctattaagccgtagaacattgcttctttgtgaaggagacgctccgggatattaggcgggatgtttaagtctcctgttcggagaagatcgagaagaacagcgaagcaatctggattcctatcgatgaagagatccccgggttgtgaaagattccaattttcgtcgaataatgctccgaagaaggaatcgcgacctgcgttagcgagcgttgtcgctgtcgtttcgaagattctgccaccaacgttgaatttgatcctgtcatttgataaacccattatttctgatttctgaaaataggtgaaatcaatgatttttatggattcgaaccaaaagcattaatgacaagacaaggaagccatgaacgctcgaactcggattgaaaatattcgaaattcgatcggattcgaagaaattgaatcctgggaaaggataacgaaatgaaatctgatttatgattaatcaaattgaatacgatgatctggactctggatatttttttaaaaaaagctgagattcccagaagagaaaataaaacgatctgtcttggtctcggacatttttccgttgctcgggcatttaaaacgtaagaaacccaactggaacatggtgggacctactagagacaatactcgtgttactaccgtcagatgcttttagatattgtcgtctatcctgcggtcgagatttcgtgtaatttcaaagctaataccgtgatccatgataacgtttctaaagcccatatagatagatatcatcccattaacatatccttttttttgtatgctgaaatg

SEQ ID NO: 17839 - DNA, 3000 bp, Unknown; identical to SEQ ID NO: 6397
  misc_feature (1)..( 3000): 2750-1469P.txt file - cDNA_ID_1814246; gDNA_ID_1621091; Annot_ID_55509

SEQ ID NO: 17840 - DNA, 3003 bp, Unknown
  misc_feature (1)..( 3003): 2750-1469P.txt file - cDNA_ID_1814246; gDNA_ID_2926199; Annot_ID_141411
tttatggtgtttaaaagagggatggagattgtaatatttgagatttgaagggtttgactttgacatgttaaatacgtttaccaaatttaccattttttttatcatccttgcaaattaattatttcgtgttattttcataatttcttgatttttttaatcactaaaagaattcgatcactgaagtcatgatttcttcaattttataatcctttgttgataatatacttttcacaattttgtagtaactacaaaaagtaagtgaaacatatatttctaaaaatatcatagtcgatcgaatgacaggcttaaagtaataaaactaacttaaaattcggttgtactaaaaaaaaaaaaaaaaaaaaaaaattcggttgtactaacttcactcaaatgatttacgtatgtttaattatctttttttttttatttaagacagaatgtggttctaataccgtatattattaaatttctatatatataacataggtttttctattaatcatttttgaaaactcatgtttaagataattgtataagattttcattcggtaacattaaaattggtttatttgaatgctgaataaaattctttggatttatgttaaggatgccaactacaaaaataaaataaaatacaaatctctattgttgatcttttttattaaaatcagtcggagttttaaacttgtcccggcaactacgtaccacgagataaatatttgctagtccaaaaatgcaatagtctacaagataacaccagagccaacactttttcttgtgacaactattttagacatataatatttagacatgcagtataaatgcatacaattatactctattcatttgggtacattcattcattcatcaacggttcatgataatgttctcttcatatattactgtttacaatttgtccccaagattacaaacatgctatccctttagacgatactcgtgttcgataagaataagatcactttttatagattattcttgttttgttttctgattaatatgataccgatcgatgaaattgttgttttaaccgatctgattaacatttgggaaagaggatcctctcaaacgagaacataacataacagaacatcgtcatcatcatcatgtcatgttaccatgtattttttatacttgttaaatattttttggtctaataaattcatcatttaccttaaaaattcttttttaccatcgtatacagtttttcagctgtttgatagtatttgattaagattaatattaaattgacaaagataagtaaagaacattattatgcaatatgcatgattaagcacatgggacattctgagttttgcacaaactcacaagaggtagagatcggctttaatacacttcccatttattaattacaaatgttggtaagcattgatgtactacacaacagaaagagagatctatcatctcatgtattagtattatcaagagaatgcaataattatttttgtttttacttaataatcataatgtataccaaaataattaactaagggggtgtaaaataagttacgaatgataatttaaattccatatagaaaaaataaacagatagtaaagacaaaaatgctactatgttaaataaactattggtcccatctagtatactgatacattagttttatttcatattatcagtagttttttctattgtttatataaaacaatacgtttacaataggaaggcaggaaaataaaccatatggtgcacaaccattgtagactcaatcctgacaaaacccaataaatttgaggaactccctcaaaaattacggctttgttcaaattgaaaaactggctcttacgatcttagtttggtacacaatcacgtctgatttcccaagttctacttattcacctataatgaactataaatataatctgtaaatatcaaaaggtgggcttaactaggccttgggaaaatattgaattatttaaccttgtatgaatctgacaaactctgattaaagtcttggttcttactctattagtctaatacaaataaataaacatatcttatttccttaaatgtaatttcattctcttaaattatactaaaaaaactctacttgagaaacatgaaagcttaatttggcttgctgtgattgtagatgaagctgagtgctggacgtgctcgaaatgctattttaatttgagagaagaagatgttgatgagttaacgcgcgtctcaatattttgttggccagtgttacgattttcgaatgttaagattgggctaaaaagggaaataaaaatgtctaaaattatggatctcggttatggaaaaccagaaatatacgtcaaaacccgaacattcggttcgattaaacgataaaccaggataaaacctaaccgggtcgttaaacccaaccgcctccttgtttgagaacaaaaaagaagcttaaaccctttcttcctccgccgcgttctcaagctcaagctcaatctcaattctcaagctcaagccttttcgatttttctctttaaagacgcaattttgctttcgcaaccctctgtgtgatttcgtttccaaacgtaagctctacttttgttgtttaatttccaaggctttagcaattaagcaattaagcaattagattgatatacatagttgctcttagaagcttctctttttttttttttagcctggatttaattgtaaagtttggggattttggaatcgaaattgactgttttggagattgatgtgtttaggaaacacggctctctgaatcatggcgacatcagctgatgctcgggcagtaaagtcgctcaacacttccgaggggcgtaagagatttgtggtacgtgtttgtttaattatatagcacatgtcttttcctttcctttgtaaaacttcctctacacctatcatagagtccactgtttctcctcattagtaagctcacttatctgttttcgttgtgctctctaatatggctgtttgtgctttattatttctggatg

SEQ ID NO: 17841 - DNA, 3000 bp, Unknown; identical to SEQ ID NO: 6395
  misc_feature (1)..( 3000): 2750-1469P.txt file - cDNA_ID_1814254; gDNA_ID_1621091; Annot_ID_55507

SEQ ID NO: 17842 - DNA, 3003 bp, Unknown
  misc_feature (1)..( 3003): 2750-1469P.txt file - cDNA_ID_1814254; gDNA_ID_2926199; Annot_ID_141413
aaaaaaactgtcttacagtgtcatagtggaagctgtcaaggtagatagtctgcagaggctatgctcgtctttggaaccattatttcgaagaattgtgagtatgatactattccgaagtttaacttccacatagaccaaatcttgagaagcctgtaagagcgataaacttggtaatgatgtcgatcaatggacaggtcagtgaagaggtggaacgtgccatatcaaggttggagaactcgaaatctacttcaaggtattttatctagctatatacgatatcattttctggactggttccatgatctttacatcaatttgagttttcagatctacagaaccgaataagattcaaggcctcgatggaagaaatctgcaacttcggttcagaacacgaatgcctcctcatttattcacaggtgggaaagtcgagggagagcaaggctcagccattcacgtggttcttatagatgcaaacaccggaaatgtaatccaaacaggagaagaatcaatgacaaagctgaatattgtcgtgttagatggagacttcaatgatgaagacgacaaagattggacgagagaacattttgagagctttgaagtgaaggaacgcgaaggaaaacgtcccatcttgactggtgacagacatgtgataattaaagaaggtgtaggaactcttggaaaacttactttcactgacaattcgagctggattaggagcagaaagtttagacttggtgttaagcctgcaacgggatttcacatccgtgaagctaaaacagaaccatttgctgttaaagatcacagaggagaacatgagtatcttaaaactttggactgacttgataagcagagagagatagagtttcttggattgtctaccttaatcttggattattttttggcggtgttttttgcagtatacaagaaacattatccaccggttttacatgatgaagtctggagattggataaaatagcgaaagatggagcgctacacaagaagctactaaaatctaacattgtgactgttgaagacttcctacagatactcatgaaggatccgcagaaactaagaagcgtatgtgcatctttaatattgtgagtatctacacaagaaaatgattgtttcttgcttatgttctttctttgtgtgtatttaacagttacttgggagtggaatgtcaaatagaatgtgggataacacggtagagcacgcaaagacttgtgtcttaggtgggaaactttacgcctattacacagatcaaacacaccagacagctgttgtctttaatcatatatatgaatttcaaggcctaattgccaatggccacttcttgtcttcggaatctcttaaccatgaccaaaaggtaactcatctctctgtaaagctagcttcttttttttattcttccctttagagtctgcagtctctaaggatcctactcaaaagtggtgaaaacttttgaacttttttggaattcaacagatttctgcagacactttggtgaagactgcttacgagaactggcataaagtggttgagtatggcggtaagctcttgaattgcttaccagttgctaagaagggaataaaaagcttgccagagccaaaaatggctcagaaccatcaaacgcagcagaaggctctgcaatgccaacagactgtgaatggctactcatcagatcctcagcatctgatagagtatccttttgtccaacaaccttgctatcagttacgagactacacatcgatggagagttcttcagtttcaggctcatataatggaggccttgaagatattttcacggaggaaattcgagcgaggagttctgagatgctcgagacggataacatgcagagattgctcaagacatttgggatatcaggcgggtttggtaacagggatgagtccatttacggtttcagtgatcagtacgaagctcagatagacaagggttatatgagagaaggaggtagaggcgcagggaaagctgtagtgggatggcttaagctcaaagctgcattgagatggggtatctttatacgcaagaaagctgcagagaggaggcctcaaattgtggagatcgactaagaaagtactacaaaaaaattccgagagcttttcttttgtataaataaacttgaagcaattacttttttaaagaggatcaaccagtatatccttccatatctaagcattggagaaaaaggttaaacgactggttatcagtcagacaaagagtcttaataccgaaagtctcagtattcgtcctctttaagataatctccacaccaaatacatacgaatggagtgaaggttcctatatatattgacaaagaaaaattaaggatttatgaacagaatgaatttaacattgcatcaacttacttagcttaccattaaattacggagtaaaatctgaagacgtggaaaatcgaggtgagatggctggactggactagaccatcatcgagatatctccagcactcatatcaagaacataggtttcggttataaaagcctcccatgcacttttttttagagatctttctttgtgattgcttgatcggccgtatcaaaagcggttgtggattgctcaatatcaacaagagaggtaggagttgtagatggccgccggagcacagcagtttcaggagcggttgtggattgctcatcttcagagatatcaacaagagaggttggggttgtagatggccggactccagcagtttcagagaagccagctccttcgttaggcaaactcattctcgcagacgtggccctagttagtagcgcgccaaggcactatataagtgacacggcagggataagtcaaacttaaaggccgacttgactaatgggccctataatgttaggcccatgttttgagagagcaagtagagagaagaaacaagcaacaagaagttccttcctcagcctctttccgatttcttcttcagtctctctccactggttcgtcgacttcgtagaagcaaaaaatg

SEQ ID NO: 17843 - DNA, 3003 bp, Unknown
  misc_feature (1)..( 3003): 2750-1469P.txt file - cDNA_ID_1814257; gDNA_ID_1621091; Annot_ID_55506
ctcattccatgggcattagactttttggctcatgattatctacttatgcccttcttagacaggtgattttcttcatttttgctgttaattccccaggttatgtctctatttacgttgtgttagtccccagtttgattatttagtctgtgcctttacttaaagatatgtgaagactgtaccacttgctgcccagacgcttgatgtgagacgaaatcagaagctagaaatggttaaggaacttaatagagaaaaagctaggtaccgtcttgaagttgagattggcaaatctccgccgctttctgacgatgatttatggtgggagatgcggggtaaagcgtaagactcgactccacatttttagtttcttttgatgtcaaaggtcgtaaacccatcttgatcgtgtaccagatagtttcttttgatagcctcactgtgtttctttttgtgttcctcccattggtttcttcaacagtttggaactgcgtgatgagtggagactagagaaccggaaagcatttgccaacatatggtctgatatggtgtttgggatctccttgtttgttcttttgtacgccaatcagggtagagtaagtttccgtttccaaccgtgattaagcccacctaaaatggcattctaagtttcctttcaagctgctatgttgttaacatgtacctttttgggttacttcatgaacttttttcaggtagccttgttgaaatttacaggatataaaatcataaacaacatttcagacacgggaaaggcatttctcatcatcctgatcaccgacatattcttggggtaaatgtccaaatctttgctttcattaagagcaaccaccagaactgaagctcataacaaacgttaaatcaaagctgttactgttccaataacctgatattagcgatagatctaccaatagtccattaatgcttctctttataggtaccattctgaatctggatgggagacattgttagagataataatggaacattatggtcttgaagttgagcaatctactattaccatttttatctgcctagttcccgttattatggacgcttgtgttaagctctgggtatcttcttttctccttttttatgctcttttgatttctatgtctctgctttgtttcgtcttctttgctcattatctcgtctgcatttctcaactgtttttttctgcttcttatgtagctgtttaagttccttccaagactgtctccgcgagtttccaacatattccaggagatgaaacgtcactgagtagtacccaccattgaaaccctccacttgagttctgtgtctctatcacacaaaccattcttcagctttatttacgttcagatagacataagagaaacataggctatttttttggtcactcatcttgatcttaaaatatattttttggttgaatttttggtgaacgattgagagagcactaatctgttggctctctcaccagtacttggtcatgtacacaataaacaaacctacaaaagaagccctttcggatatgggctttgggccttggaatttgggctttgggtgtatgtttacttgtgaaatagtagtaatcttctttacggtaagttacaagtctcgtcactttttacttgtgtcttgggttatcttttttgcttttttatggttgatttgatgattaagatttaagagctcaaacttccacacaaagctctctcatgcctttgttgaatgaagacacttttctctcttttggaccaagctctcaatgtcttaaaagctgaccatgcaaataaatgtacaatgttttgattagcaaagacatttactaggttaccctctctctactagacctctaagcggatcagttagattcctttgtagaaaaagttatctacaatgaaaacgaactgtctgcaaatagtgttattaattgatataattgtaattgcccccatttaacatggcggattttacgggccattgcacagttaaaacctcaaataatcatcattttataagcaaaaccaataaattaaactgaatcatcattagtttaactttacaccatttgctaatagttttggtcaaaatctgaagctgacgaagtccaaagcacacagaatcgtgtcagaaattaaaagcatacttgtccaaacaagacaatgtctccttttttgttattgtacttaaaaaaaaaaggaattggaacaagaaattgcaaagtgaaaacgagaccaaattgaaaaaaacagagcaagtggtattaaagataatttaggtaaataagaaggaggaatgtctgacaagacttcccattaaaagccattccttgcagcctttgaccaaatcttagcccttcgttgtgtaactctcttttcaagacacaagcacaataaatatgaacatcatcacctaaagatgaacacaagtttttaaaaacttaacccaaatattttacttgttacatacaacagaatttcattttgaccaaaacaaaaggattttttttgtattacgccatcagaatttaccaaaccatggacgaggccattcaaatattgtgtgacattaccatttctatttgaaaaaaaatctagactggcttctttcttatttatcatcatagactcatagtcatatatattcaatcctaagaatctaaagattaattatgattctataaaaacccctttaataaaacatcaactctaaaaagaaagaagagaggtgtagaagttgtttttttataaaacagctcatatcttcttctttcccccgacaagttcggttcccttcttctctcctcctccaccttctctccattttcttacctctcaacaagtttacacaaacaaaaaaccaaaaaaaaacaaaaaaaaaaacaattttttaaaattcttttcttagacaaagacagagacagagagaggggaagattttgggtttggtgtttttctccttttcttcattgaaagttgtcttcttttttaatcttctttgattaaaatg

SEQ ID NO: 17844 - DNA, 3000 bp, Unknown
  misc_feature (1)..( 3000): 2750-1469P.txt file - cDNA_ID_1814257; gDNA_ID_2926199; Annot_ID_141414
attccatgggcattagactttttggctcatgattatctacttatgcccttcttagacaggtgattttcttcatttttgctgttaattccccaggttatgtctctatttacgttgtgttagtccccagtttgattatttagtctgtgcctttacttaaagatatgtgaagactgtaccacttgctgcccagacgcttgatgtgagacgaaatcagaagctagaaatggttaaggaacttaatagagaaaaagctaggtaccgtcttgaagttgagattggcaaatctccgccgctttctgacgatgatttatggtgggagatgcggggtaaagcgtaagactcgactccacatttttagtttcttttgatgtcaaaggtcgtaaacccatcttgatcgtgtaccagatagtttcttttgatagcctcactgtgtttctttttgtgttcctcccattggtttcttcaacagtttggaactgcgtgatgagtggagactagagaaccggaaagcatttgccaacatatggtctgatatggtgtttgggatctccttgtttgttcttttgtacgccaatcagggtagagtaagtttccgtttccaaccgtgattaagcccacctaaaatggcattctaagtttcctttcaagctgctatgttgttaacatgtacctttttgggttacttcatgaacttttttcaggtagccttgttgaaatttacaggatataaaatcataaacaacatttcagacacgggaaaggcatttctcatcatcctgatcaccgacatattcttggggtaaatgtccaaatctttgctttcattaagagcaaccaccagaactgaagctcataacaaacgttaaatcaaagctgttactgttccaataacctgatattagcgatagatctaccaatagtccattaatgcttctctttataggtaccattctgaatctggatgggagacattgttagagataataatggaacattatggtcttgaagttgagcaatctactattaccatttttatctgcctagttcccgttattatggacgcttgtgttaagctctgggtatcttcttttctccttttttatgctcttttgatttctatgtctctgctttgtttcgtcttctttgctcattatctcgtctgcatttctcaactgtttttttctgcttcttatgtagctgtttaagttccttccaagactgtctccgcgagtttccaacatattccaggagatgaaacgtcactgagtagtacccaccattgaaaccctccacttgagttctgtgtctctatcacacaaaccattcttcagctttatttacgttcagatagacataagagaaacataggctatttttttggtcactcatcttgatcttaaaatatattttttggttgaatttttggtgaacgattgagagagcactaatctgttggctctctcaccagtacttggtcatgtacacaataaacaaacctacaaaagaagccctttcggatatgggctttgggccttggaatttgggctttgggtgtatgtttacttgtgaaatagtagtaatcttctttacggtaagttacaagtctcgtcactttttacttgtgtcttgggttatcttttttgcttttttatggttgatttgatgattaagatttaagagctcaaacttccacacaaagctctctcatgcctttgttgaatgaagacacttttctctcttttggaccaagctctcaatgtcttaaaagctgaccatgcaaataaatgtacaatgttttgattagcaaagacatttactaggttaccctctctctactagacctctaagcggatcagttagattcctttgtagaaaaagttatctacaatgaaaacgaactgtctgcaaatagtgttattaattgatataattgtaattgcccccatttaacatggcggattttacgggccattgcacagttaaaacctcaaataatcatcattttataagcaaaaccaataaattaaactgaatcatcattagtttaactttacaccatttgctaatagttttggtcaaaatctgaagctgacgaagtccaaagcacacagaatcgtgtcagaaattaaaagcatacttgtccaaacaagacaatgtctccttttttgttattgtacttaaaaaaaaaaggaattggaacaagaaattgcaaagtgaaaacgagaccaaattgaaaaaaacagagcaagtggtattaaagataatttaggtaaataagaaggaggaatgtctgacaagacttcccattaaaagccattccttgcagcctttgaccaaatcttagcccttcgttgtgtaactctcttttcaagacacaagcacaataaatatgaacatcatcacctaaagatgaacacaagtttttaaaaacttaacccaaatattttacttgttacatacaacagaatttcattttgaccaaaacaaaaggattttttttgtattacgccatcagaatttaccaaaccatggacgaggccattcaaatattgtgtgacattaccatttctatttgaaaaaaaatctagactggcttctttcttatttatcatcatagactcatagtcatatatattcaatcctaagaatctaaagattaattatgattctataaaaacccctttaataaaacatcaactctaaaaagaaagaagagaggtgtagaagttgtttttttataaaacagctcatatcttcttctttcccccgacaagttcggttcccttcttctctcctcctccaccttctctccattttcttacctctcaacaagtttacacaaacaaaaaaccaaaaaaaaacaaaaaaaaaaacaattttttaaaattcttttcttagacaaagacagagacagagagaggggaagattttgggtttggtgtttttctccttttcttcattgaaagttgtcttcttttttaatcttctttgattaaaatg

SEQ ID NO: 17845 - DNA, 3000 bp, Unknown; identical to SEQ ID NO: 6385
  misc_feature (1)..( 3000): 2750-1469P.txt file - cDNA_ID_1814264; gDNA_ID_1621091; Annot_ID_55503

SEQ ID NO: 17846 - DNA, 3003 bp, Unknown
  misc_feature (1)..( 3003): 2750-1469P.txt file - cDNA_ID_1814264; gDNA_ID_2926199; Annot_ID_141417
aaagtgtcttcattcaacaaaggcatgagagagctttgtgtggaagtttgagctcttaaatcttaatcatcaaatcaaccataaaaaagcaaaaaagataacccaagacacaagtaaaaagtgacgagacttgtaacttaccgtaaagaagattactactatttcacaagtaaacatacacccaaagcccaaattccaaggcccaaagcccatatccgaaagggcttcttttgtaggtttgtttattgtgtacatgaccaagtactggtgagagagccaacagattagtgctctctcaatcgttcaccaaaaattcaaccaaaaaatatattttaagatcaagatgagtgaccaaaaaaatagcctatgtttctcttatgtctatctgaacgtaaataaagctgaagaatggtttgtgtgatagagacacagaactcaagtggagggtttcaatggtgggtactactcagtgacgtttcatctcctggaatatgttggaaactcgcggagacagtcttggaaggaacttaaacagctacataagaagcagaaaaaaacagttgagaaatgcagacgagataatgagcaaagaagacgaaacaaagcagagacatagaaatcaaaagagcataaaaaaggagaaaagaagatacccagagcttaacacaagcgtccataataacgggaactaggcagataaaaatggtaatagtagattgctcaacttcaagaccataatgttccattattatctctaacaatgtctcccatccagattcagaatggtacctataaagagaagcattaatggactattggtagatctatcgctaatatcaggttattggaacagtaacagctttgatttaacgtttgttatgagcttcagttctggtggttgctcttaatgaaagcaaagatttggacatttaccccaagaatatgtcggtgatcaggatgatgagaaatgcctttcccgtgtctgaaatgttgtttatgattttatatcctgtaaatttcaacaaggctacctgaaaaaagttcatgaagtaacccaaaaaggtacatgttaacaacatagcagcttgaaaggaaacttagaatgccattttaggtgggcttaatcacggttggaaacggaaacttactctaccctgattggcgtacaaaagaacaaacaaggagatcccaaacaccatatcagaccatatgttggcaaatgctttccggttctctagtctccactcatcacgcagttccaaactgttgaagaaaccaatgggaggaacacaaaaagaaacacagtgaggctatcaaaagaaactatctggtacacgatcaagatgggtttacgacctttgacatcaaaagaaactaaaaatgtggagtcgagtcttacgctttaccccgcatctcccaccataaatcatcgtcagaaagcggcggagatttgccaatctcaacttcaagacggtacctagctttttctctattaagttccttaaccatttctagcttctgatttcgtctcacatcaagcgtctgggcagcaagtggtacagtcttcacatatctttaagtaaaggcacagactaaataatcaaactggggactaacacaacgtaaatagagacataacctggggaattaacagcaaaaatgaagaaaatcacctgtctaagaagggcataagtagataatcatgagccaaaaagtctaatgcccatggaatgagaattaagaccgccaaaaactttgcctgtaaagagttacaacgtcaatgagcattgatcaatcatctggaagaacattacaatcactaacaaatgaactaagaatcacacatatcatcaattaaggaacaagatcaacagagagagctatgtagcataactcaccgattttgaagaagcgtaacgaaaaatacggtcttcgtaaagaatatcttcctcttctgcacctaaaaccatatccctcaccattttaaccaaccctccatctggaattgtcaattcatcaagctctaaattgtcgtcactaccagcagagtctcgggtccaagactcaacaaaactatcatctgaatccacaatccaatcctcccatttcttggtcacatcagcaacaacaccactatccccaatctcctcctgaccttcccgtagctcgacaatcgcctctgctcgtctcttccaagtctcgaatttctcttcatcagacatctcatcatcctttgcaagctcagtagtctcatcaacaatgtcgtcgtctctcaaaccaagccaattcccatcatcatcaaagaaaaacctctgccaccagcttcttctcctcttattattattacccgtatgactgttattcttctccgcactgggaacaaatctccaaagcttcttccttctcttaccccacaacgaaatcgaatcacaaggcttataacgaagaagagaagatgatgatgattcaggatctgggttttgactactgaatgataagcagtggcataagaccattgacgagctcatcaaggacatgaatcaaacccaacattgttcggactttaatctcaaagcaacaacacagattcttctacaaaacccagacaaaccagcatatctttctttgtaaattcaacaactttacaaagccctatacccggaatccggtgaagataagaattagggttcttcagctcagaaagttaccgagagagagaaccagaagctgaccccagttgtggatagtggataccagatgatagataaagccacgctcttttttttgttttgttatcttcttcttcaaattaagcttgtaaaatatctgttatccataaagattgcttttttggtttcaaataattaattacatttacatattattttgtagagtcaaaattgttgtttccgtcgtttttgattggctaaaaattgaatgactgtatatttacagaaataaattttaagtaaattccactttcttctttagtacagagttatg

SEQ ID NO: 17847 - DNA, 3000 bp, Unknown; identical to SEQ ID NO: 6377
  misc_feature (1)..( 3000): 2750-1469P.txt file - cDNA_ID_1814266; gDNA_ID_1621091; Annot_ID_55502

SEQ ID NO: 17848 - DNA, 3003 bp, Unknown
  misc_feature (1)..( 3003): 2750-1469P.txt file - cDNA_ID_1814266; gDNA_ID_2926199; Annot_ID_141418
gagaagcattaatggactattggtagatctatcgctaatatcaggttattggaacagtaacagctttgatttaacgtttgttatgagcttcagttctggtggttgctcttaatgaaagcaaagatttggacatttaccccaagaatatgtcggtgatcaggatgatgagaaatgcctttcccgtgtctgaaatgttgtttatgattttatatcctgtaaatttcaacaaggctacctgaaaaaagttcatgaagtaacccaaaaaggtacatgttaacaacatagcagcttgaaaggaaacttagaatgccattttaggtgggcttaatcacggttggaaacggaaacttactctaccctgattggcgtacaaaagaacaaacaaggagatcccaaacaccatatcagaccatatgttggcaaatgctttccggttctctagtctccactcatcacgcagttccaaactgttgaagaaaccaatgggaggaacacaaaaagaaacacagtgaggctatcaaaagaaactatctggtacacgatcaagatgggtttacgacctttgacatcaaaagaaactaaaaatgtggagtcgagtcttacgctttaccccgcatctcccaccataaatcatcgtcagaaagcggcggagatttgccaatctcaacttcaagacggtacctagctttttctctattaagttccttaaccatttctagcttctgatttcgtctcacatcaagcgtctgggcagcaagtggtacagtcttcacatatctttaagtaaaggcacagactaaataatcaaactggggactaacacaacgtaaatagagacataacctggggaattaacagcaaaaatgaagaaaatcacctgtctaagaagggcataagtagataatcatgagccaaaaagtctaatgcccatggaatgagaattaagaccgccaaaaactttgcctgtaaagagttacaacgtcaatgagcattgatcaatcatctggaagaacattacaatcactaacaaatgaactaagaatcacacatatcatcaattaaggaacaagatcaacagagagagctatgtagcataactcaccgattttgaagaagcgtaacgaaaaatacggtcttcgtaaagaatatcttcctcttctgcacctaaaaccatatccctcaccattttaaccaaccctccatctggaattgtcaattcatcaagctctaaattgtcgtcactaccagcagagtctcgggtccaagactcaacaaaactatcatctgaatccacaatccaatcctcccatttcttggtcacatcagcaacaacaccactatccccaatctcctcctgaccttcccgtagctcgacaatcgcctctgctcgtctcttccaagtctcgaatttctcttcatcagacatctcatcatcctttgcaagctcagtagtctcatcaacaatgtcgtcgtctctcaaaccaagccaattcccatcatcatcaaagaaaaacctctgccaccagcttcttctcctcttattattattacccgtatgactgttattcttctccgcactgggaacaaatctccaaagcttcttccttctcttaccccacaacgaaatcgaatcacaaggcttataacgaagaagagaagatgatgatgattcaggatctgggttttgactactgaatgataagcagtggcataagaccattgacgagctcatcaaggacatgaatcaaacccaacattgttcggactttaatctcaaagcaacaacacagattcttctacaaaacccagacaaaccagcatatctttctttgtaaattcaacaactttacaaagccctatacccggaatccggtgaagataagaattagggttcttcagctcagaaagttaccgagagagagaaccagaagctgaccccagttgtggatagtggataccagatgatagataaagccacgctcttttttttgttttgttatcttcttcttcaaattaagcttgtaaaatatctgttatccataaagattgcttttttggtttcaaataattaattacatttacatattattttgtagagtcaaaattgttgtttccgtcgtttttgattggctaaaaattgaatgactgtatatttacagaaataaattttaagtaaattccactttcttctttagtacagagttatggagttgctgaatggagtagaaactctagtttcgggaattcatcatcaccatcgtactaacgcgaagagaaacagattagttagatctgtcaagatcttaaactccgggaatcatgaaatccccagaaagtaaagtttccttttttgtgctctctattttctgtttgaggcattttaacgaacaccttccgtgcaatcactatcaattttgcaggtgcctgtgttttgatctttacgacaaattggttccatacaagaaagcttggtcatggcagaagagcattgtcgaggagaaaaagacattgattgatagaaaccaagactgcgctgatacagtgattttgttacaacactctcctgtttacacaatgggaactgctagtacagaggattatctcaatttcgatataaaggatgctcctttcaatgtttatcgaactgaacgtggtggcgaagtcacttaccatggccctggtcaggtaataatgtcaacaatgcattggaagtttctgtgtgttttctaatgagctcttcaagctgattataggaatgtttgaaaatgtagctagttatgtatcctataatcaatcttcgaaatcacgagatggatcttcattggtacctcaggatgcttgaagagattgtcatccgtgtgctttcctcaactttctccattaaagcttctcgtcttgacggtttaactggagtttgggttggtatgtctcatatttcaaatggatgattttgtaagtgatctaatatatattccgagattgatttctttttgtttgcaaatg

SEQ ID NO: 17849 - DNA, 3003 bp, Unknown
  misc_feature (1)..( 3003): 2750-1469P.txt file - cDNA_ID_1814276; gDNA_ID_1971823; Annot_ID_58373
ctattatcacttagagaaaaagtttcacgagtttgtttagctctcatacatatgtcgcagacactgtccaaaaaatctctactactagacaaaaaatcagtaggaatcaagctaattgctttttatgatgcgtgtcccaaacgtttgtgccatagatcatatgaacctttgacacttgtgctcacaactgctgccaactccatacttttaaacaaaaaacttccattctctcttttaccaactccagtcaccgtcctcgtaatgcggtcctgtatcacaagaaagtgatcagcaagctgcacaacacagtaattctcatcaatcatctgtccaacagagatcaaatctgaagtcaattccttgacatagaaaacggatttcagaaccaaactggaaccaaggcgcactgttccttcactcacagcaactcgcttattcccatcagccaatataatcaaaaccggagagatcttgcgcatatcagtcaacagatgtaactttccagtcatatggtgagctgcacctatatctaggatccaagaagagaaattagaacacgtacccgttagagtctcatgtccttgttcgttgggtttgatgttggcttcatcactttttccagcgttcaagagcttgagtacaccacgccactgctcatctgtaagaccattcaccgcatctcgatctctatcagtgataactcgattagcccgttccacagtggttaagccagttgtgacagcattcacataagaggttggagtgcgattttgtcctccattaaagcctagaccgggtttgcctctgcctcgaccagattgtcctcgcggtctatcgccccaccactctgggtatccaatgatcacaaagcagttctccggcgagtgaccgccacgattgcagtgcttacaaacgttcttgttggggaactttgcagaactaggatcaatctgtggacgagactgagtagcaaaagcagtgacatctagcttttcttccttagagtatctattgctcaacatgtcctcttcttgtctcacaatgttgtagacttcttcgagtccaggaagaggaacacgtgatgttaagctagaccgaattgtatgaaattgagtttcatcaagtccatacagaaattgttgaaccatgtcatcttctctacctttctcctgctcagcttcaagattacacacacatcttccacatttgcaggttcgaagaggacgatagttgttgatattatcccaaatcttgttgagttttccataatatccttcaacagtcataccctcttgtttacaagtagcaagatctgccttcatcttctgattctttggaccactagaaacagagaagcgtttacgagtgtgttcccaaagatctctagccacgtcacggtgggagatattcgtcaagagcgccgggtcaatcgtcatcttcatccaagacactagcaaagcattaatcgttaaccagtcctcgaggtccagagattctgacggcggttgtggaatggagccgtcaagaaaaccaaacttcttccgtgagcgcagtgctgttttgaagccacatgcccattcatcataattagtcgacttcaagatcgggtgggagatcacagctccagagttatcagcgaccgttaagtcatacggcgagatcgttcgccggacttcagttacaagaggaattaccggaggagcagccattactccaaaagaaactcaaactttatcgatttcaaatgaaaaaccccagctttagctctgataccatgacaaaatcaagagacaagagataaagataaggttttgtcttgatagcagcttaagtgtttctcagacacttatacaaagagaaagcgtttcagacctaaagggacaagaagggaaaagaccaaaaggggttacaaacagtacataaagcaacattaagcttaagagcaactaattgatgtgctctaaataagataagtagcaatatcttcaacagagagatctttgcttcgttttgttaatctttttgttgggtttgatttggtctttggttagttgcagagtgggaataagctccgcgtgttttggtgtcaacttgttgtcctagtttttagttttgtttcagttagttcctgcaatttctctttcacgtatttgtaagaagactgagtcttcatctttaggctatttaaagccaaacaactatgataataaaacatcgaagcattcagttttagtctctttgttctctcagatcaacacttttgtatgtttatgtagcaaatatgtcatagagatttgaagattgagaaaacactgcttgatggtagtcttgcaccgcttttgaaaatctgtgattacttggctttgatctcataggtcattcattcattagtctctttttcttcttttgtttcagttttggttcccattattacttggctttgatctcataagttttttttttaaggaaacccatttaaggattctacctttggagaagagaatttataaaaacttgacaaaaactctaaccttcaaaattattaatatttgttattaagaaatttaaaggattccttataaaaaacccaccaatggatttgctttaagatccattaagatacttattggaacctggaaccaaatcaaaactcttttttttttttttggttcggttcggttcagttccagttttatggcaaaacctaagtttaggggtaaattggaaaatattcaaaagttttagccaaatatcaaagtttttactaattatcaaaagacacactcgagaaattcataaatgggctaacttttatcagagagcccactaaacaatcggcccgttagccaagaaaatcgtcaccggcgtcttccattccaacatttctccgtcatcgtctctctctctcttttttttttgtgtgtgcaaaacgtctctctctctgtctcataaaatctcagagaagaaacatcgtcgggtcaggtcgaagaaaggagagaaatg

SEQ ID NO: 17850 - DNA, 3003 bp, Unknown; identical to SEQ ID NO: 17849
  misc_feature (1)..( 3003): 2750-1469P.txt file - cDNA_ID_1814276; gDNA_ID_1971823; Annot_ID_176274

SEQ ID NO: 17851 - DNA, 3003 bp, Unknown; identical to SEQ ID NO: 17849
  misc_feature (1)..( 3003): 2750-1469P.txt file - cDNA_ID_1814276; gDNA_ID_2926152; Annot_ID_139369

SEQ ID NO: 17852 - DNA, 3003 bp, Unknown; identical to SEQ ID NO: 17849
  misc_feature (1)..( 3003): 2750-1469P.txt file - cDNA_ID_1814276; gDNA_ID_2926152; Annot_ID_198169

SEQ ID NO: 17853 - DNA, 3003 bp, Unknown
  misc_feature (1)..( 3003): 2750-1469P.txt file - cDNA_ID_1814288; gDNA_ID_1971823; Annot_ID_58368
acaattgaattttttttagatttaatcggaactagacctatgccactaacgatgtttagttaatgttaactgagtgccgtcttggcattgtttgaaacaaatttggtattcaaatcttcaatgagatagtatcatactactaaaaaattgaaacttaggtcttttttggcattgtttccttatatggttaaacattaaatacttacatttcttcttcttgatatatcgtatggtggaggttatatcacctcatttatgttttgtatttaaggatcggtggtggagatctataacatcattcatgtttggttcgtgtctttgtagggagctgttgggagttctcgacacgatggtgacaaggagaatttaacactttgactgagcaagacttgattgattcattctaataaagaaaattatggttgtggaggaggcaaaatcgagaccgcggatgagttcatatataagtagcaatggtggtcttggtatcgacaagtattatccatataaggctgttactggagcttgcgacggcccctcaagattggtagttacaaacttacaatcatagagattaggtatcatgtctaacaaaaaacaaaagtaattcttgaaaaaataaaaataaattgtaagtagcatataataccaagaatgttatgagtgatagtatgagaaccagcctgtgactgttgtcattgattcaagcgatcggaaatttcactttatttatcaataatatatataacattcatatttttcaaaataactatatcttaatagaagtctcacgattcgatacttcgatcgaccacaaccagacgtagtctcgtgtgattgtgtgactaactttaaaaacaacaataatgaaatcaaaacacgaaaatctaattcttacgtccttgttttttaaattctcttacgtcaattcttacctttgcgaccaaaagaacatgttaaatttaaacctactaatttccgatttaaatttcttaatcttgttactatgaaccaaaaattacacaatcttttcccacggaacaaagattatttattagtatccatatacatacaaatatacaatacactcaagccactcatatttcgtacttgatcaagatattttcccccggtaaaatccaatttagaattgtacaacatatatattggaagttccgttgtgtcataccgtcacactaataatacagcataccaataatagagcgcaaacgtttcacattgaatagttcaccacatatcaacttgagtaaattattatgcttagagttgttgtctttttgtttttttattttttttgaatatctggaaattcaaactcaaagaccttacattttctagaggcgggatccacaccagattaaattcatatcctttgggaaagaaatctcttccaacatgcctcaaacccagtatttctaactgagagatttacctacataattcaacaatcatgtctattatgttttcaatttaggatatctaaaaatattgtgaagataaacgaaacaaaacttgagggaaaaaaaacagtcacgtgagtcatgagttataaagcatggataatgttggagatctaattaatctaattgaatgccacatcaaattaagccaatcagtggagaagatcaataataaaagtgaattggatctgccactacacttttagcatgaatatggctaaaagagattggtattggtaatggtatcgttgtcggagattgtcgtaccaattaaataacatgtaattattggatatatattatattgtgtcggcctagtcatatttgatgtgtaagtgcgagtgatttgagttagatatggggtattttacgaggaaaatattgaacaatttagggtattttaagggttgtagtttgagcatcacaagttaattatatttaggttctgcgtaaatttgactcaaaagattaagttatcaaaagaaacctcgtataatatgatccatattaattttcttttttttatatagaaaagttgaagattatgagtaaattggtaaactcgcgatattccagagttcaaaacgtaattttaatgacaatttggtgaatagtataaattaatatattaagtaaaagataacattctattcgatattggtttaatatgtcaactgttatatgtacatataagatgttactgatatattaagtgaataatatgatattcaccaaaaaaaattgtataatgaatgtgactttgagttgaaagtttgaaaacgaagagactataacatttgaaggaatctatggaatacgggtgtggaaccaatagtggaggccctcttcataaaccgagtttcccgagatccaaattgtgctgatggagcggtttctaacgttcttgtcgataatacttgcaagcttggccgaaggaacagaagagttaccatgacgtctaccattacgctcgcaccacaaagtatgaattgattatatggaatacataccttagaatgaaagtatgtagttttggatgagaatcatcaagtagaagaggagagattaaactccaacttgtattgtatctcagtatctgttgcgaagaattcctttagtgagagatgtgtattgataggtgaaaaggaaaaggtctcttactttcatattacgtgggcctcataacatagaccagagctgatagcatacctctctctatattaaatagatgggccaggcccaaacgtttacccatctgtatttattacaaagtacacgtggctgatggacatgtgacgatacgttttgacctattcaaaatattcaaactaatgaaaaagagtcgttgtcctctgacgcgtctctctctatctccttagattttcaaagttttcaacattcaacaaaatcattattttaattttgcagagacgaatcgaatcgatctcatctccaaaaatcttgtattcaaagtttgattttctgggtttcttctgtattatctcgatatttgaaaaaaatg

SEQ ID NO: 17854 - DNA, 3003 bp, Unknown; identical to SEQ ID NO: 17853
  misc_feature (1)..( 3003): 2750-1469P.txt file - cDNA_ID_1814288; gDNA_ID_1971823; Annot_ID_176264

SEQ ID NO: 17855 - DNA, 3003 bp, Unknown; identical to SEQ ID NO: 17853
  misc_feature (1)..( 3003): 2750-1469P.txt file - cDNA_ID_1814288; gDNA_ID_2926152; Annot_ID_139364

SEQ ID NO: 17856 - DNA, 3003 bp, Unknown; identical to SEQ ID NO: 17853
  misc_feature (1)..( 3003): 2750-1469P.txt file - cDNA_ID_1814288; gDNA_ID_2926152; Annot_ID_198160

SEQ ID NO: 17857 - DNA, 3000 bp, Unknown; identical to SEQ ID NO: 6409
  misc_feature (1)..( 3000): 2750-1469P.txt file - cDNA_ID_1814306; gDNA_ID_1621093; Annot_ID_55586

SEQ ID NO: 17858 - DNA, 3000 bp, Unknown; identical to SEQ ID NO: 6409
  misc_feature (1)..( 3000): 2750-1469P.txt file - cDNA_ID_1814306; gDNA_ID_2926160; Annot_ID_139696

SEQ ID NO: 17859 - DNA, 3000 bp, Unknown; identical to SEQ ID NO: 6445
  misc_feature (1)..( 3000): 2750-1469P.txt file - cDNA_ID_1814309; gDNA_ID_1621093; Annot_ID_55585

SEQ ID NO: 17860 - DNA, 3000 bp, Unknown; identical to SEQ ID NO: 6445
  misc_feature (1)..( 3000): 2750-1469P.txt file - cDNA_ID_1814309; gDNA_ID_2926160; Annot_ID_139695

SEQ ID NO: 17861 - DNA, 3003 bp, Unknown
  misc_feature (1)..( 3003): 2750-1469P.txt file - cDNA_ID_1814317; gDNA_ID_1621093; Annot_ID_55583
agagaatgagaatcttcgaaagttcgaattttgaagtggaagatgaagtgtgagtgggcttttatagaccaatgtgattagtttcgtaagaatattgatattagaattaggaccagttcaaaaatcgaacattatccaagaatacgtcgatgttcgaccagcactttgctcatgagtcatgacgatatcaacttggcaaattaatattgtaatcacgtgaaggaccatgcgacatcatcatcatcatttgtggggtaataacataaaactaatgccggcttaagaaaagtgtgttcatttcttaaacttaaatcacatttggaggactcattatagagctcatcacctttgacctgactttatcttgacctgaagctaccaggaatttatatctgaacttttgtttcctttttgacggcgaaataatttgtttagtataagttttgtccattctttacaggtcaaaaacataattaatactaataacgacgatattttaatgtttcctcttgcatgaaaaagcattgaaaatgacggagttgattcactttattggtggctgctttgggctcacattcaacatgtgccaattaagaattctgagggtcgacctacccatcctcattcactcatagcgacaattcaaaacagatctactggggctttaaataagggtaaggccttgttccgaactgggctttagtaagatattataacatttctgttccaaatacagtacatcaaaacttgaatctaacttatatcaacttcaataatcatcaattcatcagttaaaaaaactccttctttcatggtttagtttatcaaagatatgcatttgatttataagaaaacccaaagagtatttgttacctagtcgtccccgggtttcacggggttacaataagagaaacaaaatgggccacataatatttatttatttagtgattctgtcgtttaaaaaaaaattagtttaacacattgtcaaagtttgaactaaggaacttgtaactcaaatactgaaactttaaccattagactacatttttatgcaaattcggccaaaactaaataataatatgattagcggccgcaagcttatgttttgcttgcttggccttgtggccggctaaataacctaagtatataatcaataaattacataaacgaccggataaatcagaacttaattataatgttaaaagtaattaaatgaatgatgaccctcgtcgtctctcctcttaaaacacaataatctcataaatacaatttttatatgaagtcttcacaaactactataaatttcccaaagttgttctctctctttgtccactcgaagactcatggggataagaaggcactcgtgttatgggcttcggggctttttattgttcgccctttcgaggaccttctcacatgtttggacttttgagtctaaatgccttatttcctcacgaatgacgtgaacattttttcgtcctgaactcaaaagtatcaattacacacttcacactactaatggtcaagttttttcgtatttgaaactacaaatgtaagtaatatatgcgataaatttattatcctctgctagtaaaatccattaaaaaaaactaccaatgtgggtgtatgttttctttcagtatatataaagagttttcgcagagagcacatatcgatggtggtacatcaaatctgatcattcatatctaaataattgttgttgagttttctatatgtgtggaacgttagattgcttaagctagaaattgacacaagagtttgatcaccgagttcctgcctcctggcctctaaccggtacgtctcgggtgggaactgtctcccacaacttttcactatcaagcaaaaagtattacaagcactaatagaggtttctcttctccttgttacaaatttagaaattaactcacacacaaaagacaatagaaaaggagactataccgacacgaagactatgcccatatcttcacaattgtgctattatttaccgttctaatctggaaaaaaaaacagcgcacgtaggagaattgggcacgaagacatgaatgggacacataaaggatcaaaagagtcatcatgggtctgccatgatgaaagttaagaaagttccaatacgcgcgaaacaagattgaatgcgacttctctctataccaaaaacgaatctcccaagtcccaagtgaatattgtgagccactaacttgttattaacattttgagacaaaaaaaaaatttgtacgtgtttttgccaaacccacttggccatgaccaatcagaaaaagacaaggaagatgtgtatctatgtgtaatgaggaggccacgccatcagtttacttgcacttttccaactagacgtggcctctcaccgatctcaacctcactttcctctcatttctcaaattttattggctacgtgtttttgtgtttagcgttcaacccaaatatcgatatattcttctttttttttcacatttttaacgatttcgagcaaaataattcgatttatttgtataattttaatatggtagttttacaaataatgaaacgaatgaccaactgatttgttaggtgttacaataaatatggaaaaaatctcataagtttgaaaacatttattctgaggaaactttttcttccccaaaagaaaaaaaaagtttaaagtggaaaaaagaaaaaaaaggaataaaaagtttgaattcagtttttttcttttctttgatagatttctttctacttatttattactctactacacaccacacaaaaacaaaaataaaataagtaatcatagtatcccataaatcagtaaagataaataaaatccagaaaatactgggcctatcattttccttcaccaactctataaatgaagagataatcctacagttacacctcaaaccaactccatctcacttctcaagtcttataatttattcatttctctcttcttcatcgatcttcggcttttagaaaacctaatcagaaatg

SEQ ID NO: 17862 - DNA, 3003 bp, Unknown
  misc_feature (1)..( 3003): 2750-1469P.txt file - cDNA_ID_1814317; gDNA_ID_1621093; Annot_ID_170807
acgtgaacattttttcgtcctgaactcaaaagtatcaattacacacttcacactactaatggtcaagttttttcgtatttgaaactacaaatgtaagtaatatatgcgataaatttattatcctctgctagtaaaatccattaaaaaaaactaccaatgtgggtgtatgttttctttcagtatatataaagagttttcgcagagagcacatatcgatggtggtacatcaaatctgatcattcatatctaaataattgttgttgagttttctatatgtgtggaacgttagattgcttaagctagaaattgacacaagagtttgatcaccgagttcctgcctcctggcctctaaccggtacgtctcgggtgggaactgtctcccacaacttttcactatcaagcaaaaagtattacaagcactaatagaggtttctcttctccttgttacaaatttagaaattaactcacacacaaaagacaatagaaaaggagactataccgacacgaagactatgcccatatcttcacaattgtgctattatttaccgttctaatctggaaaaaaaaacagcgcacgtaggagaattgggcacgaagacatgaatgggacacataaaggatcaaaagagtcatcatgggtctgccatgatgaaagttaagaaagttccaatacgcgcgaaacaagattgaatgcgacttctctctataccaaaaacgaatctcccaagtcccaagtgaatattgtgagccactaacttgttattaacattttgagacaaaaaaaaaatttgtacgtgtttttgccaaacccacttggccatgaccaatcagaaaaagacaaggaagatgtgtatctatgtgtaatgaggaggccacgccatcagtttacttgcacttttccaactagacgtggcctctcaccgatctcaacctcactttcctctcatttctcaaattttattggctacgtgtttttgtgtttagcgttcaacccaaatatcgatatattcttctttttttttcacatttttaacgatttcgagcaaaataattcgatttatttgtataattttaatatggtagttttacaaataatgaaacgaatgaccaactgatttgttaggtgttacaataaatatggaaaaaatctcataagtttgaaaacatttattctgaggaaactttttcttccccaaaagaaaaaaaaagtttaaagtggaaaaaagaaaaaaaaggaataaaaagtttgaattcagtttttttcttttctttgatagatttctttctacttatttattactctactacacaccacacaaaaacaaaaataaaataagtaatcatagtatcccataaatcagtaaagataaataaaatccagaaaatactgggcctatcattttccttcaccaactctataaatgaagagataatcctacagttacacctcaaaccaactccatctcacttctcaagtcttataatttattcatttctctcttcttcatcgatcttcggcttttagaaaacctaatcagaaatggcaacggcgtcgtttaacatgcagtcagtgttcgctgctccttccggtgtattgactacacgcaacatcagaaacacaaaccaactcttcttcaagaggattgctccggtaggagtcagatgcatggctcaggtatatatacactaacctcatagtccttccacttccctacgttacttatttgacttttaatcctgaccgttccttacattgactatttttttagggcgatcctatcaaggaagatccttctgtgccctcgacctcgacttcggccactccaccacaaatgccacagtctcctcctccaccagttagcaagcctaaggtatgatctaatgatcaaagtcattaatatatatcactagctaaaaaaatgaagctaatgaataattttcttattgtctaggtgagtacgaagtttggagatttgctagcgtttagcggtccagcacccgagaggatcaacgggagactagcaatggttggattcgtggcggccatcgccatggagttatcaaagggagaaaacgtgtttgctcagatctctgacggtggtgtcgggtggtttctaggaacaacagcgttgttgacgttggcatcgatggttccgttgttcaagggaataagggcagaggcaaagtcaaaagggttcatgacttcagacgccgagctatggaacggtcggtttgcgatgctcggtctcgttgcgttggccttcaccgagtacgtcactggtgggactctagtctaaagctaaagctttttgtttgctagtttaaggacaaatttggagaatgattatgtaacgcatagattgatttaatactatgagttttaaacagtgtgtcaacatgaatcaaaatttaaaaccatgaaaaaaacattataaaaatttatttgaaaaagtacttcaaaagttttcttataagataatgtgaatggagaagaagaagtaaaaaataaattttagcttctatccaaggtttgagagtttatgcattcttttgaaatgaatcaagagccaagaataattaattatgctcttccttgttattatcgaccaatagagtcatcatgtgtctgccataatgaaagtaaagcaagttccaagacgaaacgaaattgaatgcgatttctctctaacaaatcacctcatctcaattctcaagcccatgggttagtctcatcaaagcccaatcaaagcgtcaatgcttcccaagaacaaaaaaaaatatattaagatgaacaaacaaaaaaacacttaaaagaggaaagatctggccactacaacactacacgatagtacgatcgatgaatataatcggaaagatttgagtggctcaattacatattgcttatacgacgtcgttttgagtagcatcatttcgttaatatttatgtaggagactgaaacaagacagagaaaagagaatctccgaggaaaacaaaagttgatg

SEQ ID NO: 17863 - DNA, 3003 bp, Unknown; identical to SEQ ID NO: 17861
  misc_feature (1)..( 3003): 2750-1469P.txt file - cDNA_ID_1814317; gDNA_ID_2926160; Annot_ID_139693

SEQ ID NO: 17864 - DNA, 3003 bp, Unknown; identical to SEQ ID NO: 17861
  misc_feature (1)..( 3003): 2750-1469P.txt file - cDNA_ID_1814317; gDNA_ID_2926160; Annot_ID_198714

SEQ ID NO: 17865 - DNA, 3000 bp, Unknown; identical to SEQ ID NO: 6441
  misc_feature (1)..( 3000): 2750-1469P.txt file - cDNA_ID_1814334; gDNA_ID_1621093; Annot_ID_55576

SEQ ID NO: 17866 - DNA, 3000 bp, Unknown; identical to SEQ ID NO: 6441
  misc_feature (1)..( 3000): 2750-1469P.txt file - cDNA_ID_1814334; gDNA_ID_2926160; Annot_ID_139686

SEQ ID NO: 17867 - DNA, 3003 bp, Unknown
  misc_feature (1)..( 3003): 2750-1469P.txt file - cDNA_ID_1814342; gDNA_ID_1621093; Annot_ID_55574
tctcagagaaaacgacagataagtaaaacattaaatgtttttctttttcttgacgcccaacatcagctgtgtttttgtatttaggttaaaatgttacatgtatttataggatataaacgataacttaaaacatgtgattttgtgcaaggttttccgaaaattctgtttttatgtttacgaaaaaaaaataaaatctcatatttaaaaagttttctgtttttatcattgtatttacttgatcttgttgacaaaataactattttacttattatttataaaatttaagttaattaatttgtttaagtagtgattaacttactgatatgaatatgattgccactagtatgcttttcttctcaagtcaatatgaaaaatgtgaaattgttagccctaagcatctaacggatactgggaagcatacggttcatgtttgtcactacaacaacaatttttattagtcccttataacatatctcttttactgatcttaagcatcatccatagacaattgcaggatcacaccagttttggatcatctaaattttttttaattttactaaaattcctccagatctaaatttcattaaatcctaagtctaatacattcggtatttgagaaccccgcctttgttttaagatttttaatcataactcataagcgcgtatgaattcggattatccaaaggctaaactacagaaccaaaacgacatagttttttgtcgtttagaatctataagcgcagacaaaagtcaactttagaatcaacccaaaaatagaagtcaaaattaaaaaccaaaaccctaagattttagagtagactctcttcgaatggagaaccactttgttacatcgaaactgatccgtgtctctctacacgaagttgagaaccagctcgaactatcactacgtcaagccttcgagaatctccagccgaaactacgaccaccgttctccttagaactcccagacccacaagagtatcttgagctcaataaagccatcgtctatggagttttatgcgaaccaaattcctctaaaacccacatcaagcacttacatgctctcgtcactgatgggtacgcgtttttcactagtttacttattggaatcgttgttgaattgtatgttaagcttgttgattccgctaagattcagcttatttgggtaactaaggagatgattgatgtttcaagtgtggggattgaggatttggttgtgtcgttgttgcgacgaattggaagtggggattatggtgatcataatgtttggctttgttctgaattagttagtttgtttcttgagaaatgggaatgcttgcttgatgattctccattggtgttgactagtgctctgtatagttttcttcggttattagcggatcattatagggttttaggcgttgtgaaactggagaatgtgaagagattggagatcaaattctgtgttaaaatgtttagagagcagcttcatttaagtttgaagattggacgggaccttatcctgttgttgcaggatctgtctcatgtctctgagttcagagagatatggaacgatttggtgtcgaaccattgctctgagatataccagttgaagacttctagtagatacttccttcttcgaatcactcctgagatggaaacacaattaaggtttttgctaggaaatgttaaattgggaagtcataagcggcatcagatatggttcttgaagaagtttcttttgggtccggagaaagaaacacttttgatagatatagtgagattcgtttgctgtgttattcatccaactaacgaaatcatcagatcagagatcatgccaagatgggctattataggttggcttttggaactgtgtaggcaaaatcatcacatcgagcgaagcgttatgctggctctgttttacgactggctcttctttgacgaaagaatcgataatattatgaatgttgaacctgctgctctcttgatggtatggtcaataccgcagtatccacacatcactcactccttacttgaattcttacttcatcttgtcgaaacttatgacataacccgtcgcgatacgattgtaagaggtttgacgtcagcattcagagaaattgagcgaaaaggagttattcggtcgctggatatattcctagcaaatcctgcacttgcaccagatttgaagaagaagctagcaaatctgttgtcatgtcatcaggagaagacggttcatgtgaatctcaatcaagttagtgttctttctaagcaaacagttctttcttcggaagctaatttaaaagattgcagcaccaaaattgttgatactcctgaccagaagttggacaattccgttgaaaatccagcaaaaaaccataaggttgaactgttcaaagagtttataagaccctcacggtgaacaaaacccttagtctatgttgtgaatcttctataaatcttcagccggaatcgaagctggactctctctactaacgatcaagagactcacactcgagaaaaccatacaatcaaacacttggaacgaagacggagaagaatgacacccacgtgattcagtgattgatcctatgtctcggcgagaacagagactagcaatccactatctcaagtttacaagatcatcaagagttctaccagaggttcacgactaagtgttctcactccaaagataatagaatgaacacagcttagagatgatctttctctattatagttgtaacaaactctcgataaaccaatataatctttaaccattaccggttcaattaaatttttggttaaaagaatctttaaccgtcgatagctctccttactgatatgatccaacggttaaataaaacgtcattgtgtttacggatataactagactaaaacgcagcgttttaaattaaacgactagacccattaacccgacattttgacccgtctttgttcttcctcaatttcaattcgcgttcgatttcaaacctcagcagattccgattagattttgcgtcgatg

SEQ ID NO: 17868 - DNA, 3003 bp, Unknown; identical to SEQ ID NO: 17867
  misc_feature (1)..( 3003): 2750-1469P.txt file - cDNA_ID_1814342; gDNA_ID_2926160; Annot_ID_139684

SEQ ID NO: 17869 - DNA, 3003 bp, Unknown
  misc_feature (1)..( 3003): 2750-1469P.txt file - cDNA_ID_1814354; gDNA_ID_1621093; Annot_ID_55571
ttttgattaataatagttcaataatatgagtactaattattaatttaaaacacaaatgttgtatggaaaaacaaaaacaacaactaaaatgacaaaaaattgttcaaccatcttataaactttaaacgtagggagcattactttatacttgttgtaaaaacgataatgcttattggtaaaataacccatatacattttgatttgtcaatatgttcatatatgatctagtttttgttctcgttgtcgctagatagacaataaaatttcttagtggacagtgattgtggaatgaatatacgcccaacacaaatataaacatcaaattaaggtgcatgcggtatgggaattgcaagttaaatgaacatagttatgcgtaatttcgagaagggattaattgtattaccttgctcgaaataccacatgggccgtgtccccaaaagcccatttaaaatggtttttttttttttttaaatcatctctttagatatttttttcaactctttttcaacaaaatatatagtttcatatagatatttgtatttataataaatgttaaaatgaaattttacacaataattaaaataaaataaatagaaaaaatgttatttgagacagcatatcacatggccttaccatacttcctgcatccattattccattaagaacactcttcaccctcatccacatgcatctccctccccaatttatttactattgatcataattgtacaaacctatacttacaatttatatatgtgtctacgagaaaataaataatattttacagtgttttgtctattattttgttctatagtttcttgcaaacaaaacattacttttcacgcaaaaactgtcgaaatatttataaaaggaaattgttaattcttcgatacaaattgaccattaatatttgatcatctattctagacatctactctaccatataccaaacctttacacaaaaatgaaatattttcatgaaaactaccccacaactggggtgatcgaaaaagcttgatctatatgatcaacatgtccaacactagtttcattttttctactatgatatccgatgatccaatctgaactatacaaaatgtatctagatattttcttgaatcaatccgaataacgaatagttgcaaaacataaacctagcgtgatcgtgtggtagaaggacgaaggtcgagaagttctcttactcttatgattttctctttactcatttgaccgtaagagaaagaaacggctaggatctcgcgtacgcaactggcggagacaaatcaggaccgttgaaaataagaaagaagccgcgtccaaaatctttgtgtcccacctttgtccccttgcctctaacttgcctcctcatgctccccgacaacgtcataattcatatctctctctctctctcgttaaccctaatttcaaagcatctttccttatataaatctctctctctccctcaccattacacaacacacacaagcattttcaaggatatcaaatcacaatcccaagaagagcaataacaagagaagaagaagtagttcaagaattaaggaagagagcttctccgttaaagtatagtgagagaatatggaagtcaccaatgggcttaaccttaaggacacagagcttcgtttgggattacccggagcacaagaagaacaacaactagaactttcttgcgtcagaagcaacaacaagcgcaagaacaacgactcaacagaagaatctgctcctcctcctgcaaagtaagttgagatctgaaagttatagttttaatatccaaacttcttgatatcaatcggtgtactaataatgaatcttgatttgtaaacttcagaacacaaatcgttggatggcctccagtgagatctaaccgtaagaacaacaacaacaaaaacgtgagttatgtgaaagtgagtatggacggagctccatatctccgtaagatagatctcaagatgtacaaaaactatccagagcttctcaaagcactagagaacatgttcaagttcacagtaggtgaatattccgagagagaaggctacaaaggatctggatttgtacctacttatgaagacaaagatggagattggatgttggtcggtgatgttccatgggacatgttctcttcatcttgtcaaaaactcagaatcatgaaaggatccgaagctcctactgccttatgatccattgtctcaaaacaccttttggtcgaggcaaaaacaaattctactttgtttagataaaaaaaagtttggtgtaaagaaagaaaaagcaatagggttacaaatacgttatatagatgtaaactagctttggttaattctgtaaaagatgagttttgattatacgaagtttatatgtatgctcaagatatttgatactaacataaccaataaagtttagtatttgatactaacataagtttgggacatagtgaaagatataaaattttggattaagaaatgggcaatgtaatggatatcactatcgaaagttttcaacttttttttgttttgtttaatattagatggcgagaatctttagtcactacccaataacttgctccaccaatttgggatttgacttgagctcttctcatcgtcatcttcgtcgccttcttttccgatctactttcatcactccttcactcactcagtctccgtaagctcttcttcttcttctctcagtctctgtttttcaatccgaaaattcattactttgatggtgttaccacgaattgagaatcattgatggtattgctttgatgggtatcgtttatatgacagtttttaatccgaaagtttattactttgattggttttttgtttgttctgttttaacgaatttgaagccaatcatatctactaagaacttgattggtttagagttatggatgatgaatctgattaatggaattgttttgcaatcattagtgatttatgagatacttgtttcagttacaagaattggattcgaagatttgtagctatg

SEQ ID NO: 17870 - DNA, 3003 bp, Unknown; identical to SEQ ID NO: 17869
  misc_feature (1)..( 3003): 2750-1469P.txt file - cDNA_ID_1814354; gDNA_ID_2926160; Annot_ID_139681

SEQ ID NO: 17871 - DNA, 3000 bp, Unknown; identical to SEQ ID NO: 6438
  misc_feature (1)..( 3000): 2750-1469P.txt file - cDNA_ID_1814358; gDNA_ID_1621093; Annot_ID_55569

SEQ ID NO: 17872 - DNA, 3000 bp, Unknown; identical to SEQ ID NO: 6438
  misc_feature (1)..( 3000): 2750-1469P.txt file - cDNA_ID_1814358; gDNA_ID_2926160; Annot_ID_139679

SEQ ID NO: 17873 - DNA, 3000 bp, Unknown; identical to SEQ ID NO: 6437
  misc_feature (1)..( 3000): 2750-1469P.txt file - cDNA_ID_1814371; gDNA_ID_1621093; Annot_ID_55565

SEQ ID NO: 17874 - DNA, 3000 bp, Unknown; identical to SEQ ID NO: 6437
  misc_feature (1)..( 3000): 2750-1469P.txt file - cDNA_ID_1814371; gDNA_ID_2926160; Annot_ID_139675

SEQ ID NO: 17875 - DNA, 3003 bp, Unknown
  misc_feature (1)..( 3003): 2750-1469P.txt file - cDNA_ID_1814397; gDNA_ID_1621093; Annot_ID_55555
atgataaagatacgaaacatctgggtgttgggcaagatgtggacgggaatacacctttgcaccttgccgtcatgaactgggactttgactccattacttgtcttgctagccgtaaccacgagatactgaaattacgaaacaaaagcggcttaagagctagggatattgccgagtcagaggtgaaacccaactacatctttcatgaggtatttctgattccgtttcatacaacacatttgatccctcataaatgatttatagcttgacctccatatttttggaattacagaggtggacactggcgctcttattatacgctattcactcaagtggtttcgaatctgttaagtcattaacaatacagtcagtgccactagaccctaagaaaaacagacattacgtcaacgctcttctcgtggtagcggctcttgtagccacagtgacgtttgctgcaggctttacaataccaggtggttatatcagcgatagcaaaaaaccaaacttgggcagggcaactttggccactaacccaactctcttcatttttctgctttttgacatcttggcaatgcaaagttctgttgcaacaatatgtactcttatttgggcgcagttgggtgatctagcactcatcctcaaatccttacatgtggccttgcccttactacttttttcattactatgcatgcccgtagcattcctttttggcgtgatcactgcaattgcccatgtgaaatggcttttagtcaccattagcattatatctggtggattcttccttttcgcaatctttatccttggccctcacgtcatgctacagcgctcacaccttccgcccagttctggtatatttctcaagacttttatgctgactatagacatatctgagttgtttgtgattttgatcaaagcttgttttggttgtgtggcgtgttccgaataaatcatcaaaagtttatagatcaaaggatatttttcttctcttttttttttctttcaaaaagctacgagatatgctggtctctagctctgagaagcggcatcttgatcatacaactcattcgaagtcctatcagaattatctgtagttgtaataaagcgtgaaaagtatatcattcgaagagattttcctctaaaataatcgagtgatattttattattcggtttagtggataccagtttactaatctctcgaatttatgaaccacattcaaaggagatgagtttaacaaaaaaaaaaggtaaattgttttttattctcgtcgtgcgttccacatgagtcgttttcaagagcaatatagacgatacttcacaagaattattatttttgttggggtataaaaatttgaagatacgtttggcaacgacaatacgacgttagattgttccaagaggtgcaaaaacttagggaccctctttattcgttcactgtaaccactgaccacaacatgactaggtagactcttctttttgtcaatgttgatgtttatacgattttgatgagactggctctatcaagatatgaatctctgatcatatctccactaatctttcatcttgttattccctcatttacttttgatttccttctctctctctcttttttatgtatacaaatttttctttatttcgcttcactaaaccccaccatgtaattgtgtgagttttggcgaagtggcgcaacaccgtagagcacaccaacactaacccaatccattttatgaccgtaaattttgttgttgattagtgtatttttttcttgtttagttattctgagaagtaaattttttttttacaattagtttttaaacatagtaaaataaatttatgacagattataatattattttaaaaatcaataatatctaacaaattaaataaacaaatcacaaattactatattttaaataaatattgataattttaattatattattttgtttattggttaactcgcaggatatgcgagttaattcatttgagattgtaatccgccatatactaactcgataaccctgactttttagaaatctaaaagtataaccctataataaaatagattatgtccaactcgcggattctaaacctgaattgacatggcggaaccattcataaaaccataccaattcttgcgttttggaaagttggtttccttttcatttctttgaatttgatcctagattgtgtagttctcaagctcatgctcttgctcgtcaaaaacgtatcaacgatttgcttttcctttagacgttcttgcatcggattggtttactcaactccactcgatgaaaaagttactatcttaaaaagaacaaatgcaaattcaataaaattccccaatatctacgcatgaaaatatgattctgtcttttttttgtttgtctatctttcaatactttaaaaagtgtatttctagaggcgatttgtcatttcccgaataggaatttgagtaaaaaaaaacactctgttttttatttccactaatatcaaatcggcgaatatagttcccaccattcttatctccttgtcgtcactcggaattttttaaataataggatcgctttaataatataatctctataatttatagttccttttccaatattggcgtctccgttgaagctttccacaaatctcaaatttgtttggagactctcaaatgtatccttctctcgacgatgatttcgtctctgatttgttttgcttcgatcaaaggttcgtcctttcgcactcttctcttccttcaccttcctctgttttctctatctctttcgattcagttgttttatcgaatttgatcccttttttcaattgcaaaatcatatctttaatgttcaattcgatttctgtgaaaagtgttgttgtttttttcgcatttcagggggaaaggttgtgtcttttgatgataatttgacgaaccctaatgtatctgaaagctgttaaattgaataggagaagaagtagctttatggatgttgttgtttatatttactcctattgatg

SEQ ID NO: 17876 - DNA, 3003 bp, Unknown; identical to SEQ ID NO: 17875
  misc_feature (1)..( 3003): 2750-1469P.txt file - cDNA_ID_1814397; gDNA_ID_2926159; Annot_ID_139665

SEQ ID NO: 17877 - DNA, 3003 bp, Unknown
  misc_feature (1)..( 3003): 2750-1469P.txt file - cDNA_ID_1814399; gDNA_ID_1621093; Annot_ID_55554
ggtagctgctcttgtagccacaatgacgtttgctgcaggttttacaataccaggtgggtttaacagctctgctccacacttgggcagggcaactttggccactaatccaactctcttcatttttctggtacttgacatcttggccatgcaaagttccgttgcaacaataggtattcttatttgggcgcagttaggtgatccagtgctcattcgctcatccttacatgtggctttgcccttactgctttttgctttactctgcatgcccttggcattcctttttggcgtggtcactgcagttgggcatgtgaaatggcttgtagtcatcatttgcattatatctgttttattcttttcttgggcgatctttgtccttggccctcacgtcatgctacaacggtcatacgtttctcccaagtacgctggtgactttctcgtgacttttatgcagtataaagacataattgggctttttgtgtctttgataaagtttcttttttgtggttgttattaagagtttgtagcctattcaaaggcattcttcgtatgaaaaaatcatcaaaagtttattgatgaaaggagatttttgttctctttcaaaataaaaataaaaagctagatatgatggtctctctgagaagcggtatcttggtagctttaactgatagctcaactcactcaatccgtagtcatcgaacaccgacttcacaagcttgtcgtgcgttatttccgtatctatttgcacaactctacaccatttatcgacggtgttaaatacaaattctttacccaatcgtatcgagagaaggatgaaagaagaatgaggaagacggtgatgaattggaaattccgatgatgtgaaaaactcatgtgaagaagacgagttgaaaaaaaaaacgtttcgtatttcctttgatgatgatgacatggactgttgcatccgacatcatttttttaattgatgaagtgacaagtaagccaccaaacaaacatgaaaatttgcctaaataaatcagccaaataaagttatatgttagtcgcaacatgaatactattacagtaattaaaaacgaaaaaacggcaagttacttcagccgtttagcaaacaaaataaaacacacacacatgattcgattgctaaccaacacaagaaacaaaacaaacacatctttgcctataagataatgtgtataaaccatacaactagtgatgtgacggaggacaatgagaagactatttcattatgctgaaccgtccttgacgtcttagcagttagcactgtaaaatgggttcatatcatagtaaacgaatcactctacacaacaattacatgctaaaaactaagaagctaagttaccaaattctctatagaaatagcaatcacttacaataaccaatgctacataacaacttttgagtccataactgataaattgatagaaactgtttgaatttgcaaacccaaaaccgtttcttaggatggagaaatgggtttgtatttttctatttccgatcaaggaaaaatatatcaggcaacaactgcggaagatagggcattttgggatgaaggaggaaaccatagttaacaagcggaaacaatttcaaaggttgatttcaaagatcataaagtcaaagtcaaatccccatagagagactcggttacggaagtgttggtatccgaatatccgatagtcatagcctcagaacttatgttagaatcaataggtttaaccatgcagtgtgcactttggaaatcaagccaagaaaagctatccacgcaaacaatttgcgttagagcgaaatcggataaagagaaagaaaatataggatttaaaaatcttatagcgagtaagacttatttgaaacatcgtcaaatttacttcttttggtgtatatttctcattatatggcgtatatatctgtttatgtaagaaattgtttccaaaaattactgtatactgactttgtaatcttgttttgatatcaatgaatttataaggaaaaaaataaaataaaaatataaagtatgatgtacatgtaaaaaaagttgtttcaagcgtaattgttttttggctagagaatgaatatacagcaacagtaaactaataaacttgcgatgaactaaaatttctggtattcctacaatcaatgaatcactaatttatctataagttttagctatatccgcttaaaccccgcctcaacttgctctctggtctgggtatagttgggctacaacagtgaaaccgtaattaggaaagaaatgataaaaacccaatccagaagcttactgcaagataaagagaaagatcatgaagaggtaggagtgattcatataacaaacagggtcacgttgtcactttctcccagaaaaatacaaatttagactaactatataaggagacgacttcagagtcttctaatgggttagtataactcgggtcatcttttaatctctggctttaaagacatggtaagattccatatatatgaaaactctgtgtgtggtggattgcttttttcatttaaggcaaagataggttttaaggcagaagacaagaacgacctttggcttatttataggagaccaccactttcacttgagtcgagacagtaacgacatttagaatttgcattactcatcttgtcactttctcccaggaaaaaaaaatacaaatttagaccaactatattaggagacgacttcaaagtcttctaatgagttagtaactggggtcatcttttaatcgccggctttcaagacatgtacaatttcatatgaaaactctgtgtgtggtggattgcatccaagacagttttaagacagaagataagaacggcctttgcttatttataggagaccaccactcctctcgataaccatgactcgagacattaacgacttttaaaactaagggacgaaccttaagcaaaagctcttgcattactcaaattcttctgccacttggtaagtctttttctctgccccttctgcatgcaatg

SEQ ID NO: 17878 - DNA, 3003 bp, Unknown; identical to SEQ ID NO: 17877
  misc_feature (1)..( 3003): 2750-1469P.txt file - cDNA_ID_1814399; gDNA_ID_2926159; Annot_ID_139664

SEQ ID NO: 17879 - DNA, 3000 bp, Unknown; identical to SEQ ID NO: 6421
  misc_feature (1)..( 3000): 2750-1469P.txt file - cDNA_ID_1814415; gDNA_ID_1621093; Annot_ID_55550

SEQ ID NO: 17880 - DNA, 3000 bp, Unknown; identical to SEQ ID NO: 6421
  misc_feature (1)..( 3000): 2750-1469P.txt file - cDNA_ID_1814415; gDNA_ID_2926159; Annot_ID_139660

SEQ ID NO: 17881 - DNA, 3000 bp, Unknown; identical to SEQ ID NO: 6428
  misc_feature (1)..( 3000): 2750-1469P.txt file - cDNA_ID_1814419; gDNA_ID_1621093; Annot_ID_55549

SEQ ID NO: 17882 - DNA, 3000 bp, Unknown; identical to SEQ ID NO: 6428
  misc_feature (1)..( 3000): 2750-1469P.txt file - cDNA_ID_1814419; gDNA_ID_2926159; Annot_ID_139659

SEQ ID NO: 17883 - DNA, 3000 bp, Unknown; identical to SEQ ID NO: 6427
  misc_feature (1)..( 3000): 2750-1469P.txt file - cDNA_ID_1814423; gDNA_ID_1621093; Annot_ID_55548

SEQ ID NO: 17884 - DNA, 3000 bp, Unknown; identical to SEQ ID NO: 6423
  misc_feature (1)..( 3000): 2750-1469P.txt file - cDNA_ID_1814423; gDNA_ID_1621093; Annot_ID_170757

SEQ ID NO: 17885 - DNA, 3000 bp, Unknown; identical to SEQ ID NO: 6427
  misc_feature (1)..( 3000): 2750-1469P.txt file - cDNA_ID_1814423; gDNA_ID_2926159; Annot_ID_139658

SEQ ID NO: 17886 - DNA, 3000 bp, Unknown; identical to SEQ ID NO: 6423
  misc_feature (1)..( 3000): 2750-1469P.txt file - cDNA_ID_1814423; gDNA_ID_2926159; Annot_ID_198658

SEQ ID NO: 17887 - DNA, 2231 bp, Unknown; identical to SEQ ID NO: 6424
  misc_feature (1)..( 2231): 2750-1469P.txt file - cDNA_ID_1814427; gDNA_ID_1621093; Annot_ID_55547

SEQ ID NO: 17888 - DNA, 3003 bp, Unknown
  misc_feature (1)..( 3003): 2750-1469P.txt file - cDNA_ID_1814427; gDNA_ID_2926159; Annot_ID_139657
ttcgatagtattgctcttacgtttttggttatacatttataaaaacaaaaattgtatttgttctattatatacaatatatcaattgactaacgcatgcgcagttggtttggatctctattgatttgcaagtaaattttttggatttatctttctttctcacttcgtttcttacattattagagaatttgacttacatcgcgatgtatgttttacaagcaagtagaatcgatgccactttccttagatattagcgtagtagacaatgtcaatgatcgagaaatatacacaaaagtacctaacttttgtcagcatgaacagatttgaatgatattacgtaattgtagagaagaaacttaccttaaaattaacacctctaaaaggtaagaatgtgttagtagaaaatggctattcatattgtaaaattaaaaggccgtataattagtacagaggaattcgacttggaaacagaaaattagagattaaataaaacacgaattttaaataacggaaataaaactttagtgtaaattatctatacccataatatatatagtaccagaatctaagtataataaagtaaaaaaagaaaaactgaagtagcatccttgaccgtcaccacatcttccgccgctggctgcctggctccaccaccaccactactacattcaccggttcattgtcaataccaccaccaacaggtccttctcctctatcaccacagcagccaggaccaccacagcagacacaagagaatatcatctcatctaccattttgcccgcacagctctcaattaaaactaacacaaaggccaaaacacataggactatcatggtaatataaaaagagttgttcatgttctcttttgtgcaataaggagccaggaaacatgttcttctatttatataatttggttttattgtaacacattagtttcgggtcagctaatggcatgattatcatatagccaaaatagaaccttcattttccattcacgttgcggggaatatagaaccaccaatataccgaggagaaacttctgtatgctcttaagaaatttagtgaaagttagtatggctgaagttaaaagaagaaaacaaataatatttagtattatcaattcatttctatacgtatatgtcattttaatttgccaagctcatatataacactgatttgcagcacaaaacgataaatgatttttcgagatccgaaaatagaaagtggtttttagaacttaaagagtgttatgtctactttgtcgcaagttatagagaatactcaagggcagcctaatgaagaaagattggttaaccaaattaaaagacatccataagaccaagtcctatttaaattaaaaaccaggaccatttctggtagattcaaagtatatcacagtattgaagcaggacaggtaccaaacaaaacaaaaaaaagtagatagatgaaacaacaacttaaaagagagatgttccctttcccttcttgtctccaccgatctcaaagtgcttgcacctctgcaaaaaccacacacaaagtgtaagaaacagaactgagactaaagagtgattaacaaaggtaaagaatgtcgcagacattaccttaatcgggcgttgcgagaaatgcttgcagctttggcattgaagcctcagcacaatcttcttagttgtcttagcctgttccaaagaaagacaaataatgagcaaggtccaattaacaaatcattcctataagacatatttcacagagtcaattctgaaatcctaaattggttctcacatagaagacagtaattagagatcaagacaaggaaaagcgagtataccttcttgtggaagacgggcttggtctgacctccataaccagattgtttacgatcataacgacgctttccttgggcagcaaggctatctttacctttcttatactgcgtcaccttgtgcaaggtatgcttcttgcactccttgttcttgcagtaagtgttcttagttttcggaatgttcacctacagaaaaccaagtttaaaactaccacaagatacagtttcaacagcatacagaattaattacgatcatagaagtgaatctaaatacgcccttcagaacaaaccctaaaacttgttaataaaatttcctgcttctcctaaatcattcagaattaattgctaccatacgatctgactactcaactagtcaatattgataaccattttgtgaatcctacaagtccctgaagtacaaatccttcttaattctcctaaaaatcagaacagaattgcagcaacacaaatgaagatacataacactatatcattttgaatctctggtagattggagctaaaactcttcacagagacgaagtgaactgaatcttcgaatttacaacacagaatgcaacataacagattctaaaaatcacaattagactctaataattctcgatttaagatgcaaaatcagaaataaacaacttaaagaagaagaaaaatcacacagcagatctataatcaataatctcgttcttcaatagtaaccaaggagaaatttagcagaaataaagaaagagaagagagtcaccattttcgctcttcggtgaagctcgtgccgtcgtcttccactgccgcaaaacctttaataaaaacctaaagtaacagagcttataagagagacatttgagaaaaccctaatactacaaacattgggcctctataaacacaaaaagcccattaacttaatcaaaaagtcaggcccatctcacttcccttttttaaaagaaagtaaatatattctagttgccgaaaataaaaattgttaataatcagtggcccgtggacaaaaactagccgtttagagatacaacacaacggttatgtttgtttctttgtttcaaacttcaaacctcgtgaatcactcacaaaccctaatccccttttttattttctctctctctaacgctctctgaatctcaatttcaatttcactctttcgaaacttcttcaacaatg

SEQ ID NO: 17889 - DNA, 3000 bp, Unknown; identical to SEQ ID NO: 6472
  misc_feature (1)..( 3000): 2750-1469P.txt file - cDNA_ID_1814431; gDNA_ID_1621094; Annot_ID_55625

SEQ ID NO: 17890 - DNA, 3000 bp, Unknown; identical to SEQ ID NO: 6472
  misc_feature (1)..( 3000): 2750-1469P.txt file - cDNA_ID_1814431; gDNA_ID_1621094; Annot_ID_170904

SEQ ID NO: 17891 - DNA, 3000 bp, Unknown; identical to SEQ ID NO: 6472
  misc_feature (1)..( 3000): 2750-1469P.txt file - cDNA_ID_1814431; gDNA_ID_2926162; Annot_ID_139772

SEQ ID NO: 17892 - DNA, 3000 bp, Unknown; identical to SEQ ID NO: 6472
  misc_feature (1)..( 3000): 2750-1469P.txt file - cDNA_ID_1814431; gDNA_ID_2926162; Annot_ID_198851

SEQ ID NO: 17893 - DNA, 3003 bp, Unknown
  misc_feature (1)..( 3003): 2750-1469P.txt file - cDNA_ID_1814438; gDNA_ID_1621094; Annot_ID_55623
gattcctggatcagcaggattgattgcagtacaacgaacataaagaacgaaaacaataagagcctgcaaaacaaacacatgacacaagaagcaaaagggtatcagatatgcaaaactaccatgtacctacctagctcttatcaattccttatcattctctaaagcgattctagtacataccacaggagagtaaacaccgagaagaatatactcccagatgcgtcctccaacaaaaggagcgaaaaacgcatagtatgctacactcaataagcagaacaccgtaatcgcaaccacctgtttcatgaccaaacgaaacaaatgaactaaaacccaaatgttagaaattggagaaaatcagagaaaggttgaaataaaagacctgaaatttgtgagcaggaagttgccaaccatgtttcctcaccatttttgcttcctcccaaagcttgaacacactcacgaatcacaaaatctaaacgaaaccctaacgccgccgcaaatcgtaaaaagagacaattttgcttgcagttttgcgaaacccagaaggatataagagaaaccaagctgagaaaatatcttcttggtcttcgtatctctccctatctaactaactatggtaggtcagtcatagtcaagtgacgaaagaggaaagtaaactcctgtaatatattaaattgaaaataaaagaaaaataacgaatgtgaaattagagatgacctaagcgaattcaaagttagcaaatttagagtcgaatagcgaagaaaaagcttactgtgtagccatggcggagaccaaagtaactggagaaggaagaagagagagagaaatggaagaaggaataaaagagagaatttttagaagaaagaaaaaagacaaaatagaaaagcgttgacaggctaaaagagcgagacggacaaatgaaagtggttactggttactattagtaccaacgctggatttttagcttacgtgtctatttcacctctttgatattttctttttttccgtagcaaattttaattatttttaaattatataaccattattaatgataatatggtagcttaaagtattaattaaataatataatttttatataatattaaaaagttctcagtaatacttaaatatatatatattagaaagttatttaatgtctaaatttcagatttttagaagaatttagccaaattaaatcaaatattaaaagattttgctgtttaaaaaggaattaaatcaaaaaatattaaatgaattaaaaacaattatcttccactccacataaaaaaaaagatatgtgagtagaaaagaaaaaaaatattaaaagataagatgcaaaccctgcatttgtaactccataactaaatctaaaagcaagtgactcagagcacaactctcgtacaatttgccctacagttttatttatatttggtggcaaatgtcagctctgttttgatgtgaaagccatcaacatcatgtaattgattagcatattacatatagaatatgagatacccacatatatatagaaaaaatgacggtaaagattaaaaaaaaaagtatacttgatttgtcataataagaataagcatgtatctcatatgtacaaaaatagatttaatgttatttattttaatattcttgtattttttgttttatttgaacttataataaaaaaaaaactgtagatattaatagttatgtaaaaatcataaaaatagatgtaaaaatcatattaaaagttatgataaatttagtttactacataactcttttgaaaaatgtggaaaaattatagtaaactgtatgaaaagaagattatcatacagttaaaattaaaatcttttagaacatgtgtagtggtggtttctaaccaaagtttttaatttactaaagtaataataataaaaaaaatatttaatttgaagagttttttaaaatagttttttcaaatcttttaaattaaaaactttctcatattttcttagaaattgttttaattaaaaaaatattgtttattattttattattattaatgtaggcgagagattttggtaaaaaatcacaatgctgatgcttttaaaataatcaatttttctaagaatacataaatcagcaatgcttctcacacgccaaacgtaaatatagacgcgattatgaaaaaaaatcgcgtcgaaaacaaacgtcattatgtcattacacgtgttaccaatcaaaaagcctttatgtttaattagtaaaggctagtaagagatttacaacaaatgaaaaaaataaaaataaaaacataatccaagatccctaaaaattcccaaaaagaaccctagattttctcctctcacgctccttggttcctcactcgcttttgcttccccactcgcctgcttcgtgttcttctttgctttgctcttttcacgtcagaattttgccttccctccctttgtctctctctgggtggccgagaaaatacagtaaaaagccctcaccaatccaaaagtttgacatttcctgaattttgtagtctcttcatttgaattctcaggttttctcttaagatacattaaagtctctgtcttttatgctgatactaatgaaagttcagttctttcactgaaattttagaaccagaacttttctactactagaagtatgttgtctctgactctcttagtttgagttctcaggtctccttctcttatttgtgtgaaattttactcttttttggctttagaaacagaacttttctactattagaagttatgttgttgaaagttcttcactttcatttgattccattgatttcatattgctttgtgtgtttcaagtttgatgtttttaggtagaagatgtcgcgctggttcttatgaagtttggttgtgacatttttcaggtgctaaggtggattatctagtagaaagatttcagtttccaatttcatggaagcccatagtggggtagttgcttttgagtgtgttagtgaatccatatgtggctaaggttaggatg

SEQ ID NO: 17894 - DNA, 3003 bp, Unknown
  misc_feature (1)..( 3003): 2750-1469P.txt file - cDNA_ID_1814438; gDNA_ID_1621094; Annot_ID_170900
aggtatctagctttggaagaaggagattctcaagtactgcttgagtacttcaagcgtatcaagaaagaaaaccctaaattcttttatgctatagacctgaacgaggaccaacgtttaagaaatctgttttgggctgatgccaagagcagagatgactatttgagtttcaatgatgttgtatcctttgatactacttatgtcaagtttaacgataagttgccactagctttatttattggggtgaaccatcactcccaacctatgttactaggctgtgcattggttgctgatgagtctatggagacttttgtgtggctgataaaaacatggctacgagcaatgggtggtcgagctcctaaagttatactcactgaccaagataaattcttgatgtctgctgtttcagagctcctaccaaacactcgtcattgctttgcgttatggcatgttttagaaaagattcctgaatatttctcacatgtgatgaaacggcacgagaatttcttactgaaattcaacaaatgcattttcagatcttggacagatgatgagtttgatatgaggtggtggaaaatggtcagccagtttggacttgagaatgatgaatggctgctatggttgcatgaacatcgccaaaagtgggtgcccacatttatgagcgatgtgtttctggcaggcatgtcgacatctcaacgttcagaaagtgtgaactctttcttcgataagtacatccataagaaaatcacgctgaaagagttcttgaggcaatacggtgtgattctgcagaataggtacgaagaggaatctgttgcagatttcgatacttgccacaagcaacctgcattgaagtccccctcgccctgggagaagcaaatggcaacaacttacacccacacaatatttaagaaatttcaagtcgaggtcttgggggttgtcgcttgccatcctagaaaggaaaaagaagatgaaaatatggcgacgtttagagttcaagactgtgaaaaagacgatgactttcttgtaacgtggagcaaaactaagtcagaactttgctgcttctgtcgtatgtttgaatacaaagggtttctttgtcggcatgctttgatgattctgcagatgtgtggtttcgccagcatcccgcctcagtatatattgaaaaggtggacaaaagatgctaagagtggagtattagctggtgaaggagcagaccagatacagacccgagttcagcgctataacgatttgtgtagtcgagccactgaattgagtgaggaaggttgtgtgtcagaagaaaactacaacatcgcattgcgcacactagtcgagaccctgaaaaattgtgttgatatgaataatgctagaaacaacatcactgagtctaatagccagcttaataatggtactcacgaagaagaaaaccaggtaatggctggggtaaaagcaacaaaaaagaagactgtatataggaaaagaaaggtatgcttttactgaagcttctcgccaatctaaacctacgtacattttcttagcttcaaaggttaaaaagaagatactcaaattgatcttatgcagggacaacaagaggctagccaaatgcttgaatctcaacagagcttgcaaccaatggtttgtgctttgatttgatcttctctaattagtttgatcattgtaactgcacattgctttatgagattaagagtaggatgtcttggatatatggccttatagttttaacattttgtgcaggaaactataagttcagaggcgatggacatgaatggttactatggtcctcaacagaacgttcaaggactggtatgctatgttagttgattaatacaaacctggttaagccattcgacatctattataaaccctaatactaaacctgtttaaactgtggatatagttaaatttaatggagccacctcatgaaggctactatgtagatcaacgaaccatccaaggcctggtaggttacatatagtttaaatgcttgaatctcccaaatctgtgctagagtataagtcaacgacatgaattttggttcttttgactcttcagggacaactgaattcgatagcaccggcgcaggatagcttcttcacgaatcagcaagccatgtctgggatggtggtacattataaaatccttcaaactgattttaaaaactgtgttatgaatgatcgtgttgttaacatcttttgtttattgtccggtccagggtcaaatcgatttcagacctcctcccaatttcacttacactttacaggtctcagctgcctggataaagtctttactttagtatcattttgtactcgaaccacacgtgttgatatcgttaaatcttttcgttattccaggaagagcatttgagttctgcccaattacctggtagttcatcaaggcagctatagtagcaacacgttttgattactttggagagaagttttgtctcaggaaacatttgcaagaagctgttccaaacatgagaaaaacacaagatctttcatggagctgagttgcaatgacaagatgtaatcttttcttaaattggtttctgtatattatgggattgccttatgatgtattaatgtgggatgaaatattgtgttatctgattgaatgtcttgagatttaatagatgcacttgtaacaacatctttatctaaacacatagaaatctatcctctgtgtattagtcaaacaagtaattttgagatcacattaaatcaaaattgttaaaacaggtttcaacttatttagtagaaacaaaaagttatttttagattaaatgtggttaatttggttaaatacacattccctggtcgttgtcgtatgtaggtgtgtcccttttgacaaaacaaacaaacagaaaaggtttctttattcagacaacatcaaaactggggaagaaccaaaactaatagagttggtcaaaagaaacatttgcaaaaaaaaaaaaagagaggcaaagatctcgagagatttcaattttcaatg

SEQ ID NO: 17895 - DNA, 3003 bp, Unknown; identical to SEQ ID NO: 17893
  misc_feature (1)..( 3003): 2750-1469P.txt file - cDNA_ID_1814438; gDNA_ID_2926162; Annot_ID_139770

SEQ ID NO: 17896 - DNA, 3000 bp, Unknown; identical to SEQ ID NO: 6483
  misc_feature (1)..( 3000): 2750-1469P.txt file - cDNA_ID_1814442; gDNA_ID_1621094; Annot_ID_55622

SEQ ID NO: 17897 - DNA, 3000 bp, Unknown; identical to SEQ ID NO: 6483
  misc_feature (1)..( 3000): 2750-1469P.txt file - cDNA_ID_1814442; gDNA_ID_2926162; Annot_ID_139769

SEQ ID NO: 17898 - DNA, 3000 bp, Unknown; identical to SEQ ID NO: 6463
  misc_feature (1)..( 3000): 2750-1469P.txt file - cDNA_ID_1814446; gDNA_ID_1621094; Annot_ID_55621

SEQ ID NO: 17899 - DNA, 3000 bp, Unknown; identical to SEQ ID NO: 6463
  misc_feature (1)..( 3000): 2750-1469P.txt file - cDNA_ID_1814446; gDNA_ID_2926162; Annot_ID_139768

SEQ ID NO: 17900 - DNA, 3003 bp, Unknown
  misc_feature (1)..( 3003): 2750-1469P.txt file - cDNA_ID_1814462; gDNA_ID_1621094; Annot_ID_55617
ttgaggagatggcgaaagagattgatgaatgcaaagcgatgtggaagaggactggctgttctattttggttgaggaactgaactctgataaaggctttaaagttcttaactttttggtttattgccctgaaaaggtagtgtttctgaaatctgtggacgcatctgaggttttatcttctgctgataaattgtttgagctacttagcgaactggttgaagaagttggcagtaccaatgttgttcaagtgattacaaaatgtgatgattactacgttgatgctgggaaaaggttgatgcttgtgtatccttctctatattgggttccttgcgctgcacattgcatagaccagatgctcgaggagtttgggaaacttggctggataagtgagactattgaacaggctcaagctatcacaagatttgtttataaccatagtggtgttttaatctgatgtggaaatttacttctggtaatgatattctgctaccagcatttagctcttctgccacaaattttgctacattgggaagaatagccgagctcaaatccaatctgcaggctatggttacttcggccgagtggaatgaatgttcatattcggaagaaccaagtggattggtgatgaatgctctcactgatgaagccttttggaaggcagtagctttggtaaaccatttaactagtcctcttttgcgggctttgagaatagtttgttctgaaaagagacctgcaatggggtatgtctatgcagcattgtaccgagcaaaggatgcaatcaagacacatctggttaatagggaggattacataatatactggaaaattatagatcatggtgggagcaacaacagcatattcctttgcttgctgctgggtttctttcttaatccaaaactcttttataataccaacgaagaaaatccgtagttagcttattctatcggtgcccgattgcatttgagagattggttcctgacgacaagattcaagataaaatcatcaaggagttaacctcccacaaaactgctggtggagtttttggaaaaaacttggcaataagagctcgggatacaatgcctcctggtatggttaattttcctgattttcttgtataaatcttttcgcttgtacttctcttacttgactctcgttacattcttgtttcttagctgagtggtggtctacgtatggagaaagctgcttgacctctcacgttttgcgatacgcattcttagtcagacgtgcagttctcagttagctgcaggagaaaccagatacctgtcgaacacatataccaatcaaagaactccattgagcaaaaacgactcagcgatcttgtatttgttcagtacaacatgcgcctcagacaactgtaagtcttagatcttgtcccatctcagccaactgcattgtttccaaggaataagaaagtatagaaataatggttctatgtcttctctaggggtcctggaagcggagatgacacactagacccgttgtcacacaacaggatagatgttctgaaagaatgggtttctggagaccaagcttgtgtagaaggaaatggaagcgcggactggaagtcgcttgagtctattcataggaaccaagtagcaccaatcattgatgatactgaagacttgggttcaggtaaaaagatttagcatcctcggacaactttttttgtgtgtttcgaagattttagattttaaaagttgaaatgaatgtgtacaggtttcgatgatattgagatattcaaggtagaaaaagaagtgagagatgaaggttattatacaaacacatcggagaagttattcacgtaagattgatcatggttggtttaagcttcttcgtcgatgctttctgacttacatgaagctgttgtagtcataggtgtcgatttgtaacattagagtcttccctttagaattatctcttctacaagacgtttcagtattcttattcttcttactctgcattgtcctattaggtttccatagagtttgggttttataatcaggttctgtccagatttttaagttgtttgacaaatatatttaatatggtcatgaaatctaaatgcctattttctttcatatatatatttgatggctttgttagaccatctgttttattactagcataattactccttaattcttgtcaagtttttgaccgatatctaagcatacacaacagaaggacctctcacaatgtatgatccattcgaccaaaccatagaaactggaaggtcattgtcagagattgtaatggtgagaccttgaatttcatcagtttagaaaccaaagacatttcagtggcccatattatatgcccatacggcccagcccattaagaaacaattggagcaatcggagaaaaaagagccagagataagctaaaaggtctacgatagttccatcggacatcggcggcgacatgacttcttcggcggcgatcagatctgacatctacgacagagaagaacgcaagcagttaatcttccttctttcgattcttcttcttcttcattctcttgttcactgtgttcgaattctgtcttctttctcttgattgctcagtcgtgtgtgcaggcaataccaagcacatattcgtggcctgaatgcttacgagcggcataagaagttcttgaaagactacggtactacacgtctttcaatctccttgtaaatgtctttggatttgttagctcgataattaggttttaataatggacaaaaagtttgggaaatagggtaaataagtggctttctatttatccaaaatccatattgtcccaaatcaaaactggttgatgaacagtcttctcctctgagctaggaaggagggctatagtcagccttacatgtcttatttgtggttccattagaaagagtattctttaccctggagttagctactatttgaggagctgttggtgttcttgtttaagattttgtagtttcattctttgttttgcaactttacagttcgattttatg

SEQ ID NO: 17901 - DNA, 3003 bp, Unknown; identical to SEQ ID NO: 17900
  misc_feature (1)..( 3003): 2750-1469P.txt file - cDNA_ID_1814462; gDNA_ID_2926162; Annot_ID_139764

SEQ ID NO: 17902 - DNA, 3000 bp, Unknown; identical to SEQ ID NO: 6460
  misc_feature (1)..( 3000): 2750-1469P.txt file - cDNA_ID_1814470; gDNA_ID_1621094; Annot_ID_55615

SEQ ID NO: 17903 - DNA, 3000 bp, Unknown; identical to SEQ ID NO: 6460
  misc_feature (1)..( 3000): 2750-1469P.txt file - cDNA_ID_1814470; gDNA_ID_2926162; Annot_ID_139762

SEQ ID NO: 17904 - DNA, 3000 bp, Unknown; identical to SEQ ID NO: 6459
  misc_feature (1)..( 3000): 2750-1469P.txt file - cDNA_ID_1814474; gDNA_ID_1621094; Annot_ID_55613

SEQ ID NO: 17905 - DNA, 3000 bp, Unknown; identical to SEQ ID NO: 6459
  misc_feature (1)..( 3000): 2750-1469P.txt file - cDNA_ID_1814474; gDNA_ID_2926162; Annot_ID_139760

SEQ ID NO: 17906 - DNA, 3000 bp, Unknown; identical to SEQ ID NO: 6469
  misc_feature (1)..( 3000): 2750-1469P.txt file - cDNA_ID_1814498; gDNA_ID_1621094; Annot_ID_55606

SEQ ID NO: 17907 - DNA, 3000 bp, Unknown; identical to SEQ ID NO: 6469
  misc_feature (1)..( 3000): 2750-1469P.txt file - cDNA_ID_1814498; gDNA_ID_2926162; Annot_ID_139754

SEQ ID NO: 17908 - DNA, 3000 bp, Unknown
  misc_feature (1)..( 3000): 2750-1469P.txt file - cDNA_ID_1814502; gDNA_ID_1621094; Annot_ID_55605
tctcttaacccttgcaaatttctttgaatttataaaaatgtggtttaccttcacaacgtccattaaaaagttctaggtgactgatccatattttgttacctagtattttctgctgataaaaaaagacgtctattatgattgccattagattagtggatgttacatgctccacttagaaccttgtacctttttttacccaagttagacatgttgtggccggaatcctggtatgaagcgtcaacatacagtgacttgttgacgggcataactgaattctaaaagacaatgagtataatgtcctgtgtgattcccaagtatttatgtcgtttaccaaagcattctgtttaagataatttcttgttgatttcagctctccgaaggtgtcaagaagtatgttggtgtcaaacatgagttggaagctggattttcatggtctctagttcatagggaatgcacaaattcagatttatccttaagtggacaccctcatattgtggaaaacaattccaagcttgcattagctttgacagtcatggatgaatgctttctgcccattattgacaggaggagtggggtgaatatagtacaaaatgtcctttacaattgtgggtaagcttttcagcactgcaaaaaattttgtctgcgtaattttactacagtgattttctttggtatttctttgtgttggttcgtttgcttatacattgcttttcgtaggtccaacttcaatcggctgaactttggtggattctatactgctcttcttgaaagaggcgacgaaatagttgcttcagcatctattaggttattcccctccttataatcctttgttttagtttcaatcctatatgtgagatggcaacaatatggcagagataaagctagtgtcaagatatatttgtctgtgcatgcttatcttatacacttgatttcgtttactttgatgcatttttttcctgtttaagggatctactgcttagtgatgatatttgcttttctctttagatttcatggtaaccgtctagctgagatgccgttcattggaactcggcatgtctacagacaccaagggatgtgccggcggcttttcagcgtagttgaatcagtaagttcaaccgctgatgtagcgaagttaactgactctttctgtataactctgctaatttgttttctggttctctgtgtcttttgatgtgaaggctcttcaacatctcaaagtcaaattactaattatccctgcaactgccgactttagccatgtttggatatccaaattcgggtttcgacaagtcgaggattctctgaagaaagaaatgcggtccatgaatctgctaaccttccctggcattgatgtgttacagaaagagctgttagcaccacgacataccgagtctgctgtcgacacaggttttactttaagaacaatttagcttcttcttcttcttcttcttcttcttcttcttctttttcgttcctatcgatattcttactttggctccattgtttgtcaagaagactgtgacccatgcaatgaaggcactaattcagcgatcaagactaatgaagtttccgtcttggagaccacatcaccgtcaagagataaaccggtatcagattatttggtcgaacaccaaccatatgaggatgtaagttctgcttcccgggatagtctagtccacgatggttaccccaaaatgctagagactgcgttcaaaacttcaaccatggcgagatcatcagatatggagaagcacatggactgcaaaacttcctatagtcgatttgatggagaagatgaggaagatagtttaattgagtctcctcctcaacgaaacagcgacatggctttcttagatcacatcatccgctctccggtagacactggtgcaacggaaaacagagatgtctatggttcaggggatgacgattctccggaaacgcaatgaaacagagttgaaatgttgatcttgtctttttaagcattttggtgtctagttcaaacaccggaatcgctttttgcgaatagaatttgttaataatgtctatatatatgttttatgcataatatgtaaatgttcatggccttgagccttctctcgccgccaagcttcacgacggtgaggcttttttgccctctttattgcgctgatcttctgtgttatcatctcgttggttcctcttactaattgtttttatgaagcattgatctaatgactcgagacaatttcttacatatgtctttttttaatctttcttttctatctaaaaaaagagatattttagaatacctcaaatgattatcgtcaaagcctagtttcatctctctctctcaatgccttgctcgagcatcgatcacgtcaagcgttacactatcagtgcctcgctgaccaaacaagctacgagagaaggcgaacgatgtcacgtttcaaatttttgtagtgtcgtagcaaattgagtttattaagaaaaacgctgatgtcactaatggaatttgctggaagtttgtgaaaaaaactgatatttgatcaactctatattcaaaaacaaatagttcatttgaaaaaattcagccaattcttcgctactcacccaaatgatatatcaatatacaactcccttttcaactaatgcagactatgcagtcaacattttacatttccatcttttctgtggctatatgaagaaaaaaagagaggtattttagaatacctcatatgatttttatacacagtaaaacctctataaattaatactcaattaagaggtagcactgctttgttctcttctctgtctctctctcagtgcctttgcccgaagcatcgaacacgtcacgcgttacacttcacagtgccttcgcagaccatcaagctactagagcaaaggcaatcacttgttctcatattttttttaacgacacttgaggttatacgacgtcgttatagtttaagtaacaaaatcaaaatcaagtggtctttctctactcttcctaaccatcgcatg

SEQ ID NO: 17909 - DNA, 3000 bp, Unknown; identical to SEQ ID NO: 17908
  misc_feature (1)..( 3000): 2750-1469P.txt file - cDNA_ID_1814502; gDNA_ID_2926162; Annot_ID_139753

SEQ ID NO: 17910 - DNA, 3000 bp, Unknown; identical to SEQ ID NO: 6455
  misc_feature (1)..( 3000): 2750-1469P.txt file - cDNA_ID_1814506; gDNA_ID_1621094; Annot_ID_55604

SEQ ID NO: 17911 - DNA, 3000 bp, Unknown; identical to SEQ ID NO: 6455
  misc_feature (1)..( 3000): 2750-1469P.txt file - cDNA_ID_1814506; gDNA_ID_2926162; Annot_ID_139752

SEQ ID NO: 17912 - DNA, 3003 bp, Unknown
  misc_feature (1)..( 3003): 2750-1469P.txt file - cDNA_ID_1814512; gDNA_ID_1621094; Annot_ID_55599
cgtgttctagagctgcccttgaagtcagacgctgacgtggctgttgaagagagtcatgactgcttcaggttcgtcgcggaaacagacgggggaggaggaggaggtgtgagggcttacatggttgagattcatcctggtgtgaccaagattcttgtgagaaccaatggttcatcgtctcttggtttgtcgcttgatgagcttgagcttgacgtgtggcgtttcaggctaccggaatcaactaggcctgagctcgttaccgtggattgcgacggcgatggagaattgattgtcactgtgcctaagattgaagacaatggtagagatttgatagtgcttgtacagtaatctaatgtgtttgtgatcaaatgagaaaaatcttgactttttttatctaatggttatcaaagttaagatctttttgtttctttatgaaaatatggatacagagtaggttttgccttatgtaacgtaacatcaattggttttagttttagagataaaatcctttgagaggggcaaatttattgaggatctctgattcacgtttaagagcattgtctttcttcatttcccattcaggtttcttcaagttagctgcttgaacttcttgaaccactttagggattgagttcgctaccatcttctgaccaaagattagatcaaccttctctttccccttgttactgatgcagcgggtaagctcggttcgtttagcttgaagctgagcgatttgctcgtcaatttgacggattgtctctgagtttctatcgacttccgtttggatattgcctagcttgtcctttaagtcgctgtattcgtacttgagagatgcgaccttcgctttgttaagctcgagagcggagaagaacctatctgcttctactatcatgctttggttctcttgaaaaacttcgctgaaagttggaatttcttcgattagcttcaacctcactatttcttcagctgataggcttggatctttcttgagtttagctgccaagcttgccatctccgtagcttcattagacatgaacaaggaagagaaatctttctccagaagcgatgaaagcttcattcgagcttctgtccattcgtaatctctcactggagagcttgcactaacgggaagtgatgatgaagactcctgtcctgcttctgaaggctgttgctgaagaagattctctagagagttcagataactgtcaaactcttctgggtttatatccacaggagggtgagagactgcaatgacaccgttcatagaagaaacatagatatgcggaacaaaagcctcttcttcttcttcttcgtctgcatagttacctctgcgtttcttcatcctcttgctgcctttctttgcatctgattccttgttttcttcagtcaagtcaaacacatcaccttgttgctgtcttgtgtaacgtttcgaggaagattcccgagctgacttatgttcagcagctggtgttgttgtggctgtctttttcctgttgctagctcgcggagttgctttaggttcattagtctgtatctgcacctgttttctcttcctctggctgtaacgcgaagttgatccttctttttttacatcctcagcatcctcatcttgattctgtccttctttggatgtctcttcaaacagagacgcagcatcaactacagaaaaaaagaaacatcattcatgtgttgcagatagagttttatggctgacgcaacagaagagtgttagttgctacctctttctgcaggctgaaacaaagccggaatgttccaggtaaaagatgcaaagaatgcattagcatccatatcagggaaactagtttcgagataacgcgaaagagtgtttttgcttgcaaaagatttgggtacattcttgcccttaagcctctccgggagaatgagtaagcgatccttatggaacccggcattattcactctcctcccaactctccaagtccaaacatcgccggggctcgggaaatcgacaggtgcaaacggcaaaccttgaccactagaagctggcggaatcgccgggagttgattcaaatcagtgaaggagcttctgtcaccattaaccttcacatcatcaccatcaccatcactgttgaatccgttttcccgataatagtcattctcaaccgggactggttcagtctccttgcttctattactcattgacactactgattcaccatcaaatctgtgcagattcataaatgtgattgaatcaaataacataacttaactaattgctttgcagttataatcacatatattcattactctattcccaataacaaaacaaaatcgatcatgactcaaagtttcctagaatcaatgcagagaaacctatacagaagtgtaaacatattgatagttcttaatgaattgaatttacccaggagaattttgacctatctcttgatccatatccatcgaagcagaccaaaaaccctaattcctgcgatagataaacacccaaataaacaaagcaaaggatgaattctaatctataacaatgttaagggaacaaacccacacaaattaaaagttaagttgattagaaatttctccagaatgcagataaagatacgaactttggagagtcaagaacagagtagccgatcttatgcttcaactacaacagattacaaatttatcaaactcattcgtttcttatatatcctcttttcgatcagattagtcctacaaacagaggtggaataacagttatacccttttagtttgtttttgtttacacagatgaagattgaaattacgattataccgttcaatgtttcttcttcaccgacttgaaagctatgacctttccgatcaccggcgttagttatgagcctcctctccgcggacgcacttgggttacttctcaagaatgcaatctccgcgagttccatgcgtttgggtcgcgtcgttcacgcaagaatcgtcaaaaccctcgattcaccaccacctccgtttctcgcgaactatctcatcaacatg

SEQ ID NO: 17913 - DNA, 3003 bp, Unknown; identical to SEQ ID NO: 17912
  misc_feature (1)..( 3003): 2750-1469P.txt file - cDNA_ID_1814512; gDNA_ID_2926162; Annot_ID_139747

SEQ ID NO: 17914 - DNA, 3000 bp, Unknown; identical to SEQ ID NO: 6452
  misc_feature (1)..( 3000): 2750-1469P.txt file - cDNA_ID_1814522; gDNA_ID_1621094; Annot_ID_55596

SEQ ID NO: 17915 - DNA, 3000 bp, Unknown; identical to SEQ ID NO: 6452
  misc_feature (1)..( 3000): 2750-1469P.txt file - cDNA_ID_1814522; gDNA_ID_1621094; Annot_ID_170858

SEQ ID NO: 17916 - DNA, 3000 bp, Unknown; identical to SEQ ID NO: 6452
  misc_feature (1)..( 3000): 2750-1469P.txt file - cDNA_ID_1814522; gDNA_ID_2926162; Annot_ID_139744

SEQ ID NO: 17917 - DNA, 3000 bp, Unknown; identical to SEQ ID NO: 6452
  misc_feature (1)..( 3000): 2750-1469P.txt file - cDNA_ID_1814522; gDNA_ID_2926162; Annot_ID_198815

SEQ ID NO: 17918 - DNA, 3003 bp, Unknown
  misc_feature (1)..( 3003): 2750-1469P.txt file - cDNA_ID_1814533; gDNA_ID_1621094; Annot_ID_55592
atgttttgatgaaacatatatcgggtacttcatgcttcatgcttgagcgtttgaatgcatgaaagctagactcgttcggcctaagtgcgggactagccgatcttggatttttttaaaaaaataattaataacaagtttatatgaattatattgcatattatgattttttctaagtgtcttttgattgcgagatgtctacgtatcgttttgtgattcacaatcctaactcaatcaagatttctgtgtcgattttttacgcatgtatgaattagataagtttgtagttgacaattattttttgaaaaacggtattttctcgtaataatttttttgtccattcctcttagattgatgtgaataattgtaatatatatttttgggctgaccttggactttgcaagtctctcgtcttttctctttaagtacaaaaaagttggtatgcaattcttttgacttatgtactcacgaatcaaggtgaatttcaactttttcattttttcatatcaatatattgatttcaatataacaaagtggagccacgccgatatatataatattaagacttgtttttctttatcaccaatgtccggctccttgaagagataaacaaaccatgttataaaaagaggatgtctatttgagctttttagatgataatatatgttttctaatagctagtgttcgaaggtgagaatgttatgtttatatatatcacatcatccccgatttctactttggatcttaaagaaataataccgttcactcataaccggataagtggaagctgttattcactagatatggtatattggtattactattaaccttttgaagtcaagtggagatttaactgcaataaattttggtcataccagatacaatgctagataataaaagcttgacatggttttctaaatgttaatggttttgagagcgcgtacatatgtagattgatgaatggaagcttgacatgctttggtcaaagaaagaactgcaactaataatttgatattggctattatattaaggtgtttagaccaactatactacttataggtttatgaagtcaaatgtttttgacttttcagtaagatatacatgtacatgtcaatcttacgtatagatgtgtattgcgacacaaaacaatatatttaagattgggtttgatcacatcttggaccgggctccttcaaaacaatttatgtttgtttgtattgtattttcaactttttaaaaaaaaaatagttcaaaaaaacttgggaaccccgggaaaacatgtacacacgggttcgtggtaagattttttagaaattacctaaacataatagtttgaatggtttctatatgttaaatgtatttcagtatgaacccaagtgataaggcgcaatggtaagttgggatacattatgtagacacttcagtgtgtacgttggatttctctacgtactaaaatctttagtataaagatatttatttcgtagacttactggtttgtcaaagtcttaagtaccgtttgaaccgatcaagcaggcgactaaatcttctgccttaagtttttatgggtcttagtttgggccatccatgtaaattgggcctcaagatctcagtttgtagtatatgacaagccttaacatttgataacatatgtactcaatttaaaagaaaactattttgtttttgttcaatggctaataatatgtatttcctgccaaattataattttatatgtatgcattatcatacattatatatgcatttaatatttctatattatatagacatatttttcttttttaaaatgttaaaatattacaaaactgaagatataaatgtttaattctgtttagatatatatttcaaacacaatagatatatacattatcaaatagtggatatacactttaatatcctacgcgatatagttggaaaaaatatagaaaacaagaagataaagattaccatagatttaatctcttagatctttagagattaaaacctaattgaaaattcaaacaattagaaggtattgaatttaatattttcaatatctctaagaacaggtctaccaatagcaaaacacataatccaatttttgtttttaattcagttttttggatatgatttagatgggaacgattcaatttatcagatagattaaaaaaataaatgtttttatgatatttacttcctattttaaaaaatccaaaaaccaaagatatgttttgatgatatttctttaagaaatatttgagagaaaaaaacaaataaatacgtatccttaaaagaagcctgaaagaaacagcttctgttccgtctttcactctccatctctcttccgtcgtttcctaagtccttttctcttatttagagattctctcttttcatccaaaaaaaaggagagatatttcagaaacaatcctctgcttctggagataaatctcgctcttttagcctcataatccaaaacccaccattaaaaatcctctctttcgttccctttgaacccatcaatttcagtttgcttattacgtctctgttctctgcatgtccttgtggttgatacagctgacttttggttttgtcgtttatgttaattgaattttaatatttgatcatcgttgtgctatattagtggttaacgagtcgttttcttaaggtttactttttcgtattgtcacgttagattttttaggctacaattgtagagaaattcattatctgaatgtcaaaccatgtgcatgatctttgagaaagtttggtgattaatagtttcttcattattaaagctgcctttgtttaacttagcaatcataagattgtttttgataacttttgtgtgatttaactattcactagtaataatctgaaaaaattagtactagatttcatgatgatgatgaaaagattgatgatttgagtcacaaaatcttgttttttgaaagttgtgtgatcttcttgtttgcatagtgaattagttttgatttgaaaagattttaagtaatg

SEQ ID NO: 17919 - DNA, 3003 bp, Unknown; identical to SEQ ID NO: 17918
  misc_feature (1)..( 3003): 2750-1469P.txt file - cDNA_ID_1814533; gDNA_ID_1621094; Annot_ID_170852

SEQ ID NO: 17920 - DNA, 3003 bp, Unknown; identical to SEQ ID NO: 17918
  misc_feature (1)..( 3003): 2750-1469P.txt file - cDNA_ID_1814533; gDNA_ID_2926160; Annot_ID_139702

SEQ ID NO: 17921 - DNA, 3003 bp, Unknown; identical to SEQ ID NO: 17918
  misc_feature (1)..( 3003): 2750-1469P.txt file - cDNA_ID_1814533; gDNA_ID_2926160; Annot_ID_198729

SEQ ID NO: 17922 - DNA, 3003 bp, Unknown; identical to SEQ ID NO: 17918
  misc_feature (1)..( 3003): 2750-1469P.txt file - cDNA_ID_1814533; gDNA_ID_2926162; Annot_ID_198810

SEQ ID NO: 17923 - DNA, 3003 bp, Unknown
  misc_feature (1)..( 3003): 2750-1469P.txt file - cDNA_ID_1814544; gDNA_ID_1621094; Annot_ID_55589
aagagttaaattgaagtaagaaaaaaaagtcatgaccaataatgcactaattactaaagcacaagaagaagaaaaatcatcaaaatcatcttttatagaaaaacaaagaacttttattgttttcgaccaattaaacggtgcgagtgaaatatcattatttgattagtccattgtcgtattctctagcaactccacctctagtttacttcctcaagaaagagtcatatcatacgttaagtctatatcggcaaatcttgaccaaaagaatatatcaaatagaataaaatatattgagatcgaaaggaatagactcttattccaaagattagaaatcagaatgaaaatggatcggcaaacggcgccgtatttgttgccggccgccgggaataaacaagaaaagtaatggcaacaaacatcaaagtaatggtttggatagatcgatgaaaccataattgaggacgctagtcaacgtattgtagtaacatgccatgtgattgccagcttcatgcacagacaccgacatgtattatcatgctactattcatatattaatatcaatatattagtcttatgtaggaattttttagttaactattaatgcacgataattaaggagtgatgatgacaaatcctcatgcatatatagttggaacaaagttccaattcatgcactaaccactagttaatcgtcaatgacagagcgagaggcagcaataatcttctctgatgattggcttccagattcaacaacttaattatatcaatgttttttttgggtgcaatttgatttatatatatactagttatttagcatctcaagacattcttatcatatttaagttgataacttgatattgtaatcagaatcatcaaatattgacattgtacgatgcatgcatttcattagatccacactgtctgatccgcttcttccatttggagtttttgtatactaatccctgatactaatataactatttaattcattttttgtttgtttaagatatcattttttacgagatttgagtgagacattgcattggttgaactaattcaccacaaaaacctaattcattacatacggaccatttctgattgttttaaacttaatttcaactaactcttatttattgtggtacctaaatttcctatataataataagcacatttaagaaaatttgtcgatctcaagtttcaacaactgtctattaaacccaaattgtctagaagcagcatccatcttctcaagctaaacaattgaatttagacctatcatatatgcatcatatctaattatcatttatggatctatgggaaacaaataagcaagaaatattgtggtatagggtctaattactatcaaaacgtgtcctacattttgagggggtcctccgaccaagaaaataaatactttggaattaatctttaatgctgtgaagacataaaagataagtataccaattttattagcaagcgtcacttactgaaaaacaatccctataagatttctatttctgcacaaaagaagaaaaaacatgaaaggttatatagtacttatatatccatcgaatttatacgcccacaaatgactaatgcctgattcacatgcaggcaattcaaaactagctcaattttcttctgttaaccagctctgattactcattttatctaatagtgttggattatatatagggataaaatgtgatgtatagatatctcttgaatagtctcattcgactgaccacaaactaaactactaacatcattttctcatacatttcagcgtgggccaataaagccaacgtgtttttattattccaaatgttgacataagatataatctattatatggtaatggtaatatgtgtctcattctcatgctaaaatccatgaacgcagaacgtctctcatcataaaatactagaagttaatgataaattatgtcacacggattctgcatgttcttatacccttttttcacatggctcacccatcacaaatctcactatctaatgacttattcacccctttctaagtccatgtccaagtccaaaactctaggtgtctatttcttttggatgagcagtgatgtatcaatatctcattatgttacgtagctatcttagctaggttcatcacatacgccgtcctacatatattaagtgttgaatagaaagttaattccatctatctcaattatcaaccaacgtaactatcgtatttagatatcaatcacacacacacacacacacacacaaaagtttatgtgattaattaggagtaggattcggagctacatttaaatgcaagttcaaactctacaatatcgataacaatattaactcaattgtttaattagtctacttatcttttattgagtaaactcgaaggatatgtatgagttgcataagagggtattctagtactttgtgatatccaacgaataaggcaaggaatctaatctgagctaatcataattattgagattgtgtgtagttggccttcgagtggataaatcgtggctatggagcttccgttctgcttcttcttctcccaaattattaagtcatcctccaaatcatatttcactaaacttgcaaaaaatataaaaaagtatatatcttcataattaatgaatggtaattaacctactaaattttcattgatttatgtataatggttatgtgtttttatattacatatatagtttactagagtttaaacattccaacataattccactaaaactcaaccaaaaagggggtacaaaaaaagagaaaaaaaaaattaaatgttattgagtgatgggtagttaaagaacttatggtgttaggctgtccaaaaagagaagcagttaaagagtttggagtacaatgtcttaaacaagaaaatgtctgtcccattataacatctcgaaaccaaacacacacacacacacatataacaatctcttcttctctgacattacacaatggtggtttgagtttacagaagataataatg

SEQ ID NO: 17924 - DNA, 3003 bp, Unknown; identical to SEQ ID NO: 17923
  misc_feature (1)..( 3003): 2750-1469P.txt file - cDNA_ID_1814544; gDNA_ID_2926160; Annot_ID_139699

SEQ ID NO: 17925 - DNA, 3000 bp, Unknown; identical to SEQ ID NO: 6447
  misc_feature (1)..( 3000): 2750-1469P.txt file - cDNA_ID_1814548; gDNA_ID_1621094; Annot_ID_55588

SEQ ID NO: 17926 - DNA, 3000 bp, Unknown; identical to SEQ ID NO: 6447
  misc_feature (1)..( 3000): 2750-1469P.txt file - cDNA_ID_1814548; gDNA_ID_2926160; Annot_ID_139698

SEQ ID NO: 17927 - DNA, 3003 bp, Unknown
  misc_feature (1)..( 3003): 2750-1469P.txt file - cDNA_ID_1814559; gDNA_ID_1621095; Annot_ID_55656
cattgttcagtttgtagagaaagacttcaagcttgctgatacggtcattagaggacttctaaagtattggcctgtgactaatagttcaaaggaagttatgtttcttggagagttggaagaagttttggaagcaactcaagcagctgagtttcagcgatgtatggttcctttatttcgtcaaatcgctagatgcctcaacagttcacattttcaggtgcgactctcgataagttgttcatatagtctcgcaattttgcaggttatattcaaagttgcttcttttgtcaggtggctgaaagggctctatttctatggaacaacgatcacataagaaacctgattactcaaaaccataaagtgataatgcccattgtgttcccggctatggagagaaacacacgggggcattggaaccaagcagttcagagtctgactttgaatgtgagaaaggtaatggcagagacagaccaaattctgtttgatgaatgcttagccaagttccaagaagatgaagcgaatgaaaccgaggttgtagccaaacgagaagcaacatggaagcttttggaagagttagcagcttcgaaatccgtaagcaacgaggcagtgctcgtcccccgattttcatcttcagttactcttgcaaccggtaaaacttcgggtagttgaacactttctgctctctatcaccgagacatactttcaaacaatccagcagaattgtatcgatccgttcgagcatcaggatcagtccttgaagaagattaagcacgatgattaagaagggcaatatcatcagtgaatacttaattataacatttttttcaggtttatggaatcatgggttcaattgtttgttgcttctgatcctttttttttcttactcagctcttagttgaataacaatctgaggtgtaagaaatatggcttatagatatagttcttgagaggacgactaaacaattattcgtatttgtattgtggaatgaattgtattttatgctttgaagttcattaatttagctcccctactaaccaaatcataaccgaagttatcgaatctcggtttggttcggtatatatgcaacggcattttcgtaaacaagtcatgttttttttcgtgtgagttttagaaaatacaaaaatcatatataacactagattttaatttaaagttagtataattttttttttgcaaattgtatctatctataatatatttttattttatagtttacaattgttattaagtaacgtcctgccaaacccgtcccgccaaacctgtcctgtaaaaaaatcatttatttatattaatattgatcttatttatgatatgtttataaatcattctctaaatatttttgtcgatgcaggacattgaacccacacattgtttgccaattggttaatatatgttcatttttaaaattttgaatcataaaatgtgacagaaaaaattaagatttttttaaactctatatattatataatgatgttaaaaaattgtgatatatcaaactttttataagtttaaatattaataatgttttataaattttaaatatataaataataatatttaaaaaattaatatttttgcttataaggtaatgacataataactctaaaagcaaggatttagaagatttaaatctttaattaaatattttcattaataaataattaatgtcagtgacatgacattgtaaataagtttaaatacaaaatttatttatttaaacaaaaaacggttagtaagaataatatttatttaacaaaaaactttgttttaaaatattgttaacaaatgtctatgctaattttaagggattgatttgaattttgttgggattaaatttgattgataatgtgattgactatttaaatcaaaaatttaaaataaaattaattattttggaaaaaagatttaatgctaatggcattagattgtaaataagttcaagtccaggatttatttgctaaaatggttgcaaaaatgtatatatagatagtgtaaaaataaattgaattaccgatgtatttttaaaaaaaatcgtgaaatctaatttatttacggaaaaatattaccacattatttttgcaaatattgtgtatggtaatgaatccaatccattattctaatttgttcttagtcaatgagtggtattcaatttcattgtcccggtcccacggactgactactcagcaacccaatcttacaaagtcaaagtcaacttttattttgtttctctttttttccgtttccatcccaaattcatttctttataaattatttattcctaaaaggatttgtaaattaacctaatttgcatttcaaaatatttttatctattttagtattaaattggaataattgttatttttgtattaaaaaaacactaatatccaaaattgttatattgctttttattttgcttttttctatttttaatttctattttttaatagcatcgccgtatcgtcgcatcgatactcggatttagtaaataagtgttttttagcaagagtttatgcaagtccgcttcgattaaagtatctaaaccaaaatccaaacacgtgggagtttccgttttaatttctagttatattatacccttcgttatttaagatataaaacagcaatttattatcactaattgataaaaccttcattgcaaatataaactagattttaaaaataaaatttgacttttaaaatacaatgtaatattattaatgatataaaaacaaaaaacctaaaatggtattgaagtgtcaaacagaggaagtatatgatatatatgtaattaactagtcaaaatctgctgtgataacgaccaattctaaacaattataaaatcttctaaaaattaatgagaatctactatatttaataactaaaataatagaaggatgacaattgacaactataacaatattgaagaagtcataccaaatatattaagacgtgtataaaaagggtatcataaccgaagacttaagatg

SEQ ID NO: 17928 - DNA, 3003 bp, Unknown; identical to SEQ ID NO: 17927
  misc_feature (1)..( 3003): 2750-1469P.txt file - cDNA_ID_1814559; gDNA_ID_2926163; Annot_ID_139800

SEQ ID NO: 17929 - DNA, 3003 bp, Unknown
  misc_feature (1)..( 3003): 2750-1469P.txt file - cDNA_ID_1814614; gDNA_ID_1621095; Annot_ID_55640
aatcgtctaattcctggagcagggtatcagaaaatggagagaccaaacttgtgacagaaggttctaaagttgaagaccagatcttgccgaaatctgatggagaaggacaatcagagtaagggttcagactctgaagtctgtgtcctaaaccagtgcagttactagcggtccactgacatccttggcaaagagaaacattttcgttcatacagtgtactgccgtgggttgtaaggaacatttctcgcagagtagagatcgcgtgtgtctttgagacagaggattcgctgagtgtacattaacgtcacagtttaaacaaagtttagccgaatcagatttgcagtagattaatgctttttcggttccacaaaagtcacatcgagcctccatacttcttcgaagacaaaactccaaagaaataacgatttctcaatcccaatcgctacacacacctaaaatcctatagcatagaaggatcgtgagacaaaaacagaacattcagagatcaaacaaaattacgattcattataggttcatgtatctttttaatgtgtgactgtgactgtgactaatacatggttgtgtttgaatgttagagaaacactcacaaactaagaaaatgtggattctcgagaccgaatcagtactaaaatcacaatgtctagaaactcataaccagttaattacagagttttttctaaacaagagtataacaataatcgtgtaaaattgtttatgtttcagggttccagagattagaagctttacaagggtgtgtgagagtccagtgagaaggagatgagaaagaacagagaagaaaaggttttgctctgtttttatcctgtgtggggtccaccttgttaagcgggtttgccacgcggggtatcttttgtcacgtgtggttttattgttccttagattttgttgatgtcataatgtggttgaccatacaattcggagtttttgtttgattctttaggtactttctgtggctcgcaagaatttcgagaattgttaataaaaaaacgtgtaaatgtcattaattttgaacacgtttttcttgttattcaaaacatccgagtaataagactagttcgaagcaatttattccgagtgttggtttaatggatctaggagtttgcagcatactagtccggtttcattaacctgtggttatggatagttattgtatctatttctcactaattttactaagtgtgttttcacaacttaaaatatgagatgttagaagcacttaaatgattgaaattctagtgagcgatcatgttttaagagagaaaactttgtgacaacgattgatattcgtttacgattttttaccagcctcagtaaaaaggctaaatgtactatttttgaaacatctcccaatgcattccatgccaaaaaaggctaaatgtacttgtaaacaattcaacagacagtaactgctggcattagctgaaaaggtcgctcatggcatgaccagtctggttgtcattgtttgtttgccaaaagatttcattagatgtccaaaaagcagctcattcgaccaaacaattgtttcctgataagtcaattgttttgttaatcaattctataggaacgctaaatccattattcgtccaaaaatcagctcatagttttcaattgttttgttaaccacttattttgcaaaagtagtgaagaaaacataacatttaaacacaccaattgttttcataaagcccttccaccaactgaaaatcaaagaataactagctaatctcttccggtattaaaaaagaggaaaaacaaaaccaattgatataatgtgcgaggcatttccaggatcaaaaggcatggaaaaaagcaaaaagatcaggatataccacaaccaatatagcgtcacaagccattatacctgaaggaactgtttttatccttcagaattggtaatggacgccaatacaaaaacaaaaaacactaaaactctttcttcaatagggcaaaatttttgataaaaaatgctcagtggaaggagaagtcgttttaaaggagagctcacggtaaacccactgctcttctcacactcttcgtgctttcatctcatcattgcatcatcatcatcaaacccataacagtaatccaacaaaacaaaacaaaaaacattgaaagaacaaataagcttcagtgtgtgtaacaaattcagttcattgattcaaaaacctcactgaaatccgctaagataattgtttttatcatcatcagctttataacccaaaacaagtacatacaaacatcaatcaaacctattaacaataatccaactaaacaaaagccaaacattaaaaaaaaaaaaaagcctcagtgtgtgtaacaaattcagatcattgattgaaaaacctcactgaaatccgctaagataattgttttctatcatcataagcttataagtggaaaaacatcaaccaacaaaaaaaaacaataacagagaaatttgtcttcaaaccaatcaaaagataagattttgggtgaaaggggaattaatactcagacagccaagggttaatcttcaacttctgggagaagaatcccagatctgaaactctagtccacaatactcttgtatcatcaccatattcaaccccttccacatcccataaaactaagacatcacaaatctctttcacaaaaaccttaaatatcaccaatttcaacatatatacacaaacgaaaatagtcacagacctaaccctaaaatcacctaacatatcattcagacatgaaaagaaagagagttcctatgatttgcattagacgaaaccttataaatacacagacacagcagacaattagggtttacttcggtcggcggctaccatatctattttaggttctcggcccaattatactaaatgggccagctttcgtgacccaacaaacaacttacatttattttactttattaacacattcactttacaaacccaatcaacgaaaagtccaaaaacgtaaaaacagaaatg

SEQ ID NO: 17930 - DNA, 3003 bp, Unknown; identical to SEQ ID NO: 17929
  misc_feature (1)..( 3003): 2750-1469P.txt file - cDNA_ID_1814614; gDNA_ID_1621095; Annot_ID_170946

SEQ ID NO: 17931 - DNA, 3003 bp, Unknown; identical to SEQ ID NO: 17929
  misc_feature (1)..( 3003): 2750-1469P.txt file - cDNA_ID_1814614; gDNA_ID_2926163; Annot_ID_139785

SEQ ID NO: 17932 - DNA, 3003 bp, Unknown; identical to SEQ ID NO: 17929
  misc_feature (1)..( 3003): 2750-1469P.txt file - cDNA_ID_1814614; gDNA_ID_2926163; Annot_ID_198895

SEQ ID NO: 17933 - DNA, 3003 bp, Unknown
  misc_feature (1)..( 3003): 2750-1469P.txt file - cDNA_ID_1814625; gDNA_ID_1621095; Annot_ID_55637
catggaaatgagaaaaatgtaatgttttccgcagaaaatcccaaaatggtggatatggatgtactacctgagccctacatcgtgggtgttggaaggattactgagttcgcagtatggagatgtcgagaaagagataacagtatttggagagaagaagagtgtttcagctttcttggaggattacttcggctacaaacatgactccttggctgttgtagcgtttgtcctcattgcttttcctatcatcgttgcttctctttttgccttcttcatgagcaaactcaattttcaaaagaaatagttctttttatttttgtcagttaggcttttctttctcttatgatatcatcataaacgttttacattttctctatctggtctcaaaaatgggcaattgtgaagcacacaaagaacaagttttgagaattgattccagcagcaaaagatgatcttttattacatataacaacataactagaaaattcttgagaggtggcttggttttgttgtttattcaaaatgcggtatggaccataccgtatggtctaaaatgttcgacgtaacgattccaacggaattggctcgagaaagcaacccctatttgtttattgattacttggcctgtgttattcagttgcaccatgcctataaggacggacttgtctaacttttttttttttttttaattttattttgtaaagttgaatctttttatttttctaatgtggtttccaataatgaaaatgcatcaagacggatgaaatttagtatgatgacttgatgatgagattaccaaattttaggtaatttgtcatcggaaaaacgtgttttcttttctcaaaagaattttaaatttgtgtgttgctctcccaaaaaaataaaacattccttacactgttacacataccaaataggcaaataaaaccgaactctgctgtgtaagatttggttttaaccaaaaaaacaacaaagaaaaaactatttcttggtggaatttgaagattccattggttaaatgatctactaactatcctcatccatattttactaataaagtaataatcatgttaatttatgaaagaactaaaaattgtcactgtttggaggattaaactcctctgacatgtttttaaaaaactatatacacacagttatttgaaagttaagttttgttgcgtcaccacttctcatattgtaaacgcgtttgcaagctaaggttttttgattaaacaaaaccttatctcattaaattctgacaacgaatcaaatattcaatcttcgtgctgatgttgaagataatatcacgtctctctcactgcagattcgatctcagggaaatataatacttttacagagttacgtggtcaaagtgttcgacgaaatgcctcacagaaagccaataagttgcgttcaagtatgaatactcttgcagatagtgggatcattgtcaataagctgattttcgaaaagatttcgtcttgataacattttgtcaacgcttaccagatttgtattagtttattcgatctttttctcccggattctatggatatgatcacgtgaagcatgggagatgataatgtatgcgtaatgtttgttaaagttattataattacaaacattcttccttcaatagttcttcattcatttgacgtttgcttcttcttgttcttgttaagtttgttttttgttgttgagttccgttggcattttaactgaaaatgatccaaacaggtgaagaagatgaagaaaaggcaacgtcccttgaagttgagtttgcttctggaaatggtgttgatgatgaggaagagcttcggttgcagtgggcaacagttgagagattaccaacttttaaaagggttactactgctttgttggcaagagatgaagtgtcagggaaagggcgagtcattgatgttactagacttgagggtgctgagagacgcttgttgattgaaatgctcgttaaacaaatcgaggatgataatctccgtttactcagaaaaataaggaagagaattgacaagtaagtcactgcacgactctactgtgtttttttatgtcaagtagagcaacatttgttttgtaaattgtatgtgcatgttagcaactattgaaccttcatgtaattgtagagttggtatagagttgccaacggtggaagtgaggttcaataacctttctgttgaggcggaatgccaagtaattcatggaaagcctatcccaactctttggaatactatcaagggcttactatctgtaagtactcaaatttatttgctgcatcgatctgaatatggagcgcttttctgctctcaatgttctttattcatgtttttctgctttccatgttacaggagttcatttgttctaagaaagaaaccaagataggcatcttgaaaggagtgagtggaatcgtaaggcctggaaggtaaagtattcaagaggttattctctagtccctttagttgcacggaagaagaaatgaagggtgactggttattttgtgcatgtagtgtttttttataggttttcattacagagttcaaaagaggtgttggttttcttgcagaatgacgttgttgctcggtcctcctggttgcggtaaaactactctgttacaagcactttctggaaaattttccgattctgtaaaggtttgactaacagagtaaaaacataagcctgttgaactaatataaaataatatattggagatcattaaggttgtcttcactttacaggttggaggagaagtatgttacaatggttgctcactctcagagtttattccggagaaaacgtcgagttatataagtcaaaacgatctgcatattcctgagctgagtgtaagagagacacttgacttctctgcgtgttgtcagggcatcggaagccgtatgggtgaggatcagatttctgaaagtttgaactgaaggatacttttgtgtgtttgaactcagttcacattaacaagcaatggtttattaaacagaaattatg

SEQ ID NO: 17934 - DNA, 3003 bp, Unknown; identical to SEQ ID NO: 17933
  misc_feature (1)..( 3003): 2750-1469P.txt file - cDNA_ID_1814625; gDNA_ID_2926162; Annot_ID_139782

SEQ ID NO: 17935 - DNA, 3003 bp, Unknown
  misc_feature (1)..( 3003): 2750-1469P.txt file - cDNA_ID_1814641; gDNA_ID_1621095; Annot_ID_55632
tttcgtatgctcctaaaatctgggcaattcattagatttcgttgcgtagataaacttaagcttgatgtattctttggtacaatgtaattctgtttagttctataacttggaatcactctaagtgtaatgtatattgatgcgaagtcaaatgttgctgaatttttgctctcctgcattttccccaattttttctgagccagtattgtgaaaaattggagtctgagaaaactgaaaagtttaatggattctcatttaatcagtgttcatagattcactagttgtttgaccagggcttaggcttaatcattcttgtgacacttggttttcttttaaatctgttttgatgttcagttttctttggaagctatatacccataaacttaaaatgaataaagatggaagctttagctgatataatttgggtgtttctttctttcttccttggtgtgaagctgtttcaaaatgtctcggaggtatgatagtcgcaccacgatcttctcaccggaaggtcgtctctaccaggttgaatatgctatggaagctattggcaatgctggttctgccattggaattcttggcaaaagacggagtggtgttggttggtgagaagaaagtcacttctaaacttcttcaaacctcttcatccatggagaaaatgtacaagatcgatgaccatgtggcttgtgcagttgctggtataatgtctgatgccaacattctgattaacactgctcgagttcaagctcagcgttacacctttatgtaccaagagccaatgcccgtttagcagctggttcagtctctttgtgacaccaagcaaggatacacccagtttggtggtctccgcccgtttggagtttcctttctttttgcaggctgggacaggaaccacgggtttcagctgtatatgagtgacccaagtggaaactatggtggatggcaagctgcagctgttggagcaaataatcaagcggctcagtctattcttaagcaagactataaggatgatgcaacgagggaagaagtggttcagctcgctatcaaggttttgagcaagacgatgacagcacgacttgacagctgaaaaactcgagcttgctgagttgtatctgactccttcaaaatgtgttaagtaccatgttcactcgcctgactcgctcactaagctcttggttaagcatggtgtgactcaaccagccgcagaaacttcctaagctagaaactggtgacagttttacctgacccgcctggttactgtagatgtccatttgctttctttccctttggagatatcgtatcagaatcaatttaccactctgattatgtcatgtgattcatttgggttgactatcttttatcttgagattgatcttcttctagtctaaagtaaagttagactttagaggttttattcaataaatgaatgagcaatcaccaacgggcccattagaaagcccataacattcattgattgaggtaacgggttttaatggctcaaattaacgaagaatcagaatctctttaagtttcaccacgtcgatttacggtcaagagtgtctgtttattaacagaacagtaaaaatgttaccgctcaaagcgtatatcttgagcgccaaatggaatttcattggtacaatgcccagaagttctgggccagaactggcctcattgtaagagattttttaggagatttatgcagatctggaaaaacaagtttttctctcttggattatctacaaaatattatttacttaagtagttgtcagttagacaatgccctgaatccaaggaattgtatcgaccgggattgaagagaccattcttgcatcgtctcttctttttgcagcatcgcgattgtatgaaacattgatggccagatctttcttctataagtcaatcaaccggccaccggaattaccctaaaaacatagaaaatatgttgaaatatattgagatattagtcatcgactatgactaagtgtcacaaacttttgtgtgataggattcaatcaatccaatggatcttagtaagaatattttacattctataccagtctagttcacatattttctaccacaaattgttaattcctcacaccttttaaattcattttctagtttgcagtttttttttaagtgtcactttaccagattacctcaaacttaaaaattatcaaattattatcaaaatatacaaatttactaattataaaacaagtatatatctaatatcttatcttaaaaggtaaatatataaatattttctaccttttgtcatgtaatacaatttttttcctatttattaggtatcagaatctcaattaattaaattcagaaaaagtgtgagaaaataatttccagtaagcaaaaaaaaaaagtattaacacgacggcttcttctttcagcaaaaaaaaaaaaacataaacggagaaagagagagagaacgatacagaagagaagccaaggtcgcagagagaaacaatacacacggcgacagatatatttcccggcgaaacgggaacaataatatatacagagagagagagagatttagtgagagagctttctagggttttcttcttctcgatttatcttcctttgacctcgatctattcctcttccttctccataaattttcccttcttctcaccttcattcatatctctcctagctccattctagggttcttgatccgtttctctaccttttcgttttcttcctccgggtataatttcttcttcaattcgtttgttttcgcgtctcttcgtctcttctaatttcatcaatttgggtcttgtagggttttgagattttctccttcgtcgggtgaagaaaaccctacattttgttttgtcactgattgtgttttcggtgtttcaggttgtttaatttactccggcgggtgaccaaattggcggtggcaaagtatgagtattgatttccctgggaaaggggagagttagggaagtttgggctagagagaaattggattgggtttccatg

SEQ ID NO: 17936 - DNA, 3003 bp, Unknown; identical to SEQ ID NO: 17935
  misc_feature (1)..( 3003): 2750-1469P.txt file - cDNA_ID_1814641; gDNA_ID_2926162; Annot_ID_139778

SEQ ID NO: 17937 - DNA, 2435 bp, Unknown
  misc_feature (1)..( 2435): 2750-1469P.txt file - cDNA_ID_1814652; gDNA_ID_1621095; Annot_ID_55627
aaatgttctttttctagttttttacctattccgaggaaaaaaaacataaaggaagaaatgttaggtatactgactttgtttgtagcagaatgaaaactttgactattgtaattttctttagttgtttattgtttttcatattttgaggacttgtggacggataaattaaataaacttaatagaattatacgattcaattagagataaaatgcggtatggttttaataacgcactacataatgcgattttgtcttcattcagaactttaaatagcatttaccaatttgagatatcgtcatttcgagtttaagaactcatttagaaagggaaacaaaaaatttaagcggctttggaaacaaatatactcaaacgtgatcacatgatatggataaatatgttcataactattcgactacaaaattatgcattttggtgttcatagtttagtattcgaacaacttgttcaaactatcctacataaattcgattataagatcccgtagtcgtattttatatgtatgaatattcgttatggtaatagttcgagtatcatatacttgtacatggaaaggtctaaatgaattttcttttccttttccttccatgtgatgatcaactttagaaaaatcttagttggcttttcaatttaaagaagaattttctctacagaaagagaagtgaagaataaatattttacgtcgccgttgcttttcgttcagaaactaggggaaatgagtcggtgaaggtaggctaccaacatgtgaagaatctcacatgatgcgtttctcttttcttctcctttttcacaaaatgaaaaagtcgtttatatcgcataaaaaacgagtaacaaaaaaagggttagagacgggatgaattaatggcccatatttaacttaatactttttctgaagaaatgaattccgttaatgtgaaaattgtttgcttgcttactaattacttttgtgcttccataccttttttttgttgcatatggttttaaatggtggcaatctggagatcttccgagcttagttatatgtatgatgggtaccattcggatatgttaataatttggttttttgctttcctttagtcggttttgaaagaacccgaactgaattagaactttgaactgaaattcaaattggttcattctatcttggttttaattttcgaacatgttaacattttccttctcgtatgttagtttcagtttttgatcctttttctgacaaaccgactctctgctgtcggattccgacctagcaacacgaccatctcaaatctaacacttttccttcgagatccgacgatcctcatatactttgagcaaagaccacctaagtccggttccgtggaagctaaatcatagcagtctcagaggctgattgttcaatcaaactaccataaactagaatccacgaccgccttctaagaaatctagggattgtccctgtatataaacagttagacagtacatataaccaaaaacgttgttgaagcataaacgaatatctcttaaagtatagtaataaaggcagtccaaactcaatatacatagtccgggttagaacgtcatatatgatatgacatcatggaatgacagataaggtgcaaaactatcggaggctctctatttgaagtgaaacattgtgctctttttatattctattcaaaagttatatataataccaacagctaaacaaccatgaacaatatcagtttagtgagttttatatagttaaaaacttagaaaactctaactgatgtaaaaccaacgacaagatcaacaatttttacctttatttcaaaaaatggtttaaagaaaatctataaaatgttaggctctaattcatgactcatattgtttatgtcattacttattaatctataaaagtttgagagtatggatgacacaatttgacccacaacatatacaacaaccacctgtaggtgtgtgtacatgtacccgggccaacatgttcccatgcgatcgaagagcactagtatcctattcggctcaaatattctttatacgtgacttctttcaaatcattcttatttttgattaatacgtttacgaaaaccattaatatatcaatatatggctgaccaaaataaaaaactatatattaaaaagaaataccaactaatatcagtgttcaaagatggccgacctatgctctcaccatctctcaattactatattttacaaaattgtcgtctatcacttttttggctttaaatgtgaatgtgagataacaatttattttaggttgcaaaaattgaaaagtcttatcggaaagaaaaaaaaaatccaatttagaaaaccgcgcgttggagggaaagccatagaaaactaaaagataacaaacattttaacaaacccaaacccaaaaattctcaaggaggccgaagaagaagaagaagaaatg

SEQ ID NO: 17938 - DNA, 3003 bp, Unknown
  misc_feature (1)..( 3003): 2750-1469P.txt file - cDNA_ID_1814652; gDNA_ID_2926162; Annot_ID_139774
caacgactggtctcaattctacaacaaccaaaccttcttcaccaccgcaacctccaccgtcacaaccaccaccaccaccgccacgtcagctgattctcctctgagtccggataatcgccgtgttgcaaagccaacacgtcggagatctagagcctcacgtcgtacacctactacacttttcaacaccgacacagccaacttcagagccatggtgcaacaattcaccggcggtccatccgccgttgcgttcgggtcttcgccgtcgtctggttttagtctcacctcgtctgatcccactgccggagtatcttcctctccttggcaatacgctaatttgcagaaccaaatggctcataacgagctaatgcaacaacagcgaccgtacatgttttcgtcgtcaaacaacgtgagcactcttagctatcctaacgcagtggctaccgatggttttgtgggggcggaggagagtagagagggtggtggaggaggaggaggaggttatgctccgtcgtcggagaggaatagcaatactacctattccgaggaaaaaacggtatattattcttagaaatgttctttttctagttttttacctattccgaggaaaaaaaacataaaggaagaaatgttaggtatactgactttgtttgtagcagaatgaaaactttgactattgtaattttctttagttgtttattgtttttcatattttgaggacttgtggacggataaattaaataaacttaatagaattatacgattcaattagagataaaatgcggtatggttttaataacgcactacataatgcgattttgtcttcattcagaactttaaatagcatttaccaatttgagatatcgtcatttcgagtttaagaactcatttagaaagggaaacaaaaaatttaagcggctttggaaacaaatatactcaaacgtgatcacatgatatggataaatatgttcataactattcgactacaaaattatgcattttggtgttcatagtttagtattcgaacaacttgttcaaactatcctacataaattcgattataagatcccgtagtcgtattttatatgtatgaatattcgttatggtaatagttcgagtatcatatacttgtacatggaaaggtctaaatgaattttcttttccttttccttccatgtgatgatcaactttagaaaaatcttagttggcttttcaatttaaagaagaattttctctacagaaagagaagtgaagaataaatattttacgtcgccgttgcttttcgttcagaaactaggggaaatgagtcggtgaaggtaggctaccaacatgtgaagaatctcacatgatgcgtttctcttttcttctcctttttcacaaaatgaaaaagtcgtttatatcgcataaaaaacgagtaacaaaaaaagggttagagacgggatgaattaatggcccatatttaacttaatactttttctgaagaaatgaattccgttaatgtgaaaattgtttgcttgcttactaattacttttgtgcttccataccttttttttgttgcatatggttttaaatggtggcaatctggagatcttccgagcttagttatatgtatgatgggtaccattcggatatgttaataatttggttttttgctttcctttagtcggttttgaaagaacccgaactgaattagaactttgaactgaaattcaaattggttcattctatcttggttttaattttcgaacatgttaacattttccttctcgtatgttagtttcagtttttgatcctttttctgacaaaccgactctctgctgtcggattccgacctagcaacacgaccatctcaaatctaacacttttccttcgagatccgacgatcctcatatactttgagcaaagaccacctaagtccggttccgtggaagctaaatcatagcagtctcagaggctgattgttcaatcaaactaccataaactagaatccacgaccgccttctaagaaatctagggattgtccctgtatataaacagttagacagtacatataaccaaaaacgttgttgaagcataaacgaatatctcttaaagtatagtaataaaggcagtccaaactcaatatacatagtccgggttagaacgtcatatatgatatgacatcatggaatgacagataaggtgcaaaactatcggaggctctctatttgaagtgaaacattgtgctctttttatattctattcaaaagttatatataataccaacagctaaacaaccatgaacaatatcagtttagtgagttttatatagttaaaaacttagaaaactctaactgatgtaaaaccaacgacaagatcaacaatttttacctttatttcaaaaaatggtttaaagaaaatctataaaatgttaggctctaattcatgactcatattgtttatgtcattacttattaatctataaaagtttgagagtatggatgacacaatttgacccacaacatatacaacaaccacctgtaggtgtgtgtacatgtacccgggccaacatgttcccatgcgatcgaagagcactagtatcctattcggctcaaatattctttatacgtgacttctttcaaatcattcttatttttgattaatacgtttacgaaaaccattaatatatcaatatatggctgaccaaaataaaaaactatatattaaaaagaaataccaactaatatcagtgttcaaagatggccgacctatgctctcaccatctctcaattactatattttacaaaattgtcgtctatcacttttttggctttaaatgtgaatgtgagataacaatttattttaggttgcaaaaattgaaaagtcttatcggaaagaaaaaaaaaatccaatttagaaaaccgcgcgttggagggaaagccatagaaaactaaaagataacaaacattttaacaaacccaaacccaaaaattctcaaggaggccgaagaagaagaagaagaaatg

SEQ ID NO: 17939 - DNA, 3000 bp, Unknown; identical to SEQ ID NO: 6509
  misc_feature (1)..( 3000): 2750-1469P.txt file - cDNA_ID_1814682; gDNA_ID_1621096; Annot_ID_55669

SEQ ID NO: 17940 - skipped

SEQ ID NO: 17941 - DNA, 3000 bp, Unknown; identical to SEQ ID NO: 6508
  misc_feature (1)..( 3000): 2750-1469P.txt file - cDNA_ID_1814690; gDNA_ID_1621096; Annot_ID_55667

SEQ ID NO: 17942 - DNA, 3000 bp, Unknown; identical to SEQ ID NO: 6508
  misc_feature (1)..( 3000): 2750-1469P.txt file - cDNA_ID_1814690; gDNA_ID_2926163; Annot_ID_139810

SEQ ID NO: 17943 - DNA, 3003 bp, Unknown
  misc_feature (1)..( 3003): 2750-1469P.txt file - cDNA_ID_1814696; gDNA_ID_1621096; Annot_ID_55661
gggtccagttgtaaagtcgaagccagggaaagcttttttctcaatggttccaggggaggttctattggcttcacttgatgctcttagtaagttaaatttatatttattagctccacattgacattagattagattatctttgtaatgatgaactaaaaatagtttgatttgatctttgaaattagataaattactagacgctgctgaagccgcagagagacaaactctttctgctacgtccaaagctctacaagaatggttagtgagaggtaagtttcacagacaaagtcctcaattttgcctcacgtttagtgtaaatgtctcacataagtgaggttacattaacaggttaggtgagagcgcgggagaagctacgaaagatgtactaggcacggttgggcacgcagccggcactgcgtggaacgtcttcaatatccgcaaagctttctctccttcctcttcagtcacatcggggatcctcaaaaacgcttcacgaaagtgatatttggtgtttgtatttatttgtgggcagagaccataaggttaaaattaagtcagaatatgcaaatgtgtaatcttgaatctcaaacaaaggaaacctctcttccttaccaaatttatccctcatgtgtctaaggaatacacagactccaaacatatcaaacaacttaaccttaaaccaaaagctttgacccaaaatgaaaaaaaaactaccaaaatcaaatcatgaaatttaaatatatcaaagaaaattgagctttagttaaataaaaaaaatatgatcatgaaaacagttgtagatccatcgacaaagggaatagttagtgtagagcctccgttcctcgtcgctggtcgatgaaccataccaccacctcttccgatcccatgcccaccttcttcttctccatgtccgccaccgcctccaccagcatggcctcctccttcaacagcatgaccacctcctccactagcatggcctcctcctacactagcatgaccacctcctccactagcatggcctcctcctacactagcatgagcacctccgacactaacatggactccacctccaccgtgagcgcctccaccaccgcctttggcaaccacggtggtacaattgactaaaagtaaagtgataattagaaggacggcgagtttcgctgcataattggtaacaaagtgtgctcgagtcttcgtgattttcatgctggtaatatcaaacatacacctttatcaaaacaaacaagttctatatcaaaattcaaaacataaacatatatgcgtagttgcgtacactatctttgattcttaaattgctgtttgctaccttaaaacggaaaagaggaatttgttatcgtggggtgagatgctttagaaaagcctctattgtatatatgtgtaggcaatattcaagatttttttgattcttttactttttgttgtgtttaggataagttgtgagtaattctaaaaaatactctttgtatttatttttcctcaaaatatggatttagatattgtgtataattatcattaccctaattaatggaaaagtaagtttcacaaaacctttgtaggttatcattaccctaattaattatcattatatttttgtaggttataaaatccataacaattattgtagcatgtagcaaaaatgaaaacgaaaagcatgatatatcattagaaaaaaaatataattaccatatgctggaattggtatatttagagtttgatgggaaagtttaacctaatcaattcgtcaattcaaaattcaatatagattacattggtgctaaagttttaacacgtgttgcttcatatataacttactatgtttaagatggtaaaaatttataatgtttacaaacacatgctttctcaattattctatacttcatagacgagactagcattttgagattagacaaaagtatcttattatataaaatttggtttcttaaagttacgattagacgtgttttcctatttttatttgaattggatttgattatttttttcattatttaatatatttctattttcacaaaaattccatgaaatgattattctgtttctctttgaaattagtttttttttcaccaaaaaagaaaaatttgaaattagtttactttttaatattaatcatattttcaaaatttatttatttatttcttaagtatgttaacaatttaacgataaagtcatatcatatctacgacataattaaataaaaattggaactgcaactaatacaaaacttaccaaaataataagaaaatgtgcatgcatgattgcatgtgatgtgtgtatataaaacactatttactggtgcgttattgtgaatccatgtcctaacttttatattttgtttgtataaattttttaaatttaatttgtaaatttttggaaatcttattatttgggtttcaataaaattttaacttactttttaaatttgactttcatatatctcattgctttccaatcaaaatttgtcacatgtttttagttatttgacgaagaaagaattgatcgagtataaccctaacccaaattgttattcatttaatttattctaactggtttaaatgttaaataaattatgggatgaattgtttggaataatccatgttcatcaaatttaaattaattgaccaatttatacataaatttctacttcacaaataaaaaagagttaaatatgtctacccatgaacacagaaatatgtttcctcaaaataattaacagactttttctctattggtctttcatataaagctaacactaacagcgttttagacatgaataatacaacgcgttatcgtaacaaatcatgtccgttcatgttgccacgtgtacatcatattgttagattagagggaaatgactcgtcgccttcgtcaacacagaatatataaatctcaaaattctataattcgatattttttcccagaatcaaccagatctgctttcgaagacgaatctagctattagccatg

SEQ ID NO: 17944 - DNA, 3003 bp, Unknown; identical to SEQ ID NO: 17943
  misc_feature (1)..( 3003): 2750-1469P.txt file - cDNA_ID_1814696; gDNA_ID_2926163; Annot_ID_139804

SEQ ID NO: 17945 - DNA, 3003 bp, Unknown
  misc_feature (1)..( 3003): 2750-1469P.txt file - cDNA_ID_1814702; gDNA_ID_1621096; Annot_ID_55659
aggaaactataagttaaaaaaaaaaattgttggcagtctttaattgtaccaatcctgtgagactttattattacagactagatgatcacccgcgctacgctgcggttttttcggatttttttgtattatttaatttaaatttaatttttatttatctaatcattcactcatgcaataagtaattactttaatattaaaaatatttttttctaacaacattctcaacaatgcatcatacatataattcataaacaacatttgtcttaaaccaatttaagagagggtagggttggattctagaaacctgagaatttgatgatagagctccttacgtattcatcagcctcagtgatttattatataaatatcataagagaatataaatatcaatttaagagaataacttactcaaatcactaagtaatccacgactattatacattcatactttgagtttggattaaaaaaaaaatcttcaagtatgagaaaactattaaaatagttttattgaaaaatcatataaaataaaaataaatttagtaataatataattaaatatgtaaaataaaattaaataagaaatatatcattaacctataaattagaagttgaagaacttacattaattatttaatagacacatgtcaaatgctaaagtgatgatgtgtcaatcatatggagagagttgaccaacttttcatatatatgattggtaagaaaagttgtgtgtggttgtagttgtactacaagcttagtagaaacaaaagtattattgtgtaaagcatattgtatttttatgtattaaaatacagaagaaacgtgatacaaaatttggcgttttccactaaatcaaaaagtgagcaccattgtaatcgatgaacagtagaatttttgttttttctttacagttgaataatataatactaaatactaatgaactcaaatttttacatgtgaattttatgtttgttacatgttataaactcagataaaaggtttcgctatggaaacactaaaacgaagctcaaaagtatggctacaagagcttcgttcaaacctaaacattttctggggaacaatcgaatccgaaatctccaaaaacggtgccgcttcatatatcttccctctccaacgttgcatcttcagtttcctctgcgcctctctcgccggcgttgacgcttccgtatcgccggacatcgctgagaacggttggaaaacaatcaatacttggcttgcgttgcaagttattcccactgctaaacttggcgtagttcctcagcctcttgaagagattttacttcatacttggccttatccttctctcttaatcgccggaaattacaaaaagctttacaatttcatcgacgagaacgccggagattgtctccggttaggtcaagaagaattcgggttgacccgagatgaggctattcaaaatcttctctttgttttaggttttaatgcctacgggggcttttccgtcttcttaccttctttgatcgggagaataaccggcgacaattccggtttacaggagaggattagaaccgaagtcaggagagtttgcggatccgggtcggatcttaatttcaagacggttaacgaaatggagctggttaaatccgtggtttacgaaacgctgcgttttagtcctccggttccgctgcaattcgcacgtgcgaggaaagattttcagataagttcacacgatgctgtttttgaggtcaagaaaggtgagcttctttgtggttatcagccgcttgtgatgagagacgctaatgtttttgacgaaccggaggaatttaaaccggaccggtatgtaggtgagaccgggtctgaattgctgaattatctctactggtctaacggtccacaaaccggtaccccgagcgcgtcgaacaaacagtgtgcagctaaggacattgtcactctcacggcttccttgctcgttgccgatttatttctccggtatgatacgattactggtgactccggttcaattaaagctgttgttaaagctaaataagttaaagattgattagtgtttaatgttatgtaatcaatcttcaacggtttcatttgttcggagtgtataaattatatgtaaactaaaataatccgaattgaaactcaaattgttatgttagatggtgttgctatgttagagagattttaactgctttttacattttattaaggatatatgactctaatttttatgatagcaagataatttttgtaatacaagaaaataaatacaaagctcagtagtataatcataaccacaaagctcagtagtataatcataaccacaaagctcagtagtatttagggttaccaagcaatataataaatgtaataaatttgtgcgatggctctaaaaaaatgtaactttgtgtgatcagcagtataataaatttctgatctaaaaaactgtaactttgagagttgtctcaaaaccaactctctttcttaacatttatgaactattaattaatcaaaatcgatttaggtcttagtggcaatctaatttttttcctttcttacatttcaatctcttttggatttactttcaagtaagccatcttttatgttgaaacaaaatcttatggatgagcttctttaaatgttttagccatttatcaagaatgtattgcttaaagagtggtgtagttctaataataataaatatatatatatatccagatatttttgttagtctaaaataatccttcttgaaacacaaattgccatgtcggtaggattcgtaattattttaaataatttcttgaaattgccataataagagaagacaaatgtggtcatgttgggggtcctagaataaagtagtttgcctcgattaacaccgaaagtaaaaacattgtataatcaattcctcttttttgttttctatttactcgataagattctcctaaaaccaaaaaggaaaaaaaatttcaatcaatcttgagattgtgtcaagaaacctcaagagtgaaaatg

SEQ ID NO: 17946 - DNA, 3003 bp, Unknown; identical to SEQ ID NO: 17945
  misc_feature (1)..( 3003): 2750-1469P.txt file - cDNA_ID_1814702; gDNA_ID_2926163; Annot_ID_139802

SEQ ID NO: 17947 - DNA, 3003 bp, Unknown
  misc_feature (1)..( 3003): 2750-1469P.txt file - cDNA_ID_1814730; gDNA_ID_1621096; Annot_ID_55699
agttgggtttcccttgtaaagccgtgaatgatggcctctggttgcaggttcgttgtccttaaacttgctttgctttctcattcagccagttgtagaaatgttgggatggttgatgtgcttagcgttgatacatttgacttaaggcatttacatgagcaattctagtctagtgtttcatgttagattacaaatgcaataatattgttaataaatgcaataatgtttatgtgtttgactacatttcagatgcttctcagtcaaagggtgcaggaagttgctgccaacacatgcaaaaggtgttgccttatcagtattgcatgtgcgtgtaaacaaggatttggggtttcacatggtgcaaccttcaacaattattattgccaagaaaacgtgcagaacaatatgatgggagacatggataacgtatatgtgccggaatcttctcaaggcgatgggataggcatctttaagcctgtcaggatcagtgtcagaggacaacatattgatggacttaccggcattggatgcgaagctacatttgtaccaccacctgcttggcctcctactccttttgtgtactctcgtgtccctattaacagaaatggtcagcaatctattgctagtgatggttctgaaggtagaattgatcagagtggagaaatttcaaaagatgggctgacagctcttgttgggttgagccaagggacaagcggtgttggtaacaatcctcgtggagaacaaactgagggagggcgtggcagtggagctactgttggaatgtcagaaccaaaggaaccttcagtaggtactgagtgggagaacgcaagttgtaccatatcacttgatacaaagacacctttgtgtcactttcctccctttcgttttgggtaacgtttccagccttatttacttgtaaacaacactcttggtttattccaattgcggtgactccttgatttgtcctgtttggcaaaatagttcctctcagatgtgtctttttcattgctgcagagttgaatttgaagatgtccacagactcgctaacggtcatgtagagcattctcctgaattcttctatgctggttctctgtggaaggtatcagaaactcacaactaagtcgtcaagcttttctcttcgagctgttcttgctttctaagaatgaaatatgggttttgataagatgttttaataccatatccagattagcatacaggctttcaatgatgaagatcctcaaggacgccgaactatcggtaacccgagttaacacaatgacaagatcacatgttttcctcacgttagattggtctgtcatagtatacataactttgataatcaatatctacaggattatttcttcaccgccgcgaagcagagatagtggattcagtaaggaaggttagttttctgtggtctattgttataaaagagctgtttagagctacttaaattgtcatgtcttgtgaaataacaatctcttctgccacattcaggtccatgtttacatagatcctcgtgacaaagtgactgcacgttaccaggtatgttacaaatatctatttgcaagttctcgttgaaattcatataagattccatttctaaccccttgttttgatgcatctagtcatggtttcctcataagttatatcattttcattgttcttgtagcttatctgcccgtcgaaaagagaagtgatgttgtttgggagctttaaacagagaggaactcttctgcctaaagctcccaaagggtggggatggcgcaccgcactgctctttgatgagctctcggaacttctccagaacggtgctctgagagtggctgctgttgttcagctcgtttagaggtgtcttaaacccgagagttgtatgtaaaaaaactcaacaaaatccacattttgaagttaaccctcttaataaatagtatatattctacttccttaaactgtggatgtgtttgtataaatgagtcacagaaactatttgagagaaatatcaagttttcagaataagaatgtctttttatataacagtcaactgcatcatccaacaattggagaatccaaggaggagagccaagatcagggtacgacaacatctacaaagtaccaaacataagtaacatacaacacattctaacactaaagaacagcgacaaaatggtaacttggtaatagcaaaaacataacaactctcaataagaccaaacacaaacggcgtagtttaatcaataataatgaaccggaacctaccggttcaagcaatcggttcatggttaacaattaacaagtaaatgtaaaaccctattggtacacccttgccggagagaagcttttgtctcaccactcaccgtcacaacttgtgcttcctctcgtcctcgtcgccgtcgtcagagagaaaacgattaaagctggtggtatggggagagataaagaagattaagacagagatggattcggttgttccatggatgagagctccggttgacgtcagcaatgtcgaaaactgcgctctcgataccctcccttgccttaatcccaagtaaacatcgtttatctgtttaaaagtttttcgttttgattgaattatctttctgtttacgacttttgactgaaacttgggcttcgggaaatctaggcaacacaacagcgttttgaccttactatgtcaaagttgttcgtttctaaaggttaaattttgatttggttgcagttagagatttctcgagttattatttgctctttcgaattggagtattagatactcaaatagtatacacttctgttaatactgaagtaaaacacctccaaatttgcttagtgttaaactgatgttctgtctcttgctcttcttcttcttagatcaatttcttgtttgaaaattttaccatatacttacaatattcatacgagtaagaagaactgttttggatcacttggtgcgtgatgaatgcctcatttttcaagttttgatgtgataggttgaagaaggcattggagaacatg

SEQ ID NO: 17948 - DNA, 3003 bp, Unknown; identical to SEQ ID NO: 17947
  misc_feature (1)..( 3003): 2750-1469P.txt file - cDNA_ID_1814730; gDNA_ID_1621096; Annot_ID_171050

SEQ ID NO: 17949 - DNA, 3003 bp, Unknown; identical to SEQ ID NO: 17947
  misc_feature (1)..( 3003): 2750-1469P.txt file - cDNA_ID_1814730; gDNA_ID_2926164; Annot_ID_139841

SEQ ID NO: 17950 - DNA, 3003 bp, Unknown; identical to SEQ ID NO: 17947
  misc_feature (1)..( 3003): 2750-1469P.txt file - cDNA_ID_1814730; gDNA_ID_2926164; Annot_ID_198989

SEQ ID NO: 17951 - DNA, 3003 bp, Unknown
  misc_feature (1)..( 3003): 2750-1469P.txt file - cDNA_ID_1814734; gDNA_ID_1621096; Annot_ID_55698
tgtagctatttttgacttgaagtgcatgcaaagttgagcttgtgtagtataactatatggaatatgctaactagtcttgaagaggaaatattttgcaatcttcagcttatcttaaaattttaggtgctgctcaggattctgagcaaagacgaccatcaaacgaagttaagaagtcaagaatatctggaaatcgagtgggcggaacaccaaatatgaaagctggttctggatttggtagcacttcattgtcagagaaacatggagacgtcaggaaaggaacaccattgagaagagcaaaggagaaacaatctgagaaagagaataaattgtggtggctcaagcttccctatgtgctggtaggtaaataatattggatttttggttaaaaagctttctttgccagatccaattattaattcacaatcaagaacgaactatcacaaaatattatgagccagacacttaccgttttctcttttcttcagagaattctcatgcggagtaatatcgatcaagacatatctgagggatattttaccttgaggaccgaatctatggaacaaaatgagggtcaagtttcacatatgattgcatttgaagatcaaagtgatgctagaaacttctcttatctgcttgaatcagtttttgaagacttggatgatttcagtgccgatatagctcccgtaacaaccaaggtagatagttcatttctttaccaacttgattcttctttattaatgtctgtatctgtgaagtttacttgtttaggagaattttgttccttaaacccttaatttctcttcatgatctgagagtatactgaattctaagagcagtgagatcgtatttttatttataggatctttatgaggaagttagttctggtggcaagaatgtgatagttgtgaggaagaggcagcttacgttgtatgctggacaaccatttgaagacgttgaaagagctttgcgaactctgattcaagaacgaagatgaaaaaagtaacaacattacttcggactgaaaaaactagagagcccagagatgatcaatgtggagatgacaggggcagtaagaacaatggttccacaacaacaatttttcatgaagcttaaagaaccactgagcttctgttgtattatggtagtagcattggaattgagaggacagatccactagaaataaaaaagattgtttatatcatgtaaaaacgtattttacatgaatcagagagaacaacattttcatcttcagaattttattgagatgcaacgatcttgatcatggcttgtgcattaagccctgttacattcttctcacaaaacttcttccaagcttcttgcttgcttccttcttcgtcttcttcttcattccatgtaaatttctcgaaaagcgagttcaccatactccttgcagcttcccttgcctctggcaacttgtcactcaactgatccgcagccatttgtgcgagcagaatcatcccaaattcttccatttcatttacctcctgataacaaacatagagacaaatatatcaatcacacaattcaagaaaataataactttgctctgagcattttaatcattgttgaagaattcaaaataccattttagaaacgcagttggaagtagacacagcagctttggccctgacacgagggttactgtgacggacataactctgaagcttacgcagaagcggcaagcgagccaccgagttaaccatcgtgttcagcgctttctctgcttcttcacacacaaacttcttgtcttgtgaagctttcatcagcaactgcaacagctgttattttcaccatcaagataccaaaatcaaactttattattaaatcaacaatccatagccaatcaaaaagctaaactaaccggaaaaaacaaaaaacaaaaatcaattttaccagatcgtccatagatttcaaatgaggtccttccagcaacttttctccataagcagtgaagatatcagaacaagtcataatcgaagtcttgcacaatgcacttctaggattcttcatcgccttcaccatcacaactataagcttttctctacaaattgacaaaaacaaaatcatcaccaagaaactccataagatttcagattctggtcaaaaaataaaaaatactcacagaattggtagcaacagagaagagtgatgaattgcaaatctccttgtgttgttcaatgagtcacatactttaatccaatcctttgatgctaattcttcaagtaatctctgtgatagattgaatcaataatcatcaaaaacaaattactacacataaattcagaatcaattgagaaatttaattacctggacagaagattcaggatctgaaaatggtttgagattctcagaagcaacgtattcgacggtcgattcagccacagcgacagggttgttttcgtcatttagaccaatctccggttgctttgagagtttggccagcttcttaggtcgttcctgtgagatcggaagagcgttttcaatgttcctcaacgccattagagataagagaaagagagagattttgatttgaaattcgttaggggaataataatcaatggtggggttgaaaagcttaatataaagagaaatttttgttacctttttcgcattttatattcaaaaattcaagaggaaaaaaagcaaaagaccgttggtaaggttttggctccaacggtcacaagcatcggttcggtttacatgaattagattcggttatctggtttattgttcaattcacacgacgtcgtttcataacttttaagaaacgacagcgtctaagttatcacttttgcgccacacgcgagtgagagctaagctaattctccgtcttcaatggcttttctcttttccccaattgaaattgaatctattccctagaacaaattgattgtgaatccggcgtcatttttgatggaccaagagtatcgaaactctagaacgacggtgacgcaccaccaacatcatcatcaaatgagaatg

SEQ ID NO: 17952 - DNA, 3003 bp, Unknown; identical to SEQ ID NO: 17951
  misc_feature (1)..( 3003): 2750-1469P.txt file - cDNA_ID_1814734; gDNA_ID_2926164; Annot_ID_139840

SEQ ID NO: 17953 - DNA, 3000 bp, Unknown
  misc_feature (1)..( 3000): 2750-1469P.txt file - cDNA_ID_1814738; gDNA_ID_1621096; Annot_ID_55697
atgtagcttcgcatccaatgccggtaagtccatcaatatgttgtcctctgacactgatcctgacaggcttaaagatgcctatcccatcgccttgagaagattccggcacatatacgttatccatgtctcccatcatattgttctgcacgttttcttggcaataataattgttgaaggttgcaccatgtgaaaccccaaatccttgtttacacgcacatgcaatactgataaggcaacaccttttgcatgtgttggcagcaacttcctgcaccctttgactgagaagcatctgaaatgtagtcaaacacataaacattattgcatttattaacaatattattgcatttgtaatctaacatgaaacactagactagaattgctcatgtaaatgccttaagtcaaatgtatcaacgctaagcacatcaaccatcccaacatttctacaactggctgaatgagaaagcaaagcaagtttaaggacaacgaacctgcaaccagaggccatcattcacggctttacaagggaaacccaactcttcaagttcttttcttgcgttcaatagtatttcaaaagacatattgcaatacagaagtgaaccaccttcaaaagtgttgacaaatgcactgtattcttcctcagtaaattcatattttcctttaacagagcctgtaccctgtcttgtccccacaacccgtccaccccaggttagagcagaaacaccacagttaccccactcattgacaacgaaaccatcagaggaagaacctaaagtaggagaatttctagagtctgctcctgataaccaactatcattactcaaatggtatgcttcttcagaaggtccttcaattgccaccacactgccttctgtcttatcaacaacactggtgcaaggacgaccaaaattcgtttgtgagttagaagattgctgaaacacgaggtttgaacctgaaacacctctttggaaatcaataacaccttctgtgagtggaacaatcacatcatcactagcatctcgtaggtcggcttctatatctaaatgacctaacttacagtccaaactcctgaaagagaaatcatccatcacatttttcccctttgatatagcagaatccaaaggaaagcttgtctctctctcaaatctggaatcttgattggaatgatctgagttggagagagcactatttgctatgaaggcgtacaatgccagttcaaacctttttgacatggaaagaaacggtttatagaaatttctagatgcaaatacagtatgaaaccataatacagttagagtatgcaattcactataccgtttttcttcactaggcacccatagttcatcagatgtcagcaatgcacatagagtctgtgctgagagtttcggcagcatctgaccataaaatgtgataaaataactaaataagtagcaattcagaactagaatacttttttattctaactaaacactaggttgaacactcttcgttttcattatcagatgctttcgagatagaatgacatataggatggaagacgttcaagacataggtagaacggcatatttctaaaatggggatacttttgcttttttgacatacacccaaaagaaacgaggccatcactaactacataaaaatcataatgtcagtctaaagcatagacattatattacctctctcagttccacggcaccactttgacagagataaccccagcaagcattccttacacgttctccatgaatgccatagtcttggctctcagcaaatacctaagtcacaagtcgaagaagctctgtatactcaagaatcacggagaccaatgaggctaaaataaacacatgactgagattctcaaacctgatatgccaggaagtttgaagtcctcagctcagaaataataaaatcagtgcatatcgcacacaaatcctgtcagacaaaagccactagttattagatcaattgatccaaaagaaactatcttttgatgcaatcataagaattaatcatacctgaaggtcaagaaaagaagcagcagctaaaacacgaaaggcattatcatcatccagcttagggatggtacccatacagataagctaaagcaacagaaattgcgtctccattaacatttttatcatccacaagtaagttcacaacaggagagctagcttctttccatggaccttgcagcatagtccttaagcaaaattgcatagtttaaaacaaattgcaaaacctgaatatcaaaatcctcccacagaaattcaatattcaaaaaattcacctgaagtaggagctgcgagatagaatcaagcggtggagatggtaactggatcccatagctttaacaacaacgtcagaaaacgcaccagagccgaaaccttcggattgaatatgatcgcataaagaagtaagattacaatcgagagaacgaagctccgaggtactctgatcactttcagcatgaggaagaaccggtggcgatggttgaggagacggtggtggtggaaccgtcattctcatttgatgatgatgttggtggtgcgtcaccgtcgttctagagtttcgatactcttggtccatcaaaaatgacgccggattcacaatcaatttgttctagggaatagattcaatttcaattggggaaaagagaaaagccattgaagacggagaattagcttagctctcactcgcgtgtggcgcaaaagtgataacttagacgctgtcgtttcttaaaagttatgaaacgacgtcgtgtgaattgaacaataaaccagataaccgaatctaattcatgtaaaccgaaccgatgcttgtgaccgttggagccaaaaccttaccaacggtcttttgctttttttcctcttgaatttttgaatataaaatgcgaaaaaggtaacaaaaatttctctttatattaagcttttcaaccccaccattgattattattcccctaacgaatttcaaatcaaaatctctctctttctcttatctctaatg

SEQ ID NO: 17954 - DNA, 3000 bp, Unknown; identical to SEQ ID NO: 17953
  misc_feature (1)..( 3000): 2750-1469P.txt file - cDNA_ID_1814738; gDNA_ID_2926164; Annot_ID_139839

SEQ ID NO: 17955 - DNA, 3000 bp, Unknown
  misc_feature (1)..( 3000): 2750-1469P.txt file - cDNA_ID_1814750; gDNA_ID_1621096; Annot_ID_55694
acccatcggaggcttctcagctttaaacttgtacttcttctcaaacatcaaacttttctcatcatttccagattcatccaacggttctacgcgcaatcccgccaaacctttcctctgtgaattcaaccgtttctccatgttagacaatcttgcttctatctctttctcaatatcaatcccagtttcatcatcttcttcttgcttaccctcacttttatgtgcttcacgtgccatcattctgatctctgcaatcttctcattcatttcaacatcctctagcaaaaccaaattgttaccctcactatcacttgaaacttccggcgttttctcggatttcgttgagtctcccagaaacaaaacagcacaaacagtttgaaaagcgaatattccgatcaaccacaatccatacttcgctactaacttcggagagatcttagttgatataccatttacctcatttgacacaaccgagctacttaagacctgaatctcctctacatcagaaactacgtcgcttgaaggatcattttccggcgtttcgattccgattatgactgtctcttgagctttggatttagggttctaaggattttgggtcgcaggtaattttccttttgatgacttcgacagaacggaatcgaagccgaagaacaccggataacttttacagaaactctccttccggtggagtacgacggaaggaaactcgaaggagataaaaagacggcgcatcggaaaactgccatggctacggcggggatggtcagccactgagactgagagtttcttattagccacattgaaaaaaaaaaaaaaaaaaaaatagtaataacaaataagccccaaacattttaaaatattcgtatattcctctttcaaatttgaaagtttcaatattgaccccaaaagtgaatgattatgcaaaatctttaattttgtcttgagccgcctgttatgtagcatcatcgctctcactcttctctgtggttgtttcgtcttccacactatcacttccatagccacaaaagcttcacataaatcctaattaaaccctaaaaatactgttaaagacaaacagaaaactacaaaatacatcttttgtatatttggaagcttttggttttatggaatcggagaagcctgggattgtttcaattctcgctgcagcaacggtcgattcggagaaacctcgcgtttcaatttctgcggtgagagcgattgcggcggcaagagctgattcgtttcttctcacgcgtactctctctgggttcgttttcatctgctgggtctgttccaattcgtgcacctgttacaattgatgaggatgatgatgatactggtactgtaactgatgaacataactcagcaagtagtgaagctagtagttatagtaatggacttgattttgagactgatgaagatgagactgtgttagaggatgtggttttggatggggttagggtagataggctactaggggaagagttaggtggagatggaagtgaatttcaggtgggagtgggatttatagaccatttgcaggtgatgttgacgaggaaacgtcggtgaattactcgtctttgggaggaagatggtgagaacagtgatgaggtttgcgagagtgaagttagtggagatgaaagaggtagtatgaaagcaaaagtagtcattcctcgggctgttttgtctttggatgatgatgagtttgatgaaattttgggtagtatgatgaagaggctgtcctgttgggtgtaactaaggctccaggtgatgaagaagctgaagttgaagatagagggtcgcagttttgagataagggagtggttatgaaccagagtgttcggattcttttataggtgatgttgattctgaagaggtgagaatgaactattcagataaattagatgatggtttgatgtcctttgggaatattgaagaatcaagtctcggtgttccaccagaaggttctagtgattttatggcagaaaatgaagggaactctagtgaggcgagtatagaattgggtcaaaatttcaagcaactcatcgagaaaggggatagtaaaagtaccatcaacaaggaggatagtggtggtagcattcatgaatttgacgcattgatgaagccaagtgatgtagaaagagtagaagatagtgcagttgaattagcaaaaatgggaatgaatgataaaccagaatacgcaggttctaatataggtgaacttgtatccatagaggaagttatggtacaagagaaatcttctgacaatgtgttagtgtcttttgagagtagtcttggtgttatgacaggtgaatgcaaggagtttctggtggaaagtgaaggaaacgctgttgatgaggataaaggattagatgaaactgtaagcagccttgtcgaacaaggggtgggtcaagctagtaccagcaaggagagcaataacagaactgatgttggtagtgtctgtgatgcagatgaattgataattccacgtgacgagtctattggatcagaaagcagagactcaggggataaagacgctggaaatatgataggcaaggcagaagaacactgtgaaaatgatcgtggtgctgttagcgaattagaaaaacttgagtgcgcggatgaacctgaaattggtatgagttctgaaagttttcagttaactccaacttcagattctgaaatgataatgaaccttgaggtcgctggaggaatagatgtcgttgtaattggttgtggttcttccgatcaaaaagctgaagaagaatctgaaaatgaaggaaatcaagaatcagacgatactgataggaagttgtcacttcctgatgaagatagagcatcaagtttaataagttcctttgaaacagccaatgagactgtggaagatgggaatcaattaataagcaggtcaattttcagtctgatagcgaagcaaaccaaatctcagtgggcatagaagaaaccagtttgctttctgttaaagacattgagaggaccatg

SEQ ID NO: 17956 - DNA, 3000 bp, Unknown; identical to SEQ ID NO: 17955
  misc_feature (1)..( 3000): 2750-1469P.txt file - cDNA_ID_1814750; gDNA_ID_2926164; Annot_ID_139836

SEQ ID NO: 17957 - DNA, 3000 bp, Unknown; identical to SEQ ID NO: 6532
  misc_feature (1)..( 3000): 2750-1469P.txt file - cDNA_ID_1814759; gDNA_ID_1621096; Annot_ID_55690

SEQ ID NO: 17958 - DNA, 3000 bp, Unknown; identical to SEQ ID NO: 6532
  misc_feature (1)..( 3000): 2750-1469P.txt file - cDNA_ID_1814759; gDNA_ID_2926164; Annot_ID_139832

SEQ ID NO: 17959 - DNA, 3000 bp, Unknown
  misc_feature (1)..( 3000): 2750-1469P.txt file - cDNA_ID_1814759; gDNA_ID_2926164; Annot_ID_198977
acaactccccaaacaaaactttagatctgaaaatctcagctttgaaatggaggaaatcggaatagttatcgtcggcggcggaatcgctggtctcgccacttccattgctcttcataggtttgttattaatttattttgtaatgagactcaaactttatgaattccatatgtaaattaatatttggtgtgtatattttttttttaaaatgtaggaaaggaataaagagtgtggtgttggagagagcagagaaagtgagatcggaaggagctggaatcggaactctctccaatggttggagagcccttgatacagcttggcgttggtgatcgccttcgtctcaattcttctcttattcacaagtaagtaatattattcttttttaaccataactttattattcattatatgtttgttttagaattttgatttatggacctttcttggatatgaacagggcacggaccatgttgattgagaatggaaaaaaacgagaattcgtttcaaatatagtgtaagtcacaattttcctatccttaaaattgaagatgataaatataaaaactatagagttaatttgagtattttgatttagtttttaatgcagtttattctattgatttgttgtaatctttgttattgatttgaatatttaatactttgaataaaacagagacgaagctcgttgtattaaaaggaacgatcttgttgaggccttatccgatgcccttccgaaaggaaccatccggttcggttctcatattgtttctattgagcaggacaaaactacgttgtttccggttgttcacttagccaatggaaatagcatcaaagccaaggtaaatatcagtattgtttatttagacattaattgttcaaaggcaaatattacatttggcttttgcatttactgaagaatttatttttgtatgctttcaatagtataaaataaattatgcaatataatgtttttcttctctcataggtcctgattggatgcgatggtgccaattctatcgtcagtgattatttgcagttaaacccgaaaaaggcgtttgcttgtcgtgcggtgagagggtttactaagtacccaaacggccatggatttccacaagaggttctaaggataaagcaaggaaatgtcttaataggaaggcttcctttgacggataatcaagtcttttggtttctagtacatatgcaagacaataatcacaatggtaaagatcaagaatcgattgcgaatctgtgtcgaaaatgggccgatgacttgtctgaagattggaaagaaatggtaaaaatatgcaatgtggagtcattaacactcacacacttaaggtaccgagcgccatcggaaatcatgttagggaaatttcgtcgtgggacagtgactgtagccggcgatgcgatgcacgtgatgggtccgttcttggcacagggcggctcagcggcgctagaggatgcggttgttttagctaggtgtctagctaggaaagttggtccggaccacggagacttgttaaaggattgttcgatgaaaaacattgaagaagctattgatgagtatgtggatgaacgtaggatgagattactcgggctttcggtgcagacttatttgaccggacgttcgctacaaacgtcatcaaaggttctgaggctaatgtttatagctttgttgttacttttgtttggtcgtgatcaaattcgtcatactaggtacgactgtggccgtctctagagatttgatggacattttgtattttttagtgtgaggttgtgtgctttaaactttttttgtgtgtttctttttcttataacatcctcctttctcaatataacaagagtttacatgaccatacattatattgcaaatgtgatttatcaactattgctatgataacaaataattgtaaaactaaacgtaactaaaatgctttggtcctggtcttaacgaatatatgtgcctaggcccaaaacctcttagttgtttaaataaaaaacaaaaacgaaactaaagaaacgaaattagacaattttttcttactttactctcagtcacatatttgtaatttattatgtgtttcatttttgtatatgtttttttcaatttattatggtcgacattgtgctatcatcacgatgtgcattttagtgatcaagactattcattcattgactcatggactcattgaatctctaggagctcctacgctcaatgacccaaaaaaatgttagtgaagttgaattttggtttggtctctccgcttcagtaaatttagtctaaggggaattgaatcgtttggtgacctcgtttttgagagattctagttaggaatcctacatctaaaatgagaaagagcctatattagcatctcaactcattgctgataaattttaattggaagtacattaatacttacacatgatatatatttcagtaaatttaagcgaacagacactacgattttattgagataaaatgagccaaggaaccaatatctcgattctcgaagatacgtgttatgttttaagactccctaaatttaactaattctcattattgatttcactatatagctgtaacaaattttctttatgtactcctttaatttgtaaatgatattttcgtttttttgacaccattaaataagataatttccttgaaacaaataaatttgtcctcatgtcaaatgagtcatcatatttttgtttatatccaatataggtatgtatcttacatgtagtaatgaaaattgtaaatgagactaaaattggtctcaacttttaatatttcattttgatgaactgtatttcataaagattaccttttaaaatttcttattcttttttttttttgacagctaaaatttcttattcttttgtttccatttactcaagaaaacatttactacattttcctacatttagcttatttgactattttaaaaaaacgttataagctagactcgcatagtttatgtcaagctctcatcacagttatg

SEQ ID NO: 17960 - DNA, 3000 bp, Unknown; identical to SEQ ID NO: 6515
  misc_feature (1)..( 3000): 2750-1469P.txt file - cDNA_ID_1814767; gDNA_ID_1621096; Annot_ID_55687

SEQ ID NO: 17961 - DNA, 3000 bp, Unknown; identical to SEQ ID NO: 6515
  misc_feature (1)..( 3000): 2750-1469P.txt file - cDNA_ID_1814767; gDNA_ID_2926164; Annot_ID_139829

SEQ ID NO: 17962 - DNA, 3003 bp, Unknown
  misc_feature (1)..( 3003): 2750-1469P.txt file - cDNA_ID_1814783; gDNA_ID_1621097; Annot_ID_55746
gtcaggtcaaagccgttgaatcaactagtgagggtaagaaatgtgctctccaaaacgatgaaagggacttggtaggatgtgcgacctcggaaatgttggaatctatcagcaaaaaatgcgaagcaagcattattgatgataacaaacgttctgtgagcatgaatgctttacaggatagtactgcatctaatgttgaaaagcatcctgaaacattttcagtagcgaagcctgctttgtctagcacactctcctctgcacatagtaatcaaatgagaggaagggactgtgttccatgtgaggttatagatgagaagaaagttatagtaattggagctggtcctgctggattaacagcagcacgtcatttacagcgccagggtttttctgtaaccgttcttgaggcaaggagtagagtaggtggtcgtgtatttacagaccggtcgtctctttcagttcctgtggatcttggggctagcataattacaggcattgaggctgatgtgccatctgaaagaatgccagatccatcggtattggtctgtaaccaattaggtctggagttgagcgtgttacatggattctgtcctctttatgatactgtaacagggaaaaaggttcctgcagaattagatgatgctctacaagcagagttcaacagtctaattgacgatgtagatttgcttgttgaggaaataggcaaggaaagagcaaataaaatgtctcttgaggatggtctagaatatggccttcaacggctgagaatgccacatgacaaggtgaacattgacaaatttgggcttctcaattcaagctcaaaaacgggcatcagaggtccctttatgcaggatgaaagctggaaagatgattttttgaatcctttggagcgaagagttatgaattggcattttgctcacacagaatatggttgtgctgctgtcctcaaggaagtttcgcttcctcactggaatcaagatgagttttatggcgggtttggagggcctcatgctatgattaagggtggttatagccgagttgttgagtcgcttgcagaaggactggacattcacttaaacaaaatagtttcagatgtatcttatgtctctgatgtatctgccatggataacagcaagcataaagtcagagttagtacatcaaatggctgtgagtatcttggagatgctgttctggtaactgttccacttggatgcttgaaagcagaaactattaagttttcaccacccttgccggactggaaatatgcgtcaatcaaacaacttggttttggagttctaaataaagttgttttggagttcccaacggtattttgggatgatagtgttgattactttggggcaactgctgaggaaacagatctaagaggtgagtgctttatgttttggaatgtcaaaaaaactgttggtgctcctgtcctgatagctttggtggttgggaaggctgcttttgaatatacaaacaagagtaagtctgagcacgtgaaccatgcaatgatggttcttcggaagctttttggtggggatctggttcctgatcctgtcgcctcggtagttactgactggggcactgaaccttacagttatggtgcctactcgtatgttgctattggtgcttctggtgaagattatgatgtattgggaaggcctgttcagaattgtttgttttttgctggtgaggcaacatgcaaagagcatcctgacactgttggtggtgcaatgatgactggagtccgggaagctgtgcgtataattgatatacttagaagtggaaatgattacacagccgaaatagaaacactagaaaaagcgcagaggaaatctgtacctgtaagggatgaagtcagagacctaataaagaggctggaagttgttgagctgtctaatgtgctagccaggcaatcattgctacgaaacatgttcttctctgccaaaacaactgtcgggcgtttgcatttagccaaggagttgcttaacctacctggtgaaaccttgaaatcctttgcaggtacaaaagaagggcttgcagtgctgaactcttggatcctggtaagctcagtgagatagttttttttaccaaagcactaaattcaacttactttcgcttatatgttttgttccacgaatttctattggctattttacatattcttgcttatataaaattttctgttaggattcgatgggtaagaatggaacccagcttttacgtcactgtgtacatattcttgttcgagttacgagtgacctctttgccttgaggctatcaggtattggtttttcttccaagtacactttttgtcccaacctaatatatcacatgcaatcagttctgtcttaagactcgacatcatgtgctatctgttttgggatttcagccctgtttgattttctctaagttggttactttccacttgctgatgcaggtattgggaagactgtgaaagaaaaggtttgtgcacacacgagccgtgatattcgtgccattgcaagtcagcttgttaatgtgtggctggatctataccggaaagaaaaagctaatagtggaaagaaatcgttgagacaagcgaatactacaaacaccccctagaataagaagaaaactgaatagtccggacacagacagtaagggaaagctgagcaatggcaacgatgtgaaaacagatgaagagtttgaggacaaccagctacctatgtcagaggaagagaaggctgtgtttgctgaagctgaggcggctcgtgcagcagcagaagcagctgcaaaggcaagttttttttaatctctaaattagtgaaaggcatttatggatgcttactgaatgtttttgttttctctgaggccgttaactctttatttatctgtttgttaacgaataaattatatgtttctgtcttgcaggcattttctgaggcctatcataatacttcattgcagcttcctaagatcccctcatttcataagtttgccaggcgagagcagtatgcaaagatg

SEQ ID NO: 17963 - DNA, 3003 bp, Unknown; identical to SEQ ID NO: 17962
  misc_feature (1)..( 3003): 2750-1469P.txt file - cDNA_ID_1814783; gDNA_ID_2926165; Annot_ID_139888

SEQ ID NO: 17964 - DNA, 3000 bp, Unknown; identical to SEQ ID NO: 6578
  misc_feature (1)..( 3000): 2750-1469P.txt file - cDNA_ID_1814790; gDNA_ID_1621097; Annot_ID_55742

SEQ ID NO: 17965 - DNA, 3000 bp, Unknown; identical to SEQ ID NO: 6578
  misc_feature (1)..( 3000): 2750-1469P.txt file - cDNA_ID_1814790; gDNA_ID_2926165; Annot_ID_139884

SEQ ID NO: 17966 - DNA, 3000 bp, Unknown; identical to SEQ ID NO: 6559
  misc_feature (1)..( 3000): 2750-1469P.txt file - cDNA_ID_1814798; gDNA_ID_1621097; Annot_ID_55739

SEQ ID NO: 17967 - DNA, 3000 bp, Unknown; identical to SEQ ID NO: 6559
  misc_feature (1)..( 3000): 2750-1469P.txt file - cDNA_ID_1814798; gDNA_ID_2926165; Annot_ID_139881

SEQ ID NO: 17968 - DNA, 3000 bp, Unknown; identical to SEQ ID NO: 6555
  misc_feature (1)..( 3000): 2750-1469P.txt file - cDNA_ID_1814815; gDNA_ID_1621097; Annot_ID_55732

SEQ ID NO: 17969 - DNA, 3000 bp, Unknown; identical to SEQ ID NO: 6555
  misc_feature (1)..( 3000): 2750-1469P.txt file - cDNA_ID_1814815; gDNA_ID_2926165; Annot_ID_139874

SEQ ID NO: 17970 - DNA, 3003 bp, Unknown
  misc_feature (1)..( 3003): 2750-1469P.txt file - cDNA_ID_1814826; gDNA_ID_1621097; Annot_ID_55729
gaaataaaaaaaaaaccaaaaagccgattaaaccgatttaaccgaactcaaaaacctacataaaaagcgtttagtttcattgttcacctattatagaacaaagacaagaaagagaggttaacaataccttacaacagaagaatttcaaacagtttgggcattccaacgcataaatattatacaatcttgtatgctcaacatattcatcacagacaaaagccatttgggaatcaacggcagcaactgagtagaattgaagtaagaaaaggaaaggaaatgaaagtaataggtcaatagtattggtttttttttctactctttgtaaaatagatcacccatcgaaaaaattaatctttttacataacactaaactatttatttaagtctgtttaaaattacttataatttaaatatttttttcaataaaaagataagacaaaaaaagttaaatgcattgaaaaaaggaagttgaacgcaaatagaatcaagtcaccttattattattggtaaatctaaaaacatctagctactaattttataagacatgttgtgttttggttatcacagtaaaagtgatagcaaatacatattttgttacctaaattcttctacacagttttaatttttttgtacaactattgttctaagtgtgataatctaactcattatctattttttgagaagatttgatattagtagaatagattatttgattatgttttattaactaatccaatttgctggtaaatccactatatattaatagagaaacacttaaaagaataacatctagctacctatttatagaaatgtcatgctaacgagtcaaccaaaacaattttcaatcaatataatttattctttatttactagattgtttactaaatcaatagaattattttgcaatatttatttgacacatttactttatttgattctatatctaatttttacttttacgggtcaatatttttcaccaaacaataattaaatgacaattcaaattaaataattcaattatcttaattacggacaatttagttttaaattcaattttaatctgacccatttatgattcacacttgtcttctagtagtataggtatttttataatgccactttgtataatgatttatgattttattgcttcaattattctcgacaaaaagatattatttattgattatatatagttttttaagaaacacatcaaatataatctacatatatatttttgcagctattttgtgaaataaatcttggagttgagacttatttacaatggctgccactggtttttaattattatttttttttgtaataaattgattaacaaacgaaaaatattccaaatatatttcaatcccatatatcacacagatttctctaaaatttgaactagatttcgacaactatttaaaacaaaaaatgtttgacaaaccaaaatacaattgcaattccttaaaatgagcaaaacgcacctaaatacattctttatcgatccaataaatcttatttctccaaaatttgaattagattttggcaactatttaaaaaaaatatttgtttgacaaaccagaatacaattgcatcccgtaaaatatttattttaattatatatttaaataagcggtgtaccgcgggtttttttatgggacaagtttggcaggacgttacttaataacaattgtaaactataaaataaaaatattttatagatagatataatttgcaaacttttatatatattaattaaaaaaaaatttgttcatggagtgtaccgcggattaaaatctagtattgtaacaatcttggacatcgtaaaagtctgaagaaattaatagttaatcaacgaaaacatataaaacaaaacatgaaatgaaatagaagtcggcaaccaactttaattggttaaacattagcttaactcgtaactttaaatttggaaactaatgtacactattaatctaaattcgaaatcttaaactcgaaaatatgtattcttagttattaatgaaatttttactagttgacaaaaaaaaaaaaatttaaaagattttttttatatatttgtgtcttattagaaaaacttggaccgtccggttaaggtgtctttttctggttttttttaattaattaattaattattttggcttctttcggaccagtcctactgtacatcgtatctttcagtatttgtcaactagtttaaaggggcaagttcacaaatgggacctgcatcttgtcctagccaataatatcgttccacgtcgtactctatattgtttgtcacacgcggaaaattaactgtgcacatttgcaggatgctattttttactattagtgaaattgcttcattcactttggcccgcttctttattttgttgtaacatttaccctacagagttctcgaattatcaatttggtacttaatgaatcattttttcaattatcgtacctattttcattgaaataatattaaagcataaattcagtaccgaagtataattaggtcaaccgatgtaattttacaaaactatatttgaaaatacaaataattataaagagaagttttaatcgaattccaaaataaatccattaattttaaaccaaaaatcttataaaggttataaaatacgtataaaaattagttttgtgaaaacatatatcaaatgttttagggggtcagggtgtaaactgtgaataaaaataaatgttatggtaaaaaaagaatattttgtttttatgcgagttaacgcataatgtaccagttccgttgaatcgtcaacacaagagtcacaaacaaatttatcttttaacaaatttctctcttaaaaaattatttataaaaactctgagctcgaaatcggatttttttttcgtctctctcatcattttgctgatttctcaatttctgtgtttacactactccatcgacttgtaatttcactttcttagggttcttcttcatcggatcatcggccgtatctgaaaccggagatg

SEQ ID NO: 17971 - DNA, 3003 bp, Unknown; identical to SEQ ID NO: 17970
  misc_feature (1)..( 3003): 2750-1469P.txt file - cDNA_ID_1814826; gDNA_ID_2926165; Annot_ID_139871

SEQ ID NO: 17972 - DNA, 3003 bp, Unknown
  misc_feature (1)..( 3003): 2750-1469P.txt file - cDNA_ID_1814830; gDNA_ID_2926112; Annot_ID_196676
acagagaaaaaacacagaaaataagcaagcacggactccacctgtaaaaaccttcaaagttacttatgctttacacgccacaacacaacatagattcctaagatcaattagaaagaattaactctatcttgtcaagtcatttcttttatcaacagattcatatttagaaatgtgatgaaagtggatcgactcatatactagctattcgattacttctgcagaagatcttaaggctcttatgattgaatccagatcaatcacaaagaatgtgttgcaaagactctcacatttgactaattcaaacattaggtgtaaaaggaagctaacaagtaacatacataagacttttatcaacgagtgagcacatgggacttaaacaatgcaattgttgctagcatttgactatctctactaatctgaaattcctccttaattatagggatctacactagatacttcatccttaacataccaaaactcctaaatatagcaaaccaagatcagtcaaaagattattaagccataaatcaagtaaaccaaaatcaaatttaaacctttttgagtagctttgggacatttccatccatcagtagcgagagtgatgttcttaggaagcggcacattcggcggcgcaactccgaactgagtcccgacgagctcaacacgagcttgcatctgagtgacatcaccagcagtctgaatagctgatttcaaatccgacgaaggataaccagcgaaaacggtaccgttttcgacgctcaccggtaagctcgagccgtctgagagtacagcgtttgaagcagagacgaggatctctcggtgtgcgaatttgacgaagacacgccatgatttgagctcgtcgcggccgtggttgagcactgttatcacagattcgaaccggtagggttgatttgcggtgtcgttgggtgggatcttagatcctttagtgtgagtgtatgaaacgaatacaccgttgcatagatccgaatctgacggtggtgacggtgacggattagtagtgttggcgtcggattgtgatgatgttagaggaattgatacgatgagaagtgatagtagaagtaaccgagggatgaagttgggagctgaatccatggaaccctaaaatctcgctcttagtcaaaaagagaagttttttgaatttgaattttgtttgggaattgagagaagttagaaaaatggaagcttttgaagagatgatgactgataaagcgaccgcgatagtgcaagctgtaatgaaaaatgtttgtatttgcaattcaaattttcccctggagcattttttgttggctttttttgctttttcttttgttgaaaatctaagaaactttatggataccaatactcttacattattacataattattttcttaacaaaaataatgtatggatataatttcttaaaccctattttataagaaaaataaagattaaaaataaaataaaaaacacctaattgcaacaaaaacttcattttgtattcaatttttagatatatttaaaacgcactaaacaagtgagagcacatgagttctgtcgcaacataccaaattcttattttctgttcaacggtggtttgcttacttataaatggtatgagcatgagactatgagagcatcaatacatattccttaaaaccatccttgtacaactttccgagtcaatgagttcgtagactttctcctgaatagtgaagaaaatgttttgtatcatcgccaaattccactctttgcgatattaagctgtgttcagtgttctcgttcatagtcaggtgattaaaacaaaataacttcagaacatataagaaagcccaaaataataaaaagcccaaacccaaaataaaacgtatagcccgatacaatagacgatacatcactatcactagtactaagccaactagacataagacatctcccgtgaaatgtttgcttggtcttaactcttaagcttaattaagaagacaatgagataatcctcatgccaagttagatcactaatacactagtaacctccaatccattattaacagtatttctaatcatcggaccagacaagaatattaaacattcatgctactgtcttgagtgtctatgatctctttcccttaaactctcttgctgctgctgctcacaaatgattcgtccaacagaaaacggtgccgtcttttcagaaactttataaataatggataagaatactatgttttttactacttgggttttgtcacagatatcatctgcctcgtcagaaaggtaacagataaaaaaaataaataaaaaaaatgatgaccttatcttcaaccgctactcctacaacttggtaactgctgctctagatagataaatttgcatcttaaaaaattgtactatatttagaaagaattatacaaatactcagagattagttacaaagatggagaatgttgagagttaacttgcaattaattgaattgcaatcaactaaattacaatataccaaacgatgatcatatcgacatttgcggataagatcaattgtagttataagtccaaatcatatgatattggtctttcctttcttattgtcctagagagtttagataagaaaacatatatagtacttttaattatttctgcaatccattctttcccaatagtgcaattttcagtgtggaatttatatcccatatataaaattcatattcacgaaattcgttttatcttttttcttgaattgcggtgttacgtaaccatccttcgcatcataataaattattaataatttataacgattttaaggaagaaaaaaaagcttttaaaatcggagaattaatttcggttagttcagatttatgagtgaaagagcaaaattgcaaaaaaaaaaaaaagtcactgaagatttattagactctcttcttcttcttcctccttggcgcaatttcgcaatttcgcaatcgcatcagtcaattatcgaatcgtcctcccagagattaccggagaaaatg

SEQ ID NO: 17973 - DNA, 3003 bp, Unknown
  misc_feature (1)..( 3003): 2750-1469P.txt file - cDNA_ID_1814830; gDNA_ID_1621097; Annot_ID_55727
atataattggatgaatatgatctgaccacatcgtacatgatagtgaggtctccatcttttcgtggaagaaactcattatcaatgatctctctgttatcatagtctgggtcaggaatgcaacatacttgcagaacatttgtacctgacaaaacagagaaaaaacacagaaaataagcaagcacggactccacctgtaaaaaccttcaaagttacttatgctttacacgccacaacacaacatagattcctaagatcaattagaaagaattaactctatcttgtcaagtcatttcttttatcaacagattcatatttagaaatgtgatgaaagtggatcgactcatatactagctattcgattacttctgcagaagatcttaaggctcttatgattgaatccagatcaatcacaaagaatgtgttgcaaagactctcacatttgactaattcaaacattaggtgtaaaaggaagctaacaagtaacatacataagacttttatcaacgagtgagcacatgggacttaaacaatgcaattgttgctagcatttgactatctctactaatctgaaattcctccttaattatagggatctacactagatacttcatccttaacataccaaaactcctaaatatagcaaaccaagatcagtcaaaagattattaagccataaatcaagtaaaccaaaatcaaatttaaacctttttgagtagctttgggacatttccatccatcagtagcgagagtgatgttcttaggaagcggcacattcggcggcgcaactccgaactgagtcccgacgagctcaacacgagcttgcatctgagtgacatcaccagcagtctgaatagctgatttcaaatccgacgaaggataaccagcgaaaacggtaccgttttcgacgctcaccggtaagctcgagccgtctgagagtacagcgtttgaagcagagacgaggatctctcggtgtgcgaatttgacgaagacacgccatgatttgagctcgtcgcggccgtggttgagcactgttatcacagattcgaaccggtagggttgatttgcggtgtcgttgggtgggatcttagatcctttagtgtgagtgtatgaaacgaatacaccgttgcatagatccgaatctgacggtggtgacggtgacggattagtagtgttggcgtcggattgtgatgatgttagaggaattgatacgatgagaagtgatagtagaagtaaccgagggatgaagttgggagctgaatccatggaaccctaaaatctcgctcttagtcaaaaagagaagttttttgaatttgaattttgtttgggaattgagagaagttagaaaaatggaagcttttgaagagatgatgactgataaagcgaccgcgatagtgcaagctgtaatgaaaaatgtttgtatttgcaattcaaattttcccctggagcattttttgttggctttttttgctttttcttttgttgaaaatctaagaaactttatggataccaatactcttacattattacataattattttcttaacaaaaataatgtatggatataatttcttaaaccctattttataagaaaaataaagattaaaaataaaataaaaaacacctaattgcaacaaaaacttcattttgtattcaatttttagatatatttaaaacgcactaaacaagtgagagcacatgagttctgtcgcaacataccaaattcttattttctgttcaacggtggtttgcttacttataaatggtatgagcatgagactatgagagcatcaatacatattccttaaaaccatccttgtacaactttccgagtcaatgagttcgtagactttctcctgaatagtgaagaaaatgttttgtatcatcgccaaattccactctttgcgatattaagctgtgttcagtgttctcgttcatagtcaggtgattaaaacaaaataacttcagaacatataagaaagcccaaaataataaaaagcccaaacccaaaataaaacgtatagcccgatacaatagacgatacatcactatcactagtactaagccaactagacataagacatctcccgtgaaatgtttgcttggtcttaactcttaagcttaattaagaagacaatgagataatcctcatgccaagttagatcactaatacactagtaacctccaatccattattaacagtatttctaatcatcggaccagacaagaatattaaacattcatgctactgtcttgagtgtctatgatctctttcccttaaactctcttgctgctgctgctcacaaatgattcgtccaacagaaaacggtgccgtcttttcagaaactttataaataatggataagaatactatgttttttactacttgggttttgtcacagatatcatctgcctcgtcagaaaggtaacagataaaaaaaataaataaaaaaaatgatgaccttatcttcaaccgctactcctacaacttggtaactgctgctctagatagataaatttgcatcttaaaaaattgtactatatttagaaagaattatacaaatactcagagattagttacaaagatggagaatgttgagagttaacttgcaattaattgaattgcaatcaactaaattacaatataccaaacgatgatcatatcgacatttgcggataagatcaattgtagttataagtccaaatcatatgatattggtctttcctttcttattgtcctagagagtttagataagaaaacatatatagtacttttaattatttctgcaatccattctttcccaatagtgcaattttcagtgtggaatttatatcccatatataaaattcatattcacgaaattcgttttatcttttttcttgaattgcggtgttacgtaaccatccttcgcatcataataaattattaataatttataacgattttaaggaagaaaaaaaagcttttaaaatcggagaattaatttcggttagttcagatttatg

SEQ ID NO: 17974 - DNA, 3003 bp, Unknown; identical to SEQ ID NO: 17973
  misc_feature (1)..( 3003): 2750-1469P.txt file - cDNA_ID_1814830; gDNA_ID_1621097; Annot_ID_171119

SEQ ID NO: 17975 - DNA, 3003 bp, Unknown; identical to SEQ ID NO: 17973
  misc_feature (1)..( 3003): 2750-1469P.txt file - cDNA_ID_1814830; gDNA_ID_2926165; Annot_ID_139869

SEQ ID NO: 17976 - DNA, 3003 bp, Unknown; identical to SEQ ID NO: 17973
  misc_feature (1)..( 3003): 2750-1469P.txt file - cDNA_ID_1814830; gDNA_ID_2926165; Annot_ID_199054

SEQ ID NO: 17977 - DNA, 3003 bp, Unknown
  misc_feature (1)..( 3003): 2750-1469P.txt file - cDNA_ID_1814838; gDNA_ID_1621097; Annot_ID_55725
atgaaagaaaggtcgaaacccgtaaatcaaggttcgagtacggattaacaaacgagtggctcggatttacgaggagtgactcggatttaaggcgagtgatctaacccatggatcaagattcatataaagtatatatagacttgaaatgatcttagctgataaaccatattctatacttttaaatctaaatttgcttcataatcataactgcaagaattaaaaagtaattggtatattttaattatgggattttgttacaaaatatatggtcaaatcgctgatgcatatatatagttcaaaaaaaaaaatctaatgcataaattgtttagaaaaatgtataagtgcatggaaggaaggccacacatttgatcttttacatgctccaactagatcagtaacttctaaagcaaacaccactctattcagcttctagctatgcaagaatttgttgctattacctattgggggttatacctttctaatatttttgttaacgattaagtttacgagcgaatacacatgtgtacgtacatatatgatatatactgtcaacatataaatagttgtgtgtatacatgtagtgttgttagaaaatgcgttgccttaatcatatgctagaatgtgcgttgatgtattattctgttttatttaagatagcatatattataatgtattttgcccaataatttaatacttgtaggtcatagtctcataagatgtaggaggcatggtttatacttaatactttatagtctccaaataaaatcatggtatagacctaaatttttgggaggataatttgataatgtcatgcctttggggtttcgtaactaaaaaaaaacttacaagaaaattataagatgattaaagaaaataagtagaaagaaaatatattttatatcttttaacaaagtaaaaacatattgaagaacaaaattaacaatattttgttaaggttgagtttataaaatgagttaatttatgttttcatgtatgagctggatccacgtatcaagggtctctggtccaactttttctcaattgttatttagtttcgtatcctgtagtttaaaacaatataagatcaaccctgcaaagttaaaaatcttacagaaaaccccatgttttgagacattacattaattgttccaaaaaaggctgtactgtccgaaaatgttgcattattgcaaccaattgtgttatatatgtgttttacatatgatatactaggaaaattaaggatacacatgatttatcataacaatacttaaaaaataaataatattatattttcatctatttatatcgcattatttaaaactcatatactgtcaaattatatcgaataaataatagaaattttgttacataacattcaaagtagtactatgactaactaaatacacactacataataagagtcaaaacccaatatatcttggccaatgccttaggaaaatgcacaaacaaactcaaacacattgaagtcattaaaaaaaagtggtacagagaatattggatgaggaatattcaccagacaatgatcctgagtagaaagttgaagaactagagcatgatttggactagtagtatacataataactagattttaacctgcggtacaccgcgggaacaatttattttttaaattaatatatataaaagtttgtaaattgtatatagttataaaatgtttttattttatagtttacaattgttattaagtaacgtcctgccaaacccgtcccgccaacccgtcctcttaaaaaaactcatttattttattaatgttgatcttatttatgatatgtttatgaattattgtctaaatattttgtaattttgtagtaattaaatgctatcaaagatctctacggtttgatgattataatcatgtagaaaagcaatatcaaaaatgataattttgtagtaattaaataatattaaatattttggaagttttattttaataattaatcgtgtagttaaggtagagagattttgggaagattattaaatgtcaaatatttaattagaagattttctttctaattatcaaaaataattattaaatgccagtggcagccgctgtaaataaatcccaactccaggatttatttcacaaagtggctgcaaaaatgtatatatagataatttaaaaagttatctttatcaaattttaaaaatcaaaattttaaatttataatgtattatagaaattagtataaatttaatatacaatagaccaaaaccataaaaggatacgagaaaagaaactcaaaacaaaaaaaaaatcatgaaatttaatattttaacgattattattttagacaaaataaatcaaatctgaaatttattttatatcagattaaataatagtaattatataaagtatgcgacaaaaaaaaaatctacttaaagcatatgagttgtagacttgtagtgaaagaaaatgtgtaccaataatctattttaagttttcactaggtttgaatttaggtttggtaatttagcatttagaaaaatggatctaaaagtaaacttgataaagtacatggtctatatctggagaaaagaaaaatgtaaaggacatctctacaccaacgtatatacaacaaagtacaaacatagacagacatgtataaactatattaatactgtttaacattttcacatttaaacctttttcaaattattagttcaacttacttcaaaaaaagaaatgtaacagagaaatccgagctttcaagctgtgaaacaatagccatgcccctcataaatctttctactaattattttttttcacgtaagattctcaaaacaaatcaaaatctcatcttcttggtatcaaaaattttcttactttttttggttttgttatcccgaatttttagaatcaaaacccacgtcaattctttttcaaaggcatatattctctctgtttcaaactttgtgtctcttcttctccttctctgatcgttcgttttctggacgagagagatg

SEQ ID NO: 17978 - DNA, 3003 bp, Unknown; identical to SEQ ID NO: 17977
  misc_feature (1)..( 3003): 2750-1469P.txt file - cDNA_ID_1814838; gDNA_ID_2926165; Annot_ID_139867

SEQ ID NO: 17979 - DNA, 3003 bp, Unknown
  misc_feature (1)..( 3003): 2750-1469P.txt file - cDNA_ID_1814842; gDNA_ID_1621097; Annot_ID_55724
agtcccttcttgactcgatctaagaccaaagtgcctggccacaagaataatgtctctctcgtttttatctttgtttccacgtttctccacatttcctttttcccttattatataatcttatgaaaatggaaacgaaatatctttgttatcaaatttgtgcacaagattctttactttgcaccaattattttttctttacttttcctttgatgacctatgtgaaaacccttttgtttctttttgattttttcacatatcaaagcaaaagctatgtcgtctctgcttctaagcctctcttccaaggcctctctccgtaaacttcctctggtaaatctcttctagtttttgtatataatctctgtttccttcgtcttcttcttctgatgtctatttcttacttttcaccagagatgccacactcttcggatgttttcctcctctaccaccaacccttacttgttgtatcgtgtcataaactatggaagttctatggatgatattcatgtaacaagtaatatccactattttgacccggtgaaggaagatgaagttattgtccgagacaaggtattaccaatggagttgcgtaaagggtgtctggtcggaatgtcccatggttggggagttttcaaggccgtgtgtgattataatgaatataaagccatatatgttactgactactacaatccatgtggctccaaatctgtcaaaagcattcctttgcatccccttggtaaacctatagctatccaacaacaagctatcactaacgccgcaatgacttgttcacctgatcaaagcaaagattttgcagttgctgtcaagtgtttaggacctatgatcaatttcaataggcctggtggcacacacaaggactcgggttcggtcatctttaaaaccccttttcaatattttgatcaatcaaaggttatgtattcaaagagagatgaaaagttctacactcctagttttggagggcacttcttggttttttgggattctttcttcggagaggatatgaccggctctgagttggttgagttgcggttttgcaacgttcctaagttgacccagtccgagtgggagctcttgactcatgttccaagactgtataccttgtggagtctccctcaggccaacgtttcctaatcaagtagtacgctcagaaccaccaaccaggtgattcgatgacattcctgtgtcgcggaacaaagcgtttcatggtgtttagagagctggaagaagataaaaggaccatgtgttacacggaggacattggagatctctgcatattcttaggcaataatgagcccttttgtgtcaaggcaagctcattccctggtctaaaccctaactccatctattttgcaggcgatggcttcggtgtttacgatatcgccactagaaaaccacgttccttccgtcccaagtctccctcagccttctcgtcagcatcactcctcccttactggatccctccaatgtctctttagtttacttgttcttcactagtcatgttctgtaacttttgttttttatgcttataattgttcttttgcgagcccttggacgttggccgccatcttcatacgagttaataaattttggtgtgaggaaatatacgagtcaatttatgaaacgaaggtagtaactttcgtaattccttttttttttttttttttctctggttgtatgaatcattcatcatcgatatcttatacttttgtatcatgatcgtatggatcattcatcatggaccttgaggggttactcaatagagagcagtagtgtggaagaccttcttggtatgactaagctcagaactctcacggtccattcccttgatggttgtacgttagaaactctgtctgcatctctctgtgaatcgagagaactcgggcagctttcattgtacgaggtcatgcatgataggcataatgaaggaaaattagttcttgatttgattcaactcaaatttttaacggtgggcatgcatatgcctaggttgcctgatcaacatcgattccctccaaaccttacgaacatatgtcttcggtattgttgcatggaagatgatccaatgccgattctagagaagttgctccacttgaaattggttgaattatcatatggtgctttcactgggaagaagatggtgtgttcaaaaggtgggtttcctcaattgtatgagctaaatttatgatttggaagagtggatagtagaagaaggctccataccatgtctccatactttgactataaatgaatgcagaaagttgaaggagcttccggatgaggtcatatacataacatccttaaaacaactgacaattggaggaaggaatagtgaatgggtgtggaaattgtctgaaagaggacaagatcactacaaagttcaccacattccttgtgttcagtttatttactagacctttgtctaattttatgtataaaaattataacaatgtagaaaactacaacacaaatgagatcaaattctgatttttaaaatccggttgtgatgattattaatcgtggaaaaaaatcagggattataacttttgttaaattgtgaacgtacaatattgaactgaaaatgccaaatgaattggttattattactttgatgaaaatgaattgatcgtttaattttttttatatttataacaaaaatgcgatatgctctttttaattctttatttctatttttgcttcagaattttttttcattttatttttggtcaaaaaggttattaatttccttttcaatttgtacgaatttaaacggtgacgtttttgtttaaattatcaaacaaatcaaaacaaaatcaataaaatctaatctctcatcatgaggcatctttgactgctctttaattcactaaaaaagtctaaaaccctaaccattgccctttttcaaacgaagaagaagaagacgaaacgctaccatcatctacacacacacacccaactacttttttccatcgccggcctgtacaaatg

SEQ ID NO: 17980 - DNA, 3003 bp, Unknown; identical to SEQ ID NO: 17979
  misc_feature (1)..( 3003): 2750-1469P.txt file - cDNA_ID_1814842; gDNA_ID_2926165; Annot_ID_139866

SEQ ID NO: 17981 - DNA, 3000 bp, Unknown; identical to SEQ ID NO: 6549
  misc_feature (1)..( 3000): 2750-1469P.txt file - cDNA_ID_1814853; gDNA_ID_1621097; Annot_ID_55721

SEQ ID NO: 17982 - DNA, 3000 bp, Unknown; identical to SEQ ID NO: 6549
  misc_feature (1)..( 3000): 2750-1469P.txt file - cDNA_ID_1814853; gDNA_ID_2926165; Annot_ID_139863

SEQ ID NO: 17983 - DNA, 3003 bp, Unknown
  misc_feature (1)..( 3003): 2750-1469P.txt file - cDNA_ID_1814857; gDNA_ID_1621097; Annot_ID_55720
atttgaagcttcaattgcttatgtggtcaacgatatgcttggtgttacagatccgttgttacgtctagagagatttgttcttgcaccattgcctgaaatgggttctccaaagcttctgcaggttagtctcctatgtctcaacgttaacgtctattagaagttattggtaatgttttctttaaggaatttatttcatgtgactttaggtttccaatctccgtatacagcataatatggaacccgatgagaagcaattagctgattatggtagatgggccttggaggtatttgttcttgaccatatattctgcaacaaaattgaattcacatatgaagaaactattgcattgaaaaggcaagaagaacttattcatgaagaggaagcagagaagaacactaaactcaaaaaaacatttgttggtaaaaaagtgaactaattctttttagtgttttattcctaggctgctctggttttaagactttttaatataagctttctatcttttaactatgtgattaaagattatatatggtggttgtgtttcttttatttttctttaaattaatgctacatacttataaatttaaggttatgttcaatcttgtcactatcctactggcgttaagtcttcgctcacacgtcacacactgcaaagcactgaaattatttcttaattagtgaaaaggtttggggtatgttaacaaataccaataaataaataaaacatatatagtacatgttcctccacctgtcacaggcaacatttgctttcaaaagcaaagaagcattttttcctccattttcttcttcttctccaaatggattcaacatttagagatgaagatctcgttgaagagagagaagaactcatggtgtcttacagtgagaataacagtcgacctatcatgaaaaaagctcactttttaaaaccctttgtcacctcctccattgatgggtttcaaggtatgcttcgtccatctccttctcctgagttaaaagcttcgtctttaagtgtttcctttcgtgggtggaggttaccaaacaaaaagtttcagttttgggttaaaaaaatggtagctttacacaaacccacttggttaaaatctgggatttttgaagcaatcaaagcatcgacttacagaatccacaaaaatccgtctttgattctctctctcgctcagaattggtgtcctgaaactaatacatttgtgttcccttggggtgaagctaccataactcttgaggatgtgaatgtgcttctgggtttttctatctctggttcttctgtttttgcttctcttcaaagctcagagatgaaagaagcagtggagaaacttcagaaacgatgtcaagggagcatgaagcaggaatcatggatttcaagctttgtagatgatgaaatggagcatgaagcgtttctagtgttgtggctttcgaaatttgtgtttccagacaagttttgcagttcgatttccagtgatgttttccccttagctgttcgtctagctagaggtgaaaggattgcttttgctcctgcggttctagcaaacctatacaatgatttgggtcatatctgtgttttagcctctatacaaaatgttttagctagttctctgtttaagcttgtccaagtatggatttgggagaggttcaagagtataagaccagaagctaaggtgataccaaggggtcaacctagaattgctcaatggagtggtctgaaacagagatttaagaatgtgggactgattatttttcatggtaattttgattggcgtccttatagtgaacctttggagaattggaacccacctcggttttatgttgaagaagctaagtgggtgaggattgatgagagtcttgatggtgattatgatgacgatgatgagtttgtgtcgtttgctagatgtgtgagagtttctaagcttgtaggtattggtgtagtagagaactactatccaaaccgagtggcgatgcaattcggattggcgcaagatgttcctgttttgggtactaatcatagaagaaacttcacagaagaagaagcatgggatgattacaacaaaccgcttgttggtttaaagctatattttccttctcgcgtcgccacagcttcggttactacgagatacagagactggtgggctaaatcagtttcagaaatgcggaaagaatcaatggaaacttttaatgtaagcagtacagttgatcattatgatgatagtgatgatgatataccccttaagatagtaccattgagccaagtctatcagaagttggacgatgaaatgaagaaagccaagcattcgacaaacaagagacgcaagcgagctcgtgaggatgatgagagtgctgctgagacagaagatgacgagagtgctgacacggaagatgatgagagtgctgacacggaagatgatgagagtgctgagacagaagatgatgataacatgaccattgctcagaggatcaattctagaaagaagtctgatgacatagagaatactgaaggagaaagaagtagacttgtggcggataacaatgtttcaggccttcctcaaaagcttgcttatggagatgagacagtagcaacaacacaagaagaaacagagcaaaagaataatgaaaacaagtcttctaatggagtagctgctgagaaggaagaagatgatgagagattgaaacagagaaagcttgcaataaaggaactagctttgaagacggaagcacgaatgttgaaggtagagaacactttggcaaagattaaacaatggaaactcacaagacttcacaccaaaaaacctctagtttcttcttaagctatatcatctctatttgcagcgtcttctcttatcaaagacaaaagctttgtgtcataaaaatggcttttacgtacattcttctctgcaaaaatgataacttttggaatttagaattttgttggaattatatatattcgtatttacgttaccaaattcacattttcgtcttcgtctccaatg

SEQ ID NO: 17984 - DNA, 3003 bp, Unknown; identical to SEQ ID NO: 17983
  misc_feature (1)..( 3003): 2750-1469P.txt file - cDNA_ID_1814857; gDNA_ID_2926165; Annot_ID_139862

SEQ ID NO: 17985 - DNA, 3000 bp, Unknown; identical to SEQ ID NO: 6545
  misc_feature (1)..( 3000): 2750-1469P.txt file - cDNA_ID_1814884; gDNA_ID_1621097; Annot_ID_55712

SEQ ID NO: 17986 - DNA, 3000 bp, Unknown; identical to SEQ ID NO: 6545
  misc_feature (1)..( 3000): 2750-1469P.txt file - cDNA_ID_1814884; gDNA_ID_1621097; Annot_ID_171094

SEQ ID NO: 17987 - DNA, 3000 bp, Unknown; identical to SEQ ID NO: 6545
  misc_feature (1)..( 3000): 2750-1469P.txt file - cDNA_ID_1814884; gDNA_ID_2926164; Annot_ID_139854

SEQ ID NO: 17988 - DNA, 3000 bp, Unknown; identical to SEQ ID NO: 6545
  misc_feature (1)..( 3000): 2750-1469P.txt file - cDNA_ID_1814884; gDNA_ID_2926164; Annot_ID_199007

SEQ ID NO: 17989 - DNA, 3000 bp, Unknown; identical to SEQ ID NO: 6543
  misc_feature (1)..( 3000): 2750-1469P.txt file - cDNA_ID_1814892; gDNA_ID_1621097; Annot_ID_55710

SEQ ID NO: 17990 - DNA, 3000 bp, Unknown; identical to SEQ ID NO: 6543
  misc_feature (1)..( 3000): 2750-1469P.txt file - cDNA_ID_1814892; gDNA_ID_2926164; Annot_ID_139852

SEQ ID NO: 17991 - DNA, 3003 bp, Unknown
  misc_feature (1)..( 3003): 2750-1469P.txt file - cDNA_ID_1814907; gDNA_ID_1621098; Annot_ID_55788
aactggacacaaaccaagtttcgaagaatacatgcaaaacggtgtgatctcgagttctgtcccaacgatactgctccaccttttctccgtcctatccgaccacatctccgaccaaaccctaaccgatgattccaaaaaccactctgtcgtccggagctgtgccaccattctccgtctcgctaatgatcttgccacctcaacggtacacaatttactcgttaattagtttcttttattcttctagcccaaaacatgttcaacatatccaaatattattagtgatgaatgatatataccatttatttatgtttcacgttttgaaaaatgtgattcctttatattatttaccattcagaacattaaataatttccacgttttagaatatgatttagctatttataatacatattttaaaatatataaattcatttatttacaatagtcagcttttcagtgttaatcttgagatatcattaggttttaacactaatttgttgacaaaaaaaaactactcatagtttcatgtataaatgattcaatttttccccacacaaaaaaaataaaaataaaatcatgaaaacactaaattataatgactcacaggaggagatggcaagaggagattccccaaagtcggtccaatgttacatgtatgagacaagagcaagtgaggaagaggcacgtagacacatgcaaagtatgatcagcgactcttgggacattataaactccgatttaaaaacggcacacacttcttctcttcctcgtggttttctggcagccgccgcaaatcttaaccgcgtggtacagtgtatctaccggcacggtgatggccacggaagcccagaaaagaccaagaccgttgattatatccaatcagtactcttcaatcccgttccgttataggattgtaaatttgtatttgccgcattatagatatgtttacataattaaaaggtatttggtttgccggaaaaatgatcattttattttccaaactatttgtaattaacacaattattttttaattatatgtgcgcaaaattgatttttaatttgtcgttaacttaacaatttggtccaaaatttgatcaatgtttactagttgatatagaaacgttaaattactcgattaaaacctaataaactcaaaaaatcctaaaatttctcccaaattgaaagctaagtcattacttcgaataaaaaaaaaaaatcttcatctattcatcgtacttcgccaaaatatgcgaattcgattttattatttagctgaaattcatttattactattttctgcatggcaatgtttcgttaattttttactttcaattttattgtaattttaattcaaattataatatatgtacataatttaacaatgtgtttgataactttctctaaaattgttgtcatttattatttatacatagatatcaggaccggtttagagtgtgtgccaagtgccaatggtgcatttgtactgtttaagcaatcatggtcctattttctcaaaaatatataataaatgtccaaatccatacataagatataaacatgttttttataattagatacagggttctatttttctctgagtcggccctgatagatacatactatcagattaggcagaggtatggactatggagtaatttatgggggcacatccatccgttggtatgatcaaaatttagtataagtcttcagaaagtattttttagatgggatgaatttgcctctctattatcccaagattgaatccccatttccttcagaagcagtaaatacaaattaaactactgagctacaaattcgcgtaaagctacatgtgtatttttaatctcaaagttgctgtaattatgaaatgtgaacgaaatagaagtgacaggagcttgagtgccccatgagataagaacttatagatgtatattaatttaaactgtactgtctaaacctagacaacgccgtgacgtctttgcccacatgtgattattcgttaccacctctcttagtgtggtccaacaaaattggcctctcagttttcattgaaggcagggatagagatatacaggtagtcacatggacaccgaatcgatatttattccttggaatttcattaaggtttttcgaaccaagacaagacaagctatgcatgaaaccatttgccatgccattaacgtggactaagggtggacactgatctatctcgtacttgttattaataaaaacaaccgatttgtttttgtttttgttattatatctcctactttttgttataccatgcatgtccacacgtttttttcaatttgttacatgtccacaactttcacaaatatttttaccaaaaaaacaaaaaaaagtttgacaaatatctttagattttttttttgggcaattagtgacaaagcaagggacgttgaaagcaagaaacgtaaatgtttggatatcacaccacaccaatatgttttagccattacttctccaagtttttttgttgtgtgggaataatacttctccaagatatttaagaaaacgcaaatgcatggtcattgaattatatagcgagaaaacgtcaaaaactaaactgattaaaacagatattcttttagtaaaacagaaaaaataaaaatatcttcatatatataacctgtggtccgagacccaaaccttaaatcagtataaaatatcatagcggagtctaaagaagagttcatccaattatttaactctttagtgtaatcattagcaacgcaaagaaatgcctaaacgacaggctcaacggcgtttcactcgcaagactgactcgaaaacaccatcccagcctctggtatcccgtcgctctgcaaactatcaaccgtctctttggcagcacgaatatctcctctcgctcggtaatacatatgtggtacgtataagaatgtacatgacgttgtattaaataaaattatgtgacatatattactatttaggaaattatatatagtgataatatttatatcatg

SEQ ID NO: 17992 - DNA, 3003 bp, Unknown; identical to SEQ ID NO: 17991
  misc_feature (1)..( 3003): 2750-1469P.txt file - cDNA_ID_1814907; gDNA_ID_2926166; Annot_ID_139927

SEQ ID NO: 17993 - DNA, 3003 bp, Unknown
  misc_feature (1)..( 3003): 2750-1469P.txt file - cDNA_ID_1814911; gDNA_ID_1621098; Annot_ID_55787
ccagactcataaaggagccccaagctcttgagattgatcgcagaggcagaactccaaggaacgaggcctagacaaccacaatcccacaaatgaacacattgagatttaagaactaatggccactgaagttgaagagaacaagagcaaaaagagttatactttgatatctgggtggaactcaagttcgattcccttctcccgtttctcttcgatctgtgtatcagccagtagaaaacgatgctaagaagaagtaccaaactctatgtaaagaaccttgccattgtggagttactacttactacattaccttcttgtcttcatagaggcggcgagcatgaagagctccaagcataaggatagtagccattgttgctccgggcacaagaaaagcattgcctacattgagtgaaacaatgattcaagctcaaaaccatagaatcgatctaattgcaatctgattggaacttcacaaagtgtttcctacagaacaaaatgctcaaaacttaaacttagaatcttttcaactgtaatctaactatgtaaaggagcttttcgaagcatatatatatatgaattacctttggaatctccggttccacctcctccggctccggctccggctccgctgctgccgccgagaggcgaagcacgagcaccggaataattcgaacggatattgttgaggaaagagctgaaggttcgacgttgactatgctgaaagcggcggagatatgaatagcgagccaaaaaatagacattttgaggaaaacgaggtttcatggcgtttttccggtggcagtgacaccgcttttgctctggggttttagggttgtttgttgactgtttgagtaaactaacaatttttcaacgacaggttaaacgacagcgtttactcctcttgacttgttgactacgttctttctgcgctgacattttatcccaattgggcctttttagctcttttatagcccaccatccttttttttggacagcagcccaccagacatttttttttgtcgaacccgaaacagagtagtttgccgtcgatgatcatcaacagtggagtgtaagcagagaaattacgccatagatcggagcgattttggagcatcgccgaagctaaagaggaattggaggtttctgtagatcggaaaacacttgttgttctctctctcgattcatcccaaagcaagattcttggatctgcctcttaagatcgatcggtgcttttgtatcctcaggtatgtgttgatacttgatcgtatctatctacagagattaatcgtatcgtagtctgatttggtagatttggaattgggaatcgagaagtttaaaaatggaggaggatagagagaatgcaaagagagtagtgtttgtaactgtaggaacaacgagtttcgatgctcttgtgaaagcagtggttagtcaaaatgttaaagacgaactgcagaagagaggatttactcatcttcttattcaaatgggtcgaggaatctttttcccaactaaggttcttcttaatcatcttctccactcacacttctttacttgattgagatttgattatgaaaattggtgtacacacacaagagatgttgttctactcttctcttggtgtacacacacaagagatgcttctcatttgtgttttttttttttccattactgatctcagtgtgatggagcggatggatcattagttgtggattacttcacattttcctcaagtatcgctgattatattcgatctgcatctcttgttattagtcacgctggttagttattgcaatagttgagcacttttacatttaatagaatcaaaaccagagacacattttcgaaatgctaggatataatgttgttgactctcactgatgtaggatctggaagtatatttgagacactgaaactagggaaaccattgattgtggtagtgaacgaagatctgatggacaatcatcaatgtgaattagctgaagcacttgaagagaggaagcacttgtactacactcgtcctcactcccttcatcaaaccttgacgaaaatggagttggggtctctggttcagtatactccaggtgatggaactcctgttgctcgcattatcgacaggttccttggattccctgatgattaaacacaacacatacatgaaaacaagtgtttagtttccaaatacaacataatatgcagtaactggtgcttttgccagtagacattgtgtcaaagatatccatcataatagcaaagcttttttctaacgtttgacagaggataatcaattttgctcagtctgtatcatttcaaacataataccaaagaatatttaataatcagatcatcttaattttattaacaaccaagtgtaaacacttagatatttgcagaaaataactactaataatctcttagaactggacatttatgttttgtatttaagttagaaataaatgctattttttattgttactgggatttggattgcaaaggggcctcgatatattccaaaaccagactgagatcaacaaaaaagcaaagcaaatataaaatttaggttcaaagcataattgtatagtctccaaaatttgcaaaaacaagtcatcctgagagagataaaagtgcaacaacatggaacctagaagatgataacagtaataataaaagcaaaaggcaatcaacggtaacgacgaaggctgagagagttgtttttcttccatgtagccctgcgagatggacggttcttgtggttgttgtgaccctttccgcggagacctctgttcttctttccctctgaggtaagtcctctgagctcacggtgcttgtgaactgggttgcagatccagttgattctcgggtcattacgcacagcattgtgtgctgggtcaaccaagatgatctcgtagtacttgtaggtcgaatcctattaaagaaaaatggacaagttaaaatatctaaccagaataatcacctaaacgaaagagtactgaaagaaggtagtaaatg

SEQ ID NO: 17994 - DNA, 3003 bp, Unknown; identical to SEQ ID NO: 17993
  misc_feature (1)..( 3003): 2750-1469P.txt file - cDNA_ID_1814911; gDNA_ID_2926166; Annot_ID_139926

SEQ ID NO: 17995 - DNA, 3003 bp, Unknown
  misc_feature (1)..( 3003): 2750-1469P.txt file - cDNA_ID_1814923; gDNA_ID_1621098; Annot_ID_55781
tcgttgaagctgtgctaacacttgacacaacagctcacgtacacacccaattcaatccaaacaaataaaatacaattccgaaaacataagttttatttgtatatatcgtaagaaccaatattaaactgaaacataacttttcttgtaaatcattcaagttcaaaatatatcttacttaaaataagcagatatatatgttaaacttatgaaccaaacatatactgcctataaaaatttaaacaacccatcctattattgtgaattctatgaagtaaattcggattaaaacatcccatcgcaataaaccaaaaatgtaaacacaaaaagaaaagcatctctagtatatttagagacccacgtacagtacttgatctactggagcattcatcgtatgttataggtgactgctaaactaaagagaagaattatttttcttctagtcccaccacatattggatcaaagaagtagaaagttttctcctacatattatagtagaatgaaaaattactctgaattcttctcttctattcttataccagtcacacccatagattttatggtaaacgagatcactcctatatcagctcctagtaaataacaaagaagttttcagtactgaattatatcaatctttatcgtgaatgtttccgtacgtatggtatttgtccttttttcaaaataagaattatgagcttgttgattgattattcaaggatgaacttatgaaatatccttttgccagagcttggttaatcccaaaacatttcgtattgtagttctaaaaaggtaaaagaggaatgaaaattataattgggtagtaaagtttggtgggacttgcaagtttcattcaataaggtttcgtttattatgaatgcaccgccatattgtgaaagtgaaaatgacgttgcaccaaactaaacaattaattccccctcatgcaagatattgatcctcttcaagtttttcttctttggtacggtgaccttcctcaatgacaatgagtcaataacaaaaagaaaaactttgcgtttcatttactaatttattttccaattttagtttaatagatatatcatgccaaaacgttgggaatgtatatttttcatacgtgcgtaatttttattcttccggttaagtattcccaaactttaacaacaaattccgttttcatgttttacacaaaactattgtaaagttgattaaccacattagctatatgactaaattattatttttggttcagttgactaagaaaatagaaactgtctaacctatgatgggaccagacaacagtatctcatagcattattgaagtttggttagttttcattaaatgaaaagaatatatatgcaggttatcttctagtcccaaagtgacaatgacttgtcttgtttggaattggactgattaaagataaatacaaaaatatttactatatgaggatacataatgtgtaagtttataacaactgccaatataactatcaaaatatcatacaaaagcatgatcgcaaattaaaaatggtacgtaacatgtaagaaaacgaattagccaccagttgatagtagtctcatttgacatctattgttctattagaagttaaaaaaaaaaaaaaaaaactatatgaaaggtaaaccattcccaatataacgtaataaacataaccatcgagtatcaaccaaaatcatgaccacaatatgtcaagatgaaagtctattagttatttgtatgttagcttaagtgaaaaaagtggatgtgggtgagtgagcggttacaatcgatgatgaatgagtaaccgtacgaattgatattgtcaactatcaaacgttaaattttcaactcaataattaatcaacatttgatattcgtgaagtaacttttcacaaaaagtactctttgataagatgatttatgtccataaaactaattgcttcaactacattattgtcaatatttgatatcaatcaattctctatgcttccatgtgcaagtcttatcgatgtgattgaaatttaacttatggtgtaatctttttgtaacaatcgtttctatttcatattttaaatgtgaaatttatcaaataggaatcatactagaaggtctcatatatattgaaccgaataaataatatttaatcatttttatgatatatatcaatcgcttaaatccgcaactaacaactttatttacaggtagatgtctatcatttacacaaatttttgtcttgtttgcggttcgatctcctgcctagcaaggattccgatgagataagaaggcaatctttatcgcataacgtttatggtaatttaatatgtcatcacaacattatctacgatctgaaatcgacatagtatctctgaacctctgtaaataccacgtattaatttttttttaatattaaccttcgtagaaatcacgttgatcgtttatataaaaatataaatgaacaaaaatttcttgacaaagatataattttaataaaatgtttgtacatatatataagtctgtataggaaacaacatatgaagacatgaagataataatgtagaggtagttataattttttgtgtcttaagtcttcaccaactcatggtgaaaggttcacaatataagttgatcgatcggagttcgagttattctactaaatatggcttcaataaaaatttggttactctaaatagtttcaatgggaaaaatatgtaacaataattttcacaaacctcaagattgattttctaattattaaaataaagtacaccatcaaaaacaaaacagggacaagatccacgtcttgcaataaaacgtgccttgtcaaagatgttctctttgactctttagtgtagccatctctttctctatatataaaaatcaaccatggtgtgtgtcagtgtgtgcacatatttttataagatatcttcacatacacaaaaacatttattgtacagtgcacaagtgatcgaatatttgattctttttcataatcagagatctgatctaaatg

SEQ ID NO: 17996 - DNA, 3003 bp, Unknown; identical to SEQ ID NO: 17995
  misc_feature (1)..( 3003): 2750-1469P.txt file - cDNA_ID_1814923; gDNA_ID_1621098; Annot_ID_171222

SEQ ID NO: 17997 - DNA, 3003 bp, Unknown; identical to SEQ ID NO: 17995
  misc_feature (1)..( 3003): 2750-1469P.txt file - cDNA_ID_1814923; gDNA_ID_2926166; Annot_ID_139920

SEQ ID NO: 17998 - DNA, 3003 bp, Unknown; identical to SEQ ID NO: 17995
  misc_feature (1)..( 3003): 2750-1469P.txt file - cDNA_ID_1814923; gDNA_ID_2926166; Annot_ID_199152

SEQ ID NO: 17999 - DNA, 3003 bp, Unknown
  misc_feature (1)..( 3003): 2750-1469P.txt file - cDNA_ID_1814927; gDNA_ID_1621098; Annot_ID_55779
tactagttcagattcttcgttattgggaaagtttgtctgaagaagaaatccttagaatcatggagagggttacgtgtgagaggagacaactaacagaagagtctcctgttgaacaagatagggaggttgaaccaaaaggataaacaattctaccaattagcttcaattatttaattagttttgtagattagtcctatcgtattcaaactctcttaagcataccattgttttcttcgttggaggctgcctatgtttatctactattattaaaaactatagatacgtcacataagaaataaacagatgtaataagattaaccaactagatgaattacctttggttgttgaaagggagataaattataactgatggtgatgtaatgcattcggagaaattctgagagagacatggacaatggcactagaggtgtcccaacaaattatatttccacacattattattcgattagggttccaaattccaaccacttgttttttttatccatattgatttattcatataaaacatatcattatcgtattttatagcgataaaaacatgtggatacttttaaagaagataaaaagattaaaataaaacgttattcagtatatttcgtaattctttgtagtactagggacttacctggacgggatcaactcgtgatcaataagacaagtggcctaggctagtgatcgcattgcacatatcgtttgggtgctatgcttaaggttttcctttaaggaagagtatgtgtcattatttgtgacagaggagatttgcattcgcgcaatgctactgattttcaattttccactcttgtcacgagtactgttgagagttaaaaggttcattgtcaagaacataatcggcattttagtcttttggactcaacatttgcattaattgtattcaatatagatggaccatggaggcgtgaatattgttctaactgctaaggacatcatatctcgatatactagcttgaccaaatggttgagctctttacatactcttcctcaatcactcgtaaaattgaacaaaaaaatttcaaatcccccgtttcaaggaaattatttaatattctttcatccttatttcaaactcactatataaattaaaatattgcttatttataagctcattatacaaattccatatagattctcgtccctttgattaataaacgtcaactaattaacggtaataacttattatatagtaccttacaaatctctagattggtggtccaacggtatttggatcaacaccattgaaataatttagtttattgccgatttaaagtagattaattatcctaatgacaaatatgattttttttttcttctttttgtcatcacaaatatgaattggtatcctcattggcctgattaacatttctaattacggatcttacctcttcgtgccaaagaagacatttggaaatatatgacccccataaaccaaatatatgtttcttattaatgttgtggaatttgggacattttttaaaatggacaaaagaagacagaaacaattttcctacccaaaatggcgtccttaattttttcattaaattgtaaagcctgtttcaaaagaaaattgactttttgttgtgatagtataaaaaatgacatttgactttttaagtgacaccaagattctgacaataacgaattatatccatgctaattaattgatagcttaattaacaattgcgcaacataacgtgatcaaattaattaagctacatatcaggccttgatccgtggtccaaataatcatcctactaaagaaaaccagcttgttatagtaaaaagccgaattcgtgtaaaaatcggtttaaaatattcggtatagactctaatctcgatttactccggtttggttatcgtgtgtgtgatcgtaacttgccggtggatttgcgacggacacgtgggatgttgtaattgtctcacgtgactcatcgtaactacctttaaattcgctactgtgattttccagattcttatgtacatttgtgacttcttcggtctatttttgttatgtttccaaaaagacatgaatgaagaaacattattacagtttcttttcttcccttaagcctatttaaaattgatatttctaaattcgaactatttattcactagtcgaagccttttaacgcaaatctgagctcttaagtggcgcaaaaaccggtttaatatgtaaatagtaactcggtttagattaatttcgggttatttttgtgattagtgtagttaactaattaattcaggtgaataattatattagagagaaataaatttcaggacaaaaaggcaaagctttggtactgtctcttctcttctccgtcttcttcaccatttcgaaaaatctcaaaactttacagagagaaagagagatcctttacatatacttcactgtcttcttgaaaaccctaatcctccgatctgtttaacctccgatcaagagagatttcttcagcttgtgtgtatcagattcctttggattccccgattcttcgtcgtatcgaatcgggggatggcatttccgtgaaatcagtgatgaaattggaggtgagaagaagttatttctatctatgggcgtagtagctgaggtttggaggtcgagcgtgaggctattaacgaactcgcctcagcttaacggtggctctcacaagagtgcgttatggaagtggcgatttttctctgctcagcccaaaagaaccgtaatgtggacatgggtttgtggtttcatgcttttctctttaggagtcatctcacttttcactggtcacgttgtctcgcaccttgagtggtattctcagcaattaagcaaacggagcttactggtaccttttagcttacttagtgtttcgtttgttacttcttctgctcaattttgtaaccaagtagtgaaattggatgttattcttcaggatatgagccgtcgagaaccaattgatgtatggaagtcaaaatattcgaagtttttctatg

SEQ ID NO: 18000 - DNA, 3003 bp, Unknown; identical to SEQ ID NO: 17999
  misc_feature (1)..( 3003): 2750-1469P.txt file - cDNA_ID_1814927; gDNA_ID_2926166; Annot_ID_139919

SEQ ID NO: 18001 - DNA, 3000 bp, Unknown; identical to SEQ ID NO: 6592
  misc_feature (1)..( 3000): 2750-1469P.txt file - cDNA_ID_1814931; gDNA_ID_1621098; Annot_ID_55777

SEQ ID NO: 18002 - DNA, 3000 bp, Unknown; identical to SEQ ID NO: 6592
  misc_feature (1)..( 3000): 2750-1469P.txt file - cDNA_ID_1814931; gDNA_ID_2926166; Annot_ID_139917

SEQ ID NO: 18003 - DNA, 3000 bp, Unknown; identical to SEQ ID NO: 6591
  misc_feature (1)..( 3000): 2750-1469P.txt file - cDNA_ID_1814935; gDNA_ID_1621098; Annot_ID_55776

SEQ ID NO: 18004 - DNA, 3000 bp, Unknown; identical to SEQ ID NO: 6591
  misc_feature (1)..( 3000): 2750-1469P.txt file - cDNA_ID_1814935; gDNA_ID_2926166; Annot_ID_139916

SEQ ID NO: 18005 - DNA, 3003 bp, Unknown
  misc_feature (1)..( 3003): 2750-1469P.txt file - cDNA_ID_1814950; gDNA_ID_1621098; Annot_ID_55771
caagaatctcaattattgcaattccctactcatttagaacataacaccattaagaagttttgttgctttgttatctcatatacttgacttcttctagtggttcctatcaaacgtccccagaatgttataccataacaaatctcagaaaaaactatcttagaaactgtattcccgcatccaaatcatcactcaaagaagctaaaggcagtgcaactgcaagctgtacttctatctaactacacaagttgcatgtgaagtgtgaacagagaagatttggtctcaatggcatctagtacttagataagctcaggtttttagttatgatcacccaaaagtcttatccatgctattgatacctaaggatccccctacaagggaaaacgagtaatctgaaccgcctgagtataggcgatagtctgaaacttaatgctagattttcaatctcttttgttcccctaatcacagtgcttaatacctcctaaaatttgttagcatgacctatactgtttccacctcacacgatcacaacacagaaaggtcactactaacgtacaagttcattcaagacgtgtttacctgttatgtggataactatgatgtcgcaagaacacatctgcaccagttaagctggaataggatgatgatgatgatctcatgcactgcaaccagtacaaacccctacattttagagatgacatagcatcaaagcaacacaagaaggcccacatataccagagatcctttatggaagtaaggggtctaaatctctgattaagtctaaatttcatggcaattattccagagcttatatcagaatccttcatgtatacgtctcatacccataaagcatggaaacaatgagattggtgttaagtgttaactattggacaatggcagaaattacatataattacttgacacatccttctttcatatacaaaatctctaataatatttggcatttgttcacagatttgccagcaaaagaatagaaaagagatattgcacagttttagcaaagagaagcaacgcaatgcggttaaacaagttgggttcagttacacctttgaaagaagaggccttatcttctctagcagtgtctcggcttcaataaatccacccaaaggtcccaaagacttgtacttgatggctttccatctgttttgatgacaatattgataacaaagcttattatctcacagttttcaagccatgggaaagtaagagagagacgcaaagaatttcccaaaaaagatcaacgagtatgaagcatatatatacctgggcacataaggcaatgcaaaacagtggagatggagatgatcaacactgttaaatggtggctggtgaaaaccaaatctgtgagaagaaagtacaaatcaggttaatgctacagaagtcaccaaaaggagccttacttactccaaattcataattgatttcattgagtgtatgtaaccaagaaagctcacctatgaatgctttgaggagcatctttctgcaacagttgttgtcccacactaagcatgtgtcttactgctcaaatcataaaacaaacatcctcatcgaaactttacataggcacaacagaaaatgaagtataaaaatgtttagataaccaaccaagtgagtagtcttcatctcttctctgaaggtcattcacagtaggaatatgttcttttggaatcaccaaatagtgcctacatcatcagtgctttgttcataaataccagtaaatgatagctaagtaagcaaggagatgcaaattgattacaatggacaagcttaagtaaacggaatcaaactcaattcacaaaactcgatagagcaaagtgagtgaacagagacacaaacctctgggctgcaggcttgatgtcttgaaaggcgatgactttctcatcctgaaaaaaagataatcgcagacgtaagaaaacttgttcaatttagcctctgatgatgaaccaaacaaacaagagaagggaagaagaagataacggtgtgaaggagacgagtagtggttggatttcgcacgatctcacagaagatacacgcctgattcactcccgccataattcttacgtttggaatttgaaatcgctgctaaccaaaattcgaaatggatttcgatttccaagttgtggaaatgggaaagttgtcttctccggccaaaagcctctttttttctccgaaactaaatatttggatctttcattttaaccccacaaatatttttattgctaagttaaacccttaactcatatacgttccgatttagtatagtctttacttgtattaattttcaaaaatatggaaaatttgcgctacaccaccgaataaccattctaactgacgaaaaaaatctatatttgatttgtcctttttgtagattaattttgttttaatataagtataattgatagaagggcttccaggatttggtattttgtatttctcaaatttttgtaatatttattttattatttgattactcttaaatataaatgtaccgtataatcaattttttttttgtattttattttatataaatattttttaatatgtgtataagtccttatttgtttttcaattgtaatatatgtagatattttcaacgaatattatacatcaagagctttagtttattttcgttaaagttttcattctttattttaatattagatcacaataattatgctataaggtgattctatgacatttgtagagtagtttaaatatttttggtatattgttccaacaaaggtatatgggaaagttgaaattctattatctctgatttagtaataatagtgtttggcctatttggcatcacaaaagagttggcagttgggattgttttacttgtatttaaaatttcgaaagtctggggttcatttgcaataaaaagaaaatgatgagggcctaaataaacaataaacataaacaatcgccggaaagtttcttctcacgactaataaaaaccttaaaagctctcctccgttaatg

SEQ ID NO: 18006 - DNA, 3003 bp, Unknown; identical to SEQ ID NO: 18005
  misc_feature (1)..( 3003): 2750-1469P.txt file - cDNA_ID_1814950; gDNA_ID_2926166; Annot_ID_139911

SEQ ID NO: 18007 - DNA, 3000 bp, Unknown; identical to SEQ ID NO: 6588
  misc_feature (1)..( 3000): 2750-1469P.txt file - cDNA_ID_1814954; gDNA_ID_1621098; Annot_ID_55770

SEQ ID NO: 18008 - DNA, 3000 bp, Unknown; identical to SEQ ID NO: 6588
  misc_feature (1)..( 3000): 2750-1469P.txt file - cDNA_ID_1814954; gDNA_ID_2926166; Annot_ID_139910

SEQ ID NO: 18009 - DNA, 3003 bp, Unknown
  misc_feature (1)..( 3003): 2750-1469P.txt file - cDNA_ID_1814966; gDNA_ID_1621098; Annot_ID_55767
acaaagaacgaagcttttctgcgatcaaacacttctccagagcacaacgctatcgttgaagataacaacaacaattaacgaaaaaatatgaaagaaaaagcaaataagcaacctacaaaaattctgcaaaacattaaaaaattatgcgataaggtcagagattctctacagatggtgtatggtaacatctaaacacttcagctgacgttgtatgcttaatctgttcagtgagaatctgacggtagatattagctatttactgaaataggaatctcaaccgtccattttactgaaggtgtacgaggtaactgtctacgtagatattgcctccaacaaaggataaagaagaaccggatatgctgggatcacgtttctgcatacgatatgacacgtttacccctagaaaatgtgtgttaggtgaagagttcggaagggtaatagttggaaattgagaatgtcgcttataagctttgcctcttctaacaaaatgtagggcctagtgcagtaatgggccttgcaaataaacggatggaaatatgaaaactaataaataaagtataggcagaagtttttttatgactgttatagagatctggagatgtaggtcttggtgtatggacagcttaggatttcaagcttaggcatttcgaaatcaagggttgaaagcaattactgtatttgagaatatatcttcaacactgcacaaaactcattttgtaatttattaaaataccggaattgagtgattaatgtcaaaaccgagaatttacaggataacaaagataattaatcaaaatgaatcttttatcaaagtaagataagttttctaacaagttttttacttatagatataaaatattatagttgtgaaaagacataaacatttttaaaagttaagattgagttttctgaagttgaaaaaaaaatcaaaattattttttaatcattatccaaaatcattacttaatccaaaccgatgcccaccctaattatttaactatattaataaggtttgtaagcaatagtatataaaaagctaaaaaaaatataagggtatctcactacgtatgacacttatcaagtttgttagagcatatggggcacatatgtgggagtatgcactttttcatgtttatttcactgcactttttcatgtttatttcactgtttcaaaacaatcaatacaattatatccttactctcgtaacctcaggtcaaatagcatggttaagaaatgcctttgacgaatgatttagctgtgcagcaatatatagtactttgaactgctctaatgggagtggattgtggattttcctttcttctgtttcttaatcttgacattagatttccactccaccccatcttcgtctagtaccttataagtcgttccagcaatgtagaaggtgactttcttctcttcaaggtacctcacaaaacgtttagcaaactcaatgggtgttgaatggcttttgtactttgataaaagactcacagcaatctcctagttaggcttgaaaatcaaagtcttgacaactcgttatgcctcatcaatcacttttcctctagccaagccgtctaaatatgtccccattatttcaatagttggttctatccatagagtcttgactatccttgcaagaagataatgcccatactcagtttgtcgagcatgtgtacaagttaccatcacgttccaaaatgttgagtgagttttgatcaaggtggaaggaatgttctcaaagacttggattgctttgaagcattcactatttgtgcctaaggttgatataaatgcattccacatacctatacatgtagctccagatttaccgcattcatgaaagagtttttctgttaagaagagtttcaaactccaactcttaagattggagagatatattagtcacatggtaactttgttaaggaaaacaaaaactcaaatatttttaaaatttgttaatcaaataattttaaaattgatttcttgtataaaagtattgtttttttgtgtattttaaattatatttttatttttattaagttattatgaatcaaatatttaagaattaaattgaattttgatttatacttatattccaatcttgtatataagttagtcagattgaaatatatggtcgaaaattggtaaaaaataatattcaccattattttggtcattaagttttgaccactttttggtaagatgttttcgaccactattctcggtcaaaaatgtcaaccgatcaaaatatttctaccatttttattggtctaaaatattcgaagcaaatgtttaattcagtataaacatgcaaccaacaatttacaaatggtcaaagaatttctaccaattttattggtcagaactcaacttgcaaccaacaatttacatcaacttcgttttggtaaaaaaaatatcgatcgaagataggtgtttttgaccaaactgatgaatgtatcaattctaatcgtaatacattttcgacatttaccacactgatgaatggtttttactgttagggtcgaacaaaaaaaaaatccaaattgatgttagctgttctgatgtctctaatttcgattaattctaccaaaacattaataacttggactacattttagttgaaatttaccccttaaaaacatccaaattgggtgatacattggtgagagagaaaccaaacctcatttaaagtcataagttataataatgcagatgaggacaaatatagattaggatatggtgttgctggtaaaggtgtgaagcgactttgcctccttggtaccttgagaaatgtaatgatgaagatgatagtgttcgtggtgaggatgatgatggtggatatagaggttatgaagctgagtgggaagaagagttattggcccataattctaaaaatatacgacagccattttgaatgatttcaactaaacatacggttagttccggtttatattcagtttcgtaaccaaagaaaaacgcaaatcccaaattttccggaaatg

SEQ ID NO: 18010 - DNA, 3003 bp, Unknown; identical to SEQ ID NO: 18009
  misc_feature (1)..( 3003): 2750-1469P.txt file - cDNA_ID_1814966; gDNA_ID_2926166; Annot_ID_139907

SEQ ID NO: 18011 - DNA, 3000 bp, Unknown; identical to SEQ ID NO: 6585
  misc_feature (1)..( 3000): 2750-1469P.txt file - cDNA_ID_1814975; gDNA_ID_1621098; Annot_ID_55763

SEQ ID NO: 18012 - DNA, 3000 bp, Unknown; identical to SEQ ID NO: 6585
  misc_feature (1)..( 3000): 2750-1469P.txt file - cDNA_ID_1814975; gDNA_ID_2926166; Annot_ID_139904

SEQ ID NO: 18013 - DNA, 3000 bp, Unknown; identical to SEQ ID NO: 6583
  misc_feature (1)..( 3000): 2750-1469P.txt file - cDNA_ID_1814994; gDNA_ID_1621098; Annot_ID_55756

SEQ ID NO: 18014 - DNA, 3000 bp, Unknown; identical to SEQ ID NO: 6583
  misc_feature (1)..( 3000): 2750-1469P.txt file - cDNA_ID_1814994; gDNA_ID_2926166; Annot_ID_139897

SEQ ID NO: 18015 - DNA, 3003 bp, Unknown
  misc_feature (1)..( 3003): 2750-1469P.txt file - cDNA_ID_1815001; gDNA_ID_1621098; Annot_ID_55753
tttacataagagagcaagtgatggggtattgtatagtagattattagcatgacctcacacaagatgtacttctcatcttctaagtctaaactaaacaatgatatcatcccattattgccaatgttacttatatggatgatatgtacccacttattaattaacttacttatgataaatagaaactgatgataatgtatgaagagaaactgaataaagcatgttacaaacggtcaattattcaaagattaagatttcttacataaatttccacaagaaatcatgttacaaacagtcaaacatttgcatacctatgtaattataaaaatagtcaaatacatatgttctcctccgtaagtgccattgggcctcctcatgacttagaagacgcgagcgtttcagctgaaaaccaaaaaattctcatcagattcaatcagacaataatgtcaaaagttatatattaagtacataatcagttttatttcagaacgttcttagctgtaaaatgtaggatatgatcctcttttggtttaaacctcatgacgtggattcaatttttttgctaaaaatgtaaatatttcatagaaaatgaaaacagtttaggtttacaatcgatatttctatcatgatcgtggattccttttcgacatttctgtcaacaacaactgagtactgatacaaaggccaacgaccagcagtatcagcaacttgagggggatatcctttggctttcaagtgaacctttcctagttattaatctttttggcctcatatcgcttccaaagtgagttatattcattgtaaaatttgtaagggttagtacatccaccaccgagacttaattttctctattcaaaaagaatgtgaaatggcctactggacctggagagtaggattggagattctgatctaaagaatgaagtccattaagaattatgtttttgtacttcgaaatacccattaggtttcatgacccatctattaaaattcatataccaatattcatcaaaaaaaaaaaaagatttctattggcttttgtaaaactcccaaatataaagtgttttattctaccaactaaactgcatgtgacgaatcttccagctatatttcttgttgttttctctccttctatcttcttcttacgtatgaagaattaatgatgatgatgattgctcaatttgttcgttagtgaaaatattataagatacgcatacaaattaacctgtttcttctatatatagatgattacaaagcatgtgatgtgggagttggactattggagtagttgattaatcgagctggagagaaacaattacaaagattctttacaatttttaattaagcaaattagtacagacaaaaaaaaaaagtgtagaaggagacaaagagttgcgttgaaggaagaatgattgagaaattgaattatgccgactcacgccccactccttccataaatagtttagttttattttttgcatgttaatgtattaacctagtaaagaaacattgaatttaggataagcagtaaatttcatttggtgacaaataaagaaagaaagattgggttaagtcaaataatggcaactatgaaagttagagatgtgaaaagggttctggtgattccattattgtacctggctgctaacatttttgtttttcttttaaaatcaagaaaaaagttttgattaatcaaaatcgacgccaactaaaaacacgtgtcaaaacgtggttggtgacagtgggatatgagactgtattataaaaagctacatttctcaccaccacccaatctctctctcccttgaagtagactctaagctaaagccaccgtcagattttcagatctcagatctcagctcttcattcgacgccatggccgagaagggcaaaggaaaggttttcttcttctcttctcttcttattcagttaatggtattctcttattattgttttttttttaatttgtgggtcttgaggatatattcaatctttatttattattaacctgaggaggtttttgtatatgtgggtttatgtttgtttgtttttgtgtggattaaaaaaaagagttggctactttgtagaaactatgagaagaaatcagattctctttaaaccccaaaaaaagtaagaaaagaaaagaagagatcagattcttcttctctttttctattttgtgtcagaggtcgaatctgttcttctgctcccttcccttttttgttgtttctttcagtaataagatcttataaacgtcaaatccattagtacatataattttttatcaaaaaagcaaactatggaagaagcagaggatttagtgatgttgatatctgaaaaacaggtaactatgatgaagttgaaggtggatcttgattgtcccaaatgttacaagaaagtgaagaaggttctttgcaagttcccctcgtgagttacttctctctttttcttaacttttttttggtgaatttgattttgattggttttgtttggaaatggactgagtggatttacttgtgtgattgggaacaagagaaataagagaccaattgttcgatgaaaagtccaacattgttatcatcaaggtggtttgctgtagtcctgagaggatcatggacaaactctgttccaaaggcggcggctcgataaagaccattgagatcgtcgagccacccaagcctcctcagccacaaccccaacaaccacctcagaaacctaaagatgctcagcctaaagctccttagaagcctaaggaacctgaaaagccaaaacagcttgaaaagcttaaagagccagagaagcccaaacagccagaaaagcccaaagaacccgaaaagacgaagcaacccgcacccgctccagctcccgcaccagcacccgcagccaaacccgcacccgctcccgctccagctcccgcacctgccccgaagcagccgggaccgccaccgcaagcgatcccgatgatgccgcaagggcagccagcaatgtgttgcgggccctactacgatg

SEQ ID NO: 18016 - DNA, 3003 bp, Unknown; identical to SEQ ID NO: 18015
  misc_feature (1)..( 3003): 2750-1469P.txt file - cDNA_ID_1815001; gDNA_ID_2926165; Annot_ID_139894

SEQ ID NO: 18017 - DNA, 3000 bp, Unknown; identical to SEQ ID NO: 6581
  misc_feature (1)..( 3000): 2750-1469P.txt file - cDNA_ID_1815008; gDNA_ID_1621098; Annot_ID_55751

SEQ ID NO: 18018 - DNA, 3000 bp, Unknown; identical to SEQ ID NO: 6581
  misc_feature (1)..( 3000): 2750-1469P.txt file - cDNA_ID_1815008; gDNA_ID_2926165; Annot_ID_139892

SEQ ID NO: 18019 - DNA, 3000 bp, Unknown; identical to SEQ ID NO: 6654
  misc_feature (1)..( 3000): 2750-1469P.txt file - cDNA_ID_1815024; gDNA_ID_1621099; Annot_ID_55826

SEQ ID NO: 18020 - DNA, 3000 bp, Unknown; identical to SEQ ID NO: 6654
  misc_feature (1)..( 3000): 2750-1469P.txt file - cDNA_ID_1815024; gDNA_ID_2926167; Annot_ID_139965

SEQ ID NO: 18021 - DNA, 3000 bp, Unknown; identical to SEQ ID NO: 6623
  misc_feature (1)..( 3000): 2750-1469P.txt file - cDNA_ID_1815028; gDNA_ID_1621099; Annot_ID_55824

SEQ ID NO: 18022 - DNA, 3000 bp, Unknown; identical to SEQ ID NO: 6623
  misc_feature (1)..( 3000): 2750-1469P.txt file - cDNA_ID_1815028; gDNA_ID_2926167; Annot_ID_139963

SEQ ID NO: 18023 - DNA, 3003 bp, Unknown
  misc_feature (1)..( 3003): 2750-1469P.txt file - cDNA_ID_1815032; gDNA_ID_1621099; Annot_ID_55822
tcgcggttcggaattggtgttttttcctcggacttaggatggatgctaatctcttatgcttagattgtcgtagtttttttttttttgttatagattcggtcattttggcttttttgtttcttctgtattcgttgttgcaattagaaaattttcgaaaattttggcaggtcatgctcaatctaaaaccacgttggaaattgagttccatagtgatggcaatgcaatgtttggttgtgaagctactaaatggttttatttgaaggagattgcaatttacgtgtgggctttatgatcaataagagggcaatggactttggttttcactgctggataattagtgaagactttgaagttggatgatgaaaaatgtgatttgcgaatgtcaaattcacgtggatctctcgagattcaaaccaagcggcaaacatgcatgaaagaaaattctgaatttctgaacatgcgaacgtctcaacgcatttcgattgtggtttgttttagtttatttatttttaattcaacttttttttctttgttgtaaaaacatgcacatcaatttcatcaaccaactacaattttattaaaattccttttttatttttttcaatcactcagtgttaaaacacttcatcgaatctaatttctttttattttgggaaactacattgaatgatgatctttataattagccacaaatcattgtcaccgatcaccatgacaccatatatagctttaattttgtttgttctgtaccgcttgtttctgttttgtatactaaattactaaccacaatatatttccaaatccactattttatttgtttctgaaagcaaacacttagtaatatgattggctaaaacgctcctataattgtcaagaaaaggggaatgtattgcgacactaaattaatttatccacaagaactatgaccacacaactcgaatacaaaatcaacttgttcatttatgtttatcttgtgtgtaattttcaatctttatccttatatatatatatatatatgggaaaaggaactattgaatttgaagcaaactgttgagcaacacatttaattaagtaagttttacagagttattttgatcatcttaagaatgatagatataattagttaaccgaatttaatcactttaatttaatcattattacgttgtatactttgtatttggctatttgctttgttcgttccaaaactttagtatattcaccacacttcttcaccttatctcgttagttttgctttattacctttcctctttctattttttttttattgttagggtcaaagctttgttaccctttttatcattcgatatttgtatatggcctttgtttgatatagataacaattatctacattggaaagatgcgtttgcgagcccataaaaattggatagagacttgcacttttggatgatatctaaattatagaaattagaaagtcaagttgccaaaaacttatccctcaaattccattggatcggtatcgaacggtgtcgtttatatcatctcgaggcaatgctgatattagccgctttctcgctgacacgtgtccagagattagcagctcaaagaatctagtgactcatctttcctcttatcatctcgttattacattactaccctttgcttgctaatgtttctttacgtgcactggaagaaaaatagaattatcaaaccaaacgactaatgactaatctatgatgcatctaaataattacaggacacaaagttgaatattctgatttaacttaaggaggtttattattattttaattaaaaattgatcagatgactctgtctcgtctttcaaaactattacttgttgataatgatttttctctatgactaattcaaacattttctatattaaattcatactttttaagttaattactcattagggcctattattagttatatataatgaatgttttaaatatagggagttgaaattccatcttaatcatagttggatttctttagttaggtgagtttatgagtgagttttttttttttttttttttttttttttgtctttcagtttggttgttaaattgttaattatgattaaaacgattattatctaaaaatattatttattatactatattggatgtatgacctcacttcttaaattaatccaattgctacacggcaagaatcaaacaaaaataatatgtgaaaaacttattgttgtgagatcatacttaactatatagaaaagaaaatgttagaatcaaataatttaagaggataaaaagagtagttgaaataattgattgtcgatatgcgaccagtacctaaaaatattagaattatgcatgctaaatattgtctgacttgaaggttattagtagtaatagattttatgtgatatgtttgcttaaaacaatatcattaataagaattaaaatcatgacaagggtaacgtttgccacgctagtggcagacacgtagaattaaaccgtacaagcataaatccttgtattagtctcaaaaccatccgggtaaacataataaaagttcattttcttgccatttctacaagcaattgacaccattattacctagaatagtactatttaatatgagagtttaaaagacccggaattttaaattttgatgtacggcattaatgcattgaatcgtaaagtatattactcttgattattaaactaaaagtgagtcatttggtatcttaatgacgagagagatttaactaatctcacattaaactaagcttaaggatcaagtgggggcaagcgaatggcataacagtaaataaaacgaaacacgagggctttatttgacaatgcctctaccttagcttcaaaactgagctcgttcttcatcatttcctgaaaactagaaaacacagtttaaaggaacataaaaagcaactcttttgagagatcacagaaaccctaatttgctaagaaccctaatctcaatttccatcttccaaagttcagattctgtatgtaaatg

SEQ ID NO: 18024 - DNA, 3003 bp, Unknown; identical to SEQ ID NO: 18023
  misc_feature (1)..( 3003): 2750-1469P.txt file - cDNA_ID_1815032; gDNA_ID_2926167; Annot_ID_139961

SEQ ID NO: 18025 - DNA, 3000 bp, Unknown; identical to SEQ ID NO: 6626
  misc_feature (1)..( 3000): 2750-1469P.txt file - cDNA_ID_1815035; gDNA_ID_1621099; Annot_ID_55821

SEQ ID NO: 18026 - DNA, 3000 bp, Unknown; identical to SEQ ID NO: 6626
  misc_feature (1)..( 3000): 2750-1469P.txt file - cDNA_ID_1815035; gDNA_ID_2926167; Annot_ID_139960

SEQ ID NO: 18027 - DNA, 3003 bp, Unknown
  misc_feature (1)..( 3003): 2750-1469P.txt file - cDNA_ID_1815042; gDNA_ID_1621099; Annot_ID_55819
aaacaatcaaagaatacaaaggtttgagatttaatcatttgtttaagacaacgaatgatatgagttctagtgtctgaaggagcataatccctttataggtgtctgccatcaatagtgaagtttcttgtaatgggcaatgaaaatgatatcactaaaaaatgggtcctaagagagcaacagaggaaaatgggaagtaactatttgaactaaaggggatgcaaaaccagaagataccagtccactataagcacttacattacaaaatatatgtccccatgtattcgtcgggtttctattaggctattgcttgaatgctaaagtaattatcataaaccatttgtgaggtgtaaaaagtgttagaacttttacaggtgttcctctttgttagtaaatgcaggacactgggataattggtccaaatttgacagaacgaaagtggtacatgattccagaatatgcccccagggaagtgtaaaatttatactttgtgtaataatagaaggttaaaattcaaaaagcaaattcatcatcattataatccatatgtagaatgacagtgagcaaattttagcttttacctgttaatcatgggatttcggaagacagttctgacattcaaatgagttgtgcctttttaaggtcagacacaactcctctgtcttggctgcccctttcattgtaaaccacctgcacacagattacagaaagagaatgattcaatcatgcagaagataataactctatgttgacaggaaaacaaaatcgctcatacgttttacggatttttctgacattttatcgtaccttatcaatgatcccatattcaacagcctcagtgggactaaaatatttcgggcgtttcatgtcagcttcaatctgctccggggatttaccaatatgctttgaatacagcttgaccttgagcataacattacatagaatagagacacatctttcagataagtttgaaggtaaaagtgaaaagttgcggacagagaatgatagcatgatttgagatttgctagcatgtgcatactattaatggctaactgatgaatattaagatgtctgcaagtatatacacccattgcctgcaagttccatttatttatatctcccccttaaaagacccaaataacacacacaactggacactgttgcataatgaagatcaaactaagatattctacgtacatcacaagggtttgattctctactatgtgaattcatatcaagtttatcttctcaccatttctgtctttatgtgcttgatttctttccttgcaatttcaacatcagttgcttggccttgaaatcgagcaatgggctacaaagttaacatgcaagagaaaatatattgataagtaaaaaggtgcatgcacagaattaagaatcataaaccttagattcttccaacttgaaaaagaaaaccaaaatcttctagcagggggaaaagacgccacctaatatttaaaagaaacgatcagaaagaacctgctttatcataatagttgatgagggcaacgcagatcgatttccttttgcaccagcagtcagaagcaaagcagcttcaccccaagcattcccgacgcaaagagtaaagattggtggtttgacatacctgaaattcaaagataaggtaagagttgattgttgcattgataattggtcgttctccccaaaatatgctggatatgaaaactgtctccaagtgcaattttgaatatttgggaaagcagtttaagtatccaagtcttgttatcgatgctattacgggaagaagtaagttgaggaaagagatgaagatcaattaccccatgacatcatagattgcaaaagcctcagtatcatagcccaacttttcaccattctgaaaagggagaagataaattctcttaaaaacagtttgaacgataggtaatgatttctaagcttttagtcattcatttgaaacaaaccacagtttcaattttactattcagtatgcgttcttaatatgatggactacataatggaagcccaccttggttgtcccagtcgagtttatgtaaaggtaaataggcttttcctcgtcttcatactgaaggtaaagaaactccgcaagtatcaactcagtaactgaaggtacgagagacattcccaaatatacaattcggttcttgaacaaatatgatgccaaatcaggaggaggttgttcgtgtgcacttccctttgagaaaggtataacctgttgataagacggaagcacgaagataagaatcatataataacaacaataaacaaaagactatatgtgaagaatatagcagcctccaaattctctatcataatcataatcagagcaattgatgcatattataagtggcacacacaatcaagtgaaacctctgccacataataactcaacttcttccttaccagccaaacacacagcataatttcttccgaaactgcattatttaatcttcatactcaactctctaactaaacatgtaccatttccgatcaattaaacaacagaaatgaatgagccgtctttgctatctaattgcatatatcaatagtaactctaatccattaattcgccgtttaaagctaagtagcaaccgttggtaagattcgacccataaattttccctcaattcaccaccacagaagcataaatctcagctatagaatgaatgagcattactcccccttgcaatctaatagcctatatctagagtcaatctaatccattggttcaaaactaaggaacaccatttctcgacaaatacaatttctgaaaattcactaccacagaagcataaatctcagctatagcaacgaaaacctcaatttcaaaatcctaacagaatagggagctcgttaattaagaaactgaaaaaaagtataaattcgagtaccatagtgacaactccgcgtttaggcttggaactggaaaaatttaacggattaagcgattccgcacgaagcttagcgccgcataagtcactagagatg

SEQ ID NO: 18028 - DNA, 3003 bp, Unknown; identical to SEQ ID NO: 18027
  misc_feature (1)..( 3003): 2750-1469P.txt file - cDNA_ID_1815042; gDNA_ID_2926167; Annot_ID_139958

SEQ ID NO: 18029 - DNA, 3000 bp, Unknown; identical to SEQ ID NO: 6628
  misc_feature (1)..( 3000): 2750-1469P.txt file - cDNA_ID_1815046; gDNA_ID_1621099; Annot_ID_55818

SEQ ID NO: 18030 - DNA, 3000 bp, Unknown; identical to SEQ ID NO: 6628
  misc_feature (1)..( 3000): 2750-1469P.txt file - cDNA_ID_1815046; gDNA_ID_2926167; Annot_ID_139957

SEQ ID NO: 18031 - DNA, 3003 bp, Unknown
  misc_feature (1)..( 3003): 2750-1469P.txt file - cDNA_ID_1815062; gDNA_ID_1621099; Annot_ID_55813
tttagctcaagctcccatgatggctccttctggctcaatgtccatgccgcctatgtctagcggcggtggaagctcggttcctcctccagtgatgtctccgatgccaatgatgactccaccacctatgcctatgactccaccacccatgcccatgactccaccacctatgcctatggctccaccaccaatgcccatggcttcaccaccaatgatgccaatgactccatctacaagcccaagcccattaacagttccggatatgccttcgccgccgatgccatccggaatggaatcttcaccttctccaggacccatgccaccggcaatggcggcttcgccggattcaggagctttcaatgttagaaacaacgtcgtaacactttcatgcgttgttggagttgttgcagcccattttctcctcgtttgaaatgattattgaattggtcagcctcgatcgttttcttgtaatttaccttcatttttttccctcaaattattagtggtcatcattttataatatttgagtttgtgtttgatgtacgattcagacatttgtttgcattatgtgcttaataagtttatcgttgactctacttgaagagagactttgtatgtgatgtaaatttcttctatctatggaacattgcattcgtagtcatatataggacataaatatggttacaacttggaaggataaataccacaaggcacaatatgatcaatacgacaatacctctcattgttagtcgataatatcgatgtatatagtcactagactcaccgatccgtaattccttttaacaaaaaatacgttattcagatatgttattttcatatatatgtgtaaaaatgttcttcctaataattaaaagagacaaaccaaagaaaaggctatatttgcaagctgtcattggaattttgcatacattttctctatatattctcattgaaattcatttattctttcattttatggaggtgtagaaatacataaaatccaaagaaaatgagaaattttcaaatatgttgaatttgagaatggaagaatatgacaaaggtgggtatagtgaataaatggtagggaatatagatatgcccgacccaagaggacagctaaaaagaaagtgacgttcacatgtctgtctttctctattgccccaaccattttccaatgtgtattagtaataacagaaatcatacatttaaaaagaactatatagaaattttattcatatatatatagcagtactagttagtatatctgcatttttttgtttttcaagtcatgttgatgatttattactttaaacagatgccgaagctttctaaagtaattacggtaaatatatgttagtcatttgtaaaaacgaccgatgacagaaagatatgttttatttcttagtatatctaacaatgttataaccgaatgatgacaacctataaaccacaatagagcactaatttaattacatgctctttgttgctggctccgtacaccggccaccacaatcaaaaccttaattgtccactttttagccacttcgaattctcagaaagataaatctaaggaagttctaggtctttcaaaggccacaaatctcgatatgttggtggtttgtgaatatgcaaatctttggtgatacgctaacttcttcaattcataatttcaataaacgaactgagaatttactgatgggtagttgttcaaagctggagtttcttccacctgctgacgtttacttggaatctctcaaggacccaaatctaaggaaatgcttacggttgaaaagtgtccgtccgatttcgaaaaccattccaggtatttttttttaagtcttacaacatattctttccggtgaggaggagaccatgttgtttttcttcccaagaaaatttaacctctattgctatgatcctaagtgtataaaaggcttgcaatcaatggaggttttaattatagtccatgggtgaataatgtcatcaatagtgataactggacaagatttttaaaaaatgccacaaacacaaaagaaaaaaaaaattgaaagtaaatgtcataaaatcataattatgcgtagtgtgcaaggtatactttggtaaaatctgtcacattagacatttacttatttacaattttgcaaattggttatttacttaaataaatgaaacttatacgcaaaataaaataaaatcctgactaagctcatatcttttaatttgttttctaacagaaatatatccctctgttagtacaccacattgacgatgtcattcattattaggaatggaaatttttcattctttcctataaaactagatgttaattaaaaaaaaaaaacaattatacggatttcttaagagatttgaatttctttacgtagattttctgtaagtagtataattcaaaagaagcaagttaaagctaatctccttgacatggattgaatttttttttgaaccaattacccgacaaggatttttttagtggtatttatagattttgccattttttatatctaaaaaatacaatttaacacattacgtttgggtttatttagttccatattttttttagggtatagtgtttgttattaagtatgtattttacaaaaaaaaatctcaagtgtttcattttttaaagttgcagaaaacgcaaaatctaaaatatttgaaggtggcaaatctaaaagatttaagtcacaaaatggcaaaatcaacaataatcctatattattttgggtggtgttgatgagccgttgacgtagaagaatagcatgtggccttatttgctataggatgtggccctaaccctaataggatgagaaatctttgctcaacttggcttagagtggaaccaaccgtgaagcatccgtctcaaaaatgtctactctatgacgtctttttcaccccaccccccccctctccacaaggcccctccatttctgtataaacttcagaatgctttcttgagaatgtttttatcttctttctatagtttccatg

SEQ ID NO: 18032 - DNA, 3003 bp, Unknown; identical to SEQ ID NO: 18031
  misc_feature (1)..( 3003): 2750-1469P.txt file - cDNA_ID_1815062; gDNA_ID_2926167; Annot_ID_139952

SEQ ID NO: 18033 - DNA, 3000 bp, Unknown
  misc_feature (1)..( 3000): 2750-1469P.txt file - cDNA_ID_1815073; gDNA_ID_1621099; Annot_ID_55810
acttgcctcatttgttttccttgcaggccctcatgttggcgctcagaagtattatgtgaataatgaaatcagaatgctggagcgttttgggtaagtaactaagtatgattaggcatgaaccttccacattttcaagcataacgatctgaaactgctgaaattattgctttatttagggggaaaaactgtataataaagcatgaaggctgtctcaagaatggagattctgattgcatcatccttgagcaccttgaacatgacagacctgattcattgaagagagaaatagatgtgtatcagctgcagtggtacggctactgcatgttcaaagctctatcgagtctgcataagcaggtatgcagattttggactgaattatttttagcattcatatttcaatcacgcaactaaccagttctattttttctcttcacaatcttgaagggtgttgttcatagggatgttaagccaggaaacttcctcttctctaggaagaccaacaaaggctatctcattgattttaaccttgccatggttagcattttttgtcacccttctcttatcaaaattttcctagcgacgatttttggttagtgtttcttactatagaatttgaagtaaccgaaaaaacctgcttattcaattctaaggtcagtgtctaacagaggcactgaaaaacttgaggaacacaaacgttcatgttaaaatttactgttatgttcccttccccacccactgatattaatctcttttttttcctgcatggttcaattaggatttgcaccagaagtacagaagagcaggtaaacttctcccctcatgcatatgtgctgtacttggctataaaatatggaaactaaagctatctcttgttatcttctgtagataaatcaaaagcagcttcaggtcttcctaccgccagcaagaaacatcatacattggttaaatcactcgatgcggtaaaccgagggaccaacaaaccttctcagaaaactttagcgcctaatagtatcaagaaagcagcgggaaagacaagagctcggaatgacatgaccagatgggagagactcaatagccaaggggcagaagggtctggcttaacttcagctaaagatgtgaccagcacaaggaacaacccttcaggtgaaaagagaagagagcctttgccatgtcatggaagaaaagcgcttttagattttctgcaagagacaatgtctgttccaattccaaaccatgaagtatcatccaaagctcctacgtctatgagaaaacgggtagctgctcttccagggaaagctgagaaggaacttctttatctgaccccaatgccactgtgctctaacggtcggcctgaagcaggtgcagttctggtgtaatcattgacttttgtttttgtttcagagtttaatttaaaccttaagaagagtttttctgactttactaggggacgtaattgagaagaaagacggtccttgctcaggaaccaaaggcttccgagctccagaggtacatcaactgtaactatagctcacttctcttaatactagttaaatatgaaaatcttgtgccttcagactaaagttgtaggcctgagctactcattagcacatctctgatgggaaagctaattctctggggctgttcttggctgaattggtttgtgcaggtttgcttcagatctttgcaccaaggacctaagatagacgtgtggtctgcgggagttactttgttatacctcataatgggaaggacacctttcactggtgaccctgaacagttaagatctgacttgaatgagtacaccatcactcgattccactcttttttctttcttgccttcttacaaagaccttgtatttcccaggaacataaaggacattgcacaactacgaggcagtgaagaattatgggaagtagccaagctgcacaaccgtgaatcctctttccctaaggtaacatctcatcttaccactcttctgtactctccattcatttatgagacacatatacttgctctgttctttttaccgccagcttaaatatcacataaaagggttttcattgttagcgttttgtgttctattgcttctactgcactcccattacagaacatatatatcttaataatgtaaattgatgacaaagtgattagatagatgatcgtgagagatgaaatcaggtagagttttgtgttgttgtttcaggaattatacgagtcaaggtacttgaaggggatggagttgagaaaatggtgcgaactcaacacaaaacgcagagagtttctagacgtaattccactatcgcttcttgacctcgttgataaatgtttgaccgttaacccgaggcgacgaatcagcgcagaggatgctctcaagcacgacttcttccatccagtacatgaaacccttagaaaccaaatgctccttaaacagcagcctacagtggttgctgacgcagtaagccaaactctaaactatttacaattgtaaaagtaaataagaaaaatatatttaacaatcttcactccactgtccacaccactcaactttggaaaactaaaaagagtattttagcaaattagatagtttgagtcttcaaaatatcttttgtagaggacacaaacttgacgtttttgtctatttgcctcgaaattatgataaattataatcttatttctgttttttacaatgacttagtcataattcagtgacagttgacaaccacaaaatcaatcttttaaaataccggtgtatagtaaacctctgtatcatattagtttagttcgtctcaattgtcttgttaggtggtttgatgttagtcacttaaaaaattatttgtttagtaagtcttctatcaagtgggagaccaagtcttcgaggaaaggaagaccaagtttctcctctctttctctcttactctcttactcataatatgtattgctaatttacttctcttacgaatcttcgtctcttctctgagttctctctatcgtctcccatg

SEQ ID NO: 18034 - DNA, 3000 bp, Unknown; identical to SEQ ID NO: 18033
  misc_feature (1)..( 3000): 2750-1469P.txt file - cDNA_ID_1815073; gDNA_ID_2926167; Annot_ID_139949

SEQ ID NO: 18035 - DNA, 3000 bp, Unknown; identical to SEQ ID NO: 6633
  misc_feature (1)..( 3000): 2750-1469P.txt file - cDNA_ID_1815077; gDNA_ID_1621099; Annot_ID_55809

SEQ ID NO: 18036 - DNA, 3000 bp, Unknown; identical to SEQ ID NO: 6633
  misc_feature (1)..( 3000): 2750-1469P.txt file - cDNA_ID_1815077; gDNA_ID_2926167; Annot_ID_139948

SEQ ID NO: 18037 - DNA, 3000 bp, Unknown
  misc_feature (1)..( 3000): 2750-1469P.txt file - cDNA_ID_1815081; gDNA_ID_1621099; Annot_ID_55808
tcaacaactgcaaaagtttggtgacacttccttctactattgggaatctccaaaaattggtgaggttggaaatgaaagaatgcacagggctggaggttcttccaaccgatgtcaacttgtcatctctcgaaaccctcgatctcagtggttgctcaagtttgagaacttttcctctgatttcaaagagtatcaaatggctctatctggaaaacaccgccattgaagaaattctagatctttcaaaggccaccaagctcgagtctttgatactcaacaactgcaaaagtttggtgacacttccttctacaattgggaatcttcaaaatttgagacgtttgtacatgaaaagatgcacagggctggaggttcttccaaccgatgtcaacttgtcatctctgggtatcctcgatctcagtggttgctcaagtttgagaacttttcctctgatttcaactaatattgtatggctctatctggaaaacaccgccattggagaagttccctgctgcattgaggatttcacgaggctccgtgtactactgatgtattgttgccagaggttgaaaaacatctccccaaacattttcagactgagaagtctaatgttcgccgactttacagactgtagaggtgtcatcaaggcgttgagtgatgcaactgtggtagcgacaatggaagatagcgtttcttgtgtaccattatctgaaaacattgaatatacatgtgaacgtttctggggtgagttgtatggtgatggtgattgggacttaggtactgaatattttagcttccgtaattgcttcaaattggatagagatgcgcgagagctcatcctacgatcatgcttcaagcctgtggccttaccaggtggagaaatccctaagtatttcacgtatcgagcttatggagattccctaactgtcactttacctcggagctctctttctcaatccttcttgcgatttaaggcttgtctcgtggttgaccctctctccgagggcaagggtttttatcgatatttggaggtaaactttggcttcaatggcaaacagtatcagaaatcatttttggaagatgaagaactggagttttgtaagacggatcatctgtttttctgttccttcaagttcgagtctgaaatgactttcaacgatgtggagtttaagttttgttgctccaataggatcaaagaatgcggtgtacgactcatgtatgtctctcaagaaacagagtacaaccaacagactacgagaagcaagaagcggatgcgggtatcttttgacttttgattagagctgaaaattataaagctatattttgacttttgatttgattttccaggatcgaaataccatagagacagactatttaatagaatcgatcgtttgatttataatgcagatgacatcgggaacatctgaagaatatatcaacttagccggtgaccaaattgtagcagacacaggattggccgctctaaatatggagctttcgttaggggagggagaagcatcatcatcaacatctctagagggggaagctttgtctgttgattatatgataactaaagaacaagatgaagacattcctttcttggatcctgtttctggtaactgaagcatcttatcattctgttttggtctgttttaggataacttgggatcgaccatgattatatatctataatgataacaagacgatttcataggttttgacacaagccattttttattgatagatggtacatggagatcattttattctgcagaatgatatttggagaaccaaattccgtttaatcatccaactccggagcctgaaagtgtttgtaatttcttctttatctgaatgcagaaacactctgtttgctttgaacattttgtctgccttttctttgaaacatagatctcaatgtgtatattagcacaggttgtttttctctttattagcaatgaatagagaaatcagactttgcgtaaacaaaaatgtatatcgcaaattcacaaaagaattgacaacaagagtgtgttggaactaattttaaatagcaagatccttgtcatcaacaacatttgcattgctgattcaatagccaaaaggcagaagcgtttttggcctaactttggccaaagatgtgaccagcataaggaacaatccatcagctgaaggaaagagcttttaaactttctgcaggagacattgtctggtccacttccaaaccatgaagtatcatccagctatcctacgtcgatgagaaaacatgtcgctgctgttcccccatcccgctgcactctttaattatatgataaagagtgaaagttgtaggcctgaactactcactagaacatctaggataggaagctcattctctggggctgttcttgactgaattggtttgcttcagatctttgcatcgagggcctaagatgatagacgtttggtctgatggggacgacacctttcactgctgaccctgatcagttaagatctgccttgactgaattcacaccatcacattgttaagattcctttcctggatccttagccgtctccacagcttatcacattgttaaggtgacctgaaacgtattacaactctgtttcataatgaacatgggatcgaccatgactatactggtaatgacaagacgatttcttagtttttcacacaagccattttctcctgcagatgatggaacacttactgacagctagaaaccttttatggttccatgtccagaacagaagtactctattcttacttctctgttttgcttctttgaaaatttcgcttctcctgaaagatgtgaatataacagtcttgtctgttgaaacacatatctctctctacgaaatgttattttcctctctttaaagcaatgaataaatcataatcttggtaaacaaaaatgtatttcacaatttcacaagagaactatcaacaacaaaaaagttttaaatagcaacctcatcagcaacaattgcatcactgctaccatg

SEQ ID NO: 18038 - DNA, 3000 bp, Unknown; identical to SEQ ID NO: 18037
  misc_feature (1)..( 3000): 2750-1469P.txt file - cDNA_ID_1815081; gDNA_ID_2926167; Annot_ID_139947

SEQ ID NO: 18039 - DNA, 3000 bp, Unknown; identical to SEQ ID NO: 6634
  misc_feature (1)..( 3000): 2750-1469P.txt file - cDNA_ID_1815089; gDNA_ID_1621099; Annot_ID_55806

SEQ ID NO: 18040 - DNA, 3000 bp, Unknown; identical to SEQ ID NO: 6634
  misc_feature (1)..( 3000): 2750-1469P.txt file - cDNA_ID_1815089; gDNA_ID_2926167; Annot_ID_139945

SEQ ID NO: 18041 - DNA, 3000 bp, Unknown; identical to SEQ ID NO: 6635
  misc_feature (1)..( 3000): 2750-1469P.txt file - cDNA_ID_1815097; gDNA_ID_1621099; Annot_ID_55804

SEQ ID NO: 18042 - DNA, 3000 bp, Unknown; identical to SEQ ID NO: 6636
  misc_feature (1)..( 3000): 2750-1469P.txt file - cDNA_ID_1815101; gDNA_ID_1621099; Annot_ID_55803

SEQ ID NO: 18043 - DNA, 3000 bp, Unknown; identical to SEQ ID NO: 6636
  misc_feature (1)..( 3000): 2750-1469P.txt file - cDNA_ID_1815101; gDNA_ID_2926167; Annot_ID_139942

SEQ ID NO: 18044 - DNA, 3000 bp, Unknown; identical to SEQ ID NO: 6637
  misc_feature (1)..( 3000): 2750-1469P.txt file - cDNA_ID_1815113; gDNA_ID_1621099; Annot_ID_55800

SEQ ID NO: 18045 - DNA, 3000 bp, Unknown; identical to SEQ ID NO: 6637
  misc_feature (1)..( 3000): 2750-1469P.txt file - cDNA_ID_1815113; gDNA_ID_2926167; Annot_ID_139939

SEQ ID NO: 18046 - DNA, 3003 bp, Unknown
  misc_feature (1)..( 3003): 2750-1469P.txt file - cDNA_ID_1815117; gDNA_ID_1621099; Annot_ID_55799
tagtggattaaggcattaagctgtccaagttgcttgtattttcttttcattttattaattaaaaaaaaagttcaactatttattgactaataataatacgtgttaaatggttatcggtttaaaatatgggccataggcccagacttgaagaaaaacttgaaacccaaagttttatttttacttgttttctttctcagtgaatatctcccaatcaagcttcttcaattttgcttgctctctctcttacacggccaatcggtgttttcgcagctttcaggtttgtctcaatctcaaattaaatcggagtcaagtaataacaattgataaccctaattgtttcaattatattgtaagatttgaaattttgcagtagatccggaatcgtattctagttctggaatcgttgatctcgatggaattttttttaagatttcttcatacacatttggttcaaaagatcacataattttattttaatttgataagtatgatgattctgctaagtggcattggataaagttttcatttttgcaatacgtctaaacttgtctatgtcttgaatgaactctctgagttgcttaaaaagtcttgtgctttctttattacacaggcctcaatacaagacattctatataagcatattgcagaagaggcggttctaattgttgcatggagttgaacaatatgacgtagggaaattctaatttaggggaggcctcagagtttgcactaacttcataatcagctctggacgttgttgattgtatttgaacaagaatgtgtaggcagaattgtcgcgcgaaatcctcaccggaggaagtgatttcaactgatgagaatctcttgatatattgtaaacctgttcgactatataacatctttcaccttcgctctctaggcaacgtatgatttggccttcctctctcatcattttagcttagtaatctttcatctcctgtgtagatcacccactaatagtttgagtttgctaagctgattatggtctgactcatggcgagtgtgtgcttcttttgtctcctaatgttatttgaacttgttgtttgttgttgcagccatcgtttctgccaagatgcttgaactacaaaattggggcaaagcgcaaaagaaagtatgcgtttcttcttgaatgtagttgccacagtgatatgttatttatcttacttctaatatggaagctgatgaactatttatctttgttgagtagatatggacataatgaatggtttcttctttgttcatgctatacacttatattttacaaaattgtgttttgcttaggtcaagatctactgggatggtagttttcaactataaggattgtaataatacattacaaagaactgaaggttagtctttttctgttcttcgacaaaattcgatgtcaatgtctatgtttctctagatgatttgttatttactatttttttctgtattgtcacgcagttagggaggattgttcttgtccattttgctctatgctatgtggtagcttcaaggtgggcaactattacaactgaggtttcttccggggcctttcatatctaacactgtgaaatgctactgccgtttaatgctatatactttcactgtttggttacatatttttgtgtttgttgtttgtcttcttgctctttttaaactgctgagtgtgtgcttatctgagaaaacatgttccagttcgagcttacaatccattgtcttgtgtctatgcaggggctgcaatttcatttgaattcatctcatgatttatttgaatttgagttcaaggtatgtggttttatggaatttcttgttttgcctatgccgttagtaatgaggttatagttaaaaaagggtctttcctattgtagcttttggaagaataccagacagttaatgtttctgtaaaacttaattccttcatatttgaggtcagttactttaaacttggttaattgggaaatcctatagctggtgaaaatttggtttatattccatccttatttgtactaggaagaaggaagtgatgatgataaatttgagcccttctctctctggtaactctcagaaccccttgattaaataccttaatagcagtaactccttgcttttcttgtcagtacttctctataaatccaaccacaatgttttgcagctcgaaacctcgtaagcgtagacaaagaggtggcagaaataacaccaggagacttaaagtatgctttttaccgttggattcacccagtttagctaatggcacagaaaatggaattgccctgctgaatgatggtaaaatcacatcttcttctgtggtattcgttgtggcttagaacttcattttacagaagaagatacaatgtcctgattgtttagtttttgtacttctcctcgcattcttcttgtgagggtaatgttaccagaactgatgtacaaaattaatggcatgctacaggaaaccgtggtttaggatatcccgaggcaacagagcttgctggacaatttgagatgactagcaacattccaccagccatagcccactcttctctggacgctggtgctaaagttatattaacaaccgaagctgtggtccctgctactaagacaagaaagttatctgctgagcgatcagaggctagaaggtttgttcatcatgacaccccgtcatcataattaccatacctgttgttacaaatgttcttcctattatggataagtgtttactgtactgccatattaaccgagaaaatttcttccagccacctacttcttcagaaacgccaattctatcattctcacagagtccaggtgatccaagttccttcacctacttcttaggcattttctttaaattgctcatgatgatatcttatcaaagcatacttggtttgttctcatctaaatttgtattttgattctgtatgtatcaacgcaaaaaaattatgtccatgttgtctccgttttattgccactaaccaaaaactgcatgtttcttgtgacaagccaatg

SEQ ID NO: 18047 - DNA, 3003 bp, Unknown; identical to SEQ ID NO: 18046
  misc_feature (1)..( 3003): 2750-1469P.txt file - cDNA_ID_1815117; gDNA_ID_2926167; Annot_ID_139938

SEQ ID NO: 18048 - DNA, 3003 bp, Unknown
  misc_feature (1)..( 3003): 2750-1469P.txt file - cDNA_ID_1815121; gDNA_ID_1621099; Annot_ID_55798
agtctcatcacacaattgtttgcaatgcggttctaacatttatccacttcatattttttttatataaaaattgtttatacgtttccaacacgtaaacacttctcattgtacattttcttttttttttttgctataatgactgaaaccatgcatgaaaagtcttctaaatagaatcgaactaaaagaaaaattacacttaaaaaaacaaattgcaatattttttggttttatttggtttaaaactatgtatgatctagaaaaaaaatattatgagcctaaagtgaattattctgattctatataaatacaaacggtaagtattaagttagaaaactaaatagtcttatgtatacaaatctcttcataattcattaaatatattgtaaattgtaatgagtattttcatatacatagactgatagaagcactttatcgttaaaattgcaaaataaaagtagttataagtgggcataaatgaccaaaatttgctaaaatagattgtttttttttttttttttttggtaggggacactggacagggagataatccaataatgaaatataaacttttgtttagatatgccgtcggtttaagtattctgataatcaccaccgtttttttgcctattccaaatttccacacattttattttcatttcttaatatttatttccttatcatttctttctctcaccaaccaacaagttctcctttctacccatttcgtctccttcattttgacgttttctttagatctgttaataatcccatccatggcttggtctagtcactagtggtgttatctctctgtgtggaataaaaagcaaggttttttaatcacttggattgttttaagatatggcaactttgaacccttttgatttgttggatgatgatgctgaggatccaagccagctcgctgttgccatcgagaagattgataagtccaagaaatctggacaggtttcgagcttgcctgctaagtcagctcctaagcttccatcgaagccacttcctcctgctcaagccggtgaggtttcttctcataaatcaatatttaatcagaaaaattcgatctttattactggagtaagctgtctgtgttattgtttggattctcttgattattcatggagttgtgttttgtcggttgaatgattgagattagtgtatgattagttttgatgctgttgactagtgagagaggcaaggagtgatgctccacgtggtggtggaggccgtggaggatttaaccgtggtcgtggtggttacaaccgtgatgatggtaacaatggatattcagggggatacactaaaccctcaggtgaaggagatgtttcaaagtcttcttacgagaggcgtggcggtggtggtgctcctcgtggttccttccgtggtgaaggtggtggacctggtggtggtcgtcgtggtggattcagcaatgagggtggtgatggggaacgtcctcgaagggcctttgagcgtcgtagtggaactggcagagggtcagtcttattctgttgttgcataatctgccattgaaatgactgtgtcaatctcataagttggagtttatcttttggataggagtgacttcaagcgtgacggatctggtcgtgggaattggggaactccaggggaagagatagctgcgtatgtaattgtttatggtttattgcatttgtttaaaaaagtatgtattaatgtgattgtgattgggaatttggactaaaagaagttttctctggattttaagtgagactgaagcagtagctggtgttgagactgagaaggatgttggagagaagccagctgttgatgatgtagctgctgatgctaacaaggaggatactgttgttgaggagaaagagcctgaggataaggtaaacagagaatagaatagaaatgctaggctcctctttactatactggtatcagttttttttattttcacttattgtttattgacttgtgtttctacaggaaatgactcttgatgagtatgagaaaatactcgaggagaagaaaaaggcacttcaatcattaactacctctgagaggaaagttgatacgaaagtgtttgaatcaatgcaacaactgtcaaacaagaagtctaatgatgaaatcttcatcaagctggtaagacatatcatgtatcatttcttcattgtcgtctattaacttgcgtcaatgattctaaacctttcctttgacctatttcccagggttctgataaggacaaacgcaaagatgacaaagaagagaaggctaagaaggtttaaatcattgtctgaattgaaacatattgtagaaatcaataagtttgcttattgatgtgtgttcctgattgtaaacaggctgtgagcatcaatgagtttctgaagccagcagagggtgggaactactaccgaggaggtcgtggtggccgtggacgtggtggtcgtggccgtggaggtgtttctagtggcgaatctggtggttaccgtaatgaagctgcaccggcaattggagatgctgctcagttcccatctcttgggggcaagtaagatccatccatgataacgtccacactcgtgcatcctcctttaggattttgtgcgaggatttactgtttactggtctctcgttgtcagatgtaaataattaggtgtcgtcgtcagtttttagattttatgcaaaactttacacttgttggtgttctttacttttgaaacagtacactcttcttaattttaccattttactcgttttgtgtttgttgttttcttatttatgaaacatgttttgagacggacatatctaatgttatcgggtttgagtctttactctgtctcctcttttctcattcgtgatcgtgttcatagatgttttagaatcagtaataatttgacatgagttatgacttatgaatgattgtcgaataacgtggttgctattacatataccaatgattctgtaggatttaaacatttttttgtgttctgtcgtaaaccatgtaaaatg

SEQ ID NO: 18049 - DNA, 3003 bp, Unknown; identical to SEQ ID NO: 18048
  misc_feature (1)..( 3003): 2750-1469P.txt file - cDNA_ID_1815121; gDNA_ID_2926167; Annot_ID_139937

SEQ ID NO: 18050 - DNA, 3000 bp, Unknown; identical to SEQ ID NO: 6621
  misc_feature (1)..( 3000): 2750-1469P.txt file - cDNA_ID_1815129; gDNA_ID_1621099; Annot_ID_55794

SEQ ID NO: 18051 - skipped

SEQ ID NO: 18052 - DNA, 3000 bp, Unknown; identical to SEQ ID NO: 6671
  misc_feature (1)..( 3000): 2750-1469P.txt file - cDNA_ID_1815133; gDNA_ID_1621100; Annot_ID_55881

SEQ ID NO: 18053 - DNA, 3000 bp, Unknown; identical to SEQ ID NO: 6671
  misc_feature (1)..( 3000): 2750-1469P.txt file - cDNA_ID_1815133; gDNA_ID_2926168; Annot_ID_140017

SEQ ID NO: 18054 - DNA, 3003 bp, Unknown
  misc_feature (1)..( 3003): 2750-1469P.txt file - cDNA_ID_1815141; gDNA_ID_1621100; Annot_ID_55879
tttcctaataagctcgtttgttatttcagcttctctctttcatttcacacacatacatattggccagtaatgtccctactgtttactctccagttggatgatcgtaccgttgacagatttgaaagagagaaattgcttaaattctgggtaagtatgatctaacacgggttacatatatcttctttgtttctccattcttgtttagacttaaatggttttaacatgctgcagatacaatcattcgtagcaggagttccatacattgtcgttggatttaggtatgaatttgccaaccattctaaggataaactcaaaaagtctaaacctttcgccatttaagcaaatcagttcaagataacattaccatatcccttttcatcttgatgtagagatgatggaggaagactagtacgcacagagagactaacaacgagagatattgcgcatagagccagattgaaaaactattggcaggtaagtgttatcagttctcattacagacatgaatgataagaaacactaatgaatttgggaactagggaggagtgtgcttggcatttgccgatgaagttctttgctggctatacggcactgttaaagaaagtaagttcattttttgttacgtctacatagaacaatggaagaagatcttttaaatttacatttcccaacaatgtgttttgcagacgaagattacatacttcagttcgtgcaccctttcatgagactagagcttcttcaagctcaatcttgtcctgatgccatcactaatcatgttcaccttctacaaaatcctgcatcaccaccaccaccacctcagtaactttatgcttctttagtggagtcataaactgtaatacttagggttcaaaatcaaatttgaaatgaaggtttagattttggatttcttttgtaacattttattaaccaaaaacccaaacattgaaaaaggaaaaaaaattgtgattcaaagattttaaactgggtccaagcagaaagcgagtctaacatgggccgggtctgttttaaactgggtccaagccttctaatcttatcacgtgagcgtcacgtgctctctttttctctctctctctctctccctctggctgacgaatcaccggagaacccaatttgtttcattcctttcccgttttgcccttccctgttcttttattcttttcttatctacaaaaaaaacttcgagcaagaacaaaaaaaaaaaactgtccatgtaccacaccatgagattagttgtcagatagatattcgcgagacgagaagctccaattaaaaaccctagagctcatctctctctccaggtacggccttttcgtttttggctttcaccggcgtggatctccggtgacggggagattcggaatttcggagagattttagatcatgtatagggagagaggtatggttggatcgaagtcggaggtggtcgatcggaaacgaataaacgagattcacgataacaggccttcgcattcgatgtctcagcctgtcaatggaaaaggcaaggtaacatcgacctccgttttgatggggaagcagcaattgcatgataaggaatcttcacgttctggttctatctctaagactaacatttccgacggttagattcgattttcccctctatcgctatttctctatgtttatcgtattcgcagattgtttatttcgagttcttgtcctgtgttggtctcctgatttgggattcaactttcttaaaattgattagaaatttcttaatttgacctattgttcttgaagaaatgttattcattttgttgttaacaaaagctagaagcttgatcttagacgcagtctagttttggttgctgtgtattcattttgcttatatcgagcaaatcattgttgtttgcttaagaacaagttataagaatgatgctgatgaaatgttttgtgggcatttcttgtggtgataatagctgtggatatatcagacacagacagcgaagaatcagaggtcagtggttctgatggagaggacacctcgtggatatcttggttctgcaaccttcgtgggaacgagttcttctgtgaagttgatgatgattacatccaggatgactttaacttgtgtggactcagccatcaagttccttactacgactatgcccttgatttgattttggatgtggagtcttcgcatggtaagtcttacccatgaattattagtatgtaattgtgtgtttttcataatataatagccgaaaacttggttcgtctttcttttcgttttgtgtcttcaatgtttgatttggattgacgggttaacaggtgagatgtttacagaggaacagaatgaattgatcgagtcagcagcagagatgctatatggaatgattcatgctcgtttcatattgactagcaaagggctggcttctatggtaaagaacttttttagactcaagttagatacttaacatatcctatagaacatacactgattgttgttttctttacaatggttttgcagttagacaaatacaaaaactatgactttggaagatgcccaagagtttattgttgtggccaaccttgtttaccagttggtcaatccgatatccctagagcaagcaccgtaaagatatactgcccaaaatgtgaagatgtctattacccacgatcaaaataccaaggaagtatcctttttctaatctcagtggtaaatgcagttctgtgcggttacacacacttagctttactttgattgtcattagataattttatcatgctgttttcgttgctgctatctttggtttttgtcattctttaacacacaaaaaaacagacatagatggagcttactttgggacaacgtttccacatctgttcttgatgacgtacgggcatctgaagccacaaaaggcatcacaaagctacactcaaagagtgtttgggttcaagctacacaagccgtgaaggaaacaaggaagaagaaatgcacccttgggttttgagaaacaagaaatg

SEQ ID NO: 18055 - DNA, 3003 bp, Unknown; identical to SEQ ID NO: 18054
  misc_feature (1)..( 3003): 2750-1469P.txt file - cDNA_ID_1815141; gDNA_ID_2926168; Annot_ID_140015

SEQ ID NO: 18056 - DNA, 3003 bp, Unknown
  misc_feature (1)..( 3003): 2750-1469P.txt file - cDNA_ID_1815146; gDNA_ID_1621100; Annot_ID_55876
tgattaaggtcctaattatgtcaacgtttgcctgccacattgcagaccgaagtactaattccacaccgactggtctacgacatatttaattcataaacacaatactttataattaaattgattcttgtagagatttggcttcatgatctgatttatttagttaataaccatttcaacagataattacagtttagagcctttttccagttgtcaagagtgttatggttttaaaatggcaccctgtaaatatcacatatgttagtggatttattttaccaaagaaacaaaaaatgttaatggattaaaaaacttgtgtttttttagatagcaaaaccaaaagaagatatggtgaccactaacacgatcagtcgaagacaaatgtttcccagactttattattggcgtttccattttgcatattagtcaaattatggagcatcgcaaatatctaataaactaactatataaaaagttattataatacagggttaccaattccgtatattcagaatattcctaagaggtgccattttgactaataaaatggacggatctttgatttattccggaagtgaatggatattagaagaaacaaaagaaattttgaatttcttgtccaaaaaatatttttcccattcttagtatacagaaacatagaaaatatcgtgtatgcttacgtaacaatcaagttgtaaaaagaaaaaaagacagaagataaatagtacagaatgaacataacagaaatcaatctatggaattaggtacaattaggttcggtctaactgaaattacatgacgacagaaaaaactgaactaaacgccgattctattaacttccaaaactgactcgtctcacacgcgcttactatgattcacacgtgcgaatatgccatcatataagcgctactaaaattcattccaaaggaaaaagaaaaataaataatcgatctcaaccgtccgatcatccatcttgccatcaccgttcaccaatcttcttcgtctcctctctctttctctctttttgctgtttctagctcctctctctctggatctcgccggcgaaccgtttctcttgggtggtgagtgttgcttcttatttttaagaatctttttcttttatttccatcgaatttcgtttttttgagtttgatttttggcctgtggaattctcgatgtttctacattgatcgtctggtttcgaatcgtgttttactggtacaattttgattccatctccgtatcttatggattcgaagaactttgtgttttttttttctttcttcattgatgctactttgctagggtttacacttttttcttccatggtaaaaaaatttgagcaaagttgttgagattcttctagactgttttcaattttacgtttcacaaagatttttttagatgatttgtttctaatgaaatggcattgtttgtgttctgtttccatatgtgtagattttgaaaatatgtttgtgatgattgtgcagtaaacagtagcaatcaagctatagaatctcagatatcgctgaattagctgttggattttatccgccttttcttcgttatccggggctcgggtataaggtttcatcgtcttatttcatctgtaaatgggctgcttccactcaaaggcagcaaaagaatttcgaggacacgaagaccctgttaagcttgcctctgagacagcttgtaagtttactcgcgctataagtttaaacctcctctagattcatttctctcaaagctgcatgttcatttgttttctgatatgagatgagaatcatcagttagattcaaatcattctttctctgttcactgatttagtttatctccggtttggatttttttagttttgtgttttggagtctttgtctgcctaacaatttctagtaatgatccttcaaagttggttaacactctatctcatgtttcttgttaccaataccatcaccttaatcttgttccttaacttgtcaagacgagttctctctccatgcaaattctaaatgtgaattattagtctctttgtttgtttgtttgtttgttcctggtaattctttgttttgatctcgtagtgttgcttgtttttttctcttttccagttagtgtgagtgaggttgaagcattatttgagctattcaagagcataagcagttcggttgttgatgatggtctgattaacaaggtacaaagtttgtttcttttgacccaatttggatcttttcatgaccccatcgttgtatctttttgttctttacgctattcatctacagtatttttcaacttagttgactttatttgagcaataattattcttccatgacgatatgtctgttccatattgcatcgattcaatgtatcgtagcccttaatgtttgacttgaacttaacttattttattgattgctttgattttgaattttgaagccttcatggcccaccttgtttatgttgttttttaatcctggcttcacatgtatgcaggaggagtttcaacttgctttgttcaaaagccggaagagggagaatatatttgctaatagggtaaaatcttaattcttcaggcttttacaagattcatcttctggaagagtgatctaaaccaagataatatgtccattatcctaaacaatattgcttttccgcagatatttgatatgtttgatgttaaacgaaaaggagtcatcgatttcggggactttgtaagatcactcaatgttttccaccccaatgcttctctagaagacaaaatagattgtaagttgacataagatagtttcatatataggtgtttattgaagcttttgtgaagagatttattgattctggtctgccattttttctcagttacgtttaggctttacgacatggactgcacgggttacattgaacgacaagaggtaatactaacttgcaagctttgaatactagtcatgatagatctttgccatgttcttgagtattcatcttttacttaataactttgcaagaaatcgttaatg

SEQ ID NO: 18057 - DNA, 3003 bp, Unknown; identical to SEQ ID NO: 18056
  misc_feature (1)..( 3003): 2750-1469P.txt file - cDNA_ID_1815146; gDNA_ID_2926168; Annot_ID_140012

SEQ ID NO: 18058 - DNA, 3000 bp, Unknown; identical to SEQ ID NO: 6698
  misc_feature (1)..( 3000): 2750-1469P.txt file - cDNA_ID_1815172; gDNA_ID_1621100; Annot_ID_55869

SEQ ID NO: 18059 - DNA, 3000 bp, Unknown; identical to SEQ ID NO: 6676
  misc_feature (1)..( 3000): 2750-1469P.txt file - cDNA_ID_1815172; gDNA_ID_1621100; Annot_ID_171373

SEQ ID NO: 18060 - DNA, 3000 bp, Unknown; identical to SEQ ID NO: 6698
  misc_feature (1)..( 3000): 2750-1469P.txt file - cDNA_ID_1815172; gDNA_ID_2926168; Annot_ID_140007

SEQ ID NO: 18061 - DNA, 3000 bp, Unknown; identical to SEQ ID NO: 6676
  misc_feature (1)..( 3000): 2750-1469P.txt file - cDNA_ID_1815172; gDNA_ID_2926168; Annot_ID_199292

SEQ ID NO: 18062 - DNA, 3000 bp, Unknown; identical to SEQ ID NO: 6678
  misc_feature (1)..( 3000): 2750-1469P.txt file - cDNA_ID_1815179; gDNA_ID_1621100; Annot_ID_55867

SEQ ID NO: 18063 - DNA, 3000 bp, Unknown; identical to SEQ ID NO: 6678
  misc_feature (1)..( 3000): 2750-1469P.txt file - cDNA_ID_1815179; gDNA_ID_1621100; Annot_ID_171371

SEQ ID NO: 18064 - DNA, 3000 bp, Unknown; identical to SEQ ID NO: 6681
  misc_feature (1)..( 3000): 2750-1469P.txt file - cDNA_ID_1815186; gDNA_ID_1621100; Annot_ID_55861

SEQ ID NO: 18065 - DNA, 3000 bp, Unknown; identical to SEQ ID NO: 6681
  misc_feature (1)..( 3000): 2750-1469P.txt file - cDNA_ID_1815186; gDNA_ID_2926168; Annot_ID_140000

SEQ ID NO: 18066 - DNA, 3000 bp, Unknown; identical to SEQ ID NO: 6690
  misc_feature (1)..( 3000): 2750-1469P.txt file - cDNA_ID_1815193; gDNA_ID_1621100; Annot_ID_55857

SEQ ID NO: 18067 - DNA, 3000 bp, Unknown; identical to SEQ ID NO: 6690
  misc_feature (1)..( 3000): 2750-1469P.txt file - cDNA_ID_1815193; gDNA_ID_2926168; Annot_ID_139996

SEQ ID NO: 18068 - DNA, 3000 bp, Unknown; identical to SEQ ID NO: 6687
  misc_feature (1)..( 3000): 2750-1469P.txt file - cDNA_ID_1815209; gDNA_ID_1621100; Annot_ID_55853

SEQ ID NO: 18069 - DNA, 3000 bp, Unknown; identical to SEQ ID NO: 6687
  misc_feature (1)..( 3000): 2750-1469P.txt file - cDNA_ID_1815209; gDNA_ID_2926168; Annot_ID_139992

SEQ ID NO: 18070 - DNA, 3003 bp, Unknown
  misc_feature (1)..( 3003): 2750-1469P.txt file - cDNA_ID_1815216; gDNA_ID_1621100; Annot_ID_55851
gaagtctacttcggtctgaaaaccggacaaggtcttttggagttcaagtgcaagagcaagattcacaagcagagatgggttgatggggttcagtctcttctccgccaagtaaattgctttgaggctgccaaatgctcgctgggatctctgaatctcactggtcacacgtgatgcaggatcctgtatatatttgattatattcatatatataatatccaaatttttgctgttgtgaggtatttgcaaaacctggcaatgtaacctcagaagacttttggataaaacaaagcaggttgttcaaatgatcacaacaagtgttaggaacattgctatgtacagaaagacatcagaagaatgatgaatctcaattgaactttttatttccaatgattcagtttctatgaagagtcaaaaaattgtagagaagtggtatgtatatttttgtttgagtgagaagttcatatgaagaatcacgtgagagacatgtcagagatattcatatagaccgtattagaatacgacagtcctttgtgtcccataaggcaatactcgcagttcgcagtaagattttatagctttcatgagacactttttctcaaggtcctctgatttctggacaaagctcctcaaattgtctcggtgggaaactctctcaacctgtaaaaactcaaattgagacgcttctgaagaacaatgcaacactcaaaacaaataaactagttgggagatgaatcaccatttgctcaatgataggacctgaatcaagctcctctgtaacaaagtgagttgttgcaccaattagtttcacacctgcatcaaatgcctaccaatacaatctagtaaagtaagagacagggacgaaaacttgagacataaggacgagctaaatataaacctgtttcacgggatttcttcctttgaatgatggcaagaggccatgatggatgttgattacatcttttccataacctttcaagaagttaccggatagtagctgtcaaaggaaacttttccagtaaacatcatccgtcaatataataactaatgctaagaaatatcttttgttaataaagctgttcctgcaaagaagcataaacacaaagcaagaacagtctgaagagaagatttgattcattttggcgcaaacaaagtgtaatgagactattcaagacaaagaaaacgagcctaggatggaacttaaaagctgatatacctgcatgtatctagcgagaactagaaaatcggtacccttaaccaattccaaaatctcctcttctattttattctgatcggttgttggtaaataatgataagagatgccatgcctctggagaaacctcataacatgggtgtttggagctctttcatgattactgaagacaccaaatattccggaatcactagtcataactaatatatccatttagttcgttggaagagatatatgcaaaccttatcacacatgttatatcaacgggaagttttccatcctgccatttatgtaacatttcaaccagacaatgatcctacaatacaaaagaatcacacaactccaggaaaaagaaggcacagaataaaaaggatcttctttatgacataaaatttacctgtttcgacagtagaagagctatcttgtatttggggtctaaagagggcactcgtactactgagctcaaagcactaaacttttgtgcaatagtttgaaaatcttcatccatctgcctcctcggccattttactggatcaaatataaactcactgcccaaagaaattaccttttcatcacaactaaacccaaaaatagaaacttttaactgctccaagcttttagtattcactttaaagacattgattcagaaagaatctattgaagtaacatcaaaggtaagatttttcaaatgggaaaattggaaactttaccttctagagtagaagacgttcttgttctcaggaaccaaaacatcataaccaagaatgttacctcctttagcagcaatacaatctgaaagtttcgctacaatcccaacgacatcctaaacttcaaaaagaaaaactggattcagttagattaggaccaaaagaaattatggggagacatcaatgattattggattcatatacgtaccggacaatggaagacgtggaagccgggaatgagaagaggtgagacagaggaatcgagggactcgccgtgaaattgagaagatttaaaggaccatttggtaaatgatctaaaagctgtggcggagagacatgaggtggtggagactcttcgtatcattgccgctatttcttgtcgcactcttttgaatccgactcatccgtcgttataaacattctcacctttttatcgttagattatgtgtttgttattcacatatcattctgaaattttagagcataaactcaaaactctacaaaatagagtgacttcactgtttacttcgtcgtattaaaaaaagtttattatattttccaaattgagcaggaattgtttttgataaaattctcatttttatacatataataacaacttttctaatgaaattattttatcttcatactctttttccactcctttcaacaaaaatagttaaagatgtatttcattatattatcaaatgggaattgcttaagtaatgttcatttcctaaattatacaccattttatggtcatttacccaaattgcaaaaaaatatctttgagcagccagccatatcctccgaaagcttccaagtttaatttgtacaccacaaaaagataaaagaaccaaaaaagtaacatcttcttttccagatatggtctgtagtctgtgctattttgtaaatatgactccatactagatttgtgtccctcaccaaatcggtctcatcctagaaacataccatttgcacacaaattattcatacagatataaccgtacaatatttgagataggccccatcgacgtcgtttagctcaaagcaagaagggagagagagagtcagcgagcttcgttaatg

SEQ ID NO: 18071 - DNA, 3003 bp, Unknown; identical to SEQ ID NO: 18070
  misc_feature (1)..( 3003): 2750-1469P.txt file - cDNA_ID_1815216; gDNA_ID_2926168; Annot_ID_139990

SEQ ID NO: 18072 - DNA, 3000 bp, Unknown
  misc_feature (1)..( 3000): 2750-1469P.txt file - cDNA_ID_1815220; gDNA_ID_1621100; Annot_ID_55850
ttctgctatagctatagacaaatacattcaattttcccaatttgtgcagaaatactatccatgggccatggcacagaaaatttcaccttcctaacggtgctataacatctatccaccagttccgataccccaaccatgccatcggctgccaatttgttgggaggaacaattatcacagaaggatcatagaaacgcaacagcgtcttcgtgttttggtatgagctgcttgtctctatatactgagatagatgcagtgaagccgatcttaggtcaaaagcagccattccaacctgaacagagaaatccaaaatcgaatccaacatcacaatcgaaatatcaagcgagaaacaagattttgaagctacgatatcgatcccagaaatcgccgtcgcaaaatcgatacccaaagagaacacaaatcatatcataatcctgccaaatccgagcaatggagaagccgtacctacctctttggctctgttctcaattaggccggcgacgaaactcgatctctctcctccgtcgtcttccattttcgctccacagatcagaatttgaaaattgagtgaaaggtacacgagttccgaaaatgaaggcaaaagcgcgccactgtgaattctatcaatcggtttggactccaccacgccgattttaatttggtaaaccggcttcaatgaccaaactgtgctgagggtttccggttcaatttacttggtttgtgaaatccagccaaaatcaaacatatacatttgttggattaattctttgtttccgatttaattaattcaattttcaatcgacatttttatattttatatttgtccaaagaacattaaaaacaaaaaaattagagaattaccaaattaaaatttggtttggttcggttattttggttcaacagagtttgaatctgtttctattatccggattgtagagaaattgaggggctgtttgatccagttccattgccaagcagtacaaataagttgctatttcaatttattggcttatcttataacaacagttgatgatcactctcttcttacaataaacagtgttgtatggcaaacatttgaacggtaataatacaaaggttctattttagtttatttacctatctgacagtcacaaatcacaagacctcgtcaatggttacatagcggcgctcctgaatggagagctgtgcagcaactcccatggcaacagccatcaatccgtcttccaaatcaacagctgctattccttcacctctgattgctgataagaaggtgaggtgttccaagtaacttgacccgtgatgcaacccttcatatctgaataaaccaacatcgtgtgatgcgatgtgagactataatacattgttaagagtgtaagacgatatgtagataaatatagcttactttattctttcatcttctgcttttattgtttgaacgtgttctcttcctccaatacgactgccagatcgaactataccctctggaacaagtgcctccccctgcaacatgcttgccacgtcagttgaaaagaaagcaaaaggacatattgacaaaactcaaaactcatggatcatatgaacaactccaaagaaatagtcttgagaacactttatgctcatcttccatctatatgcaagagcatgtagatatgccatgtgatttgggaataaatggaaattatgtactcttgggaataacgtcgaatggttcagagaagtcaataaaaaagaaagaacacccagctctgtttttttcatatcaaacctaaaatcctatcacactaagcgcataaataagcacacacacacacaaaaatggcccataatatttcaaaggaactcacctttccaatgtcaccagtaacagaaatttcttgctcgtttttgcttccttcagcaaacatgcaaagatcgagcatcccacgacatccattgtcaaactcaataataacatatgcgttatcaattatatcaggcacctatataacagagaaacatctagtatgaaactcgcaatacgttgattgagtgtaacttgggataaaaatgtacctttccaccataaacttcatccttgtggttcacatccatgcctccagaagccatcacacagacaggatttgcaccggcaaagagcctcattagatcaaagaagtggcagcatttctccactaaggtccctccagtgttcacattgaatctattccagttgttcacctagtgatgtgttctctcagcaatcatataaaaatgtgaagcgtaaacactacacatagtcccatcttgtttaagcctaccttaaccaagaaagggaatctatgttctcggattgctaccatcttgacattaccaaagtctctgccttttacttgttctattagcttagcaactggcggcatgtatctgtactccaacccaacttgcaccaccatatctgaccttttctttgcagcctccaaaacctgattccagacaaagttggatgaattgatcaatttggtaccaaacagaaaagaagagaaaaaagacctgtttgcaatctgcaactgtggtgcataaaggcttctcaacaagaacatgatgcggttttgaataattgataatgtccataagaatctgatgatgagtcatatttggagaagagacaacaataacgtcacacagctcactcttgagcaactcctcgtgtcctgagaaaaccttaaccacaacaaagtaaaaaaaaatctcaaatcctaagctcttccacaatcaaggtatgaaatttttttatcaagtacaaagactaggaatcaaacaattatgcaccagaacattatatagaaaacacagcaaaagggtccgctctaagtaagtcctaactcctaaggttgattgttctggtaaattcaaaataccttaagctcccatccaaaagattgagcgagttcaatggccaggagctgtgaaggagggtgaggatcggcgatgcaaacgacggcgaggccttggtcacggagatg

SEQ ID NO: 18073 - DNA, 3000 bp, Unknown; identical to SEQ ID NO: 18072
  misc_feature (1)..( 3000): 2750-1469P.txt file - cDNA_ID_1815220; gDNA_ID_2926168; Annot_ID_139989

SEQ ID NO: 18074 - DNA, 3000 bp, Unknown; identical to SEQ ID NO: 6666
  misc_feature (1)..( 3000): 2750-1469P.txt file - cDNA_ID_1815228; gDNA_ID_1621100; Annot_ID_55847

SEQ ID NO: 18075 - DNA, 3000 bp, Unknown; identical to SEQ ID NO: 6666
  misc_feature (1)..( 3000): 2750-1469P.txt file - cDNA_ID_1815228; gDNA_ID_2926168; Annot_ID_139986

SEQ ID NO: 18076 - DNA, 3000 bp, Unknown
  misc_feature (1)..( 3000): 2750-1469P.txt file - cDNA_ID_1815232; gDNA_ID_1621100; Annot_ID_55846
aatagcaaagagagttcagggacaaaccccatgattccactctcatcacctttatggagtttatcaacttccgtagatactttacaatcaagtagcgttcagagaggttcagctgctactcaccagccattgctttctgcatcgcatgctcaccaaactccaccaactcagaatattgttggacataataccccttggatgtcgcctctccctttccgtaacgcttggcttgcttctcagcaaaccagtggatttgatgttggttcccgtttccccgtctatccaatcactgaccctgtaaaattgactcccatgaaagaatcatccatgactctttctggcgcaaaacatgttcagagtggaacttctagcaatgtttccaaagtgacaccaacacttgagcctactagtacagttgtagcacctgctcaacattctacaagggtaaaatcaaggaaacggaagaagatgccagtctctgtggagtctggtccaaacattttgaattcgttaaagcagacagaattagctgcctcacctcttgtgccttttacacctactccggctaatctgggttataatgctggcaccctgcccagtgttgtttctatgactgcagtccctatggacctggtatctacgttccccgggaagaaaataaaatcatctttcccatctccaatttttggtggtaaccttgtacgtgaagtaaagcagagatctgtcttgtcagaggatactattgaaaaacttaaggaggctaagatgcatgcagaggatgcatctgctcttgctactgcagctgttagtcatagcgaatatgtatggaagcagatagagcaacaaagtcatgctggcctccagccagaaactcaagacagattagcttcggctgctgttgccatagctgctgcagctgcggtggcaaaagctgcagctgctgccgccaatgttgcagctaatgctgcattgcaggccaagttaatggctgaagaagcatcccttccaaatgcttctgatcagggactcccaaagtcatatgatagcatattacccggtcagggtacccctgcttctatcttgaagggtgaaggtgcagtggtgaactccagttcggttcttattgctgcgagagaggcatctaagaagagggttgaagctgctacagcggccaccaagcgtgctgaaaatatggactccattgtaaaagcagcagaattggcatcagaggctgtttctcaagctggaatacttgtttcaatgggtcatcctccgttgctcaataagctggtggaggcgggtccaagtaattactggaggcaggctcaagaatctcaggaagtacagccctgtaaaacggttgtcttagaaaaagaaactgtgtctactagtgagggaacttttgctggtcccaaaattgtgcagactgagtttggtggctctgtgaatacggcagatggtgtgtccggtccagttcctgccactggaaagttaaagggacaggagggtgataaatatgcagacttggctaaaaacaatgatgtggtttttgaaccagaagttgggtcaaaattttcaattgacgcccaacagactatcaaagcaacaaagaatgaggacatcaaggagggttctaatgtagaggtttgtgctacatttacactgtctataactaactgctcgtggttgattgtcattttttttaacggagataaatttttttgaaggttttcaaagaagaacctggattaagaaccgcatggtactctgccaatgtattgagcttagaggatgataaagcttacgtgttgttcagtgacctatctgtagaacaaggtttttgtatttatcatcaatggttttctttaaatcttatttatcatcaatagatcttttactgctcaaattcttccaagtataagtaaataggttatgcaatcacccattttccattattatattatatgcatgtaaaattatttaaaaggatgcagaactgattgccgaagctcctacgaagaggctccattgctttattaattgattggttgatcgtttgatattatcttttatcaggaacagacaagcttaaggagtgggtagccctcaaaggggaaggtgatcaggcccctaaaataagacctgctcgttctgttactgccttgccatatgaaggaaccaggaagagacgtagagctgctcttggggatcatatttggaaaattggggatagggtagactcgtgggtgcatgacaggtagtactgtctccataactagctgttttattggtctcccctaacagggatcagacaaaaccacaaaatctgtatatcaatttcagttttccgttttggaaatcctattcattccacgaagtttggaactttgatctatatttgttttgtttttcttcagttggttggagggtgttatcacagagaagaacaagaaagatgaaaacacagtgactgtgcattttcctggtgcgtaaaaaggccaatgtgcctgatgaatatacctcatttttgtgctctaaactgcttgtctgatccactgttctcaaaacgttcttattttctaaaacatatttctgcagcggaagaagaaactttgacgatcaaagcttggaatcttcgtccttctcttgtgtggaaagatggaaagtggattgaatgttctagttcaggagaaactatcagctcgtcacatgaggtattttcacccttttatggatctagagggttctcttttggatgctttggcattttgtgagactcaaaaatttgaattgcagggtgatactccaaaggagaagcgtcctagattaggaactcccgctcttgtggctgaagtaaaagacacgagtatgaagattgttgatgatccagacttggggaaaccgcctcagactggtgttcttaacctcggtgtttcagagaatacttttaacattggaaagagtaccagagaggagaacaaacccgatccactccgaatg

SEQ ID NO: 18077 - DNA, 3000 bp, Unknown; identical to SEQ ID NO: 18076
  misc_feature (1)..( 3000): 2750-1469P.txt file - cDNA_ID_1815232; gDNA_ID_2926168; Annot_ID_139985

SEQ ID NO: 18078 - DNA, 3003 bp, Unknown
  misc_feature (1)..( 3003): 2750-1469P.txt file - cDNA_ID_1815244; gDNA_ID_1621100; Annot_ID_55843
atttgaacttggaggtaccatctcttctcatgattcaatccaaagattgtctctttttgttttgttatgcaattgttcaataaagagattgtctttttgtttaggcgaggaaagatgctacacaagttgttgcaaatcttcagaggcaacaagtcaattcacgtcttattgctgctgattatcttgaatccaacattgatcttatggattttctagttgatgggtgagtttaggagatgtaatcatgtagtttgaggttgcattatggattttgttaatggctcttttaagattttgatcatgaggtttgttttatcattcatatgggtttctgtgatatctctcaggtttgaaaacaccgatatggcgttacactatggtactatgtttagagagtgcatccgtcatcagattgttgcaaagtgagcaaatcttatattttctttgattacgagattaaatcctatatgtttcaatccataaagagacaatctctatcgaatttatatagtgaaaactgcttctctttctatggttcagatatgttttggactcggagcacgtgaagaagtttttttactacatacagcttcccaatttcgacattgctgctgatgctgctgcaacttttaaggtttgggaacactgcgacatatttggagttccctcataatcacgatctgagtatatctctaatacatgccatcataactccagttccgtgattattttcttgcaggaacttctgacaaggcacaagtctacagttgctgagtttctcattaagaatgaagactgggtaagttctcttacaatgtaccaaaccataaaattttgcttgagagaaaaattatcttgaatcaatctggtatgactctcagctgttttgatttacagttttttgcagactacaactcaaagcttcttgaatcaactaattatattacccgacggcaagctattaaggtagagtaacttagaggagtgatgatatcatcgatggttaatcacgaaaaagatagcagtgacagagcattctgatggattgtaatgtgtaaaattttacagttgttgggcgatatattattggataggtcaaattcggctgtgatgacgaagtatgtgagctcgatggataacttgaggattctgatgaatcttctcagagtatgatgctttacccgccataacattaaattcttaatttctggctctgccagacagagttaatattggaaacaaactgaaacctgtggtcgaaaactctcaaatgcaggaatcaagcaagactattcagatagaagctttccatgttttcaaggtatatttcttgtactctaaatacatggagtaaatttacccagtgaaacataatcatcagtcagacgctttggcaattggatttttcggattttttaatgtgattgtagtctgagttttgataataaagtcatgaaggggcaaccaaagttcactgatattgttgtttctgtacagctgtttgtagcgaaccaaaacaagccttcagacatcgccaacattctggtggcaaacagaaacaagcttctgagattgttggctgatatcaagccggacaaaggtataggacttgtgttatatgaagccttgtatcaccagagaatggatctgattctcaccgtaaaacgagtttcttatatttatgattcatgtctgttatgtggcagaggacgagaggtttgacgcagacaaagctcaggttgtgagagagattgcaaaccttaagctgcgagagcttgcttgagcatgcacatatacacagaagctcatgatttctgttaatctttgaaagacatttttggaccatcaaagattgttgttatttattaggtactgtttcttttctctctctcagcatctacgctgttgactactctggatttttttagatcatatgaattcacatgtacactcctttagtgttgatcaaataaaaatggcattataaatcctaaatcatgaatgtaaaaaatcatcattgcatatgggaacagatagataagcagataaataactgtgtctctatgcacaaagagaaaaggaagcaagtctgttgctaatcttaagcatactgagaccgagtgccgttagatgctccatgctgagccgttttagcctccagtttccttcttttaatgactacataccaggtgaaggcttcgagtagggtggccacaatggcgagaacaacaatgataccgatgtaggcatttttccactgcttcttgggactcaatatgcctagccctttgaaaacgttcaccacccctaggatgattatcgtgtagccgatcgtgtggtggtaaatgttccagtagagcctatgcttgtgctctggttttggcctcagaaacatcgcaaacacctaatgttttcaaaacaaacgattaactggtgttgaaacctatatattttactggtttcccttttgatgtgaagtgtgtaatgtacctgaactgtcgctagagagaagagagcgatcccgatggcacggtgggtgctgtactgaatccctggtgagtcgccaccgagtttgagaccagtggcccatccggcaacaccgatgatgtaagcagaagcctggcagaaacgtgaatgtagaaccaagcagggtctgctgatttggctactctcaagtatcgagcaatgattgcccctagtggcatcatgattccccagctcactccattcaatattccatgaatctgccaaccatttttttaccaaaatcaatcattattcgttgttgccaaataaaaaattagggaaagagatgtgtgtccacaaaagattcaactcacattgcgtttgcgaagcttggaacttcctccagctcctcctgcagctgctgaaacaccggataccagattgagagttgacactgatcgaacattgttgccagaagttggatgaggcagaagactgttcccagacattgacccatcttgccacactgtgttaatg

SEQ ID NO: 18079 - DNA, 3003 bp, Unknown; identical to SEQ ID NO: 18078
  misc_feature (1)..( 3003): 2750-1469P.txt file - cDNA_ID_1815244; gDNA_ID_2926168; Annot_ID_139982

SEQ ID NO: 18080 - DNA, 3003 bp, Unknown
  misc_feature (1)..( 3003): 2750-1469P.txt file - cDNA_ID_1815247; gDNA_ID_1621100; Annot_ID_55841
cttgctcgctcaagaagttagtgaaagctgtaaacgaggcattggtctatgtcaacaagttcgaagaggtcttagacatcgaaggagagttagctaacagcaggaaagctgcagaagttgtttggttaggagttgatctctaccataaatggctcaacgtggatcttcgaaaactatccaagcaacatagcaaaacaccacaggaagttcttaaagagctggtagatatagcacaaaaagagtttacagagtcatgggagaaaaatcggatactatgcatgaagcataagccctcgcactggcccatcaagactcaagcagcaaactcaatgtaccgaatcagccaaacccttttgatgaagtacgaattcaagaaacatttgaaacagaggagactctgttgaaagatgtggaaaagatggtatcggacatagtatcaggatgcttttgcaacacggcacaagttattggaatgaagtgtttggttacagcagtggaagtgagggaagcgtcggtgagagaagcggcaatgcatttggggagaacagagaagatacttgagatcgtagacaggagatgcatgcctgctttgtctcatcacaaagtggcaaagattgatgaatggagagagttttataggaccaataaatccatcactttcactcatccttcgtcccagtgtacgacccgtgaactcattatcacctagaataacacattttcttgtcacatttaaagaattaattacgttttgtacatgataaaccctaattagcaaataaaatcctttctttgtcggttgatctaactattaacacttgatgccaagtctaaagagtttattagtttttaaaacccagtttaccaataataagtttcctttgtcggttgatgcactagtcaaactatcaaagtcgtcaagtttgctttgttgacaaggcaaagctactcttccaaaacattgatccattcttctggaaatttgcaataacgtctcaagaccaatgcaagtaataatttaaccatgccatgttatcaacaaaagctgcttctctgatttctagagtattattttttaaccattattgaagtttgaagatttcttattattgctaaatggtaaaaccatcttgaggggaacaatttgataaaactgtgtgctgcttcctgtctccgaccaaaacatgtttaaaattagattcggaccaaacaagttgtcaatttttagtacaaatcaaaggttcaaatgtcaataaataatcattacattttaaaatttcgaaataaaaggacaaacatgtaaaaaccaaaaaagtgaagcactgatatttgtcatttctgcctataaaatgtacacttcccactcacacggtcacagaaaccaaattcgaagaagaaacagagaatcatcaaatcaaatccctaaaaattgatttttgaaatggagaagaacgcatcgacttcgtcgttgaaggacttgggtccgagtggtctagatctaaccagcgcctttttcaaaccgatccacaactccgatccttctctcccttcaaaccgacgtaccaaagtctccgtcgtcggagtcggaaacgtcggaatggccatagctcaaaccatcctcactcaagatctcgcagacgagatcgctctcgttgacgccaaacccgataagcttcgtggcgaaatgcttgatctccaacacgccgctgctttcctccctcgaactaagatcaccgcttctgttgattacgaagtcaccgctggatctgatctttgtatcgtcactgctggtgctagacagaatccaggcgagtctagactcaatttgcttcagaggaacgtcgctctcttccgtcatatcattcctccactcgctaaagcttctcctgattctatattgatcattgtttctaatcccgttgatgttttgacttacgttgcttggaaactctctggctttccggtgaatcgggtgcttggatctggtactaatctcgattcttctcggttccgattcttaatcgcagatcatctcgacgttaatgctcaggatgtacaggtcagttccaaccaaaattagggatttttgttataaagctgtgatttgttttggttaaacattgcgattaaggagtcattagctggatttaatggtttagtatgataaaaatctatgctttagtggttttatactgtattgttgagaagatcaattgaagagcaaaagtgtgtttggattggttgttgtaggcatttattgtgggagagcatggagacagctcagtggcattgtggtcaagcattagtgttggaggcattcctgtcttaagctttttggagaagaaccagatagcttacgagaaacaaactcttgaggatatccaccaagctgttgttggtagcgcctatgaagtgattggactcaagggttacacttcttgggccattggctactcagttgctaatctggctcgtactatcctccgtgaccagcgcaagatccacccggttactgttcttgctcgtggattttatggtgttgatggtggtgatgttttcctcagtcttccggctttgcttggaaggaatggtgtggttgctgtgaccaatgtgcatatgactgatgaagaggctgagaagctgcagaaatcggcaaagactatattggagatgcagagccaattgggactttgaatatccacatctatatatgcatcaatttcaattttataactagtatcccacgggtgatagtgtcgatgttgatcactatatgttatgtaaatgcttgttcatgcagagtaatcccaactttgagttctattttgaaatagggtatttgcttacaacacacttgagttaccacttaccagtaatgtgaaaatgcgtggttttggcatgaaattattgtgcatattgcaaggcaatcgacacaaacattagtatatcaaaaaatatgatgtgtagaaaaaaagaaaagaaataaatttcttttaaaaaatg

SEQ ID NO: 18081 - DNA, 3003 bp, Unknown
  misc_feature (1)..( 3003): 2750-1469P.txt file - cDNA_ID_1815251; gDNA_ID_1621100; Annot_ID_55839
tgaggtttccaggattactatcaggctttatgggcttcgttgttttggttaagtaggagatttggatctgacaatggctttcgatgaaattggcttgttcgatttgaattctgcggaggatgatagatctgagtgaatcgaggaggttacggatgatctagaatcgtaggaattgtagcgagacgccattattgatggaaggttcaaaaaagattaggatctgtgaatttgaaattgaggaagaagatgaagcagagggaatttggtttttctgtttccaatgtcccactctcttcttttcaaatttcgtattctctctgttctaaaacggacttttcatctgtattgggcctaactatgggctttaaaagtttaacggcacttttgtgtttatttgaattttgttattctgtttattcaaataactaaatactaatgagataattaatcatttgctctagaaaattagaaccagcacatatctacacttttagctttcctttcatttttgtgcatttttttcctttctaatttggacttttgttacttccttcttttttcttaactgtaaaatgacatatacaaagtgaagagactttcatgttccttttttggggggtttatggacgagcattttgtatttttgtggacagtaaataatagcgaagaagttggcgttgattgaggcaggcataaaggaaaagatggaatgaataatgaagttggctttggtccatattgtagaacccaaagcctaataaccgtacactaagcccttacatacatgaaacgctgaattgtcattggtagaaaaggaaatggaagagtagtagtaaggaattatatcagttaataagagttgtaatgtgaatagaacacgtaactggactagtatgcatgtgtatgagaagttcaaatctttaactctcacaatatcgtcgaagacaattgtttaggataagatagaaactaaatgagcatttaaaatttaaagaaaaaagggaactgtagagttgccttggcaggaggggaaagcattatcatgaagaatctggtctacaagaatgggaaatggacagatgtatctgttcaccaccaatccatcttcataactcaagtggtccctttctctcgacccatccacgtctccttcatcacaagtaagaccaaattaagccaccatttggtgtctgtcatcttctctttaatgctctcttttgttctttctttataaacacaacaagacatgaaaggtttttgggaacttgtctgagttccaatgcggctgctgctatcatctgatccccaacccgaacttacgtctacatgtacctctcatagttgcggctggaagccttactctcattccaatgactttgctgccaacgcgttcctccttctcatcatcctcttctgttctttcatatgcgtcctctctctccacgctgctatccgttgttgcctccgtccagtcctccaacatgtccctaagcccgacccggaccttgaggccacccatccagacgctcccccgacacttgtctactccccgggcctaaacctagcaggcaatgaagcagagtgcatcatttgtttgtctgaattccaagacggtgacaccttacgcgtgttggagagatgcaaacatggattccacgtttattgcatccagaagtggctctcctcatcccattcttcttgtcccacttgccggacaaacatcttctcctccccacctcaacttcactcacaaagcttaccactaacgagtacaccttagtcagatggtagctagttcctggtcttgcccactttttttttatctttattttctttacaacttcacaccactatcatgttttacaagttagtttattttttacctttctccttttatattccatgaaatttgcacagtctaaaattgatatgaagtcacttttgtgaatcatcatttacaacgtataacaaacaaagaccaatgtgtaacgaagcaataacaatacctcataatatagagggaccaaaggctttatttaatgtcggagttcaagatatatgaggtcttgactggtgttaggtacgttcccacttgttggataagataaagaaaagagttgttactagataagataatggataaatatagaggatgagaaaaaaaaatagaagtggaatgacgacgactcacattacgagcattaactccattgcccattggcatggaatgattctagctagcagtaggagaaaattccaagtgcgtgcaaagttcttcaatgaattcctagaccccctaaccagagtcatggatgcaatactggaaaggcaagactatgctcgctgcatattttcaggttgctgacatgttcaagctcaaaacacaatcaagcgatgaagttagaggagaagatgattgaacaactttgatctggtctcaaaggtcaaagccatgcaatatctcctcgtatgtactacattgttctagatagcctaatgatgcacatcgtgagttatgttaaaaaactatttttagaaaaagttactgagagttctggacaaaaagttcagggtaatgatatttaaggtgacaaaaggtaggagatgttactattcacaaaaaaaaattaaagggttatcttgtaatgcgacttgttcatgttagttgttgacaaaaaaatagactgttgtagattatttgttatgagggtaggagtaggatcgtgtagtggagagacgaacacgtaagtagaaagaaagagccttgttattagattagagctgtgttaatgtgtgaacgcaaccaacagttcgtttttgaacgagtctaactagagacaagtcaaagcttatgactttgagtggacactggacagagctagtaacttctttgaagattctgaacaattttataacatcaagacacgactctgtcgctctctctctccatagaagaagacgaagaaatagaagaatcgagagagtgagacaaatctagtgatg

SEQ ID NO: 18082 - DNA, 3003 bp, Unknown; identical to SEQ ID NO: 18081
  misc_feature (1)..( 3003): 2750-1469P.txt file - cDNA_ID_1815251; gDNA_ID_2926168; Annot_ID_139978

SEQ ID NO: 18083 - DNA, 3000 bp, Unknown; identical to SEQ ID NO: 6660
  misc_feature (1)..( 3000): 2750-1469P.txt file - cDNA_ID_1815259; gDNA_ID_1621100; Annot_ID_55836

SEQ ID NO: 18084 - DNA, 3003 bp, Unknown
  misc_feature (1)..( 3003): 2750-1469P.txt file - cDNA_ID_1815270; gDNA_ID_1621100; Annot_ID_55832
taaggattgaaaagaaaaagaagcagaaggagttaccagtatcaccgatgatgatatacttaaatctataagcataagacattgaagtggacgaatctgaatccgtaggttcagacaaaaacgaatcccttcttctcctgatgggtaaggtcaagaatccgacaatgtcttcacttttaacgtttttgaatgtttctatagagtcttagaaacttctagattgtgtcacttagagatttggtgtctcaccattgggatgattgtacaatgattggagattgatgagtctgttgtgaaggttgatacgtgccatttcttttcttcttaaataaggcaatagcctcttatttggggtcccatgatttggatcaaaaaaaaaaaaaaaaaggtcctttgataaaatttaatatataattaataaatttcaacataacaaaaagtacaaaaatatagaaaattaaaaaaattatcctctattatttttctagttagctaaattaacaattttaaaaataaatgataatcaatttttagtgattttataattttaatcataaaatagataaagatctaacaaaaaaaagtttaataatgattggcaaaatttagttaaaaatcttaatataaattttgcctcaggcctccgaataacttgtcatagcccttgtaagttgtaagataaaacagtttcttttgtttgtgactttggctttttgttccttttctcaatttgcatgtctttctggtccaatattatgattgcttgagctcattttacccccttgttcaatttcgttgtcgtctgttctggttcacactcaaagacggttggttttccagcaaatccagagaaatatcaacctgtattgtcgaccattgcaaacttgctggcgtttcagtatttggtaggcttttatttgaaagacaagacagcacgcggaacaaaagccaatagactctagtaaagaagaagaagaaatcatgtgaaacaactgcaaaaacctagacacgaaatagcgggaaggagggctttgttaaacgagtaaaccatgaaagacatggaaggcatcgttcatcatgacaaaagctaaagggattactttatttgttgtataacacggtaaatggaaccacatgcagccaatacaattttctccacaaacactgaacttaccttcatgatatgatttatatccttactaccttttccagtacaatgcaaatgggctacattcctacctccattagatccttacgcaaacacatcttaatttttagatatatgaataggcatacacgtgtattgtcaaaccgttccaaaaccaaccacaacacagtcaccaaatcgaattccaaaacgatttacaactatagaaagaagcagagacatttttgctatatcatatgtgatcatttttacataatgacatagacatatttttcccatctcagccgcagcaccctcctccttgcgaggttgatccatctcttccacctgatggtcctggaattcctccatatccaactttgattccatatgactcatttgacacatcaaacacaccatcttgaatcttcttgtatattgttgcagctgtcttaatgaatgcctagcaaaaaatcacaacaccagtcgaaatcatgttaagtaattgggtaattggcaaatataccacattggaacgtatgggggtttacctcctcaacattctgagcagtcttggcagaggcctccatgaatataagaccgtgctcctttgcaaactgctctccttcctctgtactcactgcccttctgtgagcaagatcacacttattcccaatgagcattatcgtcatatttgcatttgcatgctgccttgcatcttctagccagctagctagatggttaaatgtctccctcctgcaaaaaaaacggaggtaaaaaatatcgtaagtgtcttgactgaaacagttataaattcaaaaacacaaatctaattctggttcagatctttaggagtcgaactccaatctagaaaagaagaataacgtctagttactacttacacaaaaaaaataatttgcttccctgatcaactctacttttgataaacatacagaaagaagcaaatgatttaccttgtgatatcatagacaagcaatgcccctgcagctcctctatagtatgaccttgtaatagacctaaaggattcttgaccagcctgtcattacagagagatattagccaagacaaaggatatgaaacttcagaatagccaagtcgcctagtcaaagaaaatcaaagcatatatgatgatgtgcacaaaccaatccaggtattcatgaaaacaagatagagatacatcatgaaagttgaagaagtaaggagaaagagaccgtatcccagatctgaagcttgataggtttgttatcgatggtgatcatcctagccccaaattcaacaccaatggtaaggtcatgcaccggctgaaacctcttgtcggtgaactgaagcagaagacatgatttccccactcctgaaaatcagaatcaatatacaaaaatcaacatcaccaaagcttctctcgacccctaaatccactaaaaaaagttggatatgacacagattcagatcaattcgcttttcaattttcgcaacgaaacatatataggttttgatcatctcaattccaaatggattgaagaaagataacgtagcagagaaggagttaccagtatcgccgatgatgatatacttgaagagataagcataagacattgaatttgaagaatcgaaaaatccgcaggttcaggcgaaaaatcgaattccttctttaagacgatgatgagaacgagaagagaagagaatctttttttctctataaagacggagattgacggtttgttttccagcaaatccagcgatgcatcaacctgtattgtcgccaaatttcaatctctatgtcgtttcctatttagtaaccgcactgcttgacgtttatttaaatagaaaacgacatg

SEQ ID NO: 18085 - DNA, 3003 bp, Unknown; identical to SEQ ID NO: 18084
  misc_feature (1)..( 3003): 2750-1469P.txt file - cDNA_ID_1815270; gDNA_ID_1621100; Annot_ID_171330

SEQ ID NO: 18086 - DNA, 3003 bp, Unknown; identical to SEQ ID NO: 18084
  misc_feature (1)..( 3003): 2750-1469P.txt file - cDNA_ID_1815270; gDNA_ID_2926167; Annot_ID_139971

SEQ ID NO: 18087 - DNA, 3003 bp, Unknown; identical to SEQ ID NO: 18084
  misc_feature (1)..( 3003): 2750-1469P.txt file - cDNA_ID_1815270; gDNA_ID_2926167; Annot_ID_199235

SEQ ID NO: 18088 - DNA, 678 bp, Unknown
  misc_feature (1)..( 678): 2750-1469P.txt file - cDNA_ID_1815270; gDNA_ID_2926168; Annot_ID_199252
tttgttatcgatggtgatcatcctagccccaaattcaacaccaatggtaaggtcatgcaccggctgaaacctcttgtcggtgaactgaagcagaagacatgatttccccactcctgaaaatcagaatcaatatacaaaaatcaacatcaccaaagcttctctcgacccctaaatccactaaaaaaagttggatatgacacagattcagatcaattcgcttttcaattttcgcaacgaaacatatataggttttgatcatctcaattccaaatggattgaagaaagataacgtagcagagaaggagttaccagtatcgccgatgatgatatacttgaagagataagcataagacattgaatttgaagaatcgaaaaatccgcaggttcaggcgaaaaatcgaattccttctttaagacgatgatgagaacgagaagagaagagaatctttttttctctataaagacggagattgacggtttgttttccagcaaatccagcgatgcatcaacctgtattgtcgccaaatttcaatctctatgtcgtttcctatttagtaaccgcactgcttgacgtttatttaaatagaaaacgacatgcagtctgtttataaaaataaagctgtaacctttaaaaagttgctatctttgcacccgagagagagctcagtgaaaaagatg

SEQ ID NO: 18089 - DNA, 3003 bp, Unknown
  misc_feature (1)..( 3003): 2750-1469P.txt file - cDNA_ID_1815276; gDNA_ID_1621100; Annot_ID_55829
aaacatatcaaaaaatgggtctaactgagtttataaaactattggaagatgaattcaatgaagaaacttagtcccagaataaaaacaataaatattgtatgacattgagtaagatgactgatagagaccatgaaaacaagtgaaatactactcgtgagcaaatggaatagaaaaacgaaaagataactaatgcactcaagtagatattgtttaggttagataggatatatataagaaaacacacacacacaaaacacaccttgagtttgactgatccaagaaatccagctttaaccctcacaggtaatttcaaagcattaagtgcttctggttttagttgcatatttttcagctctacatctcctgcgaaatcaagttaaaccacaagctatattaaccaaatggaaaaaataaaagcaaatttattgacatgggtatgctaaaaccttctttttatttaatcatctgttcttagtaacaactgtgagaagtaactaagcaattataagtgaacaaccagcacaaaccaagataaaccatgagcgaagaagctataaagcctgaaagcaagcagcaatcctacatcattttaatcatgtaatatgccacacgggaaattgaacagttccgatcaactaaaacacccaacacatgcctgaaaaaagaaacactaaactcaaaaatccagaagtgtgactattgacttctccgtttaatagctagctacccgaatataactcgaagagaacccaattccataaatcgcagtcaatcacagcacacaaaacctaaccagttctcacattcgttcacaactcaaaatcgctactcaatagcacatttgaactttaaactcaaatccggacattacacaaaatcagcgagaaaatagaaacaatctaaccttgccaaacactgatcttaagagcttccttattcaatcccctcacatagttccccaagtacctttgtaacaagtaagctacctgatcttccaacatctttgaactctgcaaatcaaaattctcaccgtaaaagggaaaaaacaaatgtaaaatcaataatcgtgagaagagaatgaaattctcaaagagttcgatttcgatcggactagaaacggaatcgaaggagaggcatgaggatcgtttcctcaagagcacgcaagaggcggttggaaatgtgaaatagtcatgactcaatgacttgggggagagtttcggctctgtaaaaggaatataaaaatatctgctgttgatgacggtgcagtgcagtgtgttgctgtgttgtttatcaattgtcgacataaactttattattaaaaagaaaaaactaatcagtaactgaactaaaccaaaatttaattaagtttcaaaaataatttaaccggtggagaaattcctataccatataaaccaattagataaatcggatttacgcagcctaatttttgattaatcgaactaaccgaaattactaaaatatatcatttctagttaaacatatacaaaaagtttcttaaaatatgaagttttttaaattataaccaactaaaatctgaatcaaccaaaattatatacaaataggtgatcgaatttaattgaatagacgaattatgtgaagttgctataatatatcatgaattttgattggtttttccgctataactcgcaaacttgtgaacgattgcgattgttagcatttaaaacatatttagaaatttactttaaattattttgcaccactcaatatcgctaaatttcaaaatctcatttctagaaatatttgcggttgcagacgatagcggctagtcacaagaaaaaagaaaatcacataagcgacaaatacttagatcatatatatatatctatataaaaaaaaatcatcaaaatcatagtatcaattcaaactgaagaaagacaaaatatgaacataagtattgtaaaaatattgtcgatcttgaagatctacgaattcaaaacacaattttttttgtagtttgtcatattacttgatgtagtttttggtgatcaaccaaatgcatgaagtaataataaacatatcactatgatatttatttgttttttaataattttgtactactttatttatggtttttcttattagttttttttttttattaaagtttttcttattaattatgtttaaaaaattaatatttaattataataatataaattttgcacttagatggtcattggatgtatgtaaaaaaaaaaaaaaatcattggatgatctttaaatttgtatgtttttgttgttaaccattatatttattttaatttaaacatttcacccgtaaaagttaaaagtttatgtttttagatatttttaagctttacaggtcagtctatatcaggccacctagtgagctggagaagaaaggaacagcaaactcagaatgaactaaaaaggtcgagatttcttgatagcgcaatgaccacacagaccagagttcgaaccttcaaaagggaaatatataatttgtttcttagtttctcgagtatctaccacctcgagatctgaaaatctgattctacctttccattttctttctcaaaagtcgtggctttgagaatagttttttcctcttcttctcatcagactcggtttcctagttgactcattttcaagatctgggcatctgtcatttctttaataaaagctttctttttttatttatcccttttgttttcagctgctggttgcttgtagtaggtatagttttgggtggccttacttgcttttcagcaaaagctgggagattgagatttcttcttcttctctctctttagtctttgggatctgcgcatttctcagaaattatatgggactctcgaaagcatgatgctttttgttgtctcacttgtaatttgttcgggactttgttgctgaagaaaactaagcaatgtctgtagaaacatggttcatgattcagaagactactactagctcatgagttcactggtacttggaattaagatg

SEQ ID NO: 18090 - DNA, 3003 bp, Unknown; identical to SEQ ID NO: 18089
  misc_feature (1)..( 3003): 2750-1469P.txt file - cDNA_ID_1815276; gDNA_ID_2926167; Annot_ID_139968

SEQ ID NO: 18091 - DNA, 3003 bp, Unknown
  misc_feature (1)..( 3003): 2750-1469P.txt file - cDNA_ID_1815282; gDNA_ID_1621101; Annot_ID_55895
atgggctttattccaactttcatttactatgatattgtcctttttgagcttatatcttcaagcccgcaaagatttgttattgggttcctttccaaaagacctcatactagttggagttggacttgacttatatattaaaaactctttttctaaactttcgatgtgggacatttggtttgtacccaacaatttgtagctgttttttacatttaaatattctcaaaaatacagagagcatggaatttaaatacatatactgtaataaacttacattttcaaattcaaactaataaagctgaaaaaaagtagtgtaaactttgtggcacatgttttgtcaaactgatgttttagttttatatcaccccattacatgtatattcgtcatagtctttcagttttgttacgtttttaaatatcttataacgtattaatttttaataactttaaaataaactatctaacaaaaaataaaaaaatagaattagtgtccgtgtgcttattttacctgcaagtacgggcatgaaggcaagggatttgatagatagccaatacgaacacgcatcacgtgcttttctaaacgcttcgatcactctgaagacgccacgtgtaaaaatctagccaaatagagtcagaacttaccatgtgggcacgtgcgattcccgcagctctaacatctatgtatgcctccatgactccatgtgatcatttgagccaatctaaatatattttgcgtattctttttcagtatacacacattggatacgaattgattttaaattttttacacatgatagattgttttgtaaatataataatactaatattatgtcatcgaaatgcaccaagtcgttgtttatgataagatcattaatggaccgattaggtcttaattaaccaatattttgtttcacggaaagcaatatgacaaagcacgtattaattagtgaataaacaatagccaatagcttggagacatgaaatacaataatgaaccgaatcacacaagacttagtctatattattttctgaaacatgaaatcatcatgttagttttacagtcaagaaaacaatgcgtctataaatttatttcaaatcaaaatcttatatagtaaatgttgacaaaagaaaatcttatattacatatgatcaggattttttcttttcatcaagtatctgttaaatagataaatatagagaaagatgtgatgggcggccaaaggtcgtcgtccgggagaagcggtcgtttgatagctgcaaaaggattctctttgctcccaaaaagcttcgctggcaaaacgtcattgtttgcttctcccttaatctatctttcctttattctcaacttcaatacaataatatagttatatacatacaaacgttttgacccaatgagatatacaagtaccaacattggtatatatgtttaactcggagatgcatattatcgggttaagcttttttcaacatcgttcgtctaatgtttgtgatggataaactcgaaaaattatatatgcttataattaacttatgatattaaaatgactggaattattgaaacttttaacccaattttaattagcacttaaatttgtacactcattgtcaattaattttggattaaaatcatatagtgttcctataaacaaacatattttatcactgatcatgatgaagtttttttcgcattttaaacaaaaataaaataaaaagagcgttaaaaggcctaaattacgtacttgtccaacggcccattgaaagcaaacgcaaggatccataatgacctttatttgggctgagatttatcattgtactgtaatttgactattttccaaggaaaattaagtccctttttatgtttttatttatttgaaaaacatgacaaaacaaatgcaatccacatggtccaacgaaagagcgatctagttgaaatctaactaagttcccaacgaaaccactgttaatgtaactttacatggcaaatatctttcggatatcaaggcccatcactttcagctcttctgtttttcatttttttcccaaaatttgtattgtttaatattcctagatttcaaattgtaataaaattttcatttggcataagaaaaaaaaataatatctttttctacatagaaaataatatatataatatgagttcatacaccatacatgtgtgtctatatacatatatatagttttgtaatgtatgtatatctcgaattgtagccatatgtaggatgattatctaaaatatatggtcataatgtcacagtgtaaagctactctagtcatttgtcagattctaacaagagaatcttagtaatgatcacgcaaagctaagatctttgcttcaccatttaaagcaaacaaactttgtcttaaccttacataggacatcaaagtcacaaccaactttttcctctgtaaatcttcacctatttatataaaatgcacactatttttttatttataattgggcttcctatattaattaaatgcatagcaatctatgatttaatgtctttttgtaacaaagtaccaacgaagatagaagaacacacctaaaagtgtagagttctataaagacgtaaagtttatgtaaatttctgaaagtagctaaatatatgtaagtaattaatagaaaatgagatttcatttttacttttctaacatatataagttactaaaatatgtttgcactggatttaatagaaagaaagtatattatatttgcaaattttgaattatacatgtgataatcaaaatgtgtgtgctcttacactcagtaaaatttattatggtaaaatttctttcatttactgaaaatgatattttgaagataagtgacctatctatgtatatatttcgggtccatctttatatttattattgaatttacatcattatccaccaaccccatcttcttcttattcttcatcttctactgagatttctctttttttttcaaaaaaaactcatccttgaatgaacggtggtgcatggatg

SEQ ID NO: 18092 - DNA, 3003 bp, Unknown; identical to SEQ ID NO: 18091
  misc_feature (1)..( 3003): 2750-1469P.txt file - cDNA_ID_1815282; gDNA_ID_1621101; Annot_ID_171436

SEQ ID NO: 18093 - DNA, 3003 bp, Unknown; identical to SEQ ID NO: 18091
  misc_feature (1)..( 3003): 2750-1469P.txt file - cDNA_ID_1815282; gDNA_ID_2926169; Annot_ID_140030

SEQ ID NO: 18094 - DNA, 3003 bp, Unknown; identical to SEQ ID NO: 18091
  misc_feature (1)..( 3003): 2750-1469P.txt file - cDNA_ID_1815282; gDNA_ID_2926169; Annot_ID_199354

SEQ ID NO: 18095 - DNA, 3003 bp, Unknown
  misc_feature (1)..( 3003): 2750-1469P.txt file - cDNA_ID_1815290; gDNA_ID_1621101; Annot_ID_55891
tcaaataaataaaaattgtaagcaaaacctttaaatgttctaagcttgacacgtggagttaaaacagacgtccaagtagctttctcactatttcaaagttggttggacttttttctcatgattattaaatcacactcaaaagagaaagaaatataaatgactcgaggccaaacaccaaaaaaaagtcttcaaaatataattttagaaaatcatatgattatgttgacaaaaagaaaaagtaaatcgtatgattagtgtttctaatcttcttaagaaaatgattacgtttgttaaagaagagtttgggtgatgattttatactaaagttagcagtttgtgtgttttctttaatcattttttgtaaagaaaattaccaataatgttgacatgatatcatatatcactaccatctattggaaatagtttatagaagaataattaaatgaatcgacaagaactcacacatatacgcaaattgttatgtatgtgcacctaatgtagatttgtaggcattatatggtggggacgtgttaccatttatattgacattaatgatggtattgacacttttgtggacctaatcatgatacaaacatacatcaatgctgcttatataatatacttatatgtctatgtcgcgcacacacacccacacatataaacggtgggaatttatcgaatgatatgctaatcatttctgtatactaaacgtacaatgtctcatttgtgtatgtatatgtaccgatgtacgtataaaccaatgtatatagatgtatagaccagagagacctaatatacatggaaaaaattcttactagagttaataaaactgatgaacctagcgagtcactgagacatgcgagaatctctcctttttgaatgaactatatatagtctaatcaataacatattaataaatttacggcaatttgcaccaatttgataatctaatcatatattctttgtcgggttgataatctgaaaggacattataaacaatgagaaatataaatcctattatatacgaaagtataaacaaatcattcctttcgaatcttgacaaccaataaatcctaccctaagagatttaattatatattgattagagaaatgtattgtattcttcgaaacatatgctcatgagcacggacacggtatattgttttactgatcatcggtttaaacatttgaaattttgaacttactatctacatatgtcttcggtgaacaaacctttatacggattgataaataatactcttcgaatttattaatcttattaagcccacttggcgtgagaagaaggtatataaatactaatagtagttgaaatatactacaataattactaaagtaactgcagtagttaagatttaatttaaccatagtcaacgaaatcgacgctgatattgatatttattggaatttcgacttgcgagcctcttcacatgaatttaggctttgaaattagagttatgatcattgaagttaatgtagcgatccaagcttattattttaatttttaatagcatttctagtagtagtagatagtgaatttaatttggactgtccaatttcttttattaatacatagctgatattatgtattttattgaatttaaatttggattttaagttacgaaacaaatacaaatttagaagtttcatattgattaaaaaaacttattgctatccaaattatattaaaaaaaacttatagctatcgttttataattcgaaaacaaatttaaactaaacattatattatattaccttcattttaattacatatttacctaatgactattccagcaacaatgacatcattagttcaattgctttaaccatttgaattcttatataacaggggagaaagacaaattaaactagatacgaactgtgttcctcaatcaacaaagacatcaagagatttgttgtcttttcactcacaaattattaaagttaaacatcaaaattattatttatagaaaacgaccactgatcaacattaatatcatttttttattgcattattctaatgcctagcttattttacacacccaacaacaaatctatcaagtttctaattcccaaccttaaatgatgcgtattagtagaaaccaaaagaatgtgattaaatagtatgttttaatacctttgtctcctatgtttggttataaccacttgtaaatatatcttcctaaaacatttagtcacatgaactaagataaataataatgttgtttatgcttatggatgctttgtatatatctatatttaaatccccataataaatatttttacaaaaaataaaagagaaactagtcacataaaaagaaaaaaaagaaaaatttatgtagcaaaatataaaaattgaaaaagttaattggcgtgtattttctttaacaaaattcatatttcgacctttttttcttttataaatattgtgtactcattgtcatatggactatcaattacttccattacatgattggtcataaaaaccagaaaactattgccgtatggagagaaagcagagaagagaatcttccaaaaatgttaaatcttgtgaaacaaataaagcatagcaaagcaaagtccaaagtccaatgagctaaaacaaaatcaaaaaggtttctttatgtttttttttttgaagtaagaaaaaaaaagagtttataaagaaacagtggagaaataaatagcagaacaaagagaaagatcggagaaaagaatctttttaggctctctctcgcagacttcgcactcacacactcacttccattgctccaaaaaagtgagcttttttcttcctttttcctattttcctgatcatcttctttgcatcttatgtaactgtagaatctgactaactttcagtaacccaaagttttgttttttattttcattttttcctccagctgtgtgttctgatcttgcttgtataagtgtaagctctggcttaagcttttttttttttagttgttctaactataagacatg

SEQ ID NO: 18096 - DNA, 3003 bp, Unknown; identical to SEQ ID NO: 18095
  misc_feature (1)..( 3003): 2750-1469P.txt file - cDNA_ID_1815290; gDNA_ID_2926169; Annot_ID_140026

SEQ ID NO: 18097 - DNA, 3000 bp, Unknown; identical to SEQ ID NO: 6707
  misc_feature (1)..( 3000): 2750-1469P.txt file - cDNA_ID_1815301; gDNA_ID_1621101; Annot_ID_55888

SEQ ID NO: 18098 - DNA, 3000 bp, Unknown; identical to SEQ ID NO: 6707
  misc_feature (1)..( 3000): 2750-1469P.txt file - cDNA_ID_1815301; gDNA_ID_1621101; Annot_ID_171423

SEQ ID NO: 18099 - DNA, 3000 bp, Unknown; identical to SEQ ID NO: 6707
  misc_feature (1)..( 3000): 2750-1469P.txt file - cDNA_ID_1815301; gDNA_ID_2926169; Annot_ID_140023

SEQ ID NO: 18100 - DNA, 3000 bp, Unknown; identical to SEQ ID NO: 6707
  misc_feature (1)..( 3000): 2750-1469P.txt file - cDNA_ID_1815301; gDNA_ID_2926169; Annot_ID_199341

SEQ ID NO: 18101 - DNA, 3000 bp, Unknown; identical to SEQ ID NO: 6703
  misc_feature (1)..( 3000): 2750-1469P.txt file - cDNA_ID_1815321; gDNA_ID_1621101; Annot_ID_55882

SEQ ID NO: 18102 - DNA, 3000 bp, Unknown; identical to SEQ ID NO: 6703
  misc_feature (1)..( 3000): 2750-1469P.txt file - cDNA_ID_1815321; gDNA_ID_1621101; Annot_ID_171415

SEQ ID NO: 18103 - DNA, 607 bp, Unknown
  misc_feature (1)..( 607): 2750-1469P.txt file - cDNA_ID_1815321; gDNA_ID_2926168; Annot_ID_140018
aaaaaaaacaaaaaaaaaaaattgaaaaagaaaattgttaggtagctaaaaccctcaggtactacaagattaacgaatacatctacagattattcatctggaacatgcaaatatgtgatgtatcgactgatctaaaatggattagtttggttgaaagacggtttggtttagttaggttggaagggtctttgggaagagtgttacatcgttcacatcttttaattttgattcagtctctaaattatactatatagtctatattgcaactgaagaatgattgaaagagtactagtactaaggaaaaaaatagaagtagatgcaaaaaaaaaatggtaacattagtgtgaatcatgcatataatgttgaaagctttaaaaagacccacaagtctttgtaccctttcgtccccctcccctctaaaacctcatcttccccatttatttctcccattctttctccttttctttttcagttcttaattcatacttgaaaaaatcaatacattttcatcatcatcagcatcatcatttcccatatacacaaacacacatgcatgcccttattatctgataatgaacgcataggtctcttctctgatagctcaatg

SEQ ID NO: 18104 - DNA, 607 bp, Unknown; identical to SEQ ID NO: 18103
  misc_feature (1)..( 607): 2750-1469P.txt file - cDNA_ID_1815321; gDNA_ID_2926168; Annot_ID_199308

SEQ ID NO: 18105 - DNA, 3000 bp, Unknown; identical to SEQ ID NO: 6703
  misc_feature (1)..( 3000): 2750-1469P.txt file - cDNA_ID_1815321; gDNA_ID_2926169; Annot_ID_199333

SEQ ID NO: 18106 - DNA, 3003 bp, Unknown
  misc_feature (1)..( 3003): 2750-1469P.txt file - cDNA_ID_1815328; gDNA_ID_1621102; Annot_ID_55916
ctgaccagatagatgattcgaataatgagagatatgatcttggggtccattcctgaataaaaactccaagagttgatgtgagacattagttgagtgatgcttgatatgagccttgactctggctttcgtccctcctctgcgtcaacgaggtcgtgtatttgattaatgagtgatgccatctccgaatcctccgaatcctttatttccttgaggatacgagatattttataagtgactgacgtgagcctccattgtgactccgtgggatccaagtctgtagagctggtgatagagataattcgagtcacgagtgataccaactgtgactctggtccagaaacaaccttgctgagagagattatttgcctaacgagtgatgtgatcttcggctcctgcttcggctctgaattcgaatccatatccagtgattcgatgagaggaataagttgattagcgtatgctatgaaatctcttgccacctcttgacacatatcctcacctcttaatgtagatatcattttagaaatgatatagaacatgagctccgactcccaattcatatcatctgtatagccgtagataagatcatctttttcttcttcttcggtggtgagaggcggcacttgttggttattgatgagcttctgttcctccgtctggacgagactggccacctcagaaaggagtgaaaagagctccgattcctcgtccattgccatgatgagagcgaatatttgagaagtgagtgacatgagctccggctctgactccttgagatcaaaatctatagagccgatgatagagatcattttagtcaccactgataccgactgcgactctggtcctggttctgaaacagagttgctgacataaattatctgcttaattagtgatttgagcttcgactccggctccggctgcgaatccaaatccagagagttgaccagagagattagttgacaagtaagtgctatcaactttgacttcagctgtggtgtatgtgtgtcttccccaccgcctaagatagataacagttgagaaataagagatatcatgagctccgactcggaatccatagagaaagggattgtttgaatattgatgagtggtatgagagatgattattttgagtataagaaacttactgctctctgtatgtatatatagaactcgtagcttgtcggatcacgtgacaaaacctcaaagctgtccgaatactaagtcaagccatcaatttatagagagataataatatctcaattatataacgactagaaatttagcatcagatgtgaggcaaggtgggcctatcttatttcatattttattcgaaaacaggattgccttattaatgatcgtgtactgtttttagttttggtcaaatcatttaaacgataaactctgaattttgatagcgtcatgaacgttaaacttagggttttccacatagtgtgacataggtctatttttttaccgaacgtagcttgcgggtctttctttattatacataactggaaataattgaagcagtacggcattacaatttagtcacgtcgttcgaacgaaaagtcaatgatcgatttttagagataaagatcctctaattaacaatttatatttttcgagtttctagactacattaattaagctcatacgtatattaccgttaggtcggcctgtgcacctttcacatttttattgaagaagttatgattaacgaaatggtaatatatatcattaacaaaggataatactaatatgtttgatcaagcagttacagtgaaccagcggtaaagtagagaaatcgtcaaacaaacacttttgcatgtcgatttctgctagtgatattaaagatcatggaatctgattatgtggtaaagaaacagctcaacaaaggtttgaaataattagttaacagtagacattgacttcatctaacgaaagaccaaatcaaaaccactttcaacaaccacaatgtgtagaattacagcagtttcgtgactaatacgcgacaagtgttaattttaaaacggttctttagtaaacattaaacaataatcttccaagtggaggaatacttgatatttgttcaatcgcatatatcaacttttgagttctataatattgttcccgtagcttgtggattttgtcttggtgtaatgcttaatttgagatgattactaaaaccaaaagcatgagatcatcttaaagtttacaggcgagcgcaaagtcaatgaaggatttaaagattagaaacctaaacgatgttaaaaggtcatgacaatttatattcgagttatttaggtcggtttatgggaaaaaagctgaaaaatctccatttaattttaatttgcctatttaatatccgtgctactaaatttgtccaaaatacctaaattagtttttatgtcttttaaatatttttattttttattttttttgacaaaatcagacatccgaattaacgagcgttaacagtggtaacaaaatcgttatttgcagttaaaacttaatcatgtgatgtttattagttatatacaattgttttttctaatgcatacgaatatatcgttttagtcaagtagttatatgagagtttattatcttcatgaacacgagtacgagtcccatatccgatgtttttttgttgcacttgatacttgtcttgaaagaaaactgtcacagaatcacaatctacgaaattccgagagaaatatctaagtgcaccacttagaaacgtagtggcctattagctcagttggttagagcgtcgtgctaataacgcgaaggtcacaggttcgatccctgtataggccacattttttggctttcattttgatcagactaaaacgttgtcgtgtgtttcagcttctttttttttttttttttttttttaatccttttttccggagatattttgttttttttttcaattttacggatatcgttatctgcttctcacactaacacggcgaagcagaaaaagagctcgaaacaaaaatg

SEQ ID NO: 18107 - DNA, 3000 bp, Unknown; identical to SEQ ID NO: 4613
  misc_feature (1)..( 3000): 2750-1469P.txt file - cDNA_ID_1815328; gDNA_ID_2926189; Annot_ID_140922

SEQ ID NO: 18108 - DNA, 3000 bp, Unknown
  misc_feature (1)..( 3000): 2750-1469P.txt file - cDNA_ID_1815340; gDNA_ID_1621102; Annot_ID_55912
cagtggttacagcgactcagatgcttgagtctatgatcaaatccccacgaccaacaagagcagaagctactgatgttgcaaatgctgtcctcgatggcacagactgtgtcatgcttagtggtgaaaccgcagctggagcatacccagagcttgctgttcgtacaatggccaagatatgtgtggaagcagagagcacacttgactatggagacatcttcaagaggataatgcttcacgctgcggtccctatgagcccgatggagtcacttgcttcatctgcggtcagaaccgctacttcctcaagagccactcttatgatggtcttgaccagaggaggcagcacggcgaggctggtggctaagtatagaccagggatacccattttgtccgtggtggttcctgaaatcacgtctgactcttttgattgggcgtgtagcaacgaggcaccggcaagacacagtctcatctaccgtggtttagtcccggtgctgtatgctggatcggctagagcctcgatcgacgagtcaacagaagaaactctcgagttcgcgtcagagtatggtaaaaagaagcaactctgcaagaccggagactctgttgtggctctcttccgtacaggtaacgctattgttatcaagatcttgaccgtcaagtgatcccatttgcgtttgagttttgccggtgtttcttagcgttttggatgtttattcatcatggtgactaatcttgagatgaaactcaaagtctcttttgtttctttttttgtgtgtggctcccacacactacataatgttcttggatcatactctggttacaagtacattagtttggtacgagtgcaattgcataaacaaagactattttttgaatatattttacaaaaatgtgtgatcacatttggctcgtgatcacacaactttgggattcgtatttggagataatgcgattcatgcagtcaacaaccatactcacagtcacatgcctctccctctcaacataaatacctgtgttcatctttttatattttactaaattaaaagggatacttttaacggaaacccaaatgatcatcagatattataatacaaataaagaaaagattccattcctcgaaagtgtttatttgttatgcagtattcaacaatctgagtgaacaagattttatgtactataagctgaggaatagcagtttacgagttctcaccgagatgagatgaccccgaggccgatgcggatgacgaagaggatgaagagaataatccgctgaacggccatggaaaagagaaccttctctcgctcacattactgttccttgcatcatcttccacattctcattacttacgttgatctctagagttcttgttctcggtcttacaggattaaccttggtctcatcatcaggagggagttcatatcggcacacgggacatgaactgtgaagctcgagccacggtactatacaccggatgtgaaacttgtgcttacacggcatctctttagcttcacttcctttgtcaaaatcatccaaacaaatcgagcactgcaatgattcacttatcttaaccgttgggagattatccacaacttctttacgtgctggaagactcccgtgcctgattgaatcattatcagctagatgttcaagcaaatggtctaaactggatccaacaaagtaatctccaattgcagaaagagaagtattgttccggttttgattcaaactcgttgaaccctgaacaacagctgattgatttaacaggtctcgatccgagctctcatactcagaagcaatccctgcacgaataccctgaagcaactgcaatatagtagctgagcttctccgtctcctcctaaggatagactcaaactctctgtctaaatcaatctctctaccttgttgcctgtggcgatgacgacgatgatgatgtcgatcaatatcgacgctgtcatttccatcaacatcatcagatacattgacctcatcattatccacaccaaactctgtcctcctaaaccttctacgtctacgaggattactcatcattccaagcaagattggaccccatagagacaatgcacggtctgtaccaaaatcaatctcagggtcttgaacctcccttagactgctactgctgccgccattaatctcacggctcatttcctcgacaaacccgctttggcaaaaggggcatttgatctcggcaccaataactggattcaccatttgtgaacacatgtgacaccaatacctagctgacattgcctcttcctccttctttccttccccacccaaacctctcgtttctgaaacaaccagaagaacaacaaaaaaaaaaacatgaagaagcaaacctataaagtttcgacctttgtttcatcagatctaaataaagagaatggtattcccaaaagtttcactaaaaagaggataatatcatcttcaccaacatcattagctcaagtttcagacaacaaaacgcaagctttctatgcaaatgcgaataaacagatcaaccaaaatttgcctctataaagagataacaatagaaatcagggctaatccatgaaaagaaaactctcaattctcatggagtaattaaaacaaaacaaatacaaaaacaaaccttgtaaatgttcttacttttggagatccagagggaagaaatgtcttcctccttcttttagatctccacgaagataaatgagagcttttttatttgtcttcttctgcagaaatggtgggagacgaagaaaagaggaatgaaggaggaaaggaagacgaagatgaagacgaagaaaagggaatgtaatgtatagttcgcagacccaatcttaaagcccattaaccgcaaactgatatataaaggagccgggtctatcttaaccatttaaaaccaacttctaatttggaatcaaattgaaccgaatcgaaccggttgaagttgaaagaaggagaaaaggcgttgtctccgtgcgagaaaggcaaatcggagacgatg

SEQ ID NO: 18109 - DNA, 3003 bp, Unknown
  misc_feature (1)..( 3003): 2750-1469P.txt file - cDNA_ID_1815340; gDNA_ID_2926189; Annot_ID_140926
agccagtggttacagcgactcagatgcttgagtctatgatcaaatccccacgaccaacaagagcagaagctactgatgttgcaaatgctgtcctcgatggcacagactgtgtcatgcttagtggtgaaaccgcagctggagcatacccagagcttgctgttcgtacaatggccaagatatgtgtggaagcagagagcacacttgactatggagacatcttcaagaggataatgcttcacgctgcggtccctatgagcccgatggagtcacttgcttcatctgcggtcagaaccgctacttcctcaagagccactcttatgatggtcttgaccagaggaggcagcacggcgaggctggtggctaagtatagaccagggatacccattttgtccgtggtggttcctgaaatcacgtctgactcttttgattgggcgtgtagcaacgaggcaccggcaagacacagtctcatctaccgtggtttagtcccggtgctgtatgctggatcggctagagcctcgatcgacgagtcaacagaagaaactctcgagttcgcgtcagagtatggtaaaaagaagcaactctgcaagaccggagactctgttgtggctctcttccgtacaggtaacgctattgttatcaagatcttgaccgtcaagtgatcccatttgcgtttgagttttgccggtgtttcttagcgttttggatgtttattcatcatggtgactaatcttgagatgaaactcaaagtctcttttgtttctttttttgtgtgtggctcccacacactacataatgttcttggatcatactctggttacaagtacattagtttggtacgagtgcaattgcataaacaaagactattttttgaatatattttacaaaaatgtgtgatcacatttggctcgtgatcacacaactttgggattcgtatttggagataatgcgattcatgcagtcaacaaccatactcacagtcacatgcctctccctctcaacataaatacctgtgttcatctttttatattttactaaattaaaagggatacttttaacggaaacccaaatgatcatcagatattataatacaaataaagaaaagattccattcctcgaaagtgtttatttgttatgcagtattcaacaatctgagtgaacaagattttatgtactataagctgaggaatagcagtttacgagttctcaccgagatgagatgaccccgaggccgatgcggatgacgaagaggatgaagagaataatccgctgaacggccatggaaaagagaaccttctctcgctcacattactgttccttgcatcatcttccacattctcattacttacgttgatctctagagttcttgttctcggtcttacaggattaaccttggtctcatcatcaggagggagttcatatcggcacacgggacatgaactgtgaagctcgagccacggtactatacaccggatgtgaaacttgtgcttacacggcatctctttagcttcacttcctttgtcaaaatcatccaaacaaatcgagcactgcaatgattcacttatcttaaccgttgggagattatccacaacttctttacgtgctggaagactcccgtgcctgattgaatcattatcagctagatgttcaagcaaatggtctaaactggatccaacaaagtaatctccaattgcagaaagagaagtattgttccggttttgattcaaactcgttgaaccctgaacaacagctgattgatttaacaggtctcgatccgagctctcatactcagaagcaatccctgcacgaataccctgaagcaactgcaatatagtagctgagcttctccgtctcctcctaaggatagactcaaactctctgtctaaatcaatctctctaccttgttgcctgtggcgatgacgacgatgatgatgtcgatcaatatcgacgctgtcatttccatcaacatcatcagatacattgacctcatcattatccacaccaaactctgtcctcctaaaccttctacgtctacgaggattactcatcattccaagcaagattggaccccatagagacaatgcacggtctgtaccaaaatcaatctcagggtcttgaacctcccttagactgctactgctgccgccattaatctcacggctcatttcctcgacaaacccgctttggcaaaaggggcatttgatctcggcaccaataactggattcaccatttgtgaacacatgtgacaccaatacctagctgacattgcctcttcctccttctttccttccccacccaaacctctcgtttctgaaacaaccagaagaacaacaaaaaaaaaaacatgaagaagcaaacctataaagtttcgacctttgtttcatcagatctaaataaagagaatggtattcccaaaagtttcactaaaaagaggataatatcatcttcaccaacatcattagctcaagtttcagacaacaaaacgcaagctttctatgcaaatgcgaataaacagatcaaccaaaatttgcctctataaagagataacaatagaaatcagggctaatccatgaaaagaaaactctcaattctcatggagtaattaaaacaaaacaaatacaaaaacaaaccttgtaaatgttcttacttttggagatccagagggaagaaatgtcttcctccttcttttagatctccacgaagataaatgagagcttttttatttgtcttcttctgcagaaatggtgggagacgaagaaaagaggaatgaaggaggaaaggaagacgaagatgaagacgaagaaaagggaatgtaatgtatagttcgcagacccaatcttaaagcccattaaccgcaaactgatatataaaggagccgggtctatcttaaccatttaaaaccaacttctaatttggaatcaaattgaaccgaatcgaaccggttgaagttgaaagaaggagaaaaggcgttgtctccgtgcgagaaaggcaaatcggagacgatg

SEQ ID NO: 18110 - DNA, 3000 bp, Unknown; identical to SEQ ID NO: 6722
  misc_feature (1)..( 3000): 2750-1469P.txt file - cDNA_ID_1815356; gDNA_ID_1621102; Annot_ID_55908

SEQ ID NO: 18111 - DNA, 3003 bp, Unknown
  misc_feature (1)..( 3003): 2750-1469P.txt file - cDNA_ID_1815356; gDNA_ID_2926189; Annot_ID_140930
acccaagtttcagctttaacttgggctcaagctgaaacgtgattaggtgttacatatatgacacagagcagttaacatggaactaaaatcttaaaaaattattgtaattaaaatggaaacagagcagttttttttatatgcaataagtcttttgatggagatacaagagtgattaataccttataacaatgaagataaaagagtgcttaatacctgatttactaatatacatgcaataagtgacacccatcagactttttatttcgccgtttagacagtaagagagatcgaaacatcgaaacatggacttgtctatgtctctctgtttttatgggttgatcacacaaaatgatcaatataataaatcttctgtagtagaaatctcttgctcttgctctctctctctctcgttcttgattatcgtttaccctcaacacaatgaaaatgtatatcggcagaaaaactacaagagatttacacagcttggttagataaaatttctccttaactctctaacaaacaaaaaagtttcaatttgttttctccaattgtgttaattaatcagttccacaaaaatcaccaacagtttaactatttttagaaatagagttttgtgcaaaacaaccttcaactttataaacgttttcaaattattttttatttttatttttttggtaaaagtagacagtgctgtgcccaatgacgtaaatgttgaagttacaaaaatagatgattttgaagatatttttacacaaaacccttagaaatatacattatactttcttttctctaaacagacacctataagatatgaaataccatttatttgtgtttagtcttcttatgtatatggtaagctatatctttcatatagtctaatcagtgcatgtccatcaataataccatgcatgagccttcctccaactattcacaacaggagctgaatattaaactggcaaattgatgttctaccatatatacctattatatcacaaccagcatagtctatagtggttttactatagctaatgtaattagtactaattaaagctagttgttagaaaaacatgagcaaaaaatctaatttgcaaactatatttagtatataagtgattaagttacaataatcaattaatagaaatacttttttcaataatattccaaccacagaaaaaaccaatttctatcattttggcagataaacttggtttcgctagtttgttaaacgaactagcagtatagcttatttgtttttgtttatatatagaagaaactcaagccagttgggttacctatcttgtttatgaattttcgttaatgtttgcaatatttctgattttttgtgaaagactaaattgtagaattgtatccacattttattctttccgttcatgtcgtagatttttagtttatgtttcggtcaacaagtcgtggagttaaaatatactatacaataaactgaaagttcaaatggaatggggttcaccaactttttaatttacttattcttgtggtcactttctttcaaaatgtactaaataattttatatattctcataatgtctaaatataaacaataaatatgaatatgaaaataaacataaatatgaaaataatttttcttttataaaagaattaataaactaacgataagtgattataaaaaatatatgtctttggaaaccaaacaaaatagtttaggcttcaatcccattaaattctcatctaaaattgatgcatgtagcatgtagatatgatcatgacaaaacgatgatttacaaatttttatttttcatttgttcgtcataaatatttgatcgtttatgataatattattattagacatgactgattgttattgcacaaataatttacattgtatatagaatttgcatcgcatttttatttgcgtatcaatggctgacactgagatttatgaggccacaaacaatttcggttttgggggcttcatgatctatatataaattttttttaccgtttgggcctcaaaagctatacatactacttgttaaaatttgggatccaacaccgatgttccactaggatatgatcagttacggattatttattgtaactcttgacaatattgcacaaaaaatttcttgattgtaaacattcgggttgcaacgtcagaccatctcactttctatcctcaaaataaaacatttccaacatgccatttttaaaattctaatctcataagcatgatattatttggacatgaagtgtatacagttatagtgtacaagcaggagagtagaagtcacgcgtcttacagatgaacttagtgctagtttaccaaagaagctgacgtggcgttttcatgctttccgtctttgtgctaataatatatggtagaaaaaacttttgagacgcaaataaaaatgcgaaaaccccaaaatcgtaatcagcagcgatcgagattttcgccgctgaaatctggagactgattattacaaacttgttcgtcgtgttcttcatcggagagacactagatcggaaaatttaacctcgatttgattgccgttgccgtaacatttgactgttgttttgtggtggggaattctagggttcttgtttgatgaagaagaactgaagtgaaaatgaccattaaaatctcccatgagatgattgtgtccgttcattcttcgaaatcggacaacggaatcgaatgatcgtcatattctgtaagagagaaggttagatcttcaccgaatctggaactcgagatccatcgttttgttcgattttctattctttcgcacaaggattggtctgagaagaacaagttcaagttagaagctgttgtgttctgtccggtgaaacttatttgagctgctgcaaaaacttcaaaagttgttactttttctgaaataacttaagcttcttggtattttgagactaaatggtttcactactcttgtgaattcctggaaatcagaactgttattagttttttttgtatatttagggacaaagatg

SEQ ID NO: 18112 - DNA, 3003 bp, Unknown
  misc_feature (1)..( 3003): 2750-1469P.txt file - cDNA_ID_1815368; gDNA_ID_1621102; Annot_ID_55905
tagtacaaactccgatctcggttcttggatagagttcactaggtctttttcttttatacaagttgtgggtaagcaaatagaaatatagttgaataaacatgccaaagctaaagactttgaagatgactactgactcagagaactgtaccgtattctttttcatttcttcgtcgtgcaattacgagaaatcaggattccggttggtggaccggtcatctgaagttggcacctcccgtgcagctgataagagtaatgaatcattccaaaatgagctttgactttgaaggtacctctaatctcatattctatcttgttgttttccagctgtctcctgagttccaccgcgtggtttacaggcaagcctaccaaactagagatcaaacggattggttccaacctcgtctcatgctttttctgcaagaatggctggaccacttgcgctgcaatcaatctattgaagaagaagagctcaatccgaagcttctcaaacttcacttctatcttcttattagggttagtgaaattcaccagcatggacaaatcgccgttgaaaaactccggcgtgtcgaagtagatcgtgtgtaggtttgcgtttgggatgtcgaaaacaggtattcttggtctaatcgcaagaaacactatcaaagtggcaatcgcaaaaaagataagcaaaaggctgaacacaaaacagaaaccggcaacacaccatatccagagactggtcctgctactccttggctgacggagaatcaccctatctttcctcggctctgcatcaagaccgttgaatctaaccgttgctggctttgttaagaccatttggccaactggtgtggattgtgtgctctgtggtgttctccatggtgtggttcttggagtataccatacagacgatggtgtttcccatgatggcgtttcgggcggttgcaactgcggtggaggaggaagatgaggtagatttggcatgagttatgtgatcaatgaaaggaaaattggaaatgtgtaatggttatggattaaataggaaaataacagaacttttgttttttgttgtgtgtaaaaaagggaaagcgagagtttgggcaaaagaagagagcttttgcataatggggtttggtttttgtaatgagtgggaccatgcgtgtcgttttgaagaactagtaaagcaaatctcggtggattaaagtttgaaaactacatgcgttttcgtttaatattccttcttcttaacaagtggcttttcctaattaaatctgagataaaaggttttgattgattacaggggacagatacttgttaattgaacaaacttaaaagtcttatgtattttaggaaaaggatataaaaattagtataccattaaaaaatatttcaatataggacttatttgacattttaagaataaaaaatttcattaaaaattctagttaatgcctatctaaacaatatcgttagaagcatcatgcatgataaaacactatgataaaacaatgtgttttttttcctgtctattttatgtctagtatgataaaacaacgatgttagataaaaaaaattttttgattaacctaattttattttattttcgattgaaaaactattgtgagtagaaaagaaaaaaataaaaaaataaaaaaaagtaaatgaatacaaaattattctttaagttgcttttaggttttgtctaaggtttgaaaaaacatttttgggctttatctttggttgtgaagataatcaaaatgagtttgttccttgggtaattgtgcttcttttttcttctcactttttgtggtagttgtaatgtgtggttagttgcggatccataaaacacttcagcactaagaaaaagctttttacctatgaaaaagttataataattccatttttgtcttttaacaatgatcatgctttccatagtaatttgataattccaaactcctggattttattaagagtaatggcagtaagttaggttttgttcacaaataaatacaacgataactgcgaaagagactcttattacaactgaaaaacttgttgaaagttgactacctttgattgatcctacaattgagacagacaagaatgagcagatgaagcacaaaaaaagttaacaagaagattgttttgcttttgggttaagaagttttattggggcattaacttggtcaggcccaaataataagcaaaatgctgtattttgctttggtaaagagttagctaattaagagttgttggagtctacgcataagtagtgctgcttgtgtaggtgagtcagtctagtgtctggaggtaaaatgaaagtatgtgtgcaagtgtgtgtagtagatgaaagtctactataagtatgagtgtaagagttgtagtaagattgcataaaagtatgaaggaaaagtttaagtgaaaacgattctaaacaaagagaagaaagttagagataagcataagagctaacctgaaacaaatatgagaataacaacaaaacttcatatttaatcagtaatatactaatatcttgataaaacctcacgtgttttaatattggcaataatttggtttaaccatagaatgaccaagatattttattttacagtgagtaaactagttttctataccgaattaaaggtaataatttgaagtttcaaatacgatatttaagatcctaattatgagtagaattgaatgtgaaacggttttattagtacaagaaaagggtatatgaaagggttaagcaattaggttcgaaatataaacacgcacagaactcgaagagccgaatttaacaatgaacccaaaattaaacgacactgaagcaacctttgtgttgtgactctatatgagtgtatatatatatggtttatagaatacaaagtcttcagatatgtaatggagatttcagaaaaatggataagacactatagtagcacacacaaaatccttctagttggagaaggaaacttctcattctcactatgtctagcttcagcttttggctcggccatg

SEQ ID NO: 18113 - DNA, 3003 bp, Unknown
  misc_feature (1)..( 3003): 2750-1469P.txt file - cDNA_ID_1815368; gDNA_ID_1621102; Annot_ID_171455
tttctataccgaattaaaggtaataatttgaagtttcaaatacgatatttaagatcctaattatgagtagaattgaatgtgaaacggttttattagtacaagaaaagggtatatgaaagggttaagcaattaggttcgaaatataaacacgcacagaactcgaagagccgaatttaacaatgaacccaaaattaaacgacactgaagcaacctttgtgttgtgactctatatgagtgtatatatatatggtttatagaatacaaagtcttcagatatgtaatggagatttcagaaaaatggataagacactatagtagcacacacaaaatccttctagttggagaaggaaacttctcattctcactatgtctagcttcagcttttggctcggccatgaacataactgcgacctctctcgattctgaaggtatgtaaaacccattttatatgaacatttataatatacatctatcgatcactagtcgtaactaatgtattgacttaaatcaataaaattttacatgtagatgaactgagcataaaatatatggatgcggtggataacataaacatattgaagagatacgggtgtgatattcagcacgaggttgacgtgcacacaatgagcttcgataatagtttgagtctgcaacgttatgaccgcattgtcttcaattttcctcacgcagggtctcgtttctttggtcgtgaattgtcctctagggccatcgagtaacgaaatatattctttcattttcttactataatatatagtttatgatttggactgatgtaatgataaaatgctgtgttttggatcaggagccacaaagagttagtgagaggatttcttgagaacgctaaggagatgttggaagaggacggagagatccatattacacacaagacaacgtatccatttagcgattgggggataaagaagctgggtaaaggagaaggtttgaagctgcttaagaaatcgaagttcgagctgagtcattatccgggttatatcaccaagagagggagtggtggacgtaggagtgatgattatttccctgttggtgaatgttctacttacatgtttacccaatcctaactttgggaaatcttgcttaatttttttttggtattatgataactaaaaaaaagaattgggcattacaacatcaacaaggtaacaataatttggtccgactggacacgttcattcagttccttctgaaaactcaaaagcaattggtatataaaaagatcaaaaagttatatgaactatgtactttgaaaaagaaaaaaaagaagaagttatatgaactatgttaataataaagatctttaaactttttaatctcatttttgtttataatacatcgatttttattgagcttatacaagttcccgtaactgactttatatatagtttcatgtattaatttatacataattggccaataagtaggccttttttttgttgttttctcatgtaagtataattaagtgtgtaatcatatgaatctctataatctatatgcatacatacatgtatatagaatatatctatttttcgccaacaagaaaaaggacgaggaaactaaattggttgagattaacactttagtttattggttggtccaagagttggtagatttctttgtcgtttctctatagttggaacatgcatttatgtgaacttcgattatgacgatatgcatccatactacatgtaaaatttattgttgttttccgccaacaaaagaaaaacgaaaaagctaattaaattacgtacgagtaaattgaacacttggagaatcacatggatcctggagctctgctcatgcttaggagtgctcgaggccttagatctttcctatatgtagacgttgatccttgtgatctaaaaggtttcgaggtcttggaaatctatcacccgtccatgtctgatggctttgtgaactcggtaatggtcgcacgcaaactcactgatcgattaattaagtacgagtggtgtactggaactcgatcactaaattcattaaaaaaaacaaggcaagtgatgattccctaagaaattaggtcaagattggagccatacttgtggaacaaggcagatgatgatttccctaatgaggctctctgactctcccttactagttcaatattagttctgtcttttgtcaacgtgttgacgaaatcaaatctatattattagttgttgttttctctctatgcttattgtgattatgatgtcactagatcaaatactcggtttgaatgtttccttataaatgtatcagcatgaccatttttctcatattttacgaaatatttagcctgacaagcattaagcagttctgttaaacataaaacatacaatatccatgaaagaaaatcctcaatgtacatgagtcattaccaaatgcaagccatttgatcagaagtaagctgtggctgaaacacaatgtacagatgagtcatctttttgtttgtttgcttgaatagaaacgcagcgtttttgactaatcgagtaaccaattttttttttacaagaccgaaccggatcaattcaacaaacgtgaaataaatcgaagcgggccaggtcaagtaggtagccctctcaatgattaagagggaaccagctgtatccagagaccctctgagtcagtaagaagcttctaagagggacaggaaacggtaaaaaaaacacgagttatgtccggtaatatcaaaatggcaaaaatcattcatttcaagaaagaaaagagtagagagagtctcacacagctataaaggcccaaaaacaccaatccaccgacgagtattgtagatttagaggtctacaactaaaagcctttgtgtgtgccagattagctccctactaatccgccgccgcacctcctcgatctccgcccagctcccttcttttctatctatctattcagttgtttctccggtaacaaccagctgaggaagaagaagaagtagtagccgtgatgatgatgatg

SEQ ID NO: 18114 - DNA, 3000 bp, Unknown; identical to SEQ ID NO: 4376
  misc_feature (1)..( 3000): 2750-1469P.txt file - cDNA_ID_1815368; gDNA_ID_1620702; Annot_ID_165099

SEQ ID NO: 18115 - DNA, 3000 bp, Unknown
  misc_feature (1)..( 3000): 2750-1469P.txt file - cDNA_ID_1815368; gDNA_ID_2926189; Annot_ID_140933
tacaaactccgatctcggttcttggatagagttcactaggtctttttcttttatacaagttgtgggtaagcaaatagaaatatagttgaataaacatgccaaagctaaagactttgaagatgactactgactcagagaactgtaccgtattctttttcatttcttcgtcgtgcaattacgagaaatcaggattccggttggtggaccggtcatctgaagttggcacctcccgtgcagctgataagagtaatgaatcattccaaaatgagctttgactttgaaggtacctctaatctcatattctatcttgttgttttccagctgtctcctgagttccaccgcgtggtttacaggcaagcctaccaaactagagatcaaacggattggttccaacctcgtctcatgctttttctgcaagaatggctggaccacttgcgctgcaatcaatctattgaagaagaagagctcaatccgaagcttctcaaacttcacttctatcttcttattagggttagtgaaattcaccagcatggacaaatcgccgttgaaaaactccggcgtgtcgaagtagatcgtgtgtaggtttgcgtttgggatgtcgaaaacaggtattcttggtctaatcgcaagaaacactatcaaagtggcaatcgcaaaaaagataagcaaaaggctgaacacaaaacagaaaccggcaacacaccatatccagagactggtcctgctactccttggctgacggagaatcaccctatctttcctcggctctgcatcaagaccgttgaatctaaccgttgctggctttgttaagaccatttggccaactggtgtggattgtgtgctctgtggtgttctccatggtgtggttcttggagtataccatacagacgatggtgtttcccatgatggcgtttcgggcggttgcaactgcggtggaggaggaagatgaggtagatttggcatgagttatgtgatcaatgaaaggaaaattggaaatgtgtaatggttatggattaaataggaaaataacagaacttttgttttttgttgtgtgtaaaaaagggaaagcgagagtttgggcaaaagaagagagcttttgcataatggggtttggtttttgtaatgagtgggaccatgcgtgtcgttttgaagaactagtaaagcaaatctcggtggattaaagtttgaaaactacatgcgttttcgtttaatattccttcttcttaacaagtggcttttcctaattaaatctgagataaaaggttttgattgattacaggggacagatacttgttaattgaacaaacttaaaagtcttatgtattttaggaaaaggatataaaaattagtataccattaaaaaatatttcaatataggacttatttgacattttaagaataaaaaatttcattaaaaattctagttaatgcctatctaaacaatatcgttagaagcatcatgcatgataaaacactatgataaaacaatgtgttttttttcctgtctattttatgtctagtatgataaaacaacgatgttagataaaaaaaattttttgattaacctaattttattttattttcgattgaaaaactattgtgagtagaaaagaaaaaaataaaaaaataaaaaaaagtaaatgaatacaaaattattctttaagttgcttttaggttttgtctaaggtttgaaaaaacatttttgggctttatctttggttgtgaagataatcaaaatgagtttgttccttgggtaattgtgcttcttttttcttctcactttttgtggtagttgtaatgtgtggttagttgcggatccataaaacacttcagcactaagaaaaagctttttacctatgaaaaagttataataattccatttttgtcttttaacaatgatcatgctttccatagtaatttgataattccaaactcctggattttattaagagtaatggcagtaagttaggttttgttcacaaataaatacaacgataactgcgaaagagactcttattacaactgaaaaacttgttgaaagttgactacctttgattgatcctacaattgagacagacaagaatgagcagatgaagcacaaaaaaagttaacaagaagattgttttgcttttgggttaagaagttttattggggcattaacttggtcaggcccaaataataagcaaaatgctgtattttgctttggtaaagagttagctaattaagagttgttggagtctacgcataagtagtgctgcttgtgtaggtgagtcagtctagtgtctggaggtaaaatgaaagtatgtgtgcaagtgtgtgtagtagatgaaagtctactataagtatgagtgtaagagttgtagtaagattgcataaaagtatgaaggaaaagtttaagtgaaaacgattctaaacaaagagaagaaagttagagataagcataagagctaacctgaaacaaatatgagaataacaacaaaacttcatatttaatcagtaatatactaatatcttgataaaacctcacgtgttttaatattggcaataatttggtttaaccatagaatgaccaagatattttattttacagtgagtaaactagttttctataccgaattaaaggtaataatttgaagtttcaaatacgatatttaagatcctaattatgagtagaattgaatgtgaaacggttttattagtacaagaaaagggtatatgaaagggttaagcaattaggttcgaaatataaacacgcacagaactcgaagagccgaatttaacaatgaacccaaaattaaacgacactgaagcaacctttgtgttgtgactctatatgagtgtatatatatatggtttatagaatacaaagtcttcagatatgtaatggagatttcagaaaaatggataagacactatagtagcacacacaaaatccttctagttggagaaggaaacttctcattctcactatgtctagcttcagcttttggctcggccatg

SEQ ID NO: 18116 - DNA, 3000 bp, Unknown; identical to SEQ ID NO: 4376
  misc_feature (1)..( 3000): 2750-1469P.txt file - cDNA_ID_1815368; gDNA_ID_2926189; Annot_ID_200874

SEQ ID NO: 18117 - DNA, 3000 bp, Unknown; identical to SEQ ID NO: 6727
  misc_feature (1)..( 3000): 2750-1469P.txt file - cDNA_ID_1815372; gDNA_ID_1621102; Annot_ID_55904

SEQ ID NO: 18118 - DNA, 3003 bp, Unknown
  misc_feature (1)..( 3003): 2750-1469P.txt file - cDNA_ID_1815372; gDNA_ID_2926189; Annot_ID_140934
aatgaacgtgtccagtcggaccaaattattgttaccttgttgatgttgtaatgcccaattcttttttttagttatcataataccaaaaaaaaattaagcaagatttcccaaagttaggattgggtaaacatgtaagtagaacattcaccaacagggaaataatcatcactcctacgtccaccactccctctcttggtgatataacccggataatgactcagctcgaacttcgatttcttaagcagcttcaaaccttctcctttacccagcttctttatcccccaatcgctaaatggatacgttgtcttgtgtgtaatatggatctctccgtcctcttccaacatctccttagcgttctcaagaaatcctctcactaactctttgtggctcctgatccaaaacacagcattttatcattacatcagtccaaatcataaactatatattatagtaagaaaatgaaagaatatatttcgttactcgatggccctagaggacaattcacgaccaaagaaacgagaccctgcgtgaggaaaattgaagacaatgcggtcataacgttgcagactcaaactattatcgaagctcattgtgtgcacgtcaacctcgtgctgaatatcacacccgtatctcttcaatatgtttatgttatccaccgcatccatatattttatgctcagttcatctacatgtaaaattttattgatttaagtcaatacattagttacgactagtgatcgatagatgtatattataaatgttcatataaaatgggttttacataccttcagaatcgagagaggtcgcagttatgttcatggccgagccaaaagctgaagctagacatagtgagaatgagaagtttccttctccaactagaaggattttgtgtgtgctactatagtgtcttatccatttttctgaaatctccattacatatctgaagactttgtattctataaaccatatatatatacactcatatagagtcacaacacaaaggttgcttcagtgtcgtttaattttgggttcattgttaaattcggctcttcgagttctgtgcgtgtttatatttcgaacctaattgcttaaccctttcatatacccttttcttgtactaataaaaccgtttcacattcaattctactcataattaggatcttaaatatcgtatttgaaacttcaaattattacctttaattcggtatagaaaactagtttactcactgtaaaataaaatatcttggtcattctatggttaaaccaaattattgccaatattaaaacacgtgaggttttatcaagatattagtatattactgattaaatatgaagttttgttgttattctcatatttgtttcaggttagctcttatgcttatctctaactttcttctctttgtttagaatcgttttcacttaaacttttccttcatacttttatgcaatcttactacaactcttacactcatacttatagtagactttcatctactacacacacttgcacacatactttcattttacctccagacactagactgactcacctacacaagcagcactacttatgcgtagactccaacaactcttaattagctaactctttaccaaagcaaaatacagcattttgcttattatttgggcctgaccaagttaatgccccaataaaacttcttaacccaaaagcaaaacaatcttcttgttaactttttttgtgcttcatctgctcattcttgtctgtctcaattgtaggatcaatcaaaggtagtcaactttcaacaagtttttcagttgtaataagagtctctttcgcagttatcgttgtatttatttgtgaacaaaacctaacttactgccattactcttaataaaatccaggagtttggaattatcaaattactatggaaagcatgatcattgttaaaagacaaaaatggaattattataactttttcataggtaaaaagctttttcttagtgctgaagtgttttatggatccgcaactaaccacacattacaactaccacaaaaagtgagaagaaaaaagaagcacaattacccaaggaacaaactcattttgattatcttcacaaccaaagataaagcccaaaaatgttttttcaaaccttagacaaaacctaaaagcaacttaaagaataattttgtattcatttacttttttttatttttttatttttttcttttctactcacaatagtttttcaatcgaaaataaaataaaattaggttaatcaaaaaattttttttatctaacatcgttgttttatcatactagacataaaatagacaggaaaaaaaacacattgttttatcatagtgttttatcatgcatgatgcttctaacgatattgtttagataggcattaactagaatttttaatgaaattttttattcttaaaatgtcaaataagtcctatattgaaatattttttaatggtatactaatttttatatccttttcctaaaatacataagacttttaagtttgttcaattaacaagtatctgtcccctgtaatcaatcaaaaccttttatctcagatttaattaggaaaagccacttgttaagaagaaggaatattaaacgaaaacgcatgtagttttcaaactttaatccaccgagatttgctttactagttcttcaaaacgacacgcatggtcccactcattacaaaaaccaaaccccattatgcaaaagctctcttcttttgcccaaactctcgctttcccttttttacacacaacaaaaaacaaaagttctgttattttcctatttaatccataaccattacacatttccaattttcctttcattgatcacataactcatgccaaatctacctcatcttcctcctccaccgcagttgcaaccgcccgaaacgccatcatgggaaacaccatcgtctgtatggtatactccaagaaccacaccatggagaacaccacagagcacacaatccacaccagttggccaaatg

SEQ ID NO: 18119 - DNA, 3003 bp, Unknown
  misc_feature (1)..( 3003): 2750-1469P.txt file - cDNA_ID_1815375; gDNA_ID_1621102; Annot_ID_55899
tggatgaaatgcccacttctgttcacacttctgcactactgccactacattcttggactgcttctgccgctatattcccaccacaagggaccattcttttattattagacaaaacaagttaaatccgattgaaaagtatacagacaaaaccttctactatagaaataaataacccatatcatattctagattagatccagcgtaacaccctttattaattctcacttaatataatttattggagcagatcaagccattcaacaaagcctctctctcatgtgatgagatctctgacctaattgaatcgtgattagatctagatcttgttacattgtcttcgtcaattatccgcacttaaacatttcttcgttattttacactattagtatacgttgtaacacatatttcatctttctgtactaataaagagtacccacccataaactactctttcataaacaaatgtcttcatcaacaaatgtcttatataacgtgaagtttcatatccaaaccactggttataaagtgttttgtaacgttaactttcactattagactcatcaatgtttgcctatgtaatcatacaacagtagtagttgtataaattataaattggtgtagagaatttaggaataatgtttggatgaaagggtgttgtcacccaacaaggagagggaccattaataaccgataatcataataagatttgtgaaagaaatgtttcactgatttggcagaagtacagttggaggttctttgtcttttctcttctgcaccttttgttctctttacttccttcttgtttgttggtttttgttcttttcttattttttttccctaccataaatggaccattaccattcatttctctctttttcttattatttgctgtatttagttgattttgttatatccgtttaaatttgtgtacatataaacaacgacgtctataagtttttataacaaaaaaaaggattatgttaggtgaaatttcgattcgttttacgtgtaggatcaacgtgaaagaaagtcgttgtaggtatgaaaaatatggaccgactacgatacggctgcttgagaaaattagatgtataacgtaaagtgaaatagtgaatgttaaggcaattagggaaactaaaattaaatattcaattggtatgtagggaaacgactttttatttattcacatgcacatgacctctctatgtcatgtgccttaagttgccgtgttcgatctttttataatttgttcgacccgttaccctaaatttaaaaatcatttctatttttttattattatgtccaaatctgatttctttttcatgtgtcatatatataaaactcattttaattaaattacaaatttgaaaaaatatttttttttgggaaatttaagaccgacaagatgagcaagggacatggttgtaaactaattatttctttaattaatcagtcacaaaaattcctagcttgcatgtgcaatttcactctccaagattccatgttttacttcaacttttatcactagtttatactatcaaagactcaaagtagatgatctgtattctacgctaatagtaaataattttaatataaccactatttacccacttctgttttctctcaaaataaaaacagaatccacattatatacatggtttcttgtggttactagttacacaatgtactagctacaagaagtgcttctgattaaaccatgtacagttttctagttcaaatacacatggttcctcgttactagttacacaattatgtcgacattcatgggaagttcaagggatttggatacttcaattcttactatgagaaaccctatttaaatgtaactactaaaacacaagcactttttgtcgtggatataattggttaaaattatcggtgcgtttaatgtgttgagaattcgttgaacactttattacctattattaaaccaaaaagaagcattaaagttcatcgtgccgctttaagatccacaagttttgtttcttcgattcttcgtggtgaacgttgcagccatctttgggctgtactattgtcattatatttaacgggtcttttcttttgtaagttagagctagtatatatgaattaatgatatagttaaatttaaataacttgtaatgctcggtctaactcttaaaaaaacgtttgaatgtgattgaacctttcgtaacagtttgatactagtttaatggtaaaactggccacatggaacaagacgtcaagacctataaatgatcgcaaccttttatcgaagtggagaacacttctcgttcacatgttataagatcatgatacgatgctctctgattagtggattggagtgaaatttcgacaaaattcgtacatgcaaatgtcgtaaaaggcaattacaatatagcagcggaaaagagaggaggactatttgacatgtcggtctcaaaaccatgaaagttggtgccattgtaagagggctattgttttgacatgtcattcttgattctcagatttcgattttcatataaattatagcatactatttttgttgcataatatttgattattttcttactttcaaaaattttggtggtcggccataatatgtttttccaataaataaataaaaaaggtttatctatgtaaggtatattccttgaagtcaaatccaaatttaattacaggattatgtttcaaaacgttatctaaaacttgatccagctatttcaagagtgaactactttgtaacttaattaggactatttagggtaattgttttttcaattttacaaaaatcaaaagcaaagattaaaataatactaaagggttagtgatagaaactttgttgggatcaaaaaccttcctttgctacttctctctctgctctgtgtttatttatatatttcctataaacaaaataaaaccaaaaccgatggattggttcttcgctttacaatcccaacgcacttctctcattcttcttcctcatcttcgtcttctccgatg

SEQ ID NO: 18120 - DNA, 3000 bp, Unknown; identical to SEQ ID NO: 4372
  misc_feature (1)..( 3000): 2750-1469P.txt file - cDNA_ID_1815375; gDNA_ID_2926189; Annot_ID_140939

SEQ ID NO: 18121 - DNA, 3003 bp, Unknown
  misc_feature (1)..( 3003): 2750-1469P.txt file - cDNA_ID_1815379; gDNA_ID_1621102; Annot_ID_55898
acatgtaacccatgaaatatcactaacagttaccgggaacattgttttgcagtttcgtttcagctatatgatcttaagcagcaaggtttcatagagaggcaagaggtgaagcaaatggtggtggctactcttgctgagtccggcatgaacctgtcagacgaaatcatagagagtataatcgacaaggtgtggttccttcctaccctgctcgatactatattcttgttccactgttgtatagccaactcatgatagcagttgagaataaagtaaagagtggtttctaagtttcttctttcacagacatttgaggaagctgatacaaaacatgacgggaggatcgataaggaagagtggagaacccttgttctcaggcatccttcccttctaaagaatatgactctccagtatcttaagtgagttcctaaaccaagacttatccgaggtttaggcaatgcaacttccaattttttctgtgttattattaacaccgatctctgatattgtgtgcagggatataacaactacatttccgagctttgtgttccactcgcaggtggaagatacctgagaaaaacaatagcatattagcagaggagacaatttgggaattgtgtttgttttctgattatgtatcatgtctatttgtttcaatctctctgaacattttcaagattttgttgttacttgtgtgaattaaaagtaaagaaaacaaatctgtatttttgctactcctgattttgattgctgattttctcctcgcatctgtagatatactactaaccttgagacatgaatcctattaataaagagcaaactgatgaagtgataatagagagcaaaaaagagagaacccaacaccaaatgatcgggtatgctctagtctgaattctgaagtcaaaattgaaatcaccgatttgatcgaaccggatgcaacattacaacaatcggatttgttagtcttgtggttgactttgtcagttagagttgacaaagtaattagcaaagttagtgacgattgtgttctgcataaacacgtttactttgaggaataaattacttactctttcggtctttcctaatatatatgttttccctgtctcaaagatctgaataggtatcagagcgcgttgacaatctctttttttgatcatcgatttgttctctctttcttggctaaaaagtttctatctacacgactctccatggattcaacaagaaattcagcttcttccaactccacgggatgctttacggatcagaaaaagcgaaaggcactctatgaggtgtttaagaaactcagcggtgttgattgccaaagaaacgaggttcgtataaattatatgtaactttcttgctaagtacgcatatgatataaatctgtgtttcttcgttcagggtaacgttgtagaaggcgtaacgtgttattatggtgaaatgaacaaggtatttggaattatatataaatatatatgtctttcttgccacgcactccttcttttcaacaagtcttacagattttccataacgtgtcctgttgtatttctgttgtatcaggaacagtttcatgtagccatattccagactgacaaaaatgagagcttgttttcagagagggtattttatttttgttctcaacaaaaaaagtctttgtaatccatttgcaaacaatgacattaccctatcacacaggtcttcgatttgttcgacacaaatcatgatggattacttgggtttgaggagtttgcccgagctctctctgtctttcatccatctgctcctatagatgataaaattgaccgtacgtctctgatctcaaaaactagacccgatatattaaccatctacaaacaaactgttcacatgctacctatatatattccatgaaagcttattaacggttacctggaacattatttggcagtttcgtttcagctatatgatcttaagcagcaaggttttatcgaaaggcagggggtgaaacaactggtggtggctactcttgctgcgtccggcatgagccagtcagacgaaatcgtagagagtataatcgacaaggtgtgttttccttccttctattttttggttcgactctagtctatagtatagccaactaagtttaagcagctgatgaatatgaagtgaagagtgatttttgagtttatgaggcagacatttgtgcaagctgacacaaaacatgaagggatgatcgatgaggaagagtggatggacctagtttttagacatcctcttcttctgaagaacatgactctccagtatctcaagtgagctcctaaaccaaagactaacccgaggtttagccaatgcaacttcaaatttttctgcatcacgtattattaacaccatgatatctgatattgtgtgcagggatatcacaactacatttccgagctttgtgttacactcgcaagtggaagatacctgagaaaaacaatagcatattagcagaggagactgtttgggaattgtgtttgttttctgattatgtatcatgtttatttgttttcaatctctctcaacattttcaagattttgttgttcctttgtgtggaaaaaaaacaaatccgttgatgattttctcctcgcatctgtagatctactactaatcttgagacatgtaaaagcaaactgctagagcattgaaagggcaaactgctagaaaaaaaagagagaagaactcaacaccaatgatcggctatgctctaatctgaattctcaagtcaaaattgaaatcgccggtttgatcgaaccggatgtatttaacaaaataaacaaaataaacaaaaaaagaaggaaaaatagatcctcacgcgttaccgtagcgcgtatttttttcacaacaaaattcataagcagtgtgggtcccacaggtccactaagtttagtggtgggttgctccgtagctaatctcatctctcactctttttcttatccactatccatagaagaagaagaagaagactgttgacgacgacggcgatg

SEQ ID NO: 18122 - DNA, 3000 bp, Unknown; identical to SEQ ID NO: 4371
  misc_feature (1)..( 3000): 2750-1469P.txt file - cDNA_ID_1815379; gDNA_ID_2926189; Annot_ID_140940

SEQ ID NO: 18123 - DNA, 3003 bp, Unknown
  misc_feature (1)..( 3003): 2750-1469P.txt file - cDNA_ID_1815395; gDNA_ID_1621103; Annot_ID_55935
taaagaataaatcagattattgagattcacaaaaatccatcatcgcaagttcttacgtattcgaaagacgttactacggttactaacttactgtatatgtatgtgatgtcgaaaaagaagaagagaagacgttacgtcactacttgtatgttcatcgatcagtccacgtggctttttgtaaggtccgagagaggaaagtgaaattcagacgccgcttttttttttttggatgaagttccaaaattagccattttatacagtggttaagctcgttggaccaatatcaatggcgtctgcaacgactcttctcttccaccacggttccactcgagtcctcgtcgctcgtagacggtgccaagcttcagtccttagaccctacggcggtttaaagccctttctttccttctgcagcttacctaactccactgcgccgttccgggattcgttgagagcaaaatccgatggattggctcgggcctatgttaccggagcgccgcctatcgtggaagaaccagacccaaagattgaagaatccaaatctgaggctgaatcgaaggatttaattagttgggggcttctgtggagcttgatgagcaagcacaagctcaggctcagtgtttgcttattgactctccttggatgcagtacttgcactctctctatgcctgttttttctggtaatcggttcttcaatccactctcccaccattagcaaattgtaactgtactctttttttctctttgggtttgatgtagtttaagtttgggtatgatgatttagcttgtcatctgtgtttctctttatcttggtgaagctgttttataatggtaagtgttattgttttgagtaaaggtagattctttgaagtactgattggggtgagaccggagcctttgtggcggctgctgagcaaaattgctgttttgtactcgttggaacccatctttactattgcttttgtgaccaacatgactgctatctgggaaaacgttatggcaatattaagagctcagattttcagaagggttttgatccagaaggtatgttttgtttagtatgatcaaagttcgcttaagctatattgttggctgtattgaaatatcattgatgggtttcttttttttgtcttttatatattcaggcagagttcttcgacaaatacaaggtctgttccttttattcttggtttgctcaggtttgagacattttggcacaaaccttccttatgttagattgagttcatttgttttaggttggagagctaacggggctactcacgtctgatcttggtgctctgaatagcattgtgaatgataacatctcacgagatcgtggatttagggcatttacagaggcaagccatttctttactatgcaaatgtgagatttttgtgtttgtacatacatttttcataatgaatacagatttaatcttagcctggtgttggtgtctgctgttatttttggagttctataaatgacaaagactatcctgttgcatctcaagaatgcccagttctcatggcttatgcgttatcccttttgtaggtttttggaacaatatgtatcctatttactctatctcctcaacttgcacctgtacttggtctattgatgctagctgtgtcagttctagttggtaaattctctatgtctttttcattctcctaaactttttatttttggtaattactttggtcatctttgcttactttgcttacctctacatctactccctcggtcaaatctcaaaagctgtgtacaagagatcgactgttcctgtttataaatcgcatggattagctcaagcaacaatgtctgattgtgtatcagaaacgttctctgcaatccgaactgtaagttcttgacttcatcgtatttgtatcttttagggcagattaaattatctgaagaaactttgatttacccttgaagactcaagtaatttgtatctctttataggtaagatcattcagcggcgaaaaacgtcagatgtctatcttcggtagtcaggtcatatttcagacttcttactagctaaaactgatttcttctaaacaattgttcttttttctaactgatccataatctattaatctaaacttttgtttgatgtacagattcttgcttacaagcttagcggcttaaagcttggtactttcaagtctataaatgaatctataacaagagttgctgtttatatttctctgttggctctttactgtcttgggggaagcaaggtgaagacggtaagatatacctgcctgtaagacttgttgattgccattatgatcattcaagttgaaattatgcttcttgccccctaaaacataaagagaatcgtgtttttatgaatttctattgcagaagatagtgttactcgttgtttatactttctggaacaaatgactggatgtttctagctagaatcaagttactaccttctgaatttttaaataaaaaaaaactaagaatcaaatttctctgtatctctcttttgtgtagtttcttatgttgttacattttagctcttttgcactttatttttcttggttcttattcttaaaatttctccaacccagggtgagctcgctgttggaacagttgtttcgttcattggatacacattcactctaacatttgctgtaagtacctctgtctacacatcatttactgtcacacatatgctatacatgtaatttagtttaccataaccagtgattctgttatccaggtccaagggcttgtaaacacgtttggagatctacgtgggacttttgctgctattgacaggatcaattccattttaaacgcggtggacatagatgaggctcttgcctacgggttagaaagagatatacatacaaagaaagtccaagatgaaaaccttaaattgttcttgtctgctggcccaaatgtgaatatccgtcacctcgataagtactacatgtcaaatctgaaatcaactaacaatctacgtaccctaacatgggctggagatg

SEQ ID NO: 18124 - DNA, 3003 bp, Unknown
  misc_feature (1)..( 3003): 2750-1469P.txt file - cDNA_ID_1815418; gDNA_ID_1621103; Annot_ID_55928
acataagcgaaaaacagacaaatcgggaaccaaaatcattctctaaacaaaatgtaaaaaaatctgatttttggctgaaaaaaacaacaaaaatctgattgtcagtatcctacaaatcgataaatcgtaagaagaaaacataaaaataatattaaagttgtgtgctaaaagcaaccttaaacaaccaaatagcacttcgaccaatgtcgaaaagcaaaaaccgtaaagcggtgctcgtatgaatgttgaatgggataaagagcggcgcaagatctgatatttggctggaaaaaacaacaataatctgattgtcagtatcccacaaatcgataaatcgtaagaagaaaaacataaaaataatattaaagttgtgtgctaaaagcaaccttaaacaaccaaatagcacttggaccaatggcgaaaagcaaaaaccctagagcggcgctcgtatgaatgttgaatgggataaggtatatatgagattctcgacggaaagatgtatgggcttcgataaagaatatatgagattctcgacggaaagatgtatgggcttcggcccataactctttgatattagtatagaaccataacaaaagaaaaaaaaaaaaccttaaacaagtaaacactaaacccaattgattctttactaaatttagtaatcaatggttattgtgaaatgaaatttaacttttctttcatatgaaaaaaaaaattgaaaccatccatggatggcctagttttatttagataactaaatatctatgttttgaaatagtaatctattacatgacacaagaacgaagattaactaaatcgagaaagaaaaaaaagtgtagatttggtagacgctgaatatataaaaaaactaaagtgataaaacaaattgtctttttaaaaaagtatggaattttcaaatttcccattctttcggtatatgatgagaaccttcacatggattttatttttaacaacaaaaatcaatgttgaaaagtgtatgtacctatgaaacaaaatcagggtcttaactagttttttgttttggttttggttttaatcttttctagttgctttgccttatttataagcgcagatgaggaagagaaaggcgaaggcacatcagctgcatgggacgttgctgaagctgtggcgctctcattgtgtgatatcttcaatctctgttaatagctttgtaatggtggtaacaatccaaaaatacccaattacaatcttataagtaccaatcatcatccatcctatggtttttcttttttaaacaaaatccgatataaaattaataaaaatctattgtattaacactaaaggtctatttacgaaaatttatagttacaatgatatgaaatgatagaaaaaatgaaagattataaaattgtattgaccgaaaaaagaagtttaatatatatatatatatatagggatactcattagaaaatctatatgcttagtgaaaaatgactccttcccataatattaaaaacagataaacgaaattgttaactaaatttattcaacaataataaacttttaacaatgacaggtcacactttaaatggaaatatgcattgatagactttctcggttgaagttgtaactctagatttatttttgtagaatttaaagatgtattttgttccttttgttgtgagctatgaaattaataccttataattgtaggttttaggaagcggttgatgtatagcatgtgcagagtaagctcgaaatggctgagacgaaaaaaagtgtcgccacaatgatttactttttactactatacttttgatcattgggacctaatggatgaatgttgtgtgttgtggacgagtttatgacacataacaatattgtagacaaattgtctaatttgagtagagatactaaaatttatctccatataattgtatactgtatatgtataacaaataattcaattcattggcctaagatgttttattgtatctttgtagaattttacactttagagaaaaatcattgcaataactcgatgaaaaaaaatgtttatcttatcctagttacaactaactatctatctatctctttgtggtaggagatttgcatctgatcgaacgattcatatggtgccacgtaactatggtcccacttctattacgagatctactaagacatcagcacgtgtcggtgtcgtttgatccacgaggtcggtgacgcttagagctagttgaccggtacagtcggttattaccggttatactatatgtatgttttttggtcaaagatttggagctattttatagttaataaatcaagagttttttttttccacaactaggtcttaatttgtgattgtttttttcttccatttttccaaaattctcttatcaatttcaggttagtatttttgttactgtccctagcttttgactattgtactactgtataccctttttttttggcttgagaaattagattttgttatgtttgcgtaaaatatttgtgaactcaaaaataaaatctctttttttttcattgccgatattttttcttccatgaatgctgctgtaaagtattaatttccctctctactgagtttcttccaaatttctgatttttgggatttgtgcaactcccaagtcgatttcagtttctgggttttgatttgagttcgccgattggatttgaagttttagtctttgttggtaagttctatcctttttgagatgttgaatttgctcttctgataattagggcttctgattattagcctaccaatctttgatttggttttcatttccttcagctaaatatttgtaattcttggatcctgaatgattaaccatcttagtttgattggtgaaagtataccatagctgcttaggatccgtttggctttgttatttgctcagattctgaaaggaagggtttaaagtttcaagcttttcattccgctgaatcagtccttgtatttggacggcttgatctgttatctgctctcgtgggtggggcatg

SEQ ID NO: 18125 - DNA, 3003 bp, Unknown; identical to SEQ ID NO: 18124
  misc_feature (1)..( 3003): 2750-1469P.txt file - cDNA_ID_1815418; gDNA_ID_1621103; Annot_ID_171493

SEQ ID NO: 18126 - DNA, 3000 bp, Unknown
  misc_feature (1)..( 3000): 2750-1469P.txt file - cDNA_ID_1815418; gDNA_ID_2926187; Annot_ID_200730
taagcgaaaaacagacaaatcgggaaccaaaatcattctctaaacaaaatgtaaaaaaatctgatttttggctgaaaaaaacaacaaaaatctgattgtcagtatcctacaaatcgataaatcgtaagaagaaaacataaaaataatattaaagttgtgtgctaaaagcaaccttaaacaaccaaatagcacttcgaccaatgtcgaaaagcaaaaaccgtaaagcggtgctcgtatgaatgttgaatgggataaagagcggcgcaagatctgatatttggctggaaaaaacaacaataatctgattgtcagtatcccacaaatcgataaatcgtaagaagaaaaacataaaaataatattaaagttgtgtgctaaaagcaaccttaaacaaccaaatagcacttggaccaatggcgaaaagcaaaaaccctagagcggcgctcgtatgaatgttgaatgggataaggtatatatgagattctcgacggaaagatgtatgggcttcgataaagaatatatgagattctcgacggaaagatgtatgggcttcggcccataactctttgatattagtatagaaccataacaaaagaaaaaaaaaaaaccttaaacaagtaaacactaaacccaattgattctttactaaatttagtaatcaatggttattgtgaaatgaaatttaacttttctttcatatgaaaaaaaaaattgaaaccatccatggatggcctagttttatttagataactaaatatctatgttttgaaatagtaatctattacatgacacaagaacgaagattaactaaatcgagaaagaaaaaaaagtgtagatttggtagacgctgaatatataaaaaaactaaagtgataaaacaaattgtctttttaaaaaagtatggaattttcaaatttcccattctttcggtatatgatgagaaccttcacatggattttatttttaacaacaaaaatcaatgttgaaaagtgtatgtacctatgaaacaaaatcagggtcttaactagttttttgttttggttttggttttaatcttttctagttgctttgccttatttataagcgcagatgaggaagagaaaggcgaaggcacatcagctgcatgggacgttgctgaagctgtggcgctctcattgtgtgatatcttcaatctctgttaatagctttgtaatggtggtaacaatccaaaaatacccaattacaatcttataagtaccaatcatcatccatcctatggtttttcttttttaaacaaaatccgatataaaattaataaaaatctattgtattaacactaaaggtctatttacgaaaatttatagttacaatgatatgaaatgatagaaaaaatgaaagattataaaattgtattgaccgaaaaaagaagtttaatatatatatatatatatagggatactcattagaaaatctatatgcttagtgaaaaatgactccttcccataatattaaaaacagataaacgaaattgttaactaaatttattcaacaataataaacttttaacaatgacaggtcacactttaaatggaaatatgcattgatagactttctcggttgaagttgtaactctagatttatttttgtagaatttaaagatgtattttgttccttttgttgtgagctatgaaattaataccttataattgtaggttttaggaagcggttgatgtatagcatgtgcagagtaagctcgaaatggctgagacgaaaaaaagtgtcgccacaatgatttactttttactactatacttttgatcattgggacctaatggatgaatgttgtgtgttgtggacgagtttatgacacataacaatattgtagacaaattgtctaatttgagtagagatactaaaatttatctccatataattgtatactgtatatgtataacaaataattcaattcattggcctaagatgttttattgtatctttgtagaattttacactttagagaaaaatcattgcaataactcgatgaaaaaaaatgtttatcttatcctagttacaactaactatctatctatctctttgtggtaggagatttgcatctgatcgaacgattcatatggtgccacgtaactatggtcccacttctattacgagatctactaagacatcagcacgtgtcggtgtcgtttgatccacgaggtcggtgacgcttagagctagttgaccggtacagtcggttattaccggttatactatatgtatgttttttggtcaaagatttggagctattttatagttaataaatcaagagttttttttttccacaactaggtcttaatttgtgattgtttttttcttccatttttccaaaattctcttatcaatttcaggttagtatttttgttactgtccctagcttttgactattgtactactgtataccctttttttttggcttgagaaattagattttgttatgtttgcgtaaaatatttgtgaactcaaaaataaaatctctttttttttcattgccgatattttttcttccatgaatgctgctgtaaagtattaatttccctctctactgagtttcttccaaatttctgatttttgggatttgtgcaactcccaagtcgatttcagtttctgggttttgatttgagttcgccgattggatttgaagttttagtctttgttggtaagttctatcctttttgagatgttgaatttgctcttctgataattagggcttctgattattagcctaccaatctttgatttggttttcatttccttcagctaaatatttgtaattcttggatcctgaatgattaaccatcttagtttgattggtgaaagtataccatagctgcttaggatccgtttggctttgttatttgctcagattctgaaaggaagggtttaaagtttcaagcttttcattccgctgaatcagtccttgtatttggacggcttgatctgttatctgctctcgtgggtggggcatg

SEQ ID NO: 18127 - DNA, 3000 bp, Unknown; identical to SEQ ID NO: 6734
  misc_feature (1)..( 3000): 2750-1469P.txt file - cDNA_ID_1815437; gDNA_ID_1621103; Annot_ID_55922

SEQ ID NO: 18128 - DNA, 3000 bp, Unknown; identical to SEQ ID NO: 6734
  misc_feature (1)..( 3000): 2750-1469P.txt file - cDNA_ID_1815437; gDNA_ID_1621103; Annot_ID_171487

SEQ ID NO: 18129 - DNA, 3003 bp, Unknown
  misc_feature (1)..( 3003): 2750-1469P.txt file - cDNA_ID_1815437; gDNA_ID_2926187; Annot_ID_200736
ccgattattcctctgagtttaccgactctaagcacagtcaagctccaaatgtcgaagagactctctcagcttatgaagaaatgggtgatgttgatcagttccattacaacgaaatgatgatcaacaacagcaactggactcttaacgacattgtgtttggttccaaatgtaagaagcaggagcatcatatttatagagaggcttcagattgtaattcttctgctgaattcttttctccatcaacaacgacgtaaattgcgtttattgtaatgtaaatcaaatttctaaggcaaaaccggaaaaaaaatgttttgttttttgttttgtcttaaatgctttgacaccaataaggcaaatagcatatatggttaaaggaatggcaatatgaaagaaaagaaaagaaaagaaaatgatttaaaagattcatcaatatcattgaagattttacacaccagaagtagcaaagccgtaacacacaaagcttttcgctacaaatgcatcatacataaatggagttttgagagtacaaggggcgatacagatgtaacgtggaatgtagaaagtgttttatatagcagaataactgaagtcaacactatcatcattggagacggaaggagaaggagaaggagactcagcagaagcagtgagtaccacaaaggcaccaaagagaatagtgataatggccgtgaagttgataagaaatgcttcggatccatacttgtcaagccctccattctccaagaaagtcagcttttccagaaaccctaaagctgcattcccgacagcaagtatgtaaacaaacaggccaagcattgcgtgccacggaagcaatccgcttttcaaatttgttgatcctcctgggaagaagaacactatgaagctgtacacccactgtaaagttcaaaactcttgttctggtcaggaacaatatacaacaataggtaaaaacatttttccatagaaattgatcaacttgttagccattttctatgaatcagccggtccaatagctttatatacagtgttttctgctgtctgtaattgttctttcagtttgatacagagaactcagaaacatttataaggttgatttagtagctgaaccaaatgaaacacttatcaaaaggattcctatgtaaactgattacatgtataatgggaaaatgtttgtctaaggagcaaaacgctatggaatttacctggaagccataaagagaaatgactccaataccaatccaggaatggagactgtagagattagggatatggctttcattgtggttcttaaaggctgcacagatgccaaatatcccaagagccagagcaatggcatggagtataaggtggatcaacttcttcactggtttctccagcggaagcgatttgtaacttatgatggctgcatttccattttcaacaaacaggtttatataaagtgatcatcatcaacaatactaatcaaaactgaaatgaaagtaatatcttatttctctcgttgttgaacagatgttgttatcagttaccttctcctcccaagattataaatccgatgagcatcagaacaggatgcagctggatcacataagaaaacaaaatggatcagaacacaaacacagacggattaaaaacaactgaagagatgtcccctttgctttggtaacacaacgataatgtcgatttttggatgctagttgtgaataccatcaactaaacctaaaccagaagatcgaaacatcatcttacgtacattcactcacactgtaataaacagaatacgaccccaacaacactcatagatcctaaatcacgtccatagcaaaacttgggacaaaccagaggactattgcttccaaaagagtcattttacaagctataacagatatcaagacaacaaaagaattctcctttacataataaagtcactcactcagaaacagtactgaggaacaaataagaagcttcgcagtcagatacaagacatacaaaaagtcaacgcagatgcgagagacagaaaagagaaaactttaaaggagattaaagaaagaaacatacattgaagatgagattcttgttagtagcttcccaggccaatccacctctgtaactgatactccaaaccagtaccataatcgccgctattaccgccagcgcgtgcgccacaaacgtcaccgccatcgcgtttatccggacagccatatctctttctctcctgcaactgtgtttctttcttcttgtcgttttttctactcttctaatctcctttgtccgattaatcttcaacctcggcctctgagacgaatcaatcctcagattttccatttcttcttttcaataatccactgtgggcccttcttcgcagacacgtgggcctcacgatccattttcgatttatctattcagacgtgtaatttcgtggggcagttctcgataaacgactaatgtttcgccacgtggatattgtagtagctgcatctactagttccgcttccgcgcttcgtgtctgtttcttctaccaccaaccaaaccattaaaccgcgatagagcatactggatcttttttaaggcccattatgtacatttctgttggaccaacccattgcgcaatggaaactattcatatgatatcatttcttgtcgttttcggatttcagtgactgtgttatgctgtttttccaatgatcgaaacggcatgttgttggaatgggctagtgggctaacttgtgaaagaaggtaacatcgacggttcttctcggataaagattaggctgagagcgccacgcacacaatcaagagcctgatacgtggcatgacacgtggtatttcgtaagataaagtacagaggacacagccatccagaggtagttcggctatgcgtcttcctcctctttcccatactctctgactctgtataaaactttgaagaagctcctcatattttctcagaaacaatttggatgcatagaaaggaaaagaacaaaatcaaatctagcaaataaaatg

SEQ ID NO: 18130 - DNA, 3003 bp, Unknown
  misc_feature (1)..( 3003): 2750-1469P.txt file - cDNA_ID_1815454; gDNA_ID_1621104; Annot_ID_55954
tttagccctgtttctgggtcattgtttcttagaggacgaaatgtaaaaggagagttttttaggttctatattagggatacgctgcttattagctcttttgggatgattactcttcaggacgccttatgtacaagagcaagtcagtattggttcaggaccaccaggttctaaaatcaggtggtttaggtctacgagcaatgagtcacgttacatcaacactgttacatttgatgccaaggagggagctcctacactcgtcatggttcatggttatggtgcttctcaagggtttttcttccgtaattttgatgctcttgccagtcgatttagagtgatcgctattgatcaacttgggtaagcaactttggtatcattcaacttgtcttcctcaactgtattagtcacaatatggccttttggttgcttcaagtgttaaagatttcatgctgttgccatcacttgattttaatgtcttaaaaatcgaagacaggatattgctgcccattttaaactacttgtatacattgtgaatgtataataaggtagttctctctttttcttcgtaggtggggtggttcaagtaggcctgattttacatgtagaagcacagaaggtatttattccctctactgttaatgaatcgtggctaaactttcattggtaccctctcagtctcttaatggcttgtatatgagttgatataccagtaatgaaactgcattgttccttctttaattgtgcagaaactgaggcatggtttatcgactcctttgaggaatggcgtaaagcccagaatctcagtaactttattctattaggacattcttttggaggctatgttgctgctaaatacgcgcttaaggtgaattctcatatttggtataactaaattagtaagtggtgacagtttttgattattatgatatctgacttttcattgggcatatctctggatctttcagcatcctgaacatgttcaacacttaattctggtgggatctgctgggttctcagcagaagcagatgccaaatcagaatggctcactaaatttagagcaacatggaaaggtgcagtcctaaatcatttatgggagtcaaatttcactcctcagaagctggttaggtatgctcatataatcatttcccattcaccaataggttgattagatagatactcatttcgttgatacaaatttatggcactcaattgagcatgggaacacttattcgatgaaattagttggcaggagtaatatattcactatatttctgtaaatgtgctttgtgtgcagaggattaggtccttggggtccaggtcttgtaaatcggtatacaactgcaagatttggtgcacattcggagggaactgggctaacagaagaggaagccaaattgctaaccggtaagtaattgtttctttaagttccatagaagttatggagagtgataatgcaatcgctgatagtgatggttcgttttgcaatgtagattatgtgtaccatactttggctgcaaaggctagtggagagttatgcttgaaatacatcttctcatttggagcatttgctaggaagcccctcttacaaaggtatgtccaccaaaaacattgctgataaagtttctgcatactcacactcgatgactcctcttttgtgtgcagtgcatcagagtggaaagtgccaacaacgtttatctatggaatgaatgattggatgaactatcaaggtgcggtggaagcgaggaaatccatgaaggtcccttgcgaaatcattcgggttccacaggtaaatctctaaacacattcatttgttttctcatttaagaggtgaatatagagaagaagatgacgcttacaagagattttgtttgatcgcagggtggtcattttgtgttcatagacaacccaattggttttcattctgcagtgctttatgcttgccgcaagtttatatctcaagactcctctcatgatcaacaactcctagatggtctacgattggtttagtcatagtatcttgttccttttaccttccaaatttattctatatgtgtatacaagtatatatgaaaaagaacataaaaaagaattactttctttatttgaatattcggttgtgtattggagtttcaagtcctctttccatgtctaaaagttctatttgtaacgttcttgatttcactctaaaacctcttaaagtgtttcaaatgtgatctcattatcgacatccaagttgtaatctttcacaatccacaataatcttttatctcattttttacattttacatatgaaacaaaattatatgtgcttgaaatggggaccactaggtctggtaaattcttattgttttagacttttagtcatcaacataaggttaactttccttgtacagcaaggaaatagtgtatttaccgtagcgggaagggtaaagagaggttacaatttggcatcattcttattttagtagagagacctggacttggtggtcgaaacatttccaatggccatgccgacatgttctctctcagacagctcaatcagctgaaaacttgaggaagaagaaactagagagggttttttgacctgattatttattttggctgactcattcttctcacatcccaacaaattttcgttgatatctgtctctgtcttcatttccgacatggaatttgttcaacatcaattcttttctttagctttatgatccctcacaaataaataatgtccctctctcaatttgcagcaaaccgctgacgatcaaaaggtgagccaagtcttttacatgtcgataattaggtttggtcaatgaaatgtttgaatgtttcattcttggtttctgatacgatgagaagaagtttggtttcaacacatttttttgttgttgttgtgatatctaaattctgatcatttcaatttgatcaaatgatcatcaactgatttaagcatccttaaatgggtttggatttgcacaatagagaaatatagaaagcaaggaaagatg

SEQ ID NO: 18131 - DNA, 3003 bp, Unknown; identical to SEQ ID NO: 18130
  misc_feature (1)..( 3003): 2750-1469P.txt file - cDNA_ID_1815454; gDNA_ID_2926185; Annot_ID_140727

SEQ ID NO: 18132 - DNA, 3003 bp, Unknown
  misc_feature (1)..( 3003): 2750-1469P.txt file - cDNA_ID_1815458; gDNA_ID_1621104; Annot_ID_55952
ggagatatcctccagctcaatcttggaacgtccgctacaagaaaatcaaacgaaagtaaatttcaaatattctactcctagggaaatattggccagtagttctaaaaaaaatgcatgtcaaatgttatagtaaatatgttaaatgatagtaagatatttcgttgaggtaaaaaaaaacagaacaatcacatgtaatgatgtaaaataaatagctatagattatatgagttttatttatttattatagatatctattatatattagacgaaaagattcattattgtctcttgaaatattacggttaataaaacctgtttagaggctctttttaataaacacatctttgaacaattctgatatagtgatatgagtacattttgcattaattaataaaacataaacaataatgaatatatatacccgagttcttgaagcggagaaagagtgaggatcttggactcgccattattgtgagacaaaaggatcttccctcgagttgtggtgatgggttccttgtccgacaagcaatagcaaggcttccactcggcttcgaagagataatcagctgctttgtagaggagacaaagaaatgaatcaacgatgtctaagatacagaacacgacgaagctaacggcttcgttcagccatgttcctgctacggtcgctgctccttttatcttcatcacagccatggctcaacaaaagcttagagagtttgatatacaaatcttctttatatatttgaagagagatccgtgatgatttttccacttgtacaattgtgtaatgtactttatctataatatatagaacctctctctgtctttctgtttttctctctctatttgagagttgagactaggagatattatggagagaaacgaagaatcagagagtcgtatgaatgtatatagtctatagatgatacgtgattaatatataatatgatgtcataagttgagattttgttaaagactctagaattactatataaggtcacggatccaccggtttgaccggtctggtattaaaaacattggctaaataacatgtggctgtgagttaattttagactctccttatatgaatttgtcgaaaaatctatatatgttgataggaagatggcgaatttattgcaattaactttattttttatacataaaaaaatggaacttatttttgaaataagaaaataacttttgctggaaacgaattcagaaggttccatagtaatgcgtgtaagagaaactatgtgtattttcttaacttgtgagttgtgaatgaagttgggagtgacaaattggtggtttttgtttcttctatatgtatagatgtggtacataattgtatcacatgactatattattctccatatataaatgttttctatcataattgtacacacagtattgtttgtcttgcagtgaaaacatttaaaactttcttgaatgtacaaaggtgccagattcttcagatgaacaaaatacttagtatggaaaaaacttagaaattgagaaagattggaagataaaagaggtaaataacagttgtaaccaaataaattcaaaacaaaaaaggatataaaaagataaatgtggtttgtgtcattaaacgcccaaagaaaaagaggtgcatggtggttgaaccgtcctgtgaaacagaagaatcagtccatgacttggctttatcaaatgatcatgcacaattcttcatttcaataagcttttattttcttacaaaagtatttacttttccatttgaataatcatttcttgttcctctaaaccttgctaatccaattatttcttatctaactcgtttatttctttgtttcatgacacgcaattatatctattttcagaccaacgtagaggttttaataaacaatatatcaccaattcttttttttgtttgtttgttacattgccgtttctggacgtataaggttttctaatggcgatatggttgattcgtccttatatgtgaaaaattctattcactcgtaccaccaaggcaacaactaatataccattatactagttatgacaaatatatatcaagacttcctaacattccggtgttaaataaataatcgacacatctaactgtaaaacggtacggatcacgtaggttaagaaaatgacatacatgatctttggggtatgatgtctttctatcaaattaaatttgtttctttcactcccgagtgtattttaattttgacgcaatactatttctttgttgtataaatttggatatttggttatcgtactgcgtggcagtccatgcaatttcatatatatatttagaatttttatttcccttggatttgcctatatatttctatctttcgtttagtccataaaatttactacatatactacaatacaaatgttgaatgttttaaccagaaaaagaagaagaagatcaatttccattttaaaaagttcataatttttgttctctctcatgatcatactttggcggggaatttaaaacatgtgttaagttattgattactcaataacagaaatatggatttttagtagtgggccattattgagctattatagcggcccatgcgaggctgaaggtgtcgtgatcggcaagtcaagaaaccctagccagagattgtacagataccaaacgtccgtcgcatctcagatcatcgacgatcttatgtcactagacactagtctttttgtaatacagatcagagtcgctcgtgtttgttttcctctcctattgtgcccaaattttattttgttgttacttgcagttttgcattcaacttgtttgattaatgtctctgagagaccaagttcacgttaagacgtgtctttttactcagaagacaatggaatatgaagagacaaaatgtctatcattttttgaagtgatatttctcatacaagagtgcatttaacaagtaagattttgtcagcaactaagatttgtttgagaaatgcacaaagtttgaaattctagtcattccaacaatg

SEQ ID NO: 18133 - DNA, 3003 bp, Unknown
  misc_feature (1)..( 3003): 2750-1469P.txt file - cDNA_ID_1815462; gDNA_ID_1621104; Annot_ID_55950
ggactaagattctcaagaaatcaggatttgttgcgaaaccattcacaagacaagagaacacaatgattcagacatctgctgttgcttgttacggcatcgctgtcggaggttaatttaagaacataaatttgcttttatttatttcttaatagtttattttcttgcgaaacaagcaaagattcagtgaaaggatctgtgaaacagttccaaacatactaaaatatattaactttttgaaaaacttttgggttagttgagtcacaaaaaagggttgatattgcttttgcttttgggtatgatataaaatctaagttgtaaaattttgatttaaaatatttgagtatttgtttttctttttcaggtgggtttgcttcatatcttctggggttaaaccataagacatatgtgttgtctggtgtgaacttggaaggtaactctccaaagagtgtgaaagaacctggccttggttggatgactgcttatctctttgttgtctgtttcatcggtctttttgtcctaatccctctccgaaaggttatgattgttgaccttaaattaacatatccgagtggtttagctactgcggttctcatcaatggcttccacacacaaggagatgcacaggccaagtaagttcattaacctattttacaaaaagtgatattgttacataagtttcctaatctttaattggaatcgatttgcaggaaacaagtgcgtggtttcatgaaatacttctcatttagtttcttgtggggtttcttccagtggtttttctctggtattgaagattgtggctttgctcaattcccaacctttggtttgaaagcttggaaacaaacgtaagcattaattatacaaaaacaaaacaaaaatatttcagtgaaacgagttcttgaatcatataataactaaaaacttttttttggtaggttcttctttgatttcagcatgacatttgtgggagcaggaatgatttgttcacatttggttaacctttctttgcttttaggagctatcctctcttatggcttaatgtggcctcttcttgataaacttaagggctcttggttccctgataatctcgacgaacacaacatgaagagcatttacggctacaaagtcttcttatccgtagctctaatcctcggcgacggtctttacactttcgttaagatcctctttgtgaccattgccaatgtcaacgcaagattgaagaacaaacctaatgatctagatgacgtaggtcacaagaaacaacggaaagatctcaaggaagatgagaatttcctcagagataaaatcccaatgtggttcgcagtttccggatatcttacattcgctgcggtctcaaccgtcgtggttcctctgatatttcctcagctcaaatggtattacgttattgtagcttacattttcgcgccttctctggccttctgtaacgcttatggagctggacttacagacattaacatggcttataactacggcaaaattggtctttttgtcatcgcggctgtgacgggaagagagaacggagttgtagccggactcgccggttgtggactgatcaaatccgttgtttcggtttcttgtattttgatgcaagatttcaagacggctcattacacgatgacgtcacctaaggctatgtttgctagccaaatgattggaacggtcgttggatgcatcgtgacgccgttaagtttctttttgttctacaaagcgttcgacattggaaaccctaacggagaattcaaggctccttacgctttgatttacagaaatatggcgattcttggggtgcaaggcttctctgctctgcctcttcactgtctccaaatgtgttacgggtttttcgggtttgctgttttggtcaacgtcgtcagagatcttactccggcgaagattggaagattcatgccacttccgacggcgatggctgttccgtttcttgtcggagcttatttcgcaatcgacatgtgtgttgggactttgattgtgtttgtttgggagaagatgaatcggaagaaagcagagtttatggttccggcggtggcttcagggctaatctgtggcgaagggctttggactttacctgcggcggtgcttgccctcgccggagtaaaacctccgatatgtatgaagttcttagcttcataggatcagtcaaagagataagaagacttgtgaagttagagtacttagaagacgtcaatgatattaaaatcatcctattcttagaataacaggtagacttctgaacaagaacatctcttcttctaggaattaagactaaaatctacttacatccggatgattcatgctctgttttttggtttggtataatttgtcaacacatctagatctgttccatttccggttatcttctattgggttatctctgaaactgttatgggctcggcccataaatttaaaccttggtgtaacaaaaagtaataaaatcagctatttaatcctatatatttgtttctttttttattatataggaagaaatccttgcctttagattgcatacactagaattttagtattttcaaaaaagaacactatatttcaaataaaaatggtatatatgataagttttgttaagatattatattcaataaattgcctaattcaataagcatattttagtaaaaaatcgcaaaatattcatcatctactaaacaggtcaagatgtatttgactatcttaagaaagaaatattaattcactttgaccaaataaatggacaattaggtaaccaaacaaaaaccacatgaaagtaacaagacagagaattaggcaaaccaaataaataactcacacaacccaccgctcaaccacctaccccttgtaatatatctctccccttcttctttttatttcattatcttccaaaatcctcaccacaaaacattatataatttcctcttcatatttcaagaaaactttaatctttttttgtgtgtagaattctatatttctggtaactaaatg

SEQ ID NO: 18134 - DNA, 3000 bp, Unknown; identical to SEQ ID NO: 6209
  misc_feature (1)..( 3000): 2750-1469P.txt file - cDNA_ID_1815462; gDNA_ID_1620864; Annot_ID_51303

SEQ ID NO: 18135 - DNA, 3003 bp, Unknown; identical to SEQ ID NO: 18133
  misc_feature (1)..( 3003): 2750-1469P.txt file - cDNA_ID_1815462; gDNA_ID_1621104; Annot_ID_171527

SEQ ID NO: 18136 - DNA, 3000 bp, Unknown; identical to SEQ ID NO: 6209
  misc_feature (1)..( 3000): 2750-1469P.txt file - cDNA_ID_1815462; gDNA_ID_1620864; Annot_ID_170413

SEQ ID NO: 18137 - DNA, 3003 bp, Unknown; identical to SEQ ID NO: 18133
  misc_feature (1)..( 3003): 2750-1469P.txt file - cDNA_ID_1815462; gDNA_ID_2926184; Annot_ID_140724

SEQ ID NO: 18138 - DNA, 3003 bp, Unknown; identical to SEQ ID NO: 18133
  misc_feature (1)..( 3003): 2750-1469P.txt file - cDNA_ID_1815462; gDNA_ID_2926184; Annot_ID_200509

SEQ ID NO: 18139 - DNA, 3003 bp, Unknown
  misc_feature (1)..( 3003): 2750-1469P.txt file - cDNA_ID_1815466; gDNA_ID_1621104; Annot_ID_55949
actcacacttcttcaaaagcgaatttgcttgtaacatgttaatataaaattattattaaatctataggattgtccttaatgggccggccttttacgatataaaatttggttcaaataaatgtcgaatacgtcttttcgttcagcccatgaattgactaaacaaaggggattagaatccaaacaatcaaatttcttctatagtttagtttagaacaagaccatgaccatgaccaatattatatatatcgattattcgtttttatatgttctatatgcttaaaccaaacttaaaatgtaaaagaaaaacactgtgaatcattttcagagttatgatgtattttgttaggaaaccaaacccctgttaaaaactaatactgaaagtctgaaactatgacgatattcactttcaattggattttttttttctatttgatttaaggaagtacttttgaacccgaaaactaactgaaacttaaccacacacaaaaaaaaaggatttgtatcttatattgaacactacagaatttcgacattagattttttatgattttggttttcataagagtttaaaaatgtgatcatctgttttggacactgcaaatagagattttaaaacaataaaccaagtagatataatagtccgtatagtttgtccttatatataacattataggtgtaaaacacggactacataaaagtggacacataaatgcaaaattgttactacgaaactttacactgcatgtgactgatattttacgctcattacatttggatcattcgtagtgataaattaattcagggtaacatggcaagtaagtgagaacgtggtcattaatttcccccaactagttactaaaataactaaggtaaccttcgaacaaaaacaaaactttggtaaaccaaaatacaaaaacttaggtaacatgacaatgaaagtaaagaatatatagtacttgttgataagaatatagtactcgttaataaaacgctgtcggtagaagcgggtttggacgcaatcgcaggaattagatggaaaacaaacaaaaaagaaaaagaaatagagttttagcaaagagtcaaaaagagtcattttcatatatagtttggggtcaatgtagggctataggaggataagttgtgactttaagagtgaatgagattctttctcaaatgaatggtgtcaaggactagtattcattttttcttctttcgtctccatccacctatcaatatccccaatcttttttacatttttgaaatgttttttgttttgttttgttttcctcaattttagataataagtagacgaatctaatccctactaggcctaatccctatataatacacgcattttatgtcatattagaaagcaacatgttagttgaaaagtttaaagtgttttggtttcagctttgtacccactattagattttaattactaatttttttttgtaactgatttatcgtttttagtattgatagatgttaggaactttatatcaaaaataaggtgagacctaatgtataaaagagaagcaatcaacacattaccaattcagtttaaatagaaaatttgctaaacttaaccccgcatgcccttgcgtaaagcattcaaagcacaagtgaaaataaacccacacttcagaagttatatgttagtcaattgtctaattttgattgctattttccttttctctttctttattttcttcatcgccgatgtggtgttccacaatctattattcacgtttacttaggttttgttaatatatattttcttcccctcctacgtgttttcaacatattttcattaattttctctattttcattctgggaattagatctttaacatcgtcactactcatcactgtcaccagtaatgagaaaaaatacaaaataaaaccacacactctcaaagctggatttcttgtcattgaactatcgctaattaatactgtggaactcgtagaataatcaagacgaagggattgcgtagaaagagaaacgaaaaaaaagaaagaagaaagtgcattgtccttgtcatgacatgtggaagtatcggtcttatatggtccattgagccacactcatttagaatctcactactttttcaccattttcacatctatacacgattatagcatctatatacatttactttttcaattattctgctattatgggttttggatattcatgtcctaatcattataattctcttaaacaaatatcgaatttcgaatattttttaaggttattggctatatgtactatatttctatagaatagtttttgttaatatcatcgatcgatcttcagtcttattttgaactatctaatatattcagtggcttttcatatggacataaaacctaggccagtgtcgaaagttcataaacttcgaagtcaaaactagctataatggttatctttgaaaagtaactcaaatataaggagagtagaaattctacacgtaatgctgtccgagacatttaattatggacgatgtgattgcagaaacaattttgttttcaaaccctctcttgatcaaaaaggacatttaaatcattgcatccacttcaaccacacacattcatttggctgtaataacatttcaaagattcttacaaaacaagtgaaatgtcattaaatgtccttttagaacaagatgctaacgacaatctacttggccacttgacttgtataccaaatttctcccaactttttgttcacagaatttgcgtttacaactttggcgtttgtgttttgacggattcgtctaagtgggacaatgcgcgtgtcggacatgcgcacttaagagggtagagacagtgagttctttagctttccttatattctctttcaaaccaaaaaagagactactattttttgtacacttagactaaggaaagcaaagtttcatattcctaaaaattctggttttataagtatcaaagacaaattcagtctccatggaaatagagcaaagaaggatcatg

SEQ ID NO: 18140 - DNA, 3003 bp, Unknown; identical to SEQ ID NO: 18139
  misc_feature (1)..( 3003): 2750-1469P.txt file - cDNA_ID_1815466; gDNA_ID_2926184; Annot_ID_140723

SEQ ID NO: 18141 - DNA, 3003 bp, Unknown
  misc_feature (1)..( 3003): 2750-1469P.txt file - cDNA_ID_1815470; gDNA_ID_1621104; Annot_ID_55947
tcgggtcaaccgatgtgtcgctgtacaagaaggctgtggttgatgaggtcaacgcttttaaagcgtagtgtcggaattagattagagtctgaataaaacgggaattagagtgctttgtaataagtgatgagtttatgtaccccatgattatcttctactttgttagttatgtctactactttgttagttttgacttttgagcaagtcttgttaagattcgcattatccaaaagaaaatttaaagccgcattaacagtgtttagctctggtgttactaaagaaaaagtgattatgcgggtcaaacacttctcaaatagtttgctttgatttctttggagaactgaaatgcatgccgtttcgaaatattagaatgcatgtcgtttcgtggatttcagtaccagtaaaggctaatgctgatgcatcgttgcattttaaaaatcgtgtcgtttttcattccgttttagtggccactcttcgcaaccagataagaactcgaagattttctttttctttatcaaaatgcaatctttatctctgcaatcgcttccatggaaaccaaattcagtgactttacctgaaattaatcttttgaatcccaagcaattgactgcctcgagttctcagtatcgtagaactcgaaactggagaattagaagttcgtcggaagataatgtagcaatttcgagtgacggcggagatttgaagaattctctgtccggtattgtgggaaatcaagtggaggagctattgagcagagaagagaacaaaggtttgcttgatggtctggaaaaagcttcgttgagagtggagattgcgaagagagagctcgaagatatagagagacaagaaattgaggcgaaattgctacaggattatattaatcagctcgaatcaagagccgcagaggtgagagcttgttctcgaaatggtgttagatatgaaaatgattgaacatttgattcttttgctctttggaatttgaggtttttgggaggttctactatagagtatagattaaggttgcattgagaatgattggtttatattacaatggactagtgaatttgtgcagtatatatttatatgccaggataagctcaagttgtgcattgtatgcttaggataggataggtaattcaaagtatcaatcaatatcaatggtgttgcttttgtgcttgaaacctggaaatggggtttctcttagtttgtgtgaaggtacttcattagataaggttactaactaaatcatgagtttggttgcattttgtgttttctcgtgttttggaacaaagtctctagtttggttttgtatttgtagacagagcatgttaatcttattcaatatctgattcaagattgcagaatgccagcaggagattgacgcagcaagatcaatggttgaggaagcagaacgctccttgtcattagcagataactcgacaattggaagttcggagaaaggttattcgattgataaagacaaggagaggttagaatctgcaaaagcggcagtgatcgcagctgcggttgggaccattgcggaactcccatttgctctttctcaagtcgcaagcatggagcagcttgttctgcccctgggaatagcgtttgcaagctgtgcattgtttggagtcacattcaggtatgcagtcagaagagacttggatgataatcatctcaaatccggagccgttgcagcttttgggtttgttaaaggtaacaacacatttgattactgtttctatctaacttctttgaattgttcaaaagcaattgcgttttgtgattgaataagcttaacagaaatggtaaaagaaaaagactttctttgtctttgtcatgttatatattgtgtggaagtatgagctggcaaagttcccatcgttgtcccgccctttggttgtttttaaattataatctgccagtaatagattactaatcaacgatttgatttattctaaataattgatgagttgattattagtctctgacctgtattatttggatctgtctttttttaaaaacagatttattatagattcgattttttttaatgtgttatataggacttggtatgttgagcagaggaccgccattggagctgagctgggaaagcttgttttcacatgggatagacggcgccgttttggtgtctcagagcgtcttgatatttgcgtttgcgtccataggtttggacttctgtttcaagatgaagctcttaagaccatttcctagctctgactagattgaagagcaaattaaaaatgtagaaatgaacaaaatcttcttttgaagactttatttgtttttttttatattattaattttggtctaaaatgtaaatgtttcatcctagatttttatgatctttaacttgtcacaaaaaaagttacacctgattttaaaagcatgatcataaggaatattgaatttagaatgatgaatccatacataattcaaattttgctataaaaaatgaatcagttgggataattctttcttttaactttgtataaaaagttatgaggaatatttatctttgtcaagtgatgaagtgattagtgacttgtgaacttaaccaaagaggtagatggggtcaaggccattcctagccattcattatttatagtaaagccacgtgtaataatcttagaagcttacagatataccacgtcagcacaaaacagttcttttgtctttcgatcgctctcaaatcgcgttttgtcgtggaggtcaactgatcagaaaaatatagcaagcagaaagtgaaaaacagctgaattattatttttctatacaaaaaattaaaaaattagtatccaatttcaatggggtttcgacttgttctcgagtaaactactagtctctatctctctcagctccagattttgtttcttcttcttctgtgttaaattcatttgatttgttgtatctgaaggcgaaattactggtttctgatttttggtggtattcagggcggttttaaagcgacggaagaagatg

SEQ ID NO: 18142 - DNA, 3003 bp, Unknown; identical to SEQ ID NO: 18141
  misc_feature (1)..( 3003): 2750-1469P.txt file - cDNA_ID_1815470; gDNA_ID_2926184; Annot_ID_140721

SEQ ID NO: 18143 - DNA, 3003 bp, Unknown
  misc_feature (1)..( 3003): 2750-1469P.txt file - cDNA_ID_1815474; gDNA_ID_1621104; Annot_ID_55946
gtacggtaaagacaaactctcgatgtctctgaaagatacatgtctgcatcctcaggcgagtctcttcataagcaaaaaccagataattctcttttgtttcttcgtttttatgtttcgtatatgcatgagaatcttgagcgcttaggttagatataatgtaggggatcctctagagtcgacctgcatttggtactcatgaaaaaaaaaaaattggttgattatttttccaaacataaacgatatactagtaatcttgaatgcacaacacatcaatatatgaaaaaatcattaaaatctcaattaaataaagagctacattatgattaaacaaaaaaaaacttcatggcgaaataccgataaatatagcaggagcgatatgctattctatagaattaattttcataattagatagttcataatagaaaatagttaagaagcagtaggatgaacccgatcatgataaccaatacaaccccatagagcaaacgcgatgaggatgatgaccataaggatggtggcaacgattgttacgatgaacgaagtatccatattgtttcttcaccgcaccaaattttttatttttttctaacctttcctcgtgtcttcttcttcttgaaattacatttatattgtaagtaaattggaaatagtggaagtaatttacattttgtcatcaagaaacatactagcaaattttttgaaattttacatttagtctcttaaaaatattacctaggagtaaaaattttgtaagtaaatcgggaaaagtggaagcttttacatttgtcatcaagaaacatactagcaaaatctggaaaattttacatttagtcacttaaaaatattaactaggaatatatataatagaaattttacatcttttggtattttgttggtcgtcaaagtaaacatgactatgttgattcgcttgtgcggttgtacgaagacaatgtactgtagagacaaactcttgatgtcgacgctatctggagactgcagtcttagataaccttttcatcgagttggaaataattagagaaaccaaacaaaatgcaagaccaacttaattctcttctcttgtaattctggagcttaagttagagattgggtgttgtcatattaaatttgttaatcatactgattactttcactcacatttgttcttgttattgtttatgttaaatcgtcactcacattgtatgcacatgtcagattcagaccaatgttaaaagtgcattattttgtttggaagcgtgtgagaaaacaaaaagtttatgtacataacataaatccaaaagtactactcgaataaagtacaaactttatatcttttaaactccacgtaataactcatttttgtttgttttaatcaaaaattcaaacgtctaaaatttcgtcttaaataagaaatgatattaagaaaaatatctttggattaataacagatcaccgaaaattagaatatggttttaccaacccaattaaattctcaaattaattggaaagagaataatgttgacaacaacaaaaaggaaataaatcgcatgcaatgaaaggaatgaatcttcttcttcttcttctctattaacgcttcttcttcttctccttcttcatcaccctcctccacttctctcagtcacaatggcgaccaaaaaatctctgaaatcacgtctccaagatggagaaaagcttctcggccactttcttctctccttttctccggagcttgcagagatcgctgcaagagctggatttgacttcattgtcgtctaccttgagcacggtgccggcgggattcgtgaagcgcttcactgcattcgagcaatcgaagccgctggttgctccactgtcctccgtgtacccgacattagtcaggcttgagctaagaaagcgttagatctcggacccgacggcattatgttcccaatggtcgaaaccggaagatctgcatccgaggcggtctcgttttgcctgtatcgtcctgacggtgttcgcggctgtgcttactccgttgtgagagactccagcttcggatttaacgaagggtatttgggtaattacgctgataagctcttcattatgtgccaggttcgatcctcaaatcccctttgattttcaattttattggacgaaattgttaaattgaattctaaaatgcctacttgtgaaaaaaatggaagttagaatttttatgcaattgatatattttgtgcagattgaatcagaggaaggtatgaaaaatgtgaaggagatcatagccgttgatgggatggattgtgtgatgatggggccgagagatctgagtgcgagtttggggttacttaacgatccaggaaacccgaaggtgaagtcggtcatgagggtggctgagacggcggtgttggcctctgatccggcgaatggtggagcttacttggcagggatggccacggctcaggacaaaaccggtgatctcaaggcacgtgggtatcacgtggtgctcgggtcaaccgatgtgtcgctgtacaagaaggctgtggttgatgaggtcaacgcttttaaagcgtagtgtcggaattagattagagtctgaataaaacgggaattagagtgctttgtaataagtgatgagtttatgtaccccatgattatcttctactttgttagttatgtctactactttgttagttttgacttttgagcaagtcttgttaagattcgcattatccaaaagaaaatttaaagccgcattaacagtgtttagctctggtgttactaaagaaaaagtgattatgcgggtcaaacacttctcaaatagtttgctttgatttctttggagaactgaaatgcatgccgtttcgaaatattagaatgcatgtcgtttcgtggatttcagtaccagtaaaggctaatgctgatgcatcgttgcattttaaaaatcgtgtcgtttttcattccgttttagtggccactcttcgcaaccagataagaactcgaagattttctttttctttatcaaaatg

SEQ ID NO: 18144 - DNA, 3003 bp, Unknown; identical to SEQ ID NO: 18143
  misc_feature (1)..( 3003): 2750-1469P.txt file - cDNA_ID_1815474; gDNA_ID_2926184; Annot_ID_140720

SEQ ID NO: 18145 - DNA, 3003 bp, Unknown
  misc_feature (1)..( 3003): 2750-1469P.txt file - cDNA_ID_1815488; gDNA_ID_1621104; Annot_ID_55941
tttcttatgatgtgaaataacatacgttagtaagagtgtgtttttccatagttggtacggacgaatatatctatttaatgtcactatcttatttatgtcattcgaatgagcattctttgtttaaaaattttatgtttaaaattttataatattgctttaaataaaaaaaaataaaaaaaaaagtaaacgaggaaatatggatctacaacagacggattaaatcatgtaaataaaacttaaaaaaggggatcaaaatggctgccaaaaaaaaaatcggatcaaaatgacatggaactaggtatgcatgtcaaaacaacttttaacagcatgaaaactttgacttttgaggttaagaaggatagagataccaaatttgcttgctcaaagaatatagtactacattgtttaaaaccgaaccgaaccaataacccaatatgtttattaatttaattaactaattatattaataatattgtaataactaaactaagtaattattatctacaaaattctaacctttaaaaatctaaggttctacttctaactaaataactaaactaaagtatttattatttctaaaactttaactcttaaaaacctaaggttatacttctaacttctaaaaaataaaactcaaaaaaaaactttcgtatttcatttgttctttcgtttatacggctaattgatttttttgaagtaaactaataccaaaccaaatccaaccgaactaaaactggttcaaacacaaaccaaaataacttcggttgagtatggttagagtattacaaaacccaaataaaccgaacccaaaattaaaccgaaatgcacccctgataaatattattactatataaaatatatataactttaataattacataataacacctaaaaatgacataaaaagcaaaaatcccataatcatattttctacaaaattgtaaaacgaaaacctttatctgcgcatccagggaatcgaaccctggtcagtaccgtgggagggtactatgataccactacaccagatgcgctatttctgacaaacaataatcgttttatatacttatatttacattttctcggttcaaaatcgttattcctgtaatatattgatccatcccacgatcttcttttcttggtcgtcttctgaaacgctaatcggatccagaagccatggacaaaagcatcagcatcacctccaacgttagcacgacgacttccatggaaaagatcgaccacgccgctagctggatcagcgcaaccgtaatatccgctttcttcacctccctcgaacgctgcgcctgcgtcaatctctccacctctcatgacgacgacgacgacgacgacgacgaatcccatcaccgtcctctcgctctctccgccgctcctcatccaaacgacaccgtttagctctgttttttaacctctggtaatttataaatttaatccctcgtttgtttcttttgataatcgattggtgtggatttgtaatttcttgatttgaaaatgtatgtctactgtgtgtaaatgtgcatgtctcagaatttgattgttttgcgtgtatctgactttatatacttgggtttaaaatcagaatgaatcatcgtttttgcatttacattgaaaaaatatcaagaagagaatttggtagagatcatttgtttgttttgaagttttcttttgtgatcaatgtttctcgatttacctttttcatttcatttctgatctctgcgttcaactattaaaaccggaacagcatcagtttcatgttttattttgtcaatgtgtcagagatcctgtcactttagatttcatagtttcaaaagtgattatttgatcatgtgggtccctgctgtgagaaccagtgggcactggcctttagtttggttaaaagcaggattcaaaacttcatactagtttctttgttctaaaatgtatttagcctttttcaaactcaagttgcacttgttgtacaaaagacacttttcttttgaatctaatttaacattacattcaaaaaaaaaaaaaacttcatactaagtaaatgtcgtgtttgatccaaacttttcccaatttgtttgcttagcagggtgcaatcttgtttaaatatctttgtcatgtataatgtgattccatctcttcatccatatagagaaaatcttgtttaaatgtcttttgtcatatgaccatattctcacttgggtttctagaaaaagttttgggttctttgagtttgttgaattggatctccttatggcttagaccgtcgttccaactgctgaagaagcaagtatgttgactcaaaacagtcacgttatatctctgtctctttgataattcttggcttttatgtgttgggtgcctagtatcatttgttttaaaggtttagggaacaaaaggtcataaactataataagaatactttttacaatgttatttcctcagcaaaagtagcacgcattcacattctccaagtttcatcatttgttatttatgaacgcaaacaaaaaaactgtactattaacaagcttttgttaagaaaaaagtaaggaaaccctcttaggatatgtatgtttcaacaataagcttatatctttactcattaagcccactagacaactttgtgagatagatcttataagaagcgtatcactttatccccgtgattacttctcaaaacaacgagttttgatttgtgctactttattaaattcacgttctgttttcagaaattttgttttttctgataggttcgtattgaaattgacctctttggaaactggatctttcataagatagaaagagaggtccccatttcccaagtttatcaaacaaaaagaaaaaaaaatctaaattgttctcatcttgagacaaccaatcagaatgaaccatctgagtcagccaaagggtttaatagtcaccatttgccaattgtattcatactctttcctttttggtgcgttattctaagagccctagtcagaattcaaacatttggcaatg

SEQ ID NO: 18146 - DNA, 3003 bp, Unknown; identical to SEQ ID NO: 18145
  misc_feature (1)..( 3003): 2750-1469P.txt file - cDNA_ID_1815488; gDNA_ID_1621104; Annot_ID_171515

SEQ ID NO: 18147 - DNA, 3003 bp, Unknown; identical to SEQ ID NO: 18145
  misc_feature (1)..( 3003): 2750-1469P.txt file - cDNA_ID_1815488; gDNA_ID_2926184; Annot_ID_140715

SEQ ID NO: 18148 - DNA, 3003 bp, Unknown; identical to SEQ ID NO: 18145
  misc_feature (1)..( 3003): 2750-1469P.txt file - cDNA_ID_1815488; gDNA_ID_2926184; Annot_ID_200500

SEQ ID NO: 18149 - DNA, 3003 bp, Unknown
  misc_feature (1)..( 3003): 2750-1469P.txt file - cDNA_ID_1815496; gDNA_ID_1621104; Annot_ID_55939
aatggcttttacgccggataatgagaagctcgagtaaagtttttgaaaaaacgttagaatagtgattgacaaattgttgaatactataatattgaagttgatctttaggaattacgtcaatttagaaactggtcggtagcaaattaaaatgtgttgtattgttgtatacgtttggttacgtgagacttgtataaatttacttaattgatataactaaaaaaaaggacttggtgtggtcaaatacgtgagttaattgatgttgcgttgggttctttacacctaaagtttagccagcaaaatctgtttaaattttttaaaaaacttattaatttgtaagtaatctgtttcatggcagaacgatcatacatatatatatatacggaaatcttgaaagaaatcgagacgataattccagatcatgtgatgatggtctgatggatctcatataacttcccgaccactacttctgtattgatgtataaacgccaaagagaatggtgagggtgacatttcttgtctaaaataatttaattgaaatatttaaactcgaaattaaaagatgacatattctacaactaaaagtaaatgaggttgtgggttttctttacatttttaatcattttttatggttgaattttatgattatcataatcataatacacaaactatcgaaagtggaacccgtatcacgatttttttgcctttattttattcgttgcctattaaaattaaaaggaagactaatgatactatcgcctgttccatttagatcctacacttcatgcttttttatatttctccttttggacatctaacatgtttataattactatagcctttaacgaaattttaagaaataaagccagcctataaatgaaatacaaaacggatcatatttgaggaagaccaatgtacatatgtgttgttatttgaacaaaaatttgtttctaatttttttcgaaattaatcttaaaagaacaaatgattcttatcagactttcaacaatattgatcatagtcgaaactcaaaatttcaagccaaattagaatcttaaaacctaacaatgaaaatatatgatccctcgtttacaaaaaaataaaaaataaaaataaaatatatagatatgatccctagtccttatttccgtaccaattatgatattgagagatagttttgggataaccattttcgtttactcgagataaattcactcatcagtttaaaataaaccaaaaccattaccacataagattcttatcccaatttaactattatatttctgctaattaattgattacatgttgtgaagtataaattgggccaactatagaggaatggtgtttgtttatgttttattttggctgctagtgtggttttcttaacttgttagcaatcattttactttttgaaaaaattgttagaaaactattaatgtgaatagttatttactcaataaatcttattgttaaccactgagaatttaaagcatttaaacatctgattattttaattctatgttaattccaggcattaaattttaagcgtaatttatagaagaagaaaaaaaatctagttacattccatctaagataggggtacaaatccatacaagagtctatcttctgtaattcttagcaagttgaacatttcttaatttttattttattttatttttggtcaaacgttttctttaatacaagtggcaaagatattctataacagttataatcatttatagttagggattttttaatcattttgtagtatttgtttttctcttttttcctaacaaagtttttggaacttttgatcatctctcgattgaaagcgaacatataaataatttttactactgcaaatttttaaaaagttaatattcgactttataaaagagatgagagtcaacaaaacaaaaagcaactaattttggacgtacgaaatgctttgtaaatacattgatatcacttatgtttataatatcactcatcccaagtgttggtcaacatttctttgataaaaattaaactattcaatagaacgaaaaccacaaaaaaattataaagaattattgataacaactcttcatgttaatcttatatatttttttaaaaatatttgtttttaggttttaatacaaacaacatgattctagtttattaaactaattaacgcaacttgatggattataaaaatatagcttaactaatccatcaaattaacaagtgaatcgcactataattctaaaagaatcaggtaggtccaggatttgtcttttctccacttctcaatttcccattaataatcccgaaaaggcattacgtaataattaatattttacgctgtagtattattttatgataaacatttccaaattttccaacacttaatcataatttaaggattaaaggaaatttgattggtgcattcccaccacgagtttgcttaacgtgtcgttaaatgcagccgtcggacttgacaatgcaaaaatgctacataatctaaataattaactctcgcaataagattcactaataataacatttttaacgacgatatataattttacaataagaaaaaaaatatgaatctaatatttatttaatattaatttactccattatctgaataatctagaatatgtcaaatatccttttattattttgtagctgtcgaaactatggtgaataaaatctcgaggaatatattagaaaacaaaaaagatctagaggaataataatattttaaatatttggggcacagttgtattgtgaagcagagaatcggttctcaatatattatccgaaaatgtcttaattttaaattttgttttttgtttgattctgcgatattggaatcacacactctgccaatttgacctttctctctcgcttctctttctctatccaatcggaaagagatcaaccaacgatagaggagaagaagaacttgcatacgcaaaaaaactttcccgggaaaattccagaaactgctttggaaaaatg

SEQ ID NO: 18150 - DNA, 3000 bp, Unknown; identical to SEQ ID NO: 6214
  misc_feature (1)..( 3000): 2750-1469P.txt file - cDNA_ID_1815496; gDNA_ID_1620864; Annot_ID_51312

SEQ ID NO: 18151 - DNA, 3003 bp, Unknown; identical to SEQ ID NO: 18149
  misc_feature (1)..( 3003): 2750-1469P.txt file - cDNA_ID_1815496; gDNA_ID_1621104; Annot_ID_171513

SEQ ID NO: 18152 - DNA, 3000 bp, Unknown; identical to SEQ ID NO: 6214
  misc_feature (1)..( 3000): 2750-1469P.txt file - cDNA_ID_1815496; gDNA_ID_1620864; Annot_ID_170426

SEQ ID NO: 18153 - DNA, 3003 bp, Unknown; identical to SEQ ID NO: 18149
  misc_feature (1)..( 3003): 2750-1469P.txt file - cDNA_ID_1815496; gDNA_ID_1620724; Annot_ID_165914

SEQ ID NO: 18154 - DNA, 3003 bp, Unknown; identical to SEQ ID NO: 18149
  misc_feature (1)..( 3003): 2750-1469P.txt file - cDNA_ID_1815496; gDNA_ID_2926184; Annot_ID_140713

SEQ ID NO: 18155 - DNA, 3003 bp, Unknown; identical to SEQ ID NO: 18149
  misc_feature (1)..( 3003): 2750-1469P.txt file - cDNA_ID_1815496; gDNA_ID_2926184; Annot_ID_200498

SEQ ID NO: 18156 - DNA, 1554 bp, Unknown; identical to SEQ ID NO: 6785
  misc_feature (1)..( 1554): 2750-1469P.txt file - cDNA_ID_1815504; gDNA_ID_1621105; Annot_ID_55974

SEQ ID NO: 18157 - DNA, 3003 bp, Unknown
  misc_feature (1)..( 3003): 2750-1469P.txt file - cDNA_ID_1815508; gDNA_ID_1621105; Annot_ID_55973
acaatgcgactagcagaatgtatgtactacataatcagattttatatattcttgataatctcttacagattttttataacaactgattatatgtaatatatgagtttagtgtcaaagaaaattatgataatatttttagaatcttgaaaaattaataacaagttatttacgtatggctgtggctgcttcattagtcattacgttagtcttttgaaattttcatgaccacaagaaaatatttcttccggttttgagatttttcgtaacaaacaaaattgaataatcgatgtacatcactaacttctacgtggcttgtgaccaagacaaatgactgtataaagaaaagaagtcgtcgttagggggaactcattttttatatttctagggctgatatttgatttgacaaaaaatattgtccaattatatgaaaaagtattacttaacaattcttctaaccattataatgaaaacatttctagggctgatattttagttttttgtaagaaaatcatgaaatgcattttgttttgtttgttttattacatgggccaagatatgaactctcaatttccaaatacagagacagctgaagatcaaaggataaggagtattttctttttctgtatacgtttcttggtttcatatgaacaaaattgattatgagaaaaagaaacaaccattagaaatatttattttatctagctatcttcaattattttgcctaacttgatgtgtcctttaggctttaaaaaaaaaacttgatgtgtccttttaagtgacacatcaatgaaccatatgtatagtctcttgttgttttataaagatcgattgaatttgattttcctctctatctatacgtttttgtttgtttaaaaatgtcaaaaatttgggtatccaggatgttcgaacgcaggacacgtatgaagtgacgtctttcaccgccgtaaatctttggattgacagtccggtaaaaacagattaatagcttgatagtccaaaacgcacgtataaaagtttttgcatgttgaaaatattcgtatccacacaacattagagatcaatcatgaaaccgatatattgaaggtcacccgacgtcaaatttcccctgaaagggacacctcaaaattacgtggttcgtgtaatcttttttcctttaagatagggatcggattatgcagtataaaattaagcaaatcgtatttggtgatatatcggttctaatgcataacatcttttatattcacacaatgaaatagctatttgttttcagtttcgagctaaagcccaagctccagcccaaatcaaacccatttgtacaaagaacctcactcatctatttgtgcacaaattctcggatttctccaacgctctcaatcattttataaaaattagaattatcttcaatctcgatatacgaacctaaataattgaaaacattttttttctttttatgtatttttcttttttatcaaatttctttttatgtatataaaatatttgtgaaagtttcttccacacatataaaagattaaatttctttttttatcccaagcttgaatatcaaaacatgagacaacaagagcaagtattagccaccacaaagcaatcatcttaaaactcaaaccccaaaacaaacaaaagacaaaacccgattgtttcgagcacaaacgtcacttgtggtttacatcgtcttcatcatctccataacttcatatctcctctccttccgctgccaccgttagcgatgtctttggacactgtggacaaactggtggtgttcttggccaagagagacggaatagacaagcttgtgaagacattccaatacgtggccaagctcgcgtgctggcatgttgaagccacacgacccgaagccgccgataggttcaagaagtgggaggtcgcctccggtctcagccgcaaagccttcaggtcccacatctttttaatattaatcactttatcgacaaagtggcatcatcgtaaatatagtttaatagatgaaatgaaatgaaatgttttagtcacttcttgattaatatcttatctcatctagcatatttgaatagtgactagtacgatacactttatattacaagaaaaatataattgaatagtgattatggtcgaattatgcgaacaggaccgggagatctctcacggggttcaatgcgctgagacgaaaccccggggcaaccccgatgatccgtttcttggcggtcctagccaattcaggggaaatggtttacttcttctttgatcattttctttggttatcaagaattggttcaatagacgccaagctcgccaagaaaatgagtttcatatccgcttttggcgaatctttcggctacactttcttcatcatcattgattgcatcttcataaagcaaagactcaaatccttaaaaaagctccagcattcgaccgatgaaccgaaagaagaaatcggcgccaaaattagcgagattcggggagatatagtaatgaggttgatgggaatttcagccaacgttgcggatttacttatagcattggcagaaattcacccaaaccccttttgtaaccacaccattacactcggtataagcggtttagtttcagcttgggccggttggtataggaactggccatcgtgagatgtaataaaatcaaatgtttgttgttttgaatgaacgtatcaaacgtgtaatgtaactcacttgaatatatgaaacatttctattttacattatctatagtcaaatcgaaatcaaacaaaactaagggtatacaaaagtataatccacatacgtgggggacatttatgaaattcataaaacttggtaactgtaaaatagtaacttcccactctctcaccctcttcactgggacggttatttttttttttaaattcatttgcatcaaaagtcgttaccttccagtaatatttatagatttataacgatgcaatactcactaaagaaacagaaacagagataattttttcgaaagaaattgatg

SEQ ID NO: 18158 - DNA, 3003 bp, Unknown; identical to SEQ ID NO: 18157
  misc_feature (1)..( 3003): 2750-1469P.txt file - cDNA_ID_1815508; gDNA_ID_1621105; Annot_ID_171568

SEQ ID NO: 18159 - DNA, 3000 bp, Unknown; identical to SEQ ID NO: 6798
  misc_feature (1)..( 3000): 2750-1469P.txt file - cDNA_ID_1815512; gDNA_ID_1621105; Annot_ID_55971

SEQ ID NO: 18160 - DNA, 3000 bp, Unknown; identical to SEQ ID NO: 6787
  misc_feature (1)..( 3000): 2750-1469P.txt file - cDNA_ID_1815512; gDNA_ID_1621105; Annot_ID_171564

SEQ ID NO: 18161 - DNA, 3003 bp, Unknown
  misc_feature (1)..( 3003): 2750-1469P.txt file - cDNA_ID_1815516; gDNA_ID_1621105; Annot_ID_55969
gaagtcatggtatcgaagttaatgttcttggagaagactttgagagtaaagttcttgaggtatctatgtcttcttactcttcaatttgaagttaattgttaggattctgttaactaaatgttcaagttcttataggatgctcggaaatcgtgtcttcttgtgaatgctcctttgattcatagagcttgttctcgagttccgttctctgttcttaagtatgccatgactcttgatggtaactatttcaacctccatttcatatgtttgtaggatagctgttttagctaacgttttttttgtttattgataggtaagattgcagcgagtagtggacatgcagcatggataagtagtaaactctctagaacccgagtgttcgagttgcgaggaggaagtgatgctgtgatagttggaggaaacacagtacgccaagatggtaaatattgtatcttaaatctcgcatctttacggatgcttacaacatattgaatagatatgtgaaagttgtgcaattttgtaactgcagatcctcgattgactgcaagacacggacagggtcacacccctacacgaattgtgatgactcagagtcttgatcttcctgagaaagctaatctatgggatgtctcggaagtatctaccatagttgttacccaaaggggtgcaagaaagagtttccagaaattgcttgcgtccaagggtgttgaagttgtggagtttgacatgttgaatccaagagaagttatggaatatttccatctccgtggatatctttctatactatgggagtgtgggggaacattagctgcatctgctatatcatccagtgtcatccacaaggtacccattatactatatccatacttatttgtagtcatcttatgtttttgtctggctaaacctcattttcttacacttctttctctcaatgtaattcatttttcaggttgttgctttcgttgctccaaaaattatcggtgggagtaaagcaccttcccctgtgggtgaccttgggatggtagagatgacacaagcattgaatttaattgatgtttgttatgagcaggtaatttttttgctttatgaattaacattcactgtgacaagttaaccatgttactgaatctggcctcttagttccgtgggtttaatctaaatccttgaactacaggttggtcccgacatgcttgtcagcggatttcttcagcccataccagacctcttacctgttatcccatcagaggatgcaactgtcgagattgaccccagtgttgacccctttgaacctagtatcatattcttctacaaaacatgggacctctatggaagtttctcaaatttttctccacatccaattcgaatgccctatggcgaggagaatgatgattacatgacctggtccagtgtggaacattactatcaggtaccacacaacagtccatgtaaaatggtatcttgctctttcaaaaaaacataatctcttgatccttcacccaaaaactttaaaggcaaacaagtttgttggggtcgaaaatccaaaggcatatgattgcgttgagaaaattagaacagctagaagtccagaggaggcagctctgataggcagatcaacactgagacagaaacctgaactggtatgaataaaagttgaattgtccagtttcgagcatcaaagcagttttcactcgtttgttgatctctcgagaatcgagatcgttattcaggggatcaataatactgcattctcgctttaatgattgttttaggttcggaatgattgggaagatgtgaagatagaagtaatgtacaaggctttaaaatgcaagttctcaacttatcctcacttgaaatcaatgttgctctcgacaattggaacagttctcgtggaggcttcaccgcacgatctattctggggaggtggccgtgaaggagaagggcttaactatcttggtcgactgcttatgcagcttcgttctgagtatctgggcgaatcctctgtttcagctgaaaagacttcttcggcctgatggatgatgatagtctttcatatttattccaaaaagttatcaataaaactttcagttttcctcaattttgacatttacattgttgtaattctttaacctatataacattattgtaagtttgtaacattatgatagttttcctagaccatttgattcacattaactcatactgagtattttaaatggtaacggtagagtttttatttgctttgttcggttttaaaaccaatccaacatattcaagaatccaattcgatttggtccggatcagtgaaaattccaaggcttataggaacacctttcgtaaagaagacactaggtggtcgcaacttttcgagaagaacagacactaggtggtcacgaagacactagctggtgacaacgtcagaaaatactcaacataaaagtaaaactcttaaaagagttacataacacaaatattaaaatatgtatcatataatcatcatagtaacataaacaaggattgttgtaagagtttgcgtatgcttgaaactacaagagtagaaactgagctaaaagcacatggaaggttactttaacattggaaaaacacatctttcttcttcttcctttcaagtcacttttcctcttcttttctttcattttgacatttctttcttaatactttttaaatatgtaatggaatcaattatagacctttatataggtgtttgatattatatgattttataatcataggttgctaaataagaatgtaagtcatgatatcatatgaatacaatcccaagcaaagacaacacacatcatcatgttctcccctcaataacaatcacttgcaaagtacatacacacaaactcaaaataataattctagaaaacaattattaactaatttaatatacaaaactaaattccctttaattagttaagacatcacaccaagaaacttctcaattccccatacaaactcatacccaagaacttcaaaaaaatg

SEQ ID NO: 18162 - DNA, 3003 bp, Unknown; identical to SEQ ID NO: 18161
  misc_feature (1)..( 3003): 2750-1469P.txt file - cDNA_ID_1815516; gDNA_ID_1621105; Annot_ID_171561

SEQ ID NO: 18163 - DNA, 3003 bp, Unknown
  misc_feature (1)..( 3003): 2750-1469P.txt file - cDNA_ID_1815526; gDNA_ID_1621105; Annot_ID_55965
atttagacatgtaggctaaattttgattgcttcaaacgcaagtattaatgatgtagttaatgttaatctgatacatcgatcaaaattcaaaccctatatttgactactacgtacatctaatttgtattttaaggatatcaacttttggggctcaacgtacatcacttattttgctattcctcatcttcgaaaaagcaaaggaaaaattgttgtgatttcttctgctacggcaattatacctttgcaagcggcaagcgtctattcagtaagataaacaaaatccgtaagcatcattattggtggtatcttagccaaattcttaagctaagatttgtaaaaaaagggctcttatataagagcttttaggcttatatttaagcttttatataagaaccctttcttcacaaatcttagtttaagatttggctaagataccatcaataatggtggtcttacacgctttttttttatatgttatctttttacatacttctcatatacatataaaatttatatgatattgatactacttggtatgaccgtatgatgtaggcaagcaaagcagctttagtaaaattctttgaaacattaagagttgagatcagtcccgatatcaaaataacaatcgctcttcccggatttatatctacggatatgaccactcctcagtttaaagaaatggtcagtgataactttcttgtacataatttaataccttatatatatgacattaacgatgttatgtgtaatgttttttgtgctttgttgaaaattagtatggttcagatttcatactttcggaatcagtgagtcgatgcgcaaaagcgatcttcagaggtattggtagaggagaggcatacgtcatagagccatcttggataaaatggatctttttgataaaaaatgtttgtcctgagatcgttgactacttactcgactatatatttgttagttatctaaaaccttatttcaagcgtgattgatcatatcgatctatccaagttctctctggttttcaactgtggttgtgttgtcattatggccatgaaacttatactttatgttgtattagttattgcactaagtcttggcctttttccctttcttcgtatatgtttcaatttgttttagaaccaaacatttcatatagatagaggatttcttaattatttaataaagatgattcaaatgtatataattgttcaactagttcagttcgcttccaaaaaaacagcgacgtcttctctctcacggcgataaaaacagagaaccttccatttgtttctttgagcgcgtgaccggcgcgtggcggcttagttagcgccggcgtcggtcctccagtctggttttctttagggtttcattctctacttagtctggttcgtttttagatcctgatttgatgttggcaaggtgaagaatttttggatcttagatctgtaagagccatcgttgtgggctttgattcgtcgaaggttttgtgcgatcggaactcccttttctctgttttgagaaaattatgggtttctcctttgttcttgcagatcttgtttccgacgaaggttgcaaacgaaagttatgacggcggctaatgttattggtggtctggctccttctttgggatagggtggcaacggtacaccggtattttagtgttagttgtctcataattgggttttgcgctttcgttaaccttgttctcttcatttctcttttgggttcctatcctttagtcttcattgttggcttgttggtagcgtttatggaatcaactttattctcagtcttttgtggtctagtatcttgaactcttgcctattctatgtcctgccgagtttgcttgtttctcgatccgattcgttctcttgccgtctccagtcttcggtttgttgcgaattgtatgggctcggtccttgtctctacggtttagacttgatcgaggtctctcttttgcattggtgtcttactaggcgtgaaccaatcttggttttgtttgcttcgatttcgccgtttccagaagttgtgtgggatttctagtcgtctcccattcttgctggtatggatgctttggttctctttatttgtgaggtagtcttcatttggtataggaagagtcgctatccggtgtcgtggattttctcgtctccattggctagccactaattcaagcgtttctcgtttttggattgataatttgcaagatgtttggtgctagattctgagttatgagttttaattccctctgatgtttgctttcttagccgtcagtgttttgacttgtttcttttgtagtgttgttatttgctccccattttcttggacttagtttcctaggatatcttgttatccttcgggttagttttcgggatcatgtattgatcgtcgactccttgtatttcacctagtactcatcaatgaaaattaatcttccagtgaaaaaaaaaaaatgtatataattgttatggaatttctgtgtccagtccatattaagctttttacatatatatatagcatcgaccgcgaagtccgtaacaccatctcttctagaagactcggatttcattggcagaggcgtatgctcctttggatctgatagttaaaacaccaaatcttgtgtaactttcttgtatataatgctctgtttaactttcatttttttttagtaatatttacattcctagcaacaaatatttatttatagcaattaatatatatttttagtaataattacattcctagcaacaaatatatatttattttttaacaaatacacaaatatatttttagtagcaattaacctattttcctaacaagatacaacagaagaataagaaaatagtagacagatagatccacttgctaccatttcctctccctgtagccttctgtgtctattaaaatagacttcacttgtaaagtaaaagtttgaacattttaacatataaaaaaaaaaaccaagtagagaggtaagtggtggtattggttctgcaaaagaacattatg

SEQ ID NO: 18164 - DNA, 3003 bp, Unknown; identical to SEQ ID NO: 18163
  misc_feature (1)..( 3003): 2750-1469P.txt file - cDNA_ID_1815526; gDNA_ID_1621105; Annot_ID_171556

SEQ ID NO: 18165 - DNA, 3003 bp, Unknown
  misc_feature (1)..( 3003): 2750-1469P.txt file - cDNA_ID_1815529; gDNA_ID_1621105; Annot_ID_55964
gcgcttgacataattccacattcagtaatatttggtagttgaatcatatttatatttcagtgttgcacttgtactgatcttttggtttcttacaatggatcatatatacatttttatttttatttacctcatcagaatattctttttttctagccggtatatacttccactgaataattaccacactcgatttggactctgcatcaaaagtcttgcaacgagatagtacgttctgcgaaacatcacgtttccatgtatatcgtgactagacaatgagtcgaaatctactttgctcatttaacattaacttcccttaacttacacggaaactctatattttgaattttcattacaatgtaatatttttttaattatataattccaatcttcggtaattgacagccagataatgacattgacattttctcatggtaaacttttaaacattttcacggtgaaacaaaataattaaatagcaaagtgttatggttaaaacatttttgcagctagataacaaataaactggaactgatttgccacttaaacattagtggtatataaacgttagaaattcttgcacggttgatatgaaaatggctttgggttctcatacacaattcttgttattttatttagtaatgtgttatcatgtaaaatagtgtgtcatcatgtaaaaacaacagtctataaagcatgttatcatataaaaagtaacataatatatatcatgtaacattagtaatgtgtcatcggataaatgaacatgttatttattttcaaattaaacaaatataaaatcgttaattcttttgggttaaaatcttaaactcacctcaaaaatatttagcaaattaaaaaaaaaaaaaccaataaatcatgtctcatattacttcctaaaatttggctatcttttgttgatgtttttggtctgacctaaaaaaaggtttggctatctaaatctacctaaaaacacacactaatacaattcgatactgggcttcaaataaaaacaaactccttcattattgggccaccataatgatcgacctcacaatatctcagcccaaggttactttcgtcatttaaactctcctacacttaaaaaccctaatctctctaccgtcaataaacctccctatataaacacttccacacacaaaccattcctctcacacaaaattcttcagccgattcattctctagggttcatagcttagtcctcgaatccatatatctctgctgctgtgttcttcaattgctttagtattagcttgttcttagtgttcatagaatttagggttattagaatggcttcatcagatagtcgatgtggatttgtccgttcccatatgattcgttcccttgaagcaatattaatcgtgttgctctcgttctctaaattgctctctaatcatcaaagtaatcatacggttaattctagtatgataccgattagtgagcataacttgagcagctacataatcttctcttacgagggttttgttttgtcttaattcttgttttgttgtggaagaacagtgatgagtcagtttacagacctgtaatgattgcggtaatgatcgcattattatgaacatctaagggactgagttcttctatccattgtgttttagttttctttttgtcttggtggcttttacatgatagaaagattcaggctttgaatatattttagatgtgaagcttgttgtgaagtgtaattgcctacattgaatttagtttccctcgctatcctgttcttcaattttcaatgatgtttcttaggacgtcggggaacaatatgttttatattgatgttttgttattttgcaatgggatttcaaatgaggaatactttgccaagttgttgaatgctcagatttttctgggttttatgattcacttgtataggaagatctgatgatttccttttgcattgtgtttttgttttttgtttgggaagccagtgatgattagattcaatggttgctgaacattcaatgttgaaaagcatctaacttgactaggacggtctgaggcttttaatgaactttttgtttgctctatcgttagttttgtgtccatgattcaggattgttaatgttttgtgatgttttggatgatgagaaacaaaaatcaaaatacagttatccctggcttagggtttaaagcccgttgctgagtcttttgtaatctgacacacatcacaacaatttctctttacgttcttttggtacgatgcttttgtgttttcagtttatcttaactttgttttatttctcaattttacgattcatggttctgtaaatccatattgggcagtcttttcataaacaaaacgaggtgtgatgctaaatttcattgggacaacgctatattgtagaagacggtgaagattgttatacgttttgcaaggcagggatttatgatgacactctccggtcgttttgcttccttgatgcaattgtttttccaatttaggttttgaattattactcactattttatcagggtagcaacattacctgaaagtgtctctgagctatcacaaagattgaaagaagtttatgtgatcaaaactttccttttaactttattgttttcagtattagctatcttatgttatgtatatcaatgaatgtttttaacgattaagcacaccctttaatacagtcttgtttaagaatattatggatcaagatcaaaaatttagctgtacgttcaggtaatgaatgcgatgttctgaatgagaaatgaaactaaaatcatgcatttagataactttcacatcacttgatagagagggacgatatttttgcaggatttaacttcgtaattatggctaacaaagctaccgtctttacattatttgctcggggataactgaaatacctccctttctagctttaaatgtcacttaaatagccttcgcttgtaaaataaaagtttgaatatttaaaccagaaagctaagtagagaggttgtgatgggtctgcaaacatg

SEQ ID NO: 18166 - DNA, 3003 bp, Unknown; identical to SEQ ID NO: 18165
  misc_feature (1)..( 3003): 2750-1469P.txt file - cDNA_ID_1815529; gDNA_ID_1621105; Annot_ID_171555

SEQ ID NO: 18167 - DNA, 3000 bp, Unknown; identical to SEQ ID NO: 6775
  misc_feature (1)..( 3000): 2750-1469P.txt file - cDNA_ID_1815544; gDNA_ID_1621105; Annot_ID_55959

SEQ ID NO: 18168 - DNA, 3003 bp, Unknown
  misc_feature (1)..( 3003): 2750-1469P.txt file - cDNA_ID_1815567; gDNA_ID_1621106; Annot_ID_55984
ttattattgatttttagaccaaaaacatatagcttttaaagattaaaatgatatagagtttttgttcgtaagtcataaaacacttggatgtttagatgtgttcttggcatgtttgtttctacagatttttttttaatacatgaattcacagttcagttcggcggattttcagtttgagtttataaacaaaattaaattgatcagatgaaaatataccatatcaaatgtcaagttactaaatggtgcaaaatccaaagatacagtattagtggtgggtctatttgtgacctcttaaaaaaaaaataactcacttcattaatccattttaatcacacaaatgaaagatttacttatagtccactaactcactcagacgtacaaaaattaaccaccatctcttaaataagtcatatttatatcatccgttttattttcaaaatttcaaacaatctcaaatgacacacaaaaaattactatacaattgcgtgtattattcaaacatttgaccaatttgatatttaaaattaaacagaacattcaaactggtcaaatgcttgaatgtttgaacaatgcattcaaatgtgatgtttaaaatcacggctaataggaactaaaatccagatttagatcggtttgttgtccaaaacctcgaattgtcgaggcggcccattaaaaactagtgcactcgaattttcttcaggtattttcactttgacgcgcacacacactttacatcaccacatcagcatgtaatcaattaaaacccacatccatcaatcatcattacctaaaatttgctaaattaaacttcaactgtttctccattttgtttgccgccaggctacgctattgaacttcaattgtccagttagatttgtttctcttctagcataatctcatgcatgtacatttatatatgtgtactctggcaactgactttttttcttctttctaaccttcaatataaatattatatgaaacttgaaagtaattatatatatcaaaagaaatctaattagaaccattataagtaataaagaaaaatgttgacaaaaacaaacttgcaaaagtaataaagaaaattttaatatttttaattatagtctagtcaaactttaaattaatgattttaacttttctggacattagttttatatatactacacacacacctatgacaaaaaagacatgtatacgtaaacatacacttacagggaaaaaattaaaggaaagaaactaaaaaaaaatggagatgaagaaatgtagtatgatcatgatgataatgatgatggtggtgatggcatccatacgaggaggagaagcaattataataagaacaacatgcaagcaaatgtgcatcgaccaatgtggtggccgcatcactgtccctgagaccccttgtctccgtaaatgtcttcacgaaaaatgtggctttccagctcctccgtaataattcgtaacctcgtatatatttacgtatattgatcaagtataccttttaatttgtgttgactaataatttatatttatcgcgacattgcaggatggaggctgtaggaatggaaaacctcataggatagatcctcatatcctcagtttacttttcataagttattgttgtggaaggaaagaattacaataattaagagtaatgaacaaaaactcagtttacttttcataagaaattttgatgtgtacaatgattttttcctatgatcataaagatttccgaggccaaaattagggtcaacattcattcatattggatttgaaccttattttgatccttataaagactttcttcgatcgatttacttcatccatattttatggccctttctccttcgacaacaacgcattaattctcaggacgggtgcgttgcaatgtaaaaagttctttcgaaatatttcatccgattagttttcctcaaaagtattagtttcaattaaattaaagataatagcctaattataagataatagcttaattataaagccagccagattacttcaagttgaagtaatcaagcaaactatctaacactgataattcgtttaagctccgatgctatatatctagcacatggttaatgctataacaagttaacaccctctgcatggtccaatatctataaaaattctaaacagaacaaattaatgtacaaacacagaacaaaataatgtacaaaacacatttttgtcccttttgcttacttacacagtaaactcattgtcttatctactcattacaggttttattgaattaattatcaaaaacatacgcacccatttctactgatatatagtgaaaatactctaatttattattttaaaaaaaaaaacactttgcaggtctaaagtgagctagggacgtgaaaaaactgaaaatacatattgaaactagacgaaggaattgttatgttcaatatgtatttagtgttaattaaaagactagttgcttgaaggaagagaagacatgcaatgatgcaatgcagaaaacgtagttaatgcattaaaagagtctttgactctctaaagtgtaaccgtagtattcggttttgtcagctccttcggctaactaattaaaatcctaacggttcaattttcaacctttcacacactattcaatattactattttccgaaaaattggtatgataaaaataatattattgtaactatattgtaagtaagggttttgatttagagcgattaaaaatgttataaatcaaaatagtgattgatgccaaacgcgtattaaatcaaacgtttgccgatgactgaactactttcggtaaacgagaaaccagacaaatgggcctgtctcagaatagccttttaaggagcccaataaatttggacgtagcacgatatgaaaacgccatcgttttaaagttctcatcacgatggttcgcgttttgaagcatattttcgaaactcgaatcaaaattcaaatggcgggctaaacttcgattcagtctctctctttctctctttggtgatg

SEQ ID NO: 18169 - DNA, 3000 bp, Unknown; identical to SEQ ID NO: 6804
  misc_feature (1)..( 3000): 2750-1469P.txt file - cDNA_ID_1815571; gDNA_ID_1621106; Annot_ID_55983

SEQ ID NO: 18170 - DNA, 3000 bp, Unknown; identical to SEQ ID NO: 6801
  misc_feature (1)..( 3000): 2750-1469P.txt file - cDNA_ID_1815585; gDNA_ID_1621106; Annot_ID_55978

SEQ ID NO: 18171 - DNA, 3000 bp, Unknown; identical to SEQ ID NO: 6801
  misc_feature (1)..( 3000): 2750-1469P.txt file - cDNA_ID_1815585; gDNA_ID_1621106; Annot_ID_171581

SEQ ID NO: 18172 - DNA, 3000 bp, Unknown; identical to SEQ ID NO: 6812
  misc_feature (1)..( 3000): 2750-1469P.txt file - cDNA_ID_1815595; gDNA_ID_1621107; Annot_ID_56010

SEQ ID NO: 18173 - DNA, 3000 bp, Unknown; identical to SEQ ID NO: 6812
  misc_feature (1)..( 3000): 2750-1469P.txt file - cDNA_ID_1815595; gDNA_ID_1971867; Annot_ID_176468

SEQ ID NO: 18174 - DNA, 3000 bp, Unknown; identical to SEQ ID NO: 6812
  misc_feature (1)..( 3000): 2750-1469P.txt file - cDNA_ID_1815595; gDNA_ID_1621107; Annot_ID_171649

SEQ ID NO: 18175 - DNA, 3000 bp, Unknown
  misc_feature (1)..( 3000): 2750-1469P.txt file - cDNA_ID_1815595; gDNA_ID_2926155; Annot_ID_139467
aataagaaacttggaattttttttaataatggtacacacatatctttataaaaaaatttcatgttattcgatcgatgtggtagattgatgaatttggtaactaagcttgcacaatgacagtatggctggacatagctgcgttgcacaataatctgattagaaaaaacattgttattttggtatttcacgaataacattcgaggtcttaagtgttgaagtagtccgttcccactgaatatgatcaaagcttagctagcttcttcattgcgataatttatggtaacacccctgaccaaattaattaaatagctaatgtttacacaagtcttgtaaatatatctcttgtaatatatttcattttaaatatcttgaggttttttttttttttggcacttaagatttggaattttaagtcgcatgttttgaatagaaaaaaaaagttccctaaattttgaaaagatgataaatgatacgaaaatataacaaaaaatacaaaaaaaaagttgtatttggaaaactatccatcaaagtggacacatttaaaaagcacacgcacacataagagtcatagctccttgaaggctatataagaggtaacctctttccccatacccaaacagtcttcttcttcaactctataacataaaacacagagagagataccaaaaaacaaaaaccaaaattttctccaaatctatttctttcgaatcaaacccatttcttgaaactcgatttcaaacaaacccatctcattgttttcaccaaagactttttttttttttgtcggaatctgattaaaaccaagcaatgaagagagtcagagggttcaaaattggacacagatttgtcaaaattttcaaatggataccaagaaacagatgcccgacccgaatcacaaacccggttaccggaatccggtcattagcacggtgtttaagccgtggagctaagagattgtgcggtggaagcaagaagaatccgggtcagaatcagatccggttgggtaaggatccgaaaaagtcgaaccgggttgttcctcgaggacatttggtggttcatgtcggcgaatcagacgatgacacgcggcgagttgtggtgccggtgatttactttaatcatccattgtttggagaattgttggagcaagcggagcgggttcatgggtttgatcaaccgggtcggatcactattccttgtcgggtttcggattttgaaaaagtccagttgaggatcgctgcatgggatcattgccgcaggaaaaattcttacaagattatataatttgaatttataaaatagtcaaaaatcaaaagaggattaaaaaaatttatatacacttatacagtacagagaaggatgatttcctttaatttgtgaatattagttttttttaccatctatgttatacgataaataccgattcataaatacaagataattatttgtatcagtttatttcatggatgatagaccacattgacatcctataatactatatggtttagatttatgtgtgtaattttataagttagaacaaaactgaaattatgttctaacttataaaattacacacataaaaactgaaattaaaaaaaaaaaacagaaaaaactgaaattgggctatcagtatttttgaatacttatatttcaatatatcaaatacagtgagtgatggtgtattgctgtatctgaaacctatcatccactataaaccccaattgaagtgaaacaatcaatatttagaatttccatataatgttaattatgaaattacttctatctaaatatatttcagaagaatttttgagataccacttttatgatttttatttttttttaataataccactgttttttttttttgttaattttcaatgtaacacaaaatgcaatcatagaatttgttttattaacttttatagagcatattataaaaacgtttataaagtttctataatgcataatatcaaacatttataagatttttcacaaaatttttaatgttttatagtgcttagaagatttttcttaagaaatgatatgaaactagaatttttgaacaacctttttctggtctttttgaaaaatggtatcataaaggtggtaattttcaaaatttcccaaatttgaatacaaattcaaatcatattgtaggaaagtgatcaaatatgttaaaatttagaagatgaggtgagaacaaatgtgcagaggagatgcacttgctaaatttgcatcttcatgtgatttgtattttgctttttagattgtagtttaccactttggttggttacaagtatttggagaaaccatgtactacttgttctttgagtattaatatatatgattatatgtggtatgtttagaaaaaaacaaaaaaaccaaatatcaaacctaaacttattaaaagtaaagacacatttgattaaaacctaaaccaaaaacgtacaaaactattcgcttatgatgatattatttatcataaccaaaactttaatcaccatacatacctccgatttggttttctctcccaaactggtcgtcttctcacctctggtttactactacttcggattgaagaattttgatcgtctcgttgctaactccacgatgtctttctgacgcttaatcttctgacagaagacaaagacatagcataaaaaagtaagcacagaacataaacggatgtttattcttttctagacggtatatttacataaataacgaatcacttatcaaaaagctggagtagctcagttggttagagcgtgtggctgttaaccacaaggtcagaggttcgacccctttctctagcgtttcttttccttttgtatttttaagatttaaaaacatttttccacggctacaaaagaacattctcgacatacacaaaaaaattcgaaatttcgagaactctcttgtgccttcttcttcatcttcctctgtttttaaaaatgcaatcaagcagattctcacgatacctaaaccaaatccaattcaatg

SEQ ID NO: 18176 - DNA, 3000 bp, Unknown; identical to SEQ ID NO: 18175
  misc_feature (1)..( 3000): 2750-1469P.txt file - cDNA_ID_1815595; gDNA_ID_2926155; Annot_ID_198328

SEQ ID NO: 18177 - DNA, 3000 bp, Unknown; identical to SEQ ID NO: 6813
  misc_feature (1)..( 3000): 2750-1469P.txt file - cDNA_ID_1815618; gDNA_ID_1621107; Annot_ID_56002

SEQ ID NO: 18178 - DNA, 3000 bp, Unknown; identical to SEQ ID NO: 6813
  misc_feature (1)..( 3000): 2750-1469P.txt file - cDNA_ID_1815618; gDNA_ID_1621107; Annot_ID_171638

SEQ ID NO: 18179 - DNA, 3000 bp, Unknown; identical to SEQ ID NO: 6813
  misc_feature (1)..( 3000): 2750-1469P.txt file - cDNA_ID_1815618; gDNA_ID_2926154; Annot_ID_139459

SEQ ID NO: 18180 - DNA, 3000 bp, Unknown; identical to SEQ ID NO: 6813
  misc_feature (1)..( 3000): 2750-1469P.txt file - cDNA_ID_1815618; gDNA_ID_2926154; Annot_ID_198304

SEQ ID NO: 18181 - DNA, 3000 bp, Unknown; identical to SEQ ID NO: 6814
  misc_feature (1)..( 3000): 2750-1469P.txt file - cDNA_ID_1815622; gDNA_ID_1621107; Annot_ID_56001

SEQ ID NO: 18182 - DNA, 3000 bp, Unknown; identical to SEQ ID NO: 6814
  misc_feature (1)..( 3000): 2750-1469P.txt file - cDNA_ID_1815622; gDNA_ID_1621107; Annot_ID_171637

SEQ ID NO: 18183 - DNA, 3000 bp, Unknown; identical to SEQ ID NO: 6814
  misc_feature (1)..( 3000): 2750-1469P.txt file - cDNA_ID_1815622; gDNA_ID_2926154; Annot_ID_139458

SEQ ID NO: 18184 - DNA, 3000 bp, Unknown; identical to SEQ ID NO: 6814
  misc_feature (1)..( 3000): 2750-1469P.txt file - cDNA_ID_1815622; gDNA_ID_2926154; Annot_ID_198303

SEQ ID NO: 18185 - DNA, 3000 bp, Unknown; identical to SEQ ID NO: 6815
  misc_feature (1)..( 3000): 2750-1469P.txt file - cDNA_ID_1815626; gDNA_ID_1621107; Annot_ID_56000

SEQ ID NO: 18186 - DNA, 3000 bp, Unknown; identical to SEQ ID NO: 6815
  misc_feature (1)..( 3000): 2750-1469P.txt file - cDNA_ID_1815626; gDNA_ID_1621107; Annot_ID_171636

SEQ ID NO: 18187 - DNA, 3000 bp, Unknown; identical to SEQ ID NO: 6815
  misc_feature (1)..( 3000): 2750-1469P.txt file - cDNA_ID_1815626; gDNA_ID_2926154; Annot_ID_139457

SEQ ID NO: 18188 - DNA, 3000 bp, Unknown; identical to SEQ ID NO: 6815
  misc_feature (1)..( 3000): 2750-1469P.txt file - cDNA_ID_1815626; gDNA_ID_2926154; Annot_ID_198302

SEQ ID NO: 18189 - DNA, 3003 bp, Unknown
  misc_feature (1)..( 3003): 2750-1469P.txt file - cDNA_ID_1815630; gDNA_ID_1621107; Annot_ID_55999
tggttccctacaagccataaaaaaactcgtaccctttccggagccaatactctccatatcctggaaaagaaacgctccatgtcctgagtctgcgatccctcctccatgagtagagaataagccgaccccactgtaaactctccattctccgtaccagaccatgacagagtatccgctactccgggaccgcctcccaacacgaccgcagtcaatcgtaacagcagcttctccggtaagaaacacgaaattctgcccatgtcccaaccaacacgaaattcttaattagttatttataagattgagatttcaccggggcagaaaaatgattaattgtcatgatttatgaataaaagaaaaaagaaatctacttacacttaaaatggaaacagtttatactgtgagataaagagattgattaattacgatttaagtaaaagaaagaaaaataactttgaattgtgaattgaatacaacaaaaacaatatgcacgcattacaaatatttagtcttgttttttattagccgttaagggaagtgagaccaaaggtgacacttgtggtacgaatggtagcttcagtgggtaactacgattacatcattgattatgagttccaaactgatggggttatgagagcaaaggtactttcaatatttgacttttatctcattttgacaaaaacaaatcataaaaggttccgtattgaaaatattttacttttggtaatatcaacgacaggttgggcttagtggaatgttgatggtgaaagggacaacgtacgagaacaagaaccaagtgaagaaagacaaagaaggtaatgaagaagagctttatggcacgattctgtccgaaaatgtaattggagttattcacgaccactacgtcactttttaccttgacctcgatgtcgatggcccggacaattcctttgttaaagtgaacctcaagaggcaagagacggcgccaggtgagtcacctaggaaaagttacatgaaagcagttaggaacattgtgaaaaccgaaaaagacggtcagatcaagcttagcttgtacgatccatcagaataccacgtcattaatcctggtaaaacaactcgagttggtaacccgacgggttacaaggttgtccctagagccacagcagctagtctacttgaccatgatgatccaccgcagaagagaggagcttttactaataaccaaatttgggttactccctacaataagtccgagcaatgggctagtggtttattcacttaccaaagccatggtgatgatactcttgcggtttggtccgacaggtgattagttgcaaagaattaccctttttattagttatattatagttaatattgttacgattgatttagtgtctttatttggtgtgatgcagagatagagatatagagaataaggacattgtggtgtggtacacgcttgggttccatcacattccatgtcaagaagattttccgataatgcccactgtttcttcaagtttcgatttgaagcccgtaaattttttcgagcgcaatccaatccttaaggccgctccaaactttgaatatgaccttccggtttgcggagccaaatctgattctgcttgagaagaataaagaaccaacaaaagaaattatccaactttttggatcttattggcaaaactacaaatcaagttacatgatattcactttcctatgtgttattggcgaaatcccaactcctacaaaacttataagcgcaaaaatagtatataacatgtccaattcacaccggaatgttaatctcaaggaattgtattttctcctagaatcactacttttgtgatagaagactttttttttgtcaaccttgatagaagatcttgataagattttttgtttttgtttttggcattgataacacattattctttcctaaaagaaattagtactcccctatatctcagtcaatttactaatgtttgatcttatgtttgtatatcttctcaaagcttgatcgtatctttctcttaatttgtatctcagtgtcattttatcaattaatgcttgattgtatacggagtattggtatttaacataattttaatgttcactgtgtgaatctaagtaaatcaacagtccagagactcagattgataatgctactacctaattccttgacgtaacaaatgcttatatctcatctaagaaatattcagtcgaaaataaagcatttccatcactctctgctcataaaactatcacaatagatattgacaaaaaaaatgggcttctgccttctgttagatttatctatcaaaccaactctccgaagtgggcttctaacagagaaacaagacatgggccacaaaacaattaagcccactcagaagcccaagacgaaaactgtgcaacggtcgtcttcaatgtttcagcataaagacaaagggaacaaaactgcagagatgacgaaagcttgtacggaggagatagcactctccaatcaattctcagcccttgatggcttagagacatcaagatgaagacatgtgtaagggtttatctagggttttagttcacatatgtccttgtataaaaacccaaacaatagccgcttgtaatctctaagaagcagaatgaatgaaaaccaaaacttttcataaagatttataaacttcttcattatcgacatcatgagcctcttgggccttcatcattcttcaaaatcataccatagtttatagtttttactgcgtaccacaaatatggcaccgtacatatatcattataggtttctaggagttgacaaatgtttagtcctccatttttcaatcgtcaaagataagattccttataattcgtgtacataattgttttttaatatataccatagcatgtggtagatattttattttcgggattgatatttggatatctctttatactgtaagtgtaaggtgacggtacttagttaaggctcactagtttctttaaattctatataatacgataccaattcctatg

SEQ ID NO: 18190 - DNA, 3003 bp, Unknown; identical to SEQ ID NO: 18189
  misc_feature (1)..( 3003): 2750-1469P.txt file - cDNA_ID_1815630; gDNA_ID_1621107; Annot_ID_171635

SEQ ID NO: 18191 - DNA, 3003 bp, Unknown; identical to SEQ ID NO: 18189
  misc_feature (1)..( 3003): 2750-1469P.txt file - cDNA_ID_1815630; gDNA_ID_2926154; Annot_ID_139456

SEQ ID NO: 18192 - DNA, 3003 bp, Unknown
  misc_feature (1)..( 3003): 2750-1469P.txt file - cDNA_ID_1815638; gDNA_ID_1621107; Annot_ID_55997
catcagatgtgggtttgagtaatatgataacgttttcaaaagagatagtagaaaccaaaatgttacctttactgcctaagaatcgtttcataggttatttggactttttttattttgaaactaaaattgtaacaactcttactgtacaagaagatgcaaatggagattttcaatttcatggatggagtatgattctccaacgaaacaattacaagacagacgatattataggattttggtgggatgccaataactctagatttaatttttcaggtactcatgatcgcttagttgatggagtggatctttgcaacttcgtttctcaaatatgttaggttccttattttatttatttaattttgcaaatttgtcttctcgatattggttcataagttatttttagttctatcttaattatgttttttaggatcatcttttctttttcaattataaatggatatatttggtgttaagacagtttggagttgcttattctccagatttacctatctatgattttcgttttaacgagtataaatacttttgctatagtaaggttgttgatttgattattaaaattaacgagtttttgataatcattgagaagaatattctcaaacgaagtttttgttgaacgtgaatccattgatctccgataacaatagaactctaagatatgattctcttacttgagatctattgatattcaagattactatcgtaatttattctggtacactaactatttacaccatttttaataaattagataaaatcacacaaacatgtttatatttggaccttcactatgaataaacttggtttatttgactaatatttcaccatataattttcaaaaattcgatttcaaaaaactattagttcaaaccaaacttggttgtaggatctgaagacttgtagttaggttgtttggtttgaactattattttccaagataaaagtagatctcttttgatttgaatatgtggtttgattaaaatattatcaaaatcaaaattgactttgtccttctcacgatcattaattaatcttactagaaccgttagagcaaaactggctgggtcaaggaaacttgcttttattgcacaaaattctaaatttacttcgaagacgtgttgcttgacgcttgtcgttacttctgataaatgattttgagtaaaattcaactaacattaaggttgtgatgcttcctatataacaaaggaagtctataataaaatccaaacgaaaagccataaaattgactaatctaattcccaaaagttttatatttgactgcatattgttttggaattttatagttttttttttttttttctccttgctagttgctaccatcgaattcgaaaaaaaaaaaaaaacgaaaaaaaatactaaagtatcttatttttaaaaatatgttctcttgttgaaataaataggggaaatagcctcgccacgtttttacgcaacctttgctttgactttaaatttcatatcacaccatactcttatttctcttatggactgcaatattttagtttaaaatttaagtaaatgtataaatgagtgatggttaaagaaaataacagataaaggaacatgacttgttttttaatccaagttaaagagtatatatatatatattatttctctaacaaagttaaaagtggttaaaactcacatgaaacctaaaaagaatctaccaactcaaccatattgtcttatgattcaatccctaagattcatttccaagcaatatattagatatctcatatgtaagtgtatataatatataatatatatagatgatcaaaatcaaaatttaggcattgaagagattgtgtatcagttcatgaataaattggaacctaccattgtctctttcgccaactctaatgccaattttttttggtttgattctctggtgaacaatgcagcatatctataagtacctttataaatcatccttccagtttttatactaaaatgattacttatgtctctcctcttttgtgccttctcatcgactacctttcattatgtaaacacttaaaagctaagcctgaattttatttaaggcaggtaagttagtattgggctttaaatataattaagtgggccttggaccgtatatcgacaaatcaagtgatgtcgtgtgcttcgtaaaattcccacatcgcttgtctagaaacgtaacttaatgtatatatttagacaaatcattacggtcacagttatgtttacgtacttgtcacttgttctcatactatgatgtagttgtctagttgatctcagttatgtttcatgaattgatacgtttttaatcaaggtgacaagattaatagagattaactacctctacacaactggacattggacaattcagattcaaggttgatatccttaaaaacaccaatacactcctctataaatatttacgtacttgtcacttgttctctttttattggttataaaattttaaaaatttttaaaaaataaataaactaaagggctctctaaagtctaaactacattacaaataatatattattgtattttaagagacactctccatccattgatggagatgatgttatggtttgatcaagaagatatcaactacaagacattacgcttctagttaaaaatagttggtcaacttaaaatcacgttgcatgtcttaatcacgttggtcatatattcccaattgccctcaaacgtcaaacattgaacatcatgtccgtgattctaaaatcttgtaatgttattttggcaaatttccttcttaaaacatgaataaaaaaatcaagaaaatttacatatctcagacggttcttctcgtgtgttttagtcttctaagcaccaatgccaatcttagtggatctggatctatccaagtagatatgaataaacaatacaagtctaccacacacacaatcacacattactcagctaaaccaactgagatctagagagagtaagagtgtgagaactttcatg

SEQ ID NO: 18193 - DNA, 3003 bp, Unknown; identical to SEQ ID NO: 18192
  misc_feature (1)..( 3003): 2750-1469P.txt file - cDNA_ID_1815638; gDNA_ID_1621107; Annot_ID_171631

SEQ ID NO: 18194 - DNA, 3003 bp, Unknown; identical to SEQ ID NO: 18192
  misc_feature (1)..( 3003): 2750-1469P.txt file - cDNA_ID_1815638; gDNA_ID_2926154; Annot_ID_139454

SEQ ID NO: 18195 - DNA, 3003 bp, Unknown; identical to SEQ ID NO: 18192
  misc_feature (1)..( 3003): 2750-1469P.txt file - cDNA_ID_1815638; gDNA_ID_2926154; Annot_ID_198298

SEQ ID NO: 18196 - DNA, 3000 bp, Unknown; identical to SEQ ID NO: 6834
  misc_feature (1)..( 3000): 2750-1469P.txt file - cDNA_ID_1815672; gDNA_ID_1621108; Annot_ID_56042

SEQ ID NO: 18197 - DNA, 3000 bp, Unknown; identical to SEQ ID NO: 6834
  misc_feature (1)..( 3000): 2750-1469P.txt file - cDNA_ID_1815672; gDNA_ID_2926208; Annot_ID_141822

SEQ ID NO: 18198 - DNA, 3003 bp, Unknown
  misc_feature (1)..( 3003): 2750-1469P.txt file - cDNA_ID_1815680; gDNA_ID_1621108; Annot_ID_56039
gaagaagaagttgtctctgtttcttcttcacaagagcaagaagaacaagaacatgattgtgtctttagttcacaaccttgcatctttgatcaacttccttctttgccggtaaatttctaaacttctttataccttttctttctcttcttataatcgaaagattttaagttatatttttcttgatttctttttttttgggatatttttaggatgaagatgtggaagagcttgaatgggtatctcgtgttgtggatgattgttcatcaccagaagtttcacttctcttaacacaaacacataaaaccaaaccaagcttctcaagaattccggttaaaccaagaaccaaacggtctcggaacagtttaaccggtagtcgtgtttggccactcgtttcaaccaatcatcaacatgcagcaacagagcagttgaggaagaagaaacaagaaactgtccttgtgtttcaacgaagatgcagccattgtggcacaaacaacacaccacagtggagaaccggtccggtcggtccaaaaaccttatgtaatgcatgtggagtccggtttaagtctggtaggctctgcccggaatacagaccggcggatagtccgacgttctcgaatgagattcactcaaatcttcataggaaggttctggaattaagaaagagtaaagagttgggtgaagaaacaggtgaagctagtactaaatcagacccagtcaaatttggcagcaagtggtagataagacttaggtaaaacctactttttgtaacattatctgtagtgttgtaatttaacaacttgcttcttaacattttgaaactgtttcaggaactagtcttaagtaaacaatggttttctataaacaaaattaatgtgtgtttttaatgatgtaagaccaccaccaccactactagtacttggaatgattttggtccatgtgtagtggcttaaatagactttttgagtaaacaaaatgccaaatggaagaatcatcttgaaaactccaacattactatatagtatatatattattgataaatcttgagattcgacatatttatttgataatcgatgcaagcataattaatttagacatttattcagcaaaaaaaaaaattaggtatgtaattaatttatacatatcgaattactaaaggttaattttcaggctaatcgtagataaacgatttcgttaaatccccatgaaagtaaatttaggcaaatgtatgatgctatgtctgccgcataattgtttaatctcaccatttgcatatcaatctttaagggaaacatccttttaatgtgtttatgtggccttgtctccgttttattgctactttgtgtcatactcaaaataagttgactataaagctacatgtatctacacaaaaagagagtttatttagtatgcttgcttgggaataagcaggagacaaaagaaaacatccaagttaaaacatgaagcagcaaaagagagtgttcatccacaaaatgtgagaggtttcttagcatataaagatattgatataaatctaatcattctcgtaagaacaagaacaaaatgaaagagccaaaaactaaacccatctttcactttttagatacgagaagtgccacgatcttttgaagatcttcctgattttgctttgcaacctttgtaatctcatcaagccggtgcatgtagagagcatttttggcactcatctctttcttaaactcatggataaccacactcttcttgtttatctccaaccacaagtcggctaggcttctatccgttttagaggtgttccataacccccaaacgaaggagatgcaagtaagagagccaaagaaacaccaagtgagaaacgaggtataggtttgtgagaaatctctggaggccttacctaggcaagtgtactccacaaaagtttgatgctccttccctttagctttagccagtagttgaagcttcttagcttgagatatgttgataaatttgagaaacttccatttgcgtttgacgctcctctcgcatgatctcttgaccccgatgtaatgaagcctagttgctaaaagtttaaaaaccttgaaccatgtcgattgtggatcgtcattaggtgtgtaatcatcatcgtcattattgctggatccatcatcactctttttcccatcgccggatccatcattgctctttttctcaccggatccatcatcatcactctttttttcaccagatccatcattagaactccttacaattttataatactaaattttgaataaattaaagtttaaattttttgttgaatccttatattttttattgttcaatggtggaattcttaagtggatttctttaaaaaaataaatatataatattataatatatttcaccaaacataataattattagaaatattaaaattctaaacatacataatataaaaacaataaaaaactataaaaatgaaaaacttgaaccacgataagtgttaaacttgattcgtgcaaaatttgtgtcatatatattcaaccaaatcagctctttattgttcacgcttagtctaatcacgaaatcaagttgagtaatccttaaaagaaaaaaaaaaagtttgataattttgaagtttagattttttgttgagtacttataatttttattatcgaatggtggagtaagtgaattttttttgggaaaagtgagtgtataatgaaaagacagatacgtagtgttaaataatttatttctttgactgtatcaacagtccgttgtagtctagctggtcaggatactcggctctcacccgagagacccgggttcgagtcccggcaacggagtttgtttttacctccttctttttttaatgggccgatttttgtcttaattcaagctctaatcaaaggcccatttgaaattttcttctcggtccctccaacggaaacagaaggttttccactgtaaaagatgaaaagagtgtagagagactcgaaatcaatcggaatcaggaagacaaaaatg

SEQ ID NO: 18199 - DNA, 3003 bp, Unknown; identical to SEQ ID NO: 18198
  misc_feature (1)..( 3003): 2750-1469P.txt file - cDNA_ID_1815680; gDNA_ID_2926208; Annot_ID_141819

SEQ ID NO: 18200 - DNA, 3003 bp, Unknown
  misc_feature (1)..( 3003): 2750-1469P.txt file - cDNA_ID_1815684; gDNA_ID_1621108; Annot_ID_56037
tgatgaatgattacgtattcaaatggattatgcttttgttaaaacgcaatgattatgttctgtgttaactttttttttcgtctctcgttttcgttttgtcttatttttatgtgaaagaaaaaatcatttggatacatatcttttttttcctcatttattttacttagtgataatatagcaactaaatttctaatatgcgatttgatgtcattgattcgaacaatacatttgcatcacaatgatagattggattttaggtaaatctattgaagtttttaatgttttattaggtaaaactttataataggttagatattattctacatttttttgcctagagatattgcgaatacaagaatcattaactcaaaaaccacttgcattgattacaggacttgaaactctctcccattttcttgacgtcaaaaatgataaaaactactccatgttttataaaagataagaaaagggaaagagtgatgatgatgatgcgtcgtgaatcgacgaataagaggaaaatgtgacacgttctcttttcccccattacgctctcgtcactcctcaccagcctgctcccttttcaaacttttctgttttccccctaattttacgaaaatcaaaataagttaaaatggaatatataccaactttcaaaataaaaaatcttcaaaacatatcaatgtgtatatagcgacacgagtataaagtcccacacacacaataaactaaggttggcagaaaaaaatataccaccaaactaagtgatcgtaactactctttcgaaaaaaccaaaccctaatcttgttttaagactaagaccaattatactaaaaaggaaagatttcataattggaaggaaagtagtatactttgatagttattaaaaataaaaataaaatgttcaaaagatttggctatagtggttgctttggtgaactccactccaacggtggtttgcaccatctccattcccatcactaccaaaaacccacacttctttttttttttctttctttgcgtaatgtgggttaaaaggaactttatttatgctcttgtttttgggtgtttgaatcgaatttgaaatcaacatttgtttttattttattttatttataaaaaatttgtgtgtttggaaagttgtaaaaggttcaaggggtttcggtagagataatcttaatttggtttttaacacatcgacttaatccaaattgacatctctaataggattcagatattattatatctatcctgtaattttccataaaatgtaatcaatatgagatttggtattagggtatgaacttaatgtatcttatcggaaaaatgttttctcctttgggttacctaatctcatatctaatgccaaaaatagcataacatagaagattggctagatcatatgtggacatcaccgactgcatggcaatgtttgttttataatcgcgtaatacttgtttgtcatttgccagttctcataacaaatgcgaaaataatcttatatatccttggtaatgcatgtaaaaattaattttgcttcatgaattattttatattcttaaattcatgactgaatgaaatttcttatctatattcagacgcagtatatgggacatctaactcaattttaagattctagattggatgattttatgttgtttgacaaaaaaaataaaaaaattggatgctttctataaatttcatgctttgtattttattaaattttgagctattattgtattagtatagaattgagctattattggattgttcttatcactttgttaatttcatttggtcctttagttagatatcaaaatttttaaaattttcaaaaaagatcacaggtttaatcggtgactttcaataatactagttttaacacgacaagcaaaatattgtgcatgtatactattaaattgttaatgttagtactatgaaataacaaattcatcaccattgtaaaacttaatgtttcaacatttcctaagaagaaatggtcaacccttttgacaagacaagctaaattggcatggacaaggaacacagcatcatgatataacccttcacaataattataataaaaacaatcaaatttgtattgaataatgcgaaacagacctgacttatcaatatgtgacgaaggataagcccacgccaaaaacatccacgtaaagaactcattgattaggtccaaagaaatttggagaaaataaaacaaatcctgacgtgaaaataaaaagaaatcatcacttttttttatctcttttattttcttctaaatacaaaaattgaataatcaattaatttttcatgtatgcaaacaatttcttaacaagtcttgtgagctttaaatgaaatatagaggcgagtggattagacttgatcctgatcttttattaagctgatccatattttacattgaaataaaggacacaccgtttaacacgaaaatgaagagacaaataaagaagaggaaaagcattgattctgaaataccaatatagtatcattcgtgaaagaagattttgtaatattccacaaacttagaaattaggggaaaagaaaacaaaaaaaaaagataggaaaaaagagctttaacttttggaattggaagaagcacaaacacacacaaaaaaaaagtctctgttttaccttttaaccccttcaagaatcctcctttaagttcagtgccctcttacttttctcttatcggaatatctctcttcctctgtttcttcgccattctctcagcttttctccttcttcttcgtctttgtcaggtaaagagatacgatgagcatatcccacatacctctctcctcttctcatctttttagtttctcgaaagtttgcatgcgccgactttgttataggttataaactttagttttaagcctattttcgtatgtttatggttgttgtaatagttgagaattcagagtatgtcaagtgaaacttaaaaagaattctatatgtatgtgtgtatgtgttaaagagtgaatg

SEQ ID NO: 18201 - DNA, 3003 bp, Unknown; identical to SEQ ID NO: 18200
  misc_feature (1)..( 3003): 2750-1469P.txt file - cDNA_ID_1815684; gDNA_ID_1621108; Annot_ID_171691

SEQ ID NO: 18202 - DNA, 3003 bp, Unknown; identical to SEQ ID NO: 18200
  misc_feature (1)..( 3003): 2750-1469P.txt file - cDNA_ID_1815684; gDNA_ID_2926208; Annot_ID_141817

SEQ ID NO: 18203 - DNA, 3003 bp, Unknown; identical to SEQ ID NO: 18200
  misc_feature (1)..( 3003): 2750-1469P.txt file - cDNA_ID_1815684; gDNA_ID_2926208; Annot_ID_202372

SEQ ID NO: 18204 - DNA, 3000 bp, Unknown; identical to SEQ ID NO: 6847
  misc_feature (1)..( 3000): 2750-1469P.txt file - cDNA_ID_1815686; gDNA_ID_1621108; Annot_ID_56035

SEQ ID NO: 18205 - DNA, 1928 bp, Unknown
  misc_feature (1)..( 1928): 2750-1469P.txt file - cDNA_ID_1815686; gDNA_ID_2926207; Annot_ID_141815
agctccgatgatttctgttggctcctcaaccattgtctcatcagctggcctgtctaccttcacaccaacatcctctgctgtgtaatctccatgcacctaaagataaaccaaaacaaaaagagttagatttcattacatccttggaaccaagactagtgcatcaatgatgaaattaatgtgacttcaatctacctccatgagctttccaaggtcaaacttgggagcctttaggatcttcactttacggatgaacacattctgcaacgggtagatgccctgtgttgccttctcaatctctcttccaatggcctctgggatgaacttggccactagctccttgaggtcacaagatgaagcctccttcaccataatctcactcatctttctgcggatctacaagaatcaagaaacatttacaaggaaaatgttaatcttctgtttacagaaagccaaatagtaagcacatggtatgataatgttgtaacctgacggatttggctggattgagcgtaacaggtacgcttcacttggttagcacgtctctttgtgaaggcgatgcagaacatcctcaaggtgtagccgtctgtggttttcacatcgacatgggcttcaatcaaagtctgccacttcttcaccaatgaccttagcttgtcggttgtgaaatccataccctacagagatcacagattaaaaaccgcactctgtatcaatatgccagtaaaggagtggtctttatcttacccagaactgggtcaacacattccttccctgaacatcttcagctctaagacggatcttcctgtaggcattatcctcatcattttgtagatcagcaagagaaacctcaaacaccctgtgtttcagtccctcagaggcaatctgtttaaattaagagatagcccagataacaaagtcagatttgtcgaagaggaacacgctcttttctatcacaaatgcaattcctattacttcaataatgaaagccaccaagagcaaatgcccatctctacacctcacattcagcaaatgacctatgccatgagataactatagactcaaaacctagaaagctctaacctttctccagtatagtaatagaaagacataagacattaccttggtaccctgagtcctggaaacaagagtcttcccaacattcctgttcgtgaaagaaccaggagccttcacgtcataccaatccttcttggagaagggatcaacactgcaccatccataacaattcaatcacgaacactatatacagattacaattagaaatctgagaattttattcaggacataggttacttacgccttcttctttcctcctttcctaccctttgaaatcctcttgttcttcctatatgatcaaacaaaaaccttaaatcagaacatgatatactcgaagctatgatcaaatgagagattccaatacagagactggagaaacaagcaaggaatatagagatgcgaagagagatttacccgacagccatggttaagggtcttctagatggtgtagcgacgacgagctacagtgaggaagaagaagaagcggcttcaacaagtgagagaaagccctaattcactggcttttcatttatatatgtctagggttttgcgtctttttagttattttgagatgatataaatttatagcttactggattttattttcaagcccaatgggctattatagagagcccaatattaaccttcttggtgaaacagagactttgtctatctttgatttcttcgtgttcgaaagcagagaaatttgttctgagctcaacgccatttttgacgatttcgaatctctgtcttctctgagttgttccaagtaatcggagggaactcgtaaagtggaagaataggagaaagagagaaggaagaagatttgtgaatagctcttgatctggtgaagaatg

SEQ ID NO: 18206 - DNA, 3000 bp, Unknown; identical to SEQ ID NO: 6845
  misc_feature (1)..( 3000): 2750-1469P.txt file - cDNA_ID_1815690; gDNA_ID_1621108; Annot_ID_56030

SEQ ID NO: 18207 - DNA, 3000 bp, Unknown; identical to SEQ ID NO: 6838
  misc_feature (1)..( 3000): 2750-1469P.txt file - cDNA_ID_1815690; gDNA_ID_1621108; Annot_ID_171683

SEQ ID NO: 18208 - DNA, 3000 bp, Unknown; identical to SEQ ID NO: 6845
  misc_feature (1)..( 3000): 2750-1469P.txt file - cDNA_ID_1815690; gDNA_ID_2926207; Annot_ID_141810

SEQ ID NO: 18209 - DNA, 3000 bp, Unknown; identical to SEQ ID NO: 6845
  misc_feature (1)..( 3000): 2750-1469P.txt file - cDNA_ID_1815690; gDNA_ID_2926207; Annot_ID_202333

SEQ ID NO: 18210 - DNA, 3003 bp, Unknown
  misc_feature (1)..( 3003): 2750-1469P.txt file - cDNA_ID_1815694; gDNA_ID_1621108; Annot_ID_56029
acagtaagcaaaaaggtgacatggcttacttaatgttgaaatatatggtattggtaggtagaagttggaaaacaaaacaaaacactttttcctctttacgattttcggattctccattttgttacatcatgatatgaataccactacttttaaactgcatatatatcgacgtatgctttattccttcaagtaaattttaataatcgtgaaagagaatgtttatagtcaatttatagtacaaatgtgtctagtattctgtatacatgtatatgccttttatattctcaagtttgtagattttctttttctatagtatggttctcatttcatgtccattgagatatatatgttcaaaatttatgaagataattgtatttttcttaacgcaattgcgctcaagaaattctttagcactagttttttcttctttttttggtcaaaattctaatctttcattattcaattttttctttaattttgtttttgggcactggccaactaagagaaaaaggtcattatgtataatcatctccttgttagtaaagtaaacaaatcaaatcataattaaaagacgagtatgacaaaactttaaactttaaagtaatgttttttgataaacagagaattcagacatatatttcacatttcctttagatccgtgacttaattatatttttattttgacttatgtatgttaggttccaaacctgaatccaagcgtagcttaggcttcgaacctcaaatgtctgcataaaatttagttaccattattgtagctggatagttagattctccacatttatataattgtttttttaaaaactattggtttggaagccaccgattttcaaggcctaatttagaaacaacattttctccatgaactcttttgatgcgtagtcttaatagaaatctttcagtattattgacaagaaaaaataagataaaaataaataaataaaaaataatgactaacatagatgtgaaaagtccttattaatattcaaaacgctccaaaggaattgcacgacgagacaagaaaagcaggggcggctaagagagtcctttagaaaccaatctcattcgaatagtattatggtttattgagaaaatttataatttatgtactaggaagtaaaaagtcatagccgacgatactcaaaacagaattttccttcgagttcaagtattttcttgttaattagttcggaatcgaaatttcaattctaaggtttaaactctttattgtgaaagtcacacactcgtgtatttagactctaacatagagtcgagaaaccatacatgtataatgtattagttgaatggtttcgtctaaactctatgttacaagtaacaagtccatataaatgagtagaaccctacaccaaactctaattcctacttcttcgaaaggatacctaaaagcccgtgaagtctagaaatctttgattttatctacatgtattaactttgtcagcaacacacgttcataccggatttaaagttttggtgcaagtttctatcgagagagctttgcccaacatcttaatataagcccaaccttttataaataagcacaaaacaattataaagcctcacaagtaagttaaaacataggcccgaggcaaatgttaatggtacagtatgttgttgattctaatgtctattacgtgtactaactaactacgaagcccattcaagagtttaaccggcccaacaggtttactatgattgttttgtattaatatacagcttgactctcattttgtaatagaaaaatatatagcggtgtttaacaagataaattatgctatctataacattctaatccagaatttggttccatttaaaaaattaattaggccggttttcttctaaatgagttgtggtttcttgttaggacgtgcactcataccagccttaaaaaaattagtgacaaaacaaaactgaaatttttaacaaaaataaataaataaaacaaacaaaactgaaattaagaatcgtgagggtacggtcatcatccactacatcatctttactcctttttatgtgcaaccataaaataatacgtcgaacattaattatagtgacgaatcagttcattaaagcaaagttcaaacaactttgttctctttccataatctcaattaatcagtaatccatttaatttatcattgtgtgacgaatcagtgcatcgaagcaaagtttaaacaactttgttctcttttttccataatctcaatcagcaattcatttaagtttaacactttttagcaaaaaattatgagaaaaatttatgactctatctttcagtaagtatgttatgatcgattaatttgagttaaacgaagtagtgtatcatatatagtatatcactatcagatttatagaggcctaatcgtacattattcagttggttatagctagcgatatctcttgattggagaataggaatggaactttgaccgatattgaatacctagtcttcaaggattctacaatataattatgatgatttggtaaatttaattgggttatgataatgaaggcactcatattaaataatcaggtcactaacctctttagacttattgtggccaacaataggaaagtagtctcctttcaactttttctccaatcccaccatttccatgaacaatttttttaattaaaagcattaagagatatttgcattaattaaatgatggataaatcaattgttgttatggtattttactatttttatttatttgtaattgatacaatctaattttgaaactcaagctaatctctatttaaaccggtttttattgttgctttttatttaaagcattcacgttggctaaacaaattagttaacttttaatcgtgttatttctttagagattatatatagtgatataccaaacgcattggcttctcttttttttgataaggtacgtgtatctaaatacacaagatacagcttaaggcacatcaaaaattgaaaggagaaagaagatg

SEQ ID NO: 18211 - DNA, 3003 bp, Unknown; identical to SEQ ID NO: 18210
  misc_feature (1)..( 3003): 2750-1469P.txt file - cDNA_ID_1815694; gDNA_ID_1621108; Annot_ID_171682

SEQ ID NO: 18212 - DNA, 3003 bp, Unknown; identical to SEQ ID NO: 18210
  misc_feature (1)..( 3003): 2750-1469P.txt file - cDNA_ID_1815694; gDNA_ID_2926207; Annot_ID_141809

SEQ ID NO: 18213 - DNA, 3003 bp, Unknown; identical to SEQ ID NO: 18210
  misc_feature (1)..( 3003): 2750-1469P.txt file - cDNA_ID_1815694; gDNA_ID_2926207; Annot_ID_202332

SEQ ID NO: 18214 - DNA, 3003 bp, Unknown
  misc_feature (1)..( 3003): 2750-1469P.txt file - cDNA_ID_1815710; gDNA_ID_1621108; Annot_ID_56022
gatttgggaatacttcatctagctcaatttggtatgaattagcatacatagaggcaaagggaagaatgaagaaagggaataaagcttggcagattgctttaggatcagggtttaagtgtaatagtgcggtttgggtggctctacgcaatgtcaaggcatcggcaaatagtccttggcaacattgcatcgatagatatccggttaaaattgattctgatttgtcaaagtcaaagactcatgtccaaaacggtcggtcctaatttgatgtatctgagtgccaacgtttactttgtctttcctttcttttattggttatgattagatgtttactatgttctctctttttcgttataaataaagaagttcaattcttctatagtttcaaacgcgattttaagcgtttctatttaggtttacatgatttcttttacaaaatcatctttaaaatacagtatatttttagttttcataaaatatttaaagaaatgaaagtttataaacattcactcctattctctaattaaggatttgtaaaacaaaaattttgtaagcatatcgatttatgcgttttgtcttaattagctcactaaataataaataatagcttatgttgtgggactgtttaattacctaacttagaactaaaatcaactctttgtgattgtttgttcatccagctgaccagctctgtctgccgtctaggttatgtgaagaaagttatattcctggttgtttagatttaaatataaaaatggatactttagtttatgtatgattttgaattgtttagatttgaaagtagggaagcccataaaattcaattgatagttgaataattaaaaatgataagtgtcagagagttggagcagtccccgatgagcctacatcagccaaaaaaagacactcatattttcattcttttttttggctaaaactcaccttatatatctgtttatttcaaaagatgcgtttttcttactttttacaacatgaaatcttttattttaaggaaattatagtaactaaccgtagaatacaaaagaatgaaaaaactaactatggagcaacgggtcagagacaatttttatacatttttcatttatataacaataactcatttatcattaaatcatttttataacaataactagtaaccataaaaaatataaatacttcttggatgttaagaaaaaaaaacaattcttcttttgacgaaaaagacttcttaggaaagttgtatacctttaaaatacatgcaagttatatgaaagtttataaaattcacaactcttctttattttaaaacccaaaaaaaaaaaaaaaaaaaaagtcctcttatttatacgtctaattcccatgcatatatcgagaataacccatcatataggaattaggctcccatcatgtgatcatgattcatgagtcatgaccattggatctcccctcattattgttccatcagaaatttctacgtcgatgatatgtttctaattctaattttttttacagcaatttctaattctaattaagaactctcccatatacaaattgatatagatatcttttagtaagttagtaacaacacttaattaaacatagataaatatacgtgcacagatcaattctccagtttaaggaaagaaattggatagatgtatttaaatacttttgtataaataatataactatctccaatacaacacaccgaatcaaatgtcaacatctacatacatgtcgacatgaatttatgaacatatatgtacaaggtgatggggaacccacaaattaggtgtgtggctttactttttttagtgtatgcatgtatagtatgatagggagggaaatagctgatcatcatcttctatggacttagtccaaattcatcacatcaaaaggcaacgaccatgtctttgtttctaacaactttacaccctcccctttccttatctactaactccatgtatctgctttaaaggttaatatataactggactaagcaaaataaaagagagttgggttttcattatagaatcgagaagatttcatgtccctatatcaatcacataaagcgttttccaataacataaaaagtcggataaatgaaaatatttgagaatctaaaacaatgtcatatatactttaatggaaggtccttttcttcgaaatatttgctcaccgaaatcggtgaaagtgatctaagactaaaactaacttgtgagtaattcatgtgatgggccttctgcatcgaaaaagagcatggcgatcacgtggcagcctctcttgcgccgtctcagtattagcctatcacgatagagtaagccaatgtatacagcatggcgatcagacacatgatgatgatcgatctgaataacaagattccgaaggatgtaataaattcatgtgaacagtgcttcgtagctaaactaagaccagagctattgaaatgaggtaaagtgttttctttgtaaccccattttaattaggtgaaatatctagcgcacacaccaatctgattcatataatcataactagcttgtaaactacaaaattatttttcattgtgttacaactagaccattcccacgtgaccattcacgtgctcctataatgaaagaaacctaaagaagagacgctccaattcgcatagacatcccaagcttatcctttcttagtgaatcaagatccaatttacactataatacatgcatatattacgtaataaatgttttataagttttctgtgtcactcactatttttagttattttctcaattttcaatcatcgcaaatatcaattatcacaaaacatataaagtttccagatttgtatatgggcctaccttattagatgcgatgaatatggactaagtacagagctgatggtttttgttataaatatcgtttcctcttctaccctcacctttactctgtttctttctccactctctctctctctcgttgcaagcaacttgttttctgaatccaaagaagacgataacgatg

SEQ ID NO: 18215 - DNA, 3003 bp, Unknown; identical to SEQ ID NO: 18214
  misc_feature (1)..( 3003): 2750-1469P.txt file - cDNA_ID_1815710; gDNA_ID_2926207; Annot_ID_141802

SEQ ID NO: 18216 - DNA, 3003 bp, Unknown
  misc_feature (1)..( 3003): 2750-1469P.txt file - cDNA_ID_1815722; gDNA_ID_1621108; Annot_ID_56014
caagattgtttattattggtcttatataattatgagattctaaaagtgtgatacggttagggttaggcgtatccttttgttaccgttgtgataaaatttcctttttgtttctgctactcaaataagaaaaggaaacaatcaaaatttccttttttcattgaacaaacgtgtacttataaatacaccccttctctcttcttccttgagaaaagtctccattctctcttcttcttcctggaaacctaaaccacgtaaggatttgctctgaatctaaatattgacgtggagaagacgcgatcttactaattctccattctctgcttcaacttcaccgtaagattgaacaaacctttacttatatatacctcttctttcttgagaaatccaaattctccattctctcttcttcttccaaaccaaaacctaattctccattctctgcttcaacttcaccgtaagattgatcggttgataaagcggctctttttggtgattgatctctgttgtgactacatcttaggtcaattcagattgctttcatatcaagtctctcctaatttcacaagatcaaagatcccggccatggattcagttgtcgacggcgaaggagaacacaaacgacgactaaggatgcgaaagtgggaaagagggatataacgaagacatggacaatgaaagcaacgagcagtatagaaccaaatcaatggatcatgatctgtgtttggtactaggtgtttccttggcgtcgacgagatcttttgaaaatcttgtgtttcgtcgatatcacaagcaaaggtattttcttttttccttttctatttttaatgattcattttttactaaataaaaatttatttttagatttttttattaagtgttaaaattttcaattttgtgtaaattaatttaaatttttaacacttgtttttgtttttattaaaaactgtttttaaacctatatttttatactactattaaagttttaaggtttttcttattaaatattaaatttttaaattttgtgtaaactaattggatacatcatccaatcccctaagaggtgttctaggttcaatagatggtttacacatcatttaaatttttaacacttgttttttatatttattaaataaatgtttttaaacctaaatttttatactactattaaaatttgaagtttttttttattaagtgttgaatttttaaattttgtgtaaactaattggatacatcatccaaacccctaagaggtgttctaggttcaatatggtttacacattatttaaatttttaacacttgtttttcttatatcaaaaatatgttttaaacctttatttttatactactattaaagttttaagtttttttattaagtgttaaatatttaaatttgtgtaagctaattggatacatcatccaaacccctaaatagtgttctagtttcaatatggtttacacattatttaaagttttaacacttgttttccttatattaaaaaatgttttaaacctatatttttctattactattaagatcttaagttttttttttaattttgtgtaaactaattggataaatcttaactcctaagaggttaggttcaatatggtttacatataatttaatttttcttatattaaaaaatgtttctatttttattttactattaagattttaaatttttttttgttaagtgtaaaaaattaaaattttgtgtaaactaattgaatataacattcaaacctgtaagaggtgtttataggttcaatatgatttatatataatttaaatagtttgctattttgtttagaatcaaaatatttttaaatgacatgttgtaataattgaccaaaagaaattagtgtgtgattttgttgaaatgcagagtacaaagccttaatttataccaagttatggtatctataacgtatatgaataccaaaattttattatttttaattggtgttgtattttataattcgaaataattaggggaacgggcaaaacctctctgttctctcgcttatattttttttagagagaaagcaaatcagtttcaacgatcggatattttctggtgttagccgtcctgactttttgggctttctgtccgatatcaccggctctggtagcggtgttggttggctctagtccggcagcgtcttgttcacataaccggtggttgctggctcttggtttctctcgtcgatgtagatcgatttttaatctgtgtttttttattttcatgttttgtttttaataattctcatctgagacatgttggtgatagagtgaatgcaatctcgctttctaatgcttcttatccgatctgttcttttttaagttttgatttacagaaatttttggagaaatttgagaatgatgttgaagaaaagaagtggattctgttgttaattatcatagccttaagctgttgtatatttaacatgagcctcgattgctttttatcggtgaaaaaacaaaaagatccatgttctatgagactatcgacggtgattctttcaccgaaatcggtgctcagacggcgaaaatgaagtcggttcgctttagagtactcatctgacacgtatattaatatatcgacatgtggtttgggatagagtcaaactatagtttcttcttctatgaaagactctctgttggcctatttggtcctaaatcgtttctgtaatcgcggacttttctttaagctttgactatcttgattaatacaatatttctcttgggacaaaaaaaaaataatcttagtatttctttaatattttttgtttgggtatgggctattgggccgcttcgaaaagttcactttctctatcgatctctcacagtttctgagttctctgactcaaaaacatatagtagaagaaaacgattagagatcttcttctttctcctgttgcatctgaagataaaggaaacagaaagcgcgagatctgagtgacggagtaatttcaaagggaggttttcgagatcagaaatg

SEQ ID NO: 18217 - DNA, 3003 bp, Unknown; identical to SEQ ID NO: 18216
  misc_feature (1)..( 3003): 2750-1469P.txt file - cDNA_ID_1815722; gDNA_ID_2926207; Annot_ID_141794

SEQ ID NO: 18218 - DNA, 3000 bp, Unknown
  misc_feature (1)..( 3000): 2750-1469P.txt file - cDNA_ID_1815776; gDNA_ID_1621109; Annot_ID_56058
caaaacagagacaagctaataagaagaaaaaacctatcccaaaatcccatctttaagcctcttaacattatataccaaacctaaattactatctcttcgtattactctgattctaacagcaaatattctgaatttcactcctaaagtacttaaagagagaaacagagaaaaattcgaatctcacctgagtagttctggtggcgaattcaacaccaatagtggatttagattccaagcaaaactcattcctggtgaatctcgacaagatattcgatttcccaacaccagaatcaccaatcaacacaatcttaaacaaataatcatattcctgatctactctatgcgtcattttctccttctctcttcgatctcgcaataaaacctacaaattcgaaagaaaaaaaagacagaaactttattacttttctccaaaatcaaacccagatccaacgaaattaagacgaacccacaagtaattcagaagacgaaaaacgattcgtgtaccttaatggcggatgaatcgagaaaaatatcgaattttttgagatctataaagaaagaaactttgagtaagaagctttaaatgtttgttctcactcacaatcaatggaggaaaatggaatttttcttgtttaatttgatgggcttcgtcttcttcttcgtgagaaagaggagaggagcaataaagtgaatatacggtgtatctatacgtatctctgtgtcagggaatagaaacgacgtcgcgtttgagaaaaagacaaagacttcagttatcgtgctgatgtggcaactaatgattcgttagcaggctggcaaaaagtaagagcatgttccaaggggtattattggaaatgtagttttgagctttataattgcgttaaagagcaatgattgtatttgtgagtgtggtaatgataataagcaacgtcaatttgaaaatgtcgaattaacaactttaatagaagaagaaaataatgaaatgaggatgtgatgaattgaccactacattcccaacttcccataatatttgtaagaatatagttctgatccatataatataattaaacaatgtggtggttctggtggcgatggccgatgggcaaatgaagatggtagtggatcatgtggcggctttagaaggcaacatgctacaagtctagtggaaaatacgtcggagattgcgatggtaataggctaatagctatagaggacgagactagtcttttggtgcgacacatatagaatgttacattctaatctgatgaagatgaggaccattaagtcattaacgctaaattattaatccctgaaacgtcatactttttttcaacctaacgtaataacttcattttgttataaatttgattttgtgccctctaataaaccaagttttttttttgtttttttttatcgcaaaaacatcaaataattaaatttgttcgaaaaagttagtttcgtgggccaactactccgaaacgagagggtttatatgggaaaaaagtacacctcgtactcttgcactctttgcgaggcagacaacacggacattcatagtgcgtggaatatgagataaagaaaaccgaccaaaactagctttaaatctagcaaaatcttttccaccggccaatctttactttcatcaaggatcttaagtaagcttaagcaatcggtttcaaaatgtatagattggatactttgttgtaaagtgcactccattgtccaaagaagagctccgagttctgcgtagagggcattgcgataacaattctggctactttgaccaaacagcttggtcgttgagctagtcaacatgaaccccaaactaacattctggttaataccagtccacgaagcgtcaatttggcacatagcttctcctctttgaacgtgcgcatactcacaagcttcaactacttcaggttcttcctccgcatcaatgtcatgttctagttcttgggcaactctccaacttttcgactcagaaattacatgcgctagaatatatggtgttatgtactcccgtaacgtattttcaaaaagtatatatttgacctatttaaacatttattactttaggttatgaataatcctgacgcaattcttgctgattagtcttgacgcaattgtacgttgctattgattttaaacgaatacagcacaaaagaaggcaatcgcgtggacgaaagaggagccgatacatacaattgcatacatctatttgtatactatatttgctttctattggataattcaccctaactattaagagtacatttagtcacaatatctaaattaaatctataaatgtgaatatgcacatagagttttcacaagtggtcatattttaaggataatatttgatacagttcttaatttctttggtacattttttgttacctctctagaaaggttaattaattagatacatcgcctgcaaaagtacttttaagaaaaaatattcgcgtggagaatatttcgttcgttcatgtaaggtcaaatgatgaacctcttacccatgattaggctgccataattaataaaccgaattcagaatatacattccttacttcccatcattctgaattgcccaaattatactcatttctagtcataataaaaaaaaaattaacttctagtggttagtcaatcttttcttttgtcaagagaataaatatcaagtcaaagaaaattctttctatttaatatttttctctatattcatgaacaaacaatacaagtaaaagaaaaataaaagatgatgcaaggattagtagaacaagaaacggtagcaaattaaacggtgcattcaaaaacctattaatatggaaagtacattatactgtcattaatatataagaataatttgagaaacaaatcttaaaggagtttgatgaggactttgattacgttctatgtacatacagtatctctccctataataatcctttcattctcacaatcttgtaaaatttgattataaccaaatcaatcaaaaaaatg

SEQ ID NO: 18219 - DNA, 3000 bp, Unknown; identical to SEQ ID NO: 18218
  misc_feature (1)..( 3000): 2750-1469P.txt file - cDNA_ID_1815776; gDNA_ID_1621109; Annot_ID_171739

SEQ ID NO: 18220 - DNA, 3000 bp, Unknown; identical to SEQ ID NO: 6852
  misc_feature (1)..( 3000): 2750-1469P.txt file - cDNA_ID_1815780; gDNA_ID_1621109; Annot_ID_56057

SEQ ID NO: 18221 - DNA, 3000 bp, Unknown; identical to SEQ ID NO: 6852
  misc_feature (1)..( 3000): 2750-1469P.txt file - cDNA_ID_1815780; gDNA_ID_1621109; Annot_ID_171737

SEQ ID NO: 18222 - DNA, 3003 bp, Unknown
  misc_feature (1)..( 3003): 2750-1469P.txt file - cDNA_ID_1815799; gDNA_ID_1621109; Annot_ID_56050
aaatgttccaacactttgacaatctgccagaattccggtctcttgtctgtttgcgatgaccaacatcgctcgatcagctctttcatggccgctggacaatccgtcggtataactggcctaattttctggccaatatcgaaacaatgaaatgtttaataacaactgaacaataatgatctaactcagtcagatctatgcaagatcacaatcatgaaataaggaggagatgcagaatgatttaccttgtatataactagatcacaatcatgaaataaggaggagatgcagaatgatttaccttgtatataactgcgtaggcaatttgttcagcaaatttcatctcctcatatggaagtgctccagctaccatttcccataaaagaagtccaaaactataaacatcgcacttccgtccatgtggtatccgttttaaaacttcaggtgccatccacctataagttcctatgttatcccccaaaacatcacagtactcctcctcgcacgctatgccaaagtcagcaatcttcaagtgaaagtcattgtcgatcaacacgttttctggcttcagatcctgatgaactatctctcttgagtgaatatattccattcctttagcaatatccagaccaaaatcgattagctgttccaaaggaagggatttctgctcgagcttgtgcagatatgatcttaaagaccctcgaggtacatactctgtgatgatacagtttccagtattcactccaacaaactgtttcaggacacatcaatcagaggaaaaaagtcaaacaaaccataatcataattttcaaacagagttgaaagatgtaatgttaattttcaaaggcatcattcatatttgatacaacctaaccaacataatataacatgatataaactcaccttaacgacatttggatggcttagtcgagataaaagagtggcttccacgataaactctttttctaaacgagctcccaagaatatgtcgtcactatcctcaggcgctgtgataatcttcagagcaacagctttgccttcatattcaccatgataaatctggctatatttcccgtgagcaaacctatccccataagacaacttagacacatcaatgaggcattcttcaagcactcctgcagaacttactttagaacctctatagtcaacagactttgaagacttcttatctatcttgctctttcccctctctttaactttctgcgtactaagatccctaataggacccgagtgagacagggaccgtagattaactgattttttctcagaagaatctttgcgggacgacgacttggccttcattcccttctctggttccactcttctaggatgtggagtagaaaacctcttaatatcagactttgcttcgataaaagcatcagaaagagccatatgaggcaacggagaaacagatctcttcttattagtaactggattcctctgcacttcagtaccaacaacactaccacaactcaaaccagtcagctgctgcgtactctgacaaattcctacaagtgatttcaaatcagatggtgaactcaaagtcattcttttcaatccagaactcttctcttggtttacagtaaaaggcatagattctaaactcggcgtaatcatacgataacaaacagtatgagagaaatttgctctcctaatccaagaagtaacctctccatccatgtttaaacccctccccaaaacaatcacacaatttcttaatcaagcaaagccataaagacgaataagataagtatcaatctccaacaatctcgtcttcacagatccattgaagaaacaccatctatcttcctcaaccattaaatccaaaatttcaaaatttacctacgaacaacacatcaccaaaaaatctccggaaagttttctgaattacaccaccaactctacacatgcgctcttcctaacaaaaatcaatcgaatcaaagaacaacaagtatattaagaaacgattttgtttcattgatgaatcagaaaaaaacgaaatagaaatcgagaacgtacctgaaacacgaatttttcaaaaaacaaaagtacgaagcgtgaaggtcggggaaacaggaatcggaataatccgtcgaaataggttttgagaagagagaaatcaaacggagaaattgatagcttcaatggtaagcaacaacaagacgagagagatttcgagttcgtattttttttttttttttggtctttgacggctttagagagaattttagtattaaaaaagttgccagaaatacgaagggaagacaaattctccagaattttggtcaaagaagaataacacggtagcgtataaagattccaaaacggtagcgttttaaactatcctaaacaatcagatatctaaatttaatagtcaacttaaacacaaaagcgtttgtagtccaatggtaaggttctactcctagcagtcgcatttgcctctctaatttatagagatcaacgagaaaagaatattgcacaaactaattaaaatatccaaattatcacaatttttatctcttaatcgatttattatttgaaattgtattgctttttttgtgtgttataaaagtcaaaattgtttcattattttgctaaaagttcaagaataatcagtaataacctaaaacaaaaaaaacatgtcgagtgttggaactgggagcatttacacacacgattctctcgcagtttggaaaacaaacgcaaccattcttttgcatgaggctcgaccacgtgcctcttcccatctctcacgtgtttcccttttagaaaaattctaaaaagactacagagaaaatccaaattgaggttttgatactcccaatgaaacgtcgtcgttgtatcagttccaacgactcgctttgcctctcctttcttcttctctctacaaaataggattcttcgtttcttcctcgaatacgacgaccacgatactgaccaggtgagtaatcataaaccctatccctctccctgctccaaacaatg

SEQ ID NO: 18223 - DNA, 3000 bp, Unknown; identical to SEQ ID NO: 6850
  misc_feature (1)..( 3000): 2750-1469P.txt file - cDNA_ID_1815803; gDNA_ID_1621109; Annot_ID_56049

SEQ ID NO: 18224 - DNA, 3000 bp, Unknown; identical to SEQ ID NO: 6850
  misc_feature (1)..( 3000): 2750-1469P.txt file - cDNA_ID_1815803; gDNA_ID_1621109; Annot_ID_171726

SEQ ID NO: 18225 - DNA, 2273 bp, Unknown; identical to SEQ ID NO: 6874
  misc_feature (1)..( 2273): 2750-1469P.txt file - cDNA_ID_1815814; gDNA_ID_1621110; Annot_ID_56080

SEQ ID NO: 18226 - DNA, 3003 bp, Unknown
  misc_feature (1)..( 3003): 2750-1469P.txt file - cDNA_ID_1815818; gDNA_ID_1621110; Annot_ID_56079
atgtgataagcaagcaaaaatgtggcccttgttgtctggtggtcaacctgtaactgttgctatgcatgagggtcctatcgcagctatggcttggatcccgggaatgaatctccttgcaactggaagttgggataaaactttgaagtaagaatgattgttcattatttcctatgactgaatgtagcaaattatagaatgttgactgattcatttatttgctgccatgaatttaatgatgtatgttggttttccttccagatattgggacacaagacagcaaaatcctgtacatacccaacagcttccagacaaatgttatacattgtctgtgaaacatcctctgatggttgtcgggactgccgatagaaatctgatagtcttcaacttgcaaaatcctcaggttagaatttttccttgttgttccatgttataacttgcgcatgagagttctaagtgctaacaatgctgtcagcatcacatggttttgggaattcgtgatcaatttagcccatgtgctatcttacaaagaatagatgaacaggctttcaccattagattaacagtttctcttgtgtaaactgtagactgagtttaagagaatccaatccccactgaagtaccagacgaggtgtgttactgccttccctgatcagcaaggttttttggtatgtcttcttatttatgttctgttgtgttttggttaattcagttttacaggaattagcttgttcgttagatgcttacattttaggttagacattgcaatgtttttatttgcaatctcgagaagattttatgtatgtcattctagcaaaaaatagagtaattttatatgggagattgttttgctagtcacatctccagatcctatctaaatcacaatggtgttgaatatgaaaaattaaccagatccaatgatctctataggttggttcaattgaggggcgggttggtgttcatcatctggatgattctcaacagagcaaaaacttcacattcaaatgccacagagatggaaatgatatatattctgtcaactctctgaatttccacccggtaagctctatctatagttatactcttatactcgtatgtattctttgaagccttcagcatatgttgagcgatgaaaatgattgtttgagttgttgtggatttaaggtacatggcacttttgcaactgctgggtcagatggtgctttcaatttctgggacaaagatagtaaacaaagactcaaggtattttcctcctgcattgattttttattttgttaaccaagtaattatctaacagttttgtattctgtgtccccacaggccatgtcgaggtgcaatcagccaattccatgcagctcgttcaaccacgatggatcgatatatgcatatgcggtatgatataaatcttatttggtttcactttatttgtacatgctcatgttatatgttgcaaaatcgagatggtcttttacttggaatctaaaaccatcattgtgttgaaaaacctttgagagcatacatgaatgctttctaacatgtattattatataggcttgctatgactggagcaaaggtgcagaaaatcacaacccggcgactgcaaaaagcagcattttcttgcacctgccacaggtgtgtgcgcgtcacagacaatagtaatatcatcatgtttcctaaacattagtgtctgtatctaacggacggaatttgttttaaatgaaattgcaggaaagcgaggttaaggccaagccaagagttggagcaaccggcagaaaatgagcgttgcttagtctgatttcttcgctagtgattttttttttttttttagcttgtggacttcgttgggctttgttatctactttagttcatgacattttgaatatacattaggagtcttgtctaaaagactaaaagtaaatctctaatgtttctagttgggcctaatttggaaccatctcgtctcatacctctttcgtttcatcatactaaggaaatctttttttcttatcaagaatttattttagtacatctgattccatagttaaactttagttattttaataactcaaatcaataaaatcaaccaagaaatgtttatctaaaactagtataattaaaacgactaatgttttcttctctcattgttactgtcggagcaaattttcctaaatttggttattagttaattttttttttggttgtgtgattaaatatggtcattagttagttagtgaagaaagagagagagataacgtggcagtagattagtggaagcaggagaagaaagcgggaatgagcaaaggacctggactttgtccatagccaagaaactcgcgtcctcttcttcttcctcttcacctatataaacactttgtcttcgaccccaattttccttcaattttatataaaaaataatttgttttcgttttttgtgtttctgtttttctcccttttgttcttctgtttcgttagaataacaacagaaaagaaaaaaagatcgtgagaaaatttcactttgaaaaagaaaaaagtgcagagagagatactttggaaaaattttgtcaacaaagaaagaaagaaagaaagaaagagtgaaaaagaaaacaaagaaacacaccaccctgtttctgtaaaacaagatggcggggaataaagattctagctgggacgatatcaaaaacgaaggcatcgatctcgtaagtatccttctccattaatattcccctcttttacttttgagttagctgctcattcttggttttgaaaacaggagaaaataccgatcgaggaggttcttacacagctccgatgtacaagggaaggacttaccagcgacgaaggccaaactcgcctcgagatcttcggttctaacaagctcgaagagaaaaaggcacacatccttaaatatctttctctttttgtttcttcactctcaagaaactccatctaaaaccaatttgaatcatcccacaggaaaacaaggttttgaagttcttagggtttatg

SEQ ID NO: 18227 - DNA, 3003 bp, Unknown
  misc_feature (1)..( 3003): 2750-1469P.txt file - cDNA_ID_1815822; gDNA_ID_1621110; Annot_ID_56078
ttgtaacgcatcatggatattaccagcaagcaattcgtaaagcttaattctctccttctcaatgaaattaaaatccagcccattccttctccaaaggtgaagctgctgcaagatatcattgcggtttacagttgatccaccagcctggctcaacaaacaagcaagtctaacatctcccttagatatggcaagttccacagctgaatcaagctctcgtccagttagaagaaagaataagtgctcaaggtagctagaaccatttagatcactcacatcttcttgtacacggtgactgacactttcttggagccaacaactgaattctgctcttcggataagcggaagagcttctgtatcaatttttgcagaatcttccttcacatcctgcatcacgtcttcctcgttatcagaagctgcatacatcaaacgttcagtactctgtctctcagaaaagagaacttttatgagttcccagaccatgacttggtgcattaaaaacagcttcgcagatgtggacaacccagcaacttccagctgtttctcgattataccaatataacttcggcagatatctgaaagaactacacgatcggtgacaacattctgaagtttaagactgaaagagccaaacctaacttcttcttctacatgattcaattccttgtggagacttaagggagcctcaaacgcagaatcaataagttctttctgaacttttccctttctatcccaaaccactttgtcaattgctatcttttctttattgatcacagaagacaataccatctgggaactggagctacatattggcttaccagtgtgaaaaagaacgccatttgggccccaacctgctcggaacgatcttcccatgaataatgctgcatcaacaacattgcgggaatagttatcagttaacggtgtgacatggctgatgtccagctcgaaacctcccgttttcgactttctcactgccaaattcttattttgttgtaccatcaggatactacctggggagcttttatcattaccagggttatactccagcaaagcaagcggagttttgcgcacgaccggtggagggtcttgatgactatttctttgagcaattttctgcgaaggtcttacatttcgtttagtcaaggatgtcataagatgggaagtttgctctctaaagtcctcactttcgtcttcatcttcattaggaaacatcagcattctcatttctttcatcttttcaggatcaagtcctaaatgagctgggagagaatgagaaagctctagctccgaagtttccatctgatcttcttcatcaatgtcagctacctttttaccatccagtcctacgggatctcccaaacctggcgcatcatccattgcaatatcttctgcctcatcatcactcaacccaaatctgctgaaatgaggaacgaagaacttccataaaccattatcgggatcaaatgagatgaaagttgctccttgtctttccgtgctctgtttcaatttataagcaatatggttaacttgctgttttccccaagttagatctggtatgtttacgaccagagtcacctcagcagccttgttaagtccctcaccaacaaccggcttggagctctcatcatcataaacaataacctcgtgcctatgaaacttaactatgtgatccaggtccaaccttctaacatccgtgtttccaagaaacctaatataaccgtaaccaatcctgccaatagtaaaatcaggaacccggctgcaataatcagggctttcaatttctcgctcaaccagctcgtttatacatggcttcaagaagtagtcaggagaattcaacataggcaatgaatcaatgatctctttggaatgctcacacaaggcagcaattccatctaaagagatccttcttttctttcgcgagtccaaatctctagccatccttgaaatctctgtcgacatagaatttttgaaaatttcaaaatcagatgataaaagttacaacctaagtagcacacgattctgaatcaaatgaacttagaacaggacttgagcgggtaaggtcagataaaaacatagcagagactcaaacatcagaaaaaaacaaaaagcaaatcaatgtactctaagcatcagtgttacaaactcgaattttataagagttgaatgatgaacatgattctgaagctaacatgatatgtaaaacattaatagcccaagttcaggcgcacgacttgagtagctaaggataaaaacatagcagagactcaaacatcaatagcaacacaaagaagatttacctggaaatggttgaatagaaagagacgtcatgattgaaggaaacagaaacaaacaccgagagggtaaagaaagcgacaagctagggttttctttcttataatcactgactctaccgcgacctttccgatttctcttacaaatccattactgagacgacgctaacttacggcggtgacgatgatcggataaaaatctaaaaccgtcctgattcccctaaattccagagttcttcacactgaagtggtcggagttagccgccgcaggggaaaagagagggaaagctctcatagtgtgtgagatctgccgggtttgtttaggatccgtttaaccacccgacccgaaccgaattcctttccaattaaagtcaacattgggccataataaggcccaaatattaggcccgataatgtttttccttttttcggtatgaaaatgttttaatcccagcgtctgataaacgctgcgccggacgtcaatgtgacgcagagagacctttataagtacttcgtcgcattctctctcttccgactcaattcgttttccctcctcttctgcttaccggaaaagtctatatctccgacggaccttcttctctctaggtttgtctcttttattctgataaaagcttttagagaaggattacttatgtgattctgtctcttgaattgaacttttaacagttaatcagacctcgcgctcgtgataatg

SEQ ID NO: 18228 - DNA, 3003 bp, Unknown
  misc_feature (1)..( 3003): 2750-1469P.txt file - cDNA_ID_1815844; gDNA_ID_1621111; Annot_ID_56087
tagtgggaattaaagcttttatttggggtctgtaataagtaggcgagataagttactcttactctttgaaatctcaaaaccaaaataaaaagtgggaacttaattatgacaatatacatggttcataaaaatgattattcttgataaatgaaccaaccataaaagaaggaactaacagtattccacaagaaaatcagaaatcaagaaatgaagaaaaggagccatgacgtgaaggggaaggtagggttaattaggcggcgtagatgtggatgtgaagggcgatgagggagatggtgatgaaggcgaagaagaggagagtgtggatgacaatggaggggccgcttgtctgaaacccaccgaactcaaccgctttgctctttccgggcagctgaaacaaaactccagggctcaacacgatgaagaaaattaccgacattagcaccggtccccagtccaaccccatctttgttttctgtttcttctctagctataatatacgtctctctataaacatctaccactttattatgtgcttatatttataatgtacgcgtaaatgtgagaatgaacttgatgtcaatacgattaattaataatatatatgtggcttgggctggacaaaagtggagggttcttctcaagtttgtgggatgaaggaaagaactattctctgatatagtattttaaattatctgtacacaaaaataattaaatatctagatcgatagtattttgcttgttttgaaggccaagcatatgattctcctcctcttcaggcatttcaattcataagcaagcatatgattctcctcttaaggcatttcaattcataagccaacatataacaccttacgttcttgctccggttctgagtttaagggaagtccatccgcttctgacggatgtaataatattcatgcaacatatataagtcatatatatactgaagtaattttaaaacgtcaatcgcaaaaataatacacaatacactaattaacgccataatttttatttttttaacaccataattttattatgcactaacgcggttattaatcaaatcacgtagtattagtaatgaaatagggataagatccacatgaggaaagcaaaagaatcgaaaccaaaccaataaacgcaatcaagtatcaaacactttaactttatatacatagccactaaatgtatatatccatccaacaagaaagaaagatactggtcaagtctcaatctgccttcttttgtcatccttaaataatctcaatagtttctgaatttcaaaaaagtacacaaaacacacctattatcacacgtacaatatatatataccaagtgcattaatacacttgtgtgtgtatatgtaatattgttccaagtagtgctttgacacctaataagacgatcaaatctttttggagctctaattgaggtagatatgggaggagcggactgggggccggtggcggttgcggtggtgctgttcgtagtgttatcgccggggcttctgtttcagttgccggcgaggaggagagtgttggagtgcggcaacatgaccacaagcgggatctcaatattggttcatgccattctcttctttgctattatcacgattttggtcatcgccattcaaattcacattcacatctaacatctttattttaatcaccggcttatgtttgtagtataaacctagcttggtataatattgttatctattcatctctcatgtgcttgtttttcttttcatttttaagataaaagtgtacaagttagcttgtgaaactttactgaagaaaatcaaaaatagagtaagagtagtataaaatacttgagaataaataaatgtttggtttgcctcgttatcacttcttgatgttcccacgatcgatcccttcaagagaaaataattaaaacgaaagattgcattcgtatcagcatttatggcggatgattgcgattattaatgcctcctgtaaaacgtgttttattctgtttcttttgaaaattctttcgtcgaaatgaatcattgccgtaaataatcagacattaatatctgattctatctctttaattacatcagataaaacataaaaatgacaaagatttattataaaataatatagaaaatgaaccgtcggaataatgatctgatctcgctatcgataatgaagccaaaatatatatacagtagaaactaatgacataaacgaggttaaaaaatactatcaaatgcatacatcacccaatcaattatatgtggctgcatatggtaatttctttgtatcctcgattaaacgcaacctgtattgtaaaaaaaaaagggtacacatacagaaaaagactcccccaggcccagtagacattttgaatatagatattttctgaatcaaatgttgattgttttttatttttttttgggtaggcaaatgttgattgttgtatatagaggaataagctattgttagaaaatagtttctatttaaaagctaccagtaaacattggtggtgtgtgtgatctatcaactgagtgagattttttttataaaaaaatttaaagaataagagagatcatcatatattcagtcaatcttttttttgtcggctagtattatactaatcaatttgttttttttttctttgtcggctagtatactaaatttgttagttatcagatttaagttaaactttgaatggtaagttactaaatgagacctggaaaaatgattttgaatgtggtcccaaaatgtaagtatgacagggcatgcatcgccgccgaataaaatactagtaacataatgggaaatatttcgtttaatgttttgtctaattattactctaagttcgactaatacatttttttattaaaaaacaacaactgattaacaacagtcctagttaatttcttgtgaaagaaagattaaagggatctaaagatcatcatcaattcatcaagagaccaagaaagaaatacaaggttgatcgtacaaagaaatcgaaaaaatg

SEQ ID NO: 18229 - DNA, 3003 bp, Unknown
  misc_feature (1)..( 3003): 2750-1469P.txt file - cDNA_ID_1815855; gDNA_ID_1621111; Annot_ID_56083
ctctcacaatggttaagctgttctctcggaatgttctggttatgtctgagagaagaccaactcggtcttctgctgataattccagctctaaaccctgaaagtatgtttcatatgcacaatctgtcttgagtatatcagaaatcgatgcagaacagaatgtaatttgagccaagacagagaattttcacattcctaattggttacctccgatgctctcctctcaatggctgcttccagacattgtatgacacgttcttgctctgcttctgagtttatgggaagtccatccacatgacggatgtaaaattcctgcagcaaaacactcatattattgttagaagagagatcccaacagacggccgttgagtagttacctgataagcctccactggttctgtgctgaccatgccatggaacaccacatactgcatatcagtcaaagtacagactacgtcaaacacaagctttggtctatctttggacctcatggtaacaacggtataatccttctcaatgttcattagtgtgacactgggccttgacgccgatgtccttgctcttttgactccctcgtagtccctatcatcaaacatgatctgatgcaaccgtctctccctgtgtgtatcagaacaagagaagactgttttcgcagctcttgagccgctgtttgtcctcactacattgcacagcagctccttgatggtggaaaggcgaatcgggtcagtaatggcagaatgagttgaattgtccgtgacatgaataaccgctgcagctctggtgttgtgagtccatatctcagcgttcacaacgttgcagtgaaggtctgtgagaacagcagatacttcagacaagagaccgggtctgtcagttccagcgagctcaatggatgtgtattcgtcagtgggcattacaccaactgagcttctcaaaggtggaatgaaccacccagcgttgctctctatcctctgcgcaatgaattcaacaaacgttttacacaaagaaaaaaacctgttgaaaatgaaagaaaaaaagtgatgaaatacattagaaaccttttggatatagtcaaggacttgagtgtctctgatcttattgccatcttggtcgatgactttgaaaacgtccatgaaccaacctccatcggaagagatgtaagctttcttgatcacaagattcatatcagtgagcacttgtactacttccaatagagtcccatgtttgttcacactatcaaccttttatttagcaccacaaacaaacagggaactctgttttctcaaaatctctttgtttggtacagaaccacttgaacaatttgaagagacagatttatttacctgaataacagtggcatcgtcgcttgcgttgttgtctattacaactctgtatccaccatgaaacatacataaataaagatgaatgttttagcagctggaatctttacaagggtatagaggctcacaaacggagcatggagaaacagaggacctagaaaacaataaaagagtatggagagaaagagaaaaacctgggaggattcattctcctgatgagcttggcatattcatcatcatccatggttgtagtatgtatctccttggtgatttggctgcagcagaaacccagaagagtgtgagtcctccaatttctgaggaaaattcctaaaagagagagggagagggaagttgaaggaggataaaaatggtaggccaccggaaccgaaccttgttttcattagttgatcgagcacgtgccactaaagattcttagagatgacgtggcacgggcacagcaacttttagattctgttataattgttcgaatactaccaaaagtcgggtgaagatttggggtcaatttgatgatcataaaggggattatattctccttctcaagcaagatgtggtatttactagtataatagatcattcgttatcttgaggtagacctctccgtaacgttcacaggtgcatgaccaagtaacaatttgattcctttccagcataacgtcatgttggttgcaaaaagaaggcaaagtagagcaagcaagcaagcaaagcatttttcttattttatattttgttgcggattccaccacccacttgaaaaattgacatgtcacaatgatttcgtatcctagtcttttattatttaacactctcacaatcccattactctacacctctttcattaagtcaacacacggttttcaaaaatccactaccctcccaccacctagaatcttttgttacctaccaacaccctcctttgttctctttatatattggtccaactaaatcaataagggaaagcatccttttggttggaggaattgctttcattctcactctttgtgtgttgatcaatggactagctaataacaagttcctcctctatatatttcaaaagaatggaacagaaacataaacgaaagacagagtacctgatgttgatgattcattgtctgtctggagctcccaaatgccttttatgcttacatattcataaccaacaacggctattaattataaaccaaaaacacgaaataagtttgtagcaaagtgaaattaggaatcttggagatggatccattagtagtaggataataggatatgatggaatttggttggggaacagtgataacttacgcttgcttccggcgccgggaaagttggaaaacctacaaagtacagaaatggatctgggccttgaagtgggctttttattaaagaaaaaaatacatctccgttatcaatcaccatcttcttctatctacaaattaaagaaggtaacaacagaacgtggtggatcatgtggttaggcattaattatttgctttgtttcgccgttttggtaacacacagacacagttccggtaagagcttttgcagccactctttatagttatttagaattggcgatcgaatcaatctcactccctccctcccttaagtcttgttgaatctgctgaattgttttataaagagttactttggcaaaatg

SEQ ID NO: 18230 - DNA, 3000 bp, Unknown; identical to SEQ ID NO: 14155
  misc_feature (1)..( 3000): 2750-1469P.txt file - cDNA_ID_1815954; gDNA_ID_2214703; Annot_ID_136908

SEQ ID NO: 18231 - DNA, 3000 bp, Unknown; identical to SEQ ID NO: 6895
  misc_feature (1)..( 3000): 2750-1469P.txt file - cDNA_ID_1816083; gDNA_ID_1621115; Annot_ID_56169

SEQ ID NO: 18232 - DNA, 3000 bp, Unknown; identical to SEQ ID NO: 6908
  misc_feature (1)..( 3000): 2750-1469P.txt file - cDNA_ID_1816099; gDNA_ID_1621115; Annot_ID_56191

SEQ ID NO: 18233 - DNA, 3003 bp, Unknown
  misc_feature (1)..( 3003): 2750-1469P.txt file - cDNA_ID_1816103; gDNA_ID_1621115; Annot_ID_56190
tgtccatttgtattccattatgaggcagctctccaatgagttcaatagccttagggtatccattttttaccttaatgcaacctgcaagcaactaagacatcaaagataagatataattcagaagccaaacgaaacgagatgttgcatatgcagtcatggttctttcacctatataattctaaatgcagaaacgtatcagcaagtctcaataagctaaaggatctaaatcataagtgaaagggggaataatcgttctaagcttcaagggaagaaaatatgcgaaatattttgacactcactaaagtgacgaaaacttcagctggcataccgtgttatatgtaaccacatctggtttcagaccatcgcgcttcatctgatcaaacaatttgatgcagctgtcaagctttccattcttgaccagacaactaagaatggagttacatatatagacattgattttggtagactcgtctggaatgctttggtatatttctagagccttggagacatttttggccccaacaaactttatgcagctactgtaagttgaaacactaatctttccatgttgttgcatccattcaaagagctacaaaaagaaaaacactttgattgactatgcacatcttggaactcttgttcctcaggaaacaatgaaacatacaatagtttttatgaaaccatgttcaaagcaacagacctgtataagatcctgccatcttccagagattccaaaatcacgcaaaattacattcaaatcttgtaccttcaaaactgttgctaatctgcagaggggacagttacatcgtgagaaactacagtatccagatcctgaacactcttgacgacggagtataaagattacggcatgctcattaatcgaatcttggatacaagaattcttatgtatctctagtaatgatgtggtcaattaactttccccaatttgaatcaatttaacattctatagagtatagaccaattccattagcaggcactactacatctacttcagaactgagcattctagagatttttgtttacttctgttaagaacaaaatacgtttttaaagacaaatttttgaaatgttgactgaagtaaaatgaatcacagaatttgaagataagtgataagtaatagatagtaagacctctgcagagaagagagaaaatccgaggagcgttgaacttcagaaatggcggattttctcgccaggtatgaattggaatggcgtttggaacgaggagcttctgctacgttcgccggtaattcaataacagcggaagatgtcgttgccgccgtcggcgtgaggattcgtaaggataaggcgggaatggagagagatgaagagggacgagagtgagtgttgaagagatgaggaggacaacgtagttcgagtcccacaagaagtggcgtctccattgttttttcgagctaaccgagccagagcctacgaaagtatccatccatctttgaacatgttcttgtttcttttaccaaagtatccccgcgtttttaattgtaatctagtgctagtttgagaagtgaagggtagtatagtaaattagaaaaaagttctaatcccaaatggccaaatctcatcctcaacaacgcaaggacaaacgccgttttatgatgggcttttcgggagagacaaatgggcttttaggcaaaccattaatttgaaaggattatctaacgggccatattgttaaaaaaagtgcaacaccaaattttgtaatgttgtccatatccaaattggtgacgaaaattctgagaggaacagtaacaaaatctttgacaaacaaaaaaagaggtacagtaacaaaatagtttttctggacaaatattcccatgcgcacgcacttgtcacatcatgcactgttctttgtgcgtcctatgtattgctccatgcactttcatacaagaaaaataataacttgtcatcactgacatgtttttcaacaaaatggcgtttctattgaacctagtttctctaaattacatatgtattgtagaagaaagaattcaaaaacagaaaacagattctttgcatcggcttgtacggcaggagaccgacaaggaacaagcacagccccactccccttctcttcatacgtttcgtgacacccacttcaccatttttttttgtttttttttgaatttttaaccacttcaccatttcttctcgctttggtcaattttttttatggaattcttaacctacaaagttggtatttaaaaaaaaaaaaaactattaactcatatattactttttgatatacccctattaactcatatatgtaacatgtaaaattatactatttcatactacgctaggactatctagaccagtattttgctaatcacacattcaaattatatgcgagtaactttatcttcttcttttttggtaacatatgcgagtagcttaccactatcacaatacttaacttacaccgtcattggaatcgaatctcgtagtataatattagtcattggattatagaatacacatacaagcacaatgaaattcgatagtttccaatcgttaaattattttcatacggatttaaacacatattagttgaacagaagaaaagacaaagatttgaactccatactaataataaccaataagcattgaagcagaagcaacaaaaataactagcaatatagtaagggtcctatcaatatcatttgtcttgttttgttgtgttgtcacgattcaccaagtccctatcacttggaatcgcgattaacaacatcgtccatatctcttttatatatatcttccgacgtcaacatcgttaatcgcatctaaatttagttatttaaaaaatcatcagcagaacaatattttagtggtcgggcttttttatttattcagcgatatctgaatctgatcctggacggtgtgcaacgtctttttccgatttaaaatcatttttttgcattagtgcgatttaattgtgtttctaaaacctatcacacaaaaatg

SEQ ID NO: 18234 - DNA, 3003 bp, Unknown
  misc_feature (1)..( 3003): 2750-1469P.txt file - cDNA_ID_1816111; gDNA_ID_1621115; Annot_ID_56188
tcacataagctatattatttgtaatcaaggaatgcggtcgtgctggcagggatggccagcggtcatcttgtgttttatattacggttatggcgactatgtaagtgcatataaaccaacatattgtatttttcttatccgctttggtagcctggaacgatgaagttctttcatctttccgctcttgatcatgtttatgcatataaaatataatttcagatacgagttaagcatatgattagccaaggaggagttgaccaaagccccatggcaactgggtataatcgtgtagcaagttcagggaggttacttgaaacaaataccgaaaaccttctccgcatggtacttaatgtgaagaatcctacttttttgctttcaatggtatacttgctgagatatttctcctattttattgctgcaggttagatactgcgaaaatgaggtggaatgccgacgtttcctacaactagtgcatttgggggaaaaattcgattccacaaactgcaaaaaaacgtgtgataattgttgcagtagtcagagtttgattgacaaagatgtcaccttgatcacaaggcaactggtacagaaatcattagaatgctcactatgtatgtgttatttttggtcacatctcactatcttctgtgcgttgcacaggttgaactggtgaagcaaacaggagaaaggttttcttcagctcatattcttgaagtctacagaggttccttaaaccaaatggtatgcacaaataataattatccatacttccttcaagctttatgagatatttctacacatatattttgtttttcttccagattatgctaattattaaaacctgtttggcctcataaaccatagtctcttttctatacttggtaaagactaattaataatgaaagcgtaatccaaccagtgtgggtcgatctcttgaaaaaataactgttttctttgcatctaggtcaagaaacacagacatgagactttgcagttccatggagctggaaaacatttatcgaaaattgaagtctctcgtatcttgcattatctcgtaacagaggatattcttgtggaagatgttaggaaaagtgatatgtatggatctgtgtcatcgttgctccaggtacttaattgtgaattatttccatttcgcttctccctctcagtaatgattgaggatgatagtaagctaactggaaccctaattgtctctatttacctatttgtatctaggtgaataacgcaaaggctaccatactattttctggaagccagactatagtgatgaagtatgactttgcgcttatatctttctttatggtttataggaactaggtttaagcaaatcattgcaattacctgtattttatgtgttaacggcttgttaaaattactttagctaagacttccataatctgttgcaggttcccttcttctgtaaaagtattaaagccaagtaaacagggggcaaccgcagcaaaaggtccgctaacatcagagaagcaaagtactcttccacttacaacagaagatgctcctccaaaagatgtggtatagttctgtttagttcagtctctttttttcttgtcgacatgaatctaccactctgaattgctgaggttggttccttgatctttttctctagaatctctctgccaacatgtacacagccttgaggaagcttcgtacagctcttgtcaaagaagcccctgatggtgtcatggcatatcatatattcatgtatgtctgaaaaaccattccgcttttcattttccaagctttgtacttgatcatggtcaattcgattctttcctcacagtctctgtgtttgtggtggcagcaattcaacgcttcagcagataagcagacggatacccagaaccaaagaggaactccttgaaatcaatggccttgggaagtaagtagttctttatcttaaaacctctactcaaaatgaagaaaagtccaaaagtgtttgatgatggtgtgtatctttaaactctctttcagggccaaagtaagcaagtacggtgatcagttgttggaaacaatagaaacaacggtgaacgagtactatggaaccaataagaaagactccatcatcagcaacgatagtcccgattcagggaagagaagaagagacgagaacattagtccaaatgtagccgaggatgatgatttcgaagtaagcccaagccagtcctgcaaaaaaacagtgagaaacaaaagcaatgaggttcttcatggtgaatgtatagatggagatagaagaggcatggagcttgattttgatttcaaagacgaagatgggtcagagatacgaccggagggaagagtattaccgtggtgaagttgtgaccactgaaattttagttgtaaagaaattttgatgtaatattttgttaacttctatggcctactcaatgtaccttaattttcagtagattgaagaaactagttattaaatgctgacttctttgatgatctcttttttttttttaatcaatcatatattgagatttgattagaatgaagaacctacaggtggcgatggatcattaataatataagagattaataatataagagatattattgtgaagaaaccacttcagccaatggattggttagctagacaaggttgactttgggtcaaccctctcactggacttttatctgaggctcttcttgtcgtgaccacacaagctcttttttgcttcacagaaggtaaattcttgtctgcttgttttgctttgatccgtcgtttatactttgttgtggtgagtggaatttgcttcaaaataaatcctgaaattattacgagattctgaaccagttccatttgatataatataataatataaacaatacctgaatctttaagtcaatacttactacaggtttgttatctaaacaagttcttctctgttttagtaaatgtttcttctgtctcagtctcactagaacgatctgtccatgaaattttctcgtaaagggttattatg

SEQ ID NO: 18235 - DNA, 3000 bp, Unknown
  misc_feature (1)..( 3000): 2750-1469P.txt file - cDNA_ID_1816135; gDNA_ID_1621115; Annot_ID_56179
atgatggaaaacaaatgtagactgacgcttcatcaccttggtcttctttgctgttgaacaaagtcaagaagactagggtatatatgactggaaactaaagcatcctaggcattaagtatctttaacaatgaatcagctgtttgtgataaagctaaaattacagagatacatctcttttccacacagttcatttcaatcctgtataagtgattatactaggacagaaaggaatttttcctatatcagtatttataagtgattatactggatttgatctgctagtcaagatgaagcgaaatttgcaaatctgcataaaagcctctccacagcttaagtgagttcatgaatgaacaacctaaatacttaacagaatcctagtttcatgctgttcttaatcctaagataacacagttcctcatgtgccctcaagatgagacccatcaaaaacatacaagccttaatttgaaggagagacagaaaagtcttgtcatttaccgtggatatctgattcagccattatgatcgcttgggcttcccattttctccaactgtaaatctgtgttacgtgataaaaagacaacactgtttcagatggtattgatatgttcgtctgcttaatcttactaacactctatgcacataaatgataatatcgaaggttttccctcaattttcagattgaagataatttctatttgacatatacttaggaccactaattatttgatcatgaggttctctacatcctctagacatgaggataaagttgattgcaagtataatacatctcttcctttcggagcaacatagaaatacttaagaatacaaatttaacactcatatgtagatttaggagctaggatgtgtaccttgctcatggctaaaccaatggcaatgccactgtatagaacatgagtgatacccaggacgaataagaatcttaggagttgctcgagtccctcatacgacacaaatggttcacggccctggcattggatccaacatccagttcagtaatataattaaaagtcaaaaggaaaataggctcttaagtcgatagaaaaagtaaatatttacatgaccacattgatgagaggcttcatgtattccatgatgaggtaaggagctctggtttgtagaagaggtgtgttccagaagaactttcttatggattccatagtcctcttcagagcaaatgtagaatttactattgaaaagggaagagttaacacagatttctgaaatccatctcgcgctttgtgacaacagaagtgatataagtcccagcaacatcaactctaccaagaaagtttaacaagtcaaaatcaaacgaaaaagaaagaaagtataaagcaccacaacatcagcacaggtttatttgacataccctctttcattttctcaagtgaagtaaaaagtgcctttcttctagtcttctttaaccactgaaaacaaaacagaacatgaaattagctcctcatatatatctaacatgaaagacacatcctgtaataatgacttctcttagagtgaaaacatcaacactacttctactgacatttagcaagcataaacacatatctccaagaagaaacatctcgtccataaaaattctcactttctagcacccattattagataaaacatttccagctcatgaatcatggagagcaagagttaacccaagtggcaagtgtgcagaaaaaaaaaaaaaatcataatacgttcttcacactcattcttttgagctgagcatttcaacaaacatatagtaggcacacacacgaagaaaaaatacaaaacaaaaacacacctttccaaatctgtaaatggcgcgttcaacgagaaagcaaacaaagaccaaaacagtaacaaccgaagcaacagagtaagtcggcgtctctgcaagagaccttccttctttcatcatatgctccatctccggcgaggaacttttctcccgagaaaaatggagaatcaatctgcatctgtgattaagaaagtttagctttttcctccatttaattttctacaataaaatatactagtcaaagagaagaaaaaagctcatggaatgctgtaccaagtagaaaccaaagcacatggttgcttcctcgtcttctccaacggtcttctctcttctctttctttattcaattgcttctttcatttattgcagcattcatgtgcttccccctaaatgtcgttaaagaacctaaatttaataatgcaatttaatagccggactttaccgaccggtacaaccattagtcgataataacaaagccgggttgatgatatctcaatcggtttacgtatcattgaaattaggagagagattcaatcactgtccgaattaaatgaacaataatcagatacaaaaaccaaaattacgccatttcatacaatttttgtaaaccgaatttatagcagcaatctactaatcataatctagcagcaacaactcaaccgattttactgataaatggcggttaatattagaagtttacgagtacatcaaagctttgactaatgatactaggatttggcaatttgtggtggaccggtcactgttttgccaggagaataaatgaatatgatataataaattaacacgtgtacaaattcccaacattggggtggtggcgcagttggctagcgcgtaggtctcatagctattgagtgatcctgaggtcgagagttcgagcctctctcaccccatttccctttttctctgtaattttcaattcccaaaataaagaagctttcgtttctctctcgcattgacccttcttctccagttttatgttttgcctctctcccacttctgtaaataatcttctcacatccccgcacgattattctctagccgatcaacgaacacagagacgctaatgtatttgactcgattcgaatcattagtcctctaatcacaccgattgatttccacccacagatttcttgtctgaaatttagggttagcgaaggtttggatcaatg

SEQ ID NO: 18236 - DNA, 3000 bp, Unknown; identical to SEQ ID NO: 6898
  misc_feature (1)..( 3000): 2750-1469P.txt file - cDNA_ID_1816145; gDNA_ID_1621115; Annot_ID_56176

SEQ ID NO: 18237 - DNA, 3003 bp, Unknown
  misc_feature (1)..( 3003): 2750-1469P.txt file - cDNA_ID_1816177; gDNA_ID_2926137; Annot_ID_197274
ttgattaaaagaaagataagttctcaaaagagaatacaagagtatataaagagaaggagaagagaagctgaagaggcaagtcttagaacatacttcaaggctgcctagaacacaacagtaattaaaaacaaagtttgaaattcaaaataaacccttcaactactaaggccacgaaattgtctctttattttagtgggtttgggccttgaatcatcaaaattgattatatgaagtgaaaacataagcctcattaaaaaccttcctttggaaaacccagtgggacaaaaccaaaggcagggaaaaagagcactcatgaatcacttatccatcttgatgaggtccttgagcttagatcaaaacaaagaggtagtgatttggctcaagtcatttggtcggtcccaaatgtggttaagcatcccgccaatggcatggttgaataccttagctctagaacgagtcattgggacggtcgatgtgacaagaacatcctccgctacaagcttctcctcagctacaagctcatcctcagctacaagcttacctccttcctcagctacaagctcacgttcaagctccggttcatgctccatatccttaatgttgtccatgatcatatcatcccctccctcttgaaaaggatttgacctcaaatccggttcatctgcaataaaaggtaccaagtcagaaacattaaagctagaactcacattatacttaccttgcaaatcgagttgataggcattgtcgttgatccgtttgattatcttgaatggaccgtctattcttggcatgagtttggacttcctttgagctcgaaacctctcctttcttaaatgaatccacaccatatctccaacttcgaagatttgttctcgtctccctttattagcttgcttagcatagagtttggtcttttcttctatgtttctcctcgcattctcatggatatgttgcactagctcagccttctttttaccatcaatacttactctttcactcaaaggcaaagggattagatccaaaggtgagatggggttgaaccaataaacaatttgaaaaggagaatacttagaagcagaatgcacgacatgattatatgcaaattcaatatgtggtaagcattcttcccaagttttaatgttctttttaatcaatgcacgcaagagagtacctaaggttctattaaccacttcagtttgaccatcagtttgcggatgacatgtagtagagaataacagcttagttcctaacttagaccacaatgttctccaaaagtaactaagaaacttagtatctctatccgaaactatggacctaggcatcccatgcaaacgaactatctctttaaagaatagattagctacatgcaatgcatcatcagttttatgacaagcaatgaaatgagccatcttagaaaatctatcaaccacaacaaagatagaatcatttcctgttctagtcctaggcaatcccatcacaaaatccattgaaatatcattccagggatgagtaggaataggtaaaggagtatacaaaccgatgggctgaaccttagatttggcttgcttacaagtattacatctcccacaaattctttcaacatcacgtttcatgtgcggccaatggaaatgttctttcatgacttccaacgtcttagcaatgccaaagtgtcccattagtccacctccatgaacttccctgacaaatagatctcgtagagagcagttaggaacacacaaacggttctcatagaagagaaacacgtcttgtctaaaatagtgaccgaaagcaaacttttcacaagctttataaacctcgtgaaaatcatggtcagtttcataaagttcttttatttgttcaaaacccataagcttaacattaagagtagagagtagggtgtacctccgggataatgcatcagcgactacattatccttatcttttttgtacttgatgacgtagggaaatgtctcaataaactcaaaccacctcgcatgtctcttgttaagtttctgttgtcccttcaagtgttttagcgattcatgatcagtgtgaatgacgaactccttagaccataggtagtgttgccacgtttggagagctcggaccaaggcgtacagctccttgtcataggttgggtattttagcgtagctcctccaagtttctcactgaaaaaggcaataggcttttgatcttgcattagaacagctccaatacctatacctgatgcatcacactcaatctcaaacgttttaagaaagtcaggcaatatcaaaacaggtgcattggttagtttatccttgagagactgaaatgcttcttcttgtgcttcctcctatttgaatcctacatcctttttgataacctcggtgagtggtgcggcaatggtactaaagtccttgacaaatctcctataaaatccagcaaggccatgaaaactccttacttctcccacagtctttggactcggccaatctttaataaccttaactttctcttcgtcaaccttaactccatctgcactcacaacaaagccaaaaaacacaagattatccgtgcaaaaggtgcatttctttaggttggcatagagttcctcttttctaaggacattcaaaacagaatctaaatgctctatatgctctctcaagcttttgctgtaaactaagatgtcatcaaagtaaactacaacaaatatcccaatgaatgctcttagaacatgattcatcaacctcatgaatgtactaggtgcattagttaatccaaatggcatgactagccactcatataacccatgtttagttttaaatgcagttttccattcatctccctctctcatcctaatacttaaccgttatattgttgatggctctgcaatcaacacacattctccagctgccatccgcacttacatacttttcatggataccctaagtcaggtaagtctagtggtttatgcaaactatggacgagtggaagatttcgtgagactcaagaaagatatg

SEQ ID NO: 18238 - DNA, 3003 bp, Unknown
  misc_feature (1)..( 3003): 2750-1469P.txt file - cDNA_ID_1816177; gDNA_ID_1621116; Annot_ID_56200
cctttggatatgcgcaccaaaagagactaaggattttgctggatatacacaccaacaagatgatcttcttaaaaaaggtttttgattaaaagaaagataagttctcaaaagagaatacaagagtatataaagagaaggagaagagaagctgaagaggcaagtcttagaacatacttcaaggctgcctagaacacaacagtaattaaaaacaaagtttgaaattcaaaataaacccttcaactactaaggccacgaaattgtctctttattttagtgggtttgggccttgaatcatcaaaattgattatatgaagtgaaaacataagcctcattaaaaaccttcctttggaaaacccagtgggacaaaaccaaaggcagggaaaaagagcactcatgaatcacttatccatcttgatgaggtccttgagcttagatcaaaacaaagaggtagtgatttggctcaagtcatttggtcggtcccaaatgtggttaagcatcccgccaatggcatggttgaataccttagctctagaacgagtcattgggacggtcgatgtgacaagaacatcctccgctacaagcttctcctcagctacaagctcatcctcagctacaagcttacctccttcctcagctacaagctcacgttcaagctccggttcatgctccatatccttaatgttgtccatgatcatatcatcccctccctcttgaaaaggatttgacctcaaatccggttcatctgcaataaaaggtaccaagtcagaaacattaaagctagaactcacattatacttaccttgcaaatcgagttgataggcattgtcgttgatccgtttgattatcttgaatggaccgtctattcttggcatgagtttggacttcctttgagctcgaaacctctcctttcttaaatgaatccacaccatatctccaacttcgaagatttgttctcgtctccctttattagcttgcttagcatagagtttggtcttttcttctatgtttctcctcgcattctcatggatatgttgcactagctcagccttctttttaccatcaatacttactctttcactcaaaggcaaagggattagatccaaaggtgagatggggttgaaccaataaacaatttgaaaaggagaatacttagaagcagaatgcacgacatgattatatgcaaattcaatatgtggtaagcattcttcccaagttttaatgttctttttaatcaatgcacgcaagagagtacctaaggttctattaaccacttcagtttgaccatcagtttgcggatgacatgtagtagagaataacagcttagttcctaacttagaccacaatgttctccaaaagtaactaagaaacttagtatctctatccgaaactatggacctaggcatcccatgcaaacgaactatctctttaaagaatagattagctacatgcaatgcatcatcagttttatgacaagcaatgaaatgagccatcttagaaaatctatcaaccacaacaaagatagaatcatttcctgttctagtcctaggcaatcccatcacaaaatccattgaaatatcattccagggatgagtaggaataggtaaaggagtatacaaaccgatgggctgaaccttagatttggcttgcttacaagtattacatctcccacaaattctttcaacatcacgtttcatgtgcggccaatggaaatgttctttcatgacttccaacgtcttagcaatgccaaagtgtcccattagtccacctccatgaacttccctgacaaatagatctcgtagagagcagttaggaacacacaaacggttctcatagaagagaaacacgtcttgtctaaaatagtgaccgaaagcaaacttttcacaagctttataaacctcgtgaaaatcatggtcagtttcataaagttcttttatttgttcaaaacccataagcttaacattaagagtagagagtagggtgtacctccgggataatgcatcagcgactacattatccttatcttttttgtacttgatgacgtagggaaatgtctcaataaactcaaaccacctcgcatgtctcttgttaagtttctgttgtcccttcaagtgttttagcgattcatgatcagtgtgaatgacgaactccttagaccataggtagtgttgccacgtttggagagctcggaccaaggcgtacagctccttgtcataggttgggtattttagcgtagctcctccaagtttctcactgaaaaaggcaataggcttttgatcttgcattagaacagctccaatacctatacctgatgcatcacactcaatctcaaacgttttaagaaagtcaggcaatatcaaaacaggtgcattggttagtttatccttgagagactgaaatgcttcttcttgtgcttcctcctatttgaatcctacatcctttttgataacctcggtgagtggtgcggcaatggtactaaagtccttgacaaatctcctataaaatccagcaaggccatgaaaactccttacttctcccacagtctttggactcggccaatctttaataaccttaactttctcttcgtcaaccttaactccatctgcactcacaacaaagccaaaaaacacaagattatccgtgcaaaaggtgcatttctttaggttggcatagagttcctcttttctaaggacattcaaaacagaatctaaatgctctatatgctctctcaagcttttgctgtaaactaagatgtcatcaaagtaaactacaacaaatatcccaatgaatgctcttagaacatgattcatcaacctcatgaatgtactaggtgcattagttaatccaaatggcatgactagccactcatataacccatgtttagttttaaatgcagttttccattcatctccctctctcatcctaatacttaaccgttatattgttgatggctctgcaatcaacacacattctccagctgccatccgcacttacatacttttcatg

SEQ ID NO: 18239 - DNA, 3003 bp, Unknown; identical to SEQ ID NO: 18238
  misc_feature (1)..( 3003): 2750-1469P.txt file - cDNA_ID_1816177; gDNA_ID_2926137; Annot_ID_138915

SEQ ID NO: 18240 - DNA, 3003 bp, Unknown; identical to SEQ ID NO: 18238
  misc_feature (1)..( 3003): 2750-1469P.txt file - cDNA_ID_1816177; gDNA_ID_1621116; Annot_ID_171879

SEQ ID NO: 18241 - DNA, 3000 bp, Unknown; identical to SEQ ID NO: 6940
  misc_feature (1)..( 3000): 2750-1469P.txt file - cDNA_ID_1816200; gDNA_ID_1621117; Annot_ID_56224

SEQ ID NO: 18242 - DNA, 3000 bp, Unknown; identical to SEQ ID NO: 6940
  misc_feature (1)..( 3000): 2750-1469P.txt file - cDNA_ID_1816200; gDNA_ID_1621117; Annot_ID_171929

SEQ ID NO: 18243 - DNA, 3000 bp, Unknown; identical to SEQ ID NO: 6941
  misc_feature (1)..( 3000): 2750-1469P.txt file - cDNA_ID_1816208; gDNA_ID_1621117; Annot_ID_56222

SEQ ID NO: 18244 - DNA, 3003 bp, Unknown
  misc_feature (1)..( 3003): 2750-1469P.txt file - cDNA_ID_1816212; gDNA_ID_1621117; Annot_ID_56221
tcctgcagaaccaaatgccatactgctcgcgcttccgctggctccataagccgtcgatgttttcacggcagcgtttacagcgccgtgctgatacattccgttaagcaacaacatatcaaagcctcctccgagttctgacttttgtcctgacaagtttgtagctgtttgcaccaaagctgtttcccaatccgcagaatcatccttaaacgcttcccatcctggaccagactctgaaccagaaccgcttgcgtatggcccgtcaaataaagccaacgctaagctatctccagcttgtcctgcttcaccgccgtttgtattcccaagatcaagtaaatcacccatttcttcttgtttcttctctatgatcacttcttcctttgcttcttcctcaggttttacgtcatcttcttcttttggtggaggttcaggtaaggcctttattgcgttcatatcttcttgctcttcatttacttcctctgttctcgcttcatcatcatcttcatcggcttcagatttaacagattttgattgcttggtgtgttctaaagcagatttgtctcttataaactcatccatgagatcaagcttcttctgtgtgatcttctctatctctggatactcagaagaccgtgcgatccccatgttcttacaccaagagtagaactgatcgagctcttcgaattgtttcgagacccggcagaaaatgtcatagaccttgatcgaatcaggaatatctaactccatgaatcgttcaatcaaaatccccattatctctgttacatcgtaatatatctgaaaactctccttcactatcggatacagagccacaatcacaactctgttgttcctcgcattacctgttaacaaaataacattggtccttatataaatttttatccaagaaacaaacacacacagagaaagaaatcttgagacgcaagttattacctgttgggcgacaagccaagaaacggtcaagaagttgctgcaaatgttggattctgatgaaaatctgctctgttttcatctcggcgatcggttgtgacctgaccacgatagccgtggagagatctgccgcagcttgatcctgttcttcttcgtcagcttctcctccaacgcagtaaactccacgtttcccgtgtctcgcttgcatcctcaaaaattgcaatgaaaaaaaaaaaaaaaccgcatatcttagatatcattcaaattacataaataacttgaaatcccgaatcggaacctggatcaagcacaagaactcttacctgaaatcaagcctttcgtcaaggtacaatgcgtaagtcctgacaaacgcagagtagtcccaagaattagacctcgaaacatccctaaaatcagacatattgagaagccttgttccacggcgagtggcgaagaagatctcttgctcgtaggcttgatctccttctcctaagagcctttggatcaaaatcaaggttttgagggcaacggtccagcatttggttttattaaggcgtctcgaaagcgtgctaacgcaagcgttgatgtaactgcgtgagtaagaagttaggctaagaatctctctaatgtatttctcttctgctggaaactcttcgtgacgagtggctttgacgatggctacgtcaagttcagataaagaagcgcttcgaccattgactttggctagaccgacgctggtttggtcctttacggctcctatggctcgtttaaacttactcgaacccatttttattctgattagttagtaaatttgtattaaagacaaaaaaaagaaaagaaaatatgtaaaagaaaagatttgaagagagaaaagggaagaacgaggcttgtttttattttgtttttgtttttcctcgtcgtttccttttttctcctctgtttcttgtttagttttgttttgtttcttcttcttcttcttctatgtttttgtttgtttgtttcgtcaatgtagtttctttgttgttcgtcgattattcaccatctaaagtcgccgaggttattggaggctttgtccggtgagaaatatggccacgtggcaaaaaattaacttattgtttgacgggtcaactgaaatttagtttgcatttgccattaatgggtaaggagaagagtactgattaaagaggaaaaaactttcttctaatttgtaaaaaaaaatacaccaagcttttttcttatggattggaagcccaagattgaattatggaatccaacaaatcaaaatcgatccaagcccatttctgctgacatattttttactcgtattatattcagaaatgccacaattttgttttgtgaaaaatagaaaaacccttgtctctcaaaatggaaaacgagtcggacaacggttcagcactaaggagaagcaagttgtaataccatatggcaaaatgaaacgtgtcatttttatattggatattagaaactttactccatgagtgctaaatttcggaaaaaacgacaaagacagatttttttaaaaaaatcttattttctaccactaacgagatgacgacgaccccgacaatgcgtagaatttttcccatatcatttatatattttaaaaaaagaaagttatattggtttttaacattctactaaaaagagtttggtaaaagacctttttcttaatttgatatgaataaattgaagaaagtcaaaacaaaaagcccacttcaaaacaaataaagcccacttcaagtttctggaaggtatataagaacaagggcaaaaccgaaaataaaccacaaagtaaggtccttttaacaaaaataaaatgaaagagagcataaagtgagtctttttgtcatatcctttctcgtctgtgtctcttcgtcctcattagcttaagcatcatcattctctcacctaacaactccacacaagattcttcgcatggaaagttgttcttcgacttctcttctctaactcgctatcttttaactcacccagctccactgagtcgaaaatttcaaacctttactcgtttccttcatg

SEQ ID NO: 18245 - DNA, 3003 bp, Unknown
  misc_feature (1)..( 3003): 2750-1469P.txt file - cDNA_ID_1816220; gDNA_ID_1621117; Annot_ID_56219
gagagtaaagtagaacgttcttgaaggcaccacgtggccgcgtgtgaagatgaaacgttaagtttgttgttaaccgtaaagaccggaagtctctagatgactccaaaggtttcaagtattctcttataagaatataccaaagcttccactacattattattttttaacgaaggacataaactatagcatcataaattcataatgtaagcagaatcgttatatcctccgcatcctccgccatgttcatcacaacccccaccgtgatgatcacgaaagcaacagtctttatctatttccatgtgtcatcgccggtagtgactgttcgagtttaattattctccgtcacgagacaacgataacagatgctacaacaaaatacagtaccaacgataacaaccaaactaacggttgcttacacgtacgacgacaataatataaacttccatcattgcttttatgttgttgtggaatttgttgcgacaacttttcccctaaatattctaagttctgagcatacaaatttagctcctctatccgtatttatactttttttctcctttcatttttttttttgttacttatggattaactgttagcgtaataatgtgtggtttgaggtgtttgaaattaaatatcttaacatatagtatgtaacaaaaatttaatatatgttagcattttacattagtgtgacacatgtttgaaattatcaaacaatttttaagataataagaaataatatatgtgatatattgtattagcagtataaaagaaatataataacttaaatgaaatatgcataactactaacaaagtaacatatatatatttctttatttatgataattattaaatagtaataatgtttgaggtgtgataataaattatcttaatatatacaaaaccatatgtttgaggtgttgatgacatttctagttaatcaaaatttgtgttactgtctcgtcgtcatatataaggtttatgtgggcctcatttgtaaaagaattacttaaaagtgggctttcacaaaaacataggacatgtttttagacttttaacctttaaaggtccattggaatttttttgttggcaactcctatattagaacttagtcctaaatgattatagtcgtcacatacaaatattggtgtttagatatgacatgaatcagacaaatgaaatactataataattgttggaaaattgttttagaagcagaattcggaccaagttctatctttaatttttttctgaaaatatatcgtctctttatcatcagatgttctacttttggttgatgactatttaccaccagtactataaggtttattgtttgtttaacatacgcgacctctgcattttgatagatagataaatatatgttagaattttctcacaatgacatagttatatttttaagaaattcatatataaattaaatatgaatttaaatatgtttcgtattattattaaaaagacataaaagttttggtccaaaaagtgtttaaattttgcaaagaggggatcacgtttcgcaatcgttcagcaaacctatacgaacacgtggcattctcgtcccgtgggctctacttgcgattgtagacgtgaacctagaaactacattggcccttgtttttcttaataattataatttaggtctcgtttgtttcaaaaccttcatccagatccatattgccgttaatttttctaatttctgttgatattgtgctcactagataataacttttcacaaatatggtttacaaattctttttatgttgtgttggctctcgtattacaaaaagaacctaaactgtatgctaaataaatttatttattattttggcatgaggtaaatatatatactatgtataggcttaaaagtaaaaactaagaaaggtaaaaattaactttaattttaagtatgagttaagtctattgtaaaaattcaaaagtagcaatgtttttttttccctatccatatggaatttattttattaaaaatataataaaacaaaataatatcctaatgtgtatctctaaaacatccttatttgaccatttgtatataaactaactcaaacaattatataaaatgatagagaagatagagtcaacctttgttactttcacgaacgaaatgtcaaaggtattcaagtgtccctagttgataattttatatgcgccattgttttggtctacaaaatttagctgtggggtttgcgatgcaagactaatttgggggtcaaaatggtaatgaaatattgtagtggttataaaatagtataaaacaaaatttcaagggctaataaagtaataaaattggaaataatttacgaaggagaaacaaacagtatcgtgttttagagagagaaagtgagacgacttgagcgagaaacaaggcgcggagagagacgacgccgtcaacaacaccagaacagaaaaaaaaaacaaagaaagaaggaagaaaaaagagagagaaggagatttgatttaatttaaattttctttaaggaaaaaaaaaacaaaaacaaaatcgcgtttttccgctaagctctttttcttccctttttgtcaaaatttgggtttttgctcattctcgtggaaggaaaaaaggggattttttcaagtgtttaggggttcacaaattgaaaattttggatcttagatctttcttcttgctacgaaaccctaattcgtcacattgtatcagctcaatttgatcttaaaaaaaaaagactatttttttcctttttgggtctccttcttctttctttctttaatttgaattcctcaatttaaggattgtgtgttttgtttccttcttgtgaacgaatgagagttttgggttgatcgcatttttagggttgattttatttatctgatcgacgactcggatctgaggtgggtcgtgtttggagaccgagtcagggtctggtctggtctggtgaggtcgtcgtcttcatcggatgaaagtttctgggatcgaaaagcacaacgatg

SEQ ID NO: 18246 - DNA, 3000 bp, Unknown; identical to SEQ ID NO: 6936
  misc_feature (1)..( 3000): 2750-1469P.txt file - cDNA_ID_1816224; gDNA_ID_1621117; Annot_ID_56218

SEQ ID NO: 18247 - DNA, 3000 bp, Unknown; identical to SEQ ID NO: 6934
  misc_feature (1)..( 3000): 2750-1469P.txt file - cDNA_ID_1816228; gDNA_ID_1621117; Annot_ID_56216

SEQ ID NO: 18248 - DNA, 3000 bp, Unknown; identical to SEQ ID NO: 6947
  misc_feature (1)..( 3000): 2750-1469P.txt file - cDNA_ID_1816239; gDNA_ID_1621117; Annot_ID_56213

SEQ ID NO: 18249 - DNA, 446 bp, Unknown; identical to SEQ ID NO: 6958
  misc_feature (1)..( 446): 2750-1469P.txt file - cDNA_ID_1816252; gDNA_ID_1621118; Annot_ID_56238

SEQ ID NO: 18250 - DNA, 3003 bp, Unknown
  misc_feature (1)..( 3003): 2750-1469P.txt file - cDNA_ID_1816284; gDNA_ID_1621118; Annot_ID_56229
tttgggtttgattcatctgtccctgtgttggttgctatctttatcccaatttgaggttaaagtcatgttcttgtaagaatagatttgggtttgacttatcttttccctatgatgcttagtacatcaagtttaggttctgtgtatcagagtttgaagtgttatatatagaagttgtggcctagaaggctagtgtatttgcttccctgtgttgaatatattactgtaatctcccctgtgttggttgctatcattagtacgttctgtgttgtcacagagttttaagcgctatgtatagaagttgtaacctagtgttcttacttctgccaaagcttgtgattgtttgagttatgtgtgtttgattttttgttttgttggcaaagaacttatgtgtgtgtgtacttttggaatttgttcagaggaactatgttatctgccaagtgatgtataagggtgaagatggagacgtcccatctggtggtaacaactcgagtgagccgagtcaatctttggtctctgattcgaatactgtcagagctacgagtcccacagcgcttgaggtgactccagtttctttatttgataatctcatgtacttgattcgtttactcaaaactctcttttacattttcagtttgagaagccaggtcaagaaaatttctttggtatgtctgtggatgatttggggactccaaagaatgaacaagaagatttctctttgtgggatgtactggatccagacatgttattcagtgacaataacaatcctactgtgcatccacaagctcctcacttaaccccgaatgatgatgagtttctcggtggattgaggcatgttaaccgagagcaggttgaatatttgtttgccaatgaagatttcatatccagaccaaccttatctatgaccgagaaccgcaacgatcacaggccaaagaaggctttgtcagggattattgttgattatagcagtgatagtaatagtgatgctgaatcgatatctgcaacggtaaagcaaatcacccgttttctttatcgttacttctgtgctgtaatctccattctcacattttgattatattatgtcagagttaccaaggaacatcaagtccaggtgatgatagtgttggtagttcgaatagacaatttctccagactggtggagatgagattctatcgtcttgcaatgatctacaaacctatggagaaccttccatcagtagtagcacccggcaatctcaactcacacgaagcatcatacgaccaaaacaagaggttttgcgttgctcttatgttgattctatatgatttcaacatatgttggatatataaagataatgattatgtaactttccttcacaggtgaaacaagatacatcaagagcggttgatagtgatacatccatagacaaggagtcatctatggtgaagacagagaagaagagctggtttattacagaggaagcaatggagagaaaccgcaacaatccacggtatatctatctcatgagaatgatcataggcttcattctcttgctggctctcattagcaacatcatatcggtgttacaaaacttgaacccggcgatgaagtttgatcgcgagagatagacaaaagctagcagattgatcaaagcactcgtttttactttgcttttatttatttctattttcttccgaaattttgatgtatatatgtgtgtgtatgtatgaccaagaggtatgtcttgtacctaaagttaaataaaatttagggtttgaaaattttataacatttagagcgggtccatagttcagtgccgtggtggagcattagactgctgataaagaaaacattcgacagagaccagtgaatggtttgaaaggtttctcaaagatttggtttgttgataattaagagaatgattacataccggacaagggactggtctaatgtgattgatacttcgatgatcaatcaatcaaatattacttcgatgatcaatcaatcaatcaatcatattacttacaactatgtaatatgattctatgaacctttttcttgttttttgtaaactttaatcccttatcttgcaagccaaatccatagacatatattttacaaaattagtagtagtactatattgaagtagagaaagtaataacgccatgtcgtcgtcgtcgatggtggcggctataatttccgaaagatccttcgactcaaaatacacaaaaaaaacaaggaaaagagaaaggttcatactttcgttcgaagctccgacaatgaaccgtcaataatttgccacgtcttcattctcattcacaataaaaataaattttgttcctctcatttgtcaaccttttttgtttttgtttaaagaatttgtcaacctattggaaaacattttgcattcaattaaaatcttatcgctaacagttttttgttttttgtttttttttcaactatcttatttattaacagtagtaaatttgttataaaatacataatattacatttcttccaatacataattgatatctaaatatccgatcgttgtaaatttggagtttcattcatcttaaaatgtgtgaaaaattacggctgatgtgtgacaaacacaaaagataaaaagttactaaacacaatttttttacaaaattaaattgaaacgaaaaaaaaaaatttaacaaaaaactaaaaagaaaaaacattttagaaatagacacaagtcatcaacacggtttcggcgcgagtagacttcacggcttttgttctttacttactgagaaattactaaaatttggtttttttttttttttcaaatagaaaaaaactataaataccatcactcgctatctcttcaccaatcacttcctacttgtatttgaaaaagaaagaaaaacagagagagagagggagaagccaaaaaaaaaaacagagaagcagaaaaaaataaattccttcacccaaaccctagaattttttttagaaagttttgttttttcgatctgtttctgtgtgaaaagatg

SEQ ID NO: 18251 - DNA, 3003 bp, Unknown; identical to SEQ ID NO: 18250
  misc_feature (1)..( 3003): 2750-1469P.txt file - cDNA_ID_1816284; gDNA_ID_1621118; Annot_ID_171943

SEQ ID NO: 18252 - DNA, 3000 bp, Unknown
  misc_feature (1)..( 3000): 2750-1469P.txt file - cDNA_ID_1816284; gDNA_ID_2926161; Annot_ID_139714
gggtttgattcatctgtccctgtgttggttgctatctttatcccaatttgaggttaaagtcatgttcttgtaagaatagatttgggtttgacttatcttttccctatgatgcttagtacatcaagtttaggttctgtgtatcagagtttgaagtgttatatatagaagttgtggcctagaaggctagtgtatttgcttccctgtgttgaatatattactgtaatctcccctgtgttggttgctatcattagtacgttctgtgttgtcacagagttttaagcgctatgtatagaagttgtaacctagtgttcttacttctgccaaagcttgtgattgtttgagttatgtgtgtttgattttttgttttgttggcaaagaacttatgtgtgtgtgtacttttggaatttgttcagaggaactatgttatctgccaagtgatgtataagggtgaagatggagacgtcccatctggtggtaacaactcgagtgagccgagtcaatctttggtctctgattcgaatactgtcagagctacgagtcccacagcgcttgaggtgactccagtttctttatttgataatctcatgtacttgattcgtttactcaaaactctcttttacattttcagtttgagaagccaggtcaagaaaatttctttggtatgtctgtggatgatttggggactccaaagaatgaacaagaagatttctctttgtgggatgtactggatccagacatgttattcagtgacaataacaatcctactgtgcatccacaagctcctcacttaaccccgaatgatgatgagtttctcggtggattgaggcatgttaaccgagagcaggttgaatatttgtttgccaatgaagatttcatatccagaccaaccttatctatgaccgagaaccgcaacgatcacaggccaaagaaggctttgtcagggattattgttgattatagcagtgatagtaatagtgatgctgaatcgatatctgcaacggtaaagcaaatcacccgttttctttatcgttacttctgtgctgtaatctccattctcacattttgattatattatgtcagagttaccaaggaacatcaagtccaggtgatgatagtgttggtagttcgaatagacaatttctccagactggtggagatgagattctatcgtcttgcaatgatctacaaacctatggagaaccttccatcagtagtagcacccggcaatctcaactcacacgaagcatcatacgaccaaaacaagaggttttgcgttgctcttatgttgattctatatgatttcaacatatgttggatatataaagataatgattatgtaactttccttcacaggtgaaacaagatacatcaagagcggttgatagtgatacatccatagacaaggagtcatctatggtgaagacagagaagaagagctggtttattacagaggaagcaatggagagaaaccgcaacaatccacggtatatctatctcatgagaatgatcataggcttcattctcttgctggctctcattagcaacatcatatcggtgttacaaaacttgaacccggcgatgaagtttgatcgcgagagatagacaaaagctagcagattgatcaaagcactcgtttttactttgcttttatttatttctattttcttccgaaattttgatgtatatatgtgtgtgtatgtatgaccaagaggtatgtcttgtacctaaagttaaataaaatttagggtttgaaaattttataacatttagagcgggtccatagttcagtgccgtggtggagcattagactgctgataaagaaaacattcgacagagaccagtgaatggtttgaaaggtttctcaaagatttggtttgttgataattaagagaatgattacataccggacaagggactggtctaatgtgattgatacttcgatgatcaatcaatcaaatattacttcgatgatcaatcaatcaatcaatcatattacttacaactatgtaatatgattctatgaacctttttcttgttttttgtaaactttaatcccttatcttgcaagccaaatccatagacatatattttacaaaattagtagtagtactatattgaagtagagaaagtaataacgccatgtcgtcgtcgtcgatggtggcggctataatttccgaaagatccttcgactcaaaatacacaaaaaaaacaaggaaaagagaaaggttcatactttcgttcgaagctccgacaatgaaccgtcaataatttgccacgtcttcattctcattcacaataaaaataaattttgttcctctcatttgtcaaccttttttgtttttgtttaaagaatttgtcaacctattggaaaacattttgcattcaattaaaatcttatcgctaacagttttttgttttttgtttttttttcaactatcttatttattaacagtagtaaatttgttataaaatacataatattacatttcttccaatacataattgatatctaaatatccgatcgttgtaaatttggagtttcattcatcttaaaatgtgtgaaaaattacggctgatgtgtgacaaacacaaaagataaaaagttactaaacacaatttttttacaaaattaaattgaaacgaaaaaaaaaaatttaacaaaaaactaaaaagaaaaaacattttagaaatagacacaagtcatcaacacggtttcggcgcgagtagacttcacggcttttgttctttacttactgagaaattactaaaatttggtttttttttttttttcaaatagaaaaaaactataaataccatcactcgctatctcttcaccaatcacttcctacttgtatttgaaaaagaaagaaaaacagagagagagagggagaagccaaaaaaaaaaacagagaagcagaaaaaaataaattccttcacccaaaccctagaattttttttagaaagttttgttttttcgatctgtttctgtgtgaaaagatg

SEQ ID NO: 18253 - DNA, 3000 bp, Unknown; identical to SEQ ID NO: 18252
  misc_feature (1)..( 3000): 2750-1469P.txt file - cDNA_ID_1816284; gDNA_ID_2926161; Annot_ID_198769

SEQ ID NO: 18254 - DNA, 3003 bp, Unknown
  misc_feature (1)..( 3003): 2750-1469P.txt file - cDNA_ID_1816288; gDNA_ID_1621118; Annot_ID_56228
tcagctttgccgttttcatcgattaaagagagagaggcttcgttcgccgtccgtcgtaaaaatggggttcaagaggaagaaagatgatggtgatggtgaggaaatggaatctgatgttcgtggaaagtctactttcagtgggggtgagaagaggaatgtgatacttccttcgatgattaagaacaaagataagagatcaaaagtgtatgcgaagcagaagcatgagaagaaattggagaagcagaagaagattagagctcgtgatgctgctgagaaacgagctttagagcttggagaagaggtaacgatctggagaagcttttttagggattttttaaaggtgtttatgaatttgagatattaagtttggtgtgtgttattcgtttgtagcctccacaaaagatgattccgaagacgattgagaatacaagagaatctgatgaaactgtttgcagacctgacgatgaagaagtatgtttagatttaaagtttgattcatctcaatttttgaattcaattcattgtcgtgttgctaatttagtgtaattgagtttgtagttgtttgcggatattgatgctgatgagtttaatccagttctgagacgtgagattgcacctaaggtcttgctcacaacatgtcgtttcaattccactgtaagtcttttttttttggtaccattgtttcataagagattctacagatttgtttgtggttttctgattcaagtaatgttgttggattgcagagaggacctgctttaatatctgagttgctttcggtgataccaaactctcattatcaaaagagaggaacctatgatttgaagaaggtgttgttataagtttcatagcttccttgtttctctataaagttagtctttttgcaactatataaccttgttagatatggttctgcagattgtagaatacgcaacgaagaaagattttacatctcttattgttgttcatacaaatcgtagagaacctggttagttttcactgagtttcaagttttgtgctctctactgtatatgctttgtttcaagcttttgctatttcatatgtagatgcgcttcttatcatcggtttgccaaatggtcctactgctcatttcaaattgtcaaatcttgttctaaggaaggatattaaggtatgtaagctaaccattactcttctctacatcgagtgtagattagtgatcactgaattggatgttaaatgtaactgcagaatcacggaaatcctacaagccatcaaccagaactggttttgaataactttacaacgcgtttagggaatcgtgttgggaggtatagttttcatagtgttgttgacttggttttatggtctctttgaatttcttgctgatgttagatttttccttttttcagattttttcaatcactcttccctccggatcctaatttccgtggtaggagagttgtaacattccacaaccagcgtgactttatatttttcagacatcaccggtacataacttcaccttttcttcttcgagttgcttttgctccattctccaataaaactttttattgaacaaatttcaacactatccagttacatatttgagacaaaggaaagcaagagtgataaaggaaaagaagagacaataaaacctcgtcttcaggtcagttttgaccatgttgaatcaaaaagtaatcaacattatcaatgtttgtatcattaaactttggatttttaggaatgcggtcctcgattcacgcttaagctagttactctacagcatggaacttttgacaccaaaggtggagaatttgaatgggttcataaggtaaaatcaccagaaatggacacgagcagcttcattgctgttctttagagtttttgatgatttttaattttattttctgatgtgttttttttttgtatttcattacagcctgaaatggacacgagcaggagaaggttcttcttataaattctgctgtcttccgagtttcaccaagttttgtgtttattttgcattttcgaattttccctacctccgtccaaaattgtatgtctttaaaacttctcatttcttttttcaatatagccatgagccatcgaaacaatcgtaagagtacttgtttcaacaatataggccctcgttttttactaagctatatatagttggttaaacttatgattgtttggtttggtatatatcgacatcgagcatttgaatctacagcagtaatattggattttgtttagtagttaagtggacctttatgttgcataattaatagttttacgatcatcagttcatcaccataataataggattagatttgaggatgtgaatggttacggtggttgagacggataaatccgtttgcgaattagaccgtttttgatttaccatttataaattagagtatgtaagattatagattaagaaaaataaaagaaaatcgtcgcggatcaattatagaccgtttttaccgccgtaagcattcaaatcctgaacatctctaatgataatgtaataggattgacaaaaacaaatctaaaaattaattacgattatttaggtgtagtatagaacgtaattacgtatatgtatgttactatgttgtcaattatgtcggctataatattccagaaagatccttcggaaaggaaaaaaaaaaactgaaacttcggttcgaagttcaaacaatttttcttactgccacgtgttacttcatacacaattaaaatatttttttgtccctctcatttgtcaacgtttaggggaaaaacattaatatacttttactgcattccgccacaaatatctttctttctttttttatggttcttcttcaccccaactgtattagtactgttcgtctttcagaaaaaacaataatagatagaggaaaaaagaaagaaacagagaagtgagaaaaagcccttaaaactcaaacactaaaaaattttcagtgtcgattcaaaaagttttgttatttgatctgtttctgtgtaaaaaaaatg

SEQ ID NO: 18255 - DNA, 3003 bp, Unknown
  misc_feature (1)..( 3003): 2750-1469P.txt file - cDNA_ID_1816300; gDNA_ID_1621119; Annot_ID_56271
ggtccaaaaccaagaaaagcattagaatacttctcctcagggatatctcttttcctcaacagcttcataccaaagacctcagtgtaaaacctggtgagacaaataaagaatatcttaaaatgtaaaataactcctgttacagaaagataaagaataaggtattaatgaaaaagaaaaagacatactcaatggtgcgatcaagatcaccaacgcggtagacaacatggagaaaacgacggttatccttcttaggccattccaacaaatcagaagcctcagccatgtttctagaaagaagaaaacttgattcagctgctctcattgaaacaaaatgtacattacaaatcgagataaaacattgacacagcctcaacatagaggcggaagcaatctcattcatttcccctataaacttgctctctcctgataaatttaacgaacaccatcaactctagatttacatttaccaggattcttataaaacatcactaatctcaacttcataagcattttcaacccaaaaaggtctcaactttaacatacccaaaatcatgatgcaccaaatatgaatcttattataagttcgccgctattatataatcgcaaaacgatcaacaagaacgaacggaattgtgatttctcaatgatcatcacaacacaaagaacaattacattctataaaaatcccactaaattatcgatccacgaatcctgtcctaaattagatccggaaaacaccggatcgctagaataaaattccactattgaatcgagaaaaaatgattaagaatcacaaaatctagaacatgatcaacgaaatgtttagaacttgatcatatctgcaacagtaaacacacctgggaagaagatgtacggtacaaaaaagctaaaccactctcgagtaggtgagtaatccagtcattgttggcacaatcgtcgtcacttaaataggagtttgtagaaactttgccgacaatgtctttgctactgcctgtgacatagttagatcatcacagacgcgttacaaccgatggatgagtgtattattgtgaaaatatggtgaacgaccgttacggttataatctaacagccgtgtcatgggatgacacgtggcggcgtgaaacaggtgttaaaaacatgcttctgtaaaccgtctgtttacagtgtgcgacacagactcgagcatagagaaagaatctcattcaagtagaatcgtgtttcatgtgattttggaaaggcattagccaaggcccacacaaaattgtgaaattagaatttagcgagggagtgaagcccatcagtccgtgaaatgggatctcagcccatttagaaaatattttatttcttttgtttatatatattttctggtgttttgtatgaaatttggacgatgtcttattcacgacacatcataagctttctttatcgacatgtttggttttgaaatggaatcattttcttcattcttctttttggcactaccataaaaagaaggctttttatgcattaaattttaaaagtaaaaacgataaaattggcttcacattgaatcttttgaagccatgcgtagtgtataccgagactacattatgaaaacgacacacctcttagcaatgcggtaacggattgtaaattttaaaatcaaaccctttgtataatttcaatatatataactgtagatttaataattcctataaacagacgaaaaagtgtcacggttcattgttattttgttttccgtaatgaaaatctgtttattttatttatataaaggagataactaaattgtttcaggagattggcatatactatagcatataattcagtgtgatttcatgattcaaagagtgtttgtttattgacatacatacatacagaaagctttcctctttttcagagtttgtttctttgtttgtttaatctgttatcttatgttacatatggatctctatgttagtatgtttgttgggttgctgtatttttttttttttgtcctctctttcttctcttgctcgactagaaagaagtctacaactttacaaaagagactatgtaaaagtgatacaaaaagagaaaatgtattcattttgtctaacataatttctttgtatataagttccctttaaacagtttagtcggtgcaaaaagattcaggctaacaatattacttgttacgttttcttgagacatctatttttattttttttcttgtattgtttgagatgagaaaaagtgttatcaacaaataaataaaatgggccattgtcttcttgctgttcagcggaagcatgggttatattgtaattctctgtttgtcaacttgtaattcaatgtgtttgatagatatatttcaatgaccggaaaataaatacatagagaaaacacctacataatataatagtataattcaactaaaggccattgttatatgctttcaattgtccacttttattacatgtggtcaacaccaacatcccatttccaacccaatatacaaaaccaaaataataataaagaataatattttttattttattttatcttaattgtttgaagaactattattttagacagagtctttttgtgtacaagcaattcaactttatttaatttggttttttacaaaatttatggatgaaagaaaatattccaaatggaccaaatctattaaagattacatagtgatgcctagctggtgcttttatcggaattcaagggcattacggtaaaatatcacatatggtctgaaaaaaaaacagtttgtgtggggaggagcgagcagagtcggttcacgtgaaagcacagagacataaatctttctttcacagcctaaaacccctaaaaatgtctaatctctcttcttcttctccgtttctctttagattatctcaaccatacagccataaatccatcggaagaggaggaagataatgcaagaatcagtcgctgagtctgaatctgaaggggaagagttgcacaataagctcaagctcctcttcaatg

SEQ ID NO: 18256 - DNA, 3000 bp, Unknown; identical to SEQ ID NO: 6971
  misc_feature (1)..( 3000): 2750-1469P.txt file - cDNA_ID_1816304; gDNA_ID_1621119; Annot_ID_56267

SEQ ID NO: 18257 - DNA, 3000 bp, Unknown; identical to SEQ ID NO: 6971
  misc_feature (1)..( 3000): 2750-1469P.txt file - cDNA_ID_1816304; gDNA_ID_1621119; Annot_ID_172007

SEQ ID NO: 18258 - DNA, 3000 bp, Unknown; identical to SEQ ID NO: 6973
  misc_feature (1)..( 3000): 2750-1469P.txt file - cDNA_ID_1816312; gDNA_ID_1621119; Annot_ID_56265

SEQ ID NO: 18259 - DNA, 3003 bp, Unknown
  misc_feature (1)..( 3003): 2750-1469P.txt file - cDNA_ID_1816328; gDNA_ID_1621119; Annot_ID_56257
ctatcttatatatcactgaaatgtctttgttgctctagtaaccactgtgcaacatcaattgttgacttgcatcgaagctgtccaaagtgttcatatgaattgtgtctgaactgttgccaagagatccgtggaggttggctttctgaccgcccggaatgtcagctacaattcgagtacagagggacccggtatatacatggcgaagctgcagaaccgagctcttcttctgtttccgaggatgaaactaaaactccatccatcaagtggaatgctgatgaaaatggaagcatacggtgtgcgccaaaagagctaggaggttgcggggactctgtgctggagcttaagcgaatcttaccagtgacttggatgtcagatttggagcaaaaggcagaaacattcttagcctcttatagtatcaaaccgccaatgtcatattgtagatgttcttctgatatgagtagtatgaagaggaaggcagcttcgagggacggatctagtgacaattacctttattctcctgattctttggatgtcctgaagcaagaagaacttctgcatttccaagagcattggtccaaaggtgaaccagtgattgttcgaaatgctcttaacaacacagctggtttaagctgggagccaatggtgatgtggcgggctttatgtgagaatgttgattcagcaattagctctaatatgtctgatgtcaaagctatcgattgtttagctaattgtgaggtagaaactcattttcttataaagtttctatagctgtataagaggttataaagctcattttgtttcttgttatttcaggtgaagataaatactctatgtttctttgaaggatatagcaaaggaagaacatatgaaaacttctggcctgagatgctgaagctgaaggattggcctccttcagacaagtttgaaaaccttttacctcgtcactgcgatgagttcatttccgcattaccatttcaagaatacagcgatcctagatcaggaattctcaacattgctacaaaacttcctgaaggacttcttaaaccagatcttggtccaaaaacttatgttgcatatgggacttcagatgagctcggtagaggagattcagtcactaagcttcactgtgatatgtcagatgctgtaagtttcagaattgttacttagtactgttaaataataatacggtttctcaggtgtataacggttttttgtttttgtaggttaatattctgatgcatactgctgaagtaacactaagtgaggagcaaaggtctgcaattgcagatttgaaacagaaacataagcaacagaatgagaaagagcttcaggagcaaaatggtttagaggaagaagaggttgtgagtgatgagattgtggtttatgatgaaacaagtggtgcactttgggacatctttaaaagagaagatgttcctaagcttgaagagtatctaaggaagcattgcatagaattcagacatacttattgctctcgtgttacaaaggtaagaaataatccacaaaacgttttcagttccgagtcttagaggttattgtgctgataggattctttatgttaggtgtatcatccaatacatgatcagtcatatttcttaaccgtggagcataaaagaaaactcaaggcagaatttggtatggttacttgtaactgtagtaactgtcacttaccgacattgtattcttacgtttttgtgtttgtttgtttgaactaaagggattgagccatggacatttgtgcaaaagctaggagaagcagtgtttattccagcaggttgtcctcatcaagttcggaatctcaaggttattatttgaatggaagctgtcctattaactaaactttttctcattatctttaacttgtattatggattttgatacagtcgtgcacaaaggtagctgttgattttgtttcccctgaaaacatcgatgagtgtctccgtttgactgatgagtttcgacaactccctaagaaccataaagccagagaagacaaacttgaggtgattctttttctgatattttcaattttggattagcaacttctgtcaatggatacagttttgtttgtagttgaatcttgttttaatctttgccatgtgaacagataaaaaagatggtgatctatgcagttgaacaagctctgaaagaagtggagacattattgctagatcgcagctaaaagctctatagctttgttgttgtaggattaacagcagattttgtagaattgttaaagccatggctattgtagttggcttttgctgtgatatatgtatgtaaaagagacaagtgtctcttgaaaagaatgatttcctttttttcaaatgggattttgatgtaacttttccttttccggtctgttttggcatatgaatgaatatttgatgtaagcttcttttgtatagttttgtatctttacatcattttgagagcaaatgaaagtttatgatatgagagcatcatagattcatagtagcaaatacaattggttcagttgttgcttgcaaatttttactgcagtaaatatggattgttttgttttcaaaggttttaaaatgacttaatacattaatttccaaaggttttgttttaaggtattttttttttttttctaattgtatagaaggaaatacaataattaatattcctagtcaaattgtataattttcataccattttctgacaatttcaatttcggacaacaatttaatgatgttctaatttaacgtgggtcccaactaacttaaaacgtgtacgtggcttacgacgtcgtttacaagtttatacgtcgaactatcaacatcattctacctttctttctctctttctctcaaaatccaaaatgttgtaatttgcaattcttcagtttccgtttctctcctgagaaatttattgacttcaaaaaccctaaaaagacttgtgattgttcgtttctctaactcgaatgttgatcgtacgacggtgagtgatcgtagtacaatg

SEQ ID NO: 18260 - DNA, 3003 bp, Unknown
  misc_feature (1)..( 3003): 2750-1469P.txt file - cDNA_ID_1816336; gDNA_ID_1621119; Annot_ID_56255
tatatgtttttttttcattatatgattgaagagtatatcaagattttggtgtgcacatgatatgtgagatttatatgtttcttattaattgaatcctacaaaaattcaattaaaacacaataaagaaacactcctctaaaactaggtcaaagttcagaatcttcatagaaccaaaagcaaccaatataacataagcaaatcaaacagaagaaaagaaagaaagaaaaaaattagaaaaccaaaacaattgacataaacctagctagtcttattgtaaccaaacctagattagcaacaaccacctctaagggcaagaacaagatgaagaacactaccacgttctaggttgtaatgtttggcggttaaatcatcagcaagttgtttcccagtgtagacgatcctttgatgaacaggaggaatgccttctttctcttcgattcgttctttgatccgctcaatcgtgtccgttagctcaatctcaatgtctatttgtttttccgtcagagtcttcactttgatctccatgcttactcaagttttctctctcgctctcaaccttgtcttttgtctctcaaatcaaaatatatatatcttcggatagttaaaagccttgaaggatttggagttatttccttttttttaggcattggaatttccaaaacaaatccattatttaacatattttagtagattttatcagatcaataaaaaattcattaacgtttagcaaaattaaggtaaaaactgaaataccttttatcaagtaatccattaataatctttctttgtactgaaaaaaaacccaatcaaatttcatggtttacttgatacttctagaagttttaataaaaaataaaataaaaattgaaattcacccaaaagtcctttaagaacttatccaaacttaaaaacagttcaaatatcaaattcatccctttttatattgacaattgaatattatggttgagtgtttgaaaaacaaaaaaaaattgatgaatttgttttctttcttttttgccgtccggttttggttcgatttatccttattttgtaacctttttaatcgagttgagttttctcatttctgtaatgaatatttgtttatttatttattatgtgattcaagagaatatcaagattttggtgtgacattctaatttaccagataaggttatttgcaggtttattgttctaaaaggttcatatttttgtagaatcacaacccacctagtaacattaattgacgagaataccaaaattttcggatttgtcagactaatttgcttcttatcaattaaatcctacataaattcaacataaaacatacaaacaaaacaaaaactcctctaaaactaggtctaaaagtcagaattttcatagaaccaaaagcagtgattaacattgagaaatacaacagaagaataaaagaaaaaaatagaaaaccaagacaatagaaccaaacctcgatcgattatcaaaaacgatgaataacactaccacgtagtcggttataatgttcggcggttaaatcatcagaaggaatgcctatttcctcttcgattccttctttgatctgttcaatcttgtccatgggatcaatctcaatgtcgatttttttttcactaagaaattgagatttgactttgaaacgctgtcgttcagcaatctcccgcttcccatgtgaatttaaagtattaacgtggtggcattcacgctccaacttgcgcgtgacattctccagaagctcgatcaatgcataacccacgtggcacatacgcgacttccactgttgccgccccacgtggcagctagctgattttaggatcaaatctaataccaatgcactaaattaattataataattacttaacaatctacggattatcttcttacttcataagatccttatattttcattacactttgactcattcctttcaaattctcatattcactgattgaatacagtacagcataagacatgtgtttaagtgaagtaaacgctttactaatcagtaatcaaggattcaactagaaaaagggagccacagagacaaagactatacgcagaccaacgtcaccctcaacctttttctattcacccaatgctaaagaacaaaataaaaaaaaatctttccattgtcaaacattaaaaagtaaaaaaaaaagttcttcatcttcctcgtcctcactttattcctattccgtgttttttcagcgttttccacagctaaaaaccgacatagcttctctatttttgtttcctgggtgtatgtatgtacagagaataagaccgatctctccaagatctctgttttctgaagagttggtgaatactgtttaagcttctctataagagtgtcattccaaggtatctcttacttctctaatttggtgtttttagctttgtcttcaatttcttcttcaattttaatttctatgtatttgagtaatctataagttagattgcttatacagaaattctaggaaaatggtatttctttgtcaaaaagagacgttactgcaaaaaaacacttctttttctgggttttgggtctctttgagattttgatctaggagttgaattgaattgaaatcttttcttaaaggttctagtcactgctatactagtgcataaattctgttctttttattgattactagtaatatgaaaatgagaggaacaagagacgtattaaggtatgatattaaaatgtagagatatatcttcactctttttggaatactctgaaaatcttatcttaccaattcctctttaccaatttccttttcggtaaaatgtagaattttttatatctaagaaatataaatttccataatctgtacatatatcacacgctttttgaatgaatatttttgtaggtgaagtttttgatttcaaagggttcgaattgattttgcaggtgaagaagaagcgtttgattcccaaaggagattcatttatttgataaatagatttaagctaagagttaaaaaaagatg

SEQ ID NO: 18261 - DNA, 3003 bp, Unknown
  misc_feature (1)..( 3003): 2750-1469P.txt file - cDNA_ID_1816348; gDNA_ID_1621119; Annot_ID_56251
agaaagtgctttcccaatcgacatcttcaacttcggtctcgagggtatctaaacctttggaacgaagcatttctttgaacttttgttccatatgtttcttgtagtgttcctttgtcatcctctcaatgttgtccattagatcatatggtagtccatggttcaccagctgaaataacgaaactttgaattgtaacgtccattttcggaaaaaaaaaatgtaagggaaaataatttgattatttttcaaaataataggttttatgtatatgataccaaagaatatctaagaaagaacctaaattccctgataatcaatcagcaagagaagagagacaagaacctcgaagaagccccagttttgacaagcatcgtcgatcaaagccatggtttggtctctctcttcaccattgagcttagacaagtctataactggaaacttaatgttcatctccatctctctctctctctcttaactagctacttaatgttttcgatccttgatgatgctaaatgtgtgagttaaggggttgagagagggtcgctagctatttataggcgcaaataataaaacaaatgttaagtcttttaaataattttttaagtaaaacgatagataagtatcatagagtcataagatcacataattgggtcatttagataatagttgctaaatataaaaattatttttcttattagaaagaaaaagagtttggggaagttgtatttgtgtgtgtgcaatataattggggggaccttactctcctgcttttgagatgggataaaatttggtgttttccatttgtatctctagttctacaattctattggttatttcttttgcctttttaaaaaaaaacatgaataattgtttataaggttcgtacaagtaaagactcgaagagtttttttatctgctggtgctttgtggagtcattagatgcaaaaaaaaaggctagggatgatgtgtaatatacgatcaatctcgacaaataacaatattacaatatactgattttggatttttggttatctagttatgtatgattgatcattttatttgaatcactatgaatagggaatgactaagtcattgtaaaatgcgtacaagcaataaatagaaaatcgtttgtgcttgtaattctactatttgacagatagattttcttattttgcataatagcaggatgaggagacaaattccatgttgagtaatttatttatatatattgtagatggtaacatatacaagaggatgattttcatcaccaacatcttgcatcttcgagttgcatgattatttcctcgttcttatgggtgttggcaagtaggtctgatgtatatatatcaagtaaaaatatgttattttcagtgagagaatttgaatttgacttatagttttgacttagagtaatattcaaaattagaatgaaatgaagttttttctttccttttcttaactggactgaaaatttatgatgtatatatgatgatcattttcttttacttttgtcaaataaattgtgaaataacaaaacataaattaaattatcaataactaattgacagaatcgcaaaatcagtttatcgttctaattcatggattaccaaccacaacctaaagatacgtatatgattttggtcctttttggattataaatcaactttgttaattttgggaaggaagaagattaacctgatcatttttctgtcaaattatcttgatcattatgaggttgcttcttcgataataccggttggccttggccagctaatataattacaataagttatctttggattcttccataatagggaaaaaatattcctcatagtttaacaaatcaataaaaacctttaaatcaaatgtttggtaagaaaagtatacattatatataatttaactaaagttagaaaatattcccaaactcattaagaagtgaaactaaaataaaataagtttaaaatgatagtactttctctttatgtacgaaaaacaacacaatatacgattaattacttccaagttgtaatagttgaggttataatacctttcttttttcggaaaagggttaaagttgaggttataataattcgtgccacaaaaaatcttgtatcaagtaacaagaaaataaatcaatctttatctctctcgtatcttgtgaaattaattgataattgataacaaaaaatcagaaagaaatacttcggtcggtggctactactacctacttttcttttagtgatcttagcccaataacccccatgcgagcttgttatttctttcactaattgaaaagttcttttttttgtcaagtattaatttacaaactatatatctatcgaaattcggatttatctagacttattatgaacaaaatacttactttcaatggtaacgttttaattttttaaaaaaattcagatttatgcttacaaaacgttcatatataccgtcttcttcttactgttcaatgtcttgattgattttttggtgaaagtaaactatggaattacatgtctttttaaaaacttatggagttatacacacgcatgcattttcattaatacaacactaatttcgttataataaaatgcaacagactaggctatattgtgtttggtttggtgtctacgcaaggcatgtgtactcgtcgcatacaaaacgtaaaaatagacagcaaaaaagaagctagctagatacgataatctcaaggctcaaaagcccaaaaattaaattgggccttaaagttccgaacatcatagaacaggccattatacaagatatccctaaaataccctttgccttgtaggatgagtaaattaataaaggaattgactattaaacccttgggtcagagtatatattcacaccaaccccaatgcggagacctcgaagtgaactccattgacgacgagtgaacgaaaggagggaagaaaaaagttaggttcgaaacgaaagtaaactagttaggtgaaaagcgaaacaacacccacagagcaatg

SEQ ID NO: 18262 - DNA, 3000 bp, Unknown; identical to SEQ ID NO: 6965
  misc_feature (1)..( 3000): 2750-1469P.txt file - cDNA_ID_1816352; gDNA_ID_1621119; Annot_ID_56250

SEQ ID NO: 18263 - DNA, 3000 bp, Unknown; identical to SEQ ID NO: 6965
  misc_feature (1)..( 3000): 2750-1469P.txt file - cDNA_ID_1816352; gDNA_ID_1621119; Annot_ID_171989

SEQ ID NO: 18264 - DNA, 3003 bp, Unknown
  misc_feature (1)..( 3003): 2750-1469P.txt file - cDNA_ID_1816358; gDNA_ID_1621119; Annot_ID_56248
gcgtagatccacataaaaatgacctaaatacctcacttttaagctatgttgccgggtagttaaataagcaaagctcatgttcaagtaattttcgttttctggagattgatccaaggggatgtatatataggccctataacagagcaagaaatgtccaatattacatgttcaattgcaaagcatgttaaaacaagagagggataggccatccaattttcccgatgagaaaacctctagcgcgaagtaatagtatgaaaatcccggctcacaaacataagcataccatcatcagtgtgtcattaccacagtcatgctcgtttttggtcaattggctaagaaacgatccgtggtggaatgggtgaagcagtgccttgtcgttggtgttggcgatcttaagaggggagaacaccagtatacttgtcaacaaacaccgtgtatatcgctagcacgacttagttccatcccgctgtccttcttcatccatgtggttgccttccttcttatgtatttacataggtccaaccaagtttcttatcgaaattaccatgtgaaatatttttaaaaaatcttaaattattttttataatgaatttaataaataaaatacattttactacaacactatcgattaatacattagacaaattggaatcgttgtaaaatttaaaatataagaaaaaaggcaaaaaaatgagcaaaatataagacgaaacaagaagcaaaacataagaagaaaagcttggaatggtaagttcatatttgatacattaacatcaagaattatgagttttaattaccaactatacaaaaaaagaacaacacaacaatatgaagacctatactttaaaaaatcgaacttatcaacttatcatttcaaactttatagctaatcatattatatcagttttaaactatcctctaaacttaccatacattttggctatcataaaaatgaaaaagataaatctacattttaatatgccgatcttaaaatatgaggaaataacaatttgttttgaaagcatgcgtcaaaaaaatctctacactccgattcacgaatgtggatctacaaataagctacttaagcgtaaagttataaaaatggcagaagatggtcaatccaaccgtaacgcccagcagtattaatctgctgagaacaaaagaatgattgagaaagtgttagccagggtcgcacaataataattaagatatagcaagaaaccatttaactgaatcaacaactacaaattaccaacgaaaattaattagttggaaagactaaaattcattaacttggtgtttttatttcattttcggttcaagtattttgcctattctcgagattgatccaaggcgatgcatccctaacacataaattgctagcaatgtccaatattaattaatgaacacagacgacgacaaaagaaaaaaaaaactaattttaaagcatgtggaattgaaggagtatctcaaatactctctagaagatcatttgaagggatgatccaacaaagcaaactacaatatccacaaaaactcttattgtctctgaatcaaacagagctataacattcaaaaaatttataaagccaacgcgcttgatcatcaagatgaagatagaatcgaagtttatgttattagcaaactgggaatcaggaaggaacacatccttcgaaatagataagcgatcatgtcatagtaggtacaatacaatcaaatggatcactgtattcatcaatttcagacactctagttgtaaaagaacttaacgatccataatcaagaatcacccacaattgtcagtcaaacagatcaacataaggtttaagagttctacaaatgatttagttagttcattcgttaaggaattagtggatttgtggcagaaaattcagaactaaattcaatatatgtgattagtgatcagagtgtttcaaacacgtcactgtctaaatccaaaggagaagtgttcaaacctagaggaagctactgggttttgagagttaagaagatcagaccagtccgatatatcttatatatagaaccacatgcacgagaatcatgaaaacgtagtgattttgatttttgtttagtagaacaaatattttgagatttttttagaaatttgttagaatttgagattttttatatgactaagacagagccaaacactagtgccgtcacgtgtaatagataagtttctatccggatgaagccattagcggtgacaaggtttaatagtattcaactactaattgcaagaactttagatacattgaatctagacagcatttcagattcattgaacttggacgtgtttggtttactctactacttctggtttccgcatcagatgtttagaatgtatcagcaaatctactgatgtgaaaaaaaaaacaagacgaaagatccgaccacaacttgccacgtggtaaccacaatttaacttgttgccggtacgtgtgtccacgcgctactatgtaaccgtgaccgtgacctagcttttttagtttttactccaactggaactggttatggatactttgtcacggacgttagttaataaatgttggcgtccgttaatcagaatttttgaagtaaataaaatatacaaaggtgttattaaaaatctgaatctaaaaatgaaaattaattgactaacactaaatgcctaattattttatttttctgatataatccttttaaaagtgaatgtatctggacaatatggtggtaacaattgagaatctaaaattaatccgccagcatatcccaaagctgtaattaatttaacgggatttagggtttctccgttacacaaaacgccgttaatcctttttcaccatcatgttgtcatattttacattttgtcgtttactccgtcaaaaagtcaaagtctctgtcaacataatgaaaacatatcactaaatataattaatactcgtgtatatatatcccacaagtcaccgagaagatgagaaatcaagaaaagggcataaaatg

SEQ ID NO: 18265 - DNA, 3003 bp, Unknown; identical to SEQ ID NO: 18264
  misc_feature (1)..( 3003): 2750-1469P.txt file - cDNA_ID_1816358; gDNA_ID_1621119; Annot_ID_171986

SEQ ID NO: 18266 - DNA, 3000 bp, Unknown; identical to SEQ ID NO: 6963
  misc_feature (1)..( 3000): 2750-1469P.txt file - cDNA_ID_1816366; gDNA_ID_1621119; Annot_ID_56246

SEQ ID NO: 18267 - DNA, 3003 bp, Unknown
  misc_feature (1)..( 3003): 2750-1469P.txt file - cDNA_ID_1816377; gDNA_ID_1621119; Annot_ID_56243
tttggagaataagaacccttgaataaaatttaaagggtcacactcaaaacgtttcaacttcaaatcattttggtattggatttataaaaatataaacaaatgatttaccattttgtcaaattttaacatatttgtattgtaatttattttactatcatctgttaattagcattggaaattacatgtcatgaaaagaacagactaaagaacatgatgaaactgtgtaaatgactatcttttcaccattttaatcctgttaaacgatgtgagattgattattgtctgagaaagagaatgcaatctttactattgtagtcaataattttcttaaaaatacaaatcaaaagtatcttccatgacatcaaatattattgtccaaaagaaaaaaattagtactactctattttaaatttgtaccatatttgacttaagatgacgtggctacaagttgcgggctcatgtgactataagccaggtaggattcctcgtgaatgtggaccctaaagtacatcagtttccgtttttggtcaataacgccatttaaggaaatcttaagcctaacaaaatgaccattttaatatgaaaattgaaaaaattactatcttcactagtaatatttatttttcccaatttatttagaaaactaaatttgacattatatttctacatttagtatactttacattgaaaatacatgatacgattaattttgacattattgtctttttactatctatattttagttagatagattattaagtttatctaaacatattgatgttggttttttaattttgtaaatcaaaattgtgtgattgatgttttctctaattagattttaagccaatctctaatgtttaggctctaaaactttttttttttcgattaaacaggttttataaccttataaacaatctatatttaggctttacttttagttgatgaaataagtagagcaaattgtgcataaggttgatttctttttcgacaaaaagagaagaagatacaggccacaagacacgtactcgtcacaatctgtaaagaatggccagcagaaaagccggtaaaaagagttggacggctaagatgaccccattcagttggtcctatttatcatatagttttgtccgaaaatgaactaaaacaccaataatgcgtaagggataaacgttacaaaactggaaactttaggtagaggggaacaaaaaagtagatatatcttaggtataagtcaacacagagggtcattttgatctgttaatacaatacaatattaatctaacacataatgcattcatcactctatttccaagttccagaaattttgtttggtcgcagataaataaattgcagcttaatgacgtcgtcggtcaatatcgtaataataataataataataataataataataataataataataataataataataataataataataataatgataaaaaaccgttactatacttgaaaatagtttatcaaaaacatacatttcatcaaaaactagatatattataaagaaaaaagtgggggaaataaaaaaatgagggagacacatacagtatatcctttactcctcgatataactttaattaatttatgaggtagatctgaaaaaaagttgtaaataattcacttttcgtgtcccaattatgaaaaacgccccatgtcttcaacatgtgtaacgctaaagcgcggacaaactgatggatatgtctctaaattatattttctctacgagtggttctacaccgttgatttagaagaaagatttgaatctcatggtagaggattcatatcgtaaggttagtaattgggaattgtggtttgctatatatcgatctagaccatatccaaaataattaatattggttcgaatttggatatgaagatcatacattatgattaaataatgttttaaaaaatgagagaaaattttgatgaagagaaaaaatatttttggtttggtgatcattacaaaatctgggttgggtctgatcccaaaaatatcagagaatacaaaacaaaatggctctaatcctgtatttttttctggatggtgtatacttggacatgagaagactctagttaacaatcgctatatagttcaatcatagaaattttcgaaaaaattgtacgtgaaactctattgaattagcaaaatttcttatatttttggtaaacaaaaacttcttagattataatgattgcattggtctttacgaatagtatgtattagttgttaaaatttatttattcgattttaacgatcagatagtggaggaggtcaaatttcaaagaccactgttggacttgggactagaggcctaattcaatagcccaataaaattttcaatttgactttctttaaaacctatgaaatttctcttcctttatatattaccactgctgactcagaccaatttttctccatcgccacgacgacattcgctggtcatggtagataacggaagtaacaattttgtaaccagggctttatgcacacaattttttcggaccagacttaagaggtgaatgcgtctatttcgatttacgtgcatgcatgcatatatagctaattatattgtaccaattatttttagaaaaagaaaaaaaaacctgtgaacgggaagactacaagtcttaattaattaaggatcaccacatatgaccttttcttcgaactccatatttaaacattcctcaaacatttctctctcattatcttttatttctcttcttgttactttcttctcattcttttgacgaaaaacaaaccctttaattagactctcttttattctcccatactctttttttgctgtcttatttttgaagttttttttttttttttttttttgctgtctcctcgttgaactcagttgcataaccatctccagtaaatcatgtcgaatcaaatccaacggtagagattttctacgacaaatctgaattaaatcagagaacgaatagagatcaggaaagcaaagatg

SEQ ID NO: 18268 - DNA, 3003 bp, Unknown; identical to SEQ ID NO: 18267
  misc_feature (1)..( 3003): 2750-1469P.txt file - cDNA_ID_1816377; gDNA_ID_1621119; Annot_ID_171980

SEQ ID NO: 18269 - DNA, 3000 bp, Unknown; identical to SEQ ID NO: 6959
  misc_feature (1)..( 3000): 2750-1469P.txt file - cDNA_ID_1816383; gDNA_ID_2936561; Annot_ID_194447

SEQ ID NO: 18270 - DNA, 3000 bp, Unknown; identical to SEQ ID NO: 6959
  misc_feature (1)..( 3000): 2750-1469P.txt file - cDNA_ID_1816383; gDNA_ID_1621119; Annot_ID_56239

SEQ ID NO: 18271 - DNA, 3000 bp, Unknown; identical to SEQ ID NO: 6959
  misc_feature (1)..( 3000): 2750-1469P.txt file - cDNA_ID_1816383; gDNA_ID_1621119; Annot_ID_171971

SEQ ID NO: 18272 - DNA, 3003 bp, Unknown
  misc_feature (1)..( 3003): 2750-1469P.txt file - cDNA_ID_1816391; gDNA_ID_1621121; Annot_ID_56294
aggaaaactaaaaaactaaaatcatgaatgaaaaactccaacaaaattatttttttaaattgtagggaaaccaaaattttaaaatcttgattggtatgaaaataagtttttgaaaaacaaaaaccaaaaactcttaaaaaatctacaaaacattcaaggccgttgataactgtatataaaatactagtttgataaagataagagaacatataagtaaagaaatgaatttttttttttacacgacgttgtcctcttttacagtatcaaattacaaacatttgaatgaatgtattgtctgggcttggtaacgtgattgatcatggaatgagatgaactagaatcttgtattgtaagtgattgagttaaggtggcattagttgctagaaatgcaatcatcagacgatgaattattaaataaattatcatttgatattcagatctcatattgatacatgtaccgtgttcttacatgacaaactcgtcgtttccccataaaattcgaatattttaacacttatctggactttcgacgattgctttagattcgagaatctcaatgcttgtatattactagtaccaacttgaattattctcagttttccacacatttgaattattgtataaccatatagtattaagttattatcacagttacaatttaaaaagtcattatgtaaacatctgctagaaatccatgaaatattatatacttcctctatagcataaaattgtacggtcggatataacaatatattccaattgggaacgacatcaagaacctaccatgaattcgagttaaaatagtagatttggcactgaaatgttttatgttttacattgcagtcatacttcaaagatttagtggttcttgttctcatcatgtccgagagcatacctatctaaattttggttattacttctcggttcgatccatttggttttccccacaaggtccaacccacgagcctagtgttgtctttagtgacacataacaatcctcgcagtaaaatatgctattgatatcacgacttgtaaaatatgatagatatcaagcctctattagtagatggatcaaatcatacatcataagttcataacctacgaaaacaacactacattcaagccagatcaataactaatagcccaatgcagtaaaaatgggcctaaaagcttgctcgttttgcgtttatttttgggtgagagaaaagcccataggatcacgaccggtccacagaaacaacaataaatcaagccagaccaataaaaactacggtttgacattgttcccgttacagactaaaccgaaaataaacacgttgtgacgaatggtacgttagttattacgtggttgcgtggaaaagaagaagttccacgtggtgactaaagtttgcacgttgcctcttgacacttttgcttctaacgtaaccatttctaaattttgttttggattcaattaatttccacgatattgaacgtttatattcagaaactcatgtatacatgactttttcagtttccgaccaacaatttaggtctcatttgaattgatttggacatgaaaattgttagaaaagttattaaattgatgtattatttaccaaacttttgttgcattctatcgaaagtcaattacaaaaacaggtgttgatattattgacttaagatcgtttagaagtaagaacagtatattgtcgtgattagtttgacgggtatgatcgaatcgcaagactcaaacaggaccgtcgattttatagggtaaacgattcccacaagtcacggaggctgagagccttgagcgtaggtgctgacctggcacacaaatgtaaaacttggccaccaattaagacacgtgtcttgttaagctccgtccccttaggccacgtggcaactgtttttctttggcagtgatggttcttctttgagagttcgtcggtgtccttatcggaaatgtaagaattcgtaaagaaataaaagttggcaattactataacttaggctgaaatgtctgtattgtccttaagcaataccatcaaaatttaataattttgttaactaacaaaattattgagaacattaaagtgaaaaaaccattcgacatattccaattttttcacattctttgttaaatttctgattttctccttctctatgactgttacacaattgatcaacggacgtaagggtttggagtatattgtacatttttttttcttaaacgagaggagaaaaaaaaaagaagggattcctcatccgcaaatagattcattgaatcaaaaaaaatcccaaccagacaaaaaacattagaatcatgcagtggatcccacttccgaccatttgctgatttttccgtaaatacattctagatatttttttaaaagaaaacgcaatttagattttaaattctagattttaaattctagagaagtaattcgcgcaaaaactgtaatcaaagtttaaattcgaaaattttgattagtttacgttgatcgaacaaactacaaagtaccaaaaaacagttatttatagtttcataatcacaaatggataacgacattagtaacaacattaataacatcatcttagtttaagtcagtagtaatctatggttaaacaaaaagggtaattaagtaatttgcattgctcagttcgcttccattgctggatttaacgggcgaataagaacaccaccaaggatagattggtttatttctagtttcttcggatctataaagtagaagaagaagaagaaaaattctcaatttctctctcacaatctcttcgttttctgtgattttatttagattttcccatttcaatctcttgttagaaattgtatatatacctagatcgattggttcgtagatctgtttgtttttctagggaaagttctttgattctccagaaaattggacgaagctttggattcaaattccagaattaaaaaaaaacagaaaaaaaattctttaggttttcattttgaattcttaccagagagtttcaatg

SEQ ID NO: 18273 - DNA, 3003 bp, Unknown; identical to SEQ ID NO: 18272
  misc_feature (1)..( 3003): 2750-1469P.txt file - cDNA_ID_1816391; gDNA_ID_1621121; Annot_ID_172090

SEQ ID NO: 18274 - DNA, 3 bp, Unknown
  misc_feature (1)..( 3): 2750-1469P.txt file - cDNA_ID_1816391; gDNA_ID_1563325; Annot_ID_147471
gaa

SEQ ID NO: 18275 - DNA, 3003 bp, Unknown
  misc_feature (1)..( 3003): 2750-1469P.txt file - cDNA_ID_1816407; gDNA_ID_1621121; Annot_ID_56286
accggaacttcttaaccaaattctgagcaagtctcctctcgagtctaatatacttagacccttcttcactctcatcatcatctctcttcctcttcccattactctttatcactaaagtcctctcttcctccactgtaacctaatttcccaccaaaacccccaaatcataaattaaattaaaaaaaaaaccctaatttcataaacaattcaacatttctatgggattatatcaatacctggatatctgattttgaaattccggggatatcgagataaaatatgtattctttgggagattccaaaatgtctattgggatattattgctacttcctcttccacgactctcgttattactttcgccggaacgagaaatcgggagaattagcttctcgatcgcctccggtaagccaaaaaagtggttaatcgcaacagcactcatcttctccgatcaatgactgccagaaaacaaaacagttaaaaaaatcaacaattctgaaattttccaggaaaagatcgatacagagaataggatcattacctgggaattaggataaccctttccaattggatcttcctcttcttcgatttgatagtatggggtttgaaattttcactccattgatatatagtgagtaaacaccagtgagctagaaagttccagagaaaatttctagaagtaactagtgaacttgagagttgtttcaaaagcttccacgtcattaaatctccttttattgggccttataagttatttataggccgtttagcacattggacttgatttatgtctttgttctattttgtatttttatttcttatatctgtttttattgggccttgaaagttattccaggccttagcccattagacttgatttatctcgttttattttagttagagtttttgagacttgagacaacctacctaaccatactatagacaagaaaataaaaatacttttgtatattagagaaattttgaaatccgtcagtgtgtatattcaatattcctaacgaaaaaatggccaaagcataaataccttatagcgatatttgagtatttaccataaaaccattcgaatactgtcacggttctaaatttctaatattgttcttttgttattaaaggaaagagtgaagggtgttttcgtcatttaacatatccatcgggtcaataacggagattacctatccggtgaccttatcccctcgccggtgagcgaatctcagatccaaaattttgcaaaatcctcagatcgtcttaccttctccgaatcgatcgatttttcatggaggacgacgacgagattcagtcaattccatctccgggagattcttccctttcaccacaagctcctccttctccgccgattttgccaacaaacgacgtgacggtggccgtcgtgaagaaaccacaaccggggctttcttctcaatctccgtccatgaacgctttagcgttagtggttcatactccttctgtaaccggtggtggtggtagcggaaacagaaacggacgaggaggaggaggaggaagcggtggtggtggaggaggaagagatgattgttggagcgaagaagctacaaaggttctaatcgaagcttggggagatcgattctctgaaccaggtaaaggaactttgaagcaacaacattggaaagaagtagctgagattgtgaacaagagtcgtcaatgcaaataccctaaaactgatattcagtgtaagaacagaattgatacggtgaagaagaagtataagcaagagaaagctaagattgcttctggtgatggacctagtaaatgggttttcttcaagaagcttgagagtttgattggtggtactacaacattcattgcttcttcaaaagcttcagagaaggctcctatgggaggagctcttgggaatagccgttcgagtatgtttaaacggcaaactaaaggtaatcagattgtgcagcaacaacaagagaagagaggctctgattcgatgcggtggcattttaggaaacgtagtgcttctgagactgagtctgagtctgatcctgaacctgaggcttctcctgaggaatctgctgagagtctcccacctttgcaaccgattcaaccgctttcgtttcatatgccaaagcggttgaaggtggataagagtggaggtggagggagtggagttggagatgtggcgagggcgatacttggatttacggaagcttatgagaaggcggaaactgctaagcttaagttaatggcggaactggaaaaggagaggatgaaatttgctaaagagatggagttgcagagaatgcagttcttgaaaactcaattggagataacacagaacaatcaagaagaggaagagaggagcaggcagcgaggagaaaggaggatcgttgatgatgatgatgatcgcaatggcaagaataacggcaatgtaagtagctgacaattgaacacacaaatgttcctatgatatttgctatgataagctggattttaggttttgatgttgttgttgttgttattgttactgccttgtgggatgtgtaaatgtagagaagttatgactctgattatcatcatgttgttgttattgttatccatcttcttgtcttaaacatgggcaaattaaaaagctttgaacttgaatagcttgttgaaaacctctgtgattcttaagtagagttctgaactagtagtttgtgattctaagttaagacacagcttatagaatattcaccaatgagattagagactaatgattggattagtcagcatatttatccttaaattaaaatctccttaattaagccaaagcttataattaacctcactaaaaatattcaatgcttctctcttctctttcatccttacctctctactacctctataaaaccatttccattgcaaaggaaaaaaaaagaagatagagacagtaaaataaaaacccgaaataatttgaaaaaatattgttatatatttttggataaatttttgttgatcggatg

SEQ ID NO: 18276 - DNA, 3003 bp, Unknown
  misc_feature (1)..( 3003): 2750-1469P.txt file - cDNA_ID_1816411; gDNA_ID_1621121; Annot_ID_56282
ctatactttctaaccgaatcttaaacatgaattcctaaatccctaaaaccttatttaaaccctttatccatgcttcaaagtttcaaattctttacaactaatcagtataaattgatctgactcaaactcaaatatatatgcatatatatatatatataatattaatgatatagaaaaaaatgaagaaactcaaaatcacgggtccatcaaactgcgacatgataatgattaaaaaaaaaaagttgcgacaagataaatctcaatttgtttttgcatttttgaagaaatatgttagttagaaacaggggcggacctatttaggaaaaaggggggtcacttgacaccctcaactccgggatcaaatctctagcataacacttttgcttcttttttctccatttagctttaaatacatgtatttttattgtcttatatacattttttcttttagatattacactaattaatatactatttataattgcctatgaaaatgccactggttagaagatatttagtcatgtagaacaacctgttagttataggggaaaatgctattgtaattcacatttttattttatttctcaaccaccaccaacacatgcatgtgtgttgttgtgcccacactttttcaataaacttaaaatcaagtaaacttaataaaaattatagtaagtataaaatgatatggaccaaatctatgaataagtttagtttaaatagtagatttgtaagatattcattatgttttataaaaagtgtaataatgacatgtttttgataaactatcttaataatgacatgtttcacacaaattaagataattacgcaaatttttactatatcacatgactaaattttttaataagctgtaaagaaaaactatatcagaaaacataaaacagctcactactggccaaaaaaagtgttaaaatgttagtcaaaatttcaaaaaagaaaatatgatacgtacatgaaattaattaattaattccataacattcgtagaagcaatacgttatcgccaatcaataatttgactaattcaaaatatcgttttcgttatcgaggtgaacacatggagctgctgatccatgaatgaagttacaatcttgtatccaaataaaataattatttatgccctcaggccaccgaaaaaaattaaaaatatggccacatagcgacaatttcgtgataaaacaaatatattaatataatatacatatatatatatatattaaactagtataaaagtaaattttatagtacctatcacataaattgtcaaagataaaattagttattgataatacaatgactatgttatctttatttaaaaaattaaattaatttaaatatttctaaacaattctaaatcaacatcatagtatgataagtttacatttttctgagcgtaatattgaattatttttcaacatttttgtgatttgagttggaacaatatctactccatttgttccaccaaatttgatattgtgagattttcacacaaattaagaaaaacaacttttatattttaaaattattgttttgttagtttaataatattaactatatatctctcttctttttattggtcagcaataaaaaaattaatgatgtgatatagaacatcaatctttgtgaaacaagaaaaaaaataatttttaacactaaatttatgcactagtggaacatttgaaaatgtgtgttatttttagaaacaaaacttatttttgtattatttgtgagaatttttcaaatataaattacttctatataactttttgaaaataatttaatctttaaaagaaaaatattaatctcttaacactaaatttatgctattagtagaacatttgcaaatgtgtgttatttttagaaacaaaacttatttttgttgtgagaaactaagaattcctcaaatataaattactcatatatataagttttgaaatttataagctaatattttttgtaataattggtttattttgattccaaattcagttttcaaattcaagttcaaaattgtttgtaatctttgaaaataaacatgagaaaaatactataaaacttttctaaataaaataataattttatcatttgttcacatggaagtggatgtaaaatgaagttatactagattttaacccgcggtataccgcggtgacaatttatctttttaaagttagtataacttttttttgcaaattatatctgtctataatatatttttattttatactttacaattattattaagaacgtcttgccaaacccgtcccgccaaacccgtcccgtaaaaaaaacatttatttatattaatgttgatcttatttctgatatgtttataaattattgtctaaatatttttgtcgatgcgggacgttgaacccacacattttttgccagttggttaatatatgtttattttaaaaaatttgaatcataaaatatgacagaaaaaattaagatttttttaaactctatatattatataatgatgttaaacaattgtgatatatcaaactttttataagtttaaatattaataatgttttataaattttatatatataaataataatattttaaaaataatatttttgcttataaggtaatgacataataactctaaaagcaaggatttagaagatttaaatctttaattaaatattttcattgataaataattaatgtcagtaacatgacattgtaaataagttcaaatacaaaatttatttatttaaacaaaaaacgtttagtaagaataatatttatttaacaaaaaactttgttttaaaatattgttagcaaatatatttatgctaattttaagggattaatttgaagtttgttgggattaaatttgattgataatgtgattgacaatttaaatcaaaaatttaaagtaaaattaattattttggaaaaaagatttaatgctaatggcattagattgtaaataagtgtcaagtagaggatttatttgctaaaatg

SEQ ID NO: 18277 - DNA, 3003 bp, Unknown; identical to SEQ ID NO: 18276
  misc_feature (1)..( 3003): 2750-1469P.txt file - cDNA_ID_1816411; gDNA_ID_1621121; Annot_ID_172074

SEQ ID NO: 18278 - DNA, 3000 bp, Unknown; identical to SEQ ID NO: 6993
  misc_feature (1)..( 3000): 2750-1469P.txt file - cDNA_ID_1816419; gDNA_ID_1621121; Annot_ID_56280

SEQ ID NO: 18279 - DNA, 3000 bp, Unknown
  misc_feature (1)..( 3000): 2750-1469P.txt file - cDNA_ID_1816423; gDNA_ID_1621121; Annot_ID_56279
gaacgaattggctagaacagctcctgcatcagctcctttccaattcaccgtctttgatttctacaacgcgattcttactaggacgcagaggaaccaaaacttccgtgagttggttaattatcatggtttaatttcatttttaaatttttttataacttctaataccatgtgtttaatatttgccattcttaggatttttcgttacgaacgcatcgtgctgcggagttgggacacatgatgcttatggttgcggttttcctaacgtacattcgaggctatgcgagtaccaacggtcttacctattcttcgacggacgtcacaacactgagaaggcgcaagagatgtttggtcatcttctttttggagccgatacaaatgttatccaaccgatgaacatccgtgagcttgtcgtttaccctgccgatgaacctatgcgtgagtcttgggtgcccccaacgtcagccaccgttcaactcagggagagccgcggttacgagtattactgagtctctaaaatcaatatttagggatcgatcggggtttctataagggttatgagtcaaattataactggatcaatatcggaatcttgagtagttttaatttccaatgttttcatgtttctctagtgagttttcctccataataaaagattgatctctgcaactcttaccccttgcaaatcttttatttaaaagaaacaaaacttttacataaatttatttcttttttttgtcaaccacatattaaaaggtaattccataattaaaaaaagaaggcacaagaagcgttttctcatcatcttatcttttggagcggacccaaatgttatccaacctatgaatgttcgtgagctcattgtgtatcctgttaatgagcctatgcgtgagttttgggaggatccaatggatgagaatatcatcgttagtccatgacgtcgacgtcgatgctagtgaatctatctaactcgtttagttcttgagctcactattttccatctctataccatgaacgagctcttggaatttgaaatgcgctgttattaatttgttgagatttaaaataataatgtaacctcaactctgttttttccataagaaaaatctcaatgagtaacgtgataaacctgacaatatgaaccaaagcgtgtccaatgacctgctttgtgctcagattagacaagtttcgggccacatgcactccattagaacaaaatgataaattttggtggaatcaatttaagaaggtagtggattcaatttgagaccttttttaccctctttttttgtttgcaattattcttgcaaggtaatattcgaaatgattggcaacaaagaaaataaaaagtagaaattataaagttccagaaaagataagtttatacatctggctttggggccggctatatttacagttaattttcatatgaaataaaaccaaaaatcatatatatagataatagatgaaccaaacaaatgaggcgttcttcatataaaacttcatcttcacgtaagcaaatgtgttttatttttatctagtttctgcactcttttagaaacaaaattgttcacctttctgtcgttctaatgattccaatcaaattgataattactagaacttacaaacgaataaggaccaactcttctgtatttgatatagacactctctcaaaacttaatcttctctaatcttcactgtaaatcttaaggaacaactctccacaagtttttataatttatatatacataactaagctattacctatactattaagattgtgtcaacgcaaaattgagttattctttcttatttaaatttgaactattaaaaatatgtaaataattaacgaaaatctttgtcaaaacactattaagaaaataatttcaaaaattaacatgatgataaaatatagattgttaattgttttttttaattgttttcaagtaatttaatcaataatatgatgaggatgattaaggaaattactataatttatcttttaaagaatatcttagcataggtatgagttgtttttgcaaaattttaataattgatttaagttatctaaacgttattaaaattattatccaaattatctataattatccgaacatattcgtctcttgtctattctggtagtgatattttatgtatctatattattcatatatcgtatcagtataatctgacttatttaaaaatatctatttgatatgtattttgatattaaaaatattttaattcgagttgtgtactcgtaaattatccaaaagttttagcagaaataaacatatctacgtatatgttggtgttgaaatttttttgttgaatttggctagtcagcaaaatttagttttatgcaaatggttactgcagaaattactgaatctggtttagtgttaccatttacaccctatatttccgtgaaatttgtatgtttaattctacttcttgcctctaaatgcacgatcttttcagcacttcgaagaggttaaagtgacttttacccgatgagaagggaattgtgtggcagatagaattgctagggaatctctttcttttctgaattatgatcccaaattgtattctatattgccggattgggttaaagcttatgtgtattcagactcttgtgtaattgtaagttgttgttgaaccaaaaaaaaaaaagcacgatctttcttggtactcgtagtaacaatagatattttgttgagaattaaaaataaagtagaagagaaaccagtaatgcgtcagacgtgattaagcgaactatataatataattgatcgataatcgtttgctagtgcgttaaataggtgtatagtaaaatgaacctcgcgctacacgttattatttgtatagtaaaatgaactattattttcattgccaaattgtagtacttgcaatataaatataacgaatcggtctacgagctaaggcacaaaagcaatcttcttctcttttcacagttctgtttctccctctctctaaatgatg

SEQ ID NO: 18280 - DNA, 3000 bp, Unknown; identical to SEQ ID NO: 7025
  misc_feature (1)..( 3000): 2750-1469P.txt file - cDNA_ID_1816456; gDNA_ID_1621122; Annot_ID_56319

SEQ ID NO: 18281 - DNA, 3000 bp, Unknown; identical to SEQ ID NO: 7024
  misc_feature (1)..( 3000): 2750-1469P.txt file - cDNA_ID_1816460; gDNA_ID_1621122; Annot_ID_56318

SEQ ID NO: 18282 - DNA, 3003 bp, Unknown; identical to SEQ ID NO: 15647
  misc_feature (1)..( 3003): 2750-1469P.txt file - cDNA_ID_1816468; gDNA_ID_1621122; Annot_ID_56314

SEQ ID NO: 18283 - DNA, 3003 bp, Unknown
  misc_feature (1)..( 3003): 2750-1469P.txt file - cDNA_ID_1816472; gDNA_ID_1621122; Annot_ID_56313
gccagatagagaaaacaatttgtcgaaaaaaggccaactctaaccttaactcaccagtctaactttgtatttacatccagcgaaaatgttgattcaattggcgtcatagcctcctcagcagtctgaacttccagtaaacgaaagtatatgaattagatcattggaagtaatattgaagcagtatatgatatgttctgaactggaaggcgaaagaatcaaagtatatgcatcagttcaacaaagtaaactcatcctcgtgcaacaagttttcatggagaatctaaatccagatcaatggggaatagcaagtaaatcatttcatttacaacataacttgttcatcagcatgacctgtgtaggtttcagatacgcacatctaattcaaatacataccttctggctcaaatccagagctccgcttataatcattgtttcctcgtgtgtcagttcaccccccttaccagcctatgttggagagaaatagcatgtcaatgggagctggaaacaacaatacttttgataatcaagcaacgtaactaactacttcacaaatcagacaaggttacagcgtaatatctgtccttttcctattctggattcgccaggttagatcataaagggaaactacctcctggctgtgaattgagacaagggctttaagctgagctcgcctaaatagtgtgtcattatgcccaattacagcatcaagaacctgaggcatgtaaaacgttgataaaagtaaacatctacagctccataccactgtggcataataaatgtatcaacttgtgttgatgatataatcaatgcagttagctctaacaagtaccacttcttaaagacattgctagatttttcaacaaatttccaaatcttccatggttgtaacataacgttctgactattgtagcaactagtgaaacaaaaccatttattatgacatttagtgctctattaaagagtagtctacaacaacatcacctttccgatagggtaagcaatcggatagcagattatcatcaaaatgcgaaccaaccacaaaaagtttgcgccaacagcaagtccatatctagagcatatagcttgcggaattatctggttagaattgcaacaacatagtttgtatcagtcataactgaagagaacacaatttgataccaagaagatatgtaaagtaagttacctctccaaaagcaagaacaaaagtaactgagagtaaaacagccacaaaaggatggaatatcttatccaggcatataggaagagcctgagacaaaagatccaagaacaaaattcactgattctgaggtgcacaaagacagtaatttatcgttgtaaatcagaaaaactagggtaacaaatcaacaataattaacctccatagcagctgcattgcaaagaagtagagtcacaagaagttgatgctgcttctttaccactggtaagattgcagctgcaatatccaaaaacaattcaagtaactccgtcaagagtaaaaatagagactctatcactctgcttttaacaaaaattacagaataagaaattagaaatcaagttttaagaaattctatagccattacgaattgaacaagtcaggtatgtaattttgagccaacaacacacagatatcgaaagtcgaaaaaaattaaagaggcgtaccggcctgttttttctcggcggaggaaccactctgttggagaatctcgagctcaacgagaccaagggacattagtccgagtgtgagacccgacattattccggcgaagagtacgaggaaacacgcgacaccgacgacgacgaaccaccacggagaaccgaatcggatgtcctcggcttcaaagacgaaactgttgagcgagtaagcggctcttaccaacgccaaagtgctcagaacaaccattgccgcgcttcgatgagagacaaaatcaaacagagacggagctagagagagagagtgtgtgttttttttgttggtaaggaagaagacgacgatgaatacctttgatacggggatacatggaccacctgacacgtcagcatcctacatgcgttatttccttatttttctctctctttttttaactcatgcgtttttttgcgttattcttcttttaattgatttgttggattattgatgacttctgagttttgctaatcatcttatttattcagcgtccaccggttttaacgcccgagaacgatatacaccttacctgattacctctaatcacattattcttgagattatcgaaggtacatttggaccgctagcaaaaaaaaatatgtaaatacttatttttcaagttacaaagctaatgttattgacaaaagaaaaaggaaaaaaaaggatgaaatcttggaaagctacagcattttgttctgcccaacgcaaattgtaacactaaagatttcgtatggtcaacgtgaatgataatttaatcgtaaatattttcttaagtgtaaaccggtatttaaattcccttaattcatcggaaagattttggtataaaattgatttactttctttgggcttttgggggtcaaactatgagcctaataatggcccaaaaagacttggcggaaattactttttttttttatttgactagtgaaaccggaacgagcgagacgcaacagaatctgaagatcgaaggacagtgaaatcgaagaattgaagcacaagcttctccatctctgcaatctctctatccatctctcgtcatcgcatgtttcgcttcccaattcggaagaaagagagacgacgcgtctgaagcatatctccgtaatcggggtgaagaaaaacgcggcgagaagaagaggcagattttcgttttgggagggtagacaaatctggcgaaagtggagggcctaagggcgaggccgtggcttaagccaggagcttgtataaatggagatcaatatgactacgacggttcggaagacgaccattccaggccttggtggcgccgtcgtctcagatccttgtatatggcagccatg

SEQ ID NO: 18284 - DNA, 3003 bp, Unknown; identical to SEQ ID NO: 18283
  misc_feature (1)..( 3003): 2750-1469P.txt file - cDNA_ID_1816472; gDNA_ID_1621122; Annot_ID_172124

SEQ ID NO: 18285 - DNA, 3000 bp, Unknown; identical to SEQ ID NO: 7014
  misc_feature (1)..( 3000): 2750-1469P.txt file - cDNA_ID_1816478; gDNA_ID_1621122; Annot_ID_56311

SEQ ID NO: 18286 - DNA, 3003 bp, Unknown
  misc_feature (1)..( 3003): 2750-1469P.txt file - cDNA_ID_1816493; gDNA_ID_1621122; Annot_ID_56306
cataaaaaaaagcaatagcatatatctataaatcatctttaaaacaaaaaaataaaaatttttgagaaaaatataggctcgttgtgtacttcttaatatgtttatcatttataaatactattaactaaaataaaatctttaacttgttaacaaaaatataaatacgttgtgtacccggatgaatatctagttattaacaaaactgtaccatttgttttgtagaattttacttattattttattttttggaccaaaccaacttattatttattggcatgtctagttagggaaaatgtttcaattgaacatgtaccgtatgtgtgcatgtataaatagaaattttatgattggattttaataatgcaacgaatcgatgtgaaactattagtgtaaaaccacaatcgacgtcctttgagaatttactggtaagaagaacacagaaaaggatagaaaaggatctggatggatccaagagaaaccctcgcgtgagtaattaaccctcacttaaaccccaatcaccatttcaaggcgagaaagcaagttgtttcttgagtaatccaagttgtttctattttgcgattttaacgggtcaaagatttgctctaagggaaggaggtagaacagttggagccggtgtggtatcaaaagtgatgagctaagtcgctatagcagatttaaaagttcttcaaacgaaaaaacacaactgttctctagtatctaaagattcatctctcatgagatttctactactttgagagtttatatcaaataaacgagagattagtgttttaaaagaaaagcttctcccagtgtgatatcttcactttattctacaacctaacattgacaaattaacctttaagcaagccaaagaatggagttagaaactagactccaaatcatcagcattccaacattcaaccaaacctaagtgcaaccatggcaataactgtggcagctctgaagtaaacttctttgattcttctttccactttatttgagacttcttcttcgttgattgttttcctattgaaattaacaagggcttccctgagtctactcacagaccacgagagcaataccaaactcaaactcattgcaccctcgaagaattggtttgcgcaaaagggtacctgcctggaagcaacattacaaacgagaaagaagagcacagccataccagtgccagcaaagccaattgaacactgagtcaaaagctcgaagagttctccacgtgatttctttagagatagcattgtggtttttctatgttgttcattgcctatcatcagagagagaaggctctcacacgcatgaagacggtttcgttcgtagaggtcatattccttatctcttatcttcggattttgtttctttggtgaaggcttgagcctggttttcttcggactgttggaaatcgaaagaaacgttttttaaagatgcaaaagtaccaaaaactagttgatgatattagatacctctttggaggagctagtgtaactgcgtcctcgggtagctgcagagtgtctattggtacttcactgtcgaatctgcagaatgagaggagagcaaaaacttaatgttaaacccaaaaggatgagactcataggtatgaatcaaacttgcagtgaagaattaactaccgctgaaactgcgggacaagccgtgagagctttctccatcttgttgagttccttaatctatgaaactcagctgccgtagagaccaaatcattcaattcagctctgctacttgagaacagaatgttagcatccaccatgagatccaataacggctttgcatatggttgctgagaacttgatcttaaagcatctagacccatcaattcagataggagagacaaatcgaatccttcttctttgagttcttcttctgatctagacaaaaggaactctaacacctcctcttttcttgcatactgctgagtgatccccaagcttaaacacacagggtctggtccagtttctgttaaccacagttcatgtcagtcgaaaaaagggattacaatttggtgaattcaactgaaatttgatcaaagtcacataccatgaacatccatgagtctatgcttcatcatggttgaatcaaactccaaaaagtggttagacttactaaaagaagaaaaaggtttcaatggctccaagagttgtgatttcaggttaaaggagctctccggtaatatctcatattttcttcctccaggattcaccagataagcccggcttgtctgaatcattcatagacataagaaccaaacaaggagaagacagaaccaggacaagaattcaacgagagattctaaacccaagtgttttaaaacagagaaagtaaaaaactgaccttgatgatctcgttgcttcttagctcttgaaggagactaaacctaagtgttgaatagctatgagaagccattgagaaaaaactgacttcttatttttttttctcttcttcgtcacaaaaccatggaaacaaaacgaaaaagcttatcgtcagcaatctcgcctatatatgcgtcagatattataagatttgtgtaaatcttttctttattcagttttggctggtgaccaaaacacactttgagtttttaaatatttaccctttgaggcacttattacttaaattaccaagaacatacccaatcttttcaataattacataaatatacctttggtttcttatattctcgaaattaacccaaagatcattagggtacatacattctttactcgagagagagaagttctaaagtcctcaaatcccgcaaagctttttcagcttctttgttgaattgcgagcagaggtagaaatcagcaggaaacaaaaatggtaaatttgaatgctttcttcatcttcatgaacttgattgttggcagttgttttgtttgacctagaaaaggtttcttctttcttcgtaattattcatgggtttactcttttttagccaatggttctagggttcttggagatttcgagtttatg

SEQ ID NO: 18287 - DNA, 3000 bp, Unknown; identical to SEQ ID NO: 7010
  misc_feature (1)..( 3000): 2750-1469P.txt file - cDNA_ID_1816504; gDNA_ID_1621122; Annot_ID_56301

SEQ ID NO: 18288 - DNA, 3000 bp, Unknown; identical to SEQ ID NO: 7038
  misc_feature (1)..( 3000): 2750-1469P.txt file - cDNA_ID_1816519; gDNA_ID_1621124; Annot_ID_56345

SEQ ID NO: 18289 - DNA, 3000 bp, Unknown; identical to SEQ ID NO: 7038
  misc_feature (1)..( 3000): 2750-1469P.txt file - cDNA_ID_1816519; gDNA_ID_1621124; Annot_ID_172202

SEQ ID NO: 18290 - DNA, 3000 bp, Unknown; identical to SEQ ID NO: 7040
  misc_feature (1)..( 3000): 2750-1469P.txt file - cDNA_ID_1816531; gDNA_ID_1621124; Annot_ID_56342

SEQ ID NO: 18291 - DNA, 3000 bp, Unknown; identical to SEQ ID NO: 7035
  misc_feature (1)..( 3000): 2750-1469P.txt file - cDNA_ID_1816538; gDNA_ID_1621124; Annot_ID_56339

SEQ ID NO: 18292 - DNA, 3000 bp, Unknown; identical to SEQ ID NO: 7034
  misc_feature (1)..( 3000): 2750-1469P.txt file - cDNA_ID_1816550; gDNA_ID_1621124; Annot_ID_56336

SEQ ID NO: 18293 - DNA, 3000 bp, Unknown; identical to SEQ ID NO: 7034
  misc_feature (1)..( 3000): 2750-1469P.txt file - cDNA_ID_1816550; gDNA_ID_1621124; Annot_ID_172187

SEQ ID NO: 18294 - DNA, 3000 bp, Unknown; identical to SEQ ID NO: 7033
  misc_feature (1)..( 3000): 2750-1469P.txt file - cDNA_ID_1816559; gDNA_ID_1621124; Annot_ID_56333

SEQ ID NO: 18295 - DNA, 3000 bp, Unknown; identical to SEQ ID NO: 7031
  misc_feature (1)..( 3000): 2750-1469P.txt file - cDNA_ID_1816574; gDNA_ID_1621124; Annot_ID_56325

SEQ ID NO: 18296 - DNA, 3000 bp, Unknown; identical to SEQ ID NO: 7031
  misc_feature (1)..( 3000): 2750-1469P.txt file - cDNA_ID_1816574; gDNA_ID_1974074; Annot_ID_180340

SEQ ID NO: 18297 - DNA, 3000 bp, Unknown; identical to SEQ ID NO: 7031
  misc_feature (1)..( 3000): 2750-1469P.txt file - cDNA_ID_1816574; gDNA_ID_1621124; Annot_ID_172157

SEQ ID NO: 18298 - DNA, 3003 bp, Unknown
  misc_feature (1)..( 3003): 2750-1469P.txt file - cDNA_ID_1816590; gDNA_ID_1621126; Annot_ID_56366
ataagatttgtcggcttcgaggattgcaatattatattatttgaagcattattattagatgtgtgatcatttttgtggctttaaatgcttcccacgtcttctaaaatgaaaattcaaaggaatgttgataaaatgttttagccttttagggtctaatgactcgtgctagcattaagtattcaaaaaaaaacaaaaaaaaaggaaataattctggttatcgcagaatagtaactagtaaaacgtataaaaattaataaagacaaaactaagttgaaaaagatagagttccacaacaaacaatgacgccatcggtagctaagtaaagtcaatatctaactaattaaatagcaaaatagtagtagatgttaacgtaatcacattcgtaatattctgtaatgacgcaaactcggggatgcagcgacaaaagaaccattacctaacaaaagtaggaaactctcttgtaatttgaacaatcttccaatagtttgtccattatatttgttttttttttgtactattttattcaagaatcgaacatatttctaatttttctacatggaccaggtctcaacattatgaatcacatccgatattacgaaaaactctattaaaatgattactaactctatttttaactatttttcaaccatatagattatttacaaattcatacatatggaccgttttggtgtcttcagatacgacctatgaggagataagaaagaatcgaatcattgacaattattgtttgtgattctgcagaaactgaagagcacttcacgttctttgcacacgtgtatgtccaatatcgcacgccatattaaccgcggttccagttgcatcagaatgtgtccagagatgaaccacgtggaaaccggtttgtggaaaaccggaatcgtcataaacgcttatcggtttctgtcatgatcgtaataatcatgcacgcgtggatcaatcatctctcttagtaagttttgatgatattttgtagacgtttttctttacttttgatgaaactctctagaaaactttaaattatccacgaatatgtggagctctatgtagacgcataattgtgccgcatataaatgccgtcagcttaattttggcagttttcgttacacgaaaatggaacaaatgtaaatgatcaaataagagaggacccataacatcatatatgtgtcggcctttcgatcaccctctccacataaaacctcaaatggccatatttttttcatttatatatttcttaaatggagtaatacccattacccaaaaaagtggtcaccaagaggaattattctgttatagattccaccatcgaagctaaaagcaaatagatatattattgataaaataaaataaggatggctgctagaaatagaaacgcatgggtgttttggataatcctataatatatgtttggtaaatataatattacattttcgataacttattgtattaagttcatatttaaaaccaactcgtgctaagaaacgaataaatgccgtggagcataaatattagtaacttggtatattaaataagtgagacttacatttgtttttaaaatttggtcaagggtttacatttctcatttaaagaaatgtcataagataaactaaacaaaaattatagttgttgagattaggtagcttgaatgttaactcaaaagtttcatgctttttcattcgctcaattgcttttgttttgaatggagcaatcagaagaaaataagtttaattgttaaaacaagtcgccaacaatttttgaaccattgaaaacataaaccaatatttgaagcatttaagaaagattttttttttgaatcatggatgttgaaaactttgacttcgatcaaaggacaaaattttcaattttcaatctttatgatatcgtaaatcactttatttttgaaaagtgaatcaaaaaacatttgtcgaactctaatagcttgaactcaaaatttttcagtaatcataaaatctccagattttactgcattttttatttttacattcgaattaccttgtttaaatatgtagattatgtactttcgcttttgttttccttaaccatattgttttccttttaaaacatagatgccaaatattaagtttattttagtatcactttaaaccacatatcttaaacaatttagttacattaaattcaaacaatataatgcaagtaaatgaataaagatggggatataaaaaaaggtaaagaaaaacaaaggtaaagattgctttgactaaatatagccaaataggcaaatataattacagtccttcatcttttctctagctttagaatttgtcttcaaatatgaacataattagtatagtattttgataatcactttatagaaagcttgaattatatgaatcaacatcccacttatcaaaagccacacttttcatttcctttttcactctcactttgacattttaactttcctcataattacaaaaaaatattgtattaaatagtaattactaaaattaagaaaattcttagcatctgaagatttagttgactaatctcagacctaatctgtttcagtaaactctatatatgtaaattaaattatatctctgattataaattaaaaacaaaaaaacaaaaaacgtctctttgtatctcctcaaaagccgaaacaaaacctctctttctcacaagtaagcaacttcaaaatctggttaacccaaattacaaaaaaaacaaaaaaataaaaagtcgctctctttcttcttaaaaatctcaactttgtcgtccaaaactccaaatccagaaacccatacgcaaatatccttctacgtgtttgctcctttcacgtttttctcgaatcttctcgcatttaccaatcaaacagattctaaagttccaaactttttctttctttctcaaaccattctctgtttctcaactcttcactttccagtggtaagatttgaatcatgggtttctcaaattcttaacttttcacaaaagcccaccatg

SEQ ID NO: 18299 - DNA, 3003 bp, Unknown
  misc_feature (1)..( 3003): 2750-1469P.txt file - cDNA_ID_1816594; gDNA_ID_1621126; Annot_ID_56364
cgtgttccagctatgatcatgcaggctgtgcttcagctatgtgcccgtctaacgaaatcacatgctttagctatccagtttctggaaaatggaggcttatcttcactttttaatcttccgaaaaaatgttttttccctgggtatgatactgttgcatctgttattgtacggcatcttgttgaagatcctcagactctccaaattgctatggaaacagaaatacgtcagaccttgagtgggaagagacatataggtagagtattacctcggacattcctgacgacaatggcacctgtaatttcaagagatccggttgtttttatgaaagctgtggcttcaacttgtcagttggagtcatcaggaggtacggactttgtgatactgacaaaggaaaaagaaaagccgaaagtttctggcagtgaacacgggttttctttaaatgaaccccttggaatatctgaaaataagcttcatgatgggtcaggaaaatgttcaaaaagccacagaagagtccccactaacttcatccaagttattgatcagcttattgacattgtcttgagttttcctgggttgaagaggcaggaaggtgaagcagccaatttaatttcgatggatgttgatgagccaactactaaagtgaagggtaaatcaaaagttggtgagccggagaaagcagaacttgggtctgaaaaatctgaagaattggccagggtaacttttattttgaagttgttgagtgatattgttctcatgtacctacatggtaccagtgtcatactgagacgggatacagaaatatctcaacttcgagggtccaatctacctgatgattcacctggaaatggagggttaatttaccatgtcattcatcgattgcttcctatatctctcgaaaagtttgttggacctgaagaatggaaggagaaactgtctgaaaaggcgtcctggtttctggttgttttgtgcagtcgttccaatgaagggcgtaaaagaataatcaatgagcttacgagggttctatccgtatttgcttccttgggaaggagttcgagtcaaagtgttctattacctgataaaagagttcttgcttttgctaacctggtttattcgatcttgacaaagaattcatcttcaagcaatttccctggttgtggctgttcacctgacgttgcaaagagcatgatagacgggggaactatccagtgtctgaccagcatccttaacgtgattgatcttgaccaccctgatgccccaaagcttgtcactcttattctcaagtctctcgagacactgacgagggctgcaaatgccgctgagcagctaaaatcagaagtaccaaatgagcaaaaaaatacagattctgatgagagacatgatagtcatggaacttcaacttcaactgaagttgatgagctgaatcaaaataatagcagtctacagcaagtaacagatgcagtagataatggacaggagcagcctcaagtttcctctcagagtgaaggtgaaaggggttctagtctaacccaggctatgcttcaggagatgaggatagagggcgatgagacaatactgcctgaacctattcagatggatttctttcgagaagagattgaaggtgatcaaatcgaaatgagttttcatgttgaagatagggctgacgatgatgtagatgatgacatggacgatgaaggagaggatgatgaaggagatgatgaagatgcagattcagtggaagatggagctggtgttatgtctattgctggaactgatgttgaagaccctgaagatactggccttggagatgaatataatgatgacatggttgatgaagatgaggaagatgaggatgaatataatgatgacatggttgatgaagatgaggatgatgaggatgaatataatgatgacatggtggatgaagatgaggatgatttccacgagactcgtgtaatagaagtgcggtggagggaagctcttgatgggctggatcacttccagattgttgggcgatctggtggtggaaatggttttattgacgatattactgctgagccgtttgaaggtgtgaatgtagacgatctgtttgctctgcggagatccttgggcttcgagcgtagacgtcaaacaggcagatcttcttttgatcgatctggctcagaagtacatggttttcagcatccgctcttctccaggccttcacaaactggcaatacagcgtcagtttcagcaagtgctggcagtatatccaggcattcagaagctggcagctacgacgtagcacaattttacatgtttgattcaccggttctaccatttgatcaagtaccagttgatccttttagtgatcgtttaggaggtggtggggcacctcctcctttgactgattattctgttgtgggtatggattcatcaagaagaggggttggtgatagtcggtggactgatgtaggtcaccctcagcctagtagcctatctgcttcaattgcccagttgatagaagaacattttattaccaacttgcgtgcttctgctccagtagatactgttgttgaaagggagactaataccacagaagtccaagagcagcagcagccggatgttcctccatctgttggaagcgaaactgttttgggtgatggtaacgaaggtggtgaacaaagtgaagaacatgaactgttaaataacaatgaagttatgcaccctcttcctttgaacagtacaccgaatgagattgatagaatggaagttggggaagggggtggagcacctattgagcaagtagaccgtgaagcagtgcatcttatctccagtgctcagggtcaatctgatacttccggtattcaaaatgtgtctgttaccgctatccctcctccagtagatgatcctgattctaattttcaaccaagtgttgatgtagatatgagtagtgatggtgcagagggaaatcaaagtgtacaaccttcacctttggacggtgacaacaatgagctctcatccatg

SEQ ID NO: 18300 - DNA, 3003 bp, Unknown
  misc_feature (1)..( 3003): 2750-1469P.txt file - cDNA_ID_1816598; gDNA_ID_1621126; Annot_ID_56363
gtctccgagtgtctcagtggaaccgattttggagccagaatcatcaagacgcttgtcaagtacccgttggtaagtcccaataagcatgtcagtatagttacaggaatctcagtcctgagaaacatcggaccgtgcaagcaaccccagaagagagggtaaaacaagagcctagcaatggaaccaccaacagcgattttctcatcctccagcatgaatacagcagtcagacacttaccaaccaagtcaaacacattgtacgctgcaataagcagaatagggtaccaatctgtaagaagctctgaatgaacatcctcagtaatgtatccaggaaatatcgacaatgtcaccatgtataagagaacaatcccgaaaccatgagatttaactttcgtcacgatatcccagagtgttgtcctccacgctaaaccggttaaagaacctttctcttcgctcttctctctgattagttcttcattcttacgctcctcatggaacttgatcaccggaagcttatgcgctacgttgtagaacacagcacaaatcaccataacaacaatccccacagcaaagtatagattcgcactttttctcaaaccatcaggatcttgaggatacacagctttagtcaaaattctcaatagtgacacaagaacacctacacatccaaaattcccaaaaacctaaattaatctaaccacagcaaccaaatcattctccattattgaggaagatgaaacatttaccggagccagcagttccggcgacaacagcttgcatatacctctccggcatttcaccggcaacaccgataagacctccttgcataagtgcatcacctagaccggataaggcaacggcggcggaagtaacatcgaatccggcgtataatccgacctgtcctttaacataaaccagatccaaaacaggaaccacaagcaaggcgattacgaagagtaaaagaccgagattgattctaaagctagcgaggctcttatgtgcatagaagacaacgataacgaatagacaaacaagagcaacgagcatgtagataacggcgaagatccgatcgacggccgtggaaggatagaggtaagagaagtaatcgacggcggtgatgaatgcgttccatggaagaagaaagccaacgccgagggtgaagtagatgatgtaagcgaagtggtaggaatcagaaggagcttttttggtagatccttcgtgaggattgaggagaagagaagtctccggtccggcttccgagtcagttacgattccggcggatttatcggtggtggtcatttgaatttgtttagtttctctcagttttggggatttttgggaaattcgttgactaatgggagtcattaaaacggtgcggttttgtatgtgtgtggaattacataaacggtgtcgttttgctggccgagcaaataatttggttggggatgcagtagcgtagacgcattagttggagtattttattttactagtttttgatttttggcaatggccctaaaacgtgtatttgataaataatttatatctgttgtagatgcgaatctcataaaatagtagatattattagttgtagtgtcctactgtgcttttgtccaaaaaaaaaaaaagtgttatagtgtgcatcaccattatcaagttgcattgcattatcataacgagttaatgacgcttgtgtcatccaaaacagatatgtatgttctggtagaaacagatatcataaagtgtttgttttccggcttccgcagtacaacaagagttcgaacaagcctcagtcttattcccatcatgtggatagttaccacatgaaataccccacaaattgcatcttttcgagtaccgagttagtcaacggcttaatctgctttcgaaaagaaacaaaacccgtaatttggaactttagcacgagacagctcttaaccttaaccaaatccatataggattccgtgtataatgttatagtctttctaggatatgatccaatcgagagtaaacacaaagttgtgtgtataccgtctggtgaatcttctgatgaatgtcgggttttaacattgagatcagatcagctgaaaatcatggacaacggttaaaaccaattacaaacatcgtcctttgtagaagagttccaggagagcatcaatggttttctatattatggagccacatatcttgatgatgatttggagattacatactaatgagttttaatggcaatactgaaaagtctgatatgataaggttaccaaacaataatccaaactcacccaaatgatttagtaatgatcgattttgatctctactaaagaagtcggaaaacaaatcgaccaaccaccgaatgagaaaatgatagatgtcgggctaaagccaattgaaatcaatcgaacggctttgctagaaaattccggatggcagagtaaagaagactttttctcttaaaagtatgaagagagaagagtgaaaactgagactatggaataactaatgtatgactatgtttactcttattaatgaagttctatcgagtaaaaaagatggtttttttaattaaaccgaccaattgaacaaaattttattaaaccgacattggaacaaaatttatcggaccgtcttagaaatctctctctctcacaccgtctttctctctccctatcaaatcccttctctctaatatgcgatcttcaaaaccctagtttcttcggatcgcttccaaacttgcgattatctccaagatagtcaaatccttcgctctttctccttttctttcttctctcttcttcttcttcttcttctcgttcgtctgcctcaccgatctccatcaatccaaagtattggaccagatcaccctcgtcgatatttttgattcgattccacaagtgattactagttctctcaatcggtgtaatgatcaattctctatcgtgttgaggatttaaaatcagtgcttaatccttctagttttggagctcctaactggattgtttctaaatcatg

SEQ ID NO: 18301 - DNA, 3003 bp, Unknown
  misc_feature (1)..( 3003): 2750-1469P.txt file - cDNA_ID_1816610; gDNA_ID_1621126; Annot_ID_56360
ttgtcgaaataacctgctcatataatttacttcaatatctacatatacatttttgcagctattttgtgaaataaatcatgtagttgagacttatttagtcactagattttaatgtttgtttttgttaattagaaaaaaaaattttcgaattaaatatttgacacttaacaatcttccctaaatctctccacattaactacacgattagttactaaaataaaacttccaaaatatttaatatcatttaattactacaaaattatcatttttgatattgtttttttccatgactataacaattcgattataatcatcaaaccggagagatatttgatagcatttaagtactacaaaattacaaaatatttagacaataattcataaacatatcataaataagatcaacattaataaaataaatgagttttttacgggacggattggcgggacgagtttggcaggacgttacttaataacaattgtaaactataaaataaaaatattttaaagataaatacaatttgcaaacttttatatatactaacttaaaaaaataaattgtttccgcggtgtaccgcaagttaaaatctagtatgttcatgtttttgtaattattaaaggtcaatcgaggctttacttttttttttttttttctcttttgtttctgctttcttttaagaagattgaagataaatgttacctaacctaactcatattttaagcataacatatcattctttttttgggatctacaaacgtataattatataattgtgggttcatctagtgcatgaaaatggaagaatccatcactttcaattaccgacttaactattttggcatgttatgtttgttactttttcccccttaaatttaggacgataaaaggattatattttttgttggtagaatttagtatggaaggataaaattaaatttgtttacatctatcacgtggttttcattactgtaaaaaagtgaatacaatccatcatcgtacataacaaacgagaggccagtagggtgtgaaactcataaccagaaacgatgttttgttatggaatcacaaggatcacaataactcttgttttggttaattggatatgtgtgtttataagttcacggttttgtgtcaacgatgctatgacaatgtaacagaggagtaatggagtttgacctctgtgtgtgatcagaaagacccacccatctctgtatatctctccccattgaagctttacctatatctcaactaacttggtccaaatccattattggatagaggaaattactgttttatgacaacaataaatttgtgaattatctatcagagaacctataaaggcatgaagtgttgtgagatcaaatcaacttcaatagagtttctgtgtttgtccttggcagagttttcacttcattcaatttggatccctctactaaatctgttaagtctgtttctggttggttgatacaatcaaagactaaatgccaatttccatgtgaacttcactctgtttcagtaactcaccatttcactatctactactattctagttttctatatacttagttctacaggacaaaacctcctttgcaaaatccgattcaatctcattcttgagtactagaagaagaagaactatactaagtttccaatgctctttacaccatcttaaacctataattgccaatttgcaagatttgaatacaaacaaacattcactccaccggattcaatatggtctctttttatcttcttccacgatttatgacgaaccaatgctccctgaaaaaccttgaaatgccctgcttatgaaggagaactttcccttttgcctccaataagtagcaaacctctccttccagttaaccacatcatgattgccttctgtcacaagatcttggcactcttccaagcacttctgcttccacaggtcattctacgaagccatgtctcgcagttcagaagaaacacaagccaatgtcccaatatccacaccgggaagcgactctagtatcttgtgttttagctctcgaggtagactgataaagcaaggtggaagttctaacccagttttgtagcaaagatcaaccaacagaggcgtaacaataccatcttttatcattctccaccacacgagtaccttacagtcaatgctcaaagtatcttcttcttcatcagatttcaaagtttccataagtaaatcaacaatgtgcacatagctacgtttatcaatagacaccacacgaacaaaactaccaacactaagagatccataaactacaacatcgcctccttctcaaaattcaaaccgactattcctttcacagaaggtagagtatagttaagcgataccaaagtcttcttcgagaagctaaaacgcatagatgaatcaggatcaaacaacacaaatccagattctaacataacagcatgaacagtcatgatcacaatcgtcaattcacaagtgtcaccagattcctccatcaatatatttttcaacaagagaggctcgcttaacctttttacaccggagagattcatgctgccaccggaatctacgaacaatctcctgatgattcgtttccgatttctgatcaaacgcactaaaatcagacgaatcgagagagtaacagccgcgaggatatcaccgtcgttgtaatcaatcgacaaacgaacagaggaaggcgtcgattcattgatctttagccggagatcatggaggctagactcatcggcaaactcgaaagttggggtttcgttcgtctcgaggtttctcaactgataaaagagaaggcatagatgataaccagttattaattcccggttgaaccagttgctaaccggttatcggctcatttttaaatatctatgggccgaattaagctttgtactgggtccttatcgtaaagatccgacccgacccgggtttaaaacctcaccttcgtaaatgacagaaatgtcgccgaagttttttttgagagtttgagaaaagagtaaacatg

SEQ ID NO: 18302 - DNA, 3003 bp, Unknown
  misc_feature (1)..( 3003): 2750-1469P.txt file - cDNA_ID_1816616; gDNA_ID_1621126; Annot_ID_56358
ctactgatttgccactctcacgagctttgtcaatttcttgccgcaatcggacagagatcgagataatgctaaaaagacgaaactctattctaatcttaatcatttgttaaataatgcgatttttggggttcactattaacgaatcttactcagttcttccacttattacatcaacacgtaccattatctttttttggggctaaaaacgcgtctcgttgcaaccatttagtccatgacacgtagtatgatgtcagacaaaaattgtttggctttttaaaatcgaactggtcagaccgaaccgtgcttccggttgtcgatcgagaactggaggactagtgtatagtggatgaaataaatgtaaaaaatgcattttaatttcgaggatacaacttaaaattcaggcccgacaaaaatagttactccaataatgcaagctatgctttatcatggagctagttatgtaaaactagtactatgaaactaaccatttaacaaacttacggttaaagttgtagatagagttatgggcaccggttttactaaacaatacatatgctttgaacttttaaagttgagcctaaatctatagtccaacactatgaatacattttcgagtctctccctgtgattgatgacgtacccagttatagaagtttaattggtacgtacaccattagttgcatatgtataatatatccatatagtacgattcaaaaaaatgacatttacaaatgaaaaaaactaaattatcataagacgtcatatctattgaagaatatgtgtgctttcatcctttttttttggtagggttatgtttgctttcatcttgatttgaaggaaatgtgtgatagtatatgctacagtaaggattaagttataacgaagaaagagattcatatctaaaatttaggtgtatactattttggaaacctagttcaattcaacaaaaggttgggtgaaactaactttctagttaccaaaattgaatgttttaaaataaaaatcaaagattcgtcatcagacaaccaacaaacttctacacaaattactataaatgggttttactgcagtactttagtagttgttggtcatcagttactaacttactatacatagattcactctaggcttagagtagttgttggccatcaattgttgtagcctttttttggtcaaaggtaaattgagaatagacagtaaatatagcttttgactatgtatagatccacaactgcactcaatttaaaacattaatgcattttgcatgcattcatatcatccgttcatgagattttatacattagtataagttttacacgacagatgttaaaatgttgaattaaatctgttgtcgccattgattttcatgctcacttaatagaaatgtctaaaagcgtgacaaaatgttatattgctacttaagatttttttttttttgccaaatttgctacttaatatatgatagttcaaaaccatgtttagctatggttatagcattgaaattatttggtattacaactaccaaaccatccaatttaaaatagtccataagtaaaaagccaagcatgacacaagagggctatgtgatggtattggttcgagaccgtgtggaatgcataatattttatagacgtttttcaatactaatatcttaaacttatttaaattaaacataatttattatcttaataatcatttataaaataaaagatacatatagctaacttaatagcctataaaatccaaagtataatacatcatttgtgtttaccaatatcaaagtaggataaatggaccagttttgagtcgttagacaaaatgatatataatataccatcaacaatagtaattaactctgaaatgcagaatcgcagaaaatagttgataaatcatttgtcattttctaatgtgatttcagttccctatatagtatagttgctatttaacaaatggtgttggaaagttgaaacatttaaactaaaagccaaaataaaataaaatttaagtctcttcttgaacatttaccattaaattttgttttcttctatacactaaagaaaaatctcctaaaatagatacagctttcattgctctttttgtttttaaacggttaaaagaagaaacaaactttaaataaccgttaaattagatattgatcagaaacaaaaaaaccggtttcgaaaacgcgttaccaaaccggatattgcttaaaaagtcccacttcaatttgtttttttcctgcttcttcttctaaaaataaaaactctactcttgtcactctctttttgctgtccctattttcactccactctttttcatttttttagtccctactttatttctcattcattatccttttctaattaaaaaaaattaataccaaatctaaacatcatcattcattttaggagatgtattagaccttacattttgaatgatgagttttagttatatgattttgatgattttaggaaagttgatgtgatttattgtaaaatcttttcaaatttcatctaaaaccatataatttggatttctgtatttttaagtgattttttttttcaaatctttcaatattaataaacatcaaattcataaactgtttccaataacagtgaaatttaaggtatattttttagttcaacaacactagatttcattagaatttttaaaatttataatgaataacataagatttataaatttacacaaatcacttaaaataataaattgaatacgctcctcttaaattattcacaaaattatacgttaccaactatacataaattataaataaattaaaaattaaaagtctataaatagatttaaatttaattgtgtagggtttagttatggagaaaacataattgtgtaagtttttttggcttctatatatattaccacaaatatataacacaatccgctctcaaacccaaacaagcccaccaatctcttcttctctgctcttctctctctgtagacactagaagaagaacaaaaatg

SEQ ID NO: 18303 - DNA, 3003 bp, Unknown; identical to SEQ ID NO: 18302
  misc_feature (1)..( 3003): 2750-1469P.txt file - cDNA_ID_1816616; gDNA_ID_1621126; Annot_ID_172308

SEQ ID NO: 18304 - DNA, 3003 bp, Unknown
  misc_feature (1)..( 3003): 2750-1469P.txt file - cDNA_ID_1816622; gDNA_ID_1621126; Annot_ID_56356
caatttcaattatagggtttcggagataattagatattgcttcttccttttttcgttgtatttgtttaaatcctctctgctttggtctgtgcttgaaacttgcaaactaaatacgttggatctgttttgttgtaggcaactcttgaagatattggtatggacatgacagaattaaatacccttacctacgatgatctcgatagtgtttcaaagctacaaaaaagtcggagatatgctgatataatgcagcaagtggaagaggctcttgaaggatctgtattagagtacaagaagctaatcgtggactgcaagcagctcttagttgatattgagaatgaaatagtcatcgtccaaaactttatccgtgacaagtatagagttaagtttcaagagcttgagttgcttgttcctcacccaatcgattatgctcgtgttgtgaaaagaattggcaatgagatggatttaaaacttgttgatcttgaaggccttcttccatctgctatgatcatggttcttttagttactgctttaaccacaaaagggaaccaactgccagaggatgttctgctaaagacgatagacgcttgtgatcgggctctggatcttgattccgcaaggaagaaggtccttgaatttgttgattgttgcattgtgtgtgtcacattctaaacctaatgtgcttcttggtctactcatagccatctcatgcttcggaaacaccctcctcctctgcatctggatacaagtctctggaaaacgtaaagcatatcaatgtagctgccaataggtactatatatttctttccaaacaaaaatgatggaactctgtttatctttctctttacttacatattggttctgtgatatcaaaagcaattaagaccacagaaaaccgttgaggcttaacctcaaacatcgaacaaaaagaccgagactcgaactccaacaatctaatggtttcccaatttgtcaaaagtgtactataattatatcttctaaacacccaacaaagtattagccatcaacttataatactctaaacttgatttctctaaatcttttcataccgagacatctaaagtagcactatcaagattactacccgtgacctcagcctcaattacaaaccgggaggtcacaagagtttcttataaacacggttttgaagaagctaaaatggtaaaggtaatggtgtataaatagaatactaagtgcggctaaaggtttgcaaatgagtagtcttatggtggttgtaataaaacagaggactggttctcgaaagagcggcaactaaatggataggtggctgtttgaattttgtggttggctgtatcgctttctgttgcgattggtcatcttcctctgcttttattcattgttctgttactgttaggctgaacttttgtaactttgcaagtacgtaaactaattgtaccactctgataagtatacttcttgataataacattacattcattttatttcaaatttacataccgacataaaccaaacattcctcaacgataaacaagatgaaaaatagaggtttaaaaagaatcgacaaataagtttaatgcgtatacgttaaacctccctgtaattgtgtacaaattacttaagtgaaaactgaaaagtgaaaaccttttaaaaagttaaaacgtgtctgtatatttgaattgattttgtgggttaacgttgtcgattgactactagatgtgtatgatattctctatatttgaattgattttgtaacaaaccatgcggtcataagagtttcttctaaacatggttttggagatcctaaaaattttcggtaacagaaaacagagtgcggctaaattaagcttcggatttacaattgctaacgttgcttttttgctgtgatcaatctttttcttcttcttttgtttattgttctttatagtttggctaaactttgtaactcgagctgtgaagtactttaacagtatatttaataataatacaataacattacattttttaggtcaacaaaattatgttcaaacctttaaaaagatgaaaaagtgtttctatagttaaactaatcttgtggattgaggactagaagtatactatgaaagtcacttttggcaccaaatttctttgctgtcataaatatcagagagtttgacaaaaaaaatttgttcatgcaattacacataagtaaagtgggagccatttttacaattttgtttactaaaacgtgtatgataatagaaaatctgtcaaaatctgtcaatgtcatacttggtatccaataatctctatgctaattggccaacaattttagtaagtttttaacatatttgtggttgtcaaaatttttatttttgcttttagatgtaagcatgaaactaaattcaagtaaactaaaaatgtatacgttttacaactcaaaaagttaaactaaagtcacaagtcacaacgttggtaacaactctgctttccacacaatatatatcacatctatgtttttgtctcagacacataataataccattagagaagaaagaaaatggagatatataatttcgaaaaaattaatgtttcgaaacacttcctgaaaatattcaattgaacattatgtcacggttgcctctgatgaaatcctttaaaaaaatggttaacttgttatctatattttgacgtaagattcaattgtattcgaagaaaataaaaatattaaaaacgagtacgacgacgaaagacaatctgtcactttcatgcatggtatccaataatctctgtggtaattggccaataattttagtaagtttttaacgtgtggaactaattaaaatttcttcttttggtttttagatgtaaagcgtgaagtataattcaaggatatacgcgttttatgactcaacacgttagaaacaaactctgaagattctctataaatatcatcaattgtgtgtgtttgctagtcctcatctatctcaaacacataatataatatcatcagagaaaaacaaaatg

SEQ ID NO: 18305 - DNA, 3003 bp, Unknown; identical to SEQ ID NO: 18304
  misc_feature (1)..( 3003): 2750-1469P.txt file - cDNA_ID_1816622; gDNA_ID_1621126; Annot_ID_172305

SEQ ID NO: 18306 - DNA, 3000 bp, Unknown; identical to SEQ ID NO: 7103
  misc_feature (1)..( 3000): 2750-1469P.txt file - cDNA_ID_1816644; gDNA_ID_1621127; Annot_ID_56390

SEQ ID NO: 18307 - DNA, 3000 bp, Unknown; identical to SEQ ID NO: 7105
  misc_feature (1)..( 3000): 2750-1469P.txt file - cDNA_ID_1816651; gDNA_ID_1621127; Annot_ID_56386

SEQ ID NO: 18308 - DNA, 3000 bp, Unknown; identical to SEQ ID NO: 7105
  misc_feature (1)..( 3000): 2750-1469P.txt file - cDNA_ID_1816651; gDNA_ID_1621127; Annot_ID_172351

SEQ ID NO: 18309 - DNA, 3000 bp, Unknown; identical to SEQ ID NO: 7099
  misc_feature (1)..( 3000): 2750-1469P.txt file - cDNA_ID_1816662; gDNA_ID_1621127; Annot_ID_56382

SEQ ID NO: 18310 - DNA, 3003 bp, Unknown
  misc_feature (1)..( 3003): 2750-1469P.txt file - cDNA_ID_1816706; gDNA_ID_1621128; Annot_ID_56423
ctctttgtccaaataattccataatattttgacaaggaaaacattttaaactcatacaaatactttgaagataatattatttatcaaaagttcaaaactatcactgtatcacatattgacgcaaaagttttttttttttttttaacgttctataataacctaaagagtgtcaaacattgactaatatttgaagtttttctaatgcaaactaaaaaagaaaaaagaaaaagaaaagaagaaacagatccctcaaattaatgaggaaaccccgaggttggtttacgaacccaagttgagtaaaataaaagattagtagtaatatgtggataagaaaattgtaaagttggctttatggttaaagaaaatgggaaaaaaatagtggtggttagattgaagtggtccagatacgccgtcaaagcaaaataaaactccaaaatgtagcggcccagcccatttaattactcctataaagatggtccaattgcaaatgaaaatgtgttaaaatttcggaaagcattatttctactacgaaggaatttaactaacttaataaagaaaatattctaaactttggaccacaccaattattatacaatgtgttgatttctattgtaaatcatttatatcaacaaaagagtcataagtacactctaatttcgttggttaagtgctaaaaatcttgcgcggtttagctttcggattagattttataaagagtgctataatcaaccagcgattctgtgatcagatgtgggacctgcatcttctgtcattggttacacgtgtacggttgatacggtggcttgagatcttctactgctctgtagggcaagcaaatatttgagtgacatgtgttatgattaatcatgtcggcaaatacaattacgaacgaattatcatcattatcttcacttctttggctaaattgctaatggatattggaggaatttattaggttttaatccgacatataagagtatatacaaaagaaaaatattaatttttcaaattttattttagaaaaagtttcatgaaatattttgcgttaactgctactatagtaaattcgtgattgttacttaatggtctaatttatcctttaaaaaaccaaaacaaatcatttttgtgtgattagttgttgtagctaagacattgtcattttattttcagtataagttactaaattcgtttatatatataattaaattgcaaagtatgctacagtatgacatataatgagtgcagaaaaataaaagatgatgccataatactatagtgaatgagaaaagcctgcggatattcatgcctaataaaagtctttaactccttatggataagatatatatgggaatacaaaacatttaatttatatttattttttatcttacgttccactgacggattataaataaattttttaggaaaaactttatatttgtttgtgtgtgcaaactttatattacatatattagtcatcaaatgcttctatatattgtgaccaattcacaaataatgatataaatatatatatattcccatcagtttttcttggtataaatacaattaattcaattcaaacttatgacctgttctgtcaagaaaacgaatctagtaatttatgactgaaccaagaagagaatgtttctcaccgtacagaagaaatcaatgcgtgatgagtactgagtagctgttagcagtcacctctaattgtatgaatttattttgttgaaatatgttcgttaatcgttagtacttgttgaaagtcactacgtacgtatatatgtagataaaaaaaaaaaaaaaattcttttaggattattgttacacgtataatgtaaagttataacataagttcttaacaactctttgcatagtaccgattcggacttcgatttcgaaagccatgcatgagaaaaccaaaaaatggagccaaaacttagatccggttcaattcgagtaggttatgtcaaagacgtaaacatctacaataggagctccatataagtagaatacaaccaatgccacgctgtaacataaacaaagacagcgagaatctgttaaagatctctcaggttccaaaacaaaactacaagaccccattatgatgttactgacatttaactaaagccttgtgctagttgatccttaaggaagatgtcctgtcgtgatgctcagttttatttcaaattcatatatacgtgtgtgtgtgtgtgtggtgatcatgattaataggttagagacagagagacaaaagttgtgggctttaacaaaccccagtaaagaacaataagtaattttgtcacgtaggctctgtttttggctcttcaacacccaaagtacctgttttttgaagatgtgagacataaattattacttatgatctcaagtcaataaactcatcaaatctgaactacccacaatccaaacattgaacactagctacctttacatatagagttaattaaccatccatctattgagaaaacgagtaaaatatgtattcggttgttgttcttggtaagaaaagattatgagcttacgatccgaaatttcttggttgtgataagttattaatgggagatagagagaggtgatatgcccatatggcataccacatgtggtgggggattcgaagatttgatctggaccgtctatcacaagaaagaaagatgaaaatattttgtttttgggtttggacagatgggagaaaaagaaagtgtccccacaaatgtccccaagaagatgggacacacttttgcctcaaagttgctgttactgctaccgacaagcttagctttttttcctttgtccttaattcagaaaacagtttcttctctctctaccagtatctatctttattctcctttaacttgtataaaacactcagcttcctcgaagcctctcatcttcatcatcagcagcttctctatatctctcctctctttcaaggataataaccaaaagcttttctttttatcttctcctgcaattcttgaagaaatg

SEQ ID NO: 18311 - DNA, 3003 bp, Unknown; identical to SEQ ID NO: 18310
  misc_feature (1)..( 3003): 2750-1469P.txt file - cDNA_ID_1816706; gDNA_ID_1621128; Annot_ID_172410

SEQ ID NO: 18312 - DNA, 3003 bp, Unknown
  misc_feature (1)..( 3003): 2750-1469P.txt file - cDNA_ID_1816716; gDNA_ID_1621128; Annot_ID_56416
aaatctttctcttacttagttttgcaaaattatcacattaaatgttttacaagataagttggtgtagtagttgttttgcgagtgtgagttcggtttatcttggtatagtataacatcatccggtttactaaggctttaagttgttgggctgtttagtgttcaaacatttgattaaaccgattaaaaagctactatacattaacagccaagggtcgaagaataaacaagacagtgaatttttaaagctgtcgtctgatccacagataggtgaaagtttgatttcgttattaattagtgggaaacaaatggagatttgctgaaacgtactctcgataacagttcatattcaagactcaagagaatctcgtatattctaaggaagacgtacctaaacagaaagttggtcccaaaaaacgagagaaggaatgaaagatcaaggatacatgttttatatacatgaaaaatactaaattttaaaagaagtattaaacgtttttataatgtcaccggaaagaagatgtaaatgtattgatcaaatcatctgactataaaagtaattcaaatcaccatttttttaaatcaatttgaatatttgatgaatttccgtatataaacaatcagtcccgctcttgctgtataaatgaaacgtctatcaaacattagctagtcttgtactggattgcctttacagacaaaagattatactgtatatgtatgtggtctcatgcaaaaaaagtaaaaatgattctgtgtacatctgttttgatttgcatatatattggcttaagtggcaaaggtgcatgcactatttctatttctttgataaaagttttatgatgcatgcattcttaccagtgatttctttaaaaggagaagacatttgttttgtaatagtgacgagaatgtagacagaaaaggaaaggaatcagcacgtgttcatcgctcgacacgtggccaataatagcattggattcagaaaaaaagaaaaagaaaaaagcgaaaaaacctgtataacaggaaaaaaatacaatctgcaccagccgggaatcgaacccgggtctgtaccgtggcagggtactattctaccactagaccactggttatttatttaaaagatttatattggtataaaaccttgaccataaaatgttcctagtgcatccactaagatcaaattcatattaataaacaaaaacataaaattcaaaccgatatagcaagattgctgttagttttgtcttctaaatctgataagtgttcgttattgtcgaggttatgtagctagtttatatattacttgtactaaatttcaatagggcaatcaaaatatacggattttcatgtgtatatatttttctaaatttgcggtttacaaagaaaagttagtggttgatcatattgatttcttgaaagggaaatattaccaataaaatgataaaattgccaagaaaaattagtagtacgatcgataatttagtgatattgggatccaaagagatgatcatgcacttagttaagactccattttctgataagagttaagtggcggtagacccacaaagaaatttgattcggtattgttattattgagtagaaaaacaaagatggagtgtttaactaaatcatgtctaataagtagcaaggtaggtcaatataacgttttacaaacgaaaaatagcattgcatatttaattatctaccaaatatcttaagtcagtcgaataaactaactcattatgttatcaaatcagccgcaaattgtgccgtttaagtcaatactatttttaacttagatatttagtgagtagacttcatacttgcatagtctagtagttatcattgtttaatgcaattttttggttttaatgtaaacttatactactatttggtcatgtaatctcactttctaaaaaaccaatgtaatcatccataatagaaataaaacatttatttaatataattaactaatttttaaacattaaaaagaatagatttatttttatacataaaataatagaaatataaatatatatatatattattataggttgtttattgtaatccaaaagcagaataaaatttgggataggtattaagagtcataaatcttgaaaatagagtcattaattaataaagctgaaaaggaaagattaaaaaaagaagaagaatcctctaaaattgaatttggtaagagtccacgtaggtcaagaagaagaagaagaagatgtcgtgctcgtgttgtgttccaaacgaaaagcgtctatgttctcttcatgtaccgtttctgggtcccacccccctttccttcttcactctccccccaattcctccctctctctctctctctctctctctctctcaccaaaacgtaaatctactctctctatcgcagcagacacagaaaaagagagagcgagagactctgctcacacacatatttacttccctaacttgtctctctctctacacattctggtgagtttcgtaagattcaacaatcgtttagacttcttcttcttcttcttctacagcttttacgttttctggaaaagagatttttggctgatcactacgttgcaggtatatgatttctcaaatgtgagatgggtttgatgttccttttcgctatttctcatctgattttgaattttctgcggattttgtgaggaatcggtagattttgatgtttgttcttgtgggtggttcataacttcatacatttaggggattaaaagaaaattaatttacaaattcggtccttgttgtgaaaaagatttataatctaaaagacattaactttactctctccttgaacaagttttgaattttgaatctttttctgattttgattttcactatgttcataggtaattgcacaattctgggtatacaaaatccaaacgttacgcatattgaattgaaaaatctcgattttgagttctgggtatgaataaaaatctcacctttttaattaattcttactcagggaaacagtaatcgatg

SEQ ID NO: 18313 - DNA, 3003 bp, Unknown; identical to SEQ ID NO: 18312
  misc_feature (1)..( 3003): 2750-1469P.txt file - cDNA_ID_1816716; gDNA_ID_1621128; Annot_ID_172402

SEQ ID NO: 18314 - DNA, 3000 bp, Unknown; identical to SEQ ID NO: 7118
  misc_feature (1)..( 3000): 2750-1469P.txt file - cDNA_ID_1816720; gDNA_ID_1621128; Annot_ID_56413

SEQ ID NO: 18315 - DNA, 3000 bp, Unknown; identical to SEQ ID NO: 7118
  misc_feature (1)..( 3000): 2750-1469P.txt file - cDNA_ID_1816720; gDNA_ID_1621128; Annot_ID_172397

SEQ ID NO: 18316 - DNA, 3000 bp, Unknown; identical to SEQ ID NO: 7116
  misc_feature (1)..( 3000): 2750-1469P.txt file - cDNA_ID_1816751; gDNA_ID_1621128; Annot_ID_56403

SEQ ID NO: 18317 - DNA, 3000 bp, Unknown
  misc_feature (1)..( 3000): 2750-1469P.txt file - cDNA_ID_1816755; gDNA_ID_1621128; Annot_ID_56402
acgcctaaaaacacttagtcatagacacacgcctaaaaacacttagtcacacgccaaaaaaaaaaaacacttagtcataaagaactcacgcctaagaaaaacatacttggtaaaacactatatatattcaaccaaatcactttagtaacaattagtcattaccttgcgtctaaaaacgcactttacaatttacactaaatcaattgaacaaattcactttagttaacaattagtcgaaccacttagtaaacacttagtcaatatccatttaggggcgacacatttaaaatttttttaactcaggcacttattctttttactcgtaacatttgaatacctaatcgtaccacttggtaaacacaaaatcaatattcatttaggggaaaacattattttcctactaaacgaaacttagtggaaggcttagaaatatgataaacaccctttggaagaaatgtaacgctagtcacttccaagtccactttcataacatgttatagtacttaataaggcaacaaattattagtccgaccactttaatcaaaacacgagtgatttaaactcaagtagtcaaacaaattagtccgaacattttagtcaaaacacaagtcgaaacattttaactgaagtacatttcagcattaagatcgtaactgtagcaaagaaaataaacaccttaatcgtaataacaagttgcaactgcaaacaataaacacattcgtcaaaatactattgtcgtaccacttttaaatcatttcatttgattatcagtcgaagcgctttgctcaatgtagtcgaaatgggagcatgcgttcaagcagtcaaaattcactccaaatcgtagcactccagtcgtaacacctccgtcgaaagaaagtgaagggtcgaaaaagggaagctatttttagaaacactttgaagtaaatatgtaatgtcgttgtttcttctttcatttccgttgtagactttcgttctcctcctttactgttttgttatgttatggcctgtctttctgtagatttttgttaagaaacctttcaataaattcgatttcttgtgttttaggttacaactctcgacccttatatatggctgatgagcttcaaaatagagtaggaccctaatacacgttttagaccgttattaacttaccagccaatttagcttgatctttttccgtttttgtattctttgtaatttttgacgcaacttcaatatttcactctttgaattatgttgttcattagttgaactattttacatagataaaattaataatattttaagatagaaaaatttatagcaaataatttatgtgtccaaacctagaaacattagataaaatgaaatagaatgagtaataaacaaaaacccaaaacaagaaaactatgttagttttagaattgaactaacacgttaacaaactttattttaaaatcaagaaactttttttttaaaatcactgtctttaaaaatcaacagattttatttgaacttatcactgtctttgtcaaaaaaaattgatgtaaactttattttaaagtcaacaaacttttttgtaactttaaaaacaaaatatatttttcttttaaccaaacagtgtattcgcatggaaaattattctaattatacaaaatactatataggaacggaggagaacacaatttaatggtcagatctagatctcgtcggtcatccacctttcagttttcacgagtgtgtcgaacgaacgatattaattaaaaactaatcaataaactgaataagtacaagttgcatggttaatgaagtaaatcaccgatttgaagtcattaaaccgaccgacacaatgaataaaaacgcgttcacggattttattccgtgttgatgggcagtgacactgacttctcccattaggcaactgtaattttttctcgtcactatttttcatagcaaatctaaaataagttgcaagaaattaatttgatatacaaaaaaaaagaaagataaacaccatgtgggggttgttgttaatggtggaattgaaaacgcattaagtggaaatctaaatacaaagatcatgaaaaatctaataaaatatttgtaagttgtaacaatctatatgtatatctttgctccaaatattaattactagacaaataaaaataagggaaacaaaaagatttaacagcaagtcgacagtgtggacatggaaagagacctttacaacgaaaacaatgtacttatcttccaattataggaataaacatttcgccagtgaaaaaaggtctcattccttccttacttgtggagatggagatctgaatctctaaagtttcgatttttatttattcacttttatgcccaaaaagaaaaatcgttactttaaagccaaaaagaagaatacacaaacttcattcactctctcccattctcggatctctctcagtgcacagtggttgtcactcttctcctttggtcggtgagttttcaatcttttttcctttcttctgcgattttcattcgttgagattcgtattttgcttccttctcattctctgagatattcgttaatcaatgagcggtttttttacttttcctgggaaattgagtgagacttttcattaaaagctctcccgataaaatggaaactctactctcagatctactactactttctatttaattgcataaagatccaatctttgacaaaaaaaataattgtcggtggccatttttataacacttgtgttacttacttggtttacacttaacttgggttctgaatcaagagtgagtggtttctgacccaataaacacggatctgactctaccaagtctgaatttatcatgttctgtttattttaagtgccagtggctttttaccaaactctatgcttaaagtcatattctttataagtgttctgttcttgatttctgcagaaactctttcttggaaagagcattttgttatcaagactctgaagagctcttttgggaggatagtaaggttggatgatg

SEQ ID NO: 18318 - DNA, 3000 bp, Unknown; identical to SEQ ID NO: 7115
  misc_feature (1)..( 3000): 2750-1469P.txt file - cDNA_ID_1816759; gDNA_ID_1621128; Annot_ID_56401

SEQ ID NO: 18319 - DNA, 3003 bp, Unknown
  misc_feature (1)..( 3003): 2750-1469P.txt file - cDNA_ID_1816768; gDNA_ID_1621128; Annot_ID_56398
cagagtgagacaaaagccatcgacactagcaaaaactcagacataatgccgacattatgtaaccttgtcgcctccttgtcatggcgcaacgctactccaacaaccgatatatgccattgggctgatggatacccacttaacatccatctctatgtggcgcttttgcagtcgatatttgacatacgtgatgagaccttggttcttgatgaaatcgatgagcttttagaactgatgaagaagacatggataatgttggggatcacacgagctatacataacttgtgtttcacttgggttctgtttcatcagtacattgtgacatcacagatggagccagacttgcttggtgcctctcacgccatgttggctgaagttgccaatgacgccaagaagtctgatcgcgaggctctttacgtgaagctcttgacctcgacattggcctctatgcaaggatggactgaaaaaaggtatttctttttgccttgtaaatggacttgatcacacaaaactgaatctgattgtgaatgtgtgattataggttgttgagctatcatgattattttcaacgagggaacgtgggattgatcgagaatcttctgccattagcgttgtcttcttctaagatcttgggggaggacgtgacaatctctcaaatgaatggtctagagaaaggtgatgtgaaattggtggattcttcaggggatcgcgtcgattactatataagagcatctattaaaaacgccttctcaaaggtaatagaaaacatgaaggccgaaatcgaagaaacagaggaaggagaagaagaagcggcaactatgttgcttcggctagctaaggagacagaggatcttgctttgcgcgagagcgagtgttttagcccgatacttaagagatggcacttggttgcagctggagtcgcctcggtttcgcttcaccaatgttatggttccatcttgatgcagtacttagctggtcgatcgacaatcactaaagagactgttgaagttctgcaaactgcggggaagctcgaaaaggttcttgtgcagatggtggcagagaattcagatgaatgtgaagatggcggtaaaggccttgttagagagatggttccgtatgaagtcgattcgattatcttacgactactaaggcaatggattgaagagaagttacaaacagttcaagaatgtttgagcagagcaaaagaagctgaagtatgtttattaaagctttacttgcagttcaagtatacaaaatgtatcatctatacactcaatatttttttctgtagacatggaacccgaaatcaaaatcagaaccctatgcacaatctgctggagagttgatgaagctagcgaatgatgcaatcgaggagttctttgagatccctattgggattacagaggatcttgttcatgatcttgctgaaggattagaaaaactcttccaagaatacaccacattcgtagcatcttgtggtaagtgaaaggatacaaatttctcatttcatacaaaccattggttactaattggtgattgttttgttttttgtcaggttcaaaacagagttacattcctacgcttcctccacttacaagatgtaaccgagactcaaagttcgtgaagctttggaagaaagccacgccatgtgctgcctcgggagaagaacttaaccaaatgggtgaagccccaggtggcaaccacccgcgtccttccactagccgaggaacccaacgcctctacattcgtctcaacactttacatttcctaagctcacaacttcactctctcaacaaatccctctcactcaacccgagggtcctccccgcgacgcgaaaacgctgccgcgaacggaccaaatcatcgtcttatttcgaattcactcaagcaggaatcgaatctgcatgccaacatgtctctgaggttgcagcttaccggttaatcttcctagactcatactctgtattctacgaaagcctataccccggagatgtcgcgaacgggaggatcaaacccgcgttgcgaatcttgaaacagaacttaacgttaatgaccgcgattcttgcggacaaagcgcaagcattggcgatgaaagaagtcatgaaggcttcattcgaagtcgttttgacggttcttctcgcgggaggacattcccgagttttctgtcgaacagatcacgatttgatcgaggaagatttcgagagtttgaagaaggtttattgcacttgcggcgaaggactaatcccagaggaagtggtggatagagaggcagagacagttgaaggagtgattcagcttatgggccaaccaacagaacaacttatggaagactttagcatcgtgacatgcgagtcaagcggaatgggtttggttgggacaggacaaaaacttccaatgcctccaacgactggacgatggaacaggtcggatccaaacacgattttgcgagttctttgctatagagacgatcgtgtggctaatcagtttttgaaaaaatcgtttcaattgggtaaacgaagatgacacaaaagagaaatagtcaaaagaatgtcatctcgctaagacgtgatctgttgtatattttgagattaagatgttacagaaccaaaaaaaattgcttgttcattagataaatgagaaaaatcttgaaaatgtaatgtttttggtttatacattaaacccggtttagagacaaccgagagcgtgtcacccatgatctaacgacatcgtattgtcgattcgatgccatcaatcgtataacttgaccttccgttccctctctccaacctatcgtcgctcgtaagcttctctcagttcttcttccgcctatattcaattagggttttgaaatttgtgttaaagttcggatttttggagtagtagcttgtgtttggttctctgaaattgactagaattcatcaatgcttcaagtcctgtgacgaaattttatctcgattctgattgattacatcacaaaagtaaacatttttcgatgattagtgaatg

SEQ ID NO: 18320 - DNA, 3003 bp, Unknown; identical to SEQ ID NO: 18319
  misc_feature (1)..( 3003): 2750-1469P.txt file - cDNA_ID_1816768; gDNA_ID_1621128; Annot_ID_172378

SEQ ID NO: 18321 - DNA, 3003 bp, Unknown
  misc_feature (1)..( 3003): 2750-1469P.txt file - cDNA_ID_1816771; gDNA_ID_1621128; Annot_ID_56397
tggtgataataaccgatggtgatgatctctgaaacaaccgtaattgatcggagcgaaatcacatcatcatcgtttcgtgattgaatgagaagttacaaacgttgcactgtaagcaccttacacattttaactaattaagctttttcactattgtaatgtgttcataacattataacaacagaacagaaaagaacttagaaaaaattgtcaaaatagccaaatcatttgaatgtcagatacatattgtcagaaaataaaaatatcttgctaccaaaattctcaaatttgtatctagacatatccatcaaatacaagcaattgattgatctgatcattagacaatggcattggcagcactagcaatccttggccaaagatcagcacactctttcccaataggaccagtaattgcagaacctttcatttctcccttggggttgacaatgactccagcattatctgtgcaacaaaaaaacacagaatcaatacttgctttcatacacaatcactaacaatgatcaatttaaggattatatagagtccatatggagcagatgcaagcgttcaagcaataaagcatctgtaacgaaggacacaattaaattttccagacttgtacgagcatcaacaccctctaaacgtgtcggtggatacttgacttaagcctggtgatatcaatcacataaactgacaaaaatcatagaatcagtaatactaaaacaatgggaatgtagagttcaaatggagcagatgcaagcgtttgagcataatagtatctgtaacgatagaacacatttaggtgtaccagattttgttttgtatttatacaccctctttatgtttcggtggatacatgacacaattctggaaatgtaataatctaaatctggcataactagaccatatactatctattcataagctagatgaccaatagaacaaatcaagctattgataattcggagtccaagtagtgtaacggtattaaacacacactaaatagtgttggtgaacaaattacgaatcctattagggttttaagagagaaagtaagtaatctaaccttcgaagtacatgaaaacaccatcctttcggcgccatggtttgcgttgcctaacgatgacggcaggaagaacctttttcctgagatcaggcttaccctttttgacggtggccatcaccatgtctccgacgcaagcagaaggtaatcgattaagacgacctttgatacctttcacggaaatgatgtagagattcttagcaccggtgttatcggcacagttcaccgtcgccgccaccggaagacccagtgacatcctgaatttgttaccagaggtacctccacgccctaatcgaaaaaaatccaaatcaacaacgattaaaacgaggttcgaaaagctgaataaacacatattgatgaactgaaaatgtaacagatctaacaactgagatagaggaaaagtgcgaacctcgcttcgacattgttgacggcttgaaggaagaagaaacgatttcggtttaatatatagtgacgcattcttcttgtagggtttcagtaggcttaaaaaatggaagaagaaacgatttcgttttttagcccaagttcaaagtatattaggcccataaaagcccaagcagagttttaaattaaatcagacgcgtcttatcactatttggagagtcccacatcggaaaggtgagagagtttgccaagggaaactttagtatatatagacttcactctccatattctcgaaccacgcagccatgtggtgagcacatagcgaactattctttcgccttttactaaagaataccgtgtgctctccacgctaagtggcatacgcctatttttggagggttcccactttactgtgggtcccaacatctctcagtttaatttttggtctcgaagtatctgagaatcctttgtggcaactctaactgttagacaattaaatctataacccggttattaaaccgtatatacccagttaaaatgcaaacagttatttaaaatatcctctattagagtctttgtgttttttgcctgttgatggatatatgaacgagtttgctatctagaatcgatagaataagctttgaggttatataagatatttggattggtttctggtgaatccattatttgtacaagtttcatggtcgtaagttgtaataactgtatttcttcataatcttctgttatagttgttttcatagaactcaatttgattagcaatatttgtcgaatcctaaaatctgaaattgcttgaggattatgagattccatatttctcaaagttaaaagataactgaaagaatcaatgatcaggtcctgaccagtgccacttgattgatatatagttgaccttaattgaaagtttgaaacaaatcccatcataagatcataaaaaatatagttatccagttaacaattaaaggacaccgtttaagtaactgctgcagacagaattgagattaagtattgacccgaatcttatcttcttttctccggatacatcaactacaacaacaaccaggtgcaaaagtatgttgagtaacaagtttcccaacaatgttttatgctggattctgttgtcaacaaaagtgaggttggattttgtttttctctctcaaaagattgtgtatatggaagagaatacatatggaatttacgaaaaacaagagattcggcttggcaaaagttacttggaataggagatttgctaattatggttaagttttcatgaggcttcctcattttactcacatcctctctccttccttagcacagagaaatttgttgtcgcctagctttttccaagttgtctctcgtcttcctccacctcctcatttttctctgtttttttgttcgttgtctctcatttttcccttattaaaaacacataactccttctctctcctcacttctcggacatctgatttcttaaacccgtatccgtctggtttctatttccttcttgcctcccctccgtgatg

SEQ ID NO: 18322 - DNA, 3003 bp, Unknown; identical to SEQ ID NO: 18321
  misc_feature (1)..( 3003): 2750-1469P.txt file - cDNA_ID_1816771; gDNA_ID_1621128; Annot_ID_172377

SEQ ID NO: 18323 - DNA, 3000 bp, Unknown
  misc_feature (1)..( 3000): 2750-1469P.txt file - cDNA_ID_1816775; gDNA_ID_1621128; Annot_ID_56396
attcagttttgtgtgatcaagtccatttacaaggcaaaaagaaataccttttttcagtccatccttgcatagaggccaatgtcgaggtcaagagcttcacgtaaagagcctcgcgatcagacttcttggcgtcattggcaacttcagccaacatggcgtgagaggcaccaagcaagtctggctccatctgtgatgtcacaatgtactgatgaaacagaacccaagtgaaacacaagttatgtatagctcgtgtgatccccaacattatccatgtcttcttcatcagttctaaaagctcatcgatttcatcaagaaccaaggtctcatcacgtatgtcaaatatcgactgcaaaagcgccacatagagatggatgttaagtgggtatccatcagcccaatggcatatatcggttgttggagtagcgttgcgccatgacaaggaggcgacaaggttacataatgtcggcattatgtctgagtttttgctagtgtcgatggcttttgtctcactctggcggatgatttctcggagacgcattgcaaagttgttggtcttctctagagggattgatgggtgaatgagaagaccagcttcaaggactttgagttgccgtctttgccaaatttgatactcatgtacatcaccaaactccgatggtttcacgtgacggagaagctctaacggaaggattattgtctctgctcgcctaccggtctaaaaaataacagttataaacattttattaattaatcaagaaacagagtttcattcacaatttaaaaacagagcaacttacttggccaacaagcgtcctcattagggttttccgtagccgagtgtcactctgttctgtcaccttcatttgctgcctcatgatttctgcagaggttaacggtcgtcgaggccgagcaggcgggactgtaaaaaacccagccccagggctaaagtgtcctgaaccacttcctatgcttccattattacctggggatgaaggagctgagacggcccctacaactgtccctactgtcgacattcgcctagaaggagatcgtttaagcatctttaaccctagcgcccgttttactcggcttgttggtgttgtcaacacttcttttcttcctaaagacccgaatccagagccgttagatgatccagatcctcctcctcctcctattccatccccttgatggtcaccagcattgtgcttggagtagaatgtgagagcatttctacctccaaatccaggtgatgatcgacatgcggcgaaaaagatctcatacgcggtttcacggatttcatcccgatcaagaccatcaagcttcccgaatggccaaagaagatcggtatcaggacaaacctcaaagccaaccatgtcgaaaaaggactccctccgagaatgacgaaccatcacggaggggaggcaagaaggaaatagaaaccagacggatacgggtttaagaaatcagatgtccgagaagtgaggagagagaaggagttatgtgtttttaataagggaaaaatgagagacaacgaacaaaaaaacagagaaaaatgaggaggtggaggaagacgagagacaacttggaaaaagctaggcgacaacaaatttctctgtgctaaggaaggagagaggatgtgagtaaaatgaggaagcctcatgaaaacttaaccataattagcaaatctcctattccaagtaacttttgccaagccgaatctcttgtttttcgtaaattccatatgtattctcttccatatacacaatcttttgagagagaaaaacaaaatccaacctcacttttgttgacaacagaatccagcataaaacattgttgggaaacttgttactcaacatacttttgcacctggttgttgttgtagttgatgtatccggagaaaagaagataagattcgggtcaatacttaatctcaattctgtctgcagcagttacttaaacggtgtcctttaattgttaactggataactatattttttatgatcttatgatgggatttgtttcaaactttcaattaaggtcaactatatatcaatcaagtggcactggtcaggacctgatcattgattctttcagttatcttttaactttgagaaatatggaatctcataatcctcaagcaatttcagattttaggattcgacaaatattgctaatcaaattgagttctatgaaaacaactataacagaagattatgaagaaatacagttattacaacttacgaccatgaaacttgtacaaataatggattcaccagaaaccaatccaaatatcttatataacctcaaagcttattctatcgattctagatagcaaactcgttcatatatccatcaacaggcaaaaaacacaaagactctaatagaggatattttaaataactgtttgcattttaactgggtatatacggtttaataaccgggttatagatttaattgtctaacagttagagttgccacaaaggattctcagatacttcgagaccaaaaattaaactgagagatgttgggacccacagtaaagtgggaaccctccaaaaataggcgtatgccacttagcgtggagagcacacggtattctttagtaaaaggcgaaagaatagttcgctatgtgctcaccacatggctgcgtggttcgagaatatggagagtgaagtctatatatactaaagtttcccttggcaaactctctcacctttccgatgtgggactctccaaatagtgataagacgcgtctgatttaatttaaaactctgcttgggcttttatgggcctaatatactttgaacttgggctaaaaaacgaaatcgtttcttcttccattttttaagcctactgaaaccctacaagaagaatgcgtcactatatattaaaccgaaatcgtttcttcttccttcaagccgtcaacaatgtcgaagcgaggttcgcacttttcctctatctcagttgttagatctgttacattttcagttcatcaatatg

SEQ ID NO: 18324 - DNA, 3000 bp, Unknown; identical to SEQ ID NO: 7110
  misc_feature (1)..( 3000): 2750-1469P.txt file - cDNA_ID_1816786; gDNA_ID_1621128; Annot_ID_56393

SEQ ID NO: 18325 - DNA, 3000 bp, Unknown; identical to SEQ ID NO: 7109
  misc_feature (1)..( 3000): 2750-1469P.txt file - cDNA_ID_1816790; gDNA_ID_1621128; Annot_ID_56392

SEQ ID NO: 18326 - DNA, 3000 bp, Unknown; identical to SEQ ID NO: 7138
  misc_feature (1)..( 3000): 2750-1469P.txt file - cDNA_ID_1816790; gDNA_ID_1621128; Annot_ID_172371

SEQ ID NO: 18327 - DNA, 3000 bp, Unknown; identical to SEQ ID NO: 5042
  misc_feature (1)..( 3000): 2750-1469P.txt file - cDNA_ID_1816798; gDNA_ID_1621129; Annot_ID_56437

SEQ ID NO: 18328 - DNA, 3003 bp, Unknown
  misc_feature (1)..( 3003): 2750-1469P.txt file - cDNA_ID_1816806; gDNA_ID_1621129; Annot_ID_56434
gtgtttggcttggtatttgttaaatcatcaatagacaataatagtttgataagacttacaacaactgaatatttataactcgcaattagccctgttaacattccaggcagtgcctgcgtttaagcaacaatacagaggcttcttttaggtcatatgtcaacacctaaaacaaatagataacatgtgagagaaatgtgttaggtatattacactatgattagttcttttgttaaaggaccacgcaccactatcattatccacgttacacacggtttgaacttaaagaagatcgcatgttccactatcttttttgttgttgtttgtcctcctcaattgaacaatttgcatacgtaagcgacatttggttcatatacagtgttcatgaactgagcaacatatatactgtttttttttcatctaagaaaagctacctttttgaaatttgtatttatgcaaacgaaagataatggaaagtgagctggcatggaccgaaagtggtacaaaaaaagtttgaacaaagccattactataccaaacaaacgcaaatgacaaaaactacgcagcattaacaactatattacaattgtcattatttatgtataacattataatacactatcaaggcttctagattgttacatcatctccttaattcttccaagttacatcatcatatatagttgaaattaatttctattattcgtgagaatataagttgattggaagaaggaagattcagtctatatatatatttgaaatactatatgtggaagaacgtagaattccctattgcgaactagaaatgtgttgacgtaccgtgtataaccaaatgtaatatattaatcaaaggacatattaacgtacacattttttactgcatagtcagcaataattgacatttaatcatacatgtattagaaaatggtatgccacgtaagacgcattaccttgcatgaatggcatgtgtagtaagtcgtcatccgcatattgtccaaacaaacaaacaaataaacacatacgggcaagaattaaaaaaaaatcatcttttgttggtcttatatagttgcttatctgaatagtctcacactctctcacttgagagcaagagtgcatgtaattatactatagtattagtacatacgaacaatttggtggtgagtataagtttggatctttggactatatataaagtcattaatttcatactcttacgctattcttttatatcttttaatcaagttgacacatttgtctcattgttttggtgcagagatgatagattggttttctttcttttatatatatgtattgaaacgataacgtgtatgtctccactttctacaaatgaattttaaaaagctcaatgtgtatacataggaattgataaaccagtgattatatagtattttgtaatatactgacacctatacagttttattttagtaatatttgtagccttgtagacaatacataatactcatcacgtcacgtgtagaatattccatggaccgtataaggttcctcctccattgtatcccacaattaattagacacagcttagattagcaaaatggtaatttctttcgtttgagttatgattggcgatttcgtataaaacgaatcgagagaataaaaacgtaaaagaatcggaatatgattcattgcttaccatggttaagtttaatgataagtgcttttattgataacatatatggtcaaataatacaataatttgatcataaagagtaaagacaattgaaaaatgaaatcaccaaaaaagtcagatcacatacagacacattgacgcatcgacgtcaagcatcgtgagcgcacaaagagcttacggctttattattaacacacacactaagcaaaacagtaagtccacgagaaagcatccaaaaagcccaaaggaaccacctttattttttattttattttaggcaaaggaagctcctttattaaattcccaatcttcttccactactttgcacaatctttaatcgatccaaccaataaattttgcattttttttcgttggcgaatgaaggattagagagaaacagaagaaattgttaatttttttcttgttgattttaattaaagagaagagagatctctcttctcgattgctctcaagaacccaagtgacgtctggtttcagctgatttgtttcttctcattctctatcttcttctctgggaaatatcgattttgatctattaagagctggtgagagccaaagtttcctttttgtttgtttgtttgtttgtttgttgtttgtatttttgtatctctgtgatcgcttctacgtgttgggtcatgcagagaaactcattttgttttgatttgcaatgtgtcaattccactttgaaatataagattcatcgcctctctctcctttgttttttttcttcttctgcagctacgagctttgggatgtggtgagatgcttgttctatctcgaacaatccgccggttgttgattttaaacaaactctctatcacaaatctttcccgatcatggattttattgagatctcgttgatctttcgagagcatttgccactactggaactatgttcggtcatcatcaacctcctactctttcttgtctttctatttgctgtctccgcgaggcagattctcgtctgcgtgagaagaggcagagataggctctctaaggacgatacggtttcagcttctaatcttagcttggaaagagaggttaaccatgttagtgttgggtttgggtttaatctgtctttgctctgttgcttatatgtgttaggcgtccaagttttggtgttagtatatgatggggttaaggttagaagagaagtcagtgactggtttgttctttgctttccagcttctcagagtttagcttggtttgtccttagcttcttagttcttcatttgaaatacaagtcttcagagaagctacccttcttggtgaggatatggtggttcctggcgttttcgatttgcctctgtactatg

SEQ ID NO: 18329 - DNA, 3000 bp, Unknown; identical to SEQ ID NO: 7147
  misc_feature (1)..( 3000): 2750-1469P.txt file - cDNA_ID_1816810; gDNA_ID_1621129; Annot_ID_56433

SEQ ID NO: 18330 - DNA, 3000 bp, Unknown; identical to SEQ ID NO: 7157
  misc_feature (1)..( 3000): 2750-1469P.txt file - cDNA_ID_1816818; gDNA_ID_1621129; Annot_ID_56430

SEQ ID NO: 18331 - DNA, 3003 bp, Unknown
  misc_feature (1)..( 3003): 2750-1469P.txt file - cDNA_ID_1816826; gDNA_ID_1621129; Annot_ID_56427
agaggagcaagacggcgccctcatcagctaaaaacctacattgccagattgcgttattacacagtagcatagaaagcattgaattaagaatttgatacaggatgcatctctatcaatacaaaaataaattattgtagagaaaaagctcaagaaaatataacttacatgccgagagtatcaaatagtgaagcaaatggtatccgaacatgtggaccagcagggtgggcatttccctccacatctgagcggtcaactgcaatcagagtaatagtttagataaacacatcgaattcttcttattcagaataatgaagaaaaaaaaatctcacattcaacatctctagcatttgctagagccttgctaaaagtattgtcagaggaaaatacatggactttagaaactgattctgaggtcgcactgtcatcacttttatccgtcatagactcatcactcatgatagacttgtgatagttaattaggataagtaaaacatgcaggctgcactccgctagtggatttttagatccgccactgttacttacaagatagttcaaaggcaagagcactaaacttgctgtatatgcaacagaaaagttttcatgagtacatggactgtttcatgtagctagttaggaaaacataattgaacggaaagtcggaaaggcaatagaaaaagatcaacatttacaagttagtacaataatacatcatatatgaagtaatatacgaacacctaccagctgcagaaccaactctctctaaaatgccttgtgaatctccatcagaatacatataggattttgcatttggaggagtacggtgtcgggaaatataattaagtagcaaccttctgactactagagaaactagagacttttcctgaaaatcgttgaaccaaaggaaatggcggaaattgatatgaggtaatatctatgctaaagacaaagaaaaaagtaattaatttggttacctgagtcattgctgcatcaataaaagggttcgcatctgttggtccatgtgaaggtccagagagaagctgtgtcgacattgtaacaagcatgaagttgagaagttcctgatgtagaacatacgagttgggacttgccaaataaatgatgaaaatcaggagaatgaaacatctaatactgaaacatataaggaataggtgatatagagaatcagcattggcatacctcacttcatttgatccaatgaagctcagaacactatgcatgacaaaattttggatgtcttgatctgccatcaaaacactcttaattagccagcttagaaataccttaacgctggaaataactattatgagagtcattacccattacaaatccatgtggaactggttcactttcgtccagagaaagatgcaactcctgaagactgtcactttttccattctcaatcaaatactttaaaaagacggatgaaatatatgttgcattaacagctttcttatagagagaagactgatcatctgaagcttgaagaagctcttgcaaacaccaggacagatgaatcaatagttttgcaaggtgcctagtgtagccattactttgtgctgaaacaaaaaaagaaaataagatcatcctcctactttcactaggtcatcatcaacattcaatttcattagctcaaagtgaattcgacaacacatcctttacaatttcaacactaaccgaaaagttcacaggcttgttgaacccgatcactaggccagcgagaactcaacggaagctcaagtagcttgttccagaaatcagacgctaaaggaaacgatttctccccaacaaaagtggcaatgaggtactcggccaccgaaacatcatcaccaccggtttttcgcggcgttgaaggcacacctcccatgtctcctaagccaagctcgccgagtcaacaaggatccaaaagagaacgagtcaattgatcgcgtccaccgagtcggttacgatgaagaacaacggcattacaaagcaagagatgaacaatgcaaagatcttgctctcaatttggtctctctcgatctaaatctgagattaattgaagattcaaactgttaaaccaaatgcttcgataccaagggtttagacttttgagcaaaaaaaaaaaagagaggacgcgttattttatttgtttatttatattataatctttttcttttaatgttggaaaactattattcctgcgtaagtttatttccaaattgattttttgatacaaataatttagcgactaaatgtgacaatttttgattattcattccatcagcacttgtaattaatgaagttaaataagtgttttcctaattttgaaaaatacaggctacgtgctaccaaattaattcccaccaaactctcataaatatgattcgaatactttatgggttcttacgttttctcttttacaagagcttatataatattttctgtatagattaacctcaaaccaaatcttgactttttttttgaagttaacagatgacttgttctattctactagagaaatgaaattattatttactagtctacgtggaataaaaacagagataatggatttgggataattcaaacgaaatggagtcaaattgatgctagctactaccgtctttgaaccgtcggttgtcggtggagtgggatgtggccgaatcttttttactgtatttacaaatttgaggcccatttattttcttgggcttttcatttcttcaatgattctagaactgaaattgctcaaggtattagttcaaacttaatcgttattgggcttttccatatgttcaatattcttagttatgtttaattaaaaatatatgcacaagtgagagaactcaaatgatgaacaaaaagtaataatatttagagaaaaaactaaaagaggaacagagcagaagtggaagtctcttgtccctctgtaaaccctaaaatagaaaagcaaatcacacttgggggattcatgttctttggctttcttacaaacctctagaaataatg

SEQ ID NO: 18332 - DNA, 3000 bp, Unknown; identical to SEQ ID NO: 7144
  misc_feature (1)..( 3000): 2750-1469P.txt file - cDNA_ID_1816834; gDNA_ID_1621129; Annot_ID_56425

SEQ ID NO: 18333 - DNA, 3003 bp, Unknown
  misc_feature (1)..( 3003): 2750-1469P.txt file - cDNA_ID_1816846; gDNA_ID_1621130; Annot_ID_56467
ctgcggttcgtttaacggtaaaaacttaacgatcattgtaactgctggcgttattggagctgttggttcattgtgtgttggatttgggatgttttggtggttctttattagagataggaggaagatgaataactacggttatggcgccggaaaatgtaaggatgatagtgattggattggtttgttgagatcacataagcttgtgcaagttactctgtttcagaaacctattgtgaagatcaaattggttgatttgattgaagctacgaacggttttgattccgggaatatcgttgtttcgtcgagaagtggtgtctcgtacaaagctgatttgcctgatgggtctacattggaggttaagaggcttagtagttgttgtgagcttagtgagaaacagtttaggtctgagattaacaagttaggtcagatcaggcatccgaatttggttccgcttctcgggttttgcgttgtggaagacgagatattgttggtgtataagcatatggctaatgggacgttgtattctcagctgcagcaatgggatattgattggccaactcgggttagagtcgctgttggagcggctagagggctagcttggttgcaccatggatgtcaaccgttgtatatgcatcaatatatcagctcaaatgtgattcttcttgacgaagatttcgatgctcgtgttattgattacggtttggggaagttagtgagttctcaagactctaaagatagctcgtttagtaacggcaagtttggttacgttgcgcctgagtattcgagcactatggttgcgtctttgagtggagatgtgtatgggtttgggattgtgcttcttgagattgttacaggacaaaagcctgttttgattaacaacggtgaagaagggtttaaggagagtttagtggagtgggtgagtaagcatttgagtaatggtagaagcaaagatgctattgatagaaggatttttggtaaaggatatgatgatgagataatgcaagttttgagaattgcgtgtagttgcgttgtatcgaggcctaaagaaagaccgttgatgatccaagtttatgaatctttgaagaatttgggagatcaacatggtttcttctctgagtatagcgatgagtttccactcatctttaacaaacaagaacacttaaaatgaatgaaaaggttttattactttcgtactccaatttgataccacttacttatctaccgttctcacttttaaccgcatttttttgtttttttctgttttgtttttgtgtgctgtataattctgtacatcatgtgatgcatccaatgaaaatgagaagaattgttttatatagatcaaactttgaagattctgattcaaaaagtctatcaagtgttagtgtttctatgagattctagttgtagttgttatcgaacgatttgaaattcgatttcaagcgaaaagacattatccaacgatgtttctgtttcttctaatgattctatggataattataatcttttctgataggagaaaaaattaatgtttcccaagtcgctaatgaaaaatttgataaaattttataagataataggataatattttttgaaaatctttgtgtaaatatatagtcccttaatatttaaattgataatcatataaattacatatatataaattgatatattaatgtactttatgcttttagtgtgtgtttttaattaaaattaaattttttgttacagcttatctctaatttttattgtataaaaaaattattatgttgtgtttttaaaatattgaatcgtaatatactttataaatatgatagcattagtttgaaaaacttggtttggagtgaaacattctctatagtttttaaattttgaatatatctcatttttgcgtgttctaaaaaatagaatatatatcattttcattttaatagttttatttttaagaaaaaaaatacgacaaatgaagtcaaaagagtatgtagaactgaattcatctaaagagtttgtatttttttttttaatttacatctatcgtttgtataagtgaattcatctaaaagatttgtaatttattatcaaaagatggttttcctaaatattaaaattttacaatatatcaaaactataaaaaaatgataacatgcacaacactaattttgtttagataaaaatttcttaattcatcttttaataaaaatttaacaattaattcttttaaaaattattaaataatagtagataaactaataatactataaattaataaaatatcacatgatctcaacatttttattttatagaggttttactgtatatggaaataagaaaggtaaaatattagtagaaaatttggaaagaatgaaacaaagtagaaaaactggaaactagatatatgtatattaaaattttggcatgcatgatattacattatacatttttataatcacattttttcaattctctgtatagtaaattttccgtaaatctcagtaattaacttttatttctatgtatctagttatatatacacgctctttgtttattttctctgtcaacagtaaaaacaacacacaagataagaagctaagttaagatctttgaataagaagaaagaagtatgtcgaaaattttgctcctcataggacttgctctccttgtaatccttgcaattgctgttatgggatacttaataatgaagcgtggtcaagaatagaagccggatgtttaatttaacggttatgtagtttttttttttttcttctttctccttagagtgttggggtgaaactataaaactttttgattttctatttgtgttgctccatattgttatcagtggatagaagtaggaatgatttctagctatttcatgtgtgtttgtgtcataatcacctaagaattatgattttttctaaatcttatggatgtcatctgacccccttaccctccatgtaaatcttaatgactaactttgaaaacaaaattttatacaataagataatg

SEQ ID NO: 18334 - DNA, 3003 bp, Unknown
  misc_feature (1)..( 3003): 2750-1469P.txt file - cDNA_ID_1816870; gDNA_ID_1621130; Annot_ID_56459
atgctgcttccttgtaacggtgctgatgcaaagaagataacttgtttcatccatacgcttgttagtctgggagtctcttaccattttgaggaaaagattgttgagttcctgaaggacgctttcgagaatatcgaggacatgatcatcgattgcaaggaagatgatctctacacggtttctattatattccgggttttcagattatatggtcattacataactccaggtgaggatctttcatctttattacggaactaactgacttggttggtttatgctccgttccgttgtttttaagtggatgtgtgatgtgaacattttgaacatgtttcagagttgcatataactatttcatactacttttttttcttaatatttcatacttgcatgtgtgtagatatattcaacaggtttaaaggagacgatggaaattttaagaaatgtctgaatgatgatgtaagaggtatgctaagcttctatgaagcgtcacactttgggacaacgacagaagatatccttgaagaagcaatgagtttcacacaaaaacacttggagttatttttggtaggcgagaaagccaaacattatccacacatcaccaagctcatacaagctgctctttatatacctcagaatttcaatttggaaatattggtggcaagggaatatattgacttctacgaactagagactgatcacaatgaaatgttactaaagttggccaaactcaactttaggttcctccagctgcaatacattcaagatctgaaaacactaaccacgtatgtatattcatttatatagatgcttcatatatatgtatattttctgaaagttttatcgattaggtgtatgtatgcagatggtggaaggagctagatttagtatctaagataccagtttacttcagagagagattggcagagccttatttctgggcgactgggatttattacgagccacaatattcagctgcacgaatcatgctggccaaatccatcattttagtggacattgtggacaacacttttgatgtatatggtactattgatgaagttaagagcctcgttcaagccattgaaaggtacgaactatatacgatcatttgttaggtgctttgtaatcacactcatggtataaacgaaaaacgaaaaaagttacaaagtggaatgaatttaaaggattaaaaagtcatatttaaaggatataaaagctcaacatctaggtctctttatattgttggaatgttggtgttctatttaattataaatcattagatgtgatccctaataattgtatggatccaatattaagtaaaggtgggactccgacgccgtagatgtcctaccggactatctcaaagtcgtcttcagaacaacgtttgacttgtttaaagaactcgaagaatatgtgagctctgaagcaagatcttttactatgcaatacgcgtatgagcaggtactgtttcttcatctatttcttaaatctaagccaaattattgcatctataaaaatagttactatacaactaatgttttaaaatgtctccaaacaacaccattctcttatatgagtaaaacaataaggagagcatttggatgttggaaatgttcattttctacgtggtatttttttcctagatcatttagctccacaaattcagccaaaaaataaaatatatatctctatattaaacgaagaattgaaggttatatatagttcgtatttaatataatgttttgcagctaaggatactcatgaaaggatacctgcaagaagccgaatggtcaaatagagggcacctgccaagccatgaagaatacatagaggtcggggtagcttcgaccgcaggtgaagtgctgctagcaatgaccttcatccctatgggagatgctgcaggagtcggagtttatgaatggctgaggtcaagaccaaaactgacccatgctctttttgtgaaatctcgtctcagagatgatattgctacctataaggtaacagaagtcctatatatatatatatatatatatatatatatatatatatatgtatattttaaatgcaaattataaaaataaaatgctaataaatcttatcgtatagtatttcacgtcataaactactttttagttatttgattgataattttgacatgatcgaaatatatgatgaatttgcatcaggaggagatgaagagaggagatgtttgtaatgggatcaactgttatacgaagcaacacaaagtaagtgaggaagaagcgtgtattgagtttgagaaaaagactaatcacatgtctaaggtcatgaacgaagagttcttgaaggcagccaaatttataccgcttcatattctaaggcctgttttgaattacggacgcttagcagatgtgtgctataagtatggagatgggtacaccttcgctggagagaagatcaaagattatatcacctctttgtatgtcgatctcatcactctttaagagtcttcagagtttgggatcacgtgaatggccaagccaaatttgtatccgcagccgcaacccaaaaataagttgtttcagtttaagttgtctttgttttcttggttgttagtctgtcttgaaaaccatcttttaatcagtaataaagcttgtcattagactatcaaaactaacaataatccgaataacaatctatgaatacgtagttaacacttatagtagtgggatttggctttctctgcagatgtgcaattatctatttttttattagcaccgataagaaaaaaaaaatattaattttttctttgttattcgcttagttaataatattaaaacgggcattcttcgaaatatattgtgtacgtaagtgacatcaagcgggtcaataggaacttttcgtagaaaataatccgtttttacatcagacaaaaaaatattcatttatctgagaaaataataattaattgggtgtaatatccaaaagccaaaaaaaaatcaaatcttgaaatgccctgaaaacatg

SEQ ID NO: 18335 - DNA, 3000 bp, Unknown; identical to SEQ ID NO: 7178
  misc_feature (1)..( 3000): 2750-1469P.txt file - cDNA_ID_1816878; gDNA_ID_1621130; Annot_ID_56456

SEQ ID NO: 18336 - DNA, 3000 bp, Unknown; identical to SEQ ID NO: 7168
  misc_feature (1)..( 3000): 2750-1469P.txt file - cDNA_ID_1816898; gDNA_ID_1621130; Annot_ID_56451

SEQ ID NO: 18337 - DNA, 3003 bp, Unknown
  misc_feature (1)..( 3003): 2750-1469P.txt file - cDNA_ID_1816909; gDNA_ID_1621130; Annot_ID_56447
gaatagtgacatttttcacatacactgtgcacacagtaactaaagatcattgctttctcatttccactttggtcttggttgaagtaattttatttagtttctgaaggttgaattgtttggaaaaaaaaaaaatgatctccaaaacatgttattttgcatggattgaaaaaagcatataaccatagcaaaatagctgttaatataaaaatgtatggttttgagtttcttttgactataatttatagctcagttttcacaatctccataatattgatcacaatctccacaatcaaactttttattattagagtgtatagttaagcaaaatcccaaaaataaaaaacctagctaggaaaatattcctctaaattaatattacacactagttctaaacaatctgatacgagttgccatcgagatttgcacacgaaaaatgttcaaagggacccttttttcatctttaatctttttggactttggtcggcgttggctgattatgactcgctataccacgatttctgtcccttgttacaaataattctattagctagtctcgattctcttttttctttcttcttttgtttaagtaacctccttatctttcttgtttagtggaatacaggctccgatcaaattcagtcacatgtcatcatttctctaagatatatgtttccacgtcaacaattaatttcagttagtttgtttttatgtgtttatataatacgtaataaatacataaactataatttaaacaagatgaggatttaaaccagcccctagtaataatctaacattaaaacaaaaagtaataacataacaacgatacaaaaaaaaaaaaaatataattacaaattttggtattaaaattattttttctatacattaaatatggaaaaaatatttctcataaaaatatatgtaaatatgtaaaaattcaatcatccttatatattatgttaatttcctttagagtttaaggaaatagttttcgatggttcatgtatttctcattttatatcatattatcacttcgtcaaaactatataaaaagttaaatggtacgaaaataattcgtacttaaaacacataataatgggacatacaccacatatcaccaaaaatattaataataatgggacatgcatagaaggaaaaaaaacataaaaactgaggactgttttgatgaaaacaagaagaagcctaaaatggaattcgtaggatattacattgaaaaatatgactgtaataaatttaagaggatatcacttcaaacacttagttaaaaaccgactatagtacatcctattctttgactttatctagttatatttagtatttacatttgtataccgtctatatatgcccaaaacatgtgaaactatttttaatatagaagtgaagatgtgtccccaataattaatgaatcacatatacgtttttcaacctaaatgtgaattatttcgttaattttgggaaatcaagtttttttctgtttccaaagcatatcttataaactcactttttgttttgataatatataggcacctatttgcgaacaaatttttattatgtacacagtacactcaaaagctttatgtagttattatcattgttatagtgcctaagttgctgcttatctaactatccactaagttttttagtttggtctatatcttagctattaactttagtcgagatcatttaactactatggcggcttgacagactgaggctattctttaatgaaaaactctataatgtaaaattctttttcttagtcatatagaattatagatatctatcgtggtttcaaactttcaatctatatagtatataagtgtataagtgacattatctaaacatgtttatatcctcaaagttgtaaagttactaaacttccgaaaagatgatagaaatagcaaccagaaaaactatattgtattgacttttgactgactttagaactcaatagtgtaggccaactcaacctaacattaaatatttatgaagactaattaacaacaatcatagggagcctattaaaatgttaaagtcttgcgcatgtttgactatataatactaacgtatagttgcatttatttcaatgatataaatattttatatctcattgtactacttaagttatagattgattattcgttggtgatatttaagaccaaatcctaagacgacatatatatgtaagtgtaacccaaaaaaatctaaaagtcataaaccgtatgattataagtatatataagatacgtattatactacagaaacacacacatgtgtaacggaccaacatggatgaagaaatggtcccattgagaagaagagatctaatgacttcaaatcaagaatggtccattttccaaaatagacacgtaaatatatacaaagcttaatccccatccctctattgggtctacacacagcctagcatttttgtattttctgctctgtttttatttttttttaactttacaaattactttttaattcttattatcttcagcttttgttctgtctttttttttattttcctgataaattctcacaacttccattcatgactcgagctgggtcctttgatttgtcacagctaatcaaaacagtattagcacaaaaaagtgtatatcaatatgaccatgaagttcataaaaacatgggacctttgaaagatgttgtctcacatattcatacatatttcaataaaatccattacgtacgattccatataaattattggtcagtcatgctaaatgtaagcaagcaaacatatcatttatggtgttacatcaagttatgacagagtatgattgaggccagaaagtaacttatgggtctaatggatcgtattccaaagtaatgggctttttattaaggccgtaagaggcccatttatgtgatttctttgaagtcgctttgtttgcaagttgcgactactcagtttcttctccggcgaagaagaggataacgaaaagaaaacacatagctatg

SEQ ID NO: 18338 - DNA, 3000 bp, Unknown; identical to SEQ ID NO: 7198
  misc_feature (1)..( 3000): 2750-1469P.txt file - cDNA_ID_1816933; gDNA_ID_1621131; Annot_ID_56481

SEQ ID NO: 18339 - DNA, 3000 bp, Unknown; identical to SEQ ID NO: 7190
  misc_feature (1)..( 3000): 2750-1469P.txt file - cDNA_ID_1816945; gDNA_ID_1621131; Annot_ID_56478

SEQ ID NO: 18340 - DNA, 3000 bp, Unknown; identical to SEQ ID NO: 7190
  misc_feature (1)..( 3000): 2750-1469P.txt file - cDNA_ID_1816945; gDNA_ID_1621131; Annot_ID_172502

SEQ ID NO: 18341 - DNA, 3003 bp, Unknown
  misc_feature (1)..( 3003): 2750-1469P.txt file - cDNA_ID_1816954; gDNA_ID_1621131; Annot_ID_56474
gatcaattacaattttcttgggtagttttataccaataaacaagtctatacatgaccaataaacgccaatccaaagtacattgtccatttttctttgaccatttattcacttgtgtataaacaatcccatcagtaggacaatgtcagttacatagcttttataaaaaaaattaacgaagatcttatttgtattacactctcaatgaagaccattagttcacttggatacacccgtctatactaattatttgtaataggtagaagacagaaggatatgtcaattcccaaaaattactgatttttattcaatagaaattcaacaaatatacatcgattgtataacgtcataaactcacaaaagttactttgattttcatcatgtctcaacctctcgtttctttcttcatcttgactttgaattagaagtgattaatctcaggaaatcaaacaatcagaaacaatactttcaaatttacagatctgatgtggaataagattaagaactttctaattttgtagatcagagataccagagtcattaggagcagagaggcaccaaacaaaacgacgaataaggcataaagctccctccgccaccgctactaccaactacgccatcatgtcttgattagctttttaaaaacaatcatagcaaggagtcaaagcaaatatgtcggagattagaagataaagccctcgtttttgaactttgatttttcgtaaaagatttgattttggttttggaaatagaaaaataaaatcgatggagaagcgctgagaagatatgacaaagagaatgagtttgcagttaaaaagggtaaattggacaatttagtttgacaaagtgctttatcattttaaagtgtctaaatccgtacatagttttttaaaagtgtcctagaatgtaatattctttttatttattttgggtaaggatcatagaagaagaataagagaaattgagaattaaaaacataaatattaaattgagggtaaaaaagtctaagaaaaaaagaattagtagaaaaagtgtctattccctataaagtgcctcaaatggaaaaacattctctaaaagtgcctcatagtggaacattcccttcaataattagagggcaccattttttttttttcttctaaatattaaaaaaaaattagtaacacaaaaatgaaatttagaatggacctataatttttttaatgtattgttttttgtttttaactaaatctttaacaaaattatcatagaatggacctataatttggcctccttagaaaaattgaaagaaacattttaagaaaatgtagtgaagattgacaacatagttggccgagtttccggatctgcttgttaatacgataaagcaatttccaccatttttgtgagcttctctctattttttccctgtgaaactaatacacgttcatcggaaatgcttctcagtgacagagtttcttcgggagacgatgataaactcgaaaccaaatctctcggatgtttcccaattatcacttccaatatcaaaaccccgaagctatacaagataaataaactctgtttatcctcaaaacaaatagttgaaaaattattaataactaaaacatatttcgtatattttgaatacatcgacaaccaaattttctttttgaaatttatactaatattttgtatttattatattttaactttttctaaattttgaattctgttttaatttattaagaaaataacttttgttttaaatctggataaaactgtcattttcaatattaaaaataatgtttttattaaaaatggagaacaatatattttcaaatgaaaacttaaaatagggtagttttttttttcaagtttttttcatgtttttttttctaattcgttctaaaataccgaaaataacaagattgataatttttgtttcataaaagatttagatatttgaaaattagccgccgaacttttctctagtattacctttaatgtgagtggttggtttaattgcatatatagatatttaactttctcgaataacaaaaaaaaaaactcaaaatataagagaagaaaatgcaaaaatttagaaaaacataagcaaaaataaaaaaataaatataaacaaaatttgatctaattattttaataatgagtttttgagcgcactaattgttatttcatatattaacaatagatgttttgtattattgtggagatatagtatattgttggataaataaataacccagaaaaaatgtatgaaaaaaagctataataaacatgtggcaccaccgcaccgaaggtaaaccaaagccagattaatttgtctcgtctcgggttcctataacacaatgatatgataccatcgatcgtatcaagaagccttgaactattgagaccgttttgttaggaaactaggtctgcgaggaagaagaagaaattgaggtatgagggtagaacgaggaacatgacaaacagctataagaagaagtaacggagaagagtgagtcctaaggttaaatataagtgcatcacacaaaatgatgaaatttctaaatatttgtgtgttttgtataagtctttccttcattcttcatgttgtcactctaagtaatcaaaacaattattagtatgttatatgttatggtgccaaaacaaccctacagcagttggtttcggtttagttgatgcggttcagttttgaaaaagacaaaaaaaaaaaaactgaaacgaagaaaccgagaaaacgaaaaagagaataacggagagattgagagagaatcagaaagcgaaacgaaattcagtatccattgcttcaaaattcgacataacttcgaattgttgggtagttgaattgtgccactgaactcccacatccggtgaagtgaaagttactgtttttcccggcgaagccaagagaaagttactgtttttcccggcgaaaccaagagaaagttactgttttttccggcgaaatttgaacctccggcgagatagcatctttagctatg

SEQ ID NO: 18342 - DNA, 3003 bp, Unknown
  misc_feature (1)..( 3003): 2750-1469P.txt file - cDNA_ID_1816958; gDNA_ID_1621131; Annot_ID_56473
accagacatacttgcagcttctcactggaattcctgttcagtagctttcaaggcggcaaatggccagatcttccacatctccttaatcaccaagcccatctacatccaactctttccaggatacatgatcaaagcaaagtatataggtctgaactccctggaaaagatttcatacttggagttgatgtccttcatagccttaagaaagtatcttggaatccaaaaagacttaagcacaagaaccaactgctaccatggactaatgtctcccatctctaccccatggaatatgaaattctatcaaagacgagattatcaaggcttcttgtgctacttcacattcagagttcctcaccaaattttcatcacctttatgaaagaatccggactttttcatatcattacccttcaagaagaatgaggatgtcatccaacaaaagcaagccttccaggaatgaatccaaaccactataatcttgctctcgaagaagtcgaccaactccaaagagaagacctcattgagaagaccacctccccatgggcatgtgaaaccttctatgttaacaaaagagctgaacaagtacgaggaaaactgaggttagttatcaactaccatccgctcaaccatttccttgcagacaacaagtttcctctaccaaagcgagaatttctattccatctaaaaacctctcaaattaattacaaactctaacaatcgagaatgggaaaaatgtcaaaaaaagcacgaactttcaaatttgggaagaaaaaacataaactttcaaaatgccattaaaatcgtaaagttttgtttgacttttgattaaatagtcaagtttcgttgactttgccatttcgggcatctcgttaagtttccgttaacaaaaaaatcacagaattaacactccgttaccattttctgttaaaagtgaaacgacgtcgttttgaaattctaaataaaagaaaaaagtaaacccacaaggattcgaacctatggtcttttgcctttcaaagaatcattaaaccactgagccacgagaacatattaacaaaatgaaaaacacatatatatataagatataaatatacaattaattaaaaataaccaaacaaagatctatattaatgcatttaatttaaattattctttcttaaattatataaaaaaagaaacatatgaaatagagaaaatgaaatatattgcctaaataaatggtttcttatattgtttccatctaattatgaacatcacatttaattatttgaagatggaatgattatattttatgtttatcttatatatatatatatatatatatattacaagttaatttatcgaatagatatgtttttataattaaaaatatttataaaattaaattgaataaaattctatgtgcatgtataaattaatcctatatttatttgagaaggattgtataaattttagcctattttctaatttcataagtttcaatttttttcataaaataaaatgaagaaaaaataaattttcagataaaaattcaatgcatttagaagaaatctctatatgtaaaattaaaaatatgatatttcgaaatgtatatttatggtatgtatatttaatatttgtacatatttggttatttttaattaattgcatacgtatatgttatatagatccgtttgcaatctgtactagaataatatcgtggccccaatggttgagtgcatctgaggaaaacaatacgtatctggatcgacgtcgttattttattttagattttcgtggactcacaatcgttattttattttagattttcaaacgacgtcgtttcgtctgtaacagaacatattaaacggaaaattaacgctgtattttttttgttaacggaaacttaacgacatgtctaaaatggcgaagtcaacgaaactttactattttattaaaagtcaaacaaaactttacgattttagtggcatttttgaagttcatgttttgttcatcccaaatttgaaagtttatgtttttttgacatttttcccgttctatatttcacaagttatttttaattagttttgtgtatatatataaatatttcagtttacaataatatcaaaacgttatcgtagcatatttggttgagcgcttgtaataattctggagagtcatgagtttgattccttcttggcacatattgtgtaatatattttcattttgaaacgacatcgtttcgcttctaacggaaaatgttaacgaaaagttaactccgttgttttgttgttaacgaaaacttaacgacatgtccaaaatagcaaagtcaacgaaacttaattattttatcaaaagtcaaacgaaactttatgattttagtggcatttcgaaagttcacgtttttttatcccaaatttgaaagttcatgatttttttgagaatgctaattaatgatttcaagagttttctttaattgagaatgacgtcgtttagcaaatgaatggatacataacatgtctgattactctcttaaaccagttaacaatatttaaatcatattgaaaacaagaggacaaagccagagcgactctgcttttaagacacggcaaaaaagtcaaccaacgaacccaataacaaggaaagagatttgtttttcatttctaatggaaaaaaaacagcaaaaattgaagtctactcgtcgtagtagtcgtcgtcttccactaattccgtggtttttttatcgaagacttttgaataaagtacatttgcagagtctgtcaataaccctttcttcacggtattgctctcaagccgcgtactggtaggctccaaaattatcccttctttatggtttttggaacctgggttctccgattttgaggtaatccttatgtgggttctttctgatttcgtgttttgttttattaaaaggacttctatgtttttttgggggtttctgaaaagttcggtttttgcaggttgttgaaatctttgagtagatttttgtggaacatctgactctcatg

SEQ ID NO: 18343 - DNA, 3003 bp, Unknown; identical to SEQ ID NO: 18342
  misc_feature (1)..( 3003): 2750-1469P.txt file - cDNA_ID_1816958; gDNA_ID_2214458; Annot_ID_182714

SEQ ID NO: 18344 - DNA, 3003 bp, Unknown; identical to SEQ ID NO: 18342
  misc_feature (1)..( 3003): 2750-1469P.txt file - cDNA_ID_1816958; gDNA_ID_1621131; Annot_ID_172493

SEQ ID NO: 18345 - DNA, 3000 bp, Unknown; identical to SEQ ID NO: 7186
  misc_feature (1)..( 3000): 2750-1469P.txt file - cDNA_ID_1816966; gDNA_ID_1621131; Annot_ID_56471

SEQ ID NO: 18346 - DNA, 3000 bp, Unknown; identical to SEQ ID NO: 7186
  misc_feature (1)..( 3000): 2750-1469P.txt file - cDNA_ID_1816966; gDNA_ID_1621131; Annot_ID_172490

SEQ ID NO: 18347 - DNA, 3003 bp, Unknown
  misc_feature (1)..( 3003): 2750-1469P.txt file - cDNA_ID_1816968; gDNA_ID_1621131; Annot_ID_56470
atccaaaggtgagcaatcaaccctactttagcaaatcccagtttattccttttttatcaattaattattatagccctctttaatcttctttgtggggattcaaaaatagaggaacatacatgttgtggccttgaatgggaactccaagcaatgagagttgcaacatattgcaagccgagtatgttagcaaagctacatatttgatcgaaactaccaaaatttcgaattcggcacaaaaatcttactctacttgaaggtaatctttcacaaaatttgttcatataatcattgttcttggttaaaatgttacacaatcttcttaatatgtcttcttttgtgtctttagtattgctgaaataacaaaattattctcacaagtaaaatacatcgttggaaattagtgtcaaggtatgtgtcttttttatttagacctttgagcatgaacgaactaattttttcacacatacagcttcatcgatttctttacaattatgactctacttcagtattggtaatcctctcactttttttattaatcaatctaagattctgtaacaattttaatttgtttgaaaagccacgaagtgatcaatatgttttgtttaaacacttccgtttcggattcatgtctagttttataaatctatgctcttgatgctagtcccaactaggaagatcgattggttctggagctgataccctggtttggaatgcaccatggatctctctctcatcatccgtaaccccaatgggtcctcctactcaagagacacaactcatgactgttaaggacttaatatgtcctatttccaagtcttggaatagagaaaagattgcaacttacctccctcaataccaatcagagatctttcagttcagaccaagtaggtttgttgctagggataaatttatctggcttcccacgaaatctggtgattatagcaccaaaacaggctactacgcagctaagactttgcggaatcttcatacacaagttccacctcaacctgtgacctcaattggaactcagagatatggaaaaagaaatgctccccgaaaattaagtttctcttattgaaagtattgaagaatgctttacccctaggtgccaacttgaaagctcgaggcatcaaccctacaactgcttgcccacattgtagtgcagaggaatcaggtcttcatctgtttttcctttgtctatttgctgcacagatctgggagcaagccccattcaaaaataccctttcgaccttcacttttaccaatcttcagatgggttttgaagcggctaaacatctgatttgcttaccactggtggaaattggctcaaaccctcttttcccctggattatttggacaatctggacctgcagaaacaagaaaatatttgagtagaaacatctatctagtcgggatgtcatatctcaagcaatttcggctgcaaaagaatggttattggctcagcctttacctcagggacaccagactctgctttcaagaccaattgtgccggaatttgaatcggatgcaatcttgtgtttcacagatgcagcgtggcgagaggattcacatgatgcgggattgggatggatttttgtagataactcaaatcactctgagatccaggatcacgcagtggcgagagaggtatcttcccctttaatggcgaaggcgatcgctctcttctctgccatccaacaggcgtcaaatcgaggattcaaaaaacttgttgtagcttctgactcgcagcagcttgtcgaagcaatcgtgggggagcttcatccaaaggagcttcaagggattctacatgacatcctttttatctctctcagtttcgctgatattagctttcattttgtcaagagagaaaacaatcgtaaggcagatgcagctgctaaagctgctttactcgcaatcaattctgtaccggtttaacatttaatgaaaaccagaattttcgacaaaaaaaaaaatgctcttgatgctctgttttctttacttatattctaaaataaacatttctaattattacatggtaaaaatgtgactacaaaacatcgaaggtacattgaaacatatattcacttgatgtttttcttctaccttgagaggattccaactctaagtacacttcaggacttagacaatcaccacatcaacaaattgtatacaagaattactctttcattgggaaataaaaacaaagcatgatatggtgggaaaaaaaactgtatataaagactttgcggaaaaactgtattgaagaagacttgaactctgcaaaagggagagatattatcgtattgtgcataaggaaccaaccgaattgtgtttataatgctaatttattaagaccattatggtcaaatataaacagtgtcgataacttaatatgtttcaatgctcatattaataaaaacataaaaaaaaaaacaatctcaaataacaattaactgtattgagtaaacaatataatttttaattaaagaaacactagtagtcaataatactctttcttcccacgtgttgaaatatccaaatattagttgttcatatagtaatattttttataaagaaaagacctaaaccaaaatcgaaatcaaaatcgtattgaagcaaaaattctgagtttactaaaaaaaaactccggtttattaaaaattctggtttagatttttttttttttctaattttgtcatgactttgtaagattttttttttttgcttaattgctttgttcctacgagcaataacccagtacccagcagcaaccacaacctcttcttcttcttcaatatctccctcaaataacagattccattaccgctgcataaatatctcttcagtaaagaaacatcattgattcaattcccagaaacatcaacctctcacctgtttccaatttgtcggcaacaacaacaaatttctattctgggttctgtgaatttcgtagggagagaaatagagatagagagagagagagcttctgggtattttttaatg

SEQ ID NO: 18348 - DNA, 3003 bp, Unknown; identical to SEQ ID NO: 18347
  misc_feature (1)..( 3003): 2750-1469P.txt file - cDNA_ID_1816968; gDNA_ID_1621131; Annot_ID_172489

SEQ ID NO: 18349 - DNA, 602 bp, Unknown; identical to SEQ ID NO: 7242
  misc_feature (1)..( 602): 2750-1469P.txt file - cDNA_ID_1816972; gDNA_ID_1621133; Annot_ID_56518

SEQ ID NO: 18350 - DNA, 3003 bp, Unknown
  misc_feature (1)..( 3003): 2750-1469P.txt file - cDNA_ID_1816976; gDNA_ID_1621133; Annot_ID_56517
tcattgaccaaacaaagattcgtcgattgatagttacggtatggttaaaattatcaataaagatcaatctcttaatatatagtttcacatcatgcaatcaaattttctttcaccgtggactcgtgagagagaaaaaaaaagaagaagctgtggttacttatttgtacagtctaaatttttttttcatatattaaatgatccatgcgtacgttaaaatttgtcccaaaaaaaaaatgtcataatcttttttatttattaatataaataattttttatcgcgccttatcgtcggtaaatatatacgttttatttgatttttgttttaagccctaagattttcaggataatataaaccaagatgattagagccaaatgagaaaactgctctggcttaatttttttctttaaaatcactgaactaggttttggttgtgtaattcattgaaattttttcatatctgtccgaattgttatcatggttgtggatctttctttttagtatatagcctaagagtaatctattatagtaattctagttttacgcttaattagaccatctatatatattatttctagttacgtcacctaatcataaaagactctacaacagcaagctagggaaacacagtagcaaagaaagttttttcttactgattttcaaaggtttgaaacacatgtgtttgtttggactcactagtgtcttctggcgtggaatcaattatttatgtctccacctaatcagaatatgacaaatgaatactcgcaacataaacataaaaataacgctctaatgataattctttttttttattgttttatgtcggaaaaagaagagtccaccgagaaaaagagccctcaaacaaatttgaacatggcaattatggagcggcagaatttaattattagtcctatagtcgatatattattgcattacctaatgtgtacacacacaatataaggttggttaatttggtaatcaaactaaagatttagaatgaaaatttccttttaaaaaaatagccatttgttttgttttaagataagagctaagacatataactacttcctaattaactttggaaaaaagtatattgtcgcaagttgcaactcttgtgccataaaaagcaagtgttcaacacatgtttatagtgatgcctcatcaacagctcaattaaattgaaacgtaagtataatacacaatcatctacatatttttgcagacattttagcaaataaatcgtagagttgaacttatttacaactcaatgtcattagcattaaatcttttttccaaaataattcattttactttaaattcttaatttaaattgtcaatcacattatcaatcaaatttaatccaaacaaacttcccatcaatcctttaaaattagcataaacgtatttgttaacaatatttaaaacaaagtttttgtttaaataaatattattcttactaaacgttttttgtttaaataaataaatcctgtatttgaacttatttacaatttcatgctactggcattaattatttaggaatgaaaatatttaattaaagatttaaatcttctaaatccttgcttttagatttattatgtcattacctaaaaggcaaaaactattagttttttaaatattattatttatattttaaatttttttaacattactaatatttaaacttataaaaagtttaatatatcaaaaaatcttaacatcattatataatatatagagtttttaaaaatctcaaatttttttccgtcatattttgtgattcaaaatttaaaaaatgaacatatattaaccaattggcgaaaaatatgtgagttcaacgtcccattttgactaaaatatttagagaatgattcataaacatatcataaataagatcaacattaacaaaataaatggtttttttttttgcgggacgagtttggcaggacgttacttaataacaattgtaaactataaaataaaaatattttatagatagatataatatataaatttttatatatattaacttaaaaaaataaattgtcctgcggtatactgcagattaaaatgtatattaatacttacgacggacgtgtacaaaatattatatagccccaaaaatagcgctgcatataaaaaccacatctacctaagcctaccatgtagtgtagttgcatataagacaactataaattaataatgtagtttaatattttttttggattggtttctttgtttttggttaagtttttttttcttgggggtataatgattttagttaagttttgtttaagtttcctcaatgacaaaggtacaatttcggcgttacgtctagtctaaaataatctattaacaaaagaatgtacttaattagtcaatactctactcaatagtaggatatcgtttcagttttgtatgtggatttttttttaaatttttgaaaaattctattcaatttcaataaaaaatttctgaggatagtcaatgaaaaccaaaaaagccataataataataattataaagtaatatatcaaaacgctcatataatattccacatacatttactgtataatcagaaaactaaatagtatagttatcaagggtccctcttaataaaaccaatattattcaactaagatatactttatttatttggagataatttaattttcgtaagcaccatataaaaaaacaatgacgcaaattattattttgtttatgtgataaataaagaaatataaaacgagagaaaacaaaaagagtgagtgatagtgattacaaaggtaagccaaaatttgaatatttaatggataccaccagataagaagaactttgcttcaaagcggcaaagcttaagcttttttctcgcgcccgcctctctctctctctctctctctctctctctctctctctctctctcttctcctctaaccaaatttcccgatgtgaaaaaacaagtttccgatcaactcaaaccaccgtcaccacttcttctctccgacatg

SEQ ID NO: 18351 - DNA, 3003 bp, Unknown
  misc_feature (1)..( 3003): 2750-1469P.txt file - cDNA_ID_1816980; gDNA_ID_1621133; Annot_ID_56516
tcgccgacccataaaataagtttagcgtaggagttaaaccacggtgggcagaagaaagtgaaaacgttgtccccggcgagggaaacggaggcgaatttctcttggtagtattgaagacagtgagatagaaactgggccacgagagattgttgttcttcgagagagatacgattagtttcatccaaggaagaagcacacataagctgttcaacgaaatacctgtgacggattaaccaaccatcaacgaagatagtgaagctttgagagctgctagtgtttggcatgtttcttatgtttggagtactcactaagtaagtatggactgtgagtgtacgttgtgcaagaatgtttatatactactacattgggcttgaccaagaaaaatcttttaggaattaatttacgatatgtcggtctatcgacgatgtgtcggcgggcgaaatggatttttgtgacttttgtcttgtcggagtgaagtgtaatcagagcagcgtcttatcatcatttgctgttgttattcaactctggttttagaatcaagttgggttaaacaatagtataaaattttaatatggatgaaaataaaatataaattatccttggtaattattgattataacctatagaatcgacaaaaagaaagactataacctagagaatttttttttttttttaaaacaagtgttcattaaaaatctttaaaatatttagtctgttttataattaaaatgtttatatctgaaattgtatctatcactactagttccagttggaattatatatctgtcagggtcgcatctcgatattatggaatgacctaaaataacatctgaagaggaaaccgacacatgttggtaaaataagaaggcacacgtcatgtaaagaagatgacatatgtcaggaaaggaacatgtccttacaaaatagaaaccaaataaaccaacagttcataaatgctccagttatgccgcgagccatcttttcttctttactaagaaaatttctacattattttaagatttttcttttccatgtagttgtctcatacttccttcgaaaagatctttctctaacttcaaccttggggatcgagcaaccatatttcaatcaacagattctttcatcactctaataacggacaaaaaaagaaaagatgtcaaaaaaaaaaaaattggaatatgcacgttgatactataagttcatttaaatcagtcgttagagtaaaccttattgagagttcaaattcatttaaaaacctgatgagataattatataatttcttataagatttttttttcttgtaagaatttaacgaatagaatttttctctctattacttaaaattcctcctcgtcaaaaattgcaaatgcttggcagttttaccattttctcagaactaccgtatgagaaataaagtacgtattaaaaaacaatacaagctttaaagataaaagaggcaacaaatttttttgacaaaaaaattagatgaaaagaagtgacgacaaataactgagaaaacacgttttgcaaaactaaaaaaaaaaaaaaaaagagagagttggaaaatgtttggagctggtgggcattagttggctatgcaacgcacggacgcggatacttttcaactcgttgcttacgcggccacgttttcgtcacaaaccgtgtttcttttgcggccttttaagttttaatcaaacatttttgttttcatttgaatcttttttttaaggcggttatacgaataaaatcattaaaaggagaaacgggccttcatgtttaggtttttgttcttcctcatttgggttatttagcttattggttcagcccacaagagtttccttcaatggatagggccttcagttgcatgccatcatcctttcttgtttctctataagccatttttgcaatgagaatttctcaatttcttatttttgcaataaaatcattttgccttagatgatggtggaatcatccgtttttctttattttgacccggtgagtaattgaacgcaaaaaatagtccaattattcaaaaccttacaatttcatatcgccataataaacctaaacatgattcgagtgagcaactacataaaaaggggaacgaaatgttggtacaaaactgaattccaacccaatcaagtgcatactaaactattgagcaaaaacaaagataaaaatcagttcacctaccctaattaaaacatgattaggcctaaaagactataagtaaagataaaaaagatgccattttagagtacgttttggtaaattggcgccatcgtgttatacgtttaaaccgtataacctgaatcatgcagcacgtgtacggctcacattggcccaagcttgattaacaaacaataacgtcattttcgtatttcaacaattttgatcgctcaatcctttcgacctaatttccatattaagtaatttattagttaaaacaacggactcaaccaaattacatattaagagaatatttgaaaattgtctatgtagatgaacatgtatttgaaaattgcgtaagcacactctttctctctctcttttttttttttttttttccccctcttctttctttgaataaagatgacatttttttctgttccaaacacaaaactgcatattgatagtgttattgaatactcaacgtctcttcttccagcttacgtaagtggaacttactttttgccccgtgatccaacagaaaatgacgaatgctccctcaaaatcatttcgtttcaacaaaaatatgtattttatccatagagaaacaacaaaccttacactatataccctcttttaacgtgcccacttttcattatttacacaatttccccaacaaatttaaaacaatttacaaaaagcactcaactttcctaaagtagattcctttagtccaatggaattcttacaacatcttcttcttcgccacctttttctctccactttaagctttttcactctctctacgccacgacgactgtgaagcgagaaatg

SEQ ID NO: 18352 - DNA, 3000 bp, Unknown; identical to SEQ ID NO: 7228
  misc_feature (1)..( 3000): 2750-1469P.txt file - cDNA_ID_1816988; gDNA_ID_1621133; Annot_ID_56514

SEQ ID NO: 18353 - DNA, 3000 bp, Unknown; identical to SEQ ID NO: 7228
  misc_feature (1)..( 3000): 2750-1469P.txt file - cDNA_ID_1816988; gDNA_ID_1621133; Annot_ID_172571

SEQ ID NO: 18354 - DNA, 3003 bp, Unknown
  misc_feature (1)..( 3003): 2750-1469P.txt file - cDNA_ID_1816996; gDNA_ID_1621133; Annot_ID_56512
tttaggtaaatgaaaacagggccatagactttcttccaaggctcaccgtgttcaaaacgaggcatcatggtttttccagcataatgagtactgtgaaacacctgaaataaccattacggaaattaacacttctaagtattatactgaaacattcaccacatatgtcacagggacacttactgcaagagtggttgggccaacatgtgaagtcaggttttgtttgagtggtccgcctgagcggaactcattactgggcgtaatttgccaaaatcctactggtggatcgaaggatatccatccatgtactctcagatccttattctcacacgaatattggtatttatcatctacctgtcagagaagaaaaatgatttagttatctgtgaaacagtatttaccggattcattatttgaagttgtaatacatcacaaaacgagcataagttcataatatacgcattcatgtatcagtaaatgggagaataaacagctcaacaacgcatgagaaagaacaaaatgttgtaatttctaaacgatggaaaaaatatggaactcatacttcgccttgtaggcgtggatcacaaggagcagtgagcagagaagcttcctggtaatctagagtttggcatcttcctttgcatagatcatctggaaaaggcattatcctttttctgtcatctgccacagccatgtaatggaatctgtaaaaaaagaatcgcaacaggaaaatatatgagtatcaaacaactacacacttttgtgtttacgaacaattaaacccaataaatagatatctgacatattgcacaattcttttgcttggaatctatggtactcttcacatggacaggcaatcactaacatttctaactttcttctcttaaggagattagacattacataagatagagaatggggataatattacttgtcttttctgagcttgaaggcaattctagtttctccaagttcaaagccaggccaatccttaagatgttcataaatgccgtatgagtacactccagaagagccacggagcattataaacctgaaagaaagagcaactagtcaatgtctttctctacttttgtttctcgccaaaggaaatatattatgtaagatagaccttttatcgatattcaagggaatgtacttgccctcaagggatggatcccatgttcttagaaatgagatctcaacctgttcttcggtctcgactatgaccctgaaagtcactccactgatgctgcatatatgatatcaaacaatccaacgattagtacacatcatataccatccaacaattagtaccgattatataacatcatatacacaagagaaaaaaagagaaaagcattaaaagagaggattctgatgcagcagtgacagctgacaacttcagttaagcagaggaaacttgttttgagtatacatcaacttaactccaccaatatcgaaaaatcccactaacagatgttgcaatcaatagcacgatgaagacctatagaataacattcctgagctcctaatcctagtgaatgttaaggtaaatgcatagagtgcatacacatcaaatattcccttgcctccaggttcattccagtgcaggtcccagtacctatacattcatttatattatcgattaacttggcttctcacagaatttgaaggaaaaaaagacttttgttctcctctgaagaaagcagtataactaaaatcatatattaaaacatgattcataccctctgttagtctccttgttacgaacttcgagcacattgtcaataccgttatactctatcccagtgataattccacctggctttgacagtgtaacttggaggatcccattgtccatcacaacctgcaccatttccgtctatagtcaaaacacattcaataaaagacacatgaaagggcacattgtcgactgaggacgttgcattacatatcgatcatggacatgcaggtggacaccatgagaggacatcctgtgatccttcctatgactaagaccacttgtaccttgatctgtcccctctgagcctgatattagtgtaaggaaaaaaatcaacacttttgaatgtagaaaaactaaagagattaatatgagaactcctctttacgcagaatgcagcagcacgagatactcaaagtttcataagtgcttgtgtaaaacaagagttttgaaatggtcatagatataggatctgtagaacaggtcttaaaacaaactgaaaaggcgtttatttccgatagtcaagcaaaatggtttatttccgatattcaatcaattgtaactctgtgatcgtttaaagtcccttcctttctggatttatacgtagacccagtgaagggaaatcatctttcaacaaagaaacaaacccaatttgatgaaacaaggaaagaaaaacagtttacagtgtcataaaaaatgaagtaaacaacaaatttaagcttatttactaatccgggctaaaaatacaaactttgctgtcacaatttcgttgagcagcctaaaaaccattctcaagtgagagaaattcaagaggatgaagaaaccatgagaagagaagggtagacgagaaatcacagtggtggccggcgtttaaagcggtttcatgattagtaaaacgatgaaggagccgatcagccagtttcttcatcagtattcgacccaagtgatcaccaccgaagcccagagagagagagagagagagagagagagagagagagagagagagagactgcgttagcgtttgttaaagcgcttctgtgccttggtttaggcacgactgcgtttgtcaactctcaaggcattgcctttgcattcagttttaattcttatcaaccaaaccgaatgtaatttgattttagtttggttttaactccaaaaagaaatctgaaatctcttttattgaaatcaaatataaaagcaagtctcatggtgatcagctcaaacaatcttttggggtttctcttgtctgggtaagctttaaaatg

SEQ ID NO: 18355 - DNA, 3003 bp, Unknown
  misc_feature (1)..( 3003): 2750-1469P.txt file - cDNA_ID_1817011; gDNA_ID_1621133; Annot_ID_56506
ctccctgttcttgtagcgtttgtcttgtagaaccttcttgatggcaacaacctccccagtttccctacatttagcctaccaaaaggaaacataaatgtgcaggggaatggagccaaatcaatagaacgaacatcatgggtcttatgttaaattagctcacttggaaaaccatgccaaaggaaccagtaccaacaacatgttctgatatgtaactgactgtctgccaatccaaaaaaaatctatatgagaaacagttagataaactacattaccaactaacacatacaattatccataaccatccaacctgtcttgattgaccatttcgaccacggagtgtggttctaatcacatgaccaggctcagcaccagccccatcaataatatctggttcactatcctgcaacgtaacgaaaacctcagacactgtaaccaactccataacatatataagctcaggataaagaagtgaagctaaaaaacagttgaataaacatgaaaaaaagaagaagcaatgcaagacttactctctcatcatcggtctctactttgtcccttatcctcgtctcagccaaatctctggtcaaccaatcgacagaactagaagagctctttaaacctttggcagatctcgaagtgcctactccatttcccagtccagaggatgccatgatatatattcagaagataacacgtactactagtaattgatagcatcataaacccatggtgatttcttggtgtcccatcccatcaaagagccgatcttcctagtagaatttgtaggcccatttgcattaaataaggtgtgttattatatctcaagtatcttgatcattagctaaatcatgaacacatacaaaaaaaagtaaacttgtgtaagcactgatgaactttgaactagtggtgaattgatacactgtaaaacctagcccaatagagacagatcagatctactgccgactagaattgatttgaaatcgacaaggtttggtttgaaaactgaaattctatagccaaaagcagctcagaaaatcagcaaaacagttactagtacccagaagaaccctagttcaacaacaactcagaaaaaaagcacattgagagaataaagagcgaaactttggaaaagattcgcagtgatatgattaggtagaagagtaaaataaaaatgatcatcaccttgagctgtcgtgaagaagaactgaaaccaaagtcaagcatttgacgattgtcttttcttcttctttcttcaattgaagagcttcacataaatatataaaatagaatatttctcggtgaatgatcggattgagaaaaaagctaaacctttagattcttcaagcgttaattttgttttcccaacttcttcacaccttctttgtcgatttctatcgttttgaatcaaacgagaatatgagacgacagctcatcattataagcatcatatattaatctttttcttatatttatgtttctataagatttttatttatgcttagttatatattttttccttcaaaaaattaattagaccttgttaaaatttcatactatactttttaatggatgtccccaaatatcataacaactggaactcaattttcaaacctcagcctacctaatttttgtaaccggatattcaaactttttggtgtacaacttatttcaactatagtggaaaatttacaaaagaaaacaacattttgtgattactagaaatcgcttcaaatgtatgtttttgtcaacacattcgagcctccactccaaaatgcatctatatgggatttatattctaatatgtgccttttgatttttgagatacgataaaacaacaatatattcttggaattttctagtgaattaaaatactgttgtagggcaaaaaataatttcaaaaaaataaagccactttcgtatttgctggttattatatagtaaaagtcgcctttacttgtcgacagttaggtaaggcttaacacatcacacttctttttgtgtgtgtggcgatggagattttgtatcgggttttattagtgatattaaagcttaaggatgtattttttttatctgcaattggttttatcataatataagccttctaaatacgaaaagattgatcaaatacattcccgttttcacaaaagtgaagttaattatttttgctttggtgagctctctcgaaaatacacgttaggcatgcacattgctttggttactactactctctggtctccgcgtgatcttatttactaattagaataagcaaaaaagggctaaatgcaataaagtcgtaagtaggtccaaagtgtactgctcatcagcctacacaaatagggagtggtggtcttataacctaaaaaggctaaagttgctttcttttgcttaataaagtatcgtagatatattacccatttaacaatgattttagtgttgaccaaacaacaacaaaacaatgatttacgatagtactgtgtgtatgtagttggattggaagctaaatgtgttaggcttttgattgccattggcctctccggcccggtcctgagcccgtgaatgatgaggataatactgacaagtccgcattttttttattaaacaaacattcaaattttgataatgatcgtttttttatgttaaaaggctttcatgataatgaacgtacttattaacattacattatgtttgtaatgcatatttcacaatatgtataattaaatttagcaatttaaaattttctggtggcaaagttgtggataattctagctacatccctcctatttacacacgtggttcacttcttctgcctcaatcattttgttcggcaatttttcaacgccaaacgctttttgtttaaaacgccaacgcaaaaccagcgttttgtaatcttattggctaaatctcaaaagaaatgggaaaaaacaaatctccaggctattccttatttctaggccaaaactatctccacgattctaacaaacaaaaattacagaaatgtcaatg

SEQ ID NO: 18356 - DNA, 3000 bp, Unknown; identical to SEQ ID NO: 7216
  misc_feature (1)..( 3000): 2750-1469P.txt file - cDNA_ID_1817015; gDNA_ID_1621133; Annot_ID_56505

SEQ ID NO: 18357 - DNA, 3000 bp, Unknown; identical to SEQ ID NO: 7215
  misc_feature (1)..( 3000): 2750-1469P.txt file - cDNA_ID_1817019; gDNA_ID_1621133; Annot_ID_56504

SEQ ID NO: 18358 - DNA, 3000 bp, Unknown; identical to SEQ ID NO: 7215
  misc_feature (1)..( 3000): 2750-1469P.txt file - cDNA_ID_1817019; gDNA_ID_1621133; Annot_ID_172558

SEQ ID NO: 18359 - DNA, 3000 bp, Unknown; identical to SEQ ID NO: 7214
  misc_feature (1)..( 3000): 2750-1469P.txt file - cDNA_ID_1817027; gDNA_ID_1621133; Annot_ID_56502

SEQ ID NO: 18360 - DNA, 3000 bp, Unknown; identical to SEQ ID NO: 7212
  misc_feature (1)..( 3000): 2750-1469P.txt file - cDNA_ID_1817037; gDNA_ID_1621133; Annot_ID_56499

SEQ ID NO: 18361 - DNA, 3000 bp, Unknown; identical to SEQ ID NO: 7210
  misc_feature (1)..( 3000): 2750-1469P.txt file - cDNA_ID_1817041; gDNA_ID_1621133; Annot_ID_56498

SEQ ID NO: 18362 - DNA, 3003 bp, Unknown
  misc_feature (1)..( 3003): 2750-1469P.txt file - cDNA_ID_1817045; gDNA_ID_1621133; Annot_ID_56497
tttacgttcttcgtacgttttgatttgaagaggtgcttaatggcgcttgaccttctacatatactttgtatgaacggctatcttcactacgcataacatggcctgcagtttcatctcttgcttcagcgatgtgatttcttttctaaattagtttctcggtaattgatgatattgagtgacaagatacaaaatactaagaagaaattctaatgcgaaaagagcataagcaaattctgtgtgcaccctcgctctccatgccaatgcagagacttaaaaagactacaatcctctttggcattctttttaagggttcaaaacagatgcctcgagcagtaaatagtttacaggttccaactgttgcgcatgagttcctaaggaagtgacagaaaccgtacaggattgccagagaaaacaattgctgtgagcattctggagcagtagctacaacgattggaggggcaacagtcacgctttctattcctgtaaagacaatatgcaagagatttgtcggtcacactgaatttagctatccagatttcttgaacaaggagcaaaattaaaaagataagcaaatacctccatgggagcagagtcatttgtggccggatcaggaattatcaggccagcaggaacctgtccaaacttcaaagcctatatatccacaagccaaaaaaaaagaagactgtcaaaatcaatcaaaaacaacatcatcaggcacaaatttgatattcaaaagaaaaagcaagggacctgttcgagtctggcaatttcttctatcgtctgagaattgataattgcagcctggaacatcatggaaatgaaatacagaaattactatcaaccacacagcgttgacctacttattataaagacaacaaaacagtgaatatgtttggtcctatataatttccagtttcgcaccttgatagctaatatttgctccgctgttggcgccaccactttcggagtctctggattttctgcagtttctgacacttttttaacctcctcccgagaaacctttttaacttcctcttctgcttctttggatgaaaacaaagatgcagcttcagctctctcctgttaggaaccaataatgtcaggtaaaaggtcttgctataaccattgtaaaatttagatatacaacagtgggctaaaggataaagccaaactattatccgatccaaggctacaaggttataacacgaggaaattaaataaaaacaccacaccctacatcaagtctggtttatatttatgccctaaatacaaaaaactttaagataatcaggcaaccaagtcatcaagacccaaactatatatactttaagcaaacccttttagctaaatgttgttaatattagtgaaatttcttatttcagcatacagatataactgtgcacaagaatcttaaacaacgtaagacaaaaggcagaccaatttcttgctctcagatattctatttttcagatgatattaaggttagctcccggtgacttgtagcatataaaataacattaagttggcatctagggtaagcaaaaatgaacagttgataaagcatatgataaggtccttaccttggctttgattttaatgaaatccagtactcgaagtgattttagcttgtgaatcacataaaggcgataatttgcctttttggtgatattattatccaacaaactaaggtactgcagcttgggaatggaggcaaggggatcaatctcaaccaaattcacaagcctgttatttgtaagaaccaaagagtgaagcttcggtaggaattctgcagatgtacaaccatacgataaatacaacacaggtaaccaacaaagcaaacaatgtgtttgaattgacatttcttacaacacacagatagatgttacctccaaggttaggatttatccgggtgatacgattgttattgatgagtaaagttcctaaacggttgaggtatgggaagttttctagcttaactatctcgttatcagacagatcaatggtatcgaactggtcctgtaagcaaaccaagacaagttaattagagaacctcaaacctgcaaataatctacctaagccaaacacaaaatttatgggaggcctttcttagagaagactggctctcaaaagtaaagaatccacagtaagaaaaaggtactattacacgaagccacatatactcctaaagagctagaaaacagatactaactaagacaaaggagcaatagctacttcaacaatgtttctgtcaatgattttcaaaatacttgaatgccgaaacccaacaggcagacttaagaacatacaatacaaccgcatcaacaaattcttcagctaacagacaaagaggaaacgaaaatcgatagaaaaaagaaatacctcagtagcacccaagttttcgattacaggaatcttgttacctgcaacaaattaacccagaaaaacgaacgattaaccagagcaggtgcgtttagggttacaaaaccctagaaaatgtaatgggaaagagaagaagtgtacctcgtagatccaattctcgctccttgatagcattgaagaagtgaggacttttccagatcaaatcagccgtgagcttcaccattattctactagggttttactgcttcgtcgagctctgtcgctgctaagcattcagaggaaagagacaacaacagtggctagagatgacataaaaacgcagcaaaatgacctttgctattaatttatcacttaaataaacggcccattgaattggcccagtcggttaggcccataagtgtatcccgatatttatgattttggaaattaaaaagaaaaaacaaataaaaagaaaaggactagtgaacgattgaatcttttcttcttcgttggttccaaccctaatctagggttactctctctctcgcttccttctgttcttcgttcttaccgagttccacgagcattagcttcagagaccttgaattggagtgcggttggatcaaaaacagttgagcgaagatg

SEQ ID NO: 18363 - DNA, 3003 bp, Unknown; identical to SEQ ID NO: 18362
  misc_feature (1)..( 3003): 2750-1469P.txt file - cDNA_ID_1817045; gDNA_ID_1621133; Annot_ID_172549

SEQ ID NO: 18364 - DNA, 3003 bp, Unknown
  misc_feature (1)..( 3003): 2750-1469P.txt file - cDNA_ID_1817049; gDNA_ID_1621133; Annot_ID_56494
aggatttggtccagttttccctcaagaagtcaaaattatttccattcatatgcagattgcttttcacttaatgctttgtctattttttaagctttaaaggcttacagtcgaatttccttattaagtttatattctcatagtgttctaaccaaatgaatcatactcataatgtagttcacaatttcccagatatcagacatccagcaaagaatatttttccttataagagcatgcaaatacatcttctaaatgaaaatgggcagaaaaaaaagtaatttttagttagcacttcataataatataagcttactcgaggtcagtattccacacagccgggtatttcacatgcagcgagtttatcttttgttgcttattaggccaattatgttcttttaccgcaatctttaactcctccatgtctggaaaccacatgaagcaatataaaaagttagaagagggaacctctatgttggaaagagtagatgcttaaaaagacagactcttcgttttgcagaaatgaaattcaataagacatctctctcttaaaactcttagccatcattaaacatgaacatacatgaagcggcaattagaaagacactatctgttcggcaaacaagcgaaatcgctaatatagatccatttaaagaattgcatgtaaagaagaattaaatatatctcactaggatatcagttcactttatattctcctttctatttaccatttttctactaaattaaaccaaaatcgaatgaaagcatgttctcgtagaatcaatagataacaaccgacaatgaaaaaaccacagtatcaggtgtctaagatgactaaccaaaaatcgtaatggtacttacaactaacaagtccgctttttacaggaagaattttatgataacctaaatggcaggtatacataccttcatggcaattttcatccttcagtagaactcgaattctgagaatgatcaatccaacctacaaaattgaccagcaaatattgtcagagtgatagaacctatgcccataaagtatccttcaaaataaaaaagtcgacataatgaataactcacattttggtaccaattgtattgaatactaactatgtcttcaactccaaattcacaagaaaatggcacttcttcattatttgcgaggaaactctttattttgatgccattgcatgaaaagattactagggatgcagcacaatgcatatccttaagtataacatactccgaagtcattataacagcggtgcttaagtcaatctgcgaagtggaaaactggaaatcattatctttttgcaaaaaagaatcattaatatcttttggcaaccacatcgttgccaaacaaattctggcagtagttttttaagccattggttaagaaactagaaaactcgttaccttttcctcatcgttgaagcaatgttcagtcatccaatctttcagcgcatataacattgaaatcaagacacggtcagacataggagatccaagcatatctataaggaaatatagagagaaggtgtagcatgtaccttcttcatcatcttctgaatcagaagcttcactcaacgcagatcgatcactcaagctttcatcaatagctgacatcatatcaatttgctcctcctgcaaatgtgaaggggttaaaaatgcaaggtaaaacttataaagtctttagcatacattaaaaacaagatagattaacatacactggatgaagaatctgaaaagggtgagtttagctggcgttgactataagatgaagtttcagcgtaaaaactatttccgcctagctggcaagagaaactctccactctatgatccacatctgtttcttctatgtcgtcttcgctattcaaaccaaacatcaatccatggttatcgtgatctatatctgtttcctttgccaggtcttcagtttttaaacctaacatcaatccctgattaacgtgctctgcatctgtttcttctaaatggtcagtggtttccaaaccaaatgtgagaatcgttctggactccttagcttctgttaccaaagtcgaatcatcttcacattgatgatcgtcagactctacagcagtagcaggctctgcacaacttggaccttccatttcttcttcctcaacacgtttttcattgcagactggcaacaattaaccatttccataagaactcactcatatatgataaaaattatttgcttctgaacaatatagtacaaatcattatagtgcctcccataaaattgtagtatcacaacagcattagtatcattatttctcacatactgcagaaacaaagcaatgttcattcaactatatacaagagtctggaaaactaaaataaacagaagaattccaaggttagcttaacttctctccgtttacaaatatctcaaccccaaaattatttttccacaactgaaactgaagcgagaatttaaatcagcatttgaagtttagagatgaatcagagtaataacttacagctttggatgcgttggcgttgcagaaccggagaattgcaaggactagggtttgtgaatttttccaataactttccagctgcagactcagcgagctcgtcctcttctttgaaatcgaatacttcaaagtttttcttcatcgctagggaaatctgaggaaaagccccaccggaaaacggagaatccaagccggagatcggcgatcagaaatcgagggggtcgagtgagggagaaggagagagagaaacgtctaaacgaaataagtcaacaacgaatgccagcgcgtctgaaactcacgcgcggacgtaagtttactctatttataatagtacgtaaataatttaatattttcattacataattcggctatggaatgacaggtatacccttttgtaagccgcgaatttaaaaatgggagacgtgaaagccatcgtcctcttgaactttccaagagttgaagaaaatcacagaaagccttagcacagagaagagagattgaagaagtcatg

SEQ ID NO: 18365 - DNA, 3003 bp, Unknown
  misc_feature (1)..( 3003): 2750-1469P.txt file - cDNA_ID_1817056; gDNA_ID_1621133; Annot_ID_56492
cagatttggcgttgtctcaattttctctgtctccacactcccaaatgctgcctcctttaacccgttcatgcatgaagaaggttccagatttggcgttgtctcaattttctctgtctccacactcccaaatgctgcctcctttaacccgttcatgcatgaaggaggttccagatttggcgttgtctcaattttctctgtctccacactcccaaatgctgcctcctttaacccgttcatgcatgaaggaggttccagatttggcgttgtctcaattttctctgtctccacactcccaaatgctgcctcctttaacccgttcatgcatgaagaaggttccagatttggcgttgtctcaattttctctgactgatcgttttgacaatgatcagtaggttgaggagggatgataatatcttcaggatttttagctactgtgcgttttcctttctgagctttcttcttgaactgagccttcctggctttaagagtcttgacggtttctttaagcgggatagctgcctgtattgtcttcttctcacaaggaagtacagtaagctgagtgttgtagttggcaaggttgtttttagtgtctgactggatcgctaaaagagcagttctcccagcgctaatctcagcatcttttttagttcttgttgcagctcctgtgtactttatgcctccaatctctacagtacatgtgaattgtgtaactctcccaagagtttcgaccttctggcactgatacaatggaatcgcgtaattcatcttttgagcgtattcttgaagtaggttcttgcataatcccgtttcgtgctgcattaataagccattcaaagttagacaagagcaataacttacagaaacagcctaagaatcttccctctagaagttggcaatacacataaatccgataagacagaagacactttattaatgagtggattctttaaactcttgaatctcgatcattgtccaaccaagagcctagacaaatacagaatgccccctaacgtattctcacagctcccctttaaaccttcaactctgaaactaaccatgagcttccctttaaaccttcaacgctcaaactaagcataaggactactgctgagatggcaaagctacaattcgctgctaaacccctaggctaggttcaatagttttgcagtgaacttaacaataatcacgagcgaaataagaaagatgaggtgcttacaacaggttgtgaaacacattggcttagctcactggattttgctaattcccggagagcaacctcggcagctgattgctctgcagccttacgattgaagaatccaggcaaagaattatatctgacaccatccagtatcacagtcgattgaaataaagatttgtgtgaagggccttctttaacgatctcataaacaggcgttgggagcttgtacttctgagcatactcctgcaaccgacttttgaaaacatagcaattggaaacacctgagcaggaaaaaaacttcaaaatgaggcaaaagataaaacagaaacagtgatgatgctatccactacagcataaattgcaaataaactcaaaacgacaacagggaacagcagtgaacgagttctgaataaagctgacgactttcacaaagaaactatacttatccaaaaggggagagacagttttaaaccaagcttctatgttccctaacaaattgagtcaataaatcatcatctcaaaagagtaaacttgccaattgccagagagatctacgcttaaacccacaagggacagatacacttgtaaattctaactaatcaaaacactgcaatccaatttccaagaagaaagaagtgagtaaagaacagaagaaaggggaaaaagcatgatctggtttcaaaattaaaacccggaaaaaacaacccatgaatgttgaattagagataatgcagacatgatggtgaagaagaagaagaagaagaagaagtaattcaccagaggaaacatcagtggaggtcattttcacgagcagaatgtagctgaagagacgaataataggttagtagggcacggcgaagagcaagaaagaaacgtgctgctgctgcgaagaagcagagagagagagatgattcttcttcaccaaaaaccctctcccctcgacttcctcctctttactgatttttatttttgtttttttttcacaagggcaaacgaaagaaggtggttcttaattgttatgttacaaatgttaatattgaatttaatttcaaacctttataaattatattatattccataaatttacctttttggtcaaattttccataaatataatttacttgtgaatattatatgaaagcaaaatgtttttatctttgaaatatttaatttaattaaaaaactaattacatatagcctaatttcgtatttcatatgtagttaactaatgtatatatccacaattgattaacctttttatggctaactttattcactagtaatccctttgttatattcacacagtttttgtattcacaaataattaatttgttctccaagtaaacatcaataatgataataaccgtttaataaaaaataaaaacaatttgagcccatatttgagcccacttgagcctatgtcccttaacagaaaagaaaaatatttgagcccatatttgagcccacttgatcctatatccctttaccagaaaagaaaaatatttgagcccatacttttcgcttctgataagcgtagaataataatagtcgaatttaccaccttccttttcgttccttttttttcttctctcttccgaaacacctctgccacgcgagtactctccacgctcttcgacagtcgtgaccatcttcttctccgatcgtcttcaccggttttcttgggcattccctcgtgcgtaagtctctgtcgtttcgtttcgtctataactccctcgggttttggtgaaatttgattcctttgtcctgttctctgcagaattgttgcaataaatacgacgaagatg

SEQ ID NO: 18366 - DNA, 3000 bp, Unknown; identical to SEQ ID NO: 7204
  misc_feature (1)..( 3000): 2750-1469P.txt file - cDNA_ID_1817060; gDNA_ID_1621133; Annot_ID_56491

SEQ ID NO: 18367 - DNA, 3000 bp, Unknown; identical to SEQ ID NO: 7204
  misc_feature (1)..( 3000): 2750-1469P.txt file - cDNA_ID_1817060; gDNA_ID_1621133; Annot_ID_172542

SEQ ID NO: 18368 - DNA, 3000 bp, Unknown
  misc_feature (1)..( 3000): 2750-1469P.txt file - cDNA_ID_1817067; gDNA_ID_1621133; Annot_ID_56488
atgaagtgttatttattacaaaggtgaaagttattgaatcagtgaagaaatcatattttgttaacgactacaaagaaataagccaagtcatcgttttcaactcttacatctttagccatttatgtacatctggacccatttgtttgttctgttaacgacaaccaaaagggaaaccgacaactgaaaaatgtcgcaatattagattagggatgatgagtaagctaaggtaccttttgtcgcctaacgttaagcccaccttgtcagaaacagactctaaagcttccttccatttcttgatttgttctccactcgaagtcttagccaacctccagaagttgcgaccaaactcagccttttgatatctaacagactctgccttcactttaaagaagataggaaccactcgtagcttgcatttatcggctcttttcttgatccttgcaagctcgtccaggcaccagcttgactctgcgtatcttttggaaaatatggtgagagccatcctcgattgcttgatccttgcaaagagatgtttgaggtctttccctttttgttcgtctttgtctatgaagaagttgattccatgtcttttaaaagcgtcaacgaggtggctcacaaagctgcagcgtagctcctctccccggaaattgatgaacacttggatcttcctattactactactccttttcatgttgtttaatttcctttagttgtgagcgtgagcaatgaagagaagttggttagactttgttccactcttatacaattttgtttggacagaagacaagttttgtaatgtaatatggaacaatggttactaagatgtttagcaagagcttaatttatagtatatgatattgggatttgggagggtttaggtacattgttaatgttaggtttatcgatattactggagggaaggcgtcgttaggaactttgtcattaactttcttgagttaacatgcgtaaatgcagtggcggacccagaatttgattattccaaaaattggacagaggaggaagaaaagtcacaatcccaaacagttaatacaagatcgtagaaaagcgtttttggcgcacgtgcgcggagagagaaagcagaagcagacctcacttttctttttttcttggttttttcttgtctctggatcctcattgttgttctcaccaccacctactagctactacccacatttttccccaatgtcgaacttctatccgttttcttctttggttttaggtctttctttttggtagttgtactacaacatgtatacttttaatttgcagcaaacatgaaacttctcctttgtcagcactcagccttacggaacaacatgtacccctaaacaaaactctacatgacctaggggatttgaaacatcccaagaaatggatttttttttttttttttttttttgggctgtgattgttaatgaaaacctttttatgtatacatttgataaagtaaatactacatatattctagtagaataataccatttacctaatatactgaaatttcttgggatgtttcaaatcccctaggtcatgtagaattttgtttagggttacatgttgttccgtaaggctgagtgctgacaaaggagaagtttcatgttggctgcaaattaaaagtatacatgtgtagaacagctaacaaacagaaagcatagaaagaagggaaccctaggataaagaattaaaaaggggaacaaagatttatgctgtttcttctttatttctcattggcaaaacggcagaatcttcattaagttgcgttttattattttttccatttcttatagtagccaacttccaactacaccatttaacccggccgtttttttttgttgctaagtaataggtaaatatcctattaatgaaaattatgatttacatgaacaatagctaagatttaggatacaaacaaggaagacgatcaaggatcttgaagatagaagtaggcgcaaatgtgttgtgaattatgcagcatcttatttctttgcttccaagttgtatataaatcacggcttgagtaactagcttccttagtgtatatgtgactgcatctatcatatacagtatgtgtgtaaactgcgtttggtgtaaaatgtaattataatttatagaaaataaattaaagtagtggaacatggaaatcaccgttcagatattctaactgattcactatagacggaattcttgttttcgtccattgtttttactttttagaatttttaagtaaaataaatcatccattacatcactgaggtgacatcatcgctcaggggacatcactaactacgttcccactaaaaatataggcaaatgcaatcaagtgaatgatgatgacctttcaagagttcgtagagataaataaaataataaatatttggcatgttgaggatcaaatgaattagatgcataagaaaggtactaggtagaccaggcccggcccaatgtgttttgttgtctaaagcaaaacaaaaaaaattaagcccattaaagaatagttatattgcctcggaagggctcgaatccatcatcttcatttttttagtttacacggattggaagtaggctacaatgtccctgagggaaggtaggcccattattagtgacctgaagcccaataataatgaaaacgcaaagaaccttttaagaagaagatgacagaatctctagagaataaaaaactaaacacaaaaatagaaaatatcgaaaatgagatgagagagagaggaggagtctctcatcgtgagtagggcttttgactccctccctactttgcctacttcttcttcttcctctgtggccactctacacagtccacacctacttcaagacacctttctcatccttgagatcggcgtcagatcctccgccgcttctcctcttcactatctccggtcacaacttgtttttctctgtttttctttatctctactttatgcacaatctgactttctaagtggatttacagtgttaaagatgatg

SEQ ID NO: 18369 - DNA, 3000 bp, Unknown; identical to SEQ ID NO: 7211
  misc_feature (1)..( 3000): 2750-1469P.txt file - cDNA_ID_1817074; gDNA_ID_1621133; Annot_ID_172530

SEQ ID NO: 18370 - DNA, 2300 bp, Unknown
  misc_feature (1)..( 2300): 2750-1469P.txt file - cDNA_ID_1817082; gDNA_ID_1621134; Annot_ID_56532
ttctcaatctgaaaagtgccatcaaaatgtttcaaaaaccaaatcgagaagcaaaacaaaagaaatatatatagactcacgagctcgatgtgcccttgaggaaagtaataaactttttctccaggtttcggaagaacacacaaaggtccagcacatatgttccataatttctcatacatataagtcttggttatatcaactagtaaaacgaaacaaaatatatggttgtttcatatttaatatataaaataagttcagacaaaatatatataaaaaaaaatctttacttatgcctgataattcaggctgtgcattcatttctccattattttccatgagctcttattgcaaagatcgatattctgtgaatcataaagcaagaaaatcatcaaaatctttttttttgttaagagtacacttattgacaggataaaagataaaaagtaatttttgtaatagaaaattatatctttccatcacaaatgagaagaaattactacaaactattaaactattttaaaaatcgtatatgatttgagtgaaaaaatttaaattagggattaaaataccaggcagactatttttctctagatccggctaccaatcacagagtaattttttaatttgatgtgtagttgatgtatacaataagcatgtatttatagagaattaagaccttattaagtcaccaaaagatatacataataaagctaccatattacacgcaagaaattaatgtattttgggaaattaagaacctactaaaactccacggtcaaagaagcccaacagttgtttaatgagttttacaaaaagtaattagggttataggttattattaattttgactcgattagatggaaagtggaaacctcgtaaatattgattctattgaattaatatatatctataactatatatattctatctttgttcatgctactatctttttggcttaatctgataatttctctattgttttaattagttcttagtgtccagaatcttttgatttcgacgatgttgtttatttctctttttgttttccattgtttgtaattaagattaatttttttttagcgtgtttgcttggatgcttattactagttgtcgaataactcctcattttgggatgaatccttctctaatgttgtttaccagtgatcagaatccctcacaaaagctctctggagaattgaacgagttcttcatggatttttcgagaattttccacatgacaagaggtgaaaattaaaacatcttctacaactgcatagagaacgttgattcacatgtcgatttttcttttttctcatccttgatcttatagatttgtgagtcttcataactaaataaatccatatgtttttgccacatttaggtttagatgtcttgtaatttttgtccttttttgtttgtctcctagtttttgtttagaataagaataaagttctatatgcataggttgttcattccattaatcgaatagatcgtttgccgatattcggtcctatatagctatctcgtcttcaaagcttactcttcccgtctttggattattcactctcttcatgggagctgcaagaattgcactctattatgggattttttaattttttcggttggaaaatatattaacaattgtaaaaaaaaaaaaaaaaatcttataatgaaaaatatgttactttctacaataatattaagactttcataacttctaagcactatttatatactttcaatacctttatcaaatactaactaatatatcaaatattattaagttattatgaataatgtaatagtaaattatgttatcttacaaaatgtaatcagtcacataaaatttattgaagtgaattgatgctacaaatttatattgtacaagtttttactctacaaaatttattttatttgattttatacgattattttattgtaagtttgaaaaatagtagtgagtggtggattcaacatttagttcctttgtaacaacaacaaattaacgaatattaaaatttatcagtttggcccctttgggcgtgtaattccaaaagcccagtaagattctcggaaacttcgttagtcagaaaaaagctgacacatataatcacaaacaaaatcatttttttgactctatccaaaatctatctaccgccgatcaaaaaaccctagaatttcttccactgttatgtaagtttgatcttgttgtctccactaagaggcgaagagagaaagagggttttaggttgtgtgttctgtttcaaagggtttacttctcgttgaccccgatcgagatg

SEQ ID NO: 18371 - DNA, 3000 bp, Unknown; identical to SEQ ID NO: 7246
  misc_feature (1)..( 3000): 2750-1469P.txt file - cDNA_ID_1817086; gDNA_ID_1621134; Annot_ID_56531

SEQ ID NO: 18372 - DNA, 3000 bp, Unknown; identical to SEQ ID NO: 7246
  misc_feature (1)..( 3000): 2750-1469P.txt file - cDNA_ID_1817086; gDNA_ID_1621134; Annot_ID_172611

SEQ ID NO: 18373 - DNA, 3000 bp, Unknown; identical to SEQ ID NO: 7245
  misc_feature (1)..( 3000): 2750-1469P.txt file - cDNA_ID_1817106; gDNA_ID_1621134; Annot_ID_56526

SEQ ID NO: 18374 - DNA, 3000 bp, Unknown; identical to SEQ ID NO: 7250
  misc_feature (1)..( 3000): 2750-1469P.txt file - cDNA_ID_1817106; gDNA_ID_1621134; Annot_ID_172600

SEQ ID NO: 18375 - DNA, 3000 bp, Unknown; identical to SEQ ID NO: 7244
  misc_feature (1)..( 3000): 2750-1469P.txt file - cDNA_ID_1817125; gDNA_ID_1621134; Annot_ID_56521

SEQ ID NO: 18376 - DNA, 3000 bp, Unknown; identical to SEQ ID NO: 7243
  misc_feature (1)..( 3000): 2750-1469P.txt file - cDNA_ID_1817132; gDNA_ID_1621134; Annot_ID_56519

SEQ ID NO: 18377 - DNA, 3003 bp, Unknown
  misc_feature (1)..( 3003): 2750-1469P.txt file - cDNA_ID_1817134; gDNA_ID_1621135; Annot_ID_56557
ggacgaaccaagggctcaaatctctcttttgagaaatcaaaactctgtactgaaacgggtttatgatttgacttattgtaagctatccaataaggagttccttgtaaacacacactcgactatggttatcaatataaaccattagaggtcttatcaacagccgtcttccaagaatcagatttgaatgagtaaacttcaaccgttgaacttaaatcagattcaaactcataaaatgtaattcctatctgtttcttgaatttgaaagtaaaaaaaaaacataaaatatccaaagatagaaactgagaaatccttaaaagaaaaaccgaaaatgttccaaacaatggagccagcttctttgttcttattctcatctcgaaaagcctggaatctgaagcaagctctgaatatagcagcaatcactgagcatgggaccaagaccagtgaagtattcaaatcttttgaattcttgattctctcccccaatgtagatgctaatattcctgcttttgatcaataatgcaagcctaccatttctctcaatgaaggaactgaaatattttccatatatcgcatcttgaggtacatcaactgtcatcagcctgctccaatgctgcttcttcatcacccataagtgtaacttacatgtttcgtggcattcaagtaacaaagaaagttgatctcctctgaaaatccctaaagagatatactttaccaaattacgtgacccaatggattgaggaggaagaaacaagggctcaaatctctcttttgagaaatcgaaactctgtatcgacatgagttcattaccagatttattgtaacctagccaataaggagttcctcgcaaacaaacacttgacaatggcaatccatcgaatccaccaaagtttgtatcaacaacaaccttccaagaatcagacttgaatgcgtagacttctacccttgatgaatttttaattccacaacgaaatcttacaactttgtaatcataaaaacctgatgattggttaaaaaggtatccaagaccatacgcgtccatggaatggtcaaacccttcgctacatttaatccatctcttttgactcaacaacggattcgcaaccaaaagcatacttttagtgacgtatagcaatagaccgtcacaatgagatatattgatcgctggtgaaagagctattggaaaaggcaatttcacaccacaattttctggtttgttgaaatcgatacctacataagaagttgtggaaccgaacaaaggagaaactatgtgttcgttgttaaagactgtgaattgttgctcacggtaacgcatgtgagacaagtgcttgttgacgaatctcggctctgcgattagggcttcccactgcttgcatgtggatctcaatcgtacaagagatctcgctggaacccgtgagagtatctcctctaccaaatcagacgaaagatccattgtagccatcgtgatcagtagttttttattcttctttaaaagggagtttgatgggatcggccatacgaagatctaggagattatgatatttgttaatatcttcgtttatgaatcatgattattcatatttatctctaatttttttatttttatattatgtttattttaattagtaaaatgatttgacatttaaatatgtaaagtcttggataaatccaaaatttaacaacaagtacaatgatcctactatattatttgggaagtacattttaaatataaccttaatttttgtaagtaattacataggtatgccattagaaataaaattttaaagagtaaattaatttatctctttaaagattaaaaagtcaaatactaatttaattaatgaaatttaattaaaaacgaaatacattattaattttcaaaaataataaccaatcaaaatcaacatataagatttgatatctaaatttaattctaaaactaacttcagtatattattattttcttacagaagtacaatccaattcattattactacattatcattatcatctaaactgattctaataaaactgatggttcttattcataaatacaaaagtcaaaaggtatatatcaaattagtaaaactttacgattttaatattctaatacgagttgttaaaaagaacgtctagttccaaacactatagtttgtatactattttctaagtaaacaaaaatacagtcaaaattataactactatcatatgtcagctagctaaacttattctcatgattataatgaaacaattaaatatgatttttttttttttttttttgtcgtaacagttaaatatgaattaacaaaaaataactgtagtgttatatattactaacgtacacaaacattttttttccccattaaaaaggggtaattgcaaggccgaatggcttatgacggctacaagcccaaacacaaaagaaataatccagagcaaaaatcagaaaaggcctcaggcccaacaagctaaggtaagagcagagaataaaatgaagaaatgaaatgaccaaaatgcaaggattagttgttcaaaaaagacgactagatatagttgcccactggcactgagccactgactatagtacttttttactcttcaacgtatggacaattcctatttgaaaagtagccactgacgatagccactgactataggaatcatactatggacaatttctcactattcatgctttgtttgttcacaaaaaacgatgagttccaataaaccctattaaataacaagtagaactagttccaataaacccaaaatgcaaggacaagttgttcaaaagagacgactagatatagttacagaaaactgactataatatttttcacgtttcaaatattttttgtttcaagtattttttacttttcaacgtacacaattatgcaatcaaactattcacgctccaataaaccctataaataaccagcagaagatgagttaaaaatcacaaatcatacactttcattttcatacatgagcaatattcaagaaatg

SEQ ID NO: 18378 - DNA, 3000 bp, Unknown; identical to SEQ ID NO: 7261
  misc_feature (1)..( 3000): 2750-1469P.txt file - cDNA_ID_1817144; gDNA_ID_1621135; Annot_ID_56552

SEQ ID NO: 18379 - DNA, 3003 bp, Unknown
  misc_feature (1)..( 3003): 2750-1469P.txt file - cDNA_ID_1817148; gDNA_ID_1621135; Annot_ID_56551
aattaatggtttctgttagagttcgattgcagaaaggttgatagaaataaagattcatataaaaggcatcggaaaattatttgattaacgtttgtttcgatacgagtatactataagtttgatagaaatgtgccaattgatttaaactcattagtttcattttcatactaaaagtaaaagcattattagttaacataatttttgctttacaactttagttgatgtgacgctcttcttaaatcttaagcatgtaccaagagttgtcaatttcctcttttaacatgtttcaattttgatcttgtagttggagttggtatttctataggatacacatattggataaaataagagatacaaattgcaagttacgtgctgtgcaaaccatatccacatactaatctttgtaataaccagaatcttatgttggtagtcagtagtctatattttttctcgatctcatccatattcggtcaaagaacactcaataaatcatttacttgcatataaagatcaatgatttccctttttcaaattagatattaacagaaattattattgttatattattacaagcttaatattttggtatgcttacgtatgtattattatgtacctaatcggctaagatctttgtaagaaaattagttgagtacgtatattctttttcttcaaaatattaaatatatccatgtcaccatgtgacatcgcagacgaaatgactcgttgtttttcataattgccacgatacgactgccatatttccaacatatcttaactgttagcattggcacgaatttaatgcaatatcttcaaaatctgtaaacaaaaaaaaaaactacatactataatgtagtgttctttatctacgccaacaaacccaaaagatatctttgatttttatttttttggttggtttcccatccgtttatcttcaaatgaaactcgtaagagatttaatttaaaagtagtattgtgatagattcttgttgagatttaaagaagggttaaattgtaaattagtcactttttcaaacttaattagaaaagtagtcactttactattcataatttgcaaaatagtcatttttcactgtttgatttgtaaatttagattgtacatcacttttagtgtacaaatatatataaaaatacacagtgtacactttacatttgtacactaaaagtgatgtacaatccaagtgtacgaatcaaacagtgaaaagtgattgttttgcaaattatgaatagtaaagtgactactttcctaattaagtttgaaaaagtgactattttgccaacacaccctttcaaaaatcggggaggtttataataaaataaaatatatctaagagacataattaataactacagttgctttaagaatacataatgatacacgtacgtcgaccaaaaataagagcttttttacccacacagtcgcagaagatacttagaacgaaactaaaatattaaacgtaacaaagtgtcaaaattggaaaggttacttttaattgctctgtgattgtgtagtagtgtctggacttaatttccgggaggaagtacgttaaactcacgtgttctgctttgatttccgcgttcggcgtttcattccacaagtgttgtcaaaaaaaagacaagatgtaaatttttcaattatcattatcattattgttatcgttactaatttatgactagttttctattttctaattaatatttttgttgagaaaattttgcgacaaacaattgtcaaaagaacataattagtaaactgtgacaacgaactttttcaataataaaaaaaaaactgtgacaaccaagagtgaaatgctgtgattagaacttgtatgattgttgatcaaaaagaacttgtatgaaaactgttgcttaattagagaaaaagaactgaaatatctgttttggcaaaaaaaaaaataaaaaaaaaattgaaatatacttctctgtttctttttatttgatttttcagaaaaaaaaattgttccaaaagattgtttttttaggtttttaatgcaatacttattagttataattgataaattataaaattcaatacaaattattgaatattattggtttatagttattgaaaattgtaaaccagaaagaataatatatttaaaagtaatatttaatatgatttcttaatatttctgtttttcctaaaagatcaaacaaaaaataacaaaggaagtatatcatttgttgtgtgaatacttaacaagacctatatttaaggaaaagagaagtttgtgtaaaaaatttataaatatgtaatatctttatacgttatatatatatatatatagatatgtatgtatttataactagttttatagttgcattaaagtatatgctacaccatacgtttttaattaagtttatgatttaaggataaatgattaatttgtgtatttgttgaagttcgtggatatcaagccggtggtcctgataaataaggttatgaatttataatcgcactttgcaaattatcgggtacaatctgctaaatgattcaatccggcacatcccatcacaaggcttatctggagtaacttgtttccatgtacgtactagctagtcatatcggtaggactcatatgactctatatatatattgatccaactattcaattttagttactttttagcctaaagagtaagatacgattaggatcggttcaccacatgccaaacatgcaaacgcctattttgtgtaaacattttatataattttcacgaaacggatgttatgattaaaaaaagaaacaaggcttattttcctctttttcagctttgttttttcttcaataatttaaaaaatagcagacacggcaaaatcgcctttatattacacctactctctgagccaagtcgcagaaagatacagacttaaacgaagatagagatagagagagagacgaagttttgtttttattttttcataaatatttgttttctttttggatatttaaaaaaaaaatg

SEQ ID NO: 18380 - DNA, 3003 bp, Unknown; identical to SEQ ID NO: 18379
  misc_feature (1)..( 3003): 2750-1469P.txt file - cDNA_ID_1817148; gDNA_ID_1621135; Annot_ID_172641

SEQ ID NO: 18381 - DNA, 3003 bp, Unknown
  misc_feature (1)..( 3003): 2750-1469P.txt file - cDNA_ID_1817171; gDNA_ID_1621135; Annot_ID_56542
ggcgtcggtgacgtaatcaacggagagtccgtattttcggatcatgtttccgtagccaccaccgctaatgtgacctccggctccaaccgtgggacaaactccggcggggaatccatgacttttggttttttcccaaatcctgtagtaaacttcaccgagtgttgcaccggcaccgacccatgcagactctgtggcggggtcgacggtgatgttacggagatttgacatgtcgaggacgaagaaaggaacgtgagagatgtaggaaacaccttcgtagtcatgaccaccgcttcgagttttcagttggatgtttagcgatttcgtgcagatgacggcagcttggacgtgactctcggaacgcgccgcgattacgatcgcgggtttcggagtcgctgtggtgttgaaacgcgcgttacggatgtaagcgcgtaagacgggggtgaaagcggcagcggtttttggtaaaacgacgtcggctaatgagttaggaggagcttttgtttggtttgtgaaacattggagaaagttttggtagattgtttcaggcggaggttcgacggcaagagaagtagagatgaaggaggagattaagaagagaattaaacaaaagatcttcatttttttttttttgattggattctatttggtgttttctgtagtataaatagttacatgtagtctttaaatttctgttgtgattcttatcgttggccatttttaggatttgttgtattggtcaaggtttctcctgttttttttttttttaatggtttaattgctcaagattttaatatagtcaagttaactatagaaagatcacaagtttcagaagtcaagttaactttagagattttaatatagtcaagttaactatagaaagaacacaatttgtttgaaggcattgtgagaaagataaatttttagaggtattggattaggttgttttgggaagagaataacatgtctttcaacctttatcttccttttttttgagggatcagttatttttgttttcatattagaacttgagatattaatgttctataaaacggtgaataaaagaccaaaaatgttttatactacaaaacaaaattatttttgattcaatctagagaatgaaaaaaaagagttacgaccatgacaagttatttgttattcaaaataaattttgttgaaaataatttaatgttcagaatatttgttctaaaatacatttagaataacaaatcttgaagcgattttacacttcgttctaatgacattaacaaactgaaaagatatacaaatataacgtttagcaatctttttacaaaaacataaggttatacttttcagctaataagagtagaagttattgtaatgatttgagaacaacatgtattttcgtgatgctactaaattaatatgttttgagagtttatgaattttgagagtagtgttgttatatgggatctgaagcatccaacatagcgaaacatcattcgttccatttttttcggtggcattctttcgaatttgcgtcgagtgtcacttttctatctacataaaccaaaattctaggcactgaatgtcaaaaaaaaaaaaaaaaaaatctaggcactataataaatgcaaggaggatgtatagctgatatatgatcttacaaacaaaaacacttcgaacaaaggcgagaacaagtaattaagcaatgtcaagagcttgtggcgcaaacgtaatgtttttttaataatggcatgttattttttgttcttgacgaattccttaaattgacatgaggataacatgcacataaacaaattgtccttctttgaatcattctgaaacttctcccttacacttttctttgaatgtaaagagtgattcttacatgaaaacaaagagtaataataatactttacaactatatcaaatcaaagatttgaataagcattttataaatattggataaacataggagagttttatcaacatccctaattccaatcatacatcttccgcatacggtgtatcaaagtactgtgatagatcccatcttcttgagcaacataattatacgagccaccatgaggcattctcttgtcttgaacatatgcgtcaaacttcttttgtaccttgtaatcagctcctttatacattgtacaccagaaaagtgtttctcccataacgtcatcgtggaaactaaaaccccaatcttctccaggtttcatatatctttcacgaacatcattgtccccagatttacaacgtaccttgagccatttgttgtgagaaagactgttcctgaataacaacgacgtcttttttcctttaaatggattcgaatggccatatgcattgctaatcatgcatagggcaaagacaactagaaagattgaagtatttttcattttttctttctagatgcttagaggttttgtcatcggagtaattttttatttacggtattgtatatatagacatatatgtatgctatttttgaatttacgttcttattatatattgctctcttattattagtattttctattaatgatttgcggtatcaaatcgtttcaaacacaacaatagatatggatggttgagtggagaacaatatatggatttagatctttgagtaaatatttccaaagaacatttgttttcaacacggacagtaatttgacgtgatacatttaccaaatactacctattatattctgccaattcgttacaaacagataaataattcgattagtatatacatatctatcgtttaattgtgataactttattattatattaacactaaagttgattaaaatcgtcttgatttcgattagatgttttattttataacattaaacacacatatttaaaagatgagaaattaaattgtatgtatatggaattttaacattaaaaaaaaaatccaaatgaccaatccggtttatgtcggtccggtttgtattaaccaatcttaatttcaatttttaccatataaacctaaccagactattacaatg

SEQ ID NO: 18382 - DNA, 3003 bp, Unknown
  misc_feature (1)..( 3003): 2750-1469P.txt file - cDNA_ID_1817171; gDNA_ID_1621135; Annot_ID_172628
ttaggaggagcttttgtttggtttgtgaaacattggagaaagttttggtagattgtttcaggcggaggttcgacggcaagagaagtagagatgaaggaggagattaagaagagaattaaacaaaagatcttcatttttttttttttgattggattctatttggtgttttctgtagtataaatagttacatgtagtctttaaatttctgttgtgattcttatcgttggccatttttaggatttgttgtattggtcaaggtttctcctgttttttttttttttaatggtttaattgctcaagattttaatatagtcaagttaactatagaaagatcacaagtttcagaagtcaagttaactttagagattttaatatagtcaagttaactatagaaagaacacaatttgtttgaaggcattgtgagaaagataaatttttagaggtattggattaggttgttttgggaagagaataacatgtctttcaacctttatcttccttttttttgagggatcagttatttttgttttcatattagaacttgagatattaatgttctataaaacggtgaataaaagaccaaaaatgttttatactacaaaacaaaattatttttgattcaatctagagaatgaaaaaaaagagttacgaccatgacaagttatttgttattcaaaataaattttgttgaaaataatttaatgttcagaatatttgttctaaaatacatttagaataacaaatcttgaagcgattttacacttcgttctaatgacattaacaaactgaaaagatatacaaatataacgtttagcaatctttttacaaaaacataaggttatacttttcagctaataagagtagaagttattgtaatgatttgagaacaacatgtattttcgtgatgctactaaattaatatgttttgagagtttatgaattttgagagtagtgttgttatatgggatctgaagcatccaacatagcgaaacatcattcgttccatttttttcggtggcattctttcgaatttgcgtcgagtgtcacttttctatctacataaaccaaaattctaggcactgaatgtcaaaaaaaaaaaaaaaaaaatctaggcactataataaatgcaaggaggatgtatagctgatatatgatcttacaaacaaaaacacttcgaacaaaggcgagaacaagtaattaagcaatgtcaagagcttgtggcgcaaacgtaatgtttttttaataatggcatgttattttttgttcttgacgaattccttaaattgacatgaggataacatgcacataaacaaattgtccttctttgaatcattctgaaacttctcccttacacttttctttgaatgtaaagagtgattcttacatgaaaacaaagagtaataataatactttacaactatatcaaatcaaagatttgaataagcattttataaatattggataaacataggagagttttatcaacatccctaattccaatcatacatcttccgcatacggtgtatcaaagtactgtgatagatcccatcttcttgagcaacataattatacgagccaccatgaggcattctcttgtcttgaacatatgcgtcaaacttcttttgtaccttgtaatcagctcctttatacattgtacaccagaaaagtgtttctcccataacgtcatcgtggaaactaaaaccccaatcttctccaggtttcatatatctttcacgaacatcattgtccccagatttacaacgtaccttgagccatttgttgtgagaaagactgttcctgaataacaacgacgtcttttttcctttaaatggattcgaatggccatatgcattgctaatcatgcatagggcaaagacaactagaaagattgaagtatttttcattttttctttctagatgcttagaggttttgtcatcggagtaattttttatttacggtattgtatatatagacatatatgtatgctatttttgaatttacgttcttattatatattgctctcttattattagtattttctattaatgatttgcggtatcaaatcgtttcaaacacaacaatagatatggatggttgagtggagaacaatatatggatttagatctttgagtaaatatttccaaagaacatttgttttcaacacggacagtaatttgacgtgatacatttaccaaatactacctattatattctgccaattcgttacaaacagataaataattcgattagtatatacatatctatcgtttaattgtgataactttattattatattaacactaaagttgattaaaatcgtcttgatttcgattagatgttttattttataacattaaacacacatatttaaaagatgagaaattaaattgtatgtatatggaattttaacattaaaaaaaaaatccaaatgaccaatccggtttatgtcggtccggtttgtattaaccaatcttaatttcaatttttaccatataaacctaaccagactattacaatgaagaagaagaagaaagaaagtgacacaaatcggactctccgttcatcgccggtaagtttctcctctttatctccggcggttttgggctgatttttttagattctgtctaaaactgctctaatgattcaattccttcacgagtttacggattctatgccgtgaatttgaaccctaggtttgcgaaagcaatcgcgagttttgcaatttcgttaaatttctgtctcaaagatgtaatctttttgatcatttagcttccattgctaccgtagcatcttattctttccctgaggttttgagttctctcattctatgtgtagcgttaacgagaacgaattaagattttttgaggtttttagggtttcttatttccagatacttttgctgggatcttacttgattccttttgcagttttttcttgtttaacttgaaatctcatgattgatacttggtttgagcagttatttgaaggggagggatcaaatg

SEQ ID NO: 18383 - DNA, 3003 bp, Unknown
  misc_feature (1)..( 3003): 2750-1469P.txt file - cDNA_ID_1817179; gDNA_ID_1621135; Annot_ID_56539
taatgtcaaaggacatttactaatcttggatccaagaacacaacatagccacagacattattaatgtcaaggggcataatttagtactcaatcatttcttaatttcaacaatcaacagaacaaaagttcaagatattttaatacaagtgtaataaactataacagaaatcagcaaagactttctgtaaaaaccatgcaaggacataatcattgtaattcttcacacaaaatctaggctatcagtaagaatctatcagccacattatctctgagcgtatataccccaacaaaggatcctacagatcaaaattcagctaaacaagatccaaaatttacaaatttcgaaagtgaaatgatcgtcagaacacaagaaccaatcagcatttccataaaccaacatgttcgatgaaatcgagaagggaaaggagatgactcactaggaagcatacttaagtctctgtgaaaagaaagagattgagtctcctgagtcaaacccaattcatcagaggactttttgagctcgcggctaaaaggaatctcgccttcaatggcagtgacagctctctgagaagctgaagaagagcactcccagagacagaaacgacggcgtttatcagcgtcgaattcagcgagacccatgagaggagaacgatgatgagtcgtttggggacaaacccaaatgggaaaacacctcagagccatagcaaagcagggagattttttcagaggactgaaatcgagcaatgtgaaggtgagattttggaggaattaggtcaacaaaagtctcaatggggaaatggggttggtgagaaagaatggagagtcatagagataacgtcaagtcacaacaaaaagtctggatttctggaaggtctttcaaagaagagcaaaactcagaatactcttactcagacggaaaggtccacactttgcaagacgttacttacatttcatacacacatatatcatttttttattaattaatttcaccgacaaaaaggtctgttgtttgttttttttctgtcaacaataaatagttttgatgacgcgtggatatttatttgggtgaattagctgtgtagccatatttcgacaaaaaattaagattataaccatataatttacgtaattcagcaagtaaccaaaaactctaactaattacaagtctattcctgtattatttccctattttccaatttgccatgactcatcatcttcttcgttttgttgatcagatattgatctaaaggtaatattccatatgttctaaaggtaatggattgtgaatcagatattgatctaaaggtaatgtttttttaacaaacctttttcattcatcatcttcttcgttgcttcttctcttctctccaatccaacagaaaatttccagaaaatttaactttttttatatcaattcattctaatttaaaacatctattgatttaagaaaactaaaccctaagatactatatatagaacccaaacaaaaataattaaactaaataaaatcatctcaagtttcagtttttagaaatctgacaaaatcatgtttatatacttttaatctcttttctcctttccttaagcgaattgaaatcgattcgattttgggtttaaatttgtgttaggaattttcaattttagatattgatcaaaccagaaaatattcaataagatcttgtgagtctttgttttcatttttcttcgttctaactagcaaatagaatggtacaaaattgaaagtaaaatagaaaactatagttcggttctgttttaattaagttaaagtagaaaaaaaaagatgagaggcgagagagatgaaacaagcaatggaagagaggaagaagtgattaaggtggtggtggtgtgtatggtgtgtatggtgtaggtcgtagtaatatttgtgttggtggttgcagtggtcgtgtgtcaattgcggccgcaataatggtgatggtggtagagatgacagcgtaatggttgtttctatggtggtgacgattgcagtggtgatggtgatgatggtatgacatttgtggaaataatggtggatgcgatgatgacgacggttgcaagggtaatggttgtaatagcatagaagagatggtgattgtgtagataagggtactttagtatatattatagtttatatacaaaatatcatctctgttttttttgttggttagtttcttaattatagttattttgttaatcaattttgcaaatttccctatttattttgttgtaaagtaaatggagtcctttcacaattgtttcaaaggatttgggccaaaagagttcctaaattttttaaaaccttcttgagaaaagttttgtggtaaatttggaaatttgttatagactatggtatatgtaattaatttcttgataaatggtgaatgaaaaaggttcaaaataattatctccaatattgttatcatctctatttatgaaaaaaaatattttgatgtccacatttgctatacatgaattggccaccaagatcaagggtaggtctaaagctgaccattaatcaagtgtaggtcttagataatgtaagcaatgaatttctcttacatatatgatatatttttacaaaaattagcaaattatttagatgactaagtttcacaaattaacaccattgatttaatagcttatgagagtgtttttgcatccttagaattaattaataccattgacatttaattttatcagtttttagatgaaagtgttacaccttagatttttcttttatttttttgtaaactttccaactctgattatgtccaatggccaaaaactagaaatgcagggttcaaatgttcaatttttcaaaataaattattggtctatttatacacaaaaaggtattataggtctaaaaaagaatttaggaaagactagtgatttttattgcaaataaaagaaaataaaaaaataaactcgggttggttgctcccccagccggagaataatcgtcgactggtgaagaagaagatg

SEQ ID NO: 18384 - DNA, 3003 bp, Unknown; identical to SEQ ID NO: 18383
  misc_feature (1)..( 3003): 2750-1469P.txt file - cDNA_ID_1817179; gDNA_ID_1621135; Annot_ID_172624

SEQ ID NO: 18385 - DNA, 2264 bp, Unknown; identical to SEQ ID NO: 7284
  misc_feature (1)..( 2264): 2750-1469P.txt file - cDNA_ID_1817193; gDNA_ID_1621137; Annot_ID_56577

SEQ ID NO: 18386 - DNA, 2264 bp, Unknown; identical to SEQ ID NO: 7284
  misc_feature (1)..( 2264): 2750-1469P.txt file - cDNA_ID_1817193; gDNA_ID_1621137; Annot_ID_172724

SEQ ID NO: 18387 - DNA, 3000 bp, Unknown; identical to SEQ ID NO: 5900
  misc_feature (1)..( 3000): 2750-1469P.txt file - cDNA_ID_1817193; gDNA_ID_1620824; Annot_ID_169620

SEQ ID NO: 18388 - DNA, 3003 bp, Unknown
  misc_feature (1)..( 3003): 2750-1469P.txt file - cDNA_ID_1817197; gDNA_ID_1621137; Annot_ID_56576
taatttttttttttttttttttaattatattcctgtataattatattttgattgtttattttaggatttcacccatgttatacatcttgtattaatatcgaccaacccgtgctaccatataatatgtcccgtcaaattgaacaccatattttttttttttttttttttgaagattagctgaagatataacatattaatttggttttttttttgaagattagctgaagatataacatattaatttgtcttatttaaatatagatatatatctatgtattatttagtgtatgattagtattgtttaggtttcaatatttaaaatttagatacgaaacatacagttcattaagtaacgatgtagcagattttaaaaattgattttttttggttttaggattttagtatgaaaatattaaaagtatataggaaatggtatgtacgtgaaataaagaattatttgttttttttttgttccatatatactaaatattattaaaaatctgtataatatcttgtatttaaaatttaaaatctaaataattagtgcattattctagctgagattgatccgcaatatacgacgggctgtttcttaaaaatttttgttatttataaacttatgattttgttgtatataaaattaaccaatttattgtgtatgatttttaattcgatgtaactcttatatttaaagtatagtattatttagctttattatggctgaatatttatatgaatatgtttttgacctgatccatcaaaatcaagaggttttaacccccatggcaaatatttagtttttgtactttagattttaaaaataaaatttaatatatgattattatttttagatcaaagtaaatatagtaattttaggttctattttatagtcaaagttctaaaccattcacgtttgtttaactattattttatttttttcaacgaaaaaactttattgaataaagattattaggtccgatcataatacaacatatcataaatctaaatcaaaggactcaaacaatccgagaaaaacatagaatctatctaacctttttctgccaacaaatgagctaactgattacacgatattttagtaaaagagaaaaagatatttctaaacttggttgcccaaaagtgaatatttttgcgtaaggcttcggtaatgaagtccaccgtaagaaccttgatgatgttgatgagcgcttcagagtctctatttttgataaattgatgtatagcagtcagaccacacttgatgcattgacattagtagagctttagcttcagcttccggtggggtacgtacggctccccatctttttgcttcaccttgacatgtatatttaattttttacttacataaacttctttacaaaataaaaaaaaacagaaccgcaaatacaacaaaattaaacacacgtatatatacacacaaacgttcatatatgaatatctaaatagtttggaacaataatacacaggtcgttaccaaaaagaaaaaagaaatacacaattctcaagtattgtgttctttaatacagaaatcaacatcaatacattgacatcacattcataaagaagggtaatacgtacaaaaaaataaaaaaaaaataaaaagaatgcccatgatgtgtgtgtttgataatgtgatgggagataaacatatgtagtatatataggcttggaatgattaggtcaatattttggtgagcaagcaaaattaatttgcgatcttaactaaaatggaatcaaatatacgtaattagaatattttaggtatatgctataaatgcgatttgtcataataattaaaattttctataaaatcttatgtataaatattttgtagtgtatagcaattagttatgtcgagatattttagaaagatttttccgagaatattggcaaagatttgggaaataatttgatgtggtaagattatgatattgtgaggcactaatattccttaaaatcaagtatatgcttattttaaataaatagaaatgtagatatgagtagttgataaaaaatcaaattgttgatattctcatatatttcgaaatgaatgtatattattgataatagtggaaagttttaatggcaattgtttagcgttaatcgttttgtattatacatttttggatttactaatcaaaccggaattattgttgtaattgataacaaaagaataaattttggtaagatttcattagcatttaaaactataatgatttccgaatctaagtaattatagatatggttagttaggatttagtatcaaatttagtaattaggaattaatgatttgcgaattacgtagagtttatagggattgatttgtgcaatttattagggtaataattaacaatatctatgtttaggcaagtagttagtgcaatatcataatagttaaacaaaagtttggtcattgtcctaaataaaatatcttgtttgattgattttatagggactaaacatacaatatcaaaattgaaaaagaatttttctacacaaatcgttccaaaaatgtatatgtagattcttaatataaacaacaattattcacttggccctaattaaaccatcagcccattaagcctcttattaccaaaacccttcaaacccaacttctttccttcttgttgactttccttcttactctgtcgttgactctctttgcgacttcttcttctcttttcttcatcttcttctccctgattcctttttcttttgttgcaggactaaaatcccaacacctccctcctgagttctttgattaaatccccaatttcaattttagggttttgattcccattgtttcttttgatttatcttcattccggaaattgctccggtgaaacagcagccaccgccacatctttctccttctccggcaagcaacttcattccggattttcgtctgagacttcattcttgtctccctcttcgaccaaactgacacttattccgacaaaaccctctgattagaccgtcggaatg

SEQ ID NO: 18389 - DNA, 3003 bp, Unknown; identical to SEQ ID NO: 18388
  misc_feature (1)..( 3003): 2750-1469P.txt file - cDNA_ID_1817197; gDNA_ID_1621137; Annot_ID_172723

SEQ ID NO: 18390 - DNA, 3003 bp, Unknown
  misc_feature (1)..( 3003): 2750-1469P.txt file - cDNA_ID_1817208; gDNA_ID_1621137; Annot_ID_56573
ggaatttaatatccttgtacgacttcgtcttgcagggttaatctctcaagcagcaaagctaggtgcacaaggtgtgccctcattccggtcattttcttttgaagagttaaaggaagccacagacgatttcgattcatcacgtttcttagctttggaattatgcaggaaaatggctaaaacagagggcgatgtgtacaactttggattcatacttctggaatctctgataggaccagtacctactacaaaaaggagaggcctatcttctcaacgaaatggtatcatatagggtaaagaaaagaagcaaatcttcatcattgttaatagctgttgctgcaatgttgtatttgcagacgtcatttgggagccaagactgtcgacagaaaataggaagtccaacggtcctaacaacaagctcgcaggagtctttacccaattgccatctcaatcgccaataaatgtgttttgcttgaaccttctgcaagacttcctttaaagatgttctctggaacttaccatatgcagctcaaatgcagtctgccgcagacgctgaacgcaaatctgataagtcgtcgtgaatccaaaggctaacctgatgattgatagttgttttcggatttataaatgttatgttttataagtttggtttttcagtagaaaaatgtaatactctagcggctaaaaaacatagtttcttgtctctcttgaaactttattcgtttaacaaatattgattgaagaagatgttgagttttgtagttggcgagaacttctcaatcttcaagaacaaggtactgaggcaggagacttgtcaaatgttcttggagaattttgtctttgaattgcagaatcgatcccaaatattttattattataaaagctacaagaatacagtttctaatacatgtattagcaaaaaagtaacagtaaaaccaagggctacacacttttcttaaacaggaactttggagtccactgatttgagaacctcctcacccatttccttgcatcccaccagtttctgcattttcaaaacacaaaaagacttctttaagtatattgtcattaacttatacaaaacaaaagacagaaatcatcatacacatacatttccgggggagtagatgtctccggttctgaaacctttgttcagagcatccacgaccgcgtcttcaatcatctttgcagccttttcttctccaagtccatacttgagaagcatcgccgcactgagaatggtggccaatgggtttgccttgtcttgtccagctatatctggtgctgaaccatgtataggttcaaagagtccaggtccctagttttcatcacaagtttaacaatcaatatatgataataataaacagaggaaccttgaaatattagatttagtcttacttaccgattcaccaagacttgcagatggaagcatcccaatgctaccagtgatcattgaagcttcatcagacaatatatcaccaaaaatgttattggtgacgattgtgtcaaactgcaataatgtttttaaaaatgccgtgagtactacaagttccacttctgtgttagcttaatcaacggctaagctttatatatgcgcgaagatcacctgtttcgggtcacggacaagctgcatcgcagcattatcgacatacatatgtgatagttcaacatctggatattcagaggctaaagctgttactcttttcctccacaatattgatgcctatacgaaacaaaacaaaaaaataattgtataacgaaaaacacacaagagtggagtggaaaaacaattcaaaacatacatccaagacattggctttgtcaacagaacacagcttgccacgccttttcctagcagtctcgaatgcaacacgagcaattctgtcaatctgaagaagataaagcaatgcattaatacacatacattgtcacagagcagcagattgtgaagagtaagtagtacctcgtgagcagcgtagatctctgtattaaaaccgacttcttcgccattttcgttgatcgtaatgcctcttggctctccaaagtaaatacctccagtgagctcccttacaatcatcatatcaacaccttgtgctacttctttcttcagtgtggaagcatcaactagctgaacaagcaaaaacagaaaaatttgagtatatttacaactagaaagcaaagtgataagcaaatcaatacctgtggtaaaactgtagcaggtctcaaattagcaaagacattgagatctcttcgaatgttaagcagacccatctcaggtctcagatgtttctcattcttgtcccatttgtacctgaacaaaaaatcatcataaagagaataaatttgctgaagaaacaacacacacacgcattacacataccctccgatagctccaagaagaatggcatcagactgtttagcagcagtggaagtttcctccggcaatggaactccgaccaaatccaaagctgctccgccgaaaggcatctcctggaaatcaaactctagtccttggagaaatccagctttctgaagcacattcttagcaacagatataacttctggaccgataccatcgccgggaagcagagtgatgttataccgttttttcaccggtgaagcggcggcgcacctaattcgatacggcgcacgaaacttatgatcggtgagagaactgtatcttcccggtatgatctccagacggatgttagtttgcaaaaacgccgccatctttttttcgagtttagggcaccaccatcggcaaaaactaaccatttgagtatactacagagaccggttatctctggttatttgttaacctgattttggttcaatgttctcattaatttcaattttaagttctatcagctttttggactctctcatgtccaccatccgttcacttggccgcgttcatataaaccaaaaaccgaacaacaacaaaaattcgaaaattctccggcgacaccaacaatgggaaggtctctaatattctctggaaacatg

SEQ ID NO: 18391 - DNA, 3000 bp, Unknown; identical to SEQ ID NO: 7281
  misc_feature (1)..( 3000): 2750-1469P.txt file - cDNA_ID_1817235; gDNA_ID_1621137; Annot_ID_56563

SEQ ID NO: 18392 - DNA, 3003 bp, Unknown
  misc_feature (1)..( 3003): 2750-1469P.txt file - cDNA_ID_1817265; gDNA_ID_1621138; Annot_ID_56590
caagcgtttgttactcacttcaagctccttagctttgttctcatgatgcaacttaatagcctcataagcttcctcagcatgcttaatcctctcctgaagactctcataatctttcaacagagtctcatgattctccttcagaatttcatgctccaaagtcatcgttttctctaaaccaaacatcatcttcttctctgatttgtcctaaacccaaacctgaaacaacatcaaccaatttctacagattattaccaaactcataagcttaatcaaaaattctgcaaaaaccctaaatatccaagctttatgttctctttatgactgaaatgcaacgaagatgagaattaaaccagatttatgagctcagattgtggaaatcgaaatgggtttcggaggattcagagagaaaatggtgagtaacagggaagagagagtgtggttaaaactcagattctttcaagcattcaacaatgtaaacagaatcagatagaaagaaatggaattttctcgagaaaatcttaccaggattgcgaacttgaagaacctaaagagagaagaagacgaagaagcaaagtcctcctaaacgttggttaatgataacgtaatcgaagatgacagataatgtttgtatgtatttaagtaatattattcaaattaattaattgtttattccatgtgaccaaaaaaataattaataaattgttcattcttaagctaatttaacccaaacctttttttaatttaatccaaaccttgtaactgatgcgatgttttttttactagaactttaattttctgtttttaccgttttatatatggcattcagtaggtctgggtacgaaacggatatccggaaaaattgtgatatttgttattcgattcgttttaaacgaatacttgattttgtgatttgctttgctttgcttcgaaaatttccggatatccggaatttcgaatatccagaattttttgtgatatttgcggatatccgctttgatatatttaaatattaaaaaaaatctatatactatataactatatcagatattcaaagtttttatttaacatgctttcaaaataaaaactaaatacttgttggtaccaccagtctacaaaatgttatcaaactaattccgaaaactaaaacccgatagtttttgatgtcgttgatcaaaacataacatgagaaaaatgatcaaacaaacattttaacataaaaacgtaaaatagcaacaatacacaaactattatgatatatatatagatataactatattttctaatatatatataaaaagatacggatcgaagcggatattcggttttttttttttaaaatttgttatttgattcggtttttacgaatactacattttcctatttgctttggtccaaaatcttacggatattcggatttttcgaatcaaaccaaatcatataccgaatcaaagcggatcgaacgaatattttgcccagccctaacattcaggttaacaacagaaattaaaggtattctaacattgtaacattaatgtatgttttcgtataaaaatgaaagtttaaatatcaaattgaagtttaggttaaatcaactgtggtataatacgtgtataaatgcagcatagttcaaactaaagatatgaaaaaaccaattttccgttttttacataacatttgtgcaaattcctatactattaaaagagaaatataaatttgtttcaatttgaattggatcgggttatgttaaaaaattaacataaattgacctgaaatttaagtaattggatttttggcaaaacaaaattcggaatataatatgaaaatcaatgtttttaaacccgatctggacagtgaaccggacaacagttttttttcttctacgcatcgtttgtttgtattatttatatatatatatatatatagtgatatgataacttccctaaaattagctgaataattaaatgaaaaaaatttcagttgatttaacattgaatttttttccttgttttttttaacccatttctccacatttttttgtagtagtttagtttcgtaatttctgcagtcacaacttttagtaatgagttataaacaattacaatcaaggtttttatagtaaacacatcttttactaaaaccacgtagaataattggaaatcaaacataatttttctaaagctcctaaatttttttagtttgtccttagaaatcaaatatatttttgaatcttttttatctaattaaccgcaatatctataatctgaaagtgttaggaccgattggtaacaagtgttatttctaactatatcaattttggttgtagaaaattttggtgtaaggaatttgaccgtagaaaatatagagacttttgcagttaaaattgcagatgtgaaaattttgaaacaattggtaaaaattatgagtttagaaattaaaactttaaataatataaacgattagattagttgtgacatatgcgatacaattttttttcatctctactgaagagatcgtttttattgatattgacacaattgatgacggtttcatatcattaaaaatgataatttagagaatgttttttccgattttaaatgatgctttcaactttcaatataaaagttaaatgtatttaatattttttgaccaataatattctatagtatattttttattggttgacttagatatagttacttatgcaaaaaaaggtaaattaaactaaacttttgtaatatgtgtaaaaaaccttaaacattacttaaaatcagagagagaataattacggttgtttagaatcctcattaatcattctctgtttcatttattaactttctgtatatcattaaccccacaagcattaaattactcactaatctttttggattctattattcattggtttatcgcttaggcaataagtacggaatcaaaaacattccactttctgaccaaaaaaaaaaaatcgtatatctctcagcgcgagggaagaagaagaagatg

SEQ ID NO: 18393 - DNA, 3000 bp, Unknown; identical to SEQ ID NO: 4539
  misc_feature (1)..( 3000): 2750-1469P.txt file - cDNA_ID_1817265; gDNA_ID_1620713; Annot_ID_49052

SEQ ID NO: 18394 - DNA, 3003 bp, Unknown; identical to SEQ ID NO: 18392
  misc_feature (1)..( 3003): 2750-1469P.txt file - cDNA_ID_1817265; gDNA_ID_1621138; Annot_ID_172749

SEQ ID NO: 18395 - DNA, 3000 bp, Unknown; identical to SEQ ID NO: 4539
  misc_feature (1)..( 3000): 2750-1469P.txt file - cDNA_ID_1817265; gDNA_ID_1620713; Annot_ID_165525

SEQ ID NO: 18396 - DNA, 3000 bp, Unknown; identical to SEQ ID NO: 4539
  misc_feature (1)..( 3000): 2750-1469P.txt file - cDNA_ID_1817265; gDNA_ID_2926152; Annot_ID_139340

SEQ ID NO: 18397 - DNA, 3000 bp, Unknown; identical to SEQ ID NO: 4539
  misc_feature (1)..( 3000): 2750-1469P.txt file - cDNA_ID_1817265; gDNA_ID_2926152; Annot_ID_198129

SEQ ID NO: 18398 - DNA, 3000 bp, Unknown; identical to SEQ ID NO: 7300
  misc_feature (1)..( 3000): 2750-1469P.txt file - cDNA_ID_1817277; gDNA_ID_1621138; Annot_ID_56585

SEQ ID NO: 18399 - DNA, 3003 bp, Unknown
  misc_feature (1)..( 3003): 2750-1469P.txt file - cDNA_ID_1817277; gDNA_ID_1620713; Annot_ID_49056
gttggaaaaagaaaagaacaaaccttagatagaacacattctcagagagattgcagtagaattagacatttctcttgatcgaatttcgattccgaaacacaattgagaagattcacagcttcttgtcgtcaaattggtaggggaagctttttctccattatcataaaccctaaactaaaagtttctgcaaaaacaactattttatcgaactcttaatgggccatcaatgggcccatacttataaacttaaacccttttccaatttcagtcgtattttacaaaaaccatcaccgtcgttatcacagtaaccaaacaactttcatcgccgggtaagctccattcccaagctatttcgatctcgtttcacgtcgatctatttctagtcaagttaatctcttcttttagggtttaattagttaagacttgcgtttgattatctcaagttcagaatttgtttcttgatgatctaaaggaaggaattttatacttatcaaattgaggatttttgtttttggatgcagagaactgattaacatataagaaaatggcgtttgctagagcagtgagaagaccaattggagtcttttattatagtgttagtagtagatttagttctggaaatgagtattctactgtggcaagcaaattcgaaactttgtctcagtacaaaagctctgtaccgtctggttacacaagccttgttcgtggttttgggaatttcatacggagttttagttcggaagctcctcctgctgtatctgaccaaatgagtcttattaagcaacttagggaaagaactagtgctcctattaaagatgttaaggcttctttagttgaatgcaattgggatcttggtaagaatttggtttaggttttttgttttggtgaaggttgtgtatgttttgttgtgttttgaagtgggtttttttggatttgacacagaggctgctcagaaggatttgagaaagagagggaaagttttggcttcgaaaaagtcgtcacggactgctgcagaaggaatgcttgccgttgctcaaaatgaagggaaagttgctgttattgaacttaactgtgagactgattttgttgctaggaatgagattttccagtacttggttagtcccatagcaatttcacattggttgttgctgaatgatgggctttttgtttattttactgttccttgtcttctaaaattgacatgtcttgcaggctttagctatggcaaaacatgctttgctggttgagagtagttcgcagcaagtttctggtgtcttcccctttgggccggagctttttgaggtcagttttttatgtactcgcttgtttccttttttgttatttaaatttatggatttatgttgtttcctttgcactgtctgagatattgatatcaacttttcatttctaatcactctaatggatgctatcaggagttcaagcttaacctcgatcatccaaaagttaatggtgaaacaacggtttcaaacgctgttacagaagtagctgcaatcatgggagagaatgtaaaatttaggagaggtttcttgatgtcaaaatcttcagcaggcgtcctttctgcatatcttcacacaagtcctcaaccaggtacaatttgttcaatatacttcccattgtttctaatctctttttttatgatatttctgtgcatttctaactttaaaaaaaaaaatgagaatagggttgggtcgtatagctgggattgtatctctcgaagtagaaggtgaaaatactcaactagaggctattcagcgtgtaggctcagaactggctatgcatgttgtagcagcaaagcctttgtttttaagcaaagaccttgtttcttctgaagcaatggcaaatgaacgcgagattctaaagtctcaggttagtgtcactttatgttatgaaattgaactgtaatttgtaaaaagtacacaacctgcgttagaaaagtttgcttatcaaatgttgtatatgacaggcagaaagtacaggcaagaatcagatggcgatagagaagattgtggaagggcgtctccgtaagtattttgaagaagttgctctaatggagcaaaagtttattgtgaacgatgctataaacattaaggtatgtgggtcttagcttaaaacacctagtttaccgttttattacctctgcatcgcttgttgaattcaactcttgggctcctattccacagacactggtggataatttgtccaaggaggtaggttctccagtgaaggttaccgattttcttagagtcgaggttggggaaggaatcgaaaggtaaactaaccgtcacccgtatgtccagtacggcttatcattgttgtaagattagtcgcttatgaattttgttttttttgaaggcttgaagcatctgatgaaccagttgctcaaactgcttgaagacaaagaatcaacgacatggttttagatttacagaactctttccttctttggttcctttagagttcatggcttcaacgccttcttgagattatagaatctttctcatgattttgtttctcacacaatatggcaataagagtgattgtgcctaggaagctatgaccagaaaaaaaaaacatgtttgtgttctcctactcctactaagatcattatacaaaaaccttcacttatgtgtttgattttaaggtactcaagtatttgaataagcagatagtgagttcttggctcctccggttaccaacggtcgaaattgacggtttaatataattcatagacaaaaccggtcaactttatattatccacaatcaacgatcaagatcaacgagaactaatcttacggttgatatcatacatctgtattgagttacagtacaccacaaaacactcaataaacactaagcactcttcttctaccttttgattttcgaaaaacgcaaactttctgaaaaagcaaaaacttctgattctctcgagaatcatttactcttcacactgtccccgtctctctttctcttgggttaatcatg

SEQ ID NO: 18400 - DNA, 3000 bp, Unknown; identical to SEQ ID NO: 7300
  misc_feature (1)..( 3000): 2750-1469P.txt file - cDNA_ID_1817277; gDNA_ID_1621138; Annot_ID_172743

SEQ ID NO: 18401 - DNA, 3003 bp, Unknown; identical to SEQ ID NO: 18399
  misc_feature (1)..( 3003): 2750-1469P.txt file - cDNA_ID_1817277; gDNA_ID_1620713; Annot_ID_165531

SEQ ID NO: 18402 - DNA, 3003 bp, Unknown; identical to SEQ ID NO: 18399
  misc_feature (1)..( 3003): 2750-1469P.txt file - cDNA_ID_1817277; gDNA_ID_2926152; Annot_ID_139344

SEQ ID NO: 18403 - DNA, 3003 bp, Unknown; identical to SEQ ID NO: 18399
  misc_feature (1)..( 3003): 2750-1469P.txt file - cDNA_ID_1817277; gDNA_ID_2926152; Annot_ID_198134

SEQ ID NO: 18404 - DNA, 3000 bp, Unknown; identical to SEQ ID NO: 7297
  misc_feature (1)..( 3000): 2750-1469P.txt file - cDNA_ID_1817285; gDNA_ID_1621138; Annot_ID_56582

SEQ ID NO: 18405 - DNA, 3003 bp, Unknown
  misc_feature (1)..( 3003): 2750-1469P.txt file - cDNA_ID_1817285; gDNA_ID_1620713; Annot_ID_49059
acttgttatgatccatcactcactgtctaggtttacttttttactttggttctctgattcactcattgttgttaacagatccgtaagtcgttgttcggccaagttactgcctgatgaaagaaaggaaaagagaaaagagattattcaaaccggtttgcgtttggttatttacctattttgggagagatttctctttgttgtgattctttgtattttgcaaaatcttactttggtgccaaacccatcgaacgcttctttttttcgaattcctttttttcattcctcctcgaatgtgtgttatcatggctatacaaataaataaaatgaaagacttcttttctttttcttcactttttctattcaatgtctatgctttatactagtggtttttcgtcatcatagataaacacttaattcataaaaagacccttgaatttttattataaggttagcaatttatccaacacgatcctgaaaatcgtccatcctagtatttttttcgtctaaacacctttaattgcggagttttgataagtttttaacagaaaaaaactcgaataagatatttttttggtttgggctaaaattgttatagacttggcccttgggttttatcccaaatacattttaggtatcacaaacaagaaaaacatagaagtaaaaaactagaagttttttgcgcttttgatctttgtccttttttctacaagttttttctccagactaatctcctcacgattgtctgaagacaagagtctacaagaccggagattcaccgttcgacaataatttccgtacctttcaaggttagatgttcttgcgcttaatttgacttgtgttctttttgtgaattttggatgcgcgcacaaggtgtttgttcatttgcctagacaaagtaaaattgatttagttattcttctcattcatcttctatagtatttgtacttgagccaatcattattcatctttggtgcaatctgaatctgacccatttgagctgttttgtctccttgttcaaattttgtgtgaatgtgtgtaaagaacgcagaatctaatagaagcttctctttagggtttgggttgttaggacatgcgtttcatcctctcaaattttgattttgtttcttttaatgaactcaagggttagtttgatgcttatcaaattgagggtttttgttttggatgcagagactgatttgacatatgaatgacgtcgaggcacttaggcaagaaggtgctctttttatactctttaccttttttttttagtgaatttcgtcgagtgtttctgaagaatttcagcgaaaagtttgtagctttagcttccatttcgttactattttctggtatttttcccaagatatgcatagctttaatgcaaattcttggtgtatttatgtttgctggtttgattagaagttatggatgatggatgattattaaatgttgtattcttagttctcatgctgtttatttattggggtttaggcctttagcttggatttaaaagtctatctgacattttatagtgaagcaaatttgcatatgtatgaatgtgactagacatacgagtatgcgtttatcattgtctaagctattggtattttaaattcttgatgtgaaatattactatttcggctgtctttcgaattgttgattctaaaaatcgttagacgctactctgccggtgaagtagcgcttagcgcctagacggtcgaaacggggattaatcggggcctaggcgttaaagtaaactataatgaatttatattgttttataagaaattttatgaaatttattatattataagtgaagttgtgatgtgaagttatgttggtcctgtggctttctgctcaaattttattgctacagcccttggttcgatacttttcacgctaaaaaaatcgaatttcccccacttaaatgataggggcaaaattgtaatttaaaaatgttggggtcatcttcttcctcaaaaccctattcgcttgtttgatcgttttttcgcttatactcaatttttttcgtttttatccgcttgtttgatcgttttctcacgtaatcaaaccaaaataacacagatctaccactaaaatacatattcatgatcaaaaagaagataattaagtagattctcatgaacgccgatttgttcaccgattgagccaaaatcgcggcggtccacgcagaaatagcgcttttttcgacgcctagtcgaccgattagtccgatgtttagaagcgtttgttttagagaataattatgccttcatttttgtcaagtttgtttggtttggtgagtagtagttacacaatgttcttattgctttgcatatgtttatggatgtctcaagaaactttatgaaatttgcagggcattcaagcctcttttagaataggtttggttcttcctcgagtagtagcatctacagagagacagatttcctctacggttttaaaaagagcttctgaaagtgtctctttttcattcgctccgtacataaatggtaagtgtcactcacaggcgattacaatttttcttagattgttagaaaatgaattagaataacgagtaatctcacccttttgttcatgtttagggtttggttttagttcgttatcaaattggtctcgtagttatgaatctttccctactgaaacatccataaggtaaaccattcgcctagacttttctgtcatttctctcttaaatttcatcctcagagcactcactatgtgaatgtttgctggcttgggttgtgtttcttcttgaacaggtattttcatgcgagtcgagaaacattggcgaaaagaaaagaggatgctgatcgactgctgagtcatcgtgaacgcaagaaacagactgtgaaaacgaaaggaaagttctcaaaacgggagaaaaaaacagataagccacctgttgaagctccttatgtgcctcctaggctgaaaagattggcaaagggattgcctgggaagactgtcgacatatttgaagggatg

SEQ ID NO: 18406 - DNA, 3003 bp, Unknown; identical to SEQ ID NO: 18405
  misc_feature (1)..( 3003): 2750-1469P.txt file - cDNA_ID_1817285; gDNA_ID_2926152; Annot_ID_139347

SEQ ID NO: 18407 - DNA, 3000 bp, Unknown; identical to SEQ ID NO: 7296
  misc_feature (1)..( 3000): 2750-1469P.txt file - cDNA_ID_1817289; gDNA_ID_1621138; Annot_ID_56581

SEQ ID NO: 18408 - DNA, 3000 bp, Unknown; identical to SEQ ID NO: 7296
  misc_feature (1)..( 3000): 2750-1469P.txt file - cDNA_ID_1817289; gDNA_ID_1621138; Annot_ID_172736

SEQ ID NO: 18409 - DNA, 3003 bp, Unknown
  misc_feature (1)..( 3003): 2750-1469P.txt file - cDNA_ID_1817289; gDNA_ID_1620713; Annot_ID_165538
ctttttgctatttagtcatttaattagaaagtttttgatgttttacaataacttaagttcaaaattttaataaaaatcataaattttgtcttaaatctatagttttatgtatctatattattaattgggaagcattgtgtgaactataaaattgtaagggtagtttaaaattaactaaatgaatttttgcatgggtaatttagtaaattaacaactagtacaactaaataaatatcttggattttgttcttttaaaaaattaaatttaaaatcaataaatttgtaactacccaatattttcagaaatcatttaaaaacgtttccataacatatcagactattttaattcgaattgtatatatgtaaatttatttattttggtaatatgttattagataattcaaaaatttcaatctaatttaataacaaataatcatttagtttagattttaaacaatttccttaacaaaactatgttaattgtttctcattagtacacttaaaaagaagattttaaattatgatttagcatattcaaaagataatttttggattttagatttgtaaatatctagaagatattatgagtatagattaaaatatttaacattttaattagaatttaaatcatataaacttttcaagtatttttttaaacatgtaattttcattatttttaaacaagtaattttcattatttttaatgctatgcatatattcacattgcctcacaatcaatctagaatatcgattctttaaaacaatagatagagattcataagtaaattacttcatgttctaatgagtttatctcctaatattactatctatttatgcgtattcttatggatttttctttcaggctaaacactagattacaagaaactagattatagttatacaatcttaaacaataaacaaaacaaatataacttaatttaattttttatttttaactaaaatcaacaaatttattagtttataaaaaaccaaaaactattactcaaccatataaaaaccaaatactattatactttaattataagaactacatcttatggaaaggtatacactaaaaatcggttttatatactagaatatcataaatatataaatcacaaattatttttaaatatattaatctaacatgtaccacatgtcaacccctcgatttttttatatattacaataacaatatttaaaaataacaaaatagtttttcattttacggaataaagttatatggtggaactagtttgggttgatattaatacgggacaataatctacaagtgaaatcttagaattaataattataacataattatacaatcttaaacactaaacaaaataaacaatatttacaaaacaactatatcttaaaatttgagtttttagttacaaacaaatcgaccaacggtgtaccgcggagtaaattttacattatatcatctaattgatcaaaaatttcaaacaaaaataatcaatttatatatacatcaaactaacaaaaatacacaaattttccaaatatctctatattattccgcaactcgaaacaaatataacaatctatttactatgctaaatacaaataaaatataaataatataaattaattaaaaaaattagctattttatcataaataacactatacactttctatgcatattataatttgtacactataatatctttcactaaaaatgtattccaatacatttcttaaaatatgaaaccccgcacgtatgtgcgggtcagaatctagtttactataattttgaaaacaatactagattaatatgtttttaaaacattaatataatcctaaaactaatctcgtttaatctccgattttaatctccgattttaatccgatttatcgattaatagctagtcccataccgagcgcccgattaacgcctaacgcgattttttaacaataatgatatatatatatatataaatgtatatatgatttatatattctagtgaattttacttgtaaactaaatctacaatttaaaagttaattaataaagtagtttagaagaagaagaagaaattgggttgtcttccctaaagattttttctacatatgttcgtagagaactattttttctaatgacaaaaaaatatttatatttaatatttttaatataggtttcaaaatgtatcattcataaactgcaatactaaatttaactaaaatgaatgaatttttaatttcatgctcaagtctaccgaaaaagataaacaaaccacaaaaaataaaagaatattatgggggtgattggggaggaggactttgaaaactgtaaattctattaacaatttttacagttttaatttatccgatcacacttttttgcttttaataatttaaaaattctcacaaccttttttctcattttgttctttgatttcatgtttttgtttaaatcgcataaatctggctttaaaatgataataaacaaaagtcaatagtttttccttttcgttcttctccatatttatgaaaactcccatagatgaattattcctttttaatttttttttacgtttatttacaattgaagtctttttcttgttttattaagttccatattttcaataattatttaaaatcataatttatgttgtcacaacctatagtatatagttatagtttttaaaatattaaaaattttatagcaaaaatttatgcagcaaaagtctttacagccaaaagtaactttcgagatgcatgttttaatttgtcttatttacttgatgatatacaaaagtcagcctaggcgacctttaatgagatgcatgttttgttgtctacaagggtctagttgcaatataataataaaaatgaaattaccatgtcatttcctagaaaatctcatattacaactttgacacgcaaaggcattccatagattctataaattgctctcccaaaacactccaaacaagtcaatataacaaatttttatcttcaatcctctccccatg

SEQ ID NO: 18410 - DNA, 3003 bp, Unknown; identical to SEQ ID NO: 18409
  misc_feature (1)..( 3003): 2750-1469P.txt file - cDNA_ID_1817289; gDNA_ID_2926152; Annot_ID_198139

SEQ ID NO: 18411 - DNA, 3000 bp, Unknown; identical to SEQ ID NO: 7311
  misc_feature (1)..( 3000): 2750-1469P.txt file - cDNA_ID_1817301; gDNA_ID_1621139; Annot_ID_56596

SEQ ID NO: 18412 - DNA, 3000 bp, Unknown; identical to SEQ ID NO: 7311
  misc_feature (1)..( 3000): 2750-1469P.txt file - cDNA_ID_1817301; gDNA_ID_1621139; Annot_ID_172768

SEQ ID NO: 18413 - DNA, 3000 bp, Unknown; identical to SEQ ID NO: 7308
  misc_feature (1)..( 3000): 2750-1469P.txt file - cDNA_ID_1817305; gDNA_ID_1621139; Annot_ID_56595

SEQ ID NO: 18414 - DNA, 3000 bp, Unknown; identical to SEQ ID NO: 7334
  misc_feature (1)..( 3000): 2750-1469P.txt file - cDNA_ID_1817317; gDNA_ID_1621140; Annot_ID_56623

SEQ ID NO: 18415 - DNA, 3003 bp, Unknown
  misc_feature (1)..( 3003): 2750-1469P.txt file - cDNA_ID_1817329; gDNA_ID_1621140; Annot_ID_56619
ccggtgaaggagatcgaagaaatgttgagtttgaactagaaaaaaaaagagaagcagagagagcagcaatggagggctcacagatccaatttaaggcagttgtcagtaaaatttttttgtgtttgtgcagtgtgcagagactctgcatagagaagagagagagatagagagagagggagcatctctctgaaatcgtttaaaattaaatcatgaaaatagaaataaaaaaggtaattatttttactaataatgctctgagtcaacataattggtgttttctatggaccaatcctactagagcatagattatatgtatcgaatttccatatttgttttgaaacataaaaatatttaccaaattgttactgtcttttttattttttgttggtctcaataaccaaaatattcggtaccaatactcaattccatattcaaaatatgttgtgtgtttttttgttttatggattaaaataaaaggaaccaagtgttttacaagagatgtttagttgtaaagcccatataagcccaataaggatcaaataagaagttccccaatgtcgagcccagtagatgaaatgatagtccacataatgggatgaaggcgaatgagttgatccaaactctcaccaaatcgagaaccaagtttgcatgcactcaccataggagtttattttgtgttttatgtttgacgttctcgggggttttggctatatagaaaataagaagatcaaactaattaactatattaagaattgaatcgctttcaaattgattttttttaattccgtgtttgatcagtttaatttatcctaatcaaatactcataacccatatatgtgatattagaacatgaggtgatggtatactcaactgcttacacctactaactcctaattcttaaaatttgattatcaattacaattaacggttttaattataatgttaaagtccatttcaaattccagtcacaatttttattccatctaaagtaatttgatacaaatttgattttgcttcgaatatggttgttttgtcaacggttttttatatcaaatatagttttttttctcttttcaatgcaatcggttaggtggtatttgatttttccttcaaattgaattttaaaaaattcattttgttcttgatgatacagttcaatttatctgaattaaacaatcttaaccatattgaatattaaaacatgagtattgtatatttcattatgattacacctcatttacccccaaatctctttaatcaataaacttgacatgatcatgaaaaaaaatcattgtttaaaaaaaaaaactaaaacaataaacaaatatttgttttgatagttcgaatataatactgctaatacattgatgagtatttataagtaaaaaaacttgtagaatcttaaaaatatatttagatcgtcctttatcaataaaatttgtacaaaatgcgctttgtaatattttttctttacggttacatctttatattttatttttattttttgctaaagtgaaaaaaatagtgcattctttagagctttgaagaacgttggtagatcaacaatgagtcgtctggaaaacatgtcggcaagagatgcttacagcaatgtgactgatctaaaaacgatagccaacaaattcgtaaacggcgaatattaaattgaaaaaactagtgaattgagtatcacatatctgcgttaacgaatttagtaatttgttggacgaatgtagtaattcgttagatgaatgagatcaatcaagccatttaaaaaaatatatattcattcgcattgtagttttacacataccacctaacattgactataaaaaatatatatgaaaaagaaatctgttgcaagggagactaacctagcccaacaatttttaaagctctagggcaaaataaaaattcaggaccttatattcatgttaaaaaaaaaaatttatatatttgggcatatttatactaaaaattattttgtttgggtcttttgaaattttattaccttgaaaacaggtcatactttacacttaaatgctaaaacattgggctacattttcattttgttatttaaacggaccggtatgagtgagacatgcatgatgatttaagcttatctactcaataggattaggctgagactgatatgattccatttttcgagaccgtgtgaacatagttcatgataactactgtgtagtaaagtagtaacaagacttcaatctcaagttttaatgggttttgttcggtggttcaagcgtccttatcataagtttgtttttctgtcttcactacacacatcttaatattgagttaatccaattaacagtaggcatatatcatatatcatatatcagaacattatttgtgttatgattaccttttatattatcaaagtccctagttaatttggtttgtttacaaagacgattacagtatattatatatccaaacaaaatttgtaatgatgataatcagcccagtatggttcaattcaatgttattgaaatttgtttggtttttaaatcagacttggttattgagtcgggttggaaaaccaaattaaccacagcgcataaggacgaagccaaaatttaaaacagtagttgtacataacttcatttgttttttatcggaaaaatctcacacgataaagtaccagtcgacgacggcgactttctctatgatctgaccgtttcgctgaatctcacgtgaatctctgattttccgggaaaatcaattttctctcattgtctctctccctacattgtttctcatagcctacgagaaattacgtggtagcttgtcggaaactcaacttccgttgacggaaggcgcgagaaagaagcaagcttaggttcgatcggaaaattctagggttctctagtgtttaaacggtagagataatcgatctctaatcggatactgttttggatctccattcacaccctctggtgagctgattttgctttagagatcgccggcttagtttctctaatg

SEQ ID NO: 18416 - DNA, 3000 bp, Unknown; identical to SEQ ID NO: 7318
  misc_feature (1)..( 3000): 2750-1469P.txt file - cDNA_ID_1817333; gDNA_ID_1621140; Annot_ID_56618

SEQ ID NO: 18417 - DNA, 3003 bp, Unknown
  misc_feature (1)..( 3003): 2750-1469P.txt file - cDNA_ID_1817337; gDNA_ID_1621140; Annot_ID_56617
tttgcagaagattacacagtgaaggattgctgaacaaccttagaactgattgatgttctaggcttgttattttcatcttacagattggcttttcttcagctctcatcacactcacaagccatggagtatctgtttgtgctgcaactgcgtatattggatgaaaacatttcttcagtcttgaaaacatatcaaagaagttacctgctcacacattgtacatgtattgagatgattactaattgctccaaaacaggtatatactttttcattgagatagttaaaggtcaaaaatgtttaattgtggttttagtattcaacagtaaaattgagttcctctaaggtattatagtttacaaatcttctacatggaacatgactcaagtttcttctcttccagcgaccttggtgtgatggttactttgaggccgtacttcatgtacaagttagttgtgactctcggggctatgacatgatcttggacaaccttgattgagtacctcaacaaaactgaagcagctatcatcttcatctgcaggtaagcaaatgtttttcctatgcacagccttggtccagcattgaatacaacgtatttgaactggtcgtcactgacaaacttccctgcttggatccatctctctggtctgaaaatttcacaatcttttccccagattgattccatccttcccatggcatagattgagaagtaaacccgtgaaccttttcttacgaatgtcccatctggtaacacatcatcttcaatggcttgtttcatttccattggaattggagggaacagtctcagagtttctgatagtgctgcttgtaggtataccatgttgtttagttctttgactgtgaagaggctctcgtttttgctggttggagaatcccctcgctgtctcaagatttctcttatctcgcagatgattttgttttcaacctctgggtgtttctgtatcacccagcagaaccatgaaagtgcaacagaacttgtatctcgtccagctaatataaaacttgtgcaaaattgtctgaaaaatctaatggtggaaggatcaatctcattttcccttttatgactctctatctgaataatccttgagagaacatcagatctattgtctaacgtttcttcttccttgagctcgcagatacgatccacaatcatcttgtcgacgaacccgtgcacgaccccaacagctatcctgagacctttttcatatcctgtgtcgaggaacctcatgggcttccatataaatggagggatcatgaatctaaacagtgtagactctgttgcttcttcaaaagctttagcaaatggaacttggggaagatcaacagctagagtttccgggtcagcacctagacccgcaaggcagatgatgtcaaacgtcaagcgcaggaacacgtcttggagatcgaaagcttcttgtgactttgcgaaactctccatcaccttcaacagcttcttccttaccaaatgttgtgttgtctgaaaggaatgctctacaaacccggttgaatgcatttcggttatgatgatccgtcgttgctccttccaagaatcatcatcagcattaaagataccttcctcgagcagatcattgaaccggcttttaaagaaggtaccttttgggaagttcttgaagttagtcttgagcatgtactcgacatttgcaggaacacaagtcacagctccataagacccatcaagccaaactccccgataaagaaaggtacctcgacattttttcaaactccttgtgacccatccatagacatcatttatatgaaagaaaaactctaaagtaattccgaaaactggccatagcattggtccacgcttgttggttaacttctcacgcaaacagcagaaaacaaagagccccaacaaggaaagaagtagatcgaagagagaaagatgattataaagtcgctctgttaaagacattgtagtctcttctcagtaaactctctgcagttttgtttgtggtgatgtcattgtttcaagagtatttgaagaaagatttgcgatgcatttcatattttggttttggaattacatttgttgtcttcgtgtagaattggtctatatgaagaagatgagggtttcttgttggcgacgaaacgtaattaggctattacaaattgtgtgtttattgagaaaaacccgtgaaagaaaaattccagaaaaaatgcaaatttgcctgtcatgtcttatgtgaatctatctgacataagctgatgacaaactgaaactcttagaatcaattaacaaacaaaagaaagagcaatcgttgttactagcaagtagattacaaggaataaatctgaaaaaagattatagaattttgactttagggggaagaggtccaaaacacagaggacgagatattttagttttagatatgttcagcctagttaagtattaatcaaagaatcctaatctatgatgcttcaatggcgatcccactgattcacactttcacagtctaaagactcgagaacaatcgaaagactcaagtaacaaacatcaagattgtaaaaaaactatcttgtagtgagtagtggtgacaaattcatgatttttgaggtttgatacgttatataatataaccaaaacttgtagcactctgcaaacacaattattattgatttacataacctgaccctttgtttcaagagtctttcactactgtgagtctctacttctctcctacatgaagcctaaaaacaaagctgttaataaattcgctgttgcattgagacagtaagtatgcaccaagtaaataaactcttcagtattcaacaatcaacacccatctttaagaaaaacataaattacttggtcttaataaccggacagaaccaaagactaatcaaatcctgaaccggtctggttcaatagatctaaacctaaagtataaatcaaacgtctcaattgttttttcctagggtttcaatctctctcccaaaaaccaaaacgcaaaacctccgataatg

SEQ ID NO: 18418 - DNA, 3003 bp, Unknown; identical to SEQ ID NO: 18417
  misc_feature (1)..( 3003): 2750-1469P.txt file - cDNA_ID_1817337; gDNA_ID_1621140; Annot_ID_172799

SEQ ID NO: 18419 - DNA, 3000 bp, Unknown; identical to SEQ ID NO: 7320
  misc_feature (1)..( 3000): 2750-1469P.txt file - cDNA_ID_1817345; gDNA_ID_1621140; Annot_ID_56615

SEQ ID NO: 18420 - DNA, 3003 bp, Unknown
  misc_feature (1)..( 3003): 2750-1469P.txt file - cDNA_ID_1817357; gDNA_ID_1621140; Annot_ID_56612
ggactagaaagatctcttacaactttaaagacatcggattcgcgccttacggtgaggaatggaaggccatgcgaaagctctcggtggtcgaactcttcaccgccaaaaaacatcagtattttaggtctatcagagaggaagagaatgacttgttggtcaagaaactaacagaattggctctgacacgatccccggtgaatttgaagaagacccttttcactttagtcgggagtattgtgtgtcggatcggattcgggtttaatcttcatgagtgtgagttcatcgatgaaaatagcatctccgaccttgttgacaagtctgagatacttgagatgacttctatgttctctgatttctttccaggaggaatcggtagattcatcgattggatctccggtcaaaacaagcgattcgataatgttttctcggacctcgacactttctttcaaaacattcttgattatcatcttaagcctggaagaaaagtagcagatagctctgatataatcgacgtggtgatcaacatgataaagaagcaagagaaagatggagactctttcaagctcacaacggatcatcttaaagggatgatctcggtaatgtttttggacctttattagttgtgtagactaatcttcccttttttaattaaatattcacacaatttttgttctgtcaggacatatttctagctggagttagcacaagtgcctccacactgatatgggcgataacagagttagttaggaaccgtaaagtgatgaagaaagtgcaagaagagattaggacaacactcggagacaagaaggagagaatcacagagcaagatctcaccaatctccattacttcaagcttgtggtcaaagagatattcagattacacccagcagttccatttttgctaccaagagagacattatctcatgtcaagattcaaggctacgacattcccgccaaaacccagatcatgatcaacgtctatgcgattgctcgcgatccaaaactttggacaaacccagatgagtttaaccctgacaggttcctagacagttccatagattacaaaggactaaattttgaactgttaccgtttgggtctggtaggagaatctgtccaggaatgacgatgggaatcacacttgttgaatttgctttattgaatttgctttacttctttgattggggtttgccggagaaggaagaggcggacaagatcatcaccggcaatggagttgctgttggcctagttcaagttcttctccactgaaaatctgatagatgtttctttttttggtttgcaacatttttttagtattggttatattgaatgcttgtgttttaaccttgcttttttctttagagacattctattaattagtaaccctaattgacatgagtaaaggaccaaaaatgttgtcatagcttagaaactctataatccaaaccaaccgaaaattttgaaatataccctaattgacatgagtaaaggataatttgacaaatttaaaatagtaaacttgcagtttgcactattgaaattaaagataatgttgacaaattctttatgaagccaaatcacattattgtataaccacaagtataatgtatatatttatatatagttggtaaaaacattcaagttcacaaccacatggtcattaattacacttgataggtagagagtgaagactaattcattgtgtatgtatccactacaccaattattcattgacttttggattcttatcagaaaagcatccgtgagtttatatgaaaggtcaatcgatcattaatgcataattccataattgtcgatataactcgattttgcaaactatattcttcaatcttgttgcaaaaaatgtcaatcttgttacgtgaataatggcatatgcattattatcgggtatcatcatttacaatcagagccaaaccaaacaaagagaactaaactgaaataatgttctttctttttttgtcgacatctatattagattgattcaaataactttcgatgatacgtacttaataaagacaagtctacgtaaacagacaaagaccaaaaattcaaaatatataacgcaaccaaaccggtccgcaaaaacgaatacttaatgcggtaatatgcctagttaaaatcgacgtaataaaagcaaaaatacaaccattgacagccctatagtcaactatagaaaaagataaaagtcaactttaaaaattgtcaaacgtttgtgagaaaacttgtacgtttagcaaaaagagattttgatattagttgcgttgccaaaagaagagagtaaactgcctaataatggacgtaaacgaatcaatatataactattgacaacctaaattacgtagtcaactgtataaaaaacgatcaactctgtcaattcaaaccttgacattatttgccaaaagaagagaagaaactgcctattaatttcaatataactaaaattattggactaggtctaaatagggtaaccaataaatttgaaaggtacatcttataaattacaaaattttggaaatttcatggaggcaattaagatttatgggcccgtggcaccccatgtgtttggatactttgacgatatttcagtttcaataatacatcattactcatggatgaagatgaaaaatagttttgtgctttaaagacagaggttgatggcttttgtggcatatctctctatagatcaccagtgttgacaattcttgtgttctgtcatctacagaattattcataattgttcatgtagcacaagtttttaaaacgatgaattctttaaaataattgacaatgactgaatgaataaatttattaaaaatgattatcttaacaaaaatacaagttgcaaccaaagaaatatatgattcatccaagtagtatataaaaataaaatctcactgtctatatatgtctctcattaaacacccaaatcaaatcgaaccaactaacacaaaagaaaagaaaaaaaaaacagagtatcaaacatg

SEQ ID NO: 18421 - DNA, 3003 bp, Unknown; identical to SEQ ID NO: 18420
  misc_feature (1)..( 3003): 2750-1469P.txt file - cDNA_ID_1817357; gDNA_ID_1621140; Annot_ID_172793

SEQ ID NO: 18422 - DNA, 3003 bp, Unknown
  misc_feature (1)..( 3003): 2750-1469P.txt file - cDNA_ID_1817361; gDNA_ID_1621140; Annot_ID_56611
tcattcaacaaaattctaaattttgtttttttaagtaaaaaatgttatagcataaatgttcagatttttatgtcgtattatattgaattaaatatagaacaaagaaaaataagatacagaacaaagagaaattttgatccaaaaaaaaaaagaaagagaaataagatctagaacaaaaacgatacattcagattgattattgaaatcaaataatcgaatttataattgaatttgatggaatttataatgtattttttgtcatggaaataataaagtttgttaatatagtaggcacgatcgaatctggagcttcaatttttttttaactaattgttatggaagatgctggaatgatctctttttacaagaaagctcctctcattcttgttccggttaaacaccattaatgacatcggcacacaaaaattcaaacaccgttgaagattgtttgctatactttatttttatcaataataagttgcggtacttggttaactgtatacgtacttctatttcttatagttgtgcgataattaccacaagtccaaaaaagtaaaatatgaatttgataaagcagtgtaaacctgagattttcaagatttgggcctaaacccattagagaatgctacgtagagaaccattgggcccataaacttattttattcccgcaaagcctgagtggattcgaaccactaccacaaaaagtaagagtttgggttatttgattttaatcattcactttgaattattatagacaccggacagtgacttatgataaagagatttttaacctttaaaactaaaacactaaaatacataatccaaagaagacggaacaaaaaacaaaaacagagccaggaataatgtcagtcttcctctgtttcctctgcctcttaccccttatcttaatcttcttgaaaaatctcaaaccatcgaaatggaagcttcctccaggcccaaagaagcttccgatcatcgggaacttacaccaacgccgggaattacatcccaggaacagtcggaatctttccgaaaagtacggaccaatcgtgtttctccgatacggattcgtccccgtggtcgtgatctcgtcaaaagaagcagcagaggaagttctcaagacccacgatcttgagtgttgtagccgaccagagacggttgggaccagagcaatctcttacaactttaaagacatcggattcgcaccgtacggtgaagattggagaacgatgcggaagctctcggtggtcgagctcttcagctcgaaaaagcttcaatctttcaggtatatcagagaggaagagaacgacttgtgtgtcaagaaactctctgatttagcttcgagacgatctttggtgaatcttgagaaaaccctttttactttagtcggaagtatagtgtgtaggatagggtttgggataaatctccgtgagtgtgagttcgttgatgaagatagcatcgatgatcttgtgcacaagtctgaagatgtcataaggaattctatcttctctgatttctttcccggattaatgggtaggctcatcgagtggatcttcagtgagaggaagagattgaatagactttactcggaagtagacactttctttcagaatattcttgatgatcatctcaagcctggaagagagagctctgatatcatcgatgtgatgattgatatgatgaagaagcaagagaaagagggagactctttcaagttcaccactgatcatctcaaagggatgatctcggtaaatctataatctttcaagataagtggttaaaaatcttgcatgcaacacagtttgtgacttttgttttgttttacgtcaggacatatttctagcaggagttggaacaagctccactacattgatatgggcgatgaccgagctgatcagaaacccgagagtgatgaagaaagttcaagacgagattcggacaacacttggggacaagaaggagagaatcacagaagaagatttaaaccagcttcactacttcaagctcatggtcaaagagatattcaggttacatccagcagctccacttttgctcccaagagagacattgtctcatgtcaagatccaaggctacgatattcctgctaaaacacagatcatgatcaacgcttacgcgattgcacgtgatccaaaactatggacaaaccctgatgagtttaaccctgataggttccttgacagctccatagattacagaggactgaactttgagctattaccgtttggatctggtaggaggatatgtccagggatgacaatggggatcgccattgttgaattgggactattgaatttgctttacttcttcgactgggggctaccagagaaggaagaagccaaggagatcatcaccgggaatgaagttgctcttgaccttgttcaagtttttctccactgaatgtgttttggttatggaatgtttgtactacactaagcttgattctaaattaataacatcttacaagtactgaaaatagtagacagtagacactatggtttatcttccattagaaacaattaaattataaaatcatttttgttaaaacagattaaattctctctttacacaagccataatactaattaattaagaatagggttacgctacgttgggagttgtttaaaagtacatattttcgtcctttttgcttctcccactaccatcaattagtggttgaaacagaaagcttatcagacagaaattggcattttcggatatgttggatgcacaaagtggtatataatacgtaagacttattcgtgtcaatcatgattcatgaagctatctaacctctacaagactacaaacacgtagaagtttggactactcatttaataatcgacaacaacccatgagctgaccataatgaatattattaaacaacccaagttgtttattttctcttaatcgttaagcacttcatctgaaatacaaaacccaaagaagaaagagattaaaaaaaactagagggcaacaaaaatg

SEQ ID NO: 18423 - DNA, 3003 bp, Unknown; identical to SEQ ID NO: 18422
  misc_feature (1)..( 3003): 2750-1469P.txt file - cDNA_ID_1817361; gDNA_ID_1621140; Annot_ID_172792

SEQ ID NO: 18424 - DNA, 3003 bp, Unknown
  misc_feature (1)..( 3003): 2750-1469P.txt file - cDNA_ID_1817365; gDNA_ID_1621140; Annot_ID_56609
ttgatgctttttaccagcatgtgattgatgatcacttgaagccatcaactttggattcctccggagatattgttgccttgatgttagatatgataaagaaaaaaggacataaagatgatttcaagctcaatgtggataacatcaaagcagtcctcatggtaaagttcaaattttggttcatatatctttttatttttcaaaccattgaataaacacttagtttaaactactaagcttattatgtatatatgtctgtttatgtgatgctcagaatatatttctcgcggggatagacacaggcgccataacaatgatttgggcgatgaccgagctcgttaaaaaacccttagtgatgaagagagctcaagaaaatatccgaggcgtcctcgggctcaaaagagatagaatcactgaagaagacctatgcaaatttgattgcttgaaacatattgtcaaggaaacattaagattacacccaccagttccatttttggtcccaagggaaacaatatctcacatcaagattcaaggctacgatattccaccaaaaacgcaaatccaagttaacgtattacgtatggacgatcggacgtgaccccaagcgttggaccgaccctgaagaattccgccctgaacggtttgcaaatacttgtgtagattttagaggacaacactttgactttctaccgtttggttctggtcgaaggatctgtcccgcgatatcaatggcgattgctaccgtggagctaggactgatgaatttgcttgactttttcgattggagattgcctgatgggatgaaagttgaagacattgatatagaagaagctggtaatgtcacggtagtcaagaaactacttatttaccttgtgccccttcaacgtcattgatgagaagttaaagaaagctccatgacatggaaagaatacgagaagataacctataattctctagatattattgcgagatatataagaattaattcatgtttgatgatcaacattccaaaaacaataatttatataataataacaaatcttctatttaaaccattttgcaatgattggattgagattcggtggctggctgtcactttatcgcagttatcgatctttttgtctaccaaatgatatttcaaagagtcaattagtagtatggacaaatatagtaataaaaatcaattatgattctgtggctactatatatggagtttatcaggccacagactgagacggaagaatgaggattatgatgttccaagagtagtggaaattttttagtaccaccaaccaacatttcgtcttaggacgagaattaaacacttgtagactttataataacatttcgtccaaaatagtgggcactaaaacaaatttattattttctttaaaaaaaacacgcttttcattataatcgagttcaaattttcaaaaactctagaagtactctatttacgatataaacccatttgaagtcaaggctaagttcacattcataaaatcatgactcatgagcgacgagatcaataataaacaaattttcagcctacatttctgatttcttgcacgttatatatagcttgaattgttgtgccagttaggtgattttaattaggttaacttctctacttaatttggatatttgcatgtggtgtctaccacgttacgtggttttagggttattatttatattttactaaagtttatatataaagttcgggctttaggaatcaagcgatcaagtcaaaaaaattgttggataaattttttaacgtatgttttgttttaaccaacttagaaactttgtatttctcgtggcagtttttttcccttttcagttctcgtgccaagcttaagaatatgaaaatatactaattgtgatggtgattcaaacccttaacaaaaaaaaaaaaaggtgatggtgattcatcacaaccatatcatcgggatgtcacattcaatactaaaggacgagacctccaccgaaacaaacatctataaatccaattttagttaatgtttttttttgtttgtttctgaacagttcaatagcctataagtagttatatacaaaagtaataatgcaaggaaacttggatctatcttaactttgattgatacaacagaattgacatattcaaaaaaatatggatgtcatattcaatttttattatttttgggaaataaaatacaatatggatgtcacagtgataatatattaatatgccagcaaacatgtaaaccatcatctattcatctacgtttcctctaagaagaaataaattggattcgaacagatttagaactctcaacgtcatcagaaattagtatatcaaagagagtggatttccaacgacatcattattttccaccatataatttaaacctcattaataaggtttcatttgccgtttaaaggcataatcatttgccgttttcctctataattctcttaaagttataatttaaaaccccaataaattagtaaatttgacaatgacataaccaaaatcctaattaattataaattttgatcaaaaatctattaaattttcaaattcgaagtctactcacctatttttaatcttactctaataaataaacttatctatctctatatatccatactatgtaatcgttgacttaaaaaggtataatattatacaatcgttgacattaaaaaccatataatatacaatgattgagaaactgcttatccactcaaccaatcaaaacaaagtgtaatcggaacacgtggattttgaaccacaagacttggtttatgcttgtgtcacatttatgatttcaacgaagataatatccacaaatctagtaacttctgtatgcgactctacaaccacttgatttgaagagttaacgtctcaatcacgtcgtcaatccctgtcactctatctctatcttataaagaagaagactcttcgaagttctaaactcatagaaacagagccaacaaaacaaaaacagaggaagaaaaacaaaaatg

SEQ ID NO: 18425 - DNA, 3003 bp, Unknown; identical to SEQ ID NO: 18424
  misc_feature (1)..( 3003): 2750-1469P.txt file - cDNA_ID_1817365; gDNA_ID_1621140; Annot_ID_172790

SEQ ID NO: 18426 - DNA, 3003 bp, Unknown
  misc_feature (1)..( 3003): 2750-1469P.txt file - cDNA_ID_1817367; gDNA_ID_1621140; Annot_ID_56608
tctgatttgaagttatgagagaaaaactctttgattgacatctgattttggtttatctccttctggatcagcttatttttattgtagcttctctgattttcgatgggtacttatattttttttttcaatttgggatttttcatgattctgtagggtttgcaaagatgaagcttgatactagtgggttcgagacttccatgcctatgattggatttggctcgagcagtgatatgcttgatgagctttcttctgtaccctcgtttgatctaccccgtactaaagaggtgactttttttgtttttgtttgtgattcgaagcagtgtgagtgaattttcaatgttgtttgattacgaaactggttttatttgttggtttcagtttgatggatttcagaaaaaagctaaagacatgttgaagcatgcaaaaggaacaaccactctcgcttttatcttcaaaggtggtgttatggtcgctgctgattctcgggctagcatgggaggatatatctgtatgttctcttttatcactttacttttagttttgtttgcagactttgacgatgtttagctgtgagctctcttaagaattcctccaaaaatatgcatcctttcgatatagttgactttggtagaaacactagtacaatgaagattaagttagcttgttgttggttttggttttgtgctggagtgtcaaacaaatttctagttttcattctgttggccattaattgtgaaccagtagaggaaagaaaacgttgtgtgatttttgttaatgttttaaatctgtttaccacattcagcctcacaatctgtgaagaagattattgaaatcaatccttatatgctcggtacaatggctggaggagctgctgattgccaattctggcacagaaatcttggaattaaggtacctaactagaaatctttttggccgtgtctgaactgataacttggatctttgattaatctttctctctgtggttatcgggaatcttgctgccttgttatatagtgatttttttatatatttctaaaagcagcagattcatttaccttatcaaatgctttaagttttagttctgtctatattaaagaatgacaaagattttgcttgtttgatgttgaccctaagatcatacaagcctctttgaatgctaagcatgcaatttcagttgagcatgtggtggctttagatcccctttttttctaatcaaacattctgtagcaagaaagttcagctttttttcctctgtacttagatagcaaataaataaagaacttagtttgttgaatgcgatgtgaaattttggcatgttaataccattgtagacttcttcattttatcaccaacatcttgtttgttgattttatggctgatctcttaatttatttgtctatccaagtgccgtctacatgagctggcaaacaagaggagaatctctgtttccggagcttcgaaacttcttgccaacatgctctattcataccgtggaatgggactttctgttggtacaatgattgctggatgggacgaaactgtcagtaaaaccaacttcatatcttcaacactgttattttcttcccacgcaaaaggaaattttgaaatgctaaatccgtttacttcttgtataatagggtcccggactatactatgtcgacaacgaaggaggacggctcaagggagacaggttttcagtcggttctggttcaccatatgcttacggtgtgctggacagcgggtaagtcatttcccaaacaacatcttcatcgcttttgtcccaatctcaaaggctaaaaaccaaaatctaatgatgttagttaagcaaccgtttcatatttatgattttacttgcatcatcaggtacaaatatgatatgtcagttgaagaagcttccgagttagcaaggagatcaatctaccatgcgacattccgtgatggagccagtggtggagttgctagcggttagtaatctgaatgcatctgtggttcaaatgtaatatttaactttcaagattctgatttagctcataagtttgttctcttctcatatgaccagtgtaccacgttggtcccgaaggatggacgaaactatcaggagatgatgttggggagctacactaccattactaccccgtggcaccagctaccgcagaacaagtcatggaggaagcaacagccgaataaaaatcctgtttagttttctaatcgttcactccctttcttgttgttgcattttgtggtagtatatactgagttgtctctagctgaagctttggtattctattttactgatctgaaatgttgctcgcggattattctctataagattctctttttctgcaatcacattcttctcttactcggtgttttaaattccaatatagggaattgtgattgttttgcaccattttgttagttaaccagtctctccctatccaactctatcggcaatcctcacagatttgctcgtgatagctggtggctggcgttgtagagactagagagcaaagcttagtttggaccacatgaattgcttcggctctgtcccatcttttttatcaacctaaattcccaatgatgataacatccaccaactagaagagaagagttcatggttttgctttcgtctctcgtttcatcaatcttttttaaacacccctcaggaaacttgcacatcagtcaacatggaagtgtctcagtggtcgacaagggcatagttctgtcttaaatgatgcgatttttaccaaacggcgttcctattagcaacataaaaagccatgaggtccataactcgtcttcgttcaatgatccaatcaatcaatcaatgatttttgaaccacacgacatgattatgttttttttttgtcgcattcatgacttgaaaatttaacgtatcgatcacatcatcaaccccttataaacaagactctttgagattctaagctcatctatccaagaaacagaaaccaaggaaaccaaaaacagaggaaggcaaaaatg

SEQ ID NO: 18427 - DNA, 3003 bp, Unknown; identical to SEQ ID NO: 18426
  misc_feature (1)..( 3003): 2750-1469P.txt file - cDNA_ID_1817367; gDNA_ID_1621140; Annot_ID_172789

SEQ ID NO: 18428 - DNA, 3003 bp, Unknown
  misc_feature (1)..( 3003): 2750-1469P.txt file - cDNA_ID_1817398; gDNA_ID_2926149; Annot_ID_197938
ttttcatactccacgtaaaagagatatgttcgaggcatacatcaaatattataatcaatcatcgtgctaacttatactacaacaaaatattaatataaatttactatccaatcttacgaattcgtgcaaaaatcatctaatttttttgccacaatggcaagaaactattaaattttgatgacgtggacacgcacatgtaaaaaacgtggatgtcaagtcataatgttaacaaactgttttttttttcatttccttcaattctggtttttgttttttaaaagttgtgtataaacataaataaatatatatatttatttatatatttccaatggattctccaaaactcttatactcactttcagcatattcttccatcgtgaaaccttaccaaaaaactaatattaaatttctatggtcgtgagtatgcttaaaatgtacctactatttatgtgtagtggtttataaaatctaatattattggaaacattttaaccattgaatttttgatgacttaaatttttttttagataatttaattcgttaaaaatgtaaagatccaaataacatggtgttaagtgtccctactaaaaaattaaaagtggtgttaagtgagacttaacaacaaatcatacaaatttcagaattcacctaaaatcattaaagtcatccaaaaactcattaaaactcaaactgatttaaaatataagattaaatgttttattctatatcacttagaaaactgaaaataaaataaaattgtttgttaacactatgatgtatcattcacgtcgtttcacacatggtctacattatctattatagtttcttgccaccatgacaagaaatgtataattttgcacaaaatcataaatttagatggtaaattttaattaacgatttgttcacgtatgaattagtattcatacttatattttaattgaacttgtcgctttagttgaggtaagaaaatactataatagtaatgaaatctcaccaaataacaatcaaaaatttatttcaatcacataagatcttgtcaaaatccaccaaatcatcatgcgtgtttttcaacatctctccaaatcttctaaaaattactaatccaatacaccgcctaactaatgtatttggtaataactcttgatatgtacaactaatttacgtgttctccaccataggttatatctgttaactagttacgtacgtcgaccaaaaacatattactttatcgtggttttatcgttgaattattcactttcatgttgggatatcaagatttgaatctttcaatcatgattttaattatagttgtcaaatgtcatatcaaaaatatctattttcttatagtttttaactgattagtatgagtttcgatttggaatatttcagatatgaacatacaactaaggaacaaaatattgatattagtttcctatatctttttatttattttaaatacaatagcagatcacatgtatatattttaactcaatagttacgtcgaccaaaaacatataactttaaatatcgtggtttcattgttgatttattcactttcaggttgggacatcggaatttgaatttttcaatacgaattttaaacatagttaaatattttcttatagttcttacttcttaacgattagtatgagtttagatttggaatattttaaatatgaacatatagttaaggaacgaaaggcgatcacatgtttgtagttcacctaagtattgtagttataatctcatccagtacctggagcagttgagctaatctttagattaagcttgggcaaaaaatccggactaaaatacttgaaccgaaaccgatccaaaaaatcggtttgggacgagtacggatattacctatttactttattgagtcttgaattgtcgtacccgtgagtatagggtaaaatccaacccgaacctgatactcgaacatgtatccgcttacccgaaattacatatacttattcatagatttatatatataaaatcttattttatatttaatatttgaactaaatacatttatatccaaatatctaaaaataattaccaaaaactaaatacatttgtaaatacttaagactaaatatttttatacgcaagatacttataagttttttggatattgggacaaaatttcggttatgtgggtaaaattcagatatttgggtaaaatattcaggtatttagataaaattttagatatttggctataaaatacctgaatctcaaagatacccatttttttggtatttagcggttctaaaattatatatccgaaccgacccgaaccccattggatccaaaccgaaacaaaacagaaattttagatttatcttattgggtcctaaacttttctacccaaaaaattcttatccgatcgaattttacccgaatattccgacccacatacctgaatgcccaaccgtactttagggaattacatccgatgcacaaaagaactaacaattttgtactatcattaacaccacccatttgcaactccgaaagacgatcacatattgtagatttaaaatgcaatcttaatcacattttcactaaaagttttccttaacgtatttggtgggcatgatttaacagctcaatttggcaggtcaacgaatcaaccgtgctttaaacgttgtaatgtttttcaacttaagataagactcgaaatcaattaaaaaaacaaacaaaaatcatagtcattgtttttctttgttaattcatatacactcatacaaaacattgacaacttatctattgtttaatctaaataatacaattatgtacaagtgttactttagtaatactgccgtccatataacggcacaaaacggagaatgacgtcaccattgttgatgtcacacctccatgtaacttctgttataaacgcattaaacgttacacttgtgtatattatatagatctctgtccctttatatttcatcttttgacattacaaaattacattaccaaacacattaaatg

SEQ ID NO: 18429 - DNA, 3000 bp, Unknown; identical to SEQ ID NO: 7342
  misc_feature (1)..( 3000): 2750-1469P.txt file - cDNA_ID_1817398; gDNA_ID_1621141; Annot_ID_56640

SEQ ID NO: 18430 - DNA, 3003 bp, Unknown; identical to SEQ ID NO: 18428
  misc_feature (1)..( 3003): 2750-1469P.txt file - cDNA_ID_1817398; gDNA_ID_2926149; Annot_ID_139231

SEQ ID NO: 18431 - DNA, 3003 bp, Unknown; identical to SEQ ID NO: 18428
  misc_feature (1)..( 3003): 2750-1469P.txt file - cDNA_ID_1817398; gDNA_ID_1620685; Annot_ID_48440

SEQ ID NO: 18432 - DNA, 3000 bp, Unknown; identical to SEQ ID NO: 7342
  misc_feature (1)..( 3000): 2750-1469P.txt file - cDNA_ID_1817398; gDNA_ID_1621141; Annot_ID_172843

SEQ ID NO: 18433 - DNA, 3003 bp, Unknown; identical to SEQ ID NO: 18428
  misc_feature (1)..( 3003): 2750-1469P.txt file - cDNA_ID_1817398; gDNA_ID_1620685; Annot_ID_164585

SEQ ID NO: 18434 - DNA, 3003 bp, Unknown
  misc_feature (1)..( 3003): 2750-1469P.txt file - cDNA_ID_1817421; gDNA_ID_1621141; Annot_ID_56633
atggtgaggcatagaggtgtcttacgcgaatccatgagagagtctggagatatgctcggaagcgtttagtattgttgctcgaaggaaatgagggtcccaacgactcgtgaggagcggggtatgctcctaaggtaccggtaactcgagggacatggtgtctttagagtacgaggggtacggtggcttcgggtgacgatccgagagcacgctttagggtgacgatccgagagcgagttttgtggtattattttctccaagtgtcgtaactcgatgactttgtggctgagagtgagccgacacaactcagggtttgactttgagtggggaagataatatgtgtgatatccgagataccgtaggccgaggcctgagagtgacggtttatgctcgaagattgcggtctgagagtggagagtaagttgtgagcaacaatgactagtaaatcgtgagtatatcgactggatagagagacctagagggggtctggttggagggaatgcagactgtagtgatggttgcacggagttcctcggagtggaagggtgaagctagattcgaagacgaatctatgttagtgggggagaattgtaacgcccgtgaaccagaaaatcggttaggatttgtttttaaatcatccggtttaattggttgggttaattggaaaccctagagtgtgcctataaaagaaggaaactcgaaattagggctttagttagccacttttcgttttataaaggagaaaaagagagaaaaggagaatgagcagaatcgttagggtttgggagaaatcagtttcgtcatatcaaatcgtggtaaaaggtaacaaaatttggtagagttattcccaaatcctttatcgttattctccagtttacagaattgaatttggattaaaattggttgagttattcgcagtttcgtgagacacgttttctcagacgcgaattaggaccagcggagattgaaactgagatcgtggtctcgtctgttttccgatcggcacgagattttgtgggcagctttgtgacgtctgcagctaggattttaccggagcgattgaatagttaacggttagcttgtattttagggtttcgtctttgagactgtttgtttctggtgttttcctgtccagtttgcttcaaggttgcttttggttgtggacttgttgtaggacgtttctggactgtttccgacgcaaggagagtctctcctgggtttaattgctattagaatcaatttgttaaggtgagtgcgtgaccatgagcttatctaagcgattgggttgtgtgatttgttttgtgtgatgatatgtaagtgttgtgaatgtgttttgggtgaattgttcaatgactggtttgtttgtattgtattcgtgattatacctttgtatttgcttgtgtgtatagttcgtagatgggagtatcgcctcactaagtatttatgataatacttacgcatctcattgtgttgttgatgcatgtaaagataaagtgtgatcgtggaatcataacaaggaagagaggatgatctaggaactcgtttgttttatttttggtgtttttggttattggaacccggttaggattgtcagttattcttggttttgttggtcgatttatttatttattcataaaatagtatttttgacttgcagtttaattattatgttattagttggtttaattaaatatttatgagaatatttaattatatttaaaaaaaaaaaatgggtcaagttgtttcacaaacatttaaatatttctagatgtacctttgctctttttctcttttcattcattttagaaaatgatgaaattattataaaaaattcaaaaactgtattaattatttcaagttacaattctacgtattagtatacaaaaaagatcattataaaaaagttgtcagccaaaatttaatattaaacatcccgtaagtttaacgaatccaatgtatttcaagcagaagtccacatcagttgtctccgtgtaaaatggtatatgtctttgaaaagcatcacgtttgtaaatggaaacacaatgaacacgattacacgaataataagttaataacaacaaaggaaacatgatgtgtttgatgaactttgtggttgtggccatatttttgagaagaaacaaatctatttggtattttctatttaatatgtttgaaacattttatttatactgatatccgaaagcttaatataacaataataagtaatgtaattgtaaaataaaattttaattcatcactttaataaagaatatatttaattaatcatttttaatttatctatttttacattatattaactaataattaattataaaatagtaatatttatcaaaatgatcaaataaaataaaaatattaaataaatagtttagtaatagaaaattgtatttttattatgcttctgttcctttttgtttgatcttttaggaaaaatacaaatattaagaaaacgtattaaatgttgttttaaatgtattattttttgtgatttacaatttttaagaactctaaaccaataatatttaataatttgtattgaagtttacaagttatcaattataactaataattattgcattgaaaacctaaaaactcaatttttttgaaataatttgtttttcttaaaaaaaaaaaaggacaaagggagtattaggtaaaagtttgatgctaaaactatactcaaatggtgtatactgtattggcaatggttcatggttgcctggttggtagcaaaaaaacacagatataattacgttaaggctatcattaaacaaagagggtctcgcaattaaaactacactaattcattgtttacaagaaaagaaattgttacttctttggaaattggccattgttaattggaaatcgtgaatccaaccaacaagacatttctctgactctcttcttccttcttctcctccaatttagggttccttcaaattctctctgatttcgtttgaaattgggggctcctcttcgaagatg

SEQ ID NO: 18435 - DNA, 3000 bp, Unknown; identical to SEQ ID NO: 7347
  misc_feature (1)..( 3000): 2750-1469P.txt file - cDNA_ID_1817437; gDNA_ID_1621141; Annot_ID_56627

SEQ ID NO: 18436 - DNA, 3000 bp, Unknown; identical to SEQ ID NO: 7368
  misc_feature (1)..( 3000): 2750-1469P.txt file - cDNA_ID_1817448; gDNA_ID_1621142; Annot_ID_56659

SEQ ID NO: 18437 - DNA, 3003 bp, Unknown
  misc_feature (1)..( 3003): 2750-1469P.txt file - cDNA_ID_1817451; gDNA_ID_1621142; Annot_ID_56658
taatgcttattgctccgacaagattgaaatattatcaagaagatgtagttgcacccaaagtgacgtacggacctgcaaaatgcagaaaagaatcagcaaatgatgagaaaacaaacaaagagagttcaacatttctatcttgatttatcggtcactaacacaccctttgattctaatcacgataaggcgtgagatcgatttggaactgttgtttcccctttgtgacactctgcaaagatgttataagagccaatgttacaacaaaaggaaacagattaaatttttatgggataatgtaaagggcttaccgcgattgcaatgagctcttctagcagttcttctagatgacgcagaggctgaacgggaagaaaaacgatgatcaagaatgcattgtgttagactaatggatatggtctgaaaaaaagtaaaactcacccattgtgttggaccatcgaccggtgcatttaaaggatcatcatgcacctaattcaccggaaaatgaaccaagtttcataaccaaattggaacaaagattcagcgagatgacaaaacttgcgataaagttggatacctccatgaaaattccatcgacaccaacagctacggcggttcttgctatgcatggtattaattcgcgaaggccaccactagcaacacccccaccatctaactatataaacaaggtatgtttgagtttagaccaattctgatttagctttaaaacaccaagcattttcttaaattactcagagcatcgttctaatgaccataccttcttgcctgcaggttgttgtaatgaatgagttatatcagcaacctgaagccaataactaaattatattatacgagtgtcaaaacatcaaagtataaagccaaagccaagatataaactcccacaacaagaaaagaacaagaagcaatattaactcacaacgggacaatcagcttccctcatccattccaaatttcgtggatctactattaaatcatctgaggaacaaaattaaaatgtaaggacactcaggagttatatccagtgtcttttagtctattttagtctctatttgcaaaaaaattggtgaattctattgacacaaagaacagttaacttactgtatccaaacatggttcctctttcacaaaccatcacatttggattccctgcgagtctaaccttctcagccgagtttctcatgaccttaaaatggatatacatgaaatcagtcactacaatataccagggaacaaaagtttgtacagatcaaaaagataactcacagagtgaccacaaaattgtcctttctttatgttgataattttcccactttgggctgccgcgaccagaagatctgtctggagatataggcaatagttaaaaccctgaactctgtatataaatgataaattcaaacagtaaatgaaaatttgatagctaaaaaagagttgaagaaaagcatatgttagaatcttgcctgtcgacataagaacgccggtatctgaattatatctgcaaccttgccaactgcttcacactaataaaaacaaacgaagcattagaaaggaacaaagatttttcgaatcttgaatctctgatgtgactaaaactcaaaatacctgactcgactcatgaacgtcagtaacgattggtagatcaaatgctactttcaccttctcaagaatctgtcgagagaaacagaaaagttactacctgtagtatacttgtgcaggaactacacacaaaaaaatgaagccacatcaatactagtttccgtaaatgtaaatggttgcattatagccaggagctaaatgcaattgctggtgtcagctcatactgaaggttctaaaagacgtaagaatttatagatataagatcgctttgacatcaatatactcctgaaggttttcaaatgcgcagttctaagagcaccagataaagagtcatccatgcttgcaactcaaagaagagggaatgatttaccttgagcccctcagccatgccaggacctcggaaggactttgatgaagttctgttagctttatcgaaacttgacttgaaaaccagaggcaacccaagcctacaacattcacaatcaacatgaacatgcataactataactatataagtaaacaccttgctcaataagctaaaatgctcatgtgatgagaggatcaaggtctccactgtgttaaacatttttcccccttgtcaattattttaatagttccaacacagttgaacacaagatgtcacaacaagaaaaagagcttcaatggtgatggttacacatactttgtcgaaatatctttgatgcttttagccatacgaagaacatgctcttcggattcgatcacatttggaccagccaataagaaaaacggctcagcaacctgcaatgagtcattgtccgtacgataagataactcaattcaccggaagaaaataaaaaaaataacactgaacctagtaaaaaaaactcaaccttgagctgatcatacagtagtgacgctgaattcgccatttctatagtagagcttaagatcagataacaaaacctcaacttccaaaatcagaatctaaaattcacgaaagaacttatgataatttctctacattgatctgcatcgaagaaaatcacaaatcaaggatttaggattctgacctttaactggaagttgtagtgtgagtgaaggcagtgagatgccaaaatagaaattgccaatggccgagaggtgatgttcggatacgccaacagtactgtccctggcgtggataatcattatccggttttaattcaattcatagatcgttaaaccaatcggttaataaataaaattctatttgatttggtttaatttcttcggttccggttttatcttttcaccaacattttcgtttgtcatctttcgcacctaaaccttcacctactcctccactgaaccctagcttacactcactgttcatttctctctattggcatcgacgccattgttggactgaagatg

SEQ ID NO: 18438 - DNA, 3003 bp, Unknown; identical to SEQ ID NO: 18437
  misc_feature (1)..( 3003): 2750-1469P.txt file - cDNA_ID_1817451; gDNA_ID_1621142; Annot_ID_172870

SEQ ID NO: 18439 - DNA, 3000 bp, Unknown; identical to SEQ ID NO: 7366
  misc_feature (1)..( 3000): 2750-1469P.txt file - cDNA_ID_1817455; gDNA_ID_1621142; Annot_ID_56657

SEQ ID NO: 18440 - DNA, 3000 bp, Unknown; identical to SEQ ID NO: 7365
  misc_feature (1)..( 3000): 2750-1469P.txt file - cDNA_ID_1817459; gDNA_ID_1621142; Annot_ID_56656

SEQ ID NO: 18441 - DNA, 3003 bp, Unknown
  misc_feature (1)..( 3003): 2750-1469P.txt file - cDNA_ID_1817462; gDNA_ID_1621142; Annot_ID_56655
tgcaatcgtgggaaaccactttgatctaaaaaactgtggacgtagtatttaatcattccttatcataatccaaaatgtataataaaaagatatctctacttaacgtggccatatagaaaaccttttaagatgaaggaaagagtaatgtaaaagaattggtaatggtatacatacatactcgtgattttatgaccatggctttttgcatcactagtgagtaatgcccacctacttcgtcaactcaacaacttatgaataactattcaattttttttttgccgattatgtgcacaattttaaaacagaagacaaatgtaaagtatatgactataaaatattgactaaataactttccggcgattttgttagtaaatgttaagaaaatttgttctttttccttgtagaaaaggaatgattctaaattactatcccaaaaaaaaaaaaagtaataacttgtttcgaagagtttgtgtgtgagtcgtatatgccgcttaactcctatattttctttctctttctcacaacttcccctagaaacacttttttcggaattcgaacgcacagcgatcggataatggcgacggagcatataactcgtacgggagatgaatacaatgtcgagcttttacctagtgacgacgatgcgccgccgcttgaatcgtcttggcgtctcaacctcgacgcttttcaactcccttcttccaccggtggccgtcacgacggacgtactcgcttttctcgctattttcgtactccaagtaatttttttattcttcttcatgtttttgttatctgctctcaatccgtaaagtgtgcatagagacgtgtacgtaaaatgatcagcgaccatgacttgtgaattgtggatatgaactttgatcatgtgtatgaaaaaaaaaaaagtagttatacaaatgtgtagttgttgaaatttttttgggaaaataaatttagaaattcagtctagaaggaaaaaaattagagtgaatgattctctctgtttaaaaccccttgctattgatttgattcagtataaaactttttctttttgttgattcaaagtttttgatgggatctttagcttctcttttggagtttgtatatacccatattctttgttttaaagttatgtggatgctgaatcagattaatctctacagaggttataaggcgttttagagtgatttgagaaactgttatacccatcaaaggtcgactatcaaattgttaaatcttgaaaatggactttaactttgaacccttttctctgttgtctcaatgcaggaaaggaacgtagagtctctgaatactacaagaagcaagagaggctcctcgagggtttcaatgagatggagactatccacgaaaatggttttgcatctggtgttccaactgaggtctggcctctactgttctttctttagtttttttttcttatggtatagatattagatgaatcctcaagcttgtttggtttgaacaggaagaaatgaagaagcttgcaaagagtgagagacttgcggttcacatatcgaacgcaacaaatttggtgctttttgtagcaaaagtttatgcctctatggagagtagatccatggctgtgattgcttcaactttggactctcttttggatctcttgtctggttttatcctctggtttacagctaatgccatgagaaaaccaaaccagtttcactatcctatcggaaagcgccggatgcaacctgtggtatgcttcttctgttttgatctcttaacccctttgtttggaacttacttgtctcacaagaaaatagaactgataatgtaaatttacagggtatcattgtgtttgcttccgtgatggcaactcttggactgcaagttttgctagagtcaggaaggcaactagttgccaaggtactttacatattttcaggtaactgctttcatcggttaattaatgtatttaaccaattctgttttttgttacagagtggtattcatatgaatagcacagaggagaaatggatgattggtatcatggtctctgtcaccatcgtgaagtttcttctaatgctttattgcagaggatttcagaacgaaatcgttagggcctatgctcaagatcacctctttgacgtcgtcactaattcaatcggcttagcaacagctgtcttggccgtcaaattctactggtggattgatcctaccggtgctatacttgtaagtaactaacttaggaatctaaaatgatcaagaaatgtctcgtcggattactaaaacgttttttttttcctttttatggttgcagattgctttgtacaccatagcaacatgggcaagaaccgtactagagaacgtccattcactgatcggccgctctgcgccaccagatttcttggcgaaactgacattcttgatatggaaccatcacgaacaaattaagcatattgacacagtaagggcttacacttttgggtcacactactttgtggaagtggacattgttttgccagaggacatgagactacaagaggctcacaacatcggagagactcttcaggaaaagctcgagcagctcgctgaagtagaacgagcttttgtccacatagactttgagttcactcatcgtcctgaacacaagtgtaactagattttaagtagtaatttgtagtactataattagttctttagtttatgtactcttcgtgtcgtttttgtctatatagatacttgaacgttgtgccgtctctgtttatcgaatgcgcattgtgtgtcgtttgaagctaatcgtcgacattaatagcgtttcaaacactaaactcaaaataaagataaaatcatatataataaaataatgaattttaaatgaaaaccactcaaaatggtttttatctatcttccgacaaaattccgtgcttcattgctcttctccacaagacaacatttctctggctcagaatcgacgccatggaaatgtaaagaagaaacaaagacgagctctcaaatccagcagcaatg

SEQ ID NO: 18442 - DNA, 3003 bp, Unknown; identical to SEQ ID NO: 18441
  misc_feature (1)..( 3003): 2750-1469P.txt file - cDNA_ID_1817462; gDNA_ID_1621142; Annot_ID_172867

SEQ ID NO: 18443 - DNA, 3003 bp, Unknown
  misc_feature (1)..( 3003): 2750-1469P.txt file - cDNA_ID_1817466; gDNA_ID_1621142; Annot_ID_56654
catactcttttcccatttagttttccttactcatagtaactgatccacgtgcttgaacacgtaatattaatcatacttaaaggcatgggataatatatcaaacttaaaccaaatcttctctcctcctcttatgcaggcttacatgttcaagtatgattctactcatggaaattacaaaggaactatcaatgtaattgatgattcaactttggagatcaatggaaaacaagtcaaagttgtcagcaagaggtattgcctcaaaatgttgactcatgtgtatctgtctagtatggtcaaattatgaatcaatttccactaatatcctattggtagggttttatgcttatccttttttagagtctaacatcttaattgttcttcctcagagacccagctgaaatcccgtgggctgatcttggagctgagtatgttgttgagtcttcaggggtattcaccaccgttggacaagcttcatcacatttgaaggtatgcactttcatttgaacacgcttgttgatctactagtttcattgatgctaacatttaataccaagccttatattattaataattccaaacattcaactcctaaaatggtctatgattttcttgacctttcattgtctgtgcagggtggtgctaagaaggtcatcatttctgcaccttcagcggacgcgcccatgtttgttgttggagtaaatgaaaagacatacctgcctaacatggatatagtctccaatgcaagttgtaccaccaattgtcttgcacctcttgccaaggtttgtagcattgcatttttgtcctgtatatagctcattatgaagagcttcattaaagtcaaataaagttgtctatggcccttaagcacttgtatctggcaggtggtgcatgaggaatttggtattcttgaaggcttgatgacaacagtccacgcgaccacaggtatttgatccttgtgccctcttgttatatgtcactgtatattactgaattttcgagactcaactatgtgttttttttaatcttattctttgcttttgaatattcagctactcagaaaactgtggacggcccatcaatgaaggactggagaggaggccgaggcgcaagtcaaaacatcattcctagctcaacaggcgctgcaaaggtacccaaatttgtacagttatatataaacatagcatctggaatcatatttaagccatgacttttttacttgtctcaataggctgttggtaaggtccttccggaactcaatggaaaactaacaggaatggccttccgtgtcccaacaccaaatgtctctgttgtggatttaacttgtcgacttgagaaggatgcatcgtatgaagacgtcaaggcagccataaagtattactctcaaaacctgttcaactaatttgcgtaccattctctatacatgaataaaacatggaacttgtaataacatctcatgattttgatttgaaatctctaacaggtttgcatcagaaggaccacttaggggcattcttggatatacagaagaagatgtcgtctctaatgattttcttggagattcaaggtatgtcactcttaaatattgtagcggatcatttaaaatcttggtactcaaaggttgtggccattgtcaaaaaaattcaggtcaagtatctttgatgctaatgctgggattggattaagcaagtccttcatgaaacttgtctcctggtatgacaacgaatggggttacaggtaacagttagtctctctcatttctttaccatcacatttaccatttgacaatacccaaagactaaaatatgcgtgggtcttgtaatgttacagcaaccgagtccttgacctgatagaacacatggcgttagttgcagccagccgctaaaaccatatcccgccaacgttcgttaggtagtttttgttacattgggggttcgattactgaaccttccggttttggctccaagttttatgtaaaaccatacgatatctaataatatggggaagattttttttgttgtacgaagaaatattgttagcagctagtcgaaaccttttctatatataaaaattggtttccaaagattggaattttctggttatatggttttttgttagcttcaatatctcatctctaagttatgaatattcgaaattgtgacagtgaaccatcgatgagtacacgaagatgtaacgttgagaatgagattatgactttgtacagcgtagtatatgatgaaatattgacgtgacatccacttataggcaaaatgatgtgatagcaaataatatctgcaaagtaaaaacataaacgatctataggactttgttaataatacgatgcaacataaaaacccactcagagaaaatgctggtaaaaagaggaaaagtgtgagttaacaaaaggcagaaggggacaaaaagctttatgcaatcgtgggaaaccactttgatctaaaaaactgtggacgtagtatttaatcattccttatcataatccaaaatgtataataaaaagatatctctacttaacgtggccatatagaaaaccttttaagatgaaggaaagagtaatgtaaaagaattggtaatggtatacatacatactcgtgattttatgaccatggctttttgcatcactagtgagtaatgcccacctacttcgtcaactcaacaacttatgaataactattcaattttttttttgccgattatgtgcacaattttaaaacagaagacaaatgtaaagtatatgactataaaatattgactaaataactttccggcgattttgttagtaaatgttaagaaaatttgttctttttccttgtagaaaaggaatgattctaaattactatcccaaaaaaaaaaaaagtaataacttgtttcgaagagtttgtgtgtgagtcgtatatgccgcttaactcctatattttctttctctttctcacaacttcccctagaaacacttttttcggaattcgaacgcacagcgatcggataatg

SEQ ID NO: 18444 - DNA, 3003 bp, Unknown; identical to SEQ ID NO: 18443
  misc_feature (1)..( 3003): 2750-1469P.txt file - cDNA_ID_1817466; gDNA_ID_1621142; Annot_ID_172866

SEQ ID NO: 18445 - DNA, 3003 bp, Unknown
  misc_feature (1)..( 3003): 2750-1469P.txt file - cDNA_ID_1817470; gDNA_ID_1621142; Annot_ID_56653
taaggctttaatgcaaaccataaagaaacgaagtttggtcacaaacttacgagtataaccatgaagcggttgagtagtccactccgagtattcctacatgtttcttaataccgttcacaaaccgcatgcacacagtatcagcaatcgcacaaacaagaggctgcaccagtgatatggaacatattttatcagaatagcaaatgaataaaccctaaaagatgcccaatataagtttcctcagcaggtgataattagcggatatgcacacttacaactctaattcctttcgtgctgaagtactttgaaacaattatttctgcaacagcctaaaatagaaaatatagcattacttggaaggcaacatggtgagaacaattttggttattgttctacgggaaatatctgtcaaactgcaagctcaattaaaagacacacagtaccttaagttcccctcgagaaaggtaaggcctcttttcaccatcttgtgaaaaacgaacctttcccctttcttctttagattttgtccactctttacatatttcagactgattccacatatcttccatatcttcgggggaagctcgagagtcccagtatgtgaaatcggtgtctgttcaaccggagggtatatttcagttcatatcagaacttataagagaatgatagaggttctccaaatatgagcatagagctaaagcattgccacactgcacgatgctcctagagatctttatatgtttgacataggtgcatgtttatacacgtggagacattgttatatgatacagaacgatacaaaaagagggagagattacttgagcctggggaagcgggattcgtaggacgaaagcttgaagggccagcatcgccatgttttctgcaacaacaattaccaaagagactgaagttttagcttcgcttccctcaacttcttggtgcaactaccttattagtagtatgaacaaaattaacaatatgaaagcccacggcaacacaaaaccttatccgtgcaaccatgcataaaatatgacagcagaaactaggtacatagagcaagcagagataagaagcaacaaccttgaagggagactttctttcactgcaaggtatcgtttccaatatggcaatgtcgacttgtgagtcgccttttttgtcccaccattgtatgctctgacaacaaactcttcacttctctggctgcacatggaaagtaaaatatatttaaagtaattccaagaggaacttagacttgttgtcactgaaattgtaaagctagcaatgtaagcttagggacaatatatatcatacttattctgatagtctgttaaccatttcaggtaagctgccccaaagtacacatttataaagggcttgtgaagaagatcaggattgtcatctacattatatgcctgatagccttggcccctgcaataaagattgaccaaaaccggaacataagatttttttataaacttaagatcttcttgaaaaggagagaaactagaaatcgttttgtacccagccaaccatgctgctgtcttttcgaaaacttgtaaaattccaaggccagtttctttggtctttttgctgtaccgcataatgagaggctttcggtcactttcaagctcagcaattgcacatatcatttcctgcagaggaataggaaggtgcaaaacttcaagatcataaaggggcatagataatttcaataacctaaacagtagctaaaaccaagctcaaaactactagttttctaatgaagcataccgaatccaagatggaatcaaaatgcctccggacagttatatcagaaacagcctgaaaatgtaaggggttgatctcaataagtagaggcagaaagaaagaaaggtctaactagaaatccacatcaatcttgtattggaatgtttgaaatttcttatagattaccctcatctcggtctgtgtaagataaggctgaccatcaggatcccttgagaggtgaaccttctggcctttagtctctccaacatcaatccattcagcactgaccgcaggatccatccacatttcttctaaatcctctggctcaacacaatcattccagaacgtgaaactgttggccattcttgcattgctatacgacctttccattgatatctatcagaaacaaacgaaaaacaagaggaaacagaagcttatttagaacacatcgttaacaacatccataagtaacatgtttgccaaatgtaaagaagaaaatcgaaatatcagacctagccgaaggcttaagcgggaaggaagagaatatcgacgagagaagcagaggaagaaggtttctcggcgaatccagagagaagaagatgatgaagattcaaattaatctctgggaaattcaagagatacagagaattcgacggttcgccatttttgacgggagagccaaaaaagcaaattaatcacacagaggggactgtgagacgagccaactgcagaaacagcacgattctttcgaagaaaatgccacctggcatatcggagctggctcagcctcgtcgtcgtttaagttttaacagtacagaagccatttttagagggagagccagctggacttgacacgtgtcaaactaaatcaggcccattttattttcgcgtggcaaaactcaataaacaacaaaagatacgtcaacgttattcaaatatgaccaaaggcccaccaaatcatgggccttgacgccgatccggtacacgcggctttgtagttttcctccgtgaaatctcaacccttagatctcatcgcaaaagtagttacgatgggccgcgacgcatcagaacacagtcatcgtctttgcagaatcgtaagcatattttacatgagaaattgcaattgcaatttgcatttgtctcatttttttactcaaacgaacattttcgtggctccagagctacactcaaaagccattcagcggaaggggttaggatttttggcggcgagatctctctgtttctggtagcttagcaatg

SEQ ID NO: 18446 - DNA, 3000 bp, Unknown; identical to SEQ ID NO: 7360
  misc_feature (1)..( 3000): 2750-1469P.txt file - cDNA_ID_1817474; gDNA_ID_1621142; Annot_ID_56652

SEQ ID NO: 18447 - DNA, 3000 bp, Unknown; identical to SEQ ID NO: 7359
  misc_feature (1)..( 3000): 2750-1469P.txt file - cDNA_ID_1817478; gDNA_ID_1621142; Annot_ID_56651

SEQ ID NO: 18448 - DNA, 3000 bp, Unknown; identical to SEQ ID NO: 7359
  misc_feature (1)..( 3000): 2750-1469P.txt file - cDNA_ID_1817478; gDNA_ID_1621142; Annot_ID_172863

SEQ ID NO: 18449 - DNA, 3003 bp, Unknown
  misc_feature (1)..( 3003): 2750-1469P.txt file - cDNA_ID_1817482; gDNA_ID_1621142; Annot_ID_56650
caacaatccagagcttagagttccacctgcattgtaagttgatcttttcactttcaatctaaaaaggcttatgcagaaacattatataacttacttaaaatggctggccaagttttctcacatctatatgatccgagaacattcacacactttctctttccacatttatttagatgtggatctctgcattcatcaatgtctacggacacaaaaattccaaacttcacataaggttatatagtacactcaagccctctattcaaagaagttaataggtaccttggcatccgccaggtatgtagggatttccttcgtaaccattgtgacacgaacattgatagctatcttcgaaaaatgtattgcctttgcatagtacacgctttgaagtcatgtaggaaagatcaagacgccattctagctctattgttgtatattcactgtactccattaattcgggaggagtaaacaaggaccctgacaatgtgaattgagtcaagaaggcaacctgacatccttgtttatttggttccagtttctctacggttgcatcaaacacttgaagttgaagaagaggtggtatagtcatctggcagcatttgtaaccaacacaactcgtgttagctcctttgtaagaccgtatctcatttccacatgtcgtctcacatcccacgatttgtaaccctgtgacattcatgaacgccttgttgttgcatccaacagctgtgaacttattgttttctgatatgaagaatgggctgcccttcaaattcaaagacgatgatgaataaccatctctgttgggacaacctgaatgtttcaatggactctggatgtagaatttgttgtacaccgatatggagaaagggtctccaaggttgaaggaagtaactgctcgtcggatccttggcaacaaaagtatcggttgttggtctgatgagcttttgcagacaatctcgaaccatttgttcttgtaacaacctttgcctatcccaaaagggtaaggaacactaacatttccgcaatggtcactgcaattacgaagtgcaagaggaaaagtagaagcagctgcgtattcacagattcgcaacagaagcataacaacaaggaaacgtttcacatcaacacccatttgctctctctctctctctctttctttcaggagccagaagttctgttcaggctcaggcacacctctctctctctctctctttctctaacacagataagtcaagagtcaaccttttcacttttatattaattttgcatgatacatcaacgaagaccttgacccatatgaattgaggccataacatatttcagtagtgggctccgtagatacagcagaaaccacgaaaaaagaggataatgtttgtaattaaatgttttaagatattctttatcaaaacaaaacgaaaaatgccaaagatattcatgttgagcctcttcaaacgaaacacaagagtttttagtttttactgtgagacgaagtttttcattaagcagaacgttttaaaatggatatgccggtacttgagatttttttcattaaaatatagatcactatttgggtgacaattaatgaaacaaaggagcccatagtcatggtcctttaatttcaaaatgggcccaaaattagtcatggtccttttatcctttaatttaaaaatgggcctaaaattcgatatcgaaccaaaataaacattgggatggttacatttacttgtagcggtcgacaaaaaaaaaaaaaaaacatttacttgtagcggccaaaaatcccacagcatattgaaatgaaatttccgaaactgaattcaatgcaaattgaaatggaatcagattaatggaattcagaaaatgacaattcgtgtgggggaaaaaaaaaacattacgtaaggaaatataaagagagaaactttataacgaaaatgagattgaaagtatccatacgcacgttcttctaatttccattaaatttcatttaggatctgatgatattgagagtcccatttaatgcaaaccgtataacataagctacggagagagacttgttgattccatgcttctcacttactccttcacccccaaaatcttattcttctttcatctccgccgtctatttttcatcaacatcgatagatgtacggttctcgtttcttctggttataaagcaaccgagtcgcacggacacgaaccattttgtatttttctttccattacaatacaaaaaaaaagaagcaatttggtcatttttatcatttctttaagcagattttaccattttttgagtaagcaacgaggaaacctagagaaggtgagagaaaatcaacaaaaataaagataaaaataaaaagttagggttttgatgcatattcttagatttgaacaaagagaagaagatagtttttgattgttactagctctcacaatccttcttgaatctattccacctgtcaagctctacattttttctttgtggtattgttctatcagttttggattctttgccattttctgattctttatttttttggtgtctgaagctaattttagcgatttggtatggtgaaatctttcaaatcgagcgaaggttttgtttttcttaaattacttctattgaggtttttggattaattgatttaaggttgttgtagagaaagtttccatttttggaacaaaaagcatgtttttggagttttctggtcggattattcatctacaattgcaaatgggaagaactttgatgagtagtctgtgtttaattgatagtttctggaggattcaacttctgccaaaacttaattatttctcccaattgtttttttttgcagcttaaatatttgggaggggaaatttgtagcctacaatctctgaagcaatttggcatctttaaagttttagcagtgattctttatagttcagtatgtcagattcttgttacaggtcttgtcagttagaataatttgaaggactgttgttgttgttgttgttgttgttgttgtgatg

SEQ ID NO: 18450 - DNA, 3003 bp, Unknown; identical to SEQ ID NO: 18449
  misc_feature (1)..( 3003): 2750-1469P.txt file - cDNA_ID_1817482; gDNA_ID_1621142; Annot_ID_172862

SEQ ID NO: 18451 - DNA, 3003 bp, Unknown
  misc_feature (1)..( 3003): 2750-1469P.txt file - cDNA_ID_1817494; gDNA_ID_1621142; Annot_ID_56646
tacccctgaagagcaagaatcaattgaacgggtacctacacttacattcctcaccaccattatctcaacatgtaatgccatttctcatcccttctaacacttgcgttaaacctttctgatcagcttgaggcaatggggtttgatagagcaatagtcatagaagccttcctttcctgtgaccgtaacgaggaattggctgcaaactatctactagagcactcagcagattttgaagactgagttccgagccttttaacctgaacaaagcacaagattttgttttgtttctccaccccttttatctgaactgttactatgctcagagaatcaaatgattatatcttacacctccatatttaccttgaagaataatctgcgttttccacactgtaaacacaattcattgtgtttctctctactgaaatgattattaacaatatgatatggttttaaataaattgtggtcatactcgcatgttgtgtgattgtgattattccagctcacaggtatccttattaaatcgatattgtctggctatatcatagtgtttatacacaaagcacaagaaacaataagcaatgttacacagtatctctcactaaacatattttctgggaaacaaaagattttcatcatgctctctgccatgcatctccttcttcatcacaccttccattgttctgactccaggttgcatttcactcattagcagcagcagccgcagcctgttttaacaataatccatccctattaatcaacacctctgcctactacttccagagacctttaggtgtgttaactgcaaacttatttgctacaaacgcaagatggattatcacttacctggttaagaggattatctggtgatttcttccacatcttccatatcaagtccttgtactgtgtgtgagttagacctggtttctcagacttgagccttggaagttccacttcttcatatgcctaaatcacaatcatagaaacaactcagtatatagatccaccagaatttggctttgcgtatcatgatcaatctatcaaacaattatcatttcaacaacagaactctcctaatatataacttcaaaaattcatacaagaacaatccggattgtctgctaatatgatccactacaaggagcaactactaatttcctctataatgacggaatctgaacatcaaacacaagtgctatgaatcaagaagcattatagcaaaaggcacacgaggtataccttaaaagaagccttgagcctcttctccgggtgtcgatcaacgggcaggttatctgacacagtaatccgtgcaagagcctcgtcaacggtatgtgcctcgatgagagaatcatcgcgattggtattggtcaccagaaccatcttttcatactcatcttcccctgccatgcgagtctgtttcttcttagagtcttctgctttcttagccagagccacttgatcttcctcgcgtcttcggatgagctcagcctctgtgaccttaggaaccggcacagtgacgcgattcgccttcttgtctggctttttcaaagccttctccaactctttctcctcctgctcagccagacgcttcgcctccaatttcttagcggcggtctctgccttcttctccgcttcctcttctcgcttcttcaccgctttggatttgggaccttccgcctcgcgccagtattgttcctctttctcccgagtctgacgatccttctgctcagcctccgcggcgttcttacgagatttggcgacctccgccttgctgttcagacccatcttcttcggcatattcgattcgctggggttaattgatctctctcgctctctcgattgttgaattcgcttagggttacgattcaactttgtgtgatagataagaaatgaattaaccgtaccgctcagagctgagaattgactggttcgatcttaacagctttgtttggttaaggcggtggctcaaaagctgggtcaacaaccgatcgatcatttcatttgttaaggtcgttaaccgggattctttttttcaaaaatccactacaatcccttgtccaaagtttagagggccgcttaacggttcaaccaacttaatccgagaaaagcccaagttttgatggagtttgggaaatttgaactattttaaattggcaataaccataatttagtttgctttgtaaagtaattgatcacacactatagacttttacttctcttagacattaggttttgataggaggagaatctagtgtatttttttttttttcacaagaaacaacgtatgtaacaattatatacacttgatgcatattcttaggaagagtttggacttcggaaatattgattttttacatgcaatgttagacatagaacctgataaatttggagtcttagactaatcactataaaacatatatacagtgattgtcatttgattgaaacatccgaccagaggcaagagacacgtttcaggttctatgtcaattacgtgaacaattcttgctaatactaaatgtttcagtaaaatcagatttttaaaatttgaaggggcagaaaacatttaaagagtgataaagtggctcacgtgcagtaccaagctgcgacctctttccaatatctctctctctttctctaattctttttgactaaaaataagtacttttttgaatagtcagtcttaacgggagtggagttagtaaacacttttgtgctctggtctgtgttcaagttttgtctcttctcaaacagagaatcctaaacagtttacgagattcttgattgtctctactcactaatgttttgtaaagatgtgatttttgcttctctctatcttagtcttttttcttgttgatgttgaaatggaagctgtgagtctttaaacgggaatttattgccgaccaaaccccagacaaaaaaacaggtctctggtagattctatttctaactatcgattttaagaaaaaggctttaacttgttttgaaagattggggatttgcaaatg

SEQ ID NO: 18452 - DNA, 3003 bp, Unknown; identical to SEQ ID NO: 18451
  misc_feature (1)..( 3003): 2750-1469P.txt file - cDNA_ID_1817494; gDNA_ID_1621142; Annot_ID_172856

SEQ ID NO: 18453 - DNA, 3003 bp, Unknown
  misc_feature (1)..( 3003): 2750-1469P.txt file - cDNA_ID_1817506; gDNA_ID_1621142; Annot_ID_56675
aattggtcaataggttacagatggttggatgaaatctctgcggctaatttaagttcaatattcttgaagattacacgaccaagaagtcaaatagaatagtacaggaatgatatatcaatcgagtacagcgcgggcccttcgtttttgtcgattatttcattataatgaatttctttccatgataactttatgttttgttatctgtttaacgtattttttgttgataaaaacgtttttttttttacgttattaatttttatagtttatctgcccgacaagaattgtaagttcctcaacattacaaataaattttggttagtttaaatgttttaagcacttcttgtctcctaaacgttatccgcatgtttcaaacgtacaatataattccttcttagaaaaaaaaaatcaaatagatacaaggatataaaagacatcgaggcagaaacaaaacatcgaccaatttcggagtcacactagacaagttgttcacgacacacttgtccccatgcgtttttggatatttctaattcgtttttaattaatgaaaatgttacattaactaaacggcatgtttacagaaaaaaaaaaacaaaataaaacgacatacttatttaataattttattaatgttcttcagtacgactttccaactatttccatatttttctatataaataaatacacacaaaaattagcgatatttatagaaaagagaacagacaagtttatgaaaatcaaaagaaagaattttatttttggtttaaagtttaaactgacgtgtgattaaaggtattaaagagtggcaggtgggtttggttgtacggtcatttattcatatagagtgtgacccaccaactctctgcctgtccttcttttctcttacccccagtacggatccttcttattttatcattatttattttgcattcatatcttaaagacttaaaccttgacgtcacttacggaagccaaaaaaaaaaaaaagacactgaaatctgatgaaagaaaaacctgaaacctaaaaaacatatgaaggcctgtcggctcggcctcaaatcattgcgatttatcttgggccttcacaataataaaggcccatcatatttttgaataagactctagtttctgtattcgtttgtactcatgtatacgctaactactatatacactgatacacaagttaagcaaatgtgaaattaaaatagataaagaaacaaaaaataataaacgttaccaagaagaaaatgagttggtggtgattaatttgcggctaattttgggggaatataaaaagaaaaaattaccgtattttaaaaccggtctatataggatcgagcttgctaacaccattttagtaagagtcttgattggttcgctttaatttttcatttttgtatctgactgccgcaaactaagtaatatcaacactcaaaagtcacgataataaacattataaaaccttttcttcgctgtcctacgaacgtaccatattacttgattccgaaccagacaatattagacagacaaccaaactaacacaaatcattattctataagctgcggtctaacctactattcaaaatttagttttacttcacgtattaaagaaaggtacgaataacagcgatgagactggattttttttaacatggtaattaatataacgataagtacataattaaacaatactacaaaataaaactaaaaaacaatttcagcgacatctttgattacagattctaagaaaacaccagagaaagttagattaaaatctccctgagcttgttgtgtatcactaaacctcataaacgatgccgttcttggctcgccgactcgattatctggtgagatattctggaaaatagcgaagaatctgagaaagacaaaaataatcagagcaagaagataacatatccgagatgcgttgaagaacaagtgatatgctgcaacttgaagacaatacatctttttctcttcttcttcttgtctatttcgagtattaaaaggttaaaatctcagaagatgatgtttttttttcttagcatcgagatgtgtgtatatataatagtatacgtgtgtgtgtgatgtttgttgtgtatatatgtaatccgtaatcgcatgtacgcgtgtatctaacgcacacagacaatcagacatactcgacgacaccactgtggtccgaacaaagcaataaatgttcaaagccgatagttgtctctcattgatttggtactgtagtccggtttggatggtataccaggcgatacaacctattacctaagtggaggagattaagatccgattaattgtttaatcgtctgaataattaatgcaaaccggaaaaaaccggttatatgtttatacatgtaaggaaattgaatacacgtagatacgaaattgatatgcatttcaatacgtgtctggtgattctgctcaactgcttagatgtagacatctcaacttgtaaccagaagatactgaaacctttattattgcatttctaaattttagaattctattttcttatatactatatggaatactttaatgccacataataataaatgagagaattcaggtcattatatgtcattttggagtgtaggaccaaaatggcactaacattttcaattttattttattttgtgaaaaacaattttgagaaactttaaaaagtgtattttttttcctctggtttggactttggagggaaaagtaatcaaaagtgtattcttaaaattcaaacaagaaaaattcaaaatagagacaggaaaaagatatgtagccaatgataaaatgccaggtgtaaagttctgttttgtctttttgatttcccttctgcaacaacttacaggcaatcggacaattccagagctaaaaaaccctaatcttctcgggcttgtcatctccaaaattcagggttcaatttcttcaccatagaagatatagcgttatctccggcgtctaaggggactttagggacattcttgtggtggagaaatg

SEQ ID NO: 18454 - DNA, 3000 bp, Unknown; identical to SEQ ID NO: 7388
  misc_feature (1)..( 3000): 2750-1469P.txt file - cDNA_ID_1817513; gDNA_ID_1621142; Annot_ID_56671

SEQ ID NO: 18455 - DNA, 3003 bp, Unknown
  misc_feature (1)..( 3003): 2750-1469P.txt file - cDNA_ID_1817533; gDNA_ID_1621142; Annot_ID_56664
acatgttttcggatgatgggagactaggaaaagccgaaaaacatcatcttgaggtgattttcaacactctaaactgtttgccaggttttagtcccgtggattacgtggaccgatggttaggtggttggaatattgatggtgaagaggagagagcgaaagtgaatgttaatcttgttcgtagttacaacaatcccataatagacgagagggtcgaaatttggagggaaaaaggtggtaaggctgctgtggaagattggcttgatacgttcattacgctaaaagatcaaaacggaaactacttggttacgccagacgaaatcaaagctcaatgcgtcgtaagtaaaatgtaacttttataaaagagtgtatgttatacacagaaattgtacactaaataagccaaacagaaaaaaaaaaaattatgttgaatactatatattgactaaattgcgagatctacacatatataatctaagtatattaattatttgttattctggtgttttttacaggaattttgtatagcagcgatcgataatccggcaaataacatggagtggacacttggggaaatgttaaagaacccggagattcttagaaaagctctgaaggagttggatgaagtagttggaaaagacaggcttgtgcaagaatcagacatacgaaatctaaactacttaaaagcttgttgcagagaaacattcaggattcacccaagcgctcattatgtcccacctcatgttgcccgtcaagataccacccttgggggttattttattcccaaaggtaaaacatatagggaatacatatgttttttatttacataagatttaacgtttatagctagtaagtttatgcatgagcttcgttaacaaaataaaacacatggttttggtttgtggctacatatgatacaacctaaatttttttgtaatacttttttgtttaaaataccaggacaactagtaaatttatacataggtttccttaacaaaatctcgatacaattttgcattatatattaagaaatattgatgattggacaggtagccacattcatgtatgccgccctgggctaggccggaaccctaaaatatggaaagatccattagcatacgaaccggagcgtcacctccaaggagacggaatcacaaaagaggttactctggtcgaaacagagatgcgttttgtctcatttagcactggtagacgtggctgcgtcggtgtcaaagtcgggacaattatgatggctatgatgttggctaggtttcttcaaggttttaactggaaactccatcgagatttcggaccgttaagcctcgaggaagatgatgcatcattgcttatggctaagcctcttcttttgtctgttgagccacgcttggcatcaaacctttatccaaaattccgtccttaaaaacaagacgccttgttttttctctgtgatgtgtttcgacgctttgtcgtttctgtattacttgacgtactgttgtttttagactatccattgcccgaaaacgctatattgttaaaatcgtgtgtcttgtttattcttttgtatctccgtaacttaatcatgaatatcaatcaataccatatgaggttaatgattaccgtgtttaattgaaatggtgtgaagaattaggttaactataccatatgaggttaatgattaccgtgtttataaattgaaatggcgtgaagaattagactacatgacaccaacaagaatgttttcctttatcaggataaacgtgttcacctacccaaggtattatttatttattcaaataatagatattggttatgtttcgcacacacacaacaacaacaaaaattagatgtagaaatatttcactggaattcacctttcaatgttttattgatgaaattgatagagcggagagtattcaaaactttaaaagaatagtttttttaaacagaaaatagataaaaatccaaaagaatagttataagttaaaaaaataattgaaccatagttgatgattttttttccccggatttttggaaatcaaaaatgaattgaagtgaatcaaagttgatgataacaagtgaagaccagtttaagacaaaacaatcggattctttggttaactccgattcatgatccagtttgctgctaagctaagagaaagatcaaaaatgaaattttcgggagtaactggtaggagaatgggagatggaaagccaaaggttggataagtgtataaaaagagagagtcggatgttcataaattttgtaataaagaactgcggttaaaatcttggatccctccactccacggctccactgtgtagagtaaattcttgacgcatgttcatagacatagtaatacgtgaaatgttgtgattcgctttttttcctttggagggaaaatcccccttgtatttgggatctctcatgttccattaaccttatccagattccaatattgaaatatcgaatatatatagtcgtgtatattagtgattaaacatatatcacaacaccactttacagtcacatatacatatatatttgaattaagtgttcaagtttgtaatatgagttttgtggatctagcaaataaaattgaaaggaattatatggataaatttattttgttaattcaatatattttttatggataattaattttaaaaattttactctctttttttttacggctaaaagacgtttacattcaaaatacaaaacaaactgtttttgtgacaaaactaaatcccttgaaatagcagtatagacgtagtagacattaaaaaatctatagagcttttactatcgctactcatcaaactagatataaaatatatataaacgtgattaccgtagtacctacccaaaagcccaaaccctacgtgagcatcacatgcatgatatcgattctataaataatccacacaacaaacactttccagatatcgctagtgttcatttctaacaaatgcacacctcactacacgcatacatacatcatgatg

SEQ ID NO: 18456 - DNA, 3003 bp, Unknown
  misc_feature (1)..( 3003): 2750-1469P.txt file - cDNA_ID_1817533; gDNA_ID_1621142; Annot_ID_172879
tcaacactctaaactgtttgccaggttttagtcccgtggattacgtggaccgatggttaggtggttggaatattgatggtgaagaggagagagcgaaagtgaatgttaatcttgttcgtagttacaacaatcccataatagacgagagggtcgaaatttggagggaaaaaggtggtaaggctgctgtggaagattggcttgatacgttcattacgctaaaagatcaaaacggaaactacttggttacgccagacgaaatcaaagctcaatgcgtcgtaagtaaaatgtaacttttataaaagagtgtatgttatacacagaaattgtacactaaataagccaaacagaaaaaaaaaaaattatgttgaatactatatattgactaaattgcgagatctacacatatataatctaagtatattaattatttgttattctggtgttttttacaggaattttgtatagcagcgatcgataatccggcaaataacatggagtggacacttggggaaatgttaaagaacccggagattcttagaaaagctctgaaggagttggatgaagtagttggaaaagacaggcttgtgcaagaatcagacatacgaaatctaaactacttaaaagcttgttgcagagaaacattcaggattcacccaagcgctcattatgtcccacctcatgttgcccgtcaagataccacccttgggggttattttattcccaaaggtaaaacatatagggaatacatatgttttttatttacataagatttaacgtttatagctagtaagtttatgcatgagcttcgttaacaaaataaaacacatggttttggtttgtggctacatatgatacaacctaaatttttttgtaatacttttttgtttaaaataccaggacaactagtaaatttatacataggtttccttaacaaaatctcgatacaattttgcattatatattaagaaatattgatgattggacaggtagccacattcatgtatgccgccctgggctaggccggaaccctaaaatatggaaagatccattagcatacgaaccggagcgtcacctccaaggagacggaatcacaaaagaggttactctggtcgaaacagagatgcgttttgtctcatttagcactggtagacgtggctgcgtcggtgtcaaagtcgggacaattatgatggctatgatgttggctaggtttcttcaaggttttaactggaaactccatcgagatttcggaccgttaagcctcgaggaagatgatgcatcattgcttatggctaagcctcttcttttgtctgttgagccacgcttggcatcaaacctttatccaaaattccgtccttaaaaacaagacgccttgttttttctctgtgatgtgtttcgacgctttgtcgtttctgtattacttgacgtactgttgtttttagactatccattgcccgaaaacgctatattgttaaaatcgtgtgtcttgtttattcttttgtatctccgtaacttaatcatgaatatcaatcaataccatatgaggttaatgattaccgtgtttaattgaaatggtgtgaagaattaggttaactataccatatgaggttaatgattaccgtgtttataaattgaaatggcgtgaagaattagactacatgacaccaacaagaatgttttcctttatcaggataaacgtgttcacctacccaaggtattatttatttattcaaataatagatattggttatgtttcgcacacacacaacaacaacaaaaattagatgtagaaatatttcactggaattcacctttcaatgttttattgatgaaattgatagagcggagagtattcaaaactttaaaagaatagtttttttaaacagaaaatagataaaaatccaaaagaatagttataagttaaaaaaataattgaaccatagttgatgattttttttccccggatttttggaaatcaaaaatgaattgaagtgaatcaaagttgatgataacaagtgaagaccagtttaagacaaaacaatcggattctttggttaactccgattcatgatccagtttgctgctaagctaagagaaagatcaaaaatgaaattttcgggagtaactggtaggagaatgggagatggaaagccaaaggttggataagtgtataaaaagagagagtcggatgttcataaattttgtaataaagaactgcggttaaaatcttggatccctccactccacggctccactgtgtagagtaaattcttgacgcatgttcatagacatagtaatacgtgaaatgttgtgattcgctttttttcctttggagggaaaatcccccttgtatttgggatctctcatgttccattaaccttatccagattccaatattgaaatatcgaatatatatagtcgtgtatattagtgattaaacatatatcacaacaccactttacagtcacatatacatatatatttgaattaagtgttcaagtttgtaatatgagttttgtggatctagcaaataaaattgaaaggaattatatggataaatttattttgttaattcaatatattttttatggataattaattttaaaaattttactctctttttttttacggctaaaagacgtttacattcaaaatacaaaacaaactgtttttgtgacaaaactaaatcccttgaaatagcagtatagacgtagtagacattaaaaaatctatagagcttttactatcgctactcatcaaactagatataaaatatatataaacgtgattaccgtagtacctacccaaaagcccaaaccctacgtgagcatcacatgcatgatatcgattctataaataatccacacaacaaacactttccagatatcgctagtgttcatttctaacaaatgcacacctcactacacgcatacatacatcatgatgagctttaccacatcattaccatacccttttcacatcctactagtctttatcctctccatg

SEQ ID NO: 18457 - DNA, 3003 bp, Unknown
  misc_feature (1)..( 3003): 2750-1469P.txt file - cDNA_ID_1817537; gDNA_ID_1621142; Annot_ID_56663
cagtgcaacttgatcattattgaaacagatttattatagcgttttacagcatctattgattgtaattttgtacttatcttacaataagatatatataaatatatttttttcctcacaataagattcaatctaagaatatgaatttattgacgaagatgtaaaataaatgaaactggctttttttatgaagatgtatatcaagaaatgataataattcatagaagaaaaaatgataattataaagaagtagaccctaaaataaatagttaaccccaaagtggttgagtgggggatcacatgcagcaaattaacggcggtggggaagaaggtctgagaaattaaccaagagatggctcatcctcagccattcacttagccatcgagagatctcaaacccattaatcatttaacttactgaacatatctaataaatgtgtgtttatatatgtaatgagttagacgccaaaaataaattatagactagagacatgtcctgctagctggatcctagtcatcacggtctcacgagcagtattgcatccaattttcgatcacaatatttacaaaaaattcccaccactctaaagttgtagtttattctctatatatagagtaacataaattgattggacatgcaaatcaagtcaaacataaaagtaaacaaaaccctatctcttcctatatatggccgactcgactcggccgcttctctcagatttcaactcgtccgagtcaaatcttccgccaccaagatcccttgaggagacgatagagcgatgcattggagacttcgggtgggcacagtttctccaagccgctttagtctcattcgcttggttcttcgacgctcaacaaacattcatcaccgtcttcaccgactcacaacccatgtggcactgtgacaactcggaccgagtcgactcagtatgcaacacatcctcctccaacctctgcaccttacccaaccaaacctggtcttgggacttgaacccacacgtttcaatcatttccgagtgggggctacaatgcgccggctcgttcctcaagggatttcctgcaagctcattcttcctcggctgtctaatcggcggcttagctctctctacactcgccgactcatcgctcggtcgtaagaacatgctcttgttgtcgtgtctcataatgtctctctcttccatgttaacagctttctcaacgagcatttgggtttatgcgtttttgagattcttgaacgggtgtggccgagccacgatcgggacttgcgcgcttgttctatcaacggagttagtcggtaaaaaatggcgaggacaagttggagcgatgggtttcttttgcttcacgctagggtttttatcgcttccgatgttaggttacattaatgaagggaattcttggaggaatctgtatgtttggacatcgataccgactttaatctattgctgtttagttcggagtttcgtccgggaatctcctagatggcttatcgtaaagggtcgtaaagaagaagccgtctcaattctccaaagcattgcttctaatgcaatcactatgagcttcacaaacttatgttttgaagtagaaaatgatcaatccaagtcaaatcctgatgtttatgatgcgttaaagatcttggtgaggaaaagttggtcgtttagaagattattagcggcaatggtggttggattcggtatcggtatggtttattatggaatgccattagctttaacgaatctaaacttcaatctttacttaggggttgtgttcaacgccttgtctgagttcccagcttttctgataacgtttttcttcattgataaaatcaataggagagatgcgttgatcggatttacagctctaagtggaatctctagcgctctaatcgcggtgttaggacaacaactagggtcattacagattgtgttagagctcgtttcgtttttcagcgcatgcaccgcatttaacatgacgcttatttacacaattgaaatgtttccgacatgtgtgaggaactcggcgatttcgatggtgaggcaagcattggtgtttggcggcgtgtttagtccagtgatggttgctgctggtcgggaaaatcagttttggtcgtatgggttgtttggtttgatcataggattgtgtggattgtttgtgtttggattgccggagactagaggaagtgttttatgcgacactatggacgaggaggagtataagactttggcaaaaagacaatttattggttgatacttgatactgttgtcttttgttgtaatggttaaaaagtttgcaggcttaaaccagttcggtattgattcaaatcaattctgattttaatacttataaaccacgggttaactccttacattataagtgactgtctcatctgtaccggaccataaaccaaattcaaccaaccataatccccctttcaattttgatctattcaacaatgactcatgcatactttatttcccttatctcatttccatattcgaaatgtaagctctaaaatggtactcttaactgaaactaaaatatatataaaaaaaaaaaaatctacatttcttgaagaaacatttttaaaattaactatagttgctaaattactattttagattgacatatatatatatgtagaccaactaattaacccactgaaatgcaaagagatggtctgaaaatcaaaacagacatctaaacgtggttacctacccaagagctcaccagcctatagtatcccattccctttatattgaatcactttagattatcttttctctttcatctttccaattccactctatattaaagaaatattattttaagaataaacaggatcgtattttcatcatatgccaatatgttatttggatttaagattgttttcgaatctataaatactaattaacacaacaaacaatttccaaatatcgtagtgttcataacgaaacgagcacacaactcactaaacactcaaacaaaaatacaaacattaagatgatgatg

SEQ ID NO: 18458 - DNA, 3000 bp, Unknown; identical to SEQ ID NO: 7401
  misc_feature (1)..( 3000): 2750-1469P.txt file - cDNA_ID_1817544; gDNA_ID_1621143; Annot_ID_56697

SEQ ID NO: 18459 - DNA, 3000 bp, Unknown; identical to SEQ ID NO: 7401
  misc_feature (1)..( 3000): 2750-1469P.txt file - cDNA_ID_1817544; gDNA_ID_2214460; Annot_ID_182719

SEQ ID NO: 18460 - DNA, 3000 bp, Unknown; identical to SEQ ID NO: 7401
  misc_feature (1)..( 3000): 2750-1469P.txt file - cDNA_ID_1817544; gDNA_ID_1621143; Annot_ID_172935

SEQ ID NO: 18461 - DNA, 3000 bp, Unknown; identical to SEQ ID NO: 7396
  misc_feature (1)..( 3000): 2750-1469P.txt file - cDNA_ID_1817562; gDNA_ID_1621143; Annot_ID_56687

SEQ ID NO: 18462 - DNA, 3000 bp, Unknown; identical to SEQ ID NO: 7396
  misc_feature (1)..( 3000): 2750-1469P.txt file - cDNA_ID_1817562; gDNA_ID_1621143; Annot_ID_172922

SEQ ID NO: 18463 - DNA, 3000 bp, Unknown; identical to SEQ ID NO: 7392
  misc_feature (1)..( 3000): 2750-1469P.txt file - cDNA_ID_1817565; gDNA_ID_1621143; Annot_ID_56684

SEQ ID NO: 18464 - DNA, 3000 bp, Unknown; identical to SEQ ID NO: 7419
  misc_feature (1)..( 3000): 2750-1469P.txt file - cDNA_ID_1817596; gDNA_ID_1621144; Annot_ID_56716

SEQ ID NO: 18465 - DNA, 3000 bp, Unknown; identical to SEQ ID NO: 7419
  misc_feature (1)..( 3000): 2750-1469P.txt file - cDNA_ID_1817596; gDNA_ID_1621144; Annot_ID_172973

SEQ ID NO: 18466 - DNA, 3003 bp, Unknown
  misc_feature (1)..( 3003): 2750-1469P.txt file - cDNA_ID_1817611; gDNA_ID_1621144; Annot_ID_56711
tcgctttttgctatttccttgtaacttaaaagaagaaaaaatgagaggtagcggagcaaagatcgccggcgttttgccgttgtttatgctattcatcgccggaacaatctccgcctttgaagacatagagaggttgaggatttggccgttaccggcacaagttagccacggtggccggagaatgtatctaagtggagatttcaagcttgttacggagggaagcaaatatggagacgcctcagggattttgaaagaaggatttgatagaatgcttggtgttgtgaggctgagccacgtcatctccggtgaccggaattcttcaggcaccggtggatctgctttgcttcagggacttcacgtcatcatctcctcctctaccgatgaggttagtttcatctatcaatctacaacaacaatttttcttaatgatatatcttcaagttgatgaaaaaagctttacgtttaatgtcattataagttacaatcatctcattattaccacaatcaaagacaaatcaattgtctttatctttaacaaaaaaaaaatcaattgtctctattggttataaattgtatcctctttttttggatatgtcattttcacaaatgttgcaacatattatttttttcttttattttattttcttttctttttcctaaaacactttctatccactagtccacttatatattatttatgaaaaaaagagaaagaaataatatttctatattatcctaaaaaatatttaatgaatttcatcgatattttggatataatcatttctttaaatattaaaattttgttaatattacagcatgaaaattgtactaacgtttagttcagagtctgtctggttaaagcaaatttttctatatttttatttagaaaatttagaaactaaattagacgaattgacaaaaacaaatatatataattttatgaagtttagagtttataattattttcattatacgtagaactaatctgagcagttttcattatttagtgcattcccttttgattttggttaaattcataccaaaactaaaagagattgaatataatgggtgtatatttttcctgaaatcataagaatttgactaaaatttttagtaaattcacaagtaaaaaaagaagaagtagaaattcttctattgatacgtttattttgtgttctggagaaaaatatttctcattttttttttttccacttttccatcaaagttatgctgaaaactttttcattttttttaatcctggttggtattaagaaaaattgagacatatatttcaattgttttcctctaacatgtttaccattcaccaattggtattatttgttttattgtcttcatttataactatttttcttttgtcaactcttgataaacaatttttctctttcttaacagaagttattttagaatatattttacaaattggatcctagtttacgcaactttgtccatgagaattgagatgtgcgtagatgtatcgattatccaacttcttatcttttttttatttttttgggttgcttggctttgttgattggtgtctggcgacttggttgtgtggtggtccaccaactcacggacatcctcgttatcttcaatcagatcattgaatatatatttgttctattttaagatcattgagaatattttattccgagatccagattttaatcagatcatttcaagatttcacgtaatataaatcacaaataagtggaaaaaaactctataaaattatagtcacaagtggtagctagtaatgaaactttcatattggttgaaatacgtatcaattatattaattaagtcttttgacaaccatacgatatagctggtgcaagtgtgcaagattattctagattctggtcctaaataaaaaaatatttatctatttataaagatatgaaagtttaatagtacaaccatatatcattgagaaaatatgataatgtctaaattttcatactaaaatagtatacatcatggcctaatcttaaatcttaaatatgaaactaatttcattgtatatacattatttcatgttcttgttatgaaattaatcatctgaacattgacgtaaatttaataatatttaaaatgggaaacccccccagtaaaaaaaaaaaagatgattgaataatatagaaaatattgtttgtactaaaaatccaacaaaggtcgttaaaatttgtgtaattttcgtgttgcagttggaatatggagcagacgagtcgtacaaattagtggttccatctccagagaagccgtcttatgcacaacttgaggttagttggtaccattgaacacctaaccccagcttttgtcactttctctaactacttatatccataaagatttaaatgtaaattcagctttataaccataaaagaacctaactttgaagattttgttttctttaatagttgagttcgacatgcaatcaaattttcaccgtaaaatacatgtttcagaaaagaaaagaaaaaaaatgaaacacttctgttgtgttttgttttatgatctagtacttttgcagcttccttttaaatgtaatttttttttcacccactatagagacccatgtaacataggtagggacatgaaatggtgtactccacgtgagctgtattaaacatgatgggataattagtgtggtcatattttgttttttcctctataagaatacaaatgcttaagcacaagtcgttagctatttattatgtcaatatagagaaaggtacaaaattattgtgaaagataagtgtgattcccactagtgttggactgttgtgtttaatcaaatattatatgaaaagaaaaataatacaatctccattgatatttatgttaccacgcgtgcaggccaagagtgtttatggtgcattgcacggtctacaggtttgtgtttgctatttttccaatttggttatcattatagttaattaaagatttgagttactgaagaaaatgaaattattgtaaatg

SEQ ID NO: 18467 - DNA, 3000 bp, Unknown; identical to SEQ ID NO: 7416
  misc_feature (1)..( 3000): 2750-1469P.txt file - cDNA_ID_1817619; gDNA_ID_1621144; Annot_ID_56709

SEQ ID NO: 18468 - DNA, 3000 bp, Unknown; identical to SEQ ID NO: 7415
  misc_feature (1)..( 3000): 2750-1469P.txt file - cDNA_ID_1817627; gDNA_ID_1621144; Annot_ID_56707

SEQ ID NO: 18469 - DNA, 3000 bp, Unknown; identical to SEQ ID NO: 7413
  misc_feature (1)..( 3000): 2750-1469P.txt file - cDNA_ID_1817639; gDNA_ID_1621144; Annot_ID_56704

SEQ ID NO: 18470 - DNA, 3000 bp, Unknown; identical to SEQ ID NO: 7434
  misc_feature (1)..( 3000): 2750-1469P.txt file - cDNA_ID_1817658; gDNA_ID_1621145; Annot_ID_56729

SEQ ID NO: 18471 - DNA, 3000 bp, Unknown
  misc_feature (1)..( 3000): 2750-1469P.txt file - cDNA_ID_1817670; gDNA_ID_1621145; Annot_ID_56726
agcattccaggtttgatccagtttgtatgcatgtggataccagtagaggcacaacacttggggtgctaaaataacctcgaattaacatggttcatatttctgttgtaccatattcaggtatatacaaactttatgatctagatttaattctttgtttacatagttcctggcaattaaattcgttgttagtatttataaatcgttataaaacggtacgagttcctttcaaataatcttgcaaatgattcggccagctgaggaagaaagtatgtttggtgggtttagaaatcaattgatctgtgtttttgatgatataatgagatgtaaatttaaagagtatatataggttctacacgattaggtcaatcatatcttgatggccaagggaaatttattggtactttaactaattaggaattaatcattaatgaattttgtcaagatttaaggaagtgattatgcaatagtttttagtactacttaataatatccattttagtaagaaattaatgcaatatttgaattgttgatgaaaaatttgttcattgtcctaatgagaactaggttttaacacgcggtttaccgcgggcaatcggtttatttggttcttatactaaatatttgaataaatttgatatcctaaacttataaatataaatttctagtgattagtgaagaatcgtaatatatgatttagatattattaattattgattttgtgattgaatatagtgtttttagggatggaatgtgattatattttgatttcaaaaacgacatagattccttatttttgttgaacggtttagattgaagggaattaattttattgaatggtttagattgaatcggatcatataaagtttaggagattgttaagaccaaattacccttaatgattttgaatagcaaagaataaaatccaaatttgaaatcaaaattgaggccaaattagacaaaatttcaatttgtacttcccttttaataataaagggatatcttgtttcattaaatttgtaaggactaaacatataattaggaagttgactaaggatttttcaacccagaatacttactaaaaatgtatatatggataactaaatttaaatacatctttcttcaatatattttcttattttacatttttataaaaaaaaattaatataagaatcgtaaattttaaaaatatcattcaatgagataggtattgtgattaaatggctatcgtacttaaagatgaagtactaataaatttggagagattaataatcaattattttatttttttacaaatttaataaaatagaaatttatatgtagatactttttatattatttagtgacaaaatatttagaaaactttctatattttcaaatcttctttaattttcatatattgttttttccattttacaaaaaatctaaaaaatagaagataataataatttcataaatgaagtcattatcctaataaagttttcgatctactaattctctattgagaatctctaaaatccagtattttggtgtcccttgacactaggggtggtgtcgattgacacctacgcaaatttacgtctccaaattgcttttgcatcataagttctctgttttgatccagaatgttccataatctcaaaatgcatcccaaacatgtaaagacctgaaaaagactataaaagagtctagaaataacaaaaaaactctaaaaaccagtatttttatgcccggtccgaccggttgaaccgtgacccgaacatttttttggtttgggtttagtgctaaaacctgacaagttcaaaaccgtaaaaacccacaaaaactcaccattaacccgtgactcggttaaaccggacgggtgtgggttttaaaaattctcttgattttggaataaaatatgagatttaagactttattcaatcatttgtagaaatgttttcagttcttaaactcatttgatgttttagattttgatgaagacttcacaatgccgccttaaaaaatgaatcgaatggtgagtgagacacccgatattagttgtgtgaattcacgatgttttattaatttatttccgtcattggtgatcttctaatatatttgttacggtattagacatttagttagatttacaaaatttaatcactttattattattgtttggtataaaggattttatatttattaaacataatctgattttatattttataaacatgttatgattatttttgtttttaaattataagaactcttttttttttgtgtgcaaaacatgttttcattcattctataacgcccgtgaaccggaaaattggttagggtttgtatttaaatcatccggtttaatcggttgggttaattgaaaactctatagtgtgcctataaaagaaataaactcgaaattagggctttagttatccacttttcgttttataaaggagaaaaagtcagagaaggagaagaaccagaatcgttagggtttgggaggaaacgttttcgacatataaaatcactgtcaaaggtaacgaaatttggtagggttatttccaagtcttttattgttactctccagtttacagaagtgattttggattacaattggttgagttattcgcagttttgtgagacacgttttctcagacgcgaattaggaccagcggggattgtaactgcgatcgtagtctcatctggcttccgatcggcacgaatttttgtgggaagctttgcgacgtctaaggctagcgtttcatcggagggatttaataattaacagttagtgtgtattttagggtttcatctttgagactgtttgtttttgttttttatgtacagtttgcttcaaaggttacttttggttgtgacatgttgtaggacgtttctggactgtttcagacgcaaggagagtctctcctggctttaatcgttgttagaataattttgttaaggagagtctcttctgggtttaatgactcgagagttggtttgggttgtgttctgatg

SEQ ID NO: 18472 - DNA, 3000 bp, Unknown; identical to SEQ ID NO: 18471
  misc_feature (1)..( 3000): 2750-1469P.txt file - cDNA_ID_1817670; gDNA_ID_2926138; Annot_ID_138930

SEQ ID NO: 18473 - DNA, 3000 bp, Unknown; identical to SEQ ID NO: 7465
  misc_feature (1)..( 3000): 2750-1469P.txt file - cDNA_ID_1817699; gDNA_ID_1621146; Annot_ID_56766

SEQ ID NO: 18474 - DNA, 3003 bp, Unknown
  misc_feature (1)..( 3003): 2750-1469P.txt file - cDNA_ID_1817711; gDNA_ID_1621146; Annot_ID_56762
aacgtcgtatcccggaacagtctactccgacgaaagattcaaaatgttaaagaatccgaaaccttcaaaaagagtgagagagagagatttgaatttgcatttaccgggagaggcgaatcagtggctttaaatttcccttgccgtctcttagcatcgacgggattaagagccgccgcaacaactttaatcaaaacctgatcttctttaatctccggcacaacaatgttactctccagcttcagaacatcaactccgccgtagtcactatacacccacgccttcatctctttcggaatcgaagcatccgccgtgacattgaccgccgctgaagcgctctgagagctcgccgagattttcaagaatttcttgctgactgtttgcacgcaagatccgaatctaactctgttgatttggtaaaccggcgattttgttgtgagagaacaataatgaagaagaggcgtctcacggcggagtacgggagttgtggcggtggttgttgcaagcgctgcgttcatttttcagtctgccactagttttgtctaaaaggcttatctctttcgctttcctctgtttttaaaatactctgtttcgtggctttctttgattggttgatattttcttgtggttgtcattttaatgtttatatcacaaaaattgtggcccataatcgtttttgatctggtgctgattttgtgattcatctttgtttcatttcttttagaactacagaagtctagaacaatcacaaaacacttcggtttttgaacattacaatgtacaatttttacgtaagaagatacaatcgacattaatgggcctaaactttaaattgggctttatgaataagcccaacagttgagaaaacgcagtactaaaagtcgatcatctaggcacgatgagattaaccatagaaaccgcgcacaacgaagcacgatcagtacacgtgttaaattatgattgggtccttggtagagattaaagatccaccgtccatttccccagaactagaaaaaagagaagggagaaaactttctccgagctcgattgtttttggaaatcgtcaatcagatatttctcgttcgtctccgccttcgatttatccaaaggtaagctattgataaaaaaaactaaatccctgatatttgattttgaatctcttatactcatacattgctgttcatgtgttgttgtcttgatttcaaatctgcccagctttttgtaataatgatgcatgcactatgtttaatgcttgagttcgatttccctttgtttcgggttttgcctcattgttataactcggtcgaaagtcatctcctttacatgaaatttctgttgttaagattatatggaatgtccttcattgttctgctttctaattcttgtgtcaatcttatctaaatcttataaatcagcatttgcattagaagatttgatctattttaaattggttaagaagtgaaatgattgattgtcaatgcaggctcttgttattgaaaatggcagattccaccaaagcagggttgaagaagccagctttcactaaggttgatcagctgcgtcctgggactagcggacacaatgtcaatgtgaagattgtcagcacgaaaatggtgttacagaaaggtcgtgctgatggtcctcaagctcgccagttgcggatttctgaatgcattgttggtgacgagacaggagtgatcgtctttaccgcaagaaatgaccaaggtactttacttcagtcaataaatcatttgaaaaacaaaacgttcatataacggtttgtgtacttgattctagtaatgttacagggtagctagtaatatcttgatttggttttgtgtgtagtggacttaatgaaagagggatcaactgtaactctacgcaatgcgaaaatcgacatgtataaaggatcaatgaggctagctgtagacaagtggggtcgtgttgaagtcacagagcctgcgagcttcaaagtgaaagaagacaccaacatgtcccttatcgagtatgagctcgtaaacgtcgttgaatgagtgacaaattcctcgaaataccactaggagaaacgccctcaagaataaacaagtcaaatccgtaaccgtttatgttagcgtcaagaaaagagttaaaccctgatcagctgatgtcttgcactaagctatgtaagagtgatgatggctctaaaagttgaatgcagagcttttggcttaggttatgacttcgtgataccttttcttttgtaatgtcatcatacacgctaaggcttttgtgctacattattactctctttgtctttgcctcgtttcaaaaaatccatattcttagtgaagtaaacagtaactgcaagcctctgttgatcaacgaccataatgattatctttctattttggggttatatataaaaatagaagtttaaccaaaatgcaactcgagatgggcttgaatcactttgttaatgattgtggagaagaaatgttgtcgtgtgaagtgatgggacttcaaatgtgtgtcatcattgcgtcatgactgatggcttcttggtttcctttgtcttttaatatgtttatcttcttacatttttatatgtttgtccttgtcacgtatcggtaatgaaacttcaaacttgatataataaacgaataataggtatgaatactaaaatagttagtgaagaaacagtttctaccaacaaaaagtaatgtatcttttcatgagtgttaagtgggcaatgtttagtgcgtttagtcctttttagtctttagagctgtttccttatctcttcctcttaatcaaaattttctaatacgatttattcagagattttaatagagtaaaatgtgacatttcggtattgattgattcatagattaaaaactatataagccttggttccaacttccaacttccaacttagaaatgtgtatatacacacatttgcatcgataataactcaccaacactctctctgtctccatcgaatgtttcctctaactctcaacaaaaatg

SEQ ID NO: 18475 - DNA, 3003 bp, Unknown; identical to SEQ ID NO: 18474
  misc_feature (1)..( 3003): 2750-1469P.txt file - cDNA_ID_1817711; gDNA_ID_1621146; Annot_ID_173050

SEQ ID NO: 18476 - DNA, 3000 bp, Unknown; identical to SEQ ID NO: 7443
  misc_feature (1)..( 3000): 2750-1469P.txt file - cDNA_ID_1817729; gDNA_ID_1621146; Annot_ID_56752

SEQ ID NO: 18477 - DNA, 3000 bp, Unknown; identical to SEQ ID NO: 7459
  misc_feature (1)..( 3000): 2750-1469P.txt file - cDNA_ID_1817733; gDNA_ID_1621146; Annot_ID_56751

SEQ ID NO: 18478 - DNA, 3000 bp, Unknown; identical to SEQ ID NO: 7445
  misc_feature (1)..( 3000): 2750-1469P.txt file - cDNA_ID_1817754; gDNA_ID_1621146; Annot_ID_56745

SEQ ID NO: 18479 - DNA, 3000 bp, Unknown; identical to SEQ ID NO: 7445
  misc_feature (1)..( 3000): 2750-1469P.txt file - cDNA_ID_1817754; gDNA_ID_1621146; Annot_ID_173033

SEQ ID NO: 18480 - DNA, 3000 bp, Unknown; identical to SEQ ID NO: 7445
  misc_feature (1)..( 3000): 2750-1469P.txt file - cDNA_ID_1817754; gDNA_ID_1620832; Annot_ID_169719

SEQ ID NO: 18481 - DNA, 1588 bp, Unknown; identical to SEQ ID NO: 7435
  misc_feature (1)..( 1588): 2750-1469P.txt file - cDNA_ID_1817788; gDNA_ID_1621146; Annot_ID_56733

SEQ ID NO: 18482 - DNA, 3003 bp, Unknown
  misc_feature (1)..( 3003): 2750-1469P.txt file - cDNA_ID_1817799; gDNA_ID_2926128; Annot_ID_138672
ttttgatttacacttttagtaatagtagtttgttaagaaaacatgcataaagcataattctatgtgtgtgtatttcacttcacatatagcatatatatgaaaacttctctctatttcctagttaaaatctctacagtcgtagttaattggctaggattaaggaagttaagcgatcatttagcacatatgtattgtgaagttttgttgaatgtttacaaggtttgtttccaagtgattgagatgacaaatcttcctctgttcgcaacaaccacgttgttttacacttattcccaagcatcatttttttttttggtttatcttttaattgcaatatacatatatagtacacacatacacgagatatatacaaacgtatgcaattgcattctataaattgatgttagtgaaggatatttccaatattacaagcaagcatttatttatatgttatgtacaatgtcttttgtgttataattagattgttttattcagcatatatttttctaaatcggtggtcttgattgatcaattactcctgtcgtgtttttttggcattattgaatcaacaacatttgctcgaattcggaaactcttccaattattaaagattgctgaaaatatcattttatctagattcttatcactctttcatatttgttggcattattatccatttcaatttcgttataaaaaaaacaggtggtaagtttgcaaactgagctttcatatctacaagcacacttagcaactctagagctgccacaacctcaaccaccacaggttccggtgtcatcttcaggatctctacaggctctttccataacggacctcccaacaatatcaccgtcggtgtacgacctctcctccatcttcgagccggtcatgtcctccacttgggccatgcagcaacaaccacgaccgtctgatcatctcttcggcgtcccgtcatcgtccaatatgggcggaggcggtgagctccaagcactggcgcgtgagtttattcacggtgggcaaatgccagctcagccatcgccgggaaccagtggttctgcctcgtcagtgataaaacgagaatgaagttatttttatcgtatgtttgtttatttggaccgtaagagatctatagttagccatatgtttctccttgtaatatatatacttggtcgaattcgtatttaaattgttgtctagaatgttaatataagaactatatgatttacattgattaaatggagtatcttataggccaatatgttgaagttgctttggtctcttggaccatcgaatatgttgttttaatcagcctagagtacaccggttctccacaacttgggtggaatcttgagcgtgaaggaggcttgattctggcgcgagacacgaaccaatgagtctcatttctcattttccctatcacttatattgggccttaaatgggttcaataaagtttttttttcttatatcaagcagcccaaaatattatttaaacccgactcaattgagtttgatactctggtttgctttgtagtccacactattttaacaacatcttcgaagcatgcatttgatttaacaatcttcctaatttactagagaatttgagccaattttgtcttttttttcaccatttttataaaagctggttttcaacttgtgttctcttagcatttcccgcctctacatcaactagaaggccctacacggaccttgaacatgatcttagcgatgtctaaggactaagctacataaaccaatgagtaaaatacatatggattggacaataatcaccaatcaaaaccccaacgtcgattgcatagccgataagtagtaccacaatggtgagaggaggatagtgccagcggctatgaagggtcgacgtaaaccaaaccttgatgagacactgtaaaacacgactattggttgaacaatcagttccaatcgaggctcacaaagtcaaagcatgcttgtaagatatttggagtaattgaaggtacggtgtaatcagagcgtttcttgaattgccgaaatgaagtttagccctatggctatagaagcaataagccatttttatattcataactttagaggtattaataagaaacatatataaatttttttataaatgtattgacaaaaaatcaagtaaaaataagcaagatgcaaaacataagcaacatttctaattaatattatataattttttataatgattttatacatgaaaaaatctctaattaatagatatgacacatgtgtgatcatgtgagttatcaattttgaataattttttaatactaaattgacatattgtttgatcagaaaatgtcattttttgaaactaagtgaatgaataaagggttgagctaagcaatatataattgttgatgatgaaataataacatgaatacaaattatatttatatgtgtgtatcaattagtgtaatatttaagagagaaccattggagtagagccttacaagacaatatatgatcaccattggaaaactttaaagctattactatggtaaaaactcaattgcttgaattcgaattcaagtaatcaaaatcttattattagctcaaatctcaagttcctattactactctatacatatacatgtgtattaatctatgttatcaccaaaatagaaacaattagatatagcaagtgaccactattttccttctaagacaccatacgaactaatttttatcaaaaacaaattatcaagctctattacaattccgcatgtgtgctatacattagattaattaaaagaaattaaatctgttttcactccatttatcaaaagtaacatctttaacgaatcaaacccataaggtactcttactctctattaatagaggagaatgtgtcatcttctcattactcaataagcatacttatcatatacacaataccacaatgataaggtcaaaatgttcttgccatcatcatctacttgttcttgttatggttgttctttggatatcaccaagatatg

SEQ ID NO: 18483 - DNA, 3003 bp, Unknown; identical to SEQ ID NO: 18482
  misc_feature (1)..( 3003): 2750-1469P.txt file - cDNA_ID_1817799; gDNA_ID_1621147; Annot_ID_56793

SEQ ID NO: 18484 - DNA, 3000 bp, Unknown; identical to SEQ ID NO: 7473
  misc_feature (1)..( 3000): 2750-1469P.txt file - cDNA_ID_1817809; gDNA_ID_2926128; Annot_ID_138669

SEQ ID NO: 18485 - DNA, 3000 bp, Unknown; identical to SEQ ID NO: 7473
  misc_feature (1)..( 3000): 2750-1469P.txt file - cDNA_ID_1817809; gDNA_ID_1621147; Annot_ID_56790

SEQ ID NO: 18486 - DNA, 3000 bp, Unknown
  misc_feature (1)..( 3000): 2750-1469P.txt file - cDNA_ID_1817817; gDNA_ID_2926128; Annot_ID_138667
aatgtttgtgtgtaaggtagattgagatatatgaatggtcaaatcggaaataaaacagtatatgttcttaaataagcttctcctttgttcaacttttttgctttcatttccgttacatgatttcgcgattaattactttttataattagtcaacttcgacgccttgtgtcgtcctcgattttaatgttctgtctttctctgcattcatagtttatcttatttcatttcatatccttacttcttttttctacaaacaataatttctagacgaattgaaacaaatttccaaaactttatgagtatatataggatatttttagtggcaaaggacgacttaaattgtaacgaaaagaatttgaacttttttccattagtccctacgatgaatatttcatcctatagaacatcatatgaattgattacttaatgaagttaaatttttgaaaactctattagggacaatgtcccacatcggaagttgagtaggatcttaagtggtatatataagatatgagcctctccacctattgccaattagttttacgttggaagcccacagtctgatatggtatcagaccccgatccgcacatactcaacccgatccacatcggtccggcccaatacttggcccgccgatccatgcccaaacatatcgagatcaatggctagaagaaccatcatctcgagggggcgtattagggataatatcccacatcggaagttgaataagatcttaagtggtatatataagatatgggcctcttcacctattgccaattggttttaggttggaaacccacactctaatatggtatcagagcctgatccgcacatactcaacccgatccacatcggtccggcccaatacttggcccgccgatccatgcccaaacatatcgagatcaatggctagaagaaccatcatctcgagggggcgtattagggacaatgtcccacatcgaaagttgagtaggatcttaagtgatatatataagatatgagcctttccatctattgccaattggttttatgttggaagcccacactctaataaactcaatacaaatactaaagttgcaaacaactatactatatttgcttgaagttctattgtgataggattttgacttacaaaaatcatattctatgtctacactatatattgtgaaaccggatagccataatatttacaaaaacttaaactaatttcagatataaataaatttaaatttcactatgacctagtaattatcacgaacaattgggaagttaccacaaaatggtggtcctgtattatggaatttagcgaaaccacacacttgcgggtaaaaataatgatgacaaaatgatatacattggaatgtagagaaagtatatacaaatactaataaatagaaaagggcatggaattgacgaggatcgagggaaagtgtggtgtggcagaaatgttattaagtgtgaaaacaactgatgaatgagcctttgcttaatcacttccatgcacaagtccctttcctcttcctctctctcccacttcatcgaactttgcgtcctttaaagaaaagaaaaaacaaaacatttttcatccaattgaattcaaaccgtaaccagattagatttaacttcgtttattttacattatcttcttcttcttattttgcggagaagacttgtacaatgacctcaatacgctgaagagttggattcactgcgagtgtatatgtgcatatagaaacaaaatatctagctatatgaccacttttaactctaaatatgggtgtaatatgccaaggactttctggagatccaccacaacacacattcaagttcaagttctgctgcttttaggtctatgaaaacaacaccaaccttattttcatattgttctctctttatctcatgcataagtatattttcatattgttccctctttattttcatgcttttagttgatattttttttgttattgtattatcattagtgcgacgacacaaagtcacaaaccatgtaacaaaatgcttaaccaaaatagaaaaccttaacaattccaatatattttctgttattgcattatcaattatcatcaaatttttttccactgttgcattatcatcattgcgacgacacaaggtcacaaaccatgtaacaaaatgcataaccaaaatagaaaaccttaacaattccaactttaacatgtgaattaatattatcttaatttttggatgttcgacattcaaataaactcctaattaaaccctatagatatggttaatcttctatacatgtgtcacgtacgacacttattagccaaattgaagttttgttttttccgcaaatatataagcggtttaaatagttggtaaaaaaaaaaaaaagttagcatgtttgtcgtatgtacatgtttgatgctgcacaaatcttgtcgttataaaactttgaaatctttatatctattattcctcaccgatcggctactaattcaatggtacttgataatgataattagtcccaaagtagagtttttatctgattatatagaaacaaagactagttccggtttgatatatagaagaaagaaaaaggatggataggaataataaagaagataaaccggttcaaaaggtagtaaatgagaatgcaggtatgcagcttatctctacaatggcctcttcatcacatgtcgccaatttgtttaggtacagtgtctcttcatatttacataaatagatatctctctctctctctctctctaaaccacatcttcctctccaccgttctttctcttccttctctctctggacttcaacttctggagaagtacaagacatttataaagtactgctcatcacccaacactaaacacaattgtcaaaagggtgtggtggaaggagaatctacttctatctgaacatcgatcagtcatatcttttcaatcaaatcaaagccctcctctctctcttactccttttttgttttaaatcaagaaaaagactccatg

SEQ ID NO: 18487 - DNA, 3000 bp, Unknown; identical to SEQ ID NO: 18486
  misc_feature (1)..( 3000): 2750-1469P.txt file - cDNA_ID_1817817; gDNA_ID_1621147; Annot_ID_56788

SEQ ID NO: 18488 - DNA, 3000 bp, Unknown; identical to SEQ ID NO: 7480
  misc_feature (1)..( 3000): 2750-1469P.txt file - cDNA_ID_1817821; gDNA_ID_2926128; Annot_ID_138666

SEQ ID NO: 18489 - DNA, 3000 bp, Unknown; identical to SEQ ID NO: 7480
  misc_feature (1)..( 3000): 2750-1469P.txt file - cDNA_ID_1817821; gDNA_ID_1621147; Annot_ID_56787

SEQ ID NO: 18490 - DNA, 3003 bp, Unknown
  misc_feature (1)..( 3003): 2750-1469P.txt file - cDNA_ID_1817861; gDNA_ID_2926128; Annot_ID_138654
cgtgtttgtgtgtcttggtgatgttaggcaaaagcacaactgtcaagacacgctacacagtcatgtcacgggagacgctgcacaaataccctgaactagcaaccgagggttccccaaccatcaaacagaggcttgagattgcaaacgatgcggttgtgcagatggcatatgaagcgagcttggtttgcatcaaggaatggggaagggcagtggaagatatcactcatcttgtctacgtttcctccagtgagttccgtttgcccggaggtgatctttacctctcggcacagctgggccttagcaacgaggttcagagagtgatgctgtattttcttggatgctatggaggtttgagtgggctgcgcgtggccaaagacattgctgagaacaacccagggagccgtgtgttgctcaccacctctgagactaccgttctggggttccgcccacccaacaaagctcgtccttacaacttagtcggggctgcactctttggagatggagcagctgccctgatcatcggagcagaccctacagagtcggaatctcctttcatggagcttcactgtgctatgcagcagttcctgccccaaacacagggggtgatcgacgggcggctgtcagaagagggcataaccttcaagctaggaagagacctccctcagaagatcgaagacaacgtggaggagttctgcaagaagctagtggcaaaggctggctctggtgcgttggagttgaatgaccttttctgggcagttcatcctggtggaccagccatcctgagcgggctggagacaaagctgaagctgaagccggaaaagctggaatgcagcagaagggcgttgatggattatgggaacgtaagcagcaacaccatcttctacataatggacaaagtcagagatgagcttgagaagaaaggcacagagggagaagagtggggtctgggcttagctttcggaccgggaatcactttcgaaggctttctcatgaggaacctctaaatgtatatgaactggacatttctcaacaaataaaatatacaggaaccgatgctaacacacatacatcatgtaatggttgcattagttttgttctttaatggtaaatcacagaaatacatcaatacagtaagtttatatacataattgaagtattcttcaatggcatcttacttcatgcatccaaaaagtaatttcaaccttacataattcagatgtcgttttctctggctttcaaagattcactcgattctagcaaaggaacatacgtaacatagtgtgacacactagtctatatatacatttttgcaatatttttaacaaataaatcatagagttgagacttatttacaactcaatgctattgacattttattattatcaattaattaatattcctaattattaggatttccttatctaatatatctccatcaattctaattatttaaaaaaagagaaattttaggacattattaatattatactttattaaaccttaccaataaaaaatatatactttattaaaggtaaatattttagttatttaaagtttattaaatattttcacggaaaaaacgtttagaatatttataatatggaaaatctataaaattaaataaacatttgaaagaaaactttttaattgatttaaattataaatcttttaataaagtattattaaaacaaaaaataaaaaataatgtttaattacaccgaactggattagatggtataatgggtttagaatattataatatatgaactttagaacaattaaataaccatttgaaagaaaactttttaattgatttttgaattataaatcttttaataaaagtattattaaaacaaaaaataaaaaataatatttaatttcaccgaactggattagatggtataatgggtttagaatattgtaatatatgaactttagaacaattaaataaccatttgaaagaaaactttttaattgatttttgaattataaatcttttaataaaagtattattaaaacaaaaaataaaaaataatgtttaatttcaccgaatggtatagatggtaggacgggtttagaatattataatatatgaactttagaacaattaaataaccatttgaaagaaaacttttatattgatttgaattatatatcttttcgattaaagtattattaaacaaaaatgacaaaataatatttaattttattgatcgggtttagatggttaggacgggtttgagtcgatagaaatacaagacgatatatcatgggtgaaatccataagatatgtttgatattcactgaacgagattagattgtaggacgggtttgagtcgatagtaatacgagacggtataccacgggcgaaatcatatatataacaatcaaaatacaattatattatcttaaacactatacaaaacaaacaatattaacaaaataaatataatttaaatttaaattatttagttataatctaaattttaacttaatggacggtatgttattgttcctatatctttaaatagtaaaaatcaaacaagtaattatacagtaaataatatataaaaataagagttgtacatttagaaaatataaaacattaaatcatatatattttaatctactaaacaaattaaatttataccgcgggataaaaactagtattatatgttagcgaatcctactaaactatgacaacaaatatacatgcgagtcgtatacagaattgattctcacatttaagctgtcaacaaaacattcaacaagtcttaagcaagccattaaagaagggacctgaacaatttaatatatatggttaactatttaagtatcatgtccccacttgtccattacgtgattactacaaaagttcacataaaagttcctttttatatatataggaaagggaagaagatctcaataacacaaaaccttttaaactagtaaaatacacagattttaggatgagccaatgtgttccaaactgtcacatcgatg

SEQ ID NO: 18491 - DNA, 3003 bp, Unknown; identical to SEQ ID NO: 18490
  misc_feature (1)..( 3003): 2750-1469P.txt file - cDNA_ID_1817861; gDNA_ID_1621147; Annot_ID_56775

SEQ ID NO: 18492 - DNA, 3003 bp, Unknown
  misc_feature (1)..( 3003): 2750-1469P.txt file - cDNA_ID_1817865; gDNA_ID_2926128; Annot_ID_138652
cgatttgggccgaaattaactttgggcttggttttaacgacataacgtctcaagacaagtgagttaatgccacggccttttattgaggtaaaaaaggcacgaatgctaaccgaaaatcgttccaaacaacaattgcttacgtggacattttaaaacatctgttcaatggtcattggtgactgacttcaatgaaaattacattgcaacaatagccaagtatcacagaaagttacattgcaacaatttccacgtcaaatttctaaacatgcagaacggtaatttacacggggaaggcgctgaggaggcggagggtgctacggaggggatcgcaggaacaccgatgaatgagaagaatccagaggcggcatgatcttgctcgtcgaggagagtggatgatgctctataaacggccaacaatatggtcgacgtacacctaaaatgtcttgctacgtggatgcaccactaaacctttcaacttttttgtgttttcttttcttaattaaacacaagattaattaggaaatcttgtgtttcgttccgtttcgtttcgatttctggtttcttgtttctattactcaaattattgctcgagtgttaggtttgcttgtatctatccttgttttttccgtgattatgtaatttgattggcccttgtagtcgagatgtttgtagccttgatggctcggggaaactcagagagagagttggtcccggttgcattctccgctgtcttactgataccataaacaccgtttgatccatgattgcctctattgtatacttgatgcttcatgatatatgcattctccatgtctctgtttcatgtttacgcataaaaatattatcaagcctcaaacttgaattcggttcaaaatcctagacatccccaagaggatcataaacacagtttagacttgtttttcaattagcaaacagttgcttgataagaagtcattcctacagctcatgtgtaacacaattctctctcttttctccaacaccccaactaaaacaatctaagccgtttctgaatgttttccggatctgctgagtcataaatacgagtgctttaggcaggcaaataagactccagcatcaatttggctggggaaggtgttaaaatctctacgatcaggtacgtgtatttccattccttctctgccttgtctttaaacatctccgtgtacactttccctgctccttgaggcccacggatgtagaagtttacctgaagcatattcaattttgatcatgttaaacctgcaaaactctagacaatttatatagcaagaatgtgaatccaagcgcaatagaggttctacaatgaaatacctcaacatgctccactccgtcttcatctgtaaatactctgttgggtatacgttgacgagcagctcggtttctagtttcttgtccatagcctttgatgggggatccaatcctaaccctcacctagttaacaagacaatcacagtcacagaaattgtttcattttataaacagatgcttttgtttcatacaccacccctccgctatgatcaatctgtagagttagtttctaattacctgaccatcatcttgaattctcttcaaggctttgtcaaagaccttgtacctagaatacataatggtgtctttagattactcaaatccaagtgtctgagcagataaatcaaattagatttctgaagcctcactcttttggttgaaaaatgagctctttaaacacaccgtagccagcagctccagcgacaccaagcccagccagaataacaagactgtaggacgcaccttctgtaaaggtcaccggcttctccgggatgtggtatgtaggagaatcaaaaggatcctccacagtcgtcacctctttcttagcctgtaaaacaattggcaaagcaagcatcattattagatgacagaagctgtctgtcgcttttgacggcttgcgttgtgataaatggcaaacacataacgtagacattaagtagaaacttgtaggaagaaacaccttattctgctgattcccaggttcttttgaagttcttgatgcaaaagatctggtaaagtaagatgagttgatgttctttggacgagcttccgtacatatacttgcttgcgggtttcggaagcgaaacaatagtcctgtataacagacaattgtcagaacaacaaggtacacatcaacactaggatttgaagtttgattacacaattatcactgctgaccattagctccagtagagtcctgcataagaaaaacgatgagaggtatgagactaacatataagcccaaaagggtgtaaagagcaaagaaaatgttgtcgaagcaaatatttaacaagtaaagggaagaaaatacctttgaaagaaatgagttgctaaaaaccctcttggactgatatataacaaaagtaacactgtaagttttccccagatcaaggacactagagagattcaattcaaacaggactagagacactgaaaaaaacgacctcaattttcacaagatcctaaacaatccgtgtctatgtagtagaagaaccaatagcttttagccaatattatatagaaatgccggcagagtgagatggaatacgaaagccttaccgattttgggattccggaacaaggttgtgtagcggaggaaaacgacgccagtttcgattttgattggcggccgatggctatcgctgatctccttaaaagattcatcatcatcatctctgaaccaccaatattactgattgaaaaatcgaagtggagacgacgacgacgacgagcgaggttgaatgagcaaggcaaagccgctcgccgttgctggggttttatcgtagacacgtgacgcgcacgtgcaagctatttccttgggcttgggcttagactcatgagataaagcaaataaaacccaaatgggctttttagaaaagaaacccaaataacagagtatctcttcttcttcttcgtgcaacaacctaaccatggaaattgcaatttgcaaacatg

SEQ ID NO: 18493 - DNA, 3003 bp, Unknown; identical to SEQ ID NO: 18492
  misc_feature (1)..( 3003): 2750-1469P.txt file - cDNA_ID_1817865; gDNA_ID_1621147; Annot_ID_56773

SEQ ID NO: 18494 - DNA, 3003 bp, Unknown; identical to SEQ ID NO: 18492
  misc_feature (1)..( 3003): 2750-1469P.txt file - cDNA_ID_1817865; gDNA_ID_1621147; Annot_ID_173077

SEQ ID NO: 18495 - DNA, 3000 bp, Unknown; identical to SEQ ID NO: 7495
  misc_feature (1)..( 3000): 2750-1469P.txt file - cDNA_ID_1817880; gDNA_ID_1621148; Annot_ID_56817

SEQ ID NO: 18496 - DNA, 3000 bp, Unknown
  misc_feature (1)..( 3000): 2750-1469P.txt file - cDNA_ID_1817884; gDNA_ID_1621148; Annot_ID_56816
tcaaatcataaaaaattataatgtgtgtacttaattcacattatttaacttattcttgattttcaatctatgactaggtgcaatcccatgtggtatccaaatgatatgtttattttttattcctgaatcacctagatggctggtaattcacacacttaaagtttgttttttatttgtttaattggtaatattatatttaaaaggtacagtctacatattaatgttcatcttaggctatgtatggtagagaacgagagcttgaggttactttgaagaggctaagaggagaaaatggtgatattctcgaagaagcagctgaaatcagagtattattgtttgttccgaaaatactactactactttggctaacatatacgtattttggttaactattaattcggtttaaaatgtgaaacaggaaacagtggaaacctctagaagagaatctcgaagtggactaaaagatttgttcaatatgaaaaacgcacatccgttaatcgtaagtctcatcaaatacctatcatttatacaaataatttagaagagatcgagttcttatctagttttgtgacctattgatgatcaacttaataaacagatagacatgtatttatgcgtatgtagatctaacattctgcctatacgtatgaatgaaatactcccaagtcctaacggaaaaaaatgttttaacttgtttagtgaaataaataaagattaatttgtttttgtttgtttattaattcgttgaaaacgattagattggattgggcctaatgctcttgcaacaattttgtgggagttcggcgataagtgcttatgctgctcgtattttcgacacagccggtaaaccatgatttaaaaaaaaaaaaaaaaaaaaaaatcattggcatgtcatatcttgtttgattttgtatcgcatttcatctcacgatttttgaatatattgtcttgggtatttaggttttccaagcgacataggaacatccatccttgcagttattttggtaaatcaaaacattgtctttttagtatttaacattttataatcgaaaatatagtatttcacattttcactacaacttattcttgtttttaggtaccgcaatctattattgtcatgtttgccgtcgaccgatgtggacgccgaccacttttgatggtaatcatttcattaccttcgttatatataatttgcgtaattgatttccctagataaatattttatttgtggtttgaaactttttttgcagagctcttctatcggtctgtgcatatgttcatttttaattggcctctcttactatcttcaggtttagtcatcttaactattttattctttgtaacttcgtttgatttttggttattatagactaaatattatttatcccccacaagcagaaccatggtgattttcaagagttttgttcccctatcttaatcgtcggtttagtggtacgtgaatgccaatcttgtttcagtcaattactatttttggtttaattcatatattactttgttgaaaccacaacactaatcaaccaagtcatactatataccagggttatgtcttatcctttggcattggtctaggtggactaccatgggttattatgtctgaggtatttgtttttttttttattttaaactagaaatatttcataatgtaatcattatctttttttttttttggacaacaatttattcattatctatggcaggtgtttccggtgaatgtgaaaattaccgccggtagtcttgtaacagtgtcaaactggtttttcagttggattatcattttcagttttaatttcatgatgcaatggagtgctttcggtaaatttctatccattaatttgacatttttgtttcttcagaatattacacatctaacacaaaaatgctttatttcgacagtatttaataattattacaataaaatgaaaataaataaataaacaaacaaccagctcttaaaattgtttaaagagtatagggttatgtataatcaaatcatggtaaatatatcttttaaattattaaaaatactaaaacgggaagattagagaattttatgttaggaatgtcccctcgaattaatattttcattatataataacttagatatgaaattaaagagaatgattatatagttattttgttttattggaatttgcaggaacatatttcatatttgctggagtttctctgatgtcattcgtatttgtatggactttggtgcctgagacgaaaggccgaacacttgaagatattcaacaatcactaggccaactttcataaatccaaagttgattctttactccacaatgccagacattgttcttttatgttacatttataagtcatgtattatccgatttggaggggggggatatggatttccgaatttttttactttgataaattttgtcaatatattttgttgacagaaaaaagaataatcaatatactgtatgtggtattattctaacaatattttttaaacgtataatatgattatgtaccaatatttataaccatatcatatgattatgtacttttgtaaaaaaaattcacaccccacttaaaacttggttactactaattggatcttgcaactcaattttctaaatcgcattacaaaatactgaatgagcaaattaataaaagattagtcaaatgtgacaacgaccaatgaggcatggccaaataaaagcttgaagagactattcaaagttaaggataagaatcaaagaaagaagatggaatctgaaagactcgaatcacatcttctgaataagcaagaagaagaagcttcttccttcacttctggtcttcttctcagcacatccgtcgttgtcgctggatccttctgttatggctgcgccgtgagatctcttcctttctctctcaatttgctatccactgattttggatattacagttttagaatcctaatttcttcgtgcataattttcataactataacatactttgtagatg

SEQ ID NO: 18497 - DNA, 3000 bp, Unknown; identical to SEQ ID NO: 7504
  misc_feature (1)..( 3000): 2750-1469P.txt file - cDNA_ID_1817892; gDNA_ID_1621148; Annot_ID_56814

SEQ ID NO: 18498 - DNA, 3000 bp, Unknown; identical to SEQ ID NO: 7492
  misc_feature (1)..( 3000): 2750-1469P.txt file - cDNA_ID_1817896; gDNA_ID_1621148; Annot_ID_56813

SEQ ID NO: 18499 - DNA, 3000 bp, Unknown; identical to SEQ ID NO: 7491
  misc_feature (1)..( 3000): 2750-1469P.txt file - cDNA_ID_1817900; gDNA_ID_1621148; Annot_ID_56812

SEQ ID NO: 18500 - DNA, 3000 bp, Unknown; identical to SEQ ID NO: 7491
  misc_feature (1)..( 3000): 2750-1469P.txt file - cDNA_ID_1817900; gDNA_ID_1621148; Annot_ID_173140

SEQ ID NO: 18501 - DNA, 3003 bp, Unknown
  misc_feature (1)..( 3003): 2750-1469P.txt file - cDNA_ID_1817912; gDNA_ID_1621148; Annot_ID_56806
gaatttccaagacggaagtctggatatctcataaatcacatagttttaaatgttttactagcttctcagtatgaaatttcactcttgagtataatagcaaatttgtaaaattgcagcttggaactcatggatcaaacttgacagaggaagagcttgagacgcacacaatagcagcctggaaagaggggaaggctcatattagccggcaatatgatggaagtgggagaccatatcctaggccacttgttcaggtgagattttcacagttgatttgtatcgctgttactactaactttcttctgtttgcgtaatctctgaacatagccttatcctagaactttctattgcatgttatattgaaaagagctagtagtatttctctcttgctattaatggttttatatatggctatcaggttggaccctatgataatctgaaagacgttgccctgaaaattttgcaaaacaaggtggcagctgttccggttatatattcttctttgcaggatggttcatatccgcagttactgcatcttgcttcgctatcaggcatattaaaatgtaaggtcccttcatttgtgaataagacactgataagcgcgccaatttggcatttctcactttttaattcatgacgtgcatatgattctgctatttccaaaattttcccacttcttcatttctccaaattctgtgaagggatgggatctttaggagggagggaaattagaaactaaagttgcaattgactttaccaaactttttacacagttttccctgttaataattcctttcgaaatttatgcctttatcagacacttaagctctaaattaagcataatcttccaggtatatgcagatactttagacattcgtctagctctttacctatccttcagcaacccatttgttcaattcccctgggtacgtgggtccctagaatcggagaatcaagtagcaaacctctcgctacattgagacctcacgcctctttgggttctgcgctcgcattattagttcaaggtaatcctttttcttatcttgttgcagcaacatcttattcaaagctcatctgcaactcagactatcaacctctacattacaatcagattttcagttttaaatattttgtctagatggtaatataatcaagtagctgaacacatgggtatactcaagtcaatgcagaccaacaaaccaactttagatgttacgaccacttttattatttttatacagatgtaattgctgcaacatgagtaaactaacgaggtttaaaaacatagaaacatttttgtcaatcttaaagcagatatatttatagaatttctcgtgatcttttccctggttcctcatagatggaaatgaatgaatgagtcatgcttaatttatgtttcctggttattacagctgaagtcagttcaattcccgtagtggatgacaacgactcgcttattgacatatactctcgaaggtaaacctctatccatcaatcgacatgatgtcttatgcattccatctttgacgtccttgtgttctgatgatatttgtaattggccagtgatataactgctctggctaaagacaaggcatacgcacagattcatcttgatgacatgacagttcaccaggtaaacctctcatcagaaaccaagatccatcacatgtctcatcaaattacgagttttacttaaatgtaacctgcctatctatcatggaaattgcctcgtttctgatttatttgaacatacatctttacaagaatgaaagaagagatgaaacgttataataaagtggaggataatgtgtttgtgggttttcaggcgctacagttggggcaagatgcgagcccgccttatggaatcttcaacgggcagagatgtcacatgtgcttgcgctcagactctcttgtgaaagtgatggagcggttggcgaatccaggtacacactatctcctatatacaatcttcagctttgttgcttgacacaggaacatcagatgagatgtaactggggtttgggtttgtgtatataaaacacaacaggtgtaaggaggctggtgatagtggaagcagggagcaaacgtgttgaaggtatcatttcactgagcgatgttttccaattcctgctcggtctttgactcccacagcaaaacaacctccccaacctctttttctcatttcccctcaatcaaaactacccaacaatttgcttctttttttttttttttttttttcttcttgcaaggaatttgtaaatttgctacgaacctctttcatcattgttttcttattatttttgttgttttagttgaacgggtttccattcttgtgaagatattggctaccggaatcttttactagtagcttccctcagctttttcttccctctttttttttccatttttttttggttttgagtttttcacttcatcgactcgaaaagcaacacagcatgagaaggccgtagaagtgtaggacaatgcactggttgacaaagatgaattgtcaccagcgagaataagccttatggttgaagtttgcaagtaatgattaatacaattacaatcataacgaatcataaccttaagtacaataacaagtaaaaaagtacaatgacaagtaatattcagtaatggttaatcgagtgatttgatcatagcattatcgatttctttcggatttttcaatagctcttaaaatatatcaataaaagtaatacaaaattcaatcaaatctagtgacactaaaaaaaaataaaaaaatctaatgtcatttaaaaaatatttgagcaaaaaaaataaaatctaatgtcattaaaaataagtgttaaataattgatgacataataagtgatagagaaaaatgtatttactctatttacttatttaggcttatccagacaataaacgttttcgtttttccagtccaacaagtttcttcatcaactctctcaactgttttcgacataaacattccagaagctgagatcagatactaaaatg

SEQ ID NO: 18502 - DNA, 3003 bp, Unknown
  misc_feature (1)..( 3003): 2750-1469P.txt file - cDNA_ID_1817916; gDNA_ID_1621148; Annot_ID_56805
gactaagagaaaaatgtattcagtggaggctaaagaaattcttctcgaaatctgatgcaaaacccataactgaaagaaaagaagaagaaagaactctttgaattagttcccgagccaaagatcatatacataaccagaattacgacgaaggagttacggatgtttaggacgagagccaaagatgttctaacaatatgtaaccaaatgaagactttccaaatattaaaaagagcccttatgagataaaaaaaaaaaactttgttggcctgtttttcaatgcccaaatatagcgatcaagattttgagatgaaagttatgaccattaaaggagtatatatatccaattgtccatactagccagcgaccgtgaatgctgcccaataaccaacaagccaaaatgaccattgtttacaaatgtctttctcatttgctgttttccgacagatagagtaagtgtatatatagaatagtactgaaagagagggccgggggacttatatacgttttgaggaaaaagataaacaacattagagtaagagcgagatatatacacttatataaagtcatgtctataagaaagttcaaatccaacttaaaaatatatactcacaacaaataaaagttacatcacttcgattatttagagtttataaaactaattagaaaccgaactctttttttcttcaaggtcgtgttttggttttaggcttttagccctaatttacaggtctttctaaggctaaatctactataaaatgtaattgcatgcctagggttcaaacatgaagtctcctctccctcaaataatgtcaacttggaagacaacacgattgtctccctgtattacatgtctaccgagaatagatgtacaatgtaatttcatggattatgtttaacccgataataaattggtgtgggatgtaatgatttattttctttaatttaagaaattataagagttgacacaataaaaattagagaaaaaaaaaacatggcttttctttttactttatttatttaccctgcttcaaaacacaagagaataagagaaaagtgtattttgaaacgtttttgaatgttagtttggttttgtttgatttatagtactgtttaacatcagaaaagacaaatgagtttaaaaaaataataccaaaaaaagaatttactagatacaattttaaagtggaaatatttttaataacttggatcctcgtctaatttattcataacatttatgtgatatattatatatataggaaatgatttattagatagttgactaaaactatatattagatgctattatttgcataattcatatagttatttattatgaaaaaagagaagaataatcagttatgtaaaagtagaattttttttttttttttaaatgttatcggaaaaactgtatacagtaataaaaaagagaaaaaaaaaaaaaaccatatctttgtcgatggattaaaaacaacattttcattacgcagcgcttcttcgccctcagattcttcttcaccttgaaagaccattaacatcattccttgcccagatccaaacaatgccatctccactctctctatttagggttctctccaacttttcaaatccctaattcttgctccctcccttcaatcaattccgatcatcatcgaggtctctctactccccgaatttaaagatcagagccgcgacttcctctgccttcttttcctcggaatttttcagctacgttttccaggtggtgtgtattgtcaatcagttgacctttgcttttgtagccagatcgttcgtgctttgagtttagggctcttttacaaggtttcgtgttggtggaatttctctacctaggtttgggggaagagttcagtaatttcgttgtagatcgtgatttgggcttttagggtttcggtttactggttgctggaatttatggtagcgttattgaattcggactctctgcatgtgtaagcgttgaagtttgaagtttcaccgggttttgtttcttctgctgaagagtcgagattattttacgcattaagaatcgattcagaaggtttttaggaattagtttctgtggattgtaactatataactactgggaggggatgtttggttctacattggatagcagccgtggaaacagcgctgcctcagggcagcttcttactccgacacgcttcgtgtggccttatggaggtagaagagtcttcctaagcggatctttcaccaggtgagatgactgagcttgaactaggatagtttactttatatttcagttaagctatttatcggggtttgtgtagagtatgtgctctgtatagtatctatcggggttttgcagtccatggactgatttctgaaatgggcatttgaacaggtggacagagcatgtgccaatgtcaccgctcgagggctgccctactgtttttcaagtcatttgcaacttgacgccaggatatcatcaggttaataatcttgtactcgacctgtatcatggcaaattctttgttaattaatccctgcagaagcatttatgtccttgtagtgatttagcgatgtccataattgtgcttcatttagtctctggatacttaacctatgcaatgagaatcttatatacctctgtcatatttgtatgactgtggctgaaaattgcaaatttccttgctaattgatcaaaatttgactttatacatcaccatccacataacaaaagttggggtcttcatgctgtgtgatacctaaatcacttcttttaataaaggctacagtgtgtgtatagagattcatatattttggcagttggatgtactatatataacaagattttaattattacaatgtgagatgcttaagaagccactaatgttacatttatgttatttcattctcatgcagtataagttttttgttgatggggaatggcggcacgatgagcaccaaccatttgtaagcggaaatggtggagtagtgaatacaatatttataactgggccagatatg

SEQ ID NO: 18503 - DNA, 3003 bp, Unknown
  misc_feature (1)..( 3003): 2750-1469P.txt file - cDNA_ID_1817932; gDNA_ID_1621148; Annot_ID_56801
acgggctgatccatagtcttatgatccatagccgaagggaccggcgcgtgaggaccactcgaagatccataagtatacttttccccaaatttgaacgagaatttgagagatcctttcgccttcccgttaggcaacctcacggcgtaagtaaccgttttctcctcgtcacctttattctgatccaaaagctccttcaccggaacgctaacctcaccgacaggtttatcaccagcgatgggacgatccgccacgatctcgaaaacaagagtaagacgattgtcacgcgccgctgcgtcatcgacggtgagcttcatttgatgcttccatttaggtttggtgccgcaatctttatcaacctttgtcttctgcttcgtcctagcgtcgccgttgatggaaacgacggcgtacaagtcttgtttaccgatcaattgaacgtctttgagatcctccgcagatataatcgtcagatccaatgatctacactccatggttactcggatcgaaattgaatgaaataaacttgaaatttgctctgagaatgttttttatgatgaggaaaagaaaagtggagagggcaaaggatatatatgcatttatgataaagtcggtttaaggaacaaagagttttttttttacacacgggagggacacgcacgagattttttttgttaaggacgcggtttctttaaatgcaaatagcttttttccttctaatattagtttcttcttatctgaagtttaattatcttgctgtttttagtaaattattatttgaccatggttcaaataataaactcatgtgtatctaagagtttagtgataatggcaatgtaaacgttcaaagatatggaaattataaacgttttaaagaatgtctcaaatgataagaccatgatcaattcggtgttctccgtaagcctggttacttgacaacgtaatcaggtacgtaaaataggacaaagacacgccggagagttagacttattattgtttgatgttgatatcatgatatgtagtaatcatatcgcattttactctgctaggattggatatgatcaacatcactaacatattcgaaaaagaatatcaagtggacgagtacgaattctacaactttaccattcgaaagtttaccgtaaactctaaatgaaaatgttttaataaatttacattgaattacagtttaacaaaaccaactaatggtggtatatatgatggtaattagttgaagattagttgtcttcggaaaaaagttactaacttaaaacttggaaccatgcatgtattgcgataatgaatgagcatataaggtggaatcttttgaaatgtagaataatctcaagcatctttcttggtttcttcttcagtagtcaagagcaatacgcgtggaataacccatacgttttctatttttgcttattctcgaaggcgattggttctcattttctcgatcgaatcatccttttaattcaacgatagcctcacgtcgcgtggtcctgacgcactatccatattctttgccactttattctccttcacggaacatttaagttaaacgcaaatatacacgttagtccatatattggaggagaccatattcacaaattttgatatataacacaaaaaaagtttacctgatttttcttctagtacttgatctcatcactcaactacttgcaagtcttgaaactaatcatcaactcaccattcagaatttgtttagcaaaaaaatcactcaatgataactaaaaacccaacaaacatacacgatcatatttcaaacgacaccattgccaatgacttaaaagtttttgaccaatgaaaattttagcgttgagtattttgaatcacgttcagttgctcatcgttattttcagtaactacaaaatgaacacaatttaatcgttagtcgctgaaaattagaaaacgaatatgacatagtcattaatgttaattaccattagcaaatacgaaatgaacataatttacattagaaccaaataattctttctatgaaactatccgaaatccaaattccggatgcattacaagtcaacaggtttagaatcaaattactgtaaaacaaccttatcaaggacttttttttttgtgtttcatcaattggtaagtttactttaataaaattgcaatattaatatatttatatataattctttgacaacatatcaaaatattttaaatttgaaatttgtatacatatttcccttaacttttgtttgtttatatccatatttggtaactgtacaatggggatccacttttgaatcaaaaaacaccacactgaaacaaaaataaagaaaagaagaaaaacaagtgaacccatatccatgttctgtctgaatccgagtttacttcttcttagttacagaggaggaaaaaaggaaaacctaagcggaaagggaatatccaaaaaaaaaaaaaaaaaaaaaagacagaagtataagaaaagtatcctgaacatgataggtctctctcccatctataacctctgcaatttctctcgaccaaaaccctaatttcaggtttggggttttccttctttcactgtaagtacgagcaattattttcatatatatatgtacctatatatatatacacacttatatacttgttgatgagcctctcgaattccccaatcttaaacactcttcttcaattctacgttcgattttagcgatttcggagttctcttcttctgtcttcgaatttgtacgcacttattagttctatacatatatcgatcgatatagcatgtgtttctagagctcttaggttcagtgattgatcatgtgtgtgtgtgtgttcgttgaattgggggatttaacgggttttgcttacaaatattggattttgggattgtaatttggttgatctctctctcaaattcgagcaggagtgtataagctaccaatttagttttctttccctttagtgagtgctcaatttctgattttagtttgaaaatctagtgttttgacaatg

SEQ ID NO: 18504 - DNA, 973 bp, Unknown; identical to SEQ ID NO: 7483
  misc_feature (1)..( 973): 2750-1469P.txt file - cDNA_ID_1817952; gDNA_ID_1621148; Annot_ID_56795

SEQ ID NO: 18505 - DNA, 3003 bp, Unknown
  misc_feature (1)..( 3003): 2750-1469P.txt file - cDNA_ID_1817960; gDNA_ID_1621149; Annot_ID_56843
gttgcttattacaccaaactccatccacatattaaagaaaaacaaaacaaaaggaaaccaaataagtcaaagcaagtaaatgattggaacaaattgataggtaagttactagagacaggtacttaccgttaaaccagtttagaaaacacggttctttttttagcagatatgaaaatgagaaagagacaacatgagctatttcaatgttttttcttgggtttgcagagtgaaggagatataaatacgaagagggtgatgaagaaatgacagaggaaaacaagcattgaattaggccaacaacccccacaacaaaaaggaagttggttgtattaaatttgaaaaatatgtttgtttaagaaatagtgaaatacttttcgaaataataaatatcaaacaaaatatttaggtcgtccgttacaaaaaaaaaacaaaaaaaaaaacattgaaccacttttaagaatttcatgatgattgcttgctagttcttgtttattaaaaagtccataagaaacagctaaaccattatagacgtttctctcttaaaaaaaaaacaaaatatacgacaaaatatatcataatgattttcttataagccatgaaaaagttactattttgtgatggatattctctttgagtctatgattacaaatttatcgcatacttctaacacaaaaaaatacgtcacaatttttgttaggtggaaaacgtgagaatgtgttaaaaatacgttatttttgcgattttagttttcatttgtttaactttatttataattggattccatcctcatgaaacttgtgaggcaatatttataaataatattattacatcttgcatcttgcatgtattatgaattatatatatgctcttgatctctctcctgacctacgtaacgcctcgacggggaaatcggaacaataactacatgatatgttcatgcataagcttgcttggtctacgcattgttcttaaatctgtttgatgtcactatgtcacacatgacacgtccatatctttgatttactattttaactctaaaacgttaacatagaagttgaaaaagtagtcagttgatatttgataagaaaaacagcatttataaatctcataacgatattcaagaggaacgtaaaatttactcaattaggtagctttcatctccaagtatatacacatgggtctatgaatagtgcatgtacatgtagtatatgtacatgtgactttttatgtagagaggtttgtagaataaaatgaaataaaggaacaaggaatgccatagagctttcaaaatcggtatttatgaggacttgtatgagagacaaaggcatgttggtgggctctgctactcccaacatctatttgaattttgaaactaatttggtggtttcatttttgaaatacatctatacttccctcttaattttacctagtaaagtttctaggcctgggatttcggctaaacccgaggaaatcgaatgtttcggttctcggcgcagagagataaagagaaggcaaaccgttcggcaaaaataatattgtgattcggattacggttcggttcggttcggcaagctaaaccgatcggttttctcggtttagaggtacaccctataaaatagaagaaaccctagatctatgtcaacaattcatgtcgtctccttccttttctaatcttaaactcttctcctcaagatccttctttgatcttcttctccttcttcagtcttcttcttcttcgttctcagcttatcatattcgtttactgctgtgaaaccaacactctctggcatcaatccaatttttttttttttctcaccgccgcgacatcaaatctctcgtctagttgccggtggtggcaaacatagacatctgcactatgtaggaattacagatctagtcaagccgctaattattctttctttccctttgaaagtcggacgcgcatgagtgaacggcgtctccgtcaccgtcatcattcttcacttgtcaaaaacctagatttcagatgggcttgggcatgttgtttattttggacttggacttttattagatttagcccattattaatttattattgttggtttataattgtaaatttaataattgagcccataattttaattttggtctaattcggtttgaattaaccgatttagaaaaagggtcggtttagttcggaattgattttaatccctgtaaccgaaccgaaaaaaccgagtaccaaaccgacccgaaccgaaatttaattcggtccaattcggcagaatttttaaaaccccaaaaaccgatttaaccgacccgattaaaccgacaaaaccgaactcccaggcctaaaagtttctatgaaaatccactactaaattaaaaaaaaaaaaaagaaaaggaaagacaaatgttaaattgcatcaaccaataaaaataaagtttttgttttcacattttctgtaccaagcatattaaagtgtagactttaaatggttgcatgcgacctaattcgtaaacaaaaaaaaaatcgtataaattttttgttttgtatcttgtaaaataaaataaatcaaccaaattaatgagtcaagacaaaaaagttcaacgagaaccgaatgttattctaaaccaaaccataatccggtacaaatttccggttctgcagcaggacaaatggcaacaaaggaaagtaacgatgataagtttgatcgaaagtttcagacttcaataagttttcagtttcgtgcatagattaggaatctcgaaaccctaattctgttttctacacgaaacccatcaaaatcgaattttgatcgtttctaatttctgccatttgattctcttcatcagtcacatttaggggaaacgagaagccctaatctttggtatgttgctccctctgatttcgcagtttctgggtttttgttttcctctgcgaaatccctaattgaatatcagatttcatagattgtgttgattgattttggtgttttaatttcagattctttaatcgccatg

SEQ ID NO: 18506 - DNA, 3003 bp, Unknown
  misc_feature (1)..( 3003): 2750-1469P.txt file - cDNA_ID_1817967; gDNA_ID_1621149; Annot_ID_56841
cggtgaagaagaagactgagtttttggtcaaggagatgaattggccagtaaaggctgtggcttcaatccctcaggtacttggatacagcctagagaagaggactgtcccaaggtgtaatgttatcaaagttctcatgtcaaaaggattgcttgaaagtgaactccctccaatgtcttctgttttgacaagtactagtgagtcgtttttaaatttgtatgttagcaaacatgatgacaagcagcttgtggctgagctgatggcaatcttcaccggaaatcgtgtttcactcaccgatcagaaggcacgcctagaacaatgagcaacgttaaggattgttttttgttttctgttaggtttagattcattagtgagtcttgttgcttgacttttggaagtagataatagattttgtgtatgagtgtctaagcctttgaccctgaaggatgatgaatcagtcttgtatgaaaaaaatctttacaattatctttctttgtcttgttgatatgaattatggttaagatctttgtgatgtgctttgttctgttttggaaattaaacagagcatatgatatatttcattttactagtttcgtggcagaaatctttcctgtttcgcaggatttggtagacaactctgaggagtaagatccactcgcaaacgatggaacggtttattcaaattcctagtttgctttttctacttgagtccttaagtttgtattagagtcttcagtatacttcataccttcttgttcaacccaattccaactcttcagtctctgctacatcttcaaactccatcaagcctcaaactaataatctttcaagtgagattataaatcttcaagcttcttggattggatatatcaatagactataaaagctagtagaaaagagtagaaaagctagttgaggatttataataaggtaaataagtagaaaagacttttatagtctattgatatatccaatccatttacttgatccatctctgtatgcaatctgactgacaaattgtaattgttaaactcttttttactagctttttttaactcttcaacattaaaagtctagaaacagaagacaactatttactacatgatatttttggttatttgttaacaagaagcactgtggtaaagcagccgaggatgaataattttagtgtttgtttgatgagtgttaatcttcatggaatccataaccacaaagatttggttgatccatctatataaagcaaataggtgtagttaatcaattcaaggtcttttagtgttatcccttgccaaggagggcaacactagagtctagagtttcgttttccacttgagtccttctgttggagacagtgtcttcattacacttcctaaccgattccaaagcttcaaatttcatcaaacctgcaacataatgatgacttcacaatggtgtcgagtgagctccattaaaacatgtataggcctaggattcagcataatgatgatcaagcgctatcttgagtgcattgtaatttgatgaaagaagttgacttgaccagtggcaactagaggctggagaagaggattgtcccaagttataacctaatcaaagctggtacgtctcgaagcatgatgataagctggtattggagattactgtttttgctccaaggaatgtcatatcaagaaactgtgcattgttcttgtacctcgctagcatcttcctttgttggttacatggtttgctattccaaccaagctctggtactataaggcaaaaggaaaggagaaggagaccattaactagtctatattacaacaatacattatatgtttcgtggatatctctttttcttatcttctctgctgttttcctttcttttgtaaagattgttctttgaacatgaatcaatacactttagaatctattaagatagcaaataagttgatgcaaagagcaagtgtgagatggataattgaacgggagtgaatgaacctgtcactagatctctaatggttgttgttacctcctggctcctcctcagctgcctaaactgcgtttagctcggccgcctatcactttttttttgtgtgtaggtttgattggtctctctcattcagaatcatatgatcaatttgttttcaagttttgcaatgtttttgaaaacattacatttacgctaattggatttttaaactcgataaccgtgattacaaatagagacgtaatattttttagattatttctcatgtttttttgtgatttgttcatcttatgcataatttatttttcacttatgttcaacaatagtatacaaaaatttagaaatgctcatcatatataaaatcacttttgacgttctgaggctccaatctattaaaaataaacgatatagatgataatatatacgtcttttaatcaagtgaatgaatatttagtttttttttttttaataggcttcactttgtttcttactcagtttaatttttatttggtttttataaaattacaacttagttttaatcaaaggttctaaattaaatttgaccaaaaacataaaaaaataattacgtaagagcttttttggcagaaaataatttagagtaattatttattccttcgacgttaaaaaagaataggaaaaaatatgtttaaattgcatcattcgaccaataagattagaactcatcctttttttttttaaggatatatagaattcatcactgaatacatgtttttatcccaaattaacgcaaaagagagaactcgagatctgggcatagcgactcactcagatctatacaccttcttcttcttcttcttcttcctcttcctcttcgcttcgttcgtaaactcatctgatctgtggtaaccaccattgttcctctccttacgatttcgaatttctgttttgatctcactaccattgttgcaatttagatctatttctaattgttcgtgattcgcttttttttttctgtgatctggtttttgtagagtgccattatcgttgagagattatg

SEQ ID NO: 18507 - DNA, 3000 bp, Unknown; identical to SEQ ID NO: 7513
  misc_feature (1)..( 3000): 2750-1469P.txt file - cDNA_ID_1817989; gDNA_ID_1621149; Annot_ID_56829

SEQ ID NO: 18508 - DNA, 3000 bp, Unknown; identical to SEQ ID NO: 7513
  misc_feature (1)..( 3000): 2750-1469P.txt file - cDNA_ID_1817989; gDNA_ID_1621149; Annot_ID_173166

SEQ ID NO: 18509 - DNA, 3003 bp, Unknown
  misc_feature (1)..( 3003): 2750-1469P.txt file - cDNA_ID_1817997; gDNA_ID_1621149; Annot_ID_56826
atttagatttttgagatctttgggttttctttttctaattaatgtaaaattaacaaaccatttaccaagaaacatttgttggttcaaaagttttaggaaacaatgagatgattatgtcaaatcatcattatttataaacttaaatatatttgtttcctaaataataagaaaaaatattaattctatatttaatcccacaaaatgaattaggaatatgtattaactaaaagattttttatccttattttctatagcatctacataacatatctttaaattataaaaaaatcacataaatattttcgggattcagatttcaataattaggatgtgaacaggttttctaaaaatatcgttcgaatatattgaagataaaaaaaatacaaataggaaatataataatttaaaagatacaaaatatttataaagaaattttgttttaaaaaaaacaaatttcaatgaattcaatataaaatcttcaatacgaatccgatattgattcttaaataaaaatattaatataatatacaatttttcttattagactgaaattttaaattgactcgaagtatcttaaataataatattattaaaaatagaaaataaataatttgatttttagttatcacgggacggattatacggtggaacgggtttagatgagacatgacaaaatattatcccgtggtgtggtctatcaccagtcaaattctataagataaaataatatatattaaacttactaatatcataattacgactcactaaaaaccgtacacaaccttatcgagaattattaatcaacacaaacaacaacaaattctttatcttataaaaaaaaaaatatatatatttaacccgcggtataccgcgggtcatatcttagtacgttataaactttatactacgggtgaaatcctagattgatattaatacaaattatatactatgggagaaattaacaatcaaatacaattataaaatcttaaacactaaataaaataaacaatattatttaaacaaatataaaattaaaatttcaaatttttagtttaaaaaatatagttttgtgatgtaccatacatttaaattaaacaaaataaaaacatatatttattgatcaacttaaaaataaatatttaattttttaataaaattataggcatgcagtataccgcggattaatatctagtttaaaaacttaaaaatattataaattaaaatttaataatcatattgaaacgaatgacgacgttttgtaactcccataagattatcgagttaccaaaactcaggcgagagagagagatcagaaacggaagagaagaataattcagtgaagaatgagactactctctcctctgatcatcactcattgatcagatttgcatttttgagtctccatttctgaatcatccaatccgatcgacgttctccggtattgatttcgttgatcgggtttttgttaagtttttaatatcgatagctccgattccttaaccaaaccagtacgtaccatacacgagagagactagcacatcactagctcagctcacattacaccatacgagagagactagcacatcactagctcagctctcaagtctctcatgcgagactcgcacaattcaacaacaacaacataaagcataatccctctaaattgatctctttccttatttatactagaacggagtttgttagagatatttttatatcttcttcaagcaagcttccttctcacgtgcctcttcacttgcacatgtcttcttttgctttgtctcccattcacatgatacaccaatcgtatcagttttcagtcatacaatcctttgtcagcaaacacactttgttagccgatccaaaataaccaattcggtttgaagttcaccgattttcgttccacctctacacggttttttgtagtgaaaaatcgtcgagaaaattatgaaaattgagagcatcgtctcgtgggagagttcaactagatctttatatttacttatgctctttttattgtaaaaaataattgattatatacttcttcattatatacatattttgatttacactgtttcactaattgtagtttccatggtatgaaatcacttttagaaatttgaattatttctatgttttttttttttggggtaggagatgggatcgaacccccacttttattaataactaaaaaaacaatcacacccgaacattcagagagcccgcatacccatttacatactcaagaacaatcgacataacactatccaaagtagaattaaacaaatgaaaatctaagggtaaagtgtaaatatatagctaactcattcgcaagacgattagcctttctatacgcatatgaaatccgtactacccattcctttgaaaaaaagttatttatctatgtccaaagaaaaccaaccaccatctctaagccaatctccagctcgaagtgtatgataccgcgatccagctatatgtgagccataatatgctccccatagttccatggtatcacttttagaaatttcatttatttctgtcatacatattttcccagatgtaatgcatatttttttttttctttttggatattcgaattattcacctttcaagcgaacgacgacgtttggtagcgtcacattgattattatcaagtattcaagttactccaaaacttccaggcgagagagatcagaaaacggaagaaaaggtgatgagagagttagtctcttctgatcatcacttcttcatcttcaaccattgatcggatcacattttgtttatcgaattcaatcgaagattaccgattttgattcgaaattctcctgttttgatttcaccctccagcggtgatcggagaatttcgccatgtcgtggggattaggatggaagagatcatcggagagtttccgtttaagtctcagctacggcgccgatgatctgaacgacgatccgattcaatcaccgtcggcgtctccattcggatctccaacgtcgatg

SEQ ID NO: 18510 - DNA, 3003 bp, Unknown
  misc_feature (1)..( 3003): 2750-1469P.txt file - cDNA_ID_1818009; gDNA_ID_1621149; Annot_ID_56823
aatataatgtttttgcagaaagaacaaaagggaagcattggcattgtggtacaaacatcatggtttgaacccattagtgattccaatgcggataaagaagctgctgagagagctcaatcattttactctaattggtatgttatattactatatatgttgagatcatatttgtagatatgaagtatagtacttcacccacatatggaatatatattgttttatctatttgtattctaacatgtactaggattctagatcccgttatatatgggaaatatccaaaagaaatggtagatattcttggaccagccttgccacaattttcgagcaatgaagtgaagaacttagagaagtcgagggcagatttcgttggtattaatcactatacaagttacttcattcaagattgtttgacctctgcttgtaatactggacatggagcttttaaggccgaaggatatgctctcaagttagaccggaaaggcaatgttactataggagaacttgtaagtacattcattcagtttcttatattcaatattttacgactatattcaaatgttttagtaaattttattgtttattgaccatgtttctattgttagaccgatgtaaattggcagcatattgatcccacaggattccacaagatgctgaattatttaaaagataggtacccaaacatgccaatgttcataactgaaaacggtacaagacctcaaatttgatcaatgatcgagtcatcaaccatatttgaaattatcatgaaaaattattattaatggcttgaaggttttggagacttgcaaaaacctgaaacaacggataaagaacttctaaatgatacaaaaaggatccaatacatgagtggatacttagaagctttacaagcagcaatgaggtaaataatttatgtaaatttatgcagaaatccaattcttaaaatcatgcattcaaatagtctttaaaccaatttttatctaatgaaaatttactaattctatataagttgtgaattgttttggtagggatggagcaaatgtgaagggttattttgtgtggtcactattagacaattttgagtggttgttcggatacaaggttcggtttggtctattccatgtggatctaacaactcttaaaaggtcaccgaaacaatcagcttcatggtacaaaaattatatcgaagaacacgtgaatcgaagagatatcgtagataattattaaacacatttatttttaattcgtattcactgccaaagaaagtcaaaaattacaaaagcatttaaaattgatacttatcattgttgttgattgttgaatgattaaatttgtcttttcctcctaaaagtgaatgtttaatgtgttacatgattatttgtctaatcttgcacaataattctattagcttaagatgttgaagaacacgtgagaagagaatttaggttttttttttggtcaaaggaagaatagtaattcgtattcctaagtaaagaaagtcaaactaggaaagaatttatgtaacttcgttaaatgaatgattaatggttttctttaccttaaagtgaatgtttaatcagtgttacgcgccatacggaagtaattgtctaatcttgcacaatcattcaacacgttttcaaagaaaactttttttgttctctatgatgataatagtgttaaatcaaaagtagtacaaaagtaaactaaacttattttagattaaaaatcaccgaaaaaactaaacacgcgttagaaagcatttgacatcacctccaaatttaatttcacgcaagcaagcgtttctaagatatggattctaaacgctatatcactgttttttgtaagataaattcttcttaattttttcaataaaaaaatttaaaattaaaaataaaatcataaactaactgataatgaccaaaggaaccataaacacctagaaaattatatttctgtgttttctatctgcggtttaacgtcagtaacatctaggaaagttattttacgaaagtgaacttggtttttgtttgattgaaatatgtttcagactttcagaagaaaaaaaaagatacttatttaaaatatgttaagattttagttcacttcaaattatgtaaacatgctgatttttttttttttttttttttttttttttgcaatcatccttcaatattgtctgcgaaacagtcaagtttcaagtacgattcacaacatttttcaaaaaatttattcattcatttcactcccaaaactttttaatttacaaaactacccgtacacgtatattggttgaatagaaattttttgaatatttattatattttgagttacatatagactatgatttaatcaaatacacaatgagtcgttaaacaatctaaagaaaaagacacacgaacaaactgataacatagataacatataagcaaaataggtcggaatcaacaattacatatataaatggttgcgtggttaatgatttcatttggtattttcacgacaagatcgtttctaggtacatagaagtcaacttcgttgccatataaactgtataacacttagtcatacaatctggtttatttatcaagttcaaaaatttaatttaatcaaaatatttgtttgcgaaattttcaatcgagaattaaaaaattaaaaaaagttgcgtggttgagttaatcgtttggtctccatcgctgatatcttcaatttctctgaattaatcttcacatagctgtataaagacctagaaaagaaaacagatatactagtaaccaaacttagaatcaagaaagaaaaaaacagctatagagttgaataagaagaagaagaagatgacattttttaaaccaattagaatcatcaattttttattcctatttttcatatttcttgtggtatacgcaaccgtgttctgcaaattttgttcagacactggaaacttcaaaagaagtaagttgaggtacgaaacttccgatgatagttatgaagctaggagtagccatg

SEQ ID NO: 18511 - DNA, 3003 bp, Unknown
  misc_feature (1)..( 3003): 2750-1469P.txt file - cDNA_ID_1818013; gDNA_ID_1621149; Annot_ID_56822
cattttgtgggctagggatctacaatccaatgactgcaaaatatttacggcatgcaaaacttcttatgacaagtgtgtttgacacacgtctctaaaatttcaattatgtggatgtgcttatttgtatcaatgcatttcatgcttgcttggcttcgtatggaaaaagtatgagccatcataaaaatttgttaaaaaagattcgagtcatttacattgttttaggagccttttttgatcggttagggtgctagagaacccattacatactagtcatctgggggtattagtattttgtaagctgttttaaacgattccgaattttgtttctatattttgtggtcagatctgatggcctgaaaatcatccccaataatcaaatcttaatgcgcgtttaatattttactaaattatgatcatattattttttgcgatctagtcagtagtcactgtagtgaagttggtgagacgacacccacccaaaaggagtacgtaaagcaattccggcttccaattattttatgctaatcttgtcggcagatgagatggatacatttatacatatcatatataataggttgggaaattgttagtttcgttgataaaataattaaggttttgacttttgactgattctggatttgatttcaggaaatgtaaaattttccagattctgtatgtactttttgataagaaatttcaagttgctgcatgtcaaaaatttcaactaatctcttttgtagtgtataaatttatttactgtccaatagacaattgccaccgatcctaaggagcaacgtacaataccaaaagtttgcatgcataataaaagttcatttaaacataacgtataataattttcagagtgattattgtaactttcaaattttcacataaattttagagtattaaatcaaatagcctttgtaatttttgagtaaactaaatgacggtctttttttactcaaaatcaattacaaccctttaaaatatcctaaaagctttgttttaaaaaagaagataaattatcacaacaagaatataatctaactcactacaaaatgtaaggccaaagaagagatacgttcactgattggacgtgatggagagagctcacatctcgtctggccttatcatcatcgtaatctattgaagatatatatatggtaagacaaattaactttactcacggattctattctttttacccattctcggttttgtaacgaacgacgaaccaccaactagacaacgaaacgtcccacttgtttccattagttaaatttgggtaacaccaaaatcgcattaacttaataaaacactgttccaatatcaaccactgccatattttctcccttatttttttttgacatcaaaactgattttggagaggctttgaaaccccgactataaatttgatttaggtgttattctgatttatgagtgaatagttacacagtcggagtttgaactgaaagttataggattacatttttggtaaaaaattgttgagtcgtatttttggtagaaaacagtaaaattatgttttttgacagaaaattggaggatagtaattttggaggaaatcatatatatgaaaattgaccaactctctccatatgattgacacataatcactttagcatttgacatgtgtctattaaataattaatgtaagctcttcaacttctaatttataggttaaagatatatttattatttaattttacatcttattttattttacgtatttaattatactattactatatttattttaatattacatgatttttcaataaaaccattttaatagttttcttatactctgaagttttttttttttttttgtaatccaaactcaaagtatgagtgtataatagtcgtggattacttaataatttgagtaagttattctcttaaatgaatatttatattttcttaaattgatatttatataataaatcactaagggtgaaaaatgcgtaaggagttccatcatcaaattcttaggtttctagaatccaacactaacctctgttaaattggtttaaaacaaacgttgtttatgaattatgtatatgatgcattgttgagaacgttgctagaaaaaaatatttttaatactaaaagtaattgtttattgcatgattgaatgattagataaatataaattatatttaaattaaacactacaaaagaatccgaaaaaaccgcgacgtagcgcggataattacctagtagtgttaaaacaaaattggaggaaattttggagatcacatttttaacataaaattagtagaaatatatattttaattattaaataaaaaattaaagtaagcgctaaatgtcattaagaaaattttgtgaaaggcggaaacaaaaattttaaaagaaaaagaaaggactaatcacatcatcgccattcaatgatatagtttgacaatgatatgattcattaactaccattcaataaatcggtttatgaaatctaacggttaaatattagttggtaaagcatgattaattaagataatcactcaacaatcaattcaggaccaacgtcacctagctaccaccacgaaggaaaatgctaatacaagaaccaaatcgtcttattaaccagttatctttttctcatggaccacatttaaatcgtcacggcaattaagctagattttaagaaagaataaatgggatactcaactaattgccacaaattttattacttttaaaactcggctgctcggcccaaacttatccggtacggatggatagacctatcttttatcgtgtaaagaaactcttgggctccactcttgacgttgctcattttatctacttttgttggtttcttagtgacctttgacgtttatttacatagagttgacagatttgaattgacgttttctcaataatgcagaccaaaattttcacgtttcttacatgtacatatatatagtaaaacaaatctctgaagacacacaagagaatcaagaacaatg

SEQ ID NO: 18512 - DNA, 3003 bp, Unknown; identical to SEQ ID NO: 18511
  misc_feature (1)..( 3003): 2750-1469P.txt file - cDNA_ID_1818013; gDNA_ID_1621149; Annot_ID_173158

SEQ ID NO: 18513 - DNA, 3003 bp, Unknown
  misc_feature (1)..( 3003): 2750-1469P.txt file - cDNA_ID_1818013; gDNA_ID_1620785; Annot_ID_168123
cattttgtgggctagggatctacaatccaatgactgcaaaatatttacggcatgcaaaacttcttatgacaagtgtgtttgacacacgtctctaaaatttcaattatgtggatgtgcttatttgtatcaatgcatttcatgcttgcttggcttcgtatggaaaaagtatgagccatcataaaaatttgttaaaaaagattcgagtcatttacattgttttaggagccttttttgatcggttagggtgctagagaacccattacatactagtcatctgggggtattagtattttgtaagctgttttaaacgattccgaattttgtttctatattttgtggtcagatctgatggcctgaaaatcatccccaataatcaaatcttaatgcgcgtttaatattttactaaattatgatcatattattttttgcgatctagtcagtagtcactgtagtgaagttggtgagacgacacccacccaaaaggagtacgtaaagcaattccggcttccaattattttatgctaatcttgtcggcagatgagatggatacatttatacatatcatatataataggttgggaaattgttagtttcgttgataaaataattaaggttttgacttttgactgattctggatttgatttcaggaaatgtaaaattttccagattctgtatgtactttttgataagaaatttcaagttgctgcatgtcaaaaatttcaactaatctcttttgtagtgtataaatttatttactgtccaatagacaattgccaccgatcctaaggagcaacgtacaataccaaaagtttgcatgcataataaaagttcatttaaacataacgtataataattttcagagtgattattgtaactttcaaattttcacataaattttagagtattaaatcaaatagcctttgtaatttttgagtaaactaaatgacggtctttttttactcaaaatcaattacaaccctttaaaatatcctaaaagctttgttttaaaaaagaagataaattatcacaacaagaatataatctaactcactacaaaatgtaaggccaaagaagagatacgttcactgattggacgtgatggagagagctcacatctcgtctggccttatcatcatcgtaatctattgaagatatatatatggtaagacaaattaactttactcacggattctattctttttacccattctcggttttgtaacgaacgacgaaccaccaactagacaacgaaacgtcccacttgtttccattagttaaatttgggtaacaccaaaatcgcattaacttaataaaacactgttccaatatcaaccactgccatattttctcccttatttttttttgacatcaaaactgattttggagaggctttgaaaccccgactataaatttgatttaggtgttattctgatttatgagtgaatagttacacagtcggagtttgaactgaaagttataggattacatttttggtaaaaaattgttgagtcgtatttttggtagaaaacagtaaaattatgttttttgacagaaaattggaggatagtaattttggaggaaatcatatatatgaaaattggccaactctctccatatgattgacacataatcactttagcatttgacatgtgtctattaaataattaatgtaagctcttcaacttctaatttataggttaaagatatatttattatttaattttacatcttattttattttacgtatttaattatactattactatatttattttaatattacatgatttttcaataaaaccattttaatagttttcttatactctgaagttttttttttttttttgtaatccaaactcaaagtatgagtgtataatagtcgtggattacttaataatttgagtaagttattctcttaaatgaatatttatattttcttaaattgatatttatataataaatcactaagggtgaaaaatgcgtaaggagttccatcatcaaattcttaggtttctagaatccaacactaacctctgttaaattggtttaaaacaaacgttgtttatgaattatgtatatgatgcattgttgagaacgttgctagaaaaaaatatttttaatactaaaagtaattgtttattgcatgattgaatgattagataaatataaattatatttaaattaaacactacaaaagaatccgaaaaaaccgcgacgtagcgcggataattacctagtagtgttaaaacaaaattggaggaaattttggagatcacatttttaacataaaattagtagaaatatatattttaattattaaataaaaaattaaagtaagcgctaaatgtcattaagaaaattttgtgaaaggcggaaacaaaaattttaaaagaaaaagaaaggactaatcacatcatcgccattcaatgatatagtttgacaatgatatgattcattaactaccattcaataaatcggtttatgaaatctaacggttaaatattagttggtaaagcatgattaattaagataatcactcaacaatcaattcaggaccaacgtcacctagctaccaccacgaaggaaaatgctaatacaagaaccaaatcgtcttattaaccagttatctttttctcatggaccacatttaaatcgtcacggcaattaagctagattttaagaaagaataaatgggatactcaactaattgccacaaattttattacttttaaaactcggctgctcggcccaaacttatccggtacggatggatagacctatcttttatcgtgtaaagaaactcttgggctccactcttgacgttgctcattttatctacttttgttggtttcttagtgacctttgacgtttatttacatagagttgacagatttgaattgacgttttctcaataatgcagaccaaaattttcacgtttcttacatgtacatatatatagtaaaacaaatctctgaagacacacaagagaatcaagaacaatg

SEQ ID NO: 18514 - DNA, 1470 bp, Unknown; identical to SEQ ID NO: 7509
  misc_feature (1)..( 1470): 2750-1469P.txt file - cDNA_ID_1818017; gDNA_ID_1621149; Annot_ID_56821

SEQ ID NO: 18515 - DNA, 3003 bp, Unknown
  misc_feature (1)..( 3003): 2750-1469P.txt file - cDNA_ID_1818050; gDNA_ID_1621150; Annot_ID_56861
ttattttattttgttgatataacagggaacatctaataatagttgttctcttcgaaatgcagagagttagctaaagattttgttgtatctggaactgcttcagaatcactctatggagcttgtgaggcaatgtacaagccagatatggtttgcccgctaacaacctcatcatctcttgttatatttctaaatcccgacaatgaaaatgcttaaattaccacatctaggcgttgcagtttggtaggttcaaggtttagtgttactatgtagaaaagttgaatcttgaattggtgtgaacattaaggtgcataatgcccgtaggaatcacgatagccattagttttctctttgatatcttcaattatccctctctggcatgaggtgtttaatagtctgagcttgttagccatactccattgtactactctagacttatgtatcgagactctggcttaacacatgaggattttcaggaagctgaggaattgttcgagacaatatcgcaagcacttctctcatctgttgaccgtgattgtctgagtggttggggagggcatgtttacattgtgtaagttctcatttcttctcttcttttccacacatttgttatccaaaattagttcttaaaacaaacttccatggtgatgtgttgtacagaacaccaacagagattaaggagaggatcctaaagggaaggatggattgatctgcttcttctattcaagttgttttccgctgtaatccggttttaagtagtgtaaccttcacatcccggtttaattatatgatcattccttggctgaaattatgggttatgtatgaagtttgattttcctcttggataatggattatatgattttaattcgtagagttatcgaagaataacacttttaactcaattgtttccaactaaataagaaaaaacaggggaaactaaaatatcacagtaaccgccagatcttagagcagttacagcgactaactcctcaaaggcctctctaatttcctgtcctaattcgatcggcttgttatgtctgttaatccgcataataactaatctagaataatccaaaatcggaagttggtcgtgatgggtaacgtaatggactcattcttcaccggattctctcattctatcggaaacttctttggttctccacttgactttttatctggaaaatcttgcaggtaattatacacaaaaccatcacttatattacaataatcttcaaagtttattggtttgcttaacggaaacttaaaactaatcttacttggaacagttcggtttgtccatcaccgtgggatttcatatgctacgttgagaatttctgcgtggctaatcttgcgaaaaccgccttaatcctaatcttatcctacttctttctattcttcatctacatgctatacaaagttggtttttggcattgtatcatccacggtttcttcaaactcctatgggttttggtctcttgttggttctacatgcttggctattgttgtagtttcttctgctatgatctgctacactctaaacgtagaagaagacgcagacacaacagatatatagaggaagattatgatgataatagtgatgacgatgatgatgttgatgatgatgggtcgttcacgtaccatagatcgaagcgagaatgcagaaaagaagaacgtcttagaaagtctctgagaccgaggaaccatcgtgttagagttggtgtgaggaaagaccatcgttctgactcgggtttgagccaacatgctgatggtggtagtccgatacatggtgttagagtgagtagagagtctaagttcgcacggaaggtttcaaaacgcagaaatcgagttcaccatggtgatagaatgaaccatgtcagtcttcttaattaatacatcacaatggaggaattacctgcaactgtcaatgatctcctctaagctttataattcctcttcttgaaagttgaccagctgcatgggtcaatttttataaaccaatctctctgtgtttttggaccttttcattatgtttaattcttgcttcttcggtttaataagtattgtaatcaacataataccaaatatttagttttgttatgacttatgagggcaaaaccaaaacatgaatgagaatctttagagtgctcgcaaaatcttgaatcaagaatcatatttatggtaatgggctcctcaatattgcttcagggacaacagctagaatgtgtgatgtacctaaaggaccacaaaaaaagaacacaagtttcagcaatttgttttcattggtcaacacatcaattgttcacaaaactacaaaacaatctaactgaggttttactaacatgaatcatgtaaatatgataggttgctcgatttgtgcaaacacaaacaataagaaaactataagacttaaggaatttcatcacacacaaaaatacaatttatttttctataatctataatgttttgctttcattccgattatacccttgataatgatgattaggtgagggtaatttcgttatttacaattaaactcacataattacaaaataatgttgccttgccctgagataaacatcaccaaaaaatgttttttttttctttcttagagcaaacaatttgttttcaaaaaattattatttttggcagctcagcaaaattatttaattctttctgtcagttcatcaaataatttaaatattttgtccatgtgataataatatgtagcgcagagagtaaaaataaataaattcatttacagaattgttttgtaaccaattagatagcagtactttaatatctgaggctattttcgtcattttcaaattatggtgtgtttttttggagggagtgggaaaaaaaaaatcgatacatgaatgacgtgacctccattgatttcggcgaacgagcttcttcttcttccctctctctctctctttggctccatctcttacagtaactgtctcttggaaccatttcctcttcactagtatcttctaacaatg

SEQ ID NO: 18516 - DNA, 3003 bp, Unknown
  misc_feature (1)..( 3003): 2750-1469P.txt file - cDNA_ID_1818058; gDNA_ID_1621150; Annot_ID_56858
tgagctctcagatataatcgattcatggatcagagatatctctaactggtgagatcataaggataataagaagcgcatatgaaatctgcatcggaaaaaagttcacaaaccaatgccataaccggattcggagacttcacaaatggaagcttgatctcagtgtcagaaccttgctcggaatatcctgcagacgcaagcggacaattagtatggcatgtcaaaggaaataactatggaaagtaattcattgctacaaattgaataaaacaaaatcaccaggtaaatccccatttgaatctgttcctttgtggtcatatccatttgtagggttttccgtattagttacaccagaaacctcaacattatctaatagaccatcctccacaggtaatcgaagaaaatgaagaatgcattgagcttttgacttggaaccaacatgatcagcaatttgaacccaattttcattgtagagttccacagcttcaagaagcaagagagtttcctgatcagtccaattgtctccatcttgatcgccataaaatttcattggatccactcttacaaagtcaagacaagaatgtccaacaacaaatcttccatggtgaaaacaatcacagcataagagtatatccccctgtaaagtagagatgaagatcctttagttagaagcggtccagtatccgagacagtaagcaagataaagcttggagtctattacatcactgggtgcaaaaaagaatcagataatgatacacaaagaacagtacgtaaggggaagcagcctaagaaccttcttttgcgattggaagtacacagttggaagcggtcgagaacaatggttgcaatgactatcacataggtgttcacgaattctgatgtccaagtcagggctgtcaccatccaaacttggcaaggatgaatagacttcaccccccttgtgtctacagttgggcttgtcaaatttgatcaaactatcaatagatgttaaagcagcagacggcacattgacctcgccatttgtgtcctccctcacatccgatacatctctcaaagggccaggatgtgactgggcagtggcacagtaattgattattccccagtgatcaagaaaacggaaaactcgtgcaaaatcttcaatgtcaacaccatctaccaatccttggcaatcagaaatcgtcagtgtcttttcagggttctctacatatttggaaacaatggcgttcctgaattccatataactttcgggtgtatgatttggcgatttcccagagaaaaactgtggcaccacttgcctttcaagtcgatctactgtgtttggtgcaaaccaatctgctcaaatgtaacagcaaaagtagaagaataaattcgagcattgggaacaaaaatatcagaaaataaaaataaaataagaggagaatctcgatatatttgagccataggactccaggaacaaaacccaaacgaattagaagaacatcacttgcatagtctattcaagttgtacttctgagataagacacctaaggctacttcaagccagcaggtactctaatttatcatgtacaaaagttataatacctcttcctttccatcagacagaacatgggaacatagagaaacatctgatatgaaattgagtcgcgttcagattaatgtaaactaagaaccaggcactagacaaaaggaagataagaacttatacgttaaggagataccggcatacaaacctgttttgactaattctcattccaatcacaagatatatactacaatactaccaaccagcaaaagctgatgctgcataaagcctaacctctaacataaatgcgcgtatcaagaggaagaaaaaacacacctgaatgcataggcaagacatgaaccagatccccaaaccgtttaacaactccttctccatccataataggtggtggagagataacataagccgaagacgatccatcactcctctcaagatcaagagaatcagcaggtacagtagataacgcttgcaattgcccaaacgaaatgttctccagagctggaagtgaaccttgccctctagtctcccctatcaaaccagctctctcagccgccacaacagccattacagacgcgtgtggccggatcacaacacgcttaaccactgccgggaaatcagagatgcgcgaaccagaatcttcaactacctcgccaataccaagtcccggatcgggagttgcgccgccgttttgctgaagctcatcggcattttcaacgtcatccatttcttcgttgttgttgttgttattctcttcgtcttcttcctccatatcttcctcctcttgtttcggtttcctcgccgccgataacccccctctcttcttccttttccatttccctcttctatctgcgacagaattgtaaaaagtgtaattcaattcacacgaattctcgaaatacccatcactacgatctatgtgggtaagtcaaatcccaatttaaatttggattttgagagagataaagatgtgaaacagcaatttaccttcagaagctggcatttttgtggatgaagatagagaaatagaggttttgggttctgtggaatcgaagcaagacccttagtaaaaagaattgctttctttgtcttctctcctccgagtcgttctgatttccagctctcgagctaaacaccaaacctttttctcgcaatttctttcaccatttccttcattaatctctatatattaattcattctccacgacgacctaaccttctcgacaaacaagagggttctgatttcgaaattcaagcttcgttgaccaatccaaattttggtttaacttcggttaaagtcaactttacttcggttttatttttcaattttgaatgagaaaaaccgaatcaattatttagttcggttcttaaagttcaaattggttaaaccggtttaaattgatacattagtcgaccgtcgcgcattaatactggtgtggtggttccgttaacgagcaacggcgatg

SEQ ID NO: 18517 - DNA, 3000 bp, Unknown; identical to SEQ ID NO: 7528
  misc_feature (1)..( 3000): 2750-1469P.txt file - cDNA_ID_1818061; gDNA_ID_1621150; Annot_ID_56857

SEQ ID NO: 18518 - DNA, 3000 bp, Unknown; identical to SEQ ID NO: 7528
  misc_feature (1)..( 3000): 2750-1469P.txt file - cDNA_ID_1818061; gDNA_ID_1621150; Annot_ID_173208

SEQ ID NO: 18519 - DNA, 3003 bp, Unknown
  misc_feature (1)..( 3003): 2750-1469P.txt file - cDNA_ID_1818067; gDNA_ID_1621150; Annot_ID_56855
aacggttgaattattgtcgtgtgctgcttgcaccatggtccatgctagatggaccgaccactatttttccaaacagtgcctatcctatcaagtagatattttctgaatacgtagataattgtagaatacaagaaaagaaatatcctctgtggaataaatgaataatatacttttgtcagaaacgttacaagttaaaattccacgactgattgccacgtgtaagcttatctcaaaagggccctacagtaccatgatgacgtcatctcttacaccactctctgaaaaattcctccgccttataaaaaaactcgattatcgtcttcacttagtagccaaccaccgaccaatccgccatgaatatatctcagattattttcttcgcgtcccttcttctacggcttcacttatcaacggcggaacatcaaaattcaaacgctggtgatggagacaccatcatattcaccactctaggacgatcgcactacgaatttgacatattcgccctctccacgactcaaccgccgtcagtttccggagagctccgaatcaccgatggggaatcggtaaatttcaacggctatttcccgtctccttctccggctctattatctctccttcccgacgaaaccctaattcaaatggaagattcgtctcctctgcatctcatatacgtcaccgagagaaacggtacttctagcttgtactacgatctagtttacggcggtaattctgattttaaaacgaaacgaagatcggtgttagaagcaccgtctcgagtccaagttccgttgttatcccgctttgatcatctgagtggcatgacggtaaattcttttaaagataagcctagtttgagtggtgagtttattgtctacgtgtcaacccatgagagctcaggtgagccgagagcaagctggaccgccgtttactctaccgagttaaaaaccgggttaaccaggcggttaacaccgagtggtgtagctgatttcagcccggcggtatcgccttccggaaatttaacggctgtggcttcatacggagagagaggctggacaggggaagttgaagagctacgtacggacatctatgtattcttgactcgggatgggtctcaccgtgtcaaggtggtggagcacggtggttggccgtgttgggttgatgagtcgactctgtatttccatagaagaagtgaggaggatggttggatcagcgtttaccgagccatcttacctgaaaacggaccgttgactactgagtcggtgacaattcagcgagtcacaccaccgggagttcacgctttcacaccggccacgtcaccaaacaaccacgagttcgttgcggtagctacaaggagaccaggctcggattaccgccacgtggagttgtttgatctaaagaggaatgagtttatagagttgactcgtttggtggcgccaaagagtcatcacttgaatccattcttgtcccctgactcgtctcgagtcggatatcatagttgtagaggcgatgctaatggacggagaagtcctctgctcttccttgaaaatattcaaaccactacaagggacctctctctctttagaattgatggttcgtttccttcgttctcacctggaggtgatcgtatcgcatacgttaagatgcctggtgtgtttgtggtgaagccggatggttcagggcagcgtgaagtgtacaagggaatggcgttttcgacagcttgggatccggttcgacctggaattgtgtactctagctcaggtccaacgtttgctacagagagaacagaggttgatgttatctctattgacgttgatgcagccgataagtcatcttccgtgaggaggctaacgacaaacgggaagaacaatgctttcccttggccatctcctgatggtaagcggatagtgtttcgttcggggcggactggtcacaaaaacctctacataatggatgctgagaaaggagaaagcggtggtctatggaggttaaccgaaggtgcgtggaccgacacaatgtgtaactggtcaccggatggggaatggatcgcgtttgcatcagatcgagaaagccctggctcgggtagttttgagctcttcttgatccaccccaacggaacagggttaaggaagctcatccaaagcgggacgggtgggagaacaaaccacccgatcttcagcccggacagtaaatcattagtcttcacttctgattatgctggaatctcggcggaaccgatctcgaacccgcatcattaccagccatacggtgatatcttcacggtgaaattagatggctctaatgtgaggaggctaacgcataactcttatgaagatgggacaccggcatgggcccctcggttcatccaccccaacaatgtggagctacaaaggaggaatgattctaggtgctcgttcgaagactgtcactggctcaacaagtaccctacactaaaaggccgaaaaatatcttgttaatatgtatctacagttttgtatcccagcttgtaactctacttatagatttgtatgagactgccactgtatatgcataagactttgtattatagagatcgttaatgtgatatgtatatcatattgtcaaaacagtcgtgataagatatcaaaccctcttctaaatgatagtcttgctattgcggtttggaatcctcatgaattatccaatgtcaattcaatctcagcgtgattgaagacaggtttttaaattccaaaatctcttctttaatcacgtttataaatcagttttgatacattattactatgttttgcgtacgtgtcagaagattactatccatgtaatgtctgaagaattaggtgcgagtcaaaagtcataacagtcgataagatatcaaaccctcttcgtgacttggaaggtttgaggcgggggcgggaaaatccagaaaacgtcggataatgtttataaaggagtctctccgtcaccggagaaaaattagaagaaaaaagaggcgaagaagagagaggaatg

SEQ ID NO: 18520 - DNA, 3000 bp, Unknown; identical to SEQ ID NO: 7531
  misc_feature (1)..( 3000): 2750-1469P.txt file - cDNA_ID_1818079; gDNA_ID_1621150; Annot_ID_56851

SEQ ID NO: 18521 - DNA, 3000 bp, Unknown; identical to SEQ ID NO: 7537
  misc_feature (1)..( 3000): 2750-1469P.txt file - cDNA_ID_1818083; gDNA_ID_1621150; Annot_ID_56850

SEQ ID NO: 18522 - DNA, 3003 bp, Unknown
  misc_feature (1)..( 3003): 2750-1469P.txt file - cDNA_ID_1818091; gDNA_ID_1621150; Annot_ID_56848
aatctcaagctcttgcaatcctacagaggaaacaagagtggtcaagagaaagaacgaggctgtaatggctgagaaacaagtcgttcttgccctgaagaagcccgaacatccacagacacgtgtaatcccagctcctcagaatctgaacatcccacgaacaaccccggacctgaacttgccaagttgacatcacgattgacaaaggagctcttagaaacgccggagacaataacctctggcctcttccttccttgtattttgaggtggcacggcattagtcctggcgatgccgatgcttggtttttttagctacaaagcatggtttataaagttgtctgtattccagtttggctcttattaagttagttactctatttacgtgtcctttttcaaaactctaatgtataaagttatgattttacgggcaactctttacttttgagtaaaaaaaacagagcaggttttagtactgaattttgggtaacgtagttgaaaatttgatttcggacgataatgtaaaattgatgaaatacatcaaaatgactacattaatccttttgacacaatatgaataatcaattttaattaatattattattacttgtaaaacagtataaatatggctcattatttcacagattctcaacactctctcattctccacaatttacgatggcacaccagctccgttttgccgccgcaagagaacccatctcagaagagtatccggcggttgctcttcctcatccacgttgcatctccgtcgcgtttcctcctccgagattcacaccatctccgtcgcctttaactaattactcattcttggccgcattaactcctcaagaactggagatgcgtttgcaaattgcaatggatgtccgtaatgactaataacgaagatcatgttgcggctccgtttgaagagatgatctcgaagttagaccaaagaaagcttcaaacgatggcgtcattgctgacatcagatcccgattacttcttgatgatcgcaagaaacatgaacggctccaaacgcattcagaaacttctcggaaaaacagatgacgtggacgctttattcgccgccgctatcttgcgccgcttcctccacatcatcaccgacaagtacgcgtcgtacgtggtgagacgggggatgacagttttcgataagaagaagaaaaaagcaatgtacgagcacattctccactacgcgagccacatagcgcgtgataaacacggtaacctcgcgctcaacgacatcataaccgacgcggtacagaaacaagctctttgacgtaatcgcgcacaaagctcttgtactaagcaacgatgcttatgggaactttgtgatacaacgcgtgcttaaactgaatgacttgcgtagcaagaacaacatcgtcgttagtctacgtggccactttgttgatctctcgtttcagaaatatggaagctacgttgtggatgtacttttggagacgaaggagtcaatggttgtggtggtggaggagcttatggaatgtgaaggagatatgttgatgaggttggcgaggaatgagtatgggaatttcttggtgtgcaaggcactgagagtcacgcagaaggagatggttaggactgatctgttttggggtttggtgcataagctcaagccttttcacaatctcttgcgttggtctcgtggaaagaacattgcatccatcttaaactcgattcgttagttcgtctcaaaactagttaacattgttcagttattaaaatctctgctgaaagttctcgatttgatgttgttagctaactcttttaaggaggtttaccataacttgtcaaaaacacaaagaaagggagaagagggattgatatacagtatatagaattctctctttcgtgttattacttattagaacaagtttgaaagctgaagcactcacagtaatttctgtaattaaggacgttttgccttatgatcaaattctacaatagatcacctgaaattttaatacaaatcctaaatccatcaaggtatgtatcaaattgagatttctgtaactactagagtttgaccaaacagttttagttaacctgaatgtgtatgcctaattgcctattgcctcataatgcatcaagcaataccatctactaagcgaaaatggctcaagaaacaaacgtagagaaatcaaacattaggcattaagatttgggatagatgtgctagaattttctttgattgttacgataaagaaacacaaccctccaaaacatttttatatgattgctttttttaggtcgggtttttatatgattgttatttccaaggaaaactaaacacaaaaaataattatgaaacgtttttcggattgttattattagtaatagattaaatctgtatttctaaattttaaattttattaccaacaaataaaatgatatgatttcatatatcaaattgtaagttttgtgagcaaattttcaaaaagaaactgtgggtattcatcaatgataatctatatttggattattatcatgacaaaaaaaggttacagaaaaattaaacaattgtagatattgtttttattttagatgaaaccttctgtccgtattataatttgcatctcgaggttcttatacgatttgtactgaataaaacatattttttttgtttttaatcataactttcccaaaaaccatctcttccatcgctagctgtaccggtttcaatctcaaatcctgggaattgaaatttgtttctctgtcggagaatcatcatcgacttctctgctacttctctccgcgctctccttcgtcgtcgtcgatctcttcagcttcaccgatctcatttccaatcctgaaaaatcgatgtggtactgatctacgattgtgctccgttggtagccttatgaattagggtttttcttacgcatcttcgtatgtggagattggatcgtgttcggaaaacttctggacactgtcttcgctgctagatttttggatcatccttttgcgaaaatg

SEQ ID NO: 18523 - DNA, 3003 bp, Unknown
  misc_feature (1)..( 3003): 2750-1469P.txt file - cDNA_ID_1818099; gDNA_ID_1621150; Annot_ID_56846
cacgccggctacaagttctaactagtccactcaacaacagtcaacaccatcccaatttctcaaatacaaacactttgttccaatcttgaatatgaaaatatctcatcacaagaataatacaagccatcataatcatcaattgaaaacttgaattaaacacctcaaaacttgcaaataagctagcttctctagtcattgaatgttagtccatcaaactattgcatctacacacttttttctagaggcccatattcatctaataacacatccatctctgctgctagtgcagtacctgaggtcaccaaaattgtataccctccaccatatcatcgatttagatcatctgctctcgttttccatctcaggaagaaagttatgctgacttgtcgtttggtgtctctcgagttcttctagaaccaatttgagacactgaagtctcgtagcttcctgagatgtttctccatgtcttctctagtcttggtccactcttctctttctattaccgttgttgggtcatctctttcaccctgaaagaatggaaatatatagacatagagtgaagatgagtaaagctagatgaaggaatacaaatgactgccagatgaaatggatttggtcatttggaaatggaaaggtaccacgtgtatgatcttaaaggaggttccattatctcgtatcacaagcaagtcatccttcctatccctttttcttcctcccggaactgtcacctgaaacaatctaaaaccttaacatcggaaagaagattgtcttcatagctttgagctatgcacagtatttaaagaactcataactcaagatatctgattcagaactagaggcataaatagcactaatataaaccagcatttcattagtgttatagcatgaaaaatattctataagaatatgtcaaaaaacccaattggctatggtctacggttgaggtttgtgctcagactcggaatgagaactttgttaataatgcttaaataacttggaagataagaattagtcataccagaactctggctctggtgattgactttgtcttggaatcaataacatatatctcttcaagatctagcacaaattctggatcgtttgtccttctgttccggtaatgttttgtcaagaaaacctgcataaaaaataaacacgatgaagacaatttgtatcagaaactgtaactactaaactaagtagtttcgtgttgatctcatccttaatgcttaaaaaacatatttcctggtgtggtttccaaaaatgttgtcaaatcaaaactaagtacatccttgttaatacatgttgctcaagactccctgcatcaaagacctaatggatttaacatcaatgtacatggtccaatatgtaccttggatatctccctctcagatttgtacagtggatctctgggggcatcaataggtggttcagtgacattgtaacatccatagtcactcattgcacatcgaatatactgtacttgtaacatcattaaacaagcccttgttagcaccactcactcattgtaacaacttgcttataaataaaccttacaatgtaaaacatacgcaatcatgaagcagcaaagagtacaaaactggccacagaatgaaaggaaagtgactaaacaaacacccagctgctacattctgactctctaatcatactaaatgctgaccatttacggcactttttgagattatatgttcaaaattccagtctatcagtgtgagtagaagttccaaacaataccaaacgtgtacagctctgtgtagataagatttcttaagttatacaattactaggtagagtgaaggtatatgggttatacaattactaggtagagctctgtgcagataagatttcttaagtgatacaattactaggtagagtggaggtatatgggttcaattagcaattaagcacaatatgaaaagcaattatcttgctgaacaaaaggaagtctcagaacaacgcataggcattacaaaaacagcaaccgataaggataaatgactgaccttttgaggcatcggtgcaagaactctcggaattgagtaaatatctgtatccggaggagtaacatacatctgcagccacccacacaaaacaatttacaattgaagaatgagcacagactctagagaaatcgaagaaatgagcaattagagtcactgggaattcacacacctctctgaaatcataaacatcattatctggatcaggaggttttctgataaagaaatcacagtccattaagctgagtttatgaaactcatcttcgtttatccgataatcaaccaccatatccgaatcccatccttgtgtcgatataaaactcttactctgaacaaaagcgatatctccatcaccaccaccgcctgcagcggctatcgcggcggccaaggggtcatactcgacatcatagtccttcttgttgtcaacttcctctacctcctcatcatccatatcatactcgtccgctccacctccatcagcatcgacgtcatctactttaacgactataccacggccgcgtcgggatttcagtgttaaaggcgcgaaaagaccgtccgttctgaatgacgcaaatagccgctgagagccggagggataaggtggcttcgaggtgaatgagagtagagataaggaaggagaagcggcggaagacgccattggaagcggataaagctcacagagtgttctatctatctgtggattagatatttcgaggaaaaatacaattaaaaaaaaaagaaaaactatataatataataataatcctttttagtgaataaaacaacaaaaataaattaggaaataattaagagcgtcatttttggtatcccgcgcaactttttcttctcagtttcagtttctctacatcgattcatcgattccactctcttgattgctgtttagatcaatccgtctcgaacccaggggttagtatatagtggatcaaactgatccgacccgacccgacccgaattattaatg

SEQ ID NO: 18524 - DNA, 3000 bp, Unknown
  misc_feature (1)..( 3000): 2750-1469P.txt file - cDNA_ID_1818115; gDNA_ID_1621151; Annot_ID_56890
gctactatgtgacttgtatgacaaatacagtcgaaacttaatatgatattcggtacccaaatgacaaaaacccacgtacatcaaaagcagagaggctttataagaaatctatgactatcaattttattttttcccataaattatatgcatggtagaaatattatgaaatgagtttccttaactatggttggcaactaaaaatgtctttagtgacaaaaatatgcaacttttctacaaactgcaaatattagtttagattaaatcaaacaaatcatgccttcaaaaatctgtaaaacaaatctttttatttttaacgccggtggcaccatagacgaaatcgacaattttgaaggttggagttggatttgtctgaattttttttttattggaatttggaaagcagctgaaagatgactaaatgcgcagcaaaactcttcattcaggcttggcgtaacttgaatttgttttctttcttctatttttttagtttcattctagtttccgatcaagtcttatggttaaaatactcaattatatactcatcatttaggcatcgaaaacggtcctaacaaaacaccaaacatatattcctaggctttcacgtgtttaattcttacccgcatgatacatttccctcaaatggattgacataatgctattgttgttaactttttgtttgacacaaaatctatctagcaaattttttatagttatagatttaatatacgcaatgttagcttgattttgtttctaacttaaggaaaagttgaaggatgttttaatttgcaaggttctctttcaaaaagatttcgtgtaaattcgacaacggcctcaaacctactctaatcctgactctaaataatattataggttgaaagctttgtaattattgtttactaaaataagagaagaaaacattattacttactctcctttagaaatatatgtttgcattatgctgtatatatagatgaataaatgccataaacgtttaaatgtgtgttggtagatgtcattttacttcattcttagaggtctcttctatcaaatttagttacgtatataaatatagatgtcttgtgctttcttgcaaggaaataaacagagataatatactatttcatacacatccacacacatatagatgtctttttgtttgttgcatggatgtagacatacatccattcacatttccaagtatatacactaacctaatgacctaatgttcttgagagagacttctttcacaacctcttctagaatgtgagtttcttatatttttgttggtataaagtatttgaacatctttatcaaaagttaaaatgtttgaccatattcttggtaattcaaccggtaagtaaatgttattcttctatgacagaacccttaattttgcctgttgtatactagaggtttggttgggtgaaaagtgggcatgataaaaagaacaacatttagttttcctccttgatttttctaaattagagtttcgtatcaaaatacctaaaaaagcttgttttgtggtgcttccaatttcgaaatcggctaaactttttccacatgatttcttcttttacgatagtaagatttagaagaaaataaaaactgaataacgtcagattttccttaataaaagaagaagaaaaatctcacaacattttaagttcctttatttttttgatatgtgccctaataaatgcagtgaaataagctcacaacaaaagatgcacaacgagataaagccaaatgaaatttagtactggtatacaaattttaatgacacgttaatactctttttcgttttggttttataatcgtacttaatattcataactagcttcgaatctggtatttgtatacttaaaaagcttacatcagccaatctactatcattgaaattgtagtgagaaaatctaatataattctttagtgactgtttgtcaaaaaaaaaaaaaactcatgtctaaagtacataacaaattcaaattttgatacaaaattagttatttgtatttgttgtgaccatttctattctacattttgtttgattattagttgaattattcttagttaaatagagcaaacaaattaaattaaatgatttcttaatctataattactgtaaatacttcaaacatcttttaaatagaaacaaataaaataattactaagacatttgtccttatataagtctaataaatgtgtgttttaattcaatacctccaaaaataatttcaaaaaactagagttactgaattggtgctttcacacggtgcatgcattgtattcacacctatatgcatgtcatatattcatggtctctatgatctcgctctatataaacaccacccaatcgaccaaccttcttctctgattattttctcaaattatttaattaatttcttcttcttcatcaccaccaattacactcaaaattatggtgtttgcacatttgaaccttcttcggaagattgtggggattataggttagtccagaattttgacatctacaagttattatatctatcatgatttttttgtcccttcttcttaactttggatgatcttgtttgcaggaaacttcatcgctctatgtctgttcttgtcaccaacgtaagtattttgctatatctatgatttaaataaaattccagaaacaatgaaagatacgtgaaaaagagattcataaaaacgaaaatcgtatttcttaaagaaaaccaaacttgtttcatgaatttaacacatgcatggttcatcctgactactgaaagatctgaaattttttgtttttcattctcactgcagctttcaaaattttctttgtgtagtataatcacaatgtgaaaattgatacttttttcctcataatataatgttttttcctattatactaattgataacaattaagaaagtttatttatgtaatagagtttcttccaaaacaagagaaaaactaaaagtatgtatcatcaataaatgactaatacttttaataaatg

SEQ ID NO: 18525 - DNA, 3003 bp, Unknown
  misc_feature (1)..( 3003): 2750-1469P.txt file - cDNA_ID_1818129; gDNA_ID_1621151; Annot_ID_56881
ttatttaccgttattttgtaccattttaactattcgcattttcggcttaaaaacttgtatagcgttgtgtcaatgtaattttatatgttaatgttaattattacaatttctttttctctaagttttataacccaaaaataattatttatgtattaaatattagtttaggcctaatgagtaccatgtgaaagagtaattgttctactttctatttttgtatttcatataaagtttaatcttgttcttctgaattagtttgtattatgtttacttacggtcaaaagaatctgttagttactgtcaaaagttaaaacttgattgttctgtcttaatttgcaggtggatcttcgagacaggtctgctcttgagaagatattctcagaaacaaagtatgattgagaaaaaaacaaacattcttttagcttcttcactttatcactaacaatgagtgataatgcatattattgggtttattctttattgattgatgaacgtggaattattattattttacaggtttgatgcagtgatacattttgctggacttaaagcagttggtgagagtgtagagaagcctttgctttattataataataatcttgttggtactattactcttttggaagttatggctcaacatggctgcaaaaatgtatgtataatttgccactacacaacaagttcgaatccatttttactttgcttgatcaattctcatgattagctacttttactctgtttccagcttgtgttttcatcatcagcaactgtgtatggctctccaaaagaagttccttgtacagaggagtttccaatttctgctttgaacccatatggacgaacaaaggttgttttcttgacaaaacccacttgagtattgtggttaattatgaagtgtgaatctgacttattatggatgtttttgtagctattcattgaggaaatctgccgcgatgtatacggttctgacccggaatggaagattatattgcttaggtatttcaatcctgttggtgcacatcctagtggtgacattggtgaagaccctcgtggtattccaaacaatctcatgccctttgtacaacaagtggctgttggtaggagacctcatctcactgtctttggaaatgattacaatacaaaagatggaacaggggtatgtacttgtcttttatgttttcataaaacaagaagaggttttcaacattttgatctcatgttttgttttaggttcgagattacattcatgttattgatttagctgatggacacatagcggctctacgtaagctagaagattgcaagatcggtatattatgatttccattcgtttctcttatctactacaatcattctcaagtctcttaactttgtttgtgtgttgtttatattcaggttgtgaagtgtacaatctcggaacaggaaatggaacatcagttcttgaaatggttgatgcttttgaaaaagcatccggaaaggtaaaaagtgacactttctttcatctttagatacttggattctaagtcatgttttgttaaacctttgaactcttttgtggatcagaaaatccctctggtgatcgcgggacgtcgaccgggagatgctgaagttgtatacgcctcgacggaaagagcagaaagtgaattgaattggaagtaagttcatacatacataaagctataactttgaagatattacttgcacaaaattgtatgttagacactaaaaagttgggaatatgtaaatgagataagtctaaatttgggttggtaacaaatgcagggccaaatatgggattgaggagatgtgtagagatttgtggaactgggctagtaataatccttatggatatgattcctcttctgaagacaactctcattaacttttcttaatcgttttcttcttttgctaaaacatatttctccacactaaattattatagtatccgcaagaaaaaacaacaacaataaagagtcagattttagggaaatatagggacattatgtattattattacaatcaatacttagtctgtaattgatttggatatgttcttgtataatcaaaaaagatttgttatgaatagctacaacgcaaatgtttagctctatacggcaaaaagtaccttgaggttgacacgacgtcgttttcagctcggtgatagttgaaatgtatctttctgaagcttttaagttcaagagcccacacacttcttctcattctttataaacataacactggacagtaaccaaacttcagatctgaatcaacctcttaaggttcgtttatactcattctgtttttcactgatagtttatgcacaatccgaatctttcttctatgtgattgttttggatttgattataaatttgacattatcattaatttagaatgattttgtgtgtgttgggttgtttacaaaatcatttctttgaatgagtttgttttaattttgtgttagggttataacgcgattgggaatttagttgaatttagaactaaatttgtgctagcttgtgatttattgtctctaattttgaactactaatatttgattaccatatgtttagtggtacagaagaagagaaaggaatgatgattagtgaaagagatgattttagtctcactggaccattacacttaacatctatagattggtatgcatctactacttctactctccttttgcatttttcgagattttgtttcgtcgaaaactgaatctttatgtttatgaaatgttgttgagttagctaatgtcttggcaccattagtttagagctaacccttgtgttaaaagacctgaaaaattgttcctttatgtgaaaaatgcttcatttacttccattttcgagattttgttatgtcgaaaactgaaactttgtgttcatagaatgttgttgagttagctaatgttttggcaccaattggtatagactttagagtttagagttaacccttgtgtttaaaaacctgaaatattgttcctttgtgtttaaaatg

SEQ ID NO: 18526 - DNA, 3000 bp, Unknown; identical to SEQ ID NO: 7545
  misc_feature (1)..( 3000): 2750-1469P.txt file - cDNA_ID_1818137; gDNA_ID_1621151; Annot_ID_56878
